United States Patent 7,709,616 (MICRORNAS AND USES THEREOF) - sequence listing, part 20

SEQ ID NO: 610104 - RNA, 64 nt, hsa
gccucuucugucauuguucaaaggugggaagagagccuggaaaagaaccaggccuggaaaagaa

SEQ ID NO: 610105 - RNA, 64 nt, hsa
cuguggggccgcugcuucuguuuaaauaaaaguggccuggaagcuggcguuugucguuucuugc

SEQ ID NO: 610106 - RNA, 64 nt, hsa
acacccuccgguuauguugcuccaguaaaaucuugccuggaaagaggcagucuucuuagcaugg

SEQ ID NO: 610107 - RNA, 64 nt, hsa
acggagugaccacugagaugcugggggucacugggccuggaagaccaucccagccucugaguuc

SEQ ID NO: 610108 - RNA, 64 nt, hsa
aucacucuguggcagcucucccuggacuugcccugccuggaacagggugauuugcuggaaugga

SEQ ID NO: 610109 - RNA, 64 nt, hsa
uuaaaucaguuacaggccagagucuccuuggagggccuggaacucugaguccuccuaugaaccu

SEQ ID NO: 610110 - RNA, 64 nt, hsa
ccaagucugagagcaacagacccucaucaucugugccuggaagaguucacugucauugagcagc

SEQ ID NO: 610111 - RNA, 64 nt, hsa
guuuggcuaaagguugguguaaaaaucaagagaagccuggaagacaucauggaugccauggauu

SEQ ID NO: 610112 - RNA, 64 nt, hsa
aacacccggcccacgcgugcugcagauguggggagccuggaaacacccggcccacgcgugcugc

SEQ ID NO: 610113 - RNA, 64 nt, hsa; identical to SEQ ID NO: 610112

SEQ ID NO: 610114 - RNA, 64 nt, hsa
cugcgaggcagaguuaagaccugugacguggggagccuggaaacacccggcccacgcgugcugc

SEQ ID NO: 610115 - RNA, 64 nt, hsa
gccuguccuccaggcuggggcagguucuuaguuugccuggaauuguucuguaccucuuuguagc

SEQ ID NO: 610116 - RNA, 64 nt, hsa
cuccaaccaccacacacucccugcuguuuucccugccuggaacuuucccuccugccccaccaag

SEQ ID NO: 610117 - RNA, 64 nt, hsa
uuuugucuguuuuaucuucuacuguaucgccagugccuggaacagugucuggugcacauaauag

SEQ ID NO: 610118 - RNA, 64 nt, hsa
aaucaggcaccagccacauaauguuccagacaaagccuggaaggguguggacccagacguggag

SEQ ID NO: 610119 - RNA, 64 nt, hsa
agaauaugaauggauuaaauguuaaagcuuuggugccuggaaacaauaucaaguaacaauauga

SEQ ID NO: 610120 - RNA, 64 nt, hsa
acugacccccuccuccagcaauagcauccaaggggccuggaaguuauguuguucaaagaagccu

SEQ ID NO: 610121 - RNA, 64 nt, hsa
guccucauccauguagcaccacuaauucuuccaugccuggaagaaaccuggggacuuaguuagg

SEQ ID NO: 610122 - RNA, 64 nt, hsa
ucaguuguugcauguaauuuuugccuuuguuuaagccuggaacuuguaagaaaaugaaaauuua

SEQ ID NO: 610123 - RNA, 64 nt, hsa
aguggcagagcaagagggggaaagcaggaucagugccuggaaggcaggugugcccgucagcggg

SEQ ID NO: 610124 - RNA, 64 nt, hsa
gaaugcugagaccagaguuuaucaugcuggacaagccuggaaggaggcaauaagugggaaaggu

SEQ ID NO: 610125 - RNA, 64 nt, hsa
agugucauguuagcugagucaccauuuggcuucggccuggaaauagugugauuagaacacugau

SEQ ID NO: 610126 - RNA, 64 nt, hsa
aggccaggggaaacugggggggccucagggacaggccuggaaaggccacgauggcugcugaauu

SEQ ID NO: 610127 - RNA, 64 nt, hsa
ucccagcaccugacuccccccacauccaagggcagccuggaaccaguggcuaguucuugaagga

SEQ ID NO: 610128 - RNA, 64 nt, hsa
gcacuuagggaucucccagcuggguuagggcagggccuggaaaugugcauuuugcagaaacuuu

SEQ ID NO: 610129 - RNA, 64 nt, hsa
gcagugagcccaugagccccaccacuacacuccagccuggaagacaccaugacacacagugagg

SEQ ID NO: 610130 - RNA, 64 nt, hsa
auuccagcuuuauucacacaaaucaugucuguuggccuggaaauuggaaaaccaguuaaaccaa

SEQ ID NO: 610131 - RNA, 64 nt, hsa
ugccuugggggcgguacucuguggagcugcuuaggccuggaaagguacaguauguagaagagga

SEQ ID NO: 610132 - RNA, 64 nt, hsa
gcuguuuuagaguaugccugcuccccagcccccugccuggaacccucugagcaacuugcucuga

SEQ ID NO: 610133 - RNA, 64 nt, hsa
aggucccaguccaucuccuggaggcggacagauggccuggaaaccucuggcuaaucgggccauc

SEQ ID NO: 610134 - RNA, 64 nt, hsa
caagagacagcgacccaaagccgaaggacagguggccuggaaagaucccgcccaggucugggag

SEQ ID NO: 610135 - RNA, 55 nt, hsa
uucuucccacagaucccugagucaugccuggaagcuuuguccccugcuucagaug

SEQ ID NO: 610136 - RNA, 64 nt, hsa
uggguuagugcuauggugggagaguacauugaaggccuggaauuagcuuggggccagggaaggg

SEQ ID NO: 610137 - RNA, 64 nt, hsa; identical to SEQ ID NO: 176114

SEQ ID NO: 610138 - RNA, 64 nt, hsa; identical to SEQ ID NO: 176115

SEQ ID NO: 610139 - RNA, 64 nt, hsa; identical to SEQ ID NO: 176116

SEQ ID NO: 610140 - RNA, 64 nt, hsa; identical to SEQ ID NO: 176117

SEQ ID NO: 610141 - RNA, 64 nt, hsa; identical to SEQ ID NO: 176118

SEQ ID NO: 610142 - RNA, 64 nt, hsa; identical to SEQ ID NO: 176119

SEQ ID NO: 610143 - RNA, 64 nt, hsa; identical to SEQ ID NO: 176120

SEQ ID NO: 610144 - RNA, 64 nt, hsa; identical to SEQ ID NO: 176121

SEQ ID NO: 610145 - RNA, 64 nt, hsa; identical to SEQ ID NO: 176122

SEQ ID NO: 610146 - RNA, 64 nt, hsa; identical to SEQ ID NO: 176123

SEQ ID NO: 610147 - RNA, 64 nt, hsa; identical to SEQ ID NO: 176124

SEQ ID NO: 610148 - RNA, 64 nt, hsa; identical to SEQ ID NO: 176125

SEQ ID NO: 610149 - RNA, 64 nt, hsa; identical to SEQ ID NO: 176126

SEQ ID NO: 610150 - RNA, 64 nt, hsa; identical to SEQ ID NO: 176127

SEQ ID NO: 610151 - RNA, 64 nt, hsa; identical to SEQ ID NO: 176128

SEQ ID NO: 610152 - RNA, 64 nt, hsa; identical to SEQ ID NO: 176129

SEQ ID NO: 610153 - RNA, 64 nt, hsa; identical to SEQ ID NO: 176130

SEQ ID NO: 610154 - RNA, 64 nt, hsa; identical to SEQ ID NO: 176131

SEQ ID NO: 610155 - RNA, 64 nt, hsa; identical to SEQ ID NO: 176132

SEQ ID NO: 610156 - RNA, 64 nt, hsa; identical to SEQ ID NO: 176133

SEQ ID NO: 610157 - RNA, 64 nt, hsa; identical to SEQ ID NO: 176134

SEQ ID NO: 610158 - RNA, 64 nt, hsa; identical to SEQ ID NO: 176135

SEQ ID NO: 610159 - RNA, 64 nt, hsa; identical to SEQ ID NO: 176136

SEQ ID NO: 610160 - RNA, 64 nt, hsa; identical to SEQ ID NO: 176137

SEQ ID NO: 610161 - RNA, 64 nt, hsa; identical to SEQ ID NO: 176138

SEQ ID NO: 610162 - RNA, 64 nt, hsa; identical to SEQ ID NO: 176139

SEQ ID NO: 610163 - RNA, 64 nt, hsa; identical to SEQ ID NO: 176140

SEQ ID NO: 610164 - RNA, 64 nt, hsa; identical to SEQ ID NO: 176141

SEQ ID NO: 610165 - RNA, 64 nt, hsa; identical to SEQ ID NO: 176142

SEQ ID NO: 610166 - RNA, 64 nt, hsa; identical to SEQ ID NO: 176143

SEQ ID NO: 610167 - RNA, 64 nt, hsa; identical to SEQ ID NO: 176144

SEQ ID NO: 610168 - RNA, 64 nt, hsa; identical to SEQ ID NO: 176145

SEQ ID NO: 610169 - RNA, 64 nt, hsa; identical to SEQ ID NO: 176146

SEQ ID NO: 610170 - RNA, 64 nt, hsa; identical to SEQ ID NO: 176147

SEQ ID NO: 610171 - RNA, 64 nt, hsa; identical to SEQ ID NO: 176148

SEQ ID NO: 610172 - RNA, 64 nt, hsa; identical to SEQ ID NO: 176149

SEQ ID NO: 610173 - RNA, 64 nt, hsa; identical to SEQ ID NO: 176150

SEQ ID NO: 610174 - RNA, 64 nt, hsa; identical to SEQ ID NO: 176151

SEQ ID NO: 610175 - RNA, 64 nt, hsa; identical to SEQ ID NO: 176152

SEQ ID NO: 610176 - RNA, 64 nt, hsa; identical to SEQ ID NO: 176153

SEQ ID NO: 610177 - RNA, 64 nt, hsa; identical to SEQ ID NO: 176154

SEQ ID NO: 610178 - RNA, 64 nt, hsa; identical to SEQ ID NO: 176155

SEQ ID NO: 610179 - RNA, 64 nt, hsa; identical to SEQ ID NO: 176156

SEQ ID NO: 610180 - RNA, 57 nt, hsa; identical to SEQ ID NO: 176157

SEQ ID NO: 610181 - RNA, 64 nt, hsa; identical to SEQ ID NO: 176158

SEQ ID NO: 610182 - RNA, 64 nt, hsa; identical to SEQ ID NO: 176159

SEQ ID NO: 610183 - RNA, 64 nt, hsa; identical to SEQ ID NO: 176160

SEQ ID NO: 610184 - RNA, 64 nt, hsa; identical to SEQ ID NO: 176161

SEQ ID NO: 610185 - RNA, 64 nt, hsa; identical to SEQ ID NO: 176162

SEQ ID NO: 610186 - RNA, 64 nt, hsa; identical to SEQ ID NO: 176163

SEQ ID NO: 610187 - RNA, 64 nt, hsa; identical to SEQ ID NO: 176164

SEQ ID NO: 610188 - RNA, 64 nt, hsa; identical to SEQ ID NO: 176165

SEQ ID NO: 610189 - RNA, 64 nt, hsa; identical to SEQ ID NO: 176166

SEQ ID NO: 610190 - RNA, 64 nt, hsa; identical to SEQ ID NO: 176167

SEQ ID NO: 610191 - RNA, 64 nt, hsa; identical to SEQ ID NO: 176168

SEQ ID NO: 610192 - RNA, 64 nt, hsa; identical to SEQ ID NO: 176169

SEQ ID NO: 610193 - RNA, 64 nt, hsa; identical to SEQ ID NO: 176170

SEQ ID NO: 610194 - RNA, 64 nt, hsa; identical to SEQ ID NO: 176171

SEQ ID NO: 610195 - RNA, 64 nt, hsa; identical to SEQ ID NO: 176172

SEQ ID NO: 610196 - RNA, 64 nt, hsa; identical to SEQ ID NO: 176173

SEQ ID NO: 610197 - RNA, 64 nt, hsa; identical to SEQ ID NO: 176174

SEQ ID NO: 610198 - RNA, 64 nt, hsa; identical to SEQ ID NO: 176175

SEQ ID NO: 610199 - RNA, 64 nt, hsa; identical to SEQ ID NO: 176176

SEQ ID NO: 610200 - RNA, 64 nt, hsa; identical to SEQ ID NO: 176177

SEQ ID NO: 610201 - RNA, 64 nt, hsa; identical to SEQ ID NO: 176178

SEQ ID NO: 610202 - RNA, 64 nt, hsa; identical to SEQ ID NO: 176179

SEQ ID NO: 610203 - RNA, 64 nt, hsa; identical to SEQ ID NO: 176180

SEQ ID NO: 610204 - RNA, 64 nt, hsa; identical to SEQ ID NO: 176181

SEQ ID NO: 610205 - RNA, 64 nt, hsa; identical to SEQ ID NO: 176182

SEQ ID NO: 610206 - RNA, 64 nt, hsa; identical to SEQ ID NO: 176183

SEQ ID NO: 610207 - RNA, 64 nt, hsa; identical to SEQ ID NO: 176184

SEQ ID NO: 610208 - RNA, 64 nt, hsa; identical to SEQ ID NO: 176185

SEQ ID NO: 610209 - RNA, 64 nt, hsa; identical to SEQ ID NO: 176186

SEQ ID NO: 610210 - RNA, 64 nt, hsa; identical to SEQ ID NO: 176187

SEQ ID NO: 610211 - RNA, 64 nt, hsa; identical to SEQ ID NO: 176188

SEQ ID NO: 610212 - RNA, 64 nt, hsa; identical to SEQ ID NO: 176189

SEQ ID NO: 610213 - RNA, 64 nt, hsa; identical to SEQ ID NO: 176190

SEQ ID NO: 610214 - RNA, 64 nt, hsa; identical to SEQ ID NO: 176191

SEQ ID NO: 610215 - RNA, 64 nt, hsa; identical to SEQ ID NO: 176192

SEQ ID NO: 610216 - RNA, 64 nt, hsa; identical to SEQ ID NO: 176193

SEQ ID NO: 610217 - RNA, 53 nt, hsa; identical to SEQ ID NO: 176194

SEQ ID NO: 610218 - RNA, 64 nt, hsa; identical to SEQ ID NO: 176195

SEQ ID NO: 610219 - RNA, 64 nt, hsa; identical to SEQ ID NO: 176196

SEQ ID NO: 610220 - RNA, 64 nt, hsa; identical to SEQ ID NO: 176197

SEQ ID NO: 610221 - RNA, 64 nt, hsa; identical to SEQ ID NO: 176198

SEQ ID NO: 610222 - RNA, 64 nt, hsa; identical to SEQ ID NO: 176199

SEQ ID NO: 610223 - RNA, 64 nt, hsa; identical to SEQ ID NO: 176200

SEQ ID NO: 610224 - RNA, 64 nt, hsa; identical to SEQ ID NO: 176201

SEQ ID NO: 610225 - RNA, 64 nt, hsa; identical to SEQ ID NO: 176202

SEQ ID NO: 610226 - RNA, 64 nt, hsa; identical to SEQ ID NO: 176203

SEQ ID NO: 610227 - RNA, 64 nt, hsa; identical to SEQ ID NO: 176204

SEQ ID NO: 610228 - RNA, 64 nt, hsa; identical to SEQ ID NO: 176205

SEQ ID NO: 610229 - RNA, 64 nt, hsa; identical to SEQ ID NO: 176206

SEQ ID NO: 610230 - RNA, 64 nt, hsa; identical to SEQ ID NO: 176207

SEQ ID NO: 610231 - RNA, 64 nt, hsa; identical to SEQ ID NO: 176208

SEQ ID NO: 610232 - RNA, 64 nt, hsa; identical to SEQ ID NO: 176209

SEQ ID NO: 610233 - RNA, 64 nt, hsa; identical to SEQ ID NO: 176210

SEQ ID NO: 610234 - RNA, 64 nt, hsa; identical to SEQ ID NO: 176211

SEQ ID NO: 610235 - RNA, 64 nt, hsa; identical to SEQ ID NO: 176212

SEQ ID NO: 610236 - RNA, 64 nt, hsa; identical to SEQ ID NO: 176213

SEQ ID NO: 610237 - RNA, 64 nt, hsa; identical to SEQ ID NO: 176214

SEQ ID NO: 610238 - RNA, 64 nt, hsa; identical to SEQ ID NO: 176215

SEQ ID NO: 610239 - RNA, 64 nt, hsa; identical to SEQ ID NO: 176216

SEQ ID NO: 610240 - RNA, 64 nt, hsa; identical to SEQ ID NO: 176217

SEQ ID NO: 610241 - RNA, 64 nt, hsa; identical to SEQ ID NO: 176218

SEQ ID NO: 610242 - RNA, 64 nt, hsa; identical to SEQ ID NO: 176219

SEQ ID NO: 610243 - RNA, 64 nt, hsa; identical to SEQ ID NO: 176220

SEQ ID NO: 610244 - RNA, 64 nt, hsa; identical to SEQ ID NO: 176221

SEQ ID NO: 610245 - RNA, 64 nt, hsa; identical to SEQ ID NO: 176222

SEQ ID NO: 610246 - RNA, 64 nt, hsa; identical to SEQ ID NO: 176223

SEQ ID NO: 610247 - RNA, 64 nt, hsa; identical to SEQ ID NO: 176220

SEQ ID NO: 610248 - RNA, 64 nt, hsa; identical to SEQ ID NO: 176225

SEQ ID NO: 610249 - RNA, 64 nt, hsa; identical to SEQ ID NO: 176226

SEQ ID NO: 610250 - RNA, 64 nt, hsa; identical to SEQ ID NO: 176227

SEQ ID NO: 610251 - RNA, 64 nt, hsa; identical to SEQ ID NO: 176228

SEQ ID NO: 610252 - RNA, 64 nt, hsa; identical to SEQ ID NO: 176229

SEQ ID NO: 610253 - RNA, 64 nt, hsa; identical to SEQ ID NO: 176230

SEQ ID NO: 610254 - RNA, 64 nt, hsa; identical to SEQ ID NO: 176231

SEQ ID NO: 610255 - RNA, 64 nt, hsa; identical to SEQ ID NO: 176232

SEQ ID NO: 610256 - RNA, 64 nt, hsa; identical to SEQ ID NO: 176233

SEQ ID NO: 610257 - RNA, 64 nt, hsa; identical to SEQ ID NO: 176234

SEQ ID NO: 610258 - RNA, 64 nt, hsa; identical to SEQ ID NO: 176235

SEQ ID NO: 610259 - RNA, 64 nt, hsa; identical to SEQ ID NO: 176236

SEQ ID NO: 610260 - RNA, 64 nt, hsa; identical to SEQ ID NO: 176237

SEQ ID NO: 610261 - RNA, 64 nt, hsa; identical to SEQ ID NO: 176238

SEQ ID NO: 610262 - RNA, 51 nt, hsa; identical to SEQ ID NO: 176239

SEQ ID NO: 610263 - RNA, 64 nt, hsa; identical to SEQ ID NO: 176240

SEQ ID NO: 610264 - RNA, 64 nt, hsa; identical to SEQ ID NO: 176241

SEQ ID NO: 610265 - RNA, 64 nt, hsa; identical to SEQ ID NO: 176242

SEQ ID NO: 610266 - RNA, 64 nt, hsa; identical to SEQ ID NO: 176243

SEQ ID NO: 610267 - RNA, 64 nt, hsa; identical to SEQ ID NO: 176244

SEQ ID NO: 610268 - RNA, 64 nt, hsa; identical to SEQ ID NO: 176245

SEQ ID NO: 610269 - RNA, 64 nt, hsa; identical to SEQ ID NO: 176246

SEQ ID NO: 610270 - RNA, 64 nt, hsa; identical to SEQ ID NO: 176247

SEQ ID NO: 610271 - RNA, 64 nt, hsa; identical to SEQ ID NO: 176248

SEQ ID NO: 610272 - RNA, 64 nt, hsa; identical to SEQ ID NO: 176249

SEQ ID NO: 610273 - RNA, 64 nt, hsa; identical to SEQ ID NO: 176250

SEQ ID NO: 610274 - RNA, 64 nt, hsa; identical to SEQ ID NO: 176251

SEQ ID NO: 610275 - RNA, 64 nt, hsa; identical to SEQ ID NO: 176252

SEQ ID NO: 610276 - RNA, 64 nt, hsa; identical to SEQ ID NO: 176253

SEQ ID NO: 610277 - RNA, 64 nt, hsa; identical to SEQ ID NO: 176254

SEQ ID NO: 610278 - RNA, 64 nt, hsa; identical to SEQ ID NO: 176255

SEQ ID NO: 610279 - RNA, 64 nt, hsa; identical to SEQ ID NO: 176256

SEQ ID NO: 610280 - RNA, 64 nt, hsa; identical to SEQ ID NO: 176257

SEQ ID NO: 610281 - RNA, 64 nt, hsa; identical to SEQ ID NO: 176258

SEQ ID NO: 610282 - RNA, 64 nt, hsa; identical to SEQ ID NO: 176259

SEQ ID NO: 610283 - RNA, 64 nt, hsa; identical to SEQ ID NO: 176260

SEQ ID NO: 610284 - RNA, 64 nt, hsa; identical to SEQ ID NO: 176261

SEQ ID NO: 610285 - RNA, 64 nt, hsa; identical to SEQ ID NO: 176262

SEQ ID NO: 610286 - RNA, 64 nt, hsa; identical to SEQ ID NO: 176263

SEQ ID NO: 610287 - RNA, 64 nt, hsa; identical to SEQ ID NO: 176264

SEQ ID NO: 610288 - RNA, 64 nt, hsa; identical to SEQ ID NO: 176265

SEQ ID NO: 610289 - RNA, 64 nt, hsa; identical to SEQ ID NO: 176266

SEQ ID NO: 610290 - RNA, 64 nt, hsa; identical to SEQ ID NO: 176267

SEQ ID NO: 610291 - RNA, 64 nt, hsa; identical to SEQ ID NO: 176268

SEQ ID NO: 610292 - RNA, 64 nt, hsa; identical to SEQ ID NO: 176269

SEQ ID NO: 610293 - RNA, 53 nt, hsa; identical to SEQ ID NO: 176270

SEQ ID NO: 610294 - RNA, 64 nt, hsa; identical to SEQ ID NO: 176271

SEQ ID NO: 610295 - RNA, 64 nt, hsa; identical to SEQ ID NO: 176272

SEQ ID NO: 610296 - RNA, 64 nt, hsa
aguuagcaaaccacuccuuuuguugcaaaggagcugaggucaaggguggcaaaggcacuugucc

SEQ ID NO: 610297 - RNA, 64 nt, hsa
ggggaaaaauuauccccggacaacaugaaacaggugaggucaggucacugcggacaucaagggc

SEQ ID NO: 610298 - RNA, 64 nt, hsa
gcugagcuauaagagggguggacacagggugggcugaggucagagguugguggggugucaucac

SEQ ID NO: 610299 - RNA, 64 nt, hsa
cuugagcacugauguaaauuacuuagaucuucuuugaggucagaauucagcgaucacgguaggc

SEQ ID NO: 610300 - RNA, 64 nt, hsa
ucagcagaauagcaaaaacuuugcucaggacauuugaggucaaauugaagacggaagacggaag

SEQ ID NO: 610301 - RNA, 64 nt, hsa
guguccccucugcaugcccuuaaacauuggacagugaggucacaguccacccacccucucucug

SEQ ID NO: 610302 - RNA, 64 nt, hsa
caguacucugggaagccaaggcaggcagaucacuugaggucaggaguucgagaccagccuggcc

SEQ ID NO: 610303 - RNA, 64 nt, hsa
cagcacuuugggaggcugaggcgggcagaucgcuugaggucaggaguucaagaccagcccgggc

SEQ ID NO: 610304 - RNA, 64 nt, hsa
caguacuuugggaggccgagucagguggaucaccugaggucaggaguucaagaccagccuggcc

SEQ ID NO: 610305 - RNA, 64 nt, hsa
caugggggcucuuucgcugcagccuccaccgugcugaggucaggaggccgacguggcaguugug

SEQ ID NO: 610306 - RNA, 64 nt, hsa
acuucacugaauuucuucaaaaccauugcagaagugaggucauccuugaaaaguggcagaaaaa

SEQ ID NO: 610307 - RNA, 64 nt, hsa
cccagcacuuugggaggccgaggugggcaaaucaugaggucaggagauugagaccuuccuggcu

SEQ ID NO: 610308 - RNA, 64 nt, hsa
uacauaguauuccucaguaucuauuccaagauacugaggucauaaucagaagcuaagcugggug

SEQ ID NO: 610309 - RNA, 64 nt, hsa
cagcacuuugggaggccaagguggguggaccacaugaggucaggaguuugagaucagccuggcc

SEQ ID NO: 610310 - RNA, 64 nt, hsa
cccagcacuuugggaggccaagacgggcggaucaugaggucaagagaucaagaucauccuggcc

SEQ ID NO: 610311 - RNA, 64 nt, hsa
caacacuuuaggagaccaaggcgggcagaucacuugaggucagaaguuugagaccagccaggcc

SEQ ID NO: 610312 - RNA, 64 nt, hsa
cagcacucugggaggcugagacagguagaucauuugaggucaggaguucaaaaccaaccugguc

SEQ ID NO: 610313 - RNA, 64 nt, hsa
gauuuggccagagccuucaggagguggaggccggugaggucaggagcccagcucuccagggggc

SEQ ID NO: 610314 - RNA, 64 nt, hsa
caggggcuuuggacuccugaggguguucccuuccugaggucacauguggauuuggccagagccu

SEQ ID NO: 610315 - RNA, 64 nt, hsa
cagcacuuugggaggcugaggcaggugaaucaccugaggucaggaguucaagaccagccuggcc

SEQ ID NO: 610316 - RNA, 64 nt, hsa
cugauaaccuaagagcauuaagcucugaguccagugaggucauagcaguguaugcuccuugccc

SEQ ID NO: 610317 - RNA, 64 nt, hsa
cagcacuuugggaguccaaggcaggcauaucauuugaggucaggaguuuaagaccagccuggcu

SEQ ID NO: 610318 - RNA, 64 nt, hsa
ugcaugugaguaaacacaccugcgcagcccuggcugaggucacuaggcuggccagaggcaggac

SEQ ID NO: 610319 - RNA, 64 nt, hsa
uuccagauuguaaauguaccaucuuaaacaacucugaggucaccaaacaguaguuauuugacug

SEQ ID NO: 610320 - RNA, 64 nt, hsa
ucccagcacuuugggagguugcggguggaucacuugaggucaggaguucgagaccagccuggcc

SEQ ID NO: 610321 - RNA, 64 nt, hsa
uaaaauguguaucugagugagaaaacaaguauggugaggucacuuuaauguuucacagcgaucu

SEQ ID NO: 610322 - RNA, 64 nt, hsa
ggcaugcccgaguccugcaaggguggcggguggcugaggucacaccaccacuggaguggauggg

SEQ ID NO: 610323 - RNA, 64 nt, hsa
cagcacuuugggaggcaggggcggguggaucaccugaggucaggaguucaagacuagccuggcc

SEQ ID NO: 610324 - RNA, 64 nt, hsa
cagcacuuugagaggcugaggugguaggaucaccugaggucaggaguucaagaccagccugucc

SEQ ID NO: 610325 - RNA, 64 nt, hsa
uggacagccagagcuuucuauguacuguuaaaauugaggucacauauuuucuuuuguauccugg

SEQ ID NO: 610326 - RNA, 64 nt, hsa
gugauguacuuaaaggaauaauaaaugcauaauaugaggucaguggacgccauuuucuguuaua

SEQ ID NO: 610327 - RNA, 64 nt, hsa
acuuugggaggcugaggcgggugaaucacuugauugaggucaggaguucgagaccagccuggcc

SEQ ID NO: 610328 - RNA, 64 nt, hsa
cagcacuuugcaaggccgaggaggguggaucacuugaggucaggaguucgagaccagccugacc

SEQ ID NO: 610329 - RNA, 64 nt, hsa
ggaaacacagucguugcagauuaauuagucaccaugaggucacugggguggccccuaacccacc

SEQ ID NO: 610330 - RNA, 64 nt, hsa
uguccuacucuguaacccuagagggcaccucugcugaggucagacaucuccuugaugucuguga

SEQ ID NO: 610331 - RNA, 64 nt, hsa
gcugugggcuggguggccccauccuaccaggcccugaggucaggauggggagcugcugccuuug

SEQ ID NO: 610332 - RNA, 64 nt, hsa
cuccuagcagaucguggggaacgucaggucucucugaggucaggucugaggccaguauccucca

SEQ ID NO: 610333 - RNA, 64 nt, hsa
cagcacuuugggaggccaaggcugguggaucaccugaggucaggaguucgagaccagccuggcc

SEQ ID NO: 610334 - RNA, 64 nt, hsa
cagcacuuugggaggcuuaggcggcuggaucaccugaggucaggaguucaagaccagccugguc

SEQ ID NO: 610335 - RNA, 64 nt, hsa
ucagcagaauaacaaaaacuuugcucaggacauuugaggucaaauugaagacggaaaccggaaa

SEQ ID NO: 610336 - RNA, 64 nt, hsa
auucuugagcacugauauaaauuacggucuucuuugaggucaaaauucagccaucaugguaggc

SEQ ID NO: 610337 - RNA, 64 nt, hsa
cagcacuuugggaggcugaggcaggcggaucacuugaggucaggagcucgagaccagccuggcc

SEQ ID NO: 610338 - RNA, 64 nt, hsa
cagcauuuugggaggccaaggcgggcggaucacuugaggucaggagcucaagaccagccuggcc

SEQ ID NO: 610339 - RNA, 64 nt, hsa
ggugugugagugggaggagagggcagagguccccugaggucaugcauuguaaucaucauagaag

SEQ ID NO: 610340 - RNA, 64 nt, hsa
cccugaggguguuaguaccuaguggugaaacggaugaggucauuucuaagguguguugcccgug

SEQ ID NO: 610341 - RNA, 64 nt, hsa
uuaagaauaaggggcccugaaugucaugaaggcuugaggucagccuacagauaacaggauuauu

SEQ ID NO: 610342 - RNA, 64 nt, hsa
aucaccugauucaaggacuuugcuagcuagguuuugaggucaggcuucaguaacuguagucuug

SEQ ID NO: 610343 - RNA, 64 nt, hsa
cuuggccacagugcucucagccagcacuaagggcugaggucaauaccgcagaccuuggggagga

SEQ ID NO: 610344 - RNA, 64 nt, hsa
uccugacacagucccucagagauggcccuggcucugaggucacaucagcuagguuugggaggcc

SEQ ID NO: 610345 - RNA, 64 nt, hsa
cguuaggaccauccuccaggacaggugaccucuaugaggucaccuacggcuguggccgugcagg

SEQ ID NO: 610346 - RNA, 64 nt, hsa
guauuccuguggagggaccucugccgugccucucugaggucaggcugugcugugugaugggcag

SEQ ID NO: 610347 - RNA, 64 nt, hsa
ccucaaauauggcauugcucaaaucugcuguguaugaggucacagggcccagcuguggcagggg

SEQ ID NO: 610348 - RNA, 64 nt, hsa
cagcacuuugggaggccaaggcaggcagaucaccugaggucaggaguuugagaccagccuggcc

SEQ ID NO: 610349 - RNA, 64 nt, hsa
aaacugggcgguggccgggcgugguggcucacgcugaggucaggaguucgagaccagccuggcc

SEQ ID NO: 610350 - RNA, 64 nt, hsa
cagcacuuugggaggccgaggugggcagaucagcugaggucaggagaucgagaccagccuggcc

SEQ ID NO: 610351 - RNA, 64 nt, hsa
uuugggccaagccucagcuagggcugcugccuggacgccugaggggcagcuuaucacagugcaa

SEQ ID NO: 610352 - RNA, 64 nt, hsa
guggagugagcacgucugcagggcccucucauacacgccugaggcagaagcagcgucccccgug

SEQ ID NO: 610353 - RNA, 64 nt, hsa
guuuuuuggcuugcuuauguguaggugaacagucacgccugaaacuuugaggauaacuuuuuaa

SEQ ID NO: 610354 - RNA, 64 nt, hsa
uuuuauaaugugucuaggcugggugcggugacucacgccugaaaucccagcacuuuggguggcu

SEQ ID NO: 610355 - RNA, 64 nt, hsa
ugcgcccuugaggggccccagcgucugcagggugacgccugagacagcaccacugcugaggagu

SEQ ID NO: 610356 - RNA, 64 nt, hsa
acacugcagugguuuuccugcagcucuccaacaaacgccugagucacaggccagagcugccuug

SEQ ID NO: 610357 - RNA, 64 nt, hsa
guuuucccagcaacucacccucuuccaucuccaaacgccugaagcuuaaccaagagugagagga

SEQ ID NO: 610358 - RNA, 64 nt, hsa
ccaggcggaggcccuuucagaaagggcgaagcucacgccugacucugcgggccgcggggccgcg

SEQ ID NO: 610359 - RNA, 64 nt, hsa
auggagcugggcuaaguaaauaggaauugguuucacgccugaggcaauuagacacuuuggaaga

SEQ ID NO: 610360 - RNA, 64 nt, hsa
aauuaaaacuagaacuauagauccacaugaacgcacgccugagauuuggccacucaccuauguu

SEQ ID NO: 610361 - RNA, 64 nt, hsa
cuguaaucccagcccuaugggaggcuggucuugaacgccugaccuugugaucugcccgccucgg

SEQ ID NO: 610362 - RNA, 64 nt, hsa
gaucccaagaguuuuuauagaauccuaaaaaauaacgccugauguauagauuaguuagcaaauu

SEQ ID NO: 610363 - RNA, 64 nt, hsa
aaagaguuaccuggaucagccaugcucagcugugacgccugaauaacugucuacuuuaucuuca

SEQ ID NO: 610364 - RNA, 64 nt, hsa
cgucccagaaaccaaagggcaggcacggcagcaaacgccugagugcugcugccuucggugacua

SEQ ID NO: 610365 - RNA, 64 nt, hsa
cgccacauagggugcagggccugggcccaccacgacgccugaagucacagcuccuuccaagguu

SEQ ID NO: 610366 - RNA, 64 nt, hsa
aaagaaccaggagaacaaccaaagcagcuuacagacgccugaacggagaaugaaguguuucaag

SEQ ID NO: 610367 - RNA, 64 nt, hsa
gggaaaccccugaaaugcucucagagcaccucugacgccugaagaaguuauaccuuccucuucc

SEQ ID NO: 610368 - RNA, 64 nt, hsa
ucaggaacacgggucuguagagggucugcuggagacgccugaaagacaguuccaucuuccuuua

SEQ ID NO: 610369 - RNA, 64 nt, hsa
uaaagaggagaaggaaaacaugcugcucuggugcacgccugagcguccuccaucuuccaggaug

SEQ ID NO: 610370 - RNA, 64 nt, hsa
gaggguuucaccauguuggccaggcuggucucgaacgccugaccucgugugauccgcccuccuc

SEQ ID NO: 610371 - RNA, 64 nt, hsa
gcuuuaaacucagggacagagccaugcugggaagacgccugagcucacucggcacccugcaaaa

SEQ ID NO: 610372 - RNA, 64 nt, hsa
cuacaauguccauuuuaauggccuggaaugcaaaacgccugaagaauacaaaggauggucugug

SEQ ID NO: 610373 - RNA, 64 nt, hsa
uaacagcuuuuguacaucaacaucaagaaggaauacgccugagagagaucagaguauauagaug

SEQ ID NO: 610374 - RNA, 64 nt, hsa
cgccuccccagacccacgaggauacucacacugcacgccugaggcucuccuaagcuccuucuuu

SEQ ID NO: 610375 - RNA, 64 nt, hsa
uaccaccuguauaguggggaaguucagggagugcacgccugaguuaugugcuuugucauuuucu

SEQ ID NO: 610376 - RNA, 64 nt, hsa
gaggguugagucagucugucuuguuugcugugccacgccugaugcccagcccagcagcaugcuu

SEQ ID NO: 610377 - RNA, 64 nt, hsa
uuggccuccauuucugucucuaaccauucaaaugacgccugauggugcugcucaggcccaugcu

SEQ ID NO: 610378 - RNA, 64 nt, hsa
caggguuucaccauguuggccaggcuggucucgaacgccugaccucaugaucuacccgccucgg

SEQ ID NO: 610379 - RNA, 64 nt, hsa
cacucccaugcugguggcccuggccccacugagcacgccugagccuccggggccacgcuucguu

SEQ ID NO: 610380 - RNA, 64 nt, hsa
ccaugguuuuggaguuccucucggguuaucucccacgccugaccuggaaccagcaagccccuuu

SEQ ID NO: 610381 - RNA, 64 nt, hsa
cagcggcuggagcagcagacguuugccauuucucacgccugagggcaggcguuggagcagcuca

SEQ ID NO: 610382 - RNA, 59 nt, hsa
acaggagguucaagaugugagagggucagacgccugaggaacccuuacaguaggagccc

SEQ ID NO: 610383 - RNA, 50 nt, hsa
gcccugcuggcagagcgugaacgccugaugcaagaugggcaucggcagcg

SEQ ID NO: 610384 - RNA, 64 nt, hsa
gccaggugaaaggccuggcggggaggaaagugaaacgccugaaucaaaagcaguuuucuaauuu

SEQ ID NO: 610385 - RNA, 64 nt, hsa
cuccuuaggccuggaggccaagguguggguccccacgccugaucuuugaaaacacuacacaggg

SEQ ID NO: 610386 - RNA, 64 nt, hsa
ucccaaguagcugggauuacaggugugcaccaccacgccugacuaauuuuguauuuuuaguaga

SEQ ID NO: 610387 - RNA, 64 nt, hsa
ggguggcuacucugugccagagccuggggcucuaacgccugagcccagggaggccgaagcuaac

SEQ ID NO: 610388 - RNA, 52 nt, hsa
uccuggagaaguacgcgugaggacgccugagccccagcgggagaccuguccu

SEQ ID NO: 610389 - RNA, 64 nt, hsa
gauaagucccgucuuguuugugaguaccacagaaacgccugagagucacuuacccggccacugc

SEQ ID NO: 610390 - RNA, 64 nt, hsa
ugccgagugccugcaauugcaggcgagcgccgccacgccugacugccucggccucccgaggugc

SEQ ID NO: 610391 - RNA, 64 nt, hsa
aaaaauacaaaaaaucugccgggcgugguggcacacgccugaagucccagcuacucaggaggcu

SEQ ID NO: 610392 - RNA, 64 nt, hsa
aaaauuuuuauuuguuggccgggcaugguggcucacgccugaaaucccagcacuuugggaggcc

SEQ ID NO: 610393 - RNA, 64 nt, hsa
augguucuaagcaugccccuccagagccuaucauacgccugauacagagaaccucucaauaaau

SEQ ID NO: 610394 - RNA, 64 nt, hsa
agcgacucaggacugcucacgggucaggagggcaacgccugaagucagaccucccuauagguca

SEQ ID NO: 610395 - RNA, 64 nt, hsa
ugugugccagggcaggcagugccccaggggcaccacgccugacucuccaucacccaggccuuga

SEQ ID NO: 610396 - RNA, 64 nt, hsa
agucagcugggcauucaaagaagcuagacugagaacgccugagaagaaccagcuacgggaagag

SEQ ID NO: 610397 - RNA, 64 nt, hsa
agcuuugggcacgguccagggcaaacugaaauguacgccugaauuuuguaaacagaaguauuaa

SEQ ID NO: 610398 - RNA, 64 nt, hsa
caguauauuccagagucagaucuaagcuccaggcacgccugaagauguguugcuacucugacau

SEQ ID NO: 610399 - RNA, 64 nt, hsa
caggguuucaccauguuggccagcauggucuugaacgccugaccucagaugauccacccaccuu

SEQ ID NO: 610400 - RNA, 64 nt, hsa
ggggaggcgcgagguccuucugggggcuccuccgacgccugagggcgcugcuuccccgcggccg

SEQ ID NO: 610401 - RNA, 64 nt, hsa
ggaagcaucuacccguucacuccagucccaccccacgccugacuccccucuggaaacugcaggc

SEQ ID NO: 610402 - RNA, 64 nt, hsa
gcaggucuaucaggcugcagguuccuacacacccacgccugagggucauagcaggcuaagggug

SEQ ID NO: 610403 - RNA, 64 nt, hsa
cugcugcgcaucaacuucaacaacuacuaccaggacgccugaggcugcucugcgggggacgugc

SEQ ID NO: 610404 - RNA, 64 nt, hsa
acgucuaccugucugggaucaacuccuggaagaaacgccugauccgcaucaaggugcgcacagg

SEQ ID NO: 610405 - RNA, 64 nt, hsa
gcauguggcaaagcucaccaucuucacuacaaacacgccugagaguggcacuggggaaacauaa

SEQ ID NO: 610406 - RNA, 64 nt, hsa
cucuuucccauagucagaguugaauuugucaggcacgccugaaaugugcucauagccaaaacau

SEQ ID NO: 610407 - RNA, 64 nt, hsa
uuccugaaaauaucggggagguuuucucccccagacgccugauauugaaguaaaaaauuuaaaa

SEQ ID NO: 610408 - RNA, 64 nt, hsa
uuuucuugccuccccaguuuucaucccagugguaacgccugauuuuugguagcuaugccaucuu

SEQ ID NO: 610409 - RNA, 64 nt, hsa
uggccuggccaggccuggcacagccuuggcuuccacgccugagcguggagagcacgaguuaguu

SEQ ID NO: 610410 - RNA, 64 nt, hsa
ugcaauagugggcugacucccuccagccccaugccggcccuacccgcccuugaaguauagccag

SEQ ID NO: 610411 - RNA, 64 nt, hsa
cucaggcauacucguuacaucuguauugaacuuucggcccuagaaaccaguggaguuauuucac

SEQ ID NO: 610412 - RNA, 64 nt, hsa
aagugcugggauuacaggcgugagccaccgugcccggcccuaaaaugaaauuauuaauguuggu

SEQ ID NO: 610413 - RNA, 64 nt, hsa
acagacaccgaugcagaccacucgauuucaugaccggcccuauugcacuauggaaguuaaagug

SEQ ID NO: 610414 - RNA, 64 nt, hsa
gccucugcugcgccgccuguggugccuggucucccggcccuagcgcccgccaaaccuggugguc

SEQ ID NO: 610415 - RNA, 64 nt, hsa
aaaagaaucuuaaaauaggaacauaauaaaagaucggcccuaaguaaagagcacuuuuuaaacu

SEQ ID NO: 610416 - RNA, 64 nt, hsa
caugcccgcuagcugugagguucauugcuacccucggcccuacuagcccucucuucccccuugu

SEQ ID NO: 610417 - RNA, 64 nt, hsa
uuucugcaguugggagauguucagcuucaguccccggcccuauggccguucuuuuccacccugu

SEQ ID NO: 610418 - RNA, 64 nt, hsa
cagaaacugcaugaaaaaucaugggccagagccucggcccuagcauugcacuuggccucaugcu

SEQ ID NO: 610419 - RNA, 64 nt, hsa
cacuuucucucaugcuaccuuuugugggccuguccggcccuacuucagucugaguuacucggga

SEQ ID NO: 610420 - RNA, 64 nt, hsa
gucccuccaggccccaaccuugccucaccacucccggcccuagucucugcaccuccuuaggccc

SEQ ID NO: 610421 - RNA, 64 nt, hsa
guaugccugggaaagacagcaggagauuggugaccggcccuaauggugcaugaaaagcgaguga

SEQ ID NO: 610422 - RNA, 64 nt, hsa
aagugcugggauugcaggcaugagccacugcucccggcccuauuauccauaguucuaauccaca

SEQ ID NO: 610423 - RNA, 64 nt, hsa
ggaugcugcagugaggcuguaaaguggcccccugcggcccuagccugacccggaggaaaggaug

SEQ ID NO: 610424 - RNA, 64 nt, hsa
acacacagaagaugguggaagcccagcguggggucggcccuagagccugcuacuccaucuggcu

SEQ ID NO: 610425 - RNA, 64 nt, hsa
gcccucuggccccgccccaacuuccaggcugacccggcccuacuggaggguguuuucacgaaug

SEQ ID NO: 610426 - RNA, 64 nt, hsa
gguguugcagggacccgcagcucccgugcggcaccggcccuagccaggccuuacugccccuacu

SEQ ID NO: 610427 - RNA, 64 nt, hsa
uggggcucccuucaucuccagggaguccccuccccggcccuaccagcgcccgcugggcugagcc

SEQ ID NO: 610428 - RNA, 64 nt, hsa
cuaauucuucaguuuugaugcugauaccugcccccggcccuaccuuagcucuguggcauuauau

SEQ ID NO: 610429 - RNA, 64 nt, hsa
aacuuaggcuuggccucuuucacaaauuaggccacggcccuaaauaggaauucccuggauugug

SEQ ID NO: 610430 - RNA, 64 nt, hsa
ggucugaggggcaacugagucugcgggagaagagcggcccuaugcaugguguagaugcccugau

SEQ ID NO: 610431 - RNA, 63 nt, hsa
uauacggucggaccuggugagaggacgccgggccggcccuagcccagcgcucugccucaccgc

SEQ ID NO: 610432 - RNA, 64 nt, hsa
gucaaaacccaaggcagccuugacagggaccccccggcccuaacacccaucaggaguuggagca

SEQ ID NO: 610433 - RNA, 64 nt, hsa
ugccggccgcccagacaccacagacgccaccuggcggcccuaagccacucccgccacacgcuca

SEQ ID NO: 610434 - RNA, 64 nt, hsa
uuucugcugagagaaggugacuuaacgccuuuuccggcccuagcuccaggcguuuugaggcguc

SEQ ID NO: 610435 - RNA, 64 nt, hsa
gaaagccuuagggaagcuggccugagaggggaagcggcccuaagggagugucuaagaacaaaag

SEQ ID NO: 610436 - RNA, 58 nt, hsa
augcugagcccgagcacuaacccuccugcggcccuagcgacccucaggcuucuucccc

SEQ ID NO: 610437 - RNA, 64 nt, hsa
ugugcucagggcugagucuuaaagaaggguuugccggcccuaacgcugcagcgcgugcgcggug

SEQ ID NO: 610438 - RNA, 64 nt, hsa
gcugcaggugcacaugaagaagcacacgggggagcggcccuacaagugugccuacugcgucaug

SEQ ID NO: 610439 - RNA, 64 nt, hsa
aagugcugggauuacagguguuagccacugcgcccggcccuagagcucacuguuuucuaguuag

SEQ ID NO: 610440 - RNA, 64 nt, hsa
aaacagaaagacgcuugugcgugaauguucauggcggcccuauucacaguagccaaacgaugaa

SEQ ID NO: 610441 - RNA, 50 nt, hsa
ccgcuggcgcucagcaguaacggcccuaucugucuccugaugccugagca

SEQ ID NO: 610442 - RNA, 64 nt, hsa
gggcuggugcugccuggcggaaggacagugagggcggcccuagccgccuccacccucuugcgcc

SEQ ID NO: 610443 - RNA, 64 nt, hsa
guacagcccccguccccgccccgccccgcccggccggcccuaacuuauuuuggcgucacagcug

SEQ ID NO: 610444 - RNA, 64 nt, hsa
accccgcccccaccuuucgcuccugcccucugcccggcccuacugagauucccaaggagaaggc

SEQ ID NO: 610445 - RNA, 64 nt, hsa; identical to SEQ ID NO: 264086

SEQ ID NO: 610446 - RNA, 64 nt, hsa; identical to SEQ ID NO: 264087

SEQ ID NO: 610447 - RNA, 64 nt, hsa; identical to SEQ ID NO: 264088

SEQ ID NO: 610448 - RNA, 64 nt, hsa; identical to SEQ ID NO: 264089

SEQ ID NO: 610449 - RNA, 64 nt, hsa; identical to SEQ ID NO: 264090

SEQ ID NO: 610450 - RNA, 64 nt, hsa; identical to SEQ ID NO: 264091

SEQ ID NO: 610451 - RNA, 64 nt, hsa; identical to SEQ ID NO: 264092

SEQ ID NO: 610452 - RNA, 64 nt, hsa; identical to SEQ ID NO: 264093

SEQ ID NO: 610453 - RNA, 64 nt, hsa; identical to SEQ ID NO: 264094

SEQ ID NO: 610454 - RNA, 64 nt, hsa; identical to SEQ ID NO: 264095

SEQ ID NO: 610455 - RNA, 64 nt, hsa; identical to SEQ ID NO: 38140

SEQ ID NO: 610456 - RNA, 64 nt, hsa; identical to SEQ ID NO: 38141

SEQ ID NO: 610457 - RNA, 64 nt, hsa; identical to SEQ ID NO: 38142

SEQ ID NO: 610458 - RNA, 64 nt, hsa; identical to SEQ ID NO: 38143

SEQ ID NO: 610459 - RNA, 64 nt, hsa; identical to SEQ ID NO: 38144

SEQ ID NO: 610460 - RNA, 64 nt, hsa; identical to SEQ ID NO: 38145

SEQ ID NO: 610461 - RNA, 64 nt, hsa; identical to SEQ ID NO: 38146

SEQ ID NO: 610462 - RNA, 64 nt, hsa; identical to SEQ ID NO: 38147

SEQ ID NO: 610463 - RNA, 64 nt, hsa; identical to SEQ ID NO: 38148

SEQ ID NO: 610464 - RNA, 64 nt, hsa; identical to SEQ ID NO: 38149

SEQ ID NO: 610465 - RNA, 64 nt, hsa; identical to SEQ ID NO: 38150

SEQ ID NO: 610466 - RNA, 64 nt, hsa; identical to SEQ ID NO: 38151

SEQ ID NO: 610467 - RNA, 64 nt, hsa; identical to SEQ ID NO: 38152

SEQ ID NO: 610468 - RNA, 64 nt, hsa; identical to SEQ ID NO: 38153

SEQ ID NO: 610469 - RNA, 64 nt, hsa; identical to SEQ ID NO: 38154

SEQ ID NO: 610470 - RNA, 64 nt, hsa; identical to SEQ ID NO: 38155

SEQ ID NO: 610471 - RNA, 64 nt, hsa; identical to SEQ ID NO: 38156

SEQ ID NO: 610472 - RNA, 64 nt, hsa; identical to SEQ ID NO: 38157

SEQ ID NO: 610473 - RNA, 64 nt, hsa; identical to SEQ ID NO: 38158

SEQ ID NO: 610474 - RNA, 64 nt, hsa; identical to SEQ ID NO: 38159

SEQ ID NO: 610475 - RNA, 64 nt, hsa; identical to SEQ ID NO: 38160

SEQ ID NO: 610476 - RNA, 64 nt, hsa; identical to SEQ ID NO: 38161

SEQ ID NO: 610477 - RNA, 64 nt, hsa; identical to SEQ ID NO: 98538

SEQ ID NO: 610478 - RNA, 64 nt, hsa; identical to SEQ ID NO: 98539

SEQ ID NO: 610479 - RNA, 64 nt, hsa; identical to SEQ ID NO: 98540

SEQ ID NO: 610480 - RNA, 64 nt, hsa; identical to SEQ ID NO: 98541

SEQ ID NO: 610481 - RNA, 64 nt, hsa; identical to SEQ ID NO: 98542

SEQ ID NO: 610482 - RNA, 64 nt, hsa; identical to SEQ ID NO: 98543

SEQ ID NO: 610483 - RNA, 64 nt, hsa; identical to SEQ ID NO: 98544

SEQ ID NO: 610484 - RNA, 64 nt, hsa; identical to SEQ ID NO: 98545

SEQ ID NO: 610485 - RNA, 64 nt, hsa; identical to SEQ ID NO: 98546

SEQ ID NO: 610486 - RNA, 64 nt, hsa; identical to SEQ ID NO: 98547

SEQ ID NO: 610487 - RNA, 64 nt, hsa; identical to SEQ ID NO: 98548

SEQ ID NO: 610488 - RNA, 64 nt, hsa; identical to SEQ ID NO: 98549

SEQ ID NO: 610489 - RNA, 64 nt, hsa; identical to SEQ ID NO: 98550

SEQ ID NO: 610490 - RNA, 64 nt, hsa; identical to SEQ ID NO: 98551

SEQ ID NO: 610491 - RNA, 64 nt, hsa; identical to SEQ ID NO: 98552

SEQ ID NO: 610492 - RNA, 64 nt, hsa; identical to SEQ ID NO: 98553

SEQ ID NO: 610493 - RNA, 64 nt, hsa; identical to SEQ ID NO: 98554

SEQ ID NO: 610494 - RNA, 64 nt, hsa; identical to SEQ ID NO: 98555

SEQ ID NO: 610495 - RNA, 64 nt, hsa; identical to SEQ ID NO: 98556

SEQ ID NO: 610496 - RNA, 64 nt, hsa; identical to SEQ ID NO: 98557

SEQ ID NO: 610497 - RNA, 64 nt, hsa; identical to SEQ ID NO: 98558

SEQ ID NO: 610498 - RNA, 64 nt, hsa; identical to SEQ ID NO: 98559

SEQ ID NO: 610499 - RNA, 64 nt, hsa; identical to SEQ ID NO: 98560

SEQ ID NO: 610500 - RNA, 64 nt, hsa; identical to SEQ ID NO: 98561

SEQ ID NO: 610501 - RNA, 64 nt, hsa; identical to SEQ ID NO: 98562

SEQ ID NO: 610502 - RNA, 64 nt, hsa; identical to SEQ ID NO: 98563

SEQ ID NO: 610503 - RNA, 64 nt, hsa; identical to SEQ ID NO: 98564

SEQ ID NO: 610504 - RNA, 64 nt, hsa; identical to SEQ ID NO: 98565

SEQ ID NO: 610505 - RNA, 64 nt, hsa; identical to SEQ ID NO: 98566

SEQ ID NO: 610506 - RNA, 64 nt, hsa; identical to SEQ ID NO: 98567

SEQ ID NO: 610507 - RNA, 64 nt, hsa; identical to SEQ ID NO: 98568

SEQ ID NO: 610508 - RNA, 64 nt, hsa; identical to SEQ ID NO: 98569

SEQ ID NO: 610509 - RNA, 64 nt, hsa; identical to SEQ ID NO: 98570

SEQ ID NO: 610510 - RNA, 64 nt, hsa; identical to SEQ ID NO: 351843

SEQ ID NO: 610511 - RNA, 64 nt, hsa; identical to SEQ ID NO: 351844

SEQ ID NO: 610512 - RNA, 64 nt, hsa
ggauggagcuaagaguucagaggccaucaaggagagcagcaaguuuccauuuggcauuagccca

SEQ ID NO: 610513 - RNA, 64 nt, hsa
uaaugucucacauggaaacagaaaacgcugggucagcagcaagcuguaguuuuuaaaaauguuu

SEQ ID NO: 610514 - RNA, 64 nt, hsa
acaucaauagauuuuuaggcugaauuaauuugaaagcagcaauuugcuguucucaaccauucuu

SEQ ID NO: 610515 - RNA, 64 nt, hsa
cuaucagaccaacaaaccuucccccugaaaagugagcagcaacguaaaaacguaugugaagccu

SEQ ID NO: 610516 - RNA, 64 nt, hsa
aaggcuccguccugacugcccugugcccuggaaaagcagcaauagcauccgccccuuagagccc

SEQ ID NO: 610517 - RNA, 64 nt, hsa
gcuggccuuguuagacagcacuugggccuuugccagcagcaagaggugaagcgaagccacucuu

SEQ ID NO: 610518 - RNA, 64 nt, hsa
uuuaaaaagaagaagaagaaaaaaaacaagaacaagcagcaacagcuguuuuguuggggcuaua

SEQ ID NO: 610519 - RNA, 64 nt, hsa
gguuuucauggguaggaaagcuuguccugaccccagcagcaaagagguggcaggucgcuaauga

SEQ ID NO: 610520 - RNA, 64 nt, hsa
cucuucagacugaagcagcaauucugccacuaccagcagcaaccaggacgucuguucuuugugg

SEQ ID NO: 610521 - RNA, 64 nt, hsa
gaguacacccuggcaaggcuucucuucagacugaagcagcaauucugccacuaccagcagcaac

SEQ ID NO: 610522 - RNA, 64 nt, hsa
agcugaauccgcccagugauagccugugggcaccagcagcaagggcugccaugggauacagcac

SEQ ID NO: 610523 - RNA, 64 nt, hsa
agacacaaaugaagaagaacaaagagccugagaaagcagcaagaggacaugaugaaaaauacgu

SEQ ID NO: 610524 - RNA, 64 nt, hsa
auagcaguuguauuguguaacaaguacugcucccagcagcaauuagggagaaaacuagucuaaa

SEQ ID NO: 610525 - RNA, 64 nt, hsa
gcugcuuguaggacuguucaccaagggggauaccagcagcaagagagugcacccguuuagcccu

SEQ ID NO: 610526 - RNA, 64 nt, hsa
gaugaaccaucuacgggcauagaccccacagggcagcagcaaauguggugagcaucauuauacc

SEQ ID NO: 610527 - RNA, 64 nt, hsa
agaaaaguugcuuuucaaagaggaagaagaaaauagcagcaagaaauaucucuuucuguguuca

SEQ ID NO: 610528 - RNA, 64 nt, hsa
caccuaaauuuuuguaagaaaauuuaaaaauuaaagcagcaaaggaacuuuuugcuuucugcca

SEQ ID NO: 610529 - RNA, 64 nt, hsa
cacaaggcccagcccugggcaaggaagcuuuggaagcagcaaggugggggucaggcuacaggug

SEQ ID NO: 610530 - RNA, 64 nt, hsa
cuucacccuuucagaugugaccucuuuuggacuaagcagcaaucuguucucuugcucaaauaau

SEQ ID NO: 610531 - RNA, 64 nt, hsa
ucacaucuacucaacucugcuguugacaugcaaaagcagcaauagacaauaugcguguaaauga

SEQ ID NO: 610532 - RNA, 64 nt, hsa; identical to SEQ ID NO: 100778

SEQ ID NO: 610533 - RNA, 64 nt, hsa; identical to SEQ ID NO: 100779

SEQ ID NO: 610534 - RNA, 64 nt, hsa; identical to SEQ ID NO: 100780

SEQ ID NO: 610535 - RNA, 64 nt, hsa; identical to SEQ ID NO: 100781

SEQ ID NO: 610536 - RNA, 64 nt, hsa; identical to SEQ ID NO: 100782

SEQ ID NO: 610537 - RNA, 64 nt, hsa; identical to SEQ ID NO: 100783

SEQ ID NO: 610538 - RNA, 64 nt, hsa; identical to SEQ ID NO: 100784

SEQ ID NO: 610539 - RNA, 64 nt, hsa; identical to SEQ ID NO: 100785

SEQ ID NO: 610540 - RNA, 64 nt, hsa; identical to SEQ ID NO: 100786

SEQ ID NO: 610541 - RNA, 64 nt, hsa; identical to SEQ ID NO: 100787

SEQ ID NO: 610542 - RNA, 64 nt, hsa; identical to SEQ ID NO: 100788

SEQ ID NO: 610543 - RNA, 64 nt, hsa; identical to SEQ ID NO: 100789

SEQ ID NO: 610544 - RNA, 64 nt, hsa; identical to SEQ ID NO: 100790

SEQ ID NO: 610545 - RNA, 62 nt, hsa; identical to SEQ ID NO: 443387

SEQ ID NO: 610546 - RNA, 62 nt, hsa; identical to SEQ ID NO: 443388

SEQ ID NO: 610547 - RNA, 62 nt, hsa; identical to SEQ ID NO: 443389

SEQ ID NO: 610548 - RNA, 62 nt, hsa; identical to SEQ ID NO: 443390

SEQ ID NO: 610549 - RNA, 62 nt, hsa; identical to SEQ ID NO: 443391

SEQ ID NO: 610550 - RNA, 62 nt, hsa; identical to SEQ ID NO: 443392

SEQ ID NO: 610551 - RNA, 62 nt, hsa; identical to SEQ ID NO: 443393

SEQ ID NO: 610552 - RNA, 62 nt, hsa; identical to SEQ ID NO: 443394

SEQ ID NO: 610553 - RNA, 62 nt, hsa; identical to SEQ ID NO: 443395

SEQ ID NO: 610554 - RNA, 62 nt, hsa; identical to SEQ ID NO: 443396

SEQ ID NO: 610555 - RNA, 62 nt, hsa; identical to SEQ ID NO: 443397

SEQ ID NO: 610556 - RNA, 62 nt, hsa; identical to SEQ ID NO: 443398

SEQ ID NO: 610557 - RNA, 62 nt, hsa; identical to SEQ ID NO: 443399

SEQ ID NO: 610558 - RNA, 62 nt, hsa; identical to SEQ ID NO: 443400

SEQ ID NO: 610559 - RNA, 62 nt, hsa; identical to SEQ ID NO: 443401

SEQ ID NO: 610560 - RNA, 62 nt, hsa; identical to SEQ ID NO: 443402

SEQ ID NO: 610561 - RNA, 62 nt, hsa; identical to SEQ ID NO: 443403

SEQ ID NO: 610562 - RNA, 62 nt, hsa; identical to SEQ ID NO: 443404

SEQ ID NO: 610563 - RNA, 62 nt, hsa; identical to SEQ ID NO: 443405

SEQ ID NO: 610564 - RNA, 62 nt, hsa; identical to SEQ ID NO: 443406

SEQ ID NO: 610565 - RNA, 62 nt, hsa; identical to SEQ ID NO: 443407

SEQ ID NO: 610566 - RNA, 62 nt, hsa; identical to SEQ ID NO: 443408

SEQ ID NO: 610567 - RNA, 64 nt, hsa; identical to SEQ ID NO: 443409

SEQ ID NO: 610568 - RNA, 64 nt, hsa; identical to SEQ ID NO: 443410

SEQ ID NO: 610569 - RNA, 64 nt, hsa; identical to SEQ ID NO: 443411

SEQ ID NO: 610570 - RNA, 64 nt, hsa; identical to SEQ ID NO: 443412

SEQ ID NO: 610571 - RNA, 64 nt, hsa; identical to SEQ ID NO: 443413

SEQ ID NO: 610572 - RNA, 64 nt, hsa; identical to SEQ ID NO: 443414

SEQ ID NO: 610573 - RNA, 64 nt, hsa; identical to SEQ ID NO: 443415

SEQ ID NO: 610574 - RNA, 64 nt, hsa; identical to SEQ ID NO: 443416

SEQ ID NO: 610575 - RNA, 64 nt, hsa; identical to SEQ ID NO: 443417

SEQ ID NO: 610576 - RNA, 64 nt, hsa; identical to SEQ ID NO: 443418

SEQ ID NO: 610577 - RNA, 64 nt, hsa; identical to SEQ ID NO: 443419

SEQ ID NO: 610578 - RNA, 64 nt, hsa; identical to SEQ ID NO: 443420

SEQ ID NO: 610579 - RNA, 64 nt, hsa; identical to SEQ ID NO: 443421

SEQ ID NO: 610580 - RNA, 64 nt, hsa; identical to SEQ ID NO: 443422

SEQ ID NO: 610581 - RNA, 64 nt, hsa; identical to SEQ ID NO: 443423

SEQ ID NO: 610582 - RNA, 64 nt, hsa; identical to SEQ ID NO: 443424

SEQ ID NO: 610583 - RNA, 64 nt, hsa; identical to SEQ ID NO: 443425

SEQ ID NO: 610584 - RNA, 64 nt, hsa; identical to SEQ ID NO: 443426

SEQ ID NO: 610585 - RNA, 64 nt, hsa; identical to SEQ ID NO: 443427

SEQ ID NO: 610586 - RNA, 64 nt, hsa; identical to SEQ ID NO: 443428

SEQ ID NO: 610587 - RNA, 64 nt, hsa; identical to SEQ ID NO: 443429

SEQ ID NO: 610588 - RNA, 64 nt, hsa; identical to SEQ ID NO: 443430

SEQ ID NO: 610589 - RNA, 64 nt, hsa; identical to SEQ ID NO: 219184

SEQ ID NO: 610590 - RNA, 64 nt, hsa; identical to SEQ ID NO: 219185

SEQ ID NO: 610591 - RNA, 64 nt, hsa; identical to SEQ ID NO: 219186

SEQ ID NO: 610592 - RNA, 64 nt, hsa; identical to SEQ ID NO: 219187

SEQ ID NO: 610593 - RNA, 64 nt, hsa; identical to SEQ ID NO: 219188

SEQ ID NO: 610594 - RNA, 64 nt, hsa; identical to SEQ ID NO: 219189

SEQ ID NO: 610595 - RNA, 64 nt, hsa; identical to SEQ ID NO: 219190

SEQ ID NO: 610596 - RNA, 64 nt, hsa; identical to SEQ ID NO: 219191

SEQ ID NO: 610597 - RNA, 64 nt, hsa; identical to SEQ ID NO: 219192

SEQ ID NO: 610598 - RNA, 64 nt, hsa; identical to SEQ ID NO: 219193

SEQ ID NO: 610599 - RNA, 64 nt, hsa; identical to SEQ ID NO: 219194

SEQ ID NO: 610600 - RNA, 64 nt, hsa; identical to SEQ ID NO: 219195

SEQ ID NO: 610601 - RNA, 64 nt, hsa; identical to SEQ ID NO: 219196

SEQ ID NO: 610602 - RNA, 64 nt, hsa; identical to SEQ ID NO: 219197

SEQ ID NO: 610603 - RNA, 64 nt, hsa; identical to SEQ ID NO: 219198

SEQ ID NO: 610604 - RNA, 64 nt, hsa; identical to SEQ ID NO: 219199

SEQ ID NO: 610605 - RNA, 64 nt, hsa; identical to SEQ ID NO: 219200

SEQ ID NO: 610606 - RNA, 64 nt, hsa; identical to SEQ ID NO: 219201

SEQ ID NO: 610607 - RNA, 64 nt, hsa; identical to SEQ ID NO: 219202

SEQ ID NO: 610608 - RNA, 64 nt, hsa; identical to SEQ ID NO: 219203

SEQ ID NO: 610609 - RNA, 64 nt, hsa; identical to SEQ ID NO: 219204

SEQ ID NO: 610610 - RNA, 64 nt, hsa; identical to SEQ ID NO: 219205

SEQ ID NO: 610611 - RNA, 64 nt, hsa; identical to SEQ ID NO: 219206

SEQ ID NO: 610612 - RNA, 64 nt, hsa; identical to SEQ ID NO: 219207

SEQ ID NO: 610613 - RNA, 64 nt, hsa; identical to SEQ ID NO: 219208

SEQ ID NO: 610614 - RNA, 64 nt, hsa; identical to SEQ ID NO: 219209

SEQ ID NO: 610615 - RNA, 64 nt, hsa; identical to SEQ ID NO: 219210

SEQ ID NO: 610616 - RNA, 64 nt, hsa; identical to SEQ ID NO: 219211

SEQ ID NO: 610617 - RNA, 64 nt, hsa; identical to SEQ ID NO: 219212

SEQ ID NO: 610618 - RNA, 64 nt, hsa; identical to SEQ ID NO: 219213

SEQ ID NO: 610619 - RNA, 64 nt, hsa; identical to SEQ ID NO: 153946

SEQ ID NO: 610620 - RNA, 64 nt, hsa; identical to SEQ ID NO: 153947

SEQ ID NO: 610621 - RNA, 64 nt, hsa; identical to SEQ ID NO: 153948

SEQ ID NO: 610622 - RNA, 64 nt, hsa; identical to SEQ ID NO: 153949

SEQ ID NO: 610623 - RNA, 64 nt, hsa; identical to SEQ ID NO: 153950

SEQ ID NO: 610624 - RNA, 64 nt, hsa; identical to SEQ ID NO: 153951

SEQ ID NO: 610625 - RNA, 64 nt, hsa; identical to SEQ ID NO: 153952

SEQ ID NO: 610626 - RNA, 64 nt, hsa; identical to SEQ ID NO: 153953

SEQ ID NO: 610627 - RNA, 64 nt, hsa; identical to SEQ ID NO: 153954

SEQ ID NO: 610628 - RNA, 64 nt, hsa; identical to SEQ ID NO: 153955

SEQ ID NO: 610629 - RNA, 64 nt, hsa; identical to SEQ ID NO: 153956

SEQ ID NO: 610630 - RNA, 64 nt, hsa; identical to SEQ ID NO: 153957

SEQ ID NO: 610631 - RNA, 64 nt, hsa; identical to SEQ ID NO: 153958

SEQ ID NO: 610632 - RNA, 64 nt, hsa; identical to SEQ ID NO: 153959

SEQ ID NO: 610633 - RNA, 64 nt, hsa; identical to SEQ ID NO: 153960

SEQ ID NO: 610634 - RNA, 64 nt, hsa; identical to SEQ ID NO: 153961

SEQ ID NO: 610635 - RNA, 64 nt, hsa; identical to SEQ ID NO: 153962

SEQ ID NO: 610636 - RNA, 64 nt, hsa; identical to SEQ ID NO: 153963

SEQ ID NO: 610637 - RNA, 64 nt, hsa; identical to SEQ ID NO: 153964

SEQ ID NO: 610638 - RNA, 64 nt, hsa; identical to SEQ ID NO: 153965

SEQ ID NO: 610639 - RNA, 64 nt, hsa; identical to SEQ ID NO: 153966

SEQ ID NO: 610640 - RNA, 64 nt, hsa; identical to SEQ ID NO: 153967

SEQ ID NO: 610641 - RNA, 64 nt, hsa; identical to SEQ ID NO: 153968

SEQ ID NO: 610642 - RNA, 64 nt, hsa; identical to SEQ ID NO: 153969

SEQ ID NO: 610643 - RNA, 64 nt, hsa; identical to SEQ ID NO: 153970

SEQ ID NO: 610644 - RNA, 64 nt, hsa; identical to SEQ ID NO: 153971

SEQ ID NO: 610645 - RNA, 64 nt, hsa; identical to SEQ ID NO: 153972

SEQ ID NO: 610646 - RNA, 64 nt, hsa; identical to SEQ ID NO: 153973

SEQ ID NO: 610647 - RNA, 64 nt, hsa; identical to SEQ ID NO: 153974

SEQ ID NO: 610648 - RNA, 64 nt, hsa; identical to SEQ ID NO: 153975

SEQ ID NO: 610649 - RNA, 64 nt, hsa; identical to SEQ ID NO: 153976

SEQ ID NO: 610650 - RNA, 64 nt, hsa; identical to SEQ ID NO: 153977

SEQ ID NO: 610651 - RNA, 64 nt, hsa; identical to SEQ ID NO: 153978

SEQ ID NO: 610652 - RNA, 64 nt, hsa; identical to SEQ ID NO: 153979

SEQ ID NO: 610653 - RNA, 64 nt, hsa; identical to SEQ ID NO: 153980

SEQ ID NO: 610654 - RNA, 64 nt, hsa; identical to SEQ ID NO: 153981

SEQ ID NO: 610655 - RNA, 64 nt, hsa; identical to SEQ ID NO: 153982

SEQ ID NO: 610656 - RNA, 64 nt, hsa; identical to SEQ ID NO: 153983

SEQ ID NO: 610657 - RNA, 64 nt, hsa; identical to SEQ ID NO: 153984

SEQ ID NO: 610658 - RNA, 64 nt, hsa; identical to SEQ ID NO: 153985

SEQ ID NO: 610659 - RNA, 64 nt, hsa; identical to SEQ ID NO: 153986

SEQ ID NO: 610660 - RNA, 64 nt, hsa; identical to SEQ ID NO: 153987

SEQ ID NO: 610661 - RNA, 64 nt, hsa; identical to SEQ ID NO: 153988

SEQ ID NO: 610662 - RNA, 64 nt, hsa; identical to SEQ ID NO: 153989

SEQ ID NO: 610663 - RNA, 64 nt, hsa; identical to SEQ ID NO: 153990

SEQ ID NO: 610664 - RNA, 64 nt, hsa; identical to SEQ ID NO: 153991

SEQ ID NO: 610665 - RNA, 64 nt, hsa; identical to SEQ ID NO: 153992

SEQ ID NO: 610666 - RNA, 64 nt, hsa; identical to SEQ ID NO: 153993

SEQ ID NO: 610667 - RNA, 64 nt, hsa; identical to SEQ ID NO: 153994

SEQ ID NO: 610668 - RNA, 64 nt, hsa; identical to SEQ ID NO: 153995

SEQ ID NO: 610669 - RNA, 64 nt, hsa; identical to SEQ ID NO: 153996

SEQ ID NO: 610670 - RNA, 64 nt, hsa; identical to SEQ ID NO: 153997

SEQ ID NO: 610671 - RNA, 64 nt, hsa; identical to SEQ ID NO: 132231

SEQ ID NO: 610672 - RNA, 64 nt, hsa; identical to SEQ ID NO: 132232

SEQ ID NO: 610673 - RNA, 64 nt, hsa; identical to SEQ ID NO: 132233

SEQ ID NO: 610674 - RNA, 64 nt, hsa; identical to SEQ ID NO: 132234

SEQ ID NO: 610675 - RNA, 64 nt, hsa; identical to SEQ ID NO: 132235

SEQ ID NO: 610676 - RNA, 64 nt, hsa; identical to SEQ ID NO: 132236

SEQ ID NO: 610677 - RNA, 64 nt, hsa; identical to SEQ ID NO: 132237

SEQ ID NO: 610678 - RNA, 64 nt, hsa; identical to SEQ ID NO: 132238

SEQ ID NO: 610679 - RNA, 64 nt, hsa; identical to SEQ ID NO: 132239

SEQ ID NO: 610680 - RNA, 64 nt, hsa; identical to SEQ ID NO: 132240

SEQ ID NO: 610681 - RNA, 64 nt, hsa; identical to SEQ ID NO: 132241

SEQ ID NO: 610682 - RNA, 64 nt, hsa; identical to SEQ ID NO: 132242

SEQ ID NO: 610683 - RNA, 64 nt, hsa; identical to SEQ ID NO: 132243

SEQ ID NO: 610684 - RNA, 64 nt, hsa; identical to SEQ ID NO: 132244

SEQ ID NO: 610685 - RNA, 64 nt, hsa; identical to SEQ ID NO: 132245

SEQ ID NO: 610686 - RNA, 64 nt, hsa; identical to SEQ ID NO: 132246

SEQ ID NO: 610687 - RNA, 64 nt, hsa; identical to SEQ ID NO: 132247

SEQ ID NO: 610688 - RNA, 64 nt, hsa; identical to SEQ ID NO: 132248

SEQ ID NO: 610689 - RNA, 64 nt, hsa; identical to SEQ ID NO: 132249

SEQ ID NO: 610690 - RNA, 64 nt, hsa; identical to SEQ ID NO: 132250

SEQ ID NO: 610691 - RNA, 64 nt, hsa; identical to SEQ ID NO: 132251

SEQ ID NO: 610692 - RNA, 64 nt, hsa; identical to SEQ ID NO: 132252

SEQ ID NO: 610693 - RNA, 64 nt, hsa; identical to SEQ ID NO: 132253

SEQ ID NO: 610694 - RNA, 64 nt, hsa; identical to SEQ ID NO: 132254

SEQ ID NO: 610695 - RNA, 64 nt, hsa; identical to SEQ ID NO: 132255

SEQ ID NO: 610696 - RNA, 64 nt, hsa; identical to SEQ ID NO: 132256

SEQ ID NO: 610697 - RNA, 64 nt, hsa; identical to SEQ ID NO: 132257

SEQ ID NO: 610698 - RNA, 64 nt, hsa; identical to SEQ ID NO: 132258

SEQ ID NO: 610699 - RNA, 64 nt, hsa; identical to SEQ ID NO: 132259

SEQ ID NO: 610700 - RNA, 64 nt, hsa; identical to SEQ ID NO: 132260

SEQ ID NO: 610701 - RNA, 64 nt, hsa; identical to SEQ ID NO: 132261

SEQ ID NO: 610702 - RNA, 64 nt, hsa; identical to SEQ ID NO: 132262

SEQ ID NO: 610703 - RNA, 64 nt, hsa; identical to SEQ ID NO: 132263

SEQ ID NO: 610704 - RNA, 64 nt, hsa; identical to SEQ ID NO: 132264

SEQ ID NO: 610705 - RNA, 64 nt, hsa; identical to SEQ ID NO: 429192

SEQ ID NO: 610706 - RNA, 64 nt, hsa; identical to SEQ ID NO: 429193

SEQ ID NO: 610707 - RNA, 64 nt, hsa; identical to SEQ ID NO: 429194

SEQ ID NO: 610708 - RNA, 64 nt, hsa; identical to SEQ ID NO: 429195

SEQ ID NO: 610709 - RNA, 64 nt, hsa; identical to SEQ ID NO: 429196

SEQ ID NO: 610710 - RNA, 64 nt, hsa; identical to SEQ ID NO: 429197

SEQ ID NO: 610711 - RNA, 64 nt, hsa; identical to SEQ ID NO: 429198

SEQ ID NO: 610712 - RNA, 64 nt, hsa; identical to SEQ ID NO: 429199

SEQ ID NO: 610713 - RNA, 64 nt, hsa; identical to SEQ ID NO: 429200

SEQ ID NO: 610714 - RNA, 64 nt, hsa; identical to SEQ ID NO: 429201

SEQ ID NO: 610715 - RNA, 64 nt, hsa; identical to SEQ ID NO: 429202

SEQ ID NO: 610716 - RNA, 64 nt, hsa; identical to SEQ ID NO: 429203

SEQ ID NO: 610717 - RNA, 64 nt, hsa; identical to SEQ ID NO: 429204

SEQ ID NO: 610718 - RNA, 64 nt, hsa; identical to SEQ ID NO: 429205

SEQ ID NO: 610719 - RNA, 64 nt, hsa; identical to SEQ ID NO: 429206

SEQ ID NO: 610720 - RNA, 64 nt, hsa; identical to SEQ ID NO: 429207

SEQ ID NO: 610721 - RNA, 64 nt, hsa; identical to SEQ ID NO: 429208

SEQ ID NO: 610722 - RNA, 64 nt, hsa; identical to SEQ ID NO: 112922

SEQ ID NO: 610723 - RNA, 64 nt, hsa; identical to SEQ ID NO: 112923

SEQ ID NO: 610724 - RNA, 64 nt, hsa; identical to SEQ ID NO: 112924

SEQ ID NO: 610725 - RNA, 64 nt, hsa; identical to SEQ ID NO: 112925

SEQ ID NO: 610726 - RNA, 64 nt, hsa; identical to SEQ ID NO: 112926

SEQ ID NO: 610727 - RNA, 64 nt, hsa; identical to SEQ ID NO: 112927

SEQ ID NO: 610728 - RNA, 64 nt, hsa; identical to SEQ ID NO: 112928

SEQ ID NO: 610729 - RNA, 64 nt, hsa; identical to SEQ ID NO: 112929

SEQ ID NO: 610730 - RNA, 64 nt, hsa; identical to SEQ ID NO: 112930

SEQ ID NO: 610731 - RNA, 64 nt, hsa; identical to SEQ ID NO: 112931

SEQ ID NO: 610732 - RNA, 64 nt, hsa; identical to SEQ ID NO: 112932

SEQ ID NO: 610733 - RNA, 64 nt, hsa; identical to SEQ ID NO: 112933

SEQ ID NO: 610734 - RNA, 64 nt, hsa; identical to SEQ ID NO: 112934

SEQ ID NO: 610735 - RNA, 64 nt, hsa; identical to SEQ ID NO: 112935

SEQ ID NO: 610736 - RNA, 64 nt, hsa; identical to SEQ ID NO: 112936

SEQ ID NO: 610737 - RNA, 64 nt, hsa; identical to SEQ ID NO: 112937

SEQ ID NO: 610738 - RNA, 64 nt, hsa; identical to SEQ ID NO: 112938

SEQ ID NO: 610739 - RNA, 64 nt, hsa; identical to SEQ ID NO: 112939

SEQ ID NO: 610740 - RNA, 64 nt, hsa; identical to SEQ ID NO: 112940

SEQ ID NO: 610741 - RNA, 64 nt, hsa; identical to SEQ ID NO: 112941

SEQ ID NO: 610742 - RNA, 64 nt, hsa; identical to SEQ ID NO: 112942

SEQ ID NO: 610743 - RNA, 64 nt, hsa; identical to SEQ ID NO: 112943

SEQ ID NO: 610744 - RNA, 64 nt, hsa; identical to SEQ ID NO: 112944

SEQ ID NO: 610745 - RNA, 64 nt, hsa; identical to SEQ ID NO: 112945

SEQ ID NO: 610746 - RNA, 64 nt, hsa; identical to SEQ ID NO: 112946

SEQ ID NO: 610747 - RNA, 64 nt, hsa; identical to SEQ ID NO: 112947

SEQ ID NO: 610748 - RNA, 64 nt, hsa; identical to SEQ ID NO: 112948

SEQ ID NO: 610749 - RNA, 64 nt, hsa; identical to SEQ ID NO: 112949

SEQ ID NO: 610750 - RNA, 64 nt, hsa; identical to SEQ ID NO: 112950

SEQ ID NO: 610751 - RNA, 64 nt, hsa; identical to SEQ ID NO: 112951

SEQ ID NO: 610752 - RNA, 64 nt, hsa; identical to SEQ ID NO: 112952

SEQ ID NO: 610753 - RNA, 64 nt, hsa; identical to SEQ ID NO: 112953

SEQ ID NO: 610754 - RNA, 64 nt, hsa; identical to SEQ ID NO: 112954

SEQ ID NO: 610755 - RNA, 50 nt, hsa; identical to SEQ ID NO: 112955

SEQ ID NO: 610756 - RNA, 64 nt, hsa; identical to SEQ ID NO: 112956

SEQ ID NO: 610757 - RNA, 64 nt, hsa; identical to SEQ ID NO: 112957

SEQ ID NO: 610758 - RNA, 64 nt, hsa; identical to SEQ ID NO: 112958

SEQ ID NO: 610759 - RNA, 64 nt, hsa; identical to SEQ ID NO: 112959

SEQ ID NO: 610760 - RNA, 64 nt, hsa; identical to SEQ ID NO: 112960

SEQ ID NO: 610761 - RNA, 64 nt, hsa; identical to SEQ ID NO: 112961

SEQ ID NO: 610762 - RNA, 64 nt, hsa; identical to SEQ ID NO: 218966

SEQ ID NO: 610763 - RNA, 64 nt, hsa; identical to SEQ ID NO: 218967

SEQ ID NO: 610764 - RNA, 64 nt, hsa; identical to SEQ ID NO: 218968

SEQ ID NO: 610765 - RNA, 64 nt, hsa; identical to SEQ ID NO: 218969

SEQ ID NO: 610766 - RNA, 64 nt, hsa; identical to SEQ ID NO: 218970

SEQ ID NO: 610767 - RNA, 64 nt, hsa; identical to SEQ ID NO: 218971

SEQ ID NO: 610768 - RNA, 64 nt, hsa; identical to SEQ ID NO: 218972

SEQ ID NO: 610769 - RNA, 64 nt, hsa; identical to SEQ ID NO: 218973

SEQ ID NO: 610770 - RNA, 64 nt, hsa; identical to SEQ ID NO: 218974

SEQ ID NO: 610771 - RNA, 64 nt, hsa; identical to SEQ ID NO: 218975

SEQ ID NO: 610772 - RNA, 64 nt, hsa; identical to SEQ ID NO: 218976

SEQ ID NO: 610773 - RNA, 64 nt, hsa; identical to SEQ ID NO: 218977

SEQ ID NO: 610774 - RNA, 64 nt, hsa; identical to SEQ ID NO: 218978

SEQ ID NO: 610775 - RNA, 64 nt, hsa; identical to SEQ ID NO: 218979

SEQ ID NO: 610776 - RNA, 64 nt, hsa; identical to SEQ ID NO: 218980

SEQ ID NO: 610777 - RNA, 64 nt, hsa; identical to SEQ ID NO: 218981

SEQ ID NO: 610778 - RNA, 64 nt, hsa; identical to SEQ ID NO: 218982

SEQ ID NO: 610779 - RNA, 64 nt, hsa; identical to SEQ ID NO: 218983

SEQ ID NO: 610780 - RNA, 64 nt, hsa; identical to SEQ ID NO: 218984

SEQ ID NO: 610781 - RNA, 64 nt, hsa; identical to SEQ ID NO: 218985

SEQ ID NO: 610782 - RNA, 64 nt, hsa; identical to SEQ ID NO: 218986

SEQ ID NO: 610783 - RNA, 64 nt, hsa; identical to SEQ ID NO: 218987

SEQ ID NO: 610784 - RNA, 64 nt, hsa; identical to SEQ ID NO: 218988

SEQ ID NO: 610785 - RNA, 64 nt, hsa; identical to SEQ ID NO: 218989

SEQ ID NO: 610786 - RNA, 64 nt, hsa; identical to SEQ ID NO: 218990

SEQ ID NO: 610787 - RNA, 64 nt, hsa; identical to SEQ ID NO: 218991

SEQ ID NO: 610788 - RNA, 64 nt, hsa; identical to SEQ ID NO: 218992

SEQ ID NO: 610789 - RNA, 64 nt, hsa; identical to SEQ ID NO: 218993

SEQ ID NO: 610790 - RNA, 64 nt, hsa; identical to SEQ ID NO: 218994

SEQ ID NO: 610791 - RNA, 64 nt, hsa; identical to SEQ ID NO: 218995

SEQ ID NO: 610792 - RNA, 64 nt, hsa; identical to SEQ ID NO: 218996

SEQ ID NO: 610793 - RNA, 64 nt, hsa; identical to SEQ ID NO: 112922

SEQ ID NO: 610794 - RNA, 64 nt, hsa; identical to SEQ ID NO: 112923

SEQ ID NO: 610795 - RNA, 64 nt, hsa; identical to SEQ ID NO: 112924

SEQ ID NO: 610796 - RNA, 64 nt, hsa; identical to SEQ ID NO: 112925

SEQ ID NO: 610797 - RNA, 64 nt, hsa; identical to SEQ ID NO: 112926

SEQ ID NO: 610798 - RNA, 64 nt, hsa; identical to SEQ ID NO: 112927

SEQ ID NO: 610799 - RNA, 64 nt, hsa; identical to SEQ ID NO: 112928

SEQ ID NO: 610800 - RNA, 64 nt, hsa; identical to SEQ ID NO: 112929

SEQ ID NO: 610801 - RNA, 64 nt, hsa; identical to SEQ ID NO: 112930

SEQ ID NO: 610802 - RNA, 64 nt, hsa; identical to SEQ ID NO: 112931

SEQ ID NO: 610803 - RNA, 64 nt, hsa; identical to SEQ ID NO: 112932

SEQ ID NO: 610804 - RNA, 64 nt, hsa; identical to SEQ ID NO: 112933

SEQ ID NO: 610805 - RNA, 64 nt, hsa; identical to SEQ ID NO: 112934

SEQ ID NO: 610806 - RNA, 64 nt, hsa; identical to SEQ ID NO: 112935

SEQ ID NO: 610807 - RNA, 64 nt, hsa; identical to SEQ ID NO: 112936

SEQ ID NO: 610808 - RNA, 64 nt, hsa; identical to SEQ ID NO: 112937

SEQ ID NO: 610809 - RNA, 64 nt, hsa; identical to SEQ ID NO: 112938

SEQ ID NO: 610810 - RNA, 64 nt, hsa; identical to SEQ ID NO: 112939

SEQ ID NO: 610811 - RNA, 64 nt, hsa; identical to SEQ ID NO: 112940

SEQ ID NO: 610812 - RNA, 64 nt, hsa; identical to SEQ ID NO: 112941

SEQ ID NO: 610813 - RNA, 64 nt, hsa; identical to SEQ ID NO: 112942

SEQ ID NO: 610814 - RNA, 64 nt, hsa; identical to SEQ ID NO: 112943

SEQ ID NO: 610815 - RNA, 64 nt, hsa; identical to SEQ ID NO: 112944

SEQ ID NO: 610816 - RNA, 64 nt, hsa; identical to SEQ ID NO: 112945

SEQ ID NO: 610817 - RNA, 64 nt, hsa; identical to SEQ ID NO: 112946

SEQ ID NO: 610818 - RNA, 64 nt, hsa; identical to SEQ ID NO: 112947

SEQ ID NO: 610819 - RNA, 64 nt, hsa; identical to SEQ ID NO: 112948

SEQ ID NO: 610820 - RNA, 64 nt, hsa; identical to SEQ ID NO: 112949

SEQ ID NO: 610821 - RNA, 64 nt, hsa; identical to SEQ ID NO: 112950

SEQ ID NO: 610822 - RNA, 64 nt, hsa; identical to SEQ ID NO: 112951

SEQ ID NO: 610823 - RNA, 64 nt, hsa; identical to SEQ ID NO: 112952

SEQ ID NO: 610824 - RNA, 64 nt, hsa; identical to SEQ ID NO: 112953

SEQ ID NO: 610825 - RNA, 64 nt, hsa; identical to SEQ ID NO: 112954

SEQ ID NO: 610826 - RNA, 50 nt, hsa; identical to SEQ ID NO: 112955

SEQ ID NO: 610827 - RNA, 64 nt, hsa; identical to SEQ ID NO: 112956

SEQ ID NO: 610828 - RNA, 64 nt, hsa; identical to SEQ ID NO: 112957

SEQ ID NO: 610829 - RNA, 64 nt, hsa; identical to SEQ ID NO: 112958

SEQ ID NO: 610830 - RNA, 64 nt, hsa; identical to SEQ ID NO: 112959

SEQ ID NO: 610831 - RNA, 64 nt, hsa; identical to SEQ ID NO: 112960

SEQ ID NO: 610832 - RNA, 64 nt, hsa; identical to SEQ ID NO: 112961

SEQ ID NO: 610833 - RNA, 64 nt, hsa; identical to SEQ ID NO: 218966

SEQ ID NO: 610834 - RNA, 64 nt, hsa; identical to SEQ ID NO: 218967

SEQ ID NO: 610835 - RNA, 64 nt, hsa; identical to SEQ ID NO: 218968

SEQ ID NO: 610836 - RNA, 64 nt, hsa; identical to SEQ ID NO: 218969

SEQ ID NO: 610837 - RNA, 64 nt, hsa; identical to SEQ ID NO: 218970

SEQ ID NO: 610838 - RNA, 64 nt, hsa; identical to SEQ ID NO: 218971

SEQ ID NO: 610839 - RNA, 64 nt, hsa; identical to SEQ ID NO: 218972

SEQ ID NO: 610840 - RNA, 64 nt, hsa; identical to SEQ ID NO: 218973

SEQ ID NO: 610841 - RNA, 64 nt, hsa; identical to SEQ ID NO: 218974

SEQ ID NO: 610842 - RNA, 64 nt, hsa; identical to SEQ ID NO: 218975

SEQ ID NO: 610843 - RNA, 64 nt, hsa; identical to SEQ ID NO: 218976

SEQ ID NO: 610844 - RNA, 64 nt, hsa; identical to SEQ ID NO: 218977

SEQ ID NO: 610845 - RNA, 64 nt, hsa; identical to SEQ ID NO: 218978

SEQ ID NO: 610846 - RNA, 64 nt, hsa; identical to SEQ ID NO: 218979

SEQ ID NO: 610847 - RNA, 64 nt, hsa; identical to SEQ ID NO: 218980

SEQ ID NO: 610848 - RNA, 64 nt, hsa; identical to SEQ ID NO: 218981

SEQ ID NO: 610849 - RNA, 64 nt, hsa; identical to SEQ ID NO: 218982

SEQ ID NO: 610850 - RNA, 64 nt, hsa; identical to SEQ ID NO: 218983

SEQ ID NO: 610851 - RNA, 64 nt, hsa; identical to SEQ ID NO: 218984

SEQ ID NO: 610852 - RNA, 64 nt, hsa; identical to SEQ ID NO: 218985

SEQ ID NO: 610853 - RNA, 64 nt, hsa; identical to SEQ ID NO: 218986

SEQ ID NO: 610854 - RNA, 64 nt, hsa; identical to SEQ ID NO: 218987

SEQ ID NO: 610855 - RNA, 64 nt, hsa; identical to SEQ ID NO: 218988

SEQ ID NO: 610856 - RNA, 64 nt, hsa; identical to SEQ ID NO: 218989

SEQ ID NO: 610857 - RNA, 64 nt, hsa; identical to SEQ ID NO: 218990

SEQ ID NO: 610858 - RNA, 64 nt, hsa; identical to SEQ ID NO: 218991

SEQ ID NO: 610859 - RNA, 64 nt, hsa; identical to SEQ ID NO: 218992

SEQ ID NO: 610860 - RNA, 64 nt, hsa; identical to SEQ ID NO: 218993

SEQ ID NO: 610861 - RNA, 64 nt, hsa; identical to SEQ ID NO: 218994

SEQ ID NO: 610862 - RNA, 64 nt, hsa; identical to SEQ ID NO: 218995

SEQ ID NO: 610863 - RNA, 64 nt, hsa; identical to SEQ ID NO: 218996

SEQ ID NO: 610864 - RNA, 64 nt, hsa; identical to SEQ ID NO: 237905

SEQ ID NO: 610865 - RNA, 64 nt, hsa; identical to SEQ ID NO: 237906

SEQ ID NO: 610866 - RNA, 64 nt, hsa; identical to SEQ ID NO: 60301

SEQ ID NO: 610867 - RNA, 64 nt, hsa; identical to SEQ ID NO: 60302

SEQ ID NO: 610868 - RNA, 64 nt, hsa; identical to SEQ ID NO: 60303

SEQ ID NO: 610869 - RNA, 64 nt, hsa; identical to SEQ ID NO: 60304

SEQ ID NO: 610870 - RNA, 64 nt, hsa; identical to SEQ ID NO: 60305

SEQ ID NO: 610871 - RNA, 64 nt, hsa; identical to SEQ ID NO: 60306

SEQ ID NO: 610872 - RNA, 64 nt, hsa; identical to SEQ ID NO: 60307

SEQ ID NO: 610873 - RNA, 64 nt, hsa; identical to SEQ ID NO: 60308

SEQ ID NO: 610874 - RNA, 64 nt, hsa; identical to SEQ ID NO: 60309

SEQ ID NO: 610875 - RNA, 64 nt, hsa; identical to SEQ ID NO: 60310

SEQ ID NO: 610876 - RNA, 64 nt, hsa; identical to SEQ ID NO: 130376

SEQ ID NO: 610877 - RNA, 64 nt, hsa; identical to SEQ ID NO: 130377

SEQ ID NO: 610878 - RNA, 64 nt, hsa; identical to SEQ ID NO: 130378

SEQ ID NO: 610879 - RNA, 64 nt, hsa; identical to SEQ ID NO: 130379

SEQ ID NO: 610880 - RNA, 64 nt, hsa
ugaaugcauugguguuuaacuaagggccauccaaccauccaaccuuuaaaaaacaaaacgaaag

SEQ ID NO: 610881 - RNA, 64 nt, hsa
cuaccauuugaaugcauugguguuuaacuaagggccauccaaccauccaaccuuuaaaaaacaa

SEQ ID NO: 610882 - RNA, 64 nt, hsa
gaccucucaggcucaagcgauucucccaccucagccauccaaauagcugggaccacaggugugc

SEQ ID NO: 610883 - RNA, 64 nt, hsa
aauugucacaugaccgguacuggaagaaacucucccauccaacaucacccaguggauggaacau

SEQ ID NO: 610884 - RNA, 64 nt, hsa
cagugcuaugccuggaggcucaacacaaaacuucccauccaaacauucagaugaacugagcguc

SEQ ID NO: 610885 - RNA, 64 nt, hsa
aucaagcuucucgcccacuccacggcucugagccccauccaagggcaagacuuggugcccagcu

SEQ ID NO: 610886 - RNA, 64 nt, hsa
gauccgauaacuuaaaaacguagcucaucccuuaccauccaaggggcacucccuugguuggauu

SEQ ID NO: 610887 - RNA, 64 nt, hsa
accacccaagacacaguacccagucaugguuuccccauccaacuauuaguuucauacuuugaaa

SEQ ID NO: 610888 - RNA, 64 nt, hsa
aggugugaagggacugcuguuugcaaugggcuuaccauccaaauaucccaaaggcuuugaccag

SEQ ID NO: 610889 - RNA, 64 nt, hsa
gaguucugcccaaauuccgauaucaccccuucccccauccaagcauccuucgauuagggaagug

SEQ ID NO: 610890 - RNA, 64 nt, hsa
aagaccucuuguacuugguugcaaacucagaucucuagucuagucuagucuagucuagucuagu

SEQ ID NO: 610891 - RNA, 64 nt, hsa
cucuuguacuugguugcaaacucagaucucuagucuagucuagucuagucuagucuagucaugu

SEQ ID NO: 610892 - RNA, 64 nt, hsa
guacuugguugcaaacucagaucucuagucuagucuagucuagucuagucuagucaugugugac

SEQ ID NO: 610893 - RNA, 64 nt, hsa
ugguugcaaacucagaucucuagucuagucuagucuagucuagucuagucaugugugacugugu

SEQ ID NO: 610894 - RNA, 64 nt, hsa
gcaaacucagaucucuagucuagucuagucuagucuagucuagucaugugugacuguguacuga

SEQ ID NO: 610895 - RNA, 61 nt, hsa
gcuguggcuuuuugggagguggggcaugggaggaccagagacgaagggcuuggaaggagac

SEQ ID NO: 610896 - RNA, 61 nt, hsa
acaugugagcuucuuuuaggucccagugaugggaccagaagcaucuaaagcaaaaaaaaaa

SEQ ID NO: 610897 - RNA, 61 nt, hsa
ggccagaugugugauucugugacuugucccaggaccagaauguaccuaagucagauccaua

SEQ ID NO: 610898 - RNA, 61 nt, hsa
cagauccauagacgcauguugguaggucacuggaccagagcuugugaagcaggcaaccucu

SEQ ID NO: 610899 - RNA, 61 nt, hsa
cccugggagcagagagagaaacccucuucauggaccagacucugcacccggugagugagga

SEQ ID NO: 610900 - RNA, 61 nt, hsa
gggucuggcuggcugguagccaagcacuuauggaccagaguggcccaggccagcugggcgc

SEQ ID NO: 610901 - RNA, 61 nt, hsa
ucagggcaaaaagcauacgcaugcuucccauggaccagagaaaccuggccuggguugucuc

SEQ ID NO: 610902 - RNA, 61 nt, hsa
ucccggcuccugguccucacagcccugauuuggaccagaaucucagaugcucagaagaaag

SEQ ID NO: 610903 - RNA, 55 nt, hsa; identical to SEQ ID NO: 199855

SEQ ID NO: 610904 - RNA, 61 nt, hsa
caaaauaucaggaccagaauuuucuaccuaaggaccagaauuuuuuaucuagagaccagca

SEQ ID NO: 610905 - RNA, 61 nt, hsa
ccaaagaccaagauauucugccaaaauaucaggaccagaauuuucuaccuaaggaccagaa

SEQ ID NO: 610906 - RNA, 61 nt, hsa
caaaauaucaggaccagaauuuucuaccuaaggaccagaauuuuuugucuagagaccagca

SEQ ID NO: 610907 - RNA, 61 nt, hsa
agcccuuauuuguggggugagauuggggguuggaccagagugauguccucucucagcuauc

SEQ ID NO: 610908 - RNA, 61 nt, hsa
acuuucagucucucugaaaaugaaaagcuuaggaccagaagagagaauuggagcuguacga

SEQ ID NO: 610909 - RNA, 61 nt, hsa
cuauugaaaaaguucagaaaacauacaccguggaccagaggucuuaauccuaucuauggau

SEQ ID NO: 610910 - RNA, 61 nt, hsa
aauauaaacaggacuuguuuuuuucaguaagggaccagaagugacuagccuucauguaauu

SEQ ID NO: 610911 - RNA, 61 nt, hsa
gcuacaccuuccagcaggugcaggagcacacggaccagauuuggaaguuccagcgccauga

SEQ ID NO: 610912 - RNA, 61 nt, hsa
ucgagacgguggccgucagcguccacuuccaggaccagaaugacguggagcugaacaggcu

SEQ ID NO: 610913 - RNA, 61 nt, hsa
aaguugaggaaguggaggcugguaaagagcaggaccagaggaagaauccagauuuccuuau

SEQ ID NO: 610914 - RNA, 61 nt, hsa
acaguuaugcuugcauuaauaauuucaauguggaccagacauucuaauuauauuuuaaaug

SEQ ID NO: 610915 - RNA, 64 nt, hsa; identical to SEQ ID NO: 298345

SEQ ID NO: 610916 - RNA, 64 nt, hsa; identical to SEQ ID NO: 298346

SEQ ID NO: 610917 - RNA, 64 nt, hsa; identical to SEQ ID NO: 298347

SEQ ID NO: 610918 - RNA, 64 nt, hsa; identical to SEQ ID NO: 298348

SEQ ID NO: 610919 - RNA, 64 nt, hsa; identical to SEQ ID NO: 298349

SEQ ID NO: 610920 - RNA, 64 nt, hsa; identical to SEQ ID NO: 298350

SEQ ID NO: 610921 - RNA, 64 nt, hsa; identical to SEQ ID NO: 298351

SEQ ID NO: 610922 - RNA, 64 nt, hsa; identical to SEQ ID NO: 298352

SEQ ID NO: 610923 - RNA, 63 nt, hsa
augagaguuccuuugcuuuaaccauuccuggaugccugcaaaguaaggaauaaugcaguuuuu

SEQ ID NO: 610924 - RNA, 63 nt, hsa
uauaacuugaauaucugguacuaguuuuuucacgccugcaaucuuggagucuagguugccuug

SEQ ID NO: 610925 - RNA, 63 nt, hsa
uuccccgaggcccacucggccuggccuuccucugccugcaagugagcagggaugggcugggga

SEQ ID NO: 610926 - RNA, 63 nt, hsa
uuuccucugggcaggacucucuggccuucuguggccugcaaugccaggccaugugccccucug

SEQ ID NO: 610927 - RNA, 63 nt, hsa
aaggaccuugcacugccuaccgagcucccucaugccugcaauuuaaauaccgagguguguucu

SEQ ID NO: 610928 - RNA, 63 nt, hsa
cagcauauggaugcccuccccuuggagggcccagccugcaaaccccaucugauaccacacaug

SEQ ID NO: 610929 - RNA, 63 nt, hsa
gauacuauccaguuacugccgguuugaaaauaugccugcaaucugagccagugcuuuaauggc

SEQ ID NO: 610930 - RNA, 60 nt, hsa; identical to SEQ ID NO: 180829

SEQ ID NO: 610931 - RNA, 63 nt, hsa
acacgccugcaaacgcugccugcccguaaacacgccugcaaacgcugccugcccacacagguu

SEQ ID NO: 610932 - RNA, 63 nt, hsa
acacgccugcaaacgcugccugccgguaaacacgccugcaaacgcugccugcccguaaacacg

SEQ ID NO: 610933 - RNA, 63 nt, hsa
gucucacauggugcuacgccugcauguaaacacgccugcaaacgcugccugccgguaaacacg

SEQ ID NO: 610934 - RNA, 63 nt, hsa
gccauuucuuguugugccccuuuccaagauacagccugcaagugguagcaagaagugauuaga

SEQ ID NO: 610935 - RNA, 63 nt, hsa
cuucaguuuuacucugcugcaaaaugaaggcgggccugcaagccgacuacaccuacggaggcu

SEQ ID NO: 610936 - RNA, 63 nt, hsa
uugcuuuuagugcuggcccucucuguggguguggccugcaaaggaaccaacagacccuaugcu

SEQ ID NO: 610937 - RNA, 63 nt, hsa
gcuccagcccaaugccccagcuggccuuccccagccugcaaggagccuguagcauggcaaauc

SEQ ID NO: 610938 - RNA, 64 nt, hsa
acaucacuuuuaagcuaauaaauauaagaauucuuuuggaaauuagagguggaaacacacugga

SEQ ID NO: 610939 - RNA, 64 nt, hsa
uucagccaggaguaagaaaagaugguuagugauauuuggaaauaccuggauauuugcuagagga

SEQ ID NO: 610940 - RNA, 64 nt, hsa
auuuuuauaccauaacuugaguguauugccaaaauuuggaaauccuucccaugccugaugaguu

SEQ ID NO: 610941 - RNA, 64 nt, hsa
uagaaaaaucaucucaaacuagccaaaaggcaguuuuggaaacuacauugggggacguuauuuu

SEQ ID NO: 610942 - RNA, 64 nt, hsa
uugacaucuaauuuaccaucaaguuguaaaauuauuuggaaaaauacagaacucguuuuauuug

SEQ ID NO: 610943 - RNA, 64 nt, hsa
gugggguuuuuuuguuuguuuguuucuuuuguuuuuuggaaaauccgugucuuuaucuuuuuuu

SEQ ID NO: 610944 - RNA, 64 nt, hsa
augcuaccuugcuguacauacuuauaaccuuguauuuggaaaugagaaauagguuuauauuuuc

SEQ ID NO: 610945 - RNA, 64 nt, hsa
uaucaaauuuuuaaaauacaaguuugguaugugauuuggaaaagaugccuucuggaucuuaagc

SEQ ID NO: 610946 - RNA, 64 nt, hsa
auauauauauacauauauauauauaauuugaauuuuuggaaacuuuagcugugcugucaacuuu

SEQ ID NO: 610947 - RNA, 64 nt, hsa
uugaauuuuuggaaacuuuagcugugcugucaacuuuggaaaaaguaucccgguuuacuguguu

SEQ ID NO: 610948 - RNA, 64 nt, hsa
uaaugagauacaauaaucauaucucuuuugacauuuuggaaauuuuuuuaauuuuacaaguaca

SEQ ID NO: 610949 - RNA, 64 nt, hsa
ggaguccauuuuaacacuuaccgacuuuuuuugguuuggaaacauauuaccacgucuuaauagg

SEQ ID NO: 610950 - RNA, 64 nt, hsa
aaaauuauuuaauuuccuuagaaaaauaacaccauuuggaaaaaaaaacugguguuaugaagaa

SEQ ID NO: 610951 - RNA, 64 nt, hsa
gaauggaaaacuccauuguguguugcuggacuguuuuggaaauauuugguuaaauguguguuaa

SEQ ID NO: 610952 - RNA, 64 nt, hsa
uuauaaaacugcuuuuuaucugagaacaaacggguuuggaaauuagucgucuuuuuuccccacu

SEQ ID NO: 610953 - RNA, 64 nt, hsa
ggccgcaaaaaaucuuuuccugggagucuacaaauuuggaaaugaaaaaacccagacaucagau

SEQ ID NO: 610954 - RNA, 64 nt, hsa
cacugaugguggggauguaaaaugguacaaccaguuuggaaaacaguuuggcaguuucucaaag

SEQ ID NO: 610955 - RNA, 64 nt, hsa
gaacugccucacuaaauucuuagggauggaaguauuuggaaaaaaaccuaacaguagagucacc

SEQ ID NO: 610956 - RNA, 64 nt, hsa
gucaaauuguuugcuuuugcuauuaagcuuaugauuuggaaacguaaaauuucaugguggauau

SEQ ID NO: 610957 - RNA, 64 nt, hsa
auuuaagggaucaguuaucauaugauuagggcuuuuuggaaauaauuuguuucauauguacaua

SEQ ID NO: 610958 - RNA, 64 nt, hsa
ccaauuacaucuuuguccacguuuaauacuuuguuuuggaaaauuuaaaugcugcagauuugug

SEQ ID NO: 610959 - RNA, 64 nt, hsa
aaccuucacaaccuucaugauuucauaggauuauuuuggaaauauagcacuugacuuuaugaaa

SEQ ID NO: 610960 - RNA, 64 nt, hsa
guggggaggccuguggauggggggauuugaacuauuuggaaacaaaugauucucuaucucaggu

SEQ ID NO: 610961 - RNA, 64 nt, hsa
cccaaauuucccaagacggcugaaagacagguuuuuuggaaacuguuaagauaaacuguaaucc

SEQ ID NO: 610962 - RNA, 64 nt, hsa
uuuguguacuuuuaagacuuugguuauuuuacuuuuuggaaaagaauaaaccaagaauugauug

SEQ ID NO: 610963 - RNA, 64 nt, hsa
cuauuaaacaugcuguacauacuuuuuggguuuauuuggaaaggaaugcaaagaugaaggucug

SEQ ID NO: 610964 - RNA, 64 nt, hsa
auauuauuaauuuuaaguccugucuuuacauccuuuuggaaaacuuguauuaccauggguuugg

SEQ ID NO: 610965 - RNA, 64 nt, hsa
uuacauccuuuuggaaaacuuguauuaccauggguuuggaaaaaggacaacgaaaggcuuuuca

SEQ ID NO: 610966 - RNA, 64 nt, hsa
auuccaaacucccauuugguaaaccaguugauuauuuggaaauguucacugccaaaauaguaag

SEQ ID NO: 610967 - RNA, 64 nt, hsa
auaacuaaaugcgcuuuuaauuaaugauauaguguuuggaaaggaguagaacaugcagcauaag

SEQ ID NO: 610968 - RNA, 64 nt, hsa
ugcuacccguugcugggggaggagucaugguuuauuuggaaaugucaguugcaaucaugguucu

SEQ ID NO: 610969 - RNA, 64 nt, hsa
gcauaaggcuuaugacuuaaaaaaaaaaauucuuuuuggaaacacaagcauuucuuuaaggaug

SEQ ID NO: 610970 - RNA, 64 nt, hsa
uaagcaguuucucuguuugcuugucauagcagcauuuggaaacucaaacaugcuuucauuuaca

SEQ ID NO: 610971 - RNA, 64 nt, hsa
augugugaaccuuaagaaauccccauuuguggaauuuggaaacguguguugacuccugguggua

SEQ ID NO: 610972 - RNA, 64 nt, hsa
gaaccuauauuugugcuugaagguguuuuugauauuuggaaacaguauaagccauuuggaguca

SEQ ID NO: 610973 - RNA, 64 nt, hsa
acuuugcuucuuuggaaagguuuucuccugauuuuuuggaaaaccuuuugaacccucaaguuac

SEQ ID NO: 610974 - RNA, 64 nt, hsa
uauuucagaaaauuggaccuuaaaacuuugcuucuuuggaaagguuuucuccugauuuuuugga

SEQ ID NO: 610975 - RNA, 64 nt, hsa
ugguuugagaggcuagaaacugagccucucuacuuuuggaaaaaugaacaugugaggucagauu

SEQ ID NO: 610976 - RNA, 64 nt, hsa
ucugcagagacugugggcuacaccacauauguuauuuggaaauauagguauuuuaguacaguac

SEQ ID NO: 610977 - RNA, 64 nt, hsa
auugggauuccauuguaagcuguguaugugcguguuuggaaaaguguauucauacuuaguuuuu

SEQ ID NO: 610978 - RNA, 64 nt, hsa
gaaagucagaaucagaagauagucuuggaagcuguuuggaaaagacaguggagaugaggucagu

SEQ ID NO: 610979 - RNA, 64 nt, hsa
augauuuuuugaaaguuaacauuaaugccugcuuuuuggaaagucagaaucagaagauagucuu

SEQ ID NO: 610980 - RNA, 64 nt, hsa
uacgccucccuagaagugccuuccaagucaguccuuuggaaaccagcaggucugaaaaagaggc

SEQ ID NO: 610981 - RNA, 64 nt, hsa
guggauagcucaucccuaggaauuuucauuaaaauuuggaaacagaguaaugaagaaauaauau

SEQ ID NO: 610982 - RNA, 64 nt, hsa
guagaaucccaccaggacuuugcuaacaauaauguuuggaaauaaagaagugcucugaaaaaau

SEQ ID NO: 610983 - RNA, 64 nt, hsa
uuggaugcaggaagcugggaaagacugauguugauuuggaaacaugggcugaaaaugaaggccc

SEQ ID NO: 610984 - RNA, 64 nt, hsa
uuuaaaugaaauaguagcgaggaggauuuucuguuuuggaaaacaccauuagaaccagaccagc

SEQ ID NO: 610985 - RNA, 64 nt, hsa
aauaauucugucaauauggaguugagcuuauuucuuuggaaacccuuuuaaguugccuugcugg

SEQ ID NO: 610986 - RNA, 64 nt, hsa
aucuuagguuucuaaauauuauuuaauuccuuaauuuggaaagcaguuuuaauguuuacaguuu

SEQ ID NO: 610987 - RNA, 64 nt, hsa
guuuuaaugaaaucuucaauucuugcagcuguguuuuggaaagugauuaagcaauauuucucaa

SEQ ID NO: 610988 - RNA, 64 nt, hsa
uucccauaggggaaguuggccucccuccgugagcuuuggaaauguuuucuaauagacacaggga

SEQ ID NO: 610989 - RNA, 64 nt, hsa
uacucaggcacuucacaguuuacuugaaagaggcuuuggaaaauagauaaagugaaagaagaau

SEQ ID NO: 610990 - RNA, 64 nt, hsa
agcuuuuuaaaaaaaucuccccaguagagaaacauuuggaaaagacagaaaacuaaaaaggaag

SEQ ID NO: 610991 - RNA, 64 nt, hsa
cuggcaugguggcucccgccuguaaucccaguacuuuggaaagccaagguaagaggauugcuug

SEQ ID NO: 610992 - RNA, 64 nt, hsa
aaggagccuagagacagaaaugacagaucucugcuuuggaaaucacacgucuggcuucacagau

SEQ ID NO: 610993 - RNA, 64 nt, hsa
gaugaaauguaaauacuguuuuuaacaacuaugauuuggaaaauaaaucaaugcuauaacuaug

SEQ ID NO: 610994 - RNA, 64 nt, hsa
gaacuaguauuggauugaaugaauagucuuccauuuuggaaacguucauccacucucauauuua

SEQ ID NO: 610995 - RNA, 64 nt, hsa
gcauuugaaugaagacuuugcaaaacacaccaaguuuggaaauacaauuguacauggaguuuug

SEQ ID NO: 610996 - RNA, 64 nt, hsa
uguagacacugccucaacccuuuugagguuuugauuuggaaauagauuuaaaagaaaacaggcu

SEQ ID NO: 610997 - RNA, 64 nt, hsa
ggcauuuaacugucucuuguuuuauuuuuaaguuuuuggaaaccuuuugacauaaaaugcugcc

SEQ ID NO: 610998 - RNA, 64 nt, hsa
acugauaagggauuauuggaagucagucacagaauuuggaaauaaauucuagucucuccuuagc

SEQ ID NO: 610999 - RNA, 64 nt, hsa
gaggaggugcuuuacacuguacuuuuugguguuuuuuggaaaaguuacauuuagaucuauucug

SEQ ID NO: 611000 - RNA, 64 nt, hsa
auaacaaaagcuagggugacaaguacauguuccuuuuggaaagaagcaaggcaauguauauuaa

SEQ ID NO: 611001 - RNA, 64 nt, hsa
ugguagcaugucauugaugggacaugaagacaucuuuggaaaugaugagauuauuuccuguguu

SEQ ID NO: 611002 - RNA, 64 nt, hsa
uuaucuaacaaauugguuauauucuaagaucugcuuuggaaauuauugccucugauacauaccu

SEQ ID NO: 611003 - RNA, 64 nt, hsa
auauggcacugccguaauucaaauuuguuuuuauuuuggaaauaaaaguucacuguacuuuuuu

SEQ ID NO: 611004 - RNA, 64 nt, hsa
ccuauaauuauuucuguagcacuccacacugaucuuuggaaacuugccccuuauuuaaaaaaaa

SEQ ID NO: 611005 - RNA, 64 nt, hsa
uaaguuccuugauugaugaaacuaaaaaggcaauuuuggaaaaagagagggggaaaaguagauc

SEQ ID NO: 611006 - RNA, 64 nt, hsa
ucuuggcauguugaauauuauuugcacauuucacuuuggaaacacaguagacucuaucgaggcc

SEQ ID NO: 611007 - RNA, 64 nt, hsa
uggaaagcauauguauauaacaugugucauguccuuuggaaaccuggucaccuggugaaaaccc

SEQ ID NO: 611008 - RNA, 64 nt, hsa
cugauuugggggauuguuuuguuuuggugguuguuuuggaaaaacaguuuauaaacugauuuuu

SEQ ID NO: 611009 - RNA, 64 nt, hsa
uuuaggauugcuaucaauuuucagcauugugcuauuuggaaauaaguguuuugcuuuugucuga

SEQ ID NO: 611010 - RNA, 64 nt, hsa
aagagaucagauuaaauauuucuuuguuuuuccuuuuggaaacuuuuauguauaauucuuucug

SEQ ID NO: 611011 - RNA, 64 nt, hsa
uacaaauauuucuguuuaagcuauuucaccuuuguuuggaaauccuucccuuuuaaagagaaaa

SEQ ID NO: 611012 - RNA, 64 nt, hsa
aggcaaacuuaacaaugacuuguacucugaaaguuuuggaaacguauucaaacaauuugaauau

SEQ ID NO: 611013 - RNA, 64 nt, hsa
auuaccauauagcuuaauauguuuauuaguucucuuuggaaaaaaacuaccacuguggucuuaa

SEQ ID NO: 611014 - RNA, 64 nt, hsa
acaugagauuuuaggaauagaaauuugccggccauuuggaaagugaaaugccacuuaguucuca

SEQ ID NO: 611015 - RNA, 64 nt, hsa
aaaucacuuuuuaaauuuucucucacugaugcccuuuggaaauuauuggaaauuucuggacuau

SEQ ID NO: 611016 - RNA, 64 nt, hsa
uuuggaaauuauuggaaauuucuggacuauccucuuuggaaagagaaccaugaaaacaaugccu

SEQ ID NO: 611017 - RNA, 64 nt, hsa
aacucaucacuggcuuagacaguccuggaugccauuuggaaaguaguggcccugcaagccuaaa

SEQ ID NO: 611018 - RNA, 64 nt, hsa
uugauauggguuaaauuaugcauuuuguucagauuuuggaaauugguaugcauuauaaguuucu

SEQ ID NO: 611019 - RNA, 64 nt, hsa
aaaagauuccugaauguaauuauaaggauuuggguuuggaaauggagggaggaauuuucauugc

SEQ ID NO: 611020 - RNA, 64 nt, hsa
uaauacuuauuauaagcugcucccugucuauguauuuggaaaccuuuucacaaagggaauugcc

SEQ ID NO: 611021 - RNA, 64 nt, hsa
aagaccugauuuaugaaauuuuguacuaaaaucauuuggaaaugauuguauuguaaacugaggc

SEQ ID NO: 611022 - RNA, 64 nt, hsa
cuuacuaacaauuuuuauacagaaaaugagucauuuuggaaaugauucuuauguuuuuuuuuuu

SEQ ID NO: 611023 - RNA, 64 nt, hsa
ugcauucacuugaaaaacuaaaaaaaaacaauaauuuggaaaaacccaugaagguaacuaacgg

SEQ ID NO: 611024 - RNA, 64 nt, hsa
uuaaaaauaauaacuuauugccagauuuggggcauuuggaaagaaguucauugaagauaaagca

SEQ ID NO: 611025 - RNA, 64 nt, hsa
cacccugacagugacccuuguaacuuaaaugauuuuuggaaauauuaguauguaaguauaauuc

SEQ ID NO: 611026 - RNA, 64 nt, hsa
auuauugacauaucuaaaaccaaacugaaaucgcuuuggaaaucagauuuuuuaauguuaggaa

SEQ ID NO: 611027 - RNA, 64 nt, hsa
accacuaaaauucuccaacuuucauaaacuuuuuuuuggaaaaauuuccauuguaucagccccu

SEQ ID NO: 611028 - RNA, 64 nt, hsa
gcaucuugggggauggggaaaucacucacuuuauuuuggaaauuuuugauuaaaaaaaaauuuu

SEQ ID NO: 611029 - RNA, 64 nt, hsa
uuauugaaaccaauuucuacuucauacugauguuuuuggaaacagcaauuaaaguuuuucuucc

SEQ ID NO: 611030 - RNA, 64 nt, hsa
ggaauuuagccucucuuuuauuguaaugugcucuuuuggaaaauaguugguuagcagggaagac

SEQ ID NO: 611031 - RNA, 64 nt, hsa
gugaaaauuugaagcuaucucaguaaaaagcagcuuuggaaacugugaaugaucuuuagcuugu

SEQ ID NO: 611032 - RNA, 64 nt, hsa
aguucugguaccucuguuuuacuuucuuaugcucuuuggaaacuuuuugcaaaauuuaagccug

SEQ ID NO: 611033 - RNA, 64 nt, hsa
aaaccaaaacugaauaaagucuuugaggaaacauuuuggaaacuucacaugcauuccgcuugag

SEQ ID NO: 611034 - RNA, 64 nt, hsa
acugaggcuugcagaauuaagguucaggggaaauuuuggaaaguugguuguauuuucauugaag

SEQ ID NO: 611035 - RNA, 64 nt, hsa
uucuaaaaaccuucuuuuagaucuuccuugggccuuuggaaaaauaugugacaagugaauguaa

SEQ ID NO: 611036 - RNA, 64 nt, hsa
guaaacugaccuauaacagaauaugugaaaugaauuuggaaauaaugcaagaaggcagaacuca

SEQ ID NO: 611037 - RNA, 64 nt, hsa
gaaaauaauuuuacuauuucuuuuaaaaguauguuuuggaaaaucaaugauuuuaaugcauagc

SEQ ID NO: 611038 - RNA, 64 nt, hsa
aucgaauauucaacaccaugaagauaaaucuuauuuuggaaaucuacugaccuuaauaccccaa

SEQ ID NO: 611039 - RNA, 64 nt, hsa
uugagaaugccaaaccacauuuuuaucacacuucuuuggaaaucaaugccuuugcauagaaaau

SEQ ID NO: 611040 - RNA, 64 nt, hsa
uacagaauuuugaguaauggugaaaauuguugucuuuggaaagcacaaaagaaaccuggaaagg

SEQ ID NO: 611041 - RNA, 64 nt, hsa
ggugagcugcucgggcuucucuugguaugucuuguuuggaaaaguggauuucauucauuucuga

SEQ ID NO: 611042 - RNA, 64 nt, hsa
ugauugaaauguucgcccaggggucuccagcaacuuuggaaaucucuuuguauuuuuacuugaa

SEQ ID NO: 611043 - RNA, 64 nt, hsa
uaaauggccuuaaguuuucuaauucaagcggguuuuuggaaaaauuuauggucuccauuaaaau

SEQ ID NO: 611044 - RNA, 64 nt, hsa
cccacgacacacggagagacugacugauacgagauuuggaaagcuauguagacaucuuuggagc

SEQ ID NO: 611045 - RNA, 64 nt, hsa
agaaggcaccaccucgcuuucaugucccguguguuuuggaaaagcaguauggugugucaugucu

SEQ ID NO: 611046 - RNA, 64 nt, hsa
gcagucucacuggucguguaaacuuuuuuuuuuuuuuggaaauugaagcuguagagugcugccc

SEQ ID NO: 611047 - RNA, 64 nt, hsa
aguccaaggagcgcgggucggaggagacaaacucuuuggaaauaacccuuucaagacuuucuuu

SEQ ID NO: 611048 - RNA, 64 nt, hsa
uagcuucaugcacacucugcauuuuauugguuuguuuggaaaauguuggccauugaauuauuca

SEQ ID NO: 611049 - RNA, 64 nt, hsa
gccauugaauuauucauagauuuauuucaaauaguuuggaaauuguuguacuuuugaaaacaug

SEQ ID NO: 611050 - RNA, 64 nt, hsa
auguuauuauuacuuuaaauauuauuuuaaauauuuuggaaauacugguauuuuugaauagaug

SEQ ID NO: 611051 - RNA, 64 nt, hsa
uuauauuggagaaaaacccuaugaguguaaugaauuuggaaaaauauuuuuuucaacaacagcu

SEQ ID NO: 611052 - RNA, 64 nt, hsa
gcagagguauauuuacauucagaguacacuuuucuuuggaaaaaauuacagguuuuuugaaaag

SEQ ID NO: 611053 - RNA, 64 nt, hsa
ccauuagccauauauagcaaacucacuuugacauuuuggaaauaacauugugcugaggugcucc

SEQ ID NO: 611054 - RNA, 64 nt, hsa
aauaagauaauugggagcugagcauaaaacauuauuuggaaaaauuaacuuugcuuuucuucau

SEQ ID NO: 611055 - RNA, 64 nt, hsa
uuuuuuuucugcugccuuucccaaagugguuagguuuggaaaagagaugaugaugguaauauuu

SEQ ID NO: 611056 - RNA, 64 nt, hsa
aucuuauuaguuaauuuguauauuuuauuaguauuuuggaaauagcauaucugagacugaagag

SEQ ID NO: 611057 - RNA, 64 nt, hsa
ccauccaaaauuucuggugaauuacacagaaauuuuuggaaaugggacuuugugcagguaacca

SEQ ID NO: 611058 - RNA, 64 nt, hsa
acagccugaauggacguagcacugucauguggcauuuggaaaaucuuuaauuauccuaauguua

SEQ ID NO: 611059 - RNA, 64 nt, hsa
aagagcucaaaacacuacauccacauuauugacuuuuggaaaccaaccaaauuacuuaagaaau

SEQ ID NO: 611060 - RNA, 64 nt, hsa
uuacuucuuucuaauccuaguuauucagacaaaauuuggaaacuuauuuuaugaccacaucuaa

SEQ ID NO: 611061 - RNA, 64 nt, hsa
uggguccgacaguaaugaucaaaauaugaaugacuuuggaaaauuuacaugaagcucaaguguu

SEQ ID NO: 611062 - RNA, 64 nt, hsa
uggcucuaguaaccagaggacacagaaaguaucuuuuggaaaguuuagccaccugugcuuucug

SEQ ID NO: 611063 - RNA, 64 nt, hsa
aaccuucuguaugacaucaugcuuuaucauuucuuuuggaaaauagccuguaagcuuuuuauua

SEQ ID NO: 611064 - RNA, 64 nt, hsa
auuaugcaaaucauuaaauaaaaaucauacaacuuuuggaaaguuaguucaacaugaacuaaaa

SEQ ID NO: 611065 - RNA, 64 nt, hsa
aaguuaguucaacaugaacuaaaauggcaugcuauuuggaaauuuaguuugagauaaacuaaag

SEQ ID NO: 611066 - RNA, 64 nt, hsa
ucaccacuggggucuuuggaagauaaucuuccucuuuggaaaugaauggaaaagcaaaaggccc

SEQ ID NO: 611067 - RNA, 64 nt, hsa
ggaacuuauugcuuaucuuuagaaaauguucuaguuuggaaacagauucuugagauucagaagg

SEQ ID NO: 611068 - RNA, 64 nt, hsa
ccaagauuucuggagcagauuguacagcugugacuuuggaaaacagaaaguaagacccucagaa

SEQ ID NO: 611069 - RNA, 64 nt, hsa
auucaaagucacuaugaaaauuuuacucauguaguuuggaaaugcaacauuuuccuaucaugaa

SEQ ID NO: 611070 - RNA, 64 nt, hsa
auguaaguuaaauauaucaagaaagaagagacuguuuggaaaaaugugguucaaguuuuaugcu

SEQ ID NO: 611071 - RNA, 64 nt, hsa
auguaugucaauuauuuucaaaugucuaaauuccuuuggaaauaaaaauaucaguuuuacuuug

SEQ ID NO: 611072 - RNA, 64 nt, hsa
gcuauaaaguuucuuugauguguuugucaaaacauuuggaaaaagucaaccucccaguuuaaag

SEQ ID NO: 611073 - RNA, 64 nt, hsa
ccaucuucccuacucauuccuaugggaaugaugcuuuggaaauuauuagauauauccuauuccc

SEQ ID NO: 611074 - RNA, 64 nt, hsa
cccuacugccuaaacacuauuucauuuauuuauguuuggaaaccccguaaacauuuuuguuugc

SEQ ID NO: 611075 - RNA, 64 nt, hsa
auaauuccauuuuuuauuuuuauuuuuuuaagcuuuuggaaaagcuccagguccucauguauug

SEQ ID NO: 611076 - RNA, 64 nt, hsa
gggcuguucauugucauugcuguguucagggaccuuuggaaauaaaaccuguucugucccaaau

SEQ ID NO: 611077 - RNA, 64 nt, hsa
caaauuccuccauggccaaguguuaaaaucuguguuuggaaaauagcgaauuaaccuaagacac

SEQ ID NO: 611078 - RNA, 64 nt, hsa
acagguuuacacuaguugagcuaauaugcgugucuuuggaaauuaaacacaaaugguaacauau

SEQ ID NO: 611079 - RNA, 64 nt, hsa
auauaguugugauaauggucaucgaauggauuuguuuggaaagcuacaucuuauuugugaaaug

SEQ ID NO: 611080 - RNA, 64 nt, hsa
cacugucugggccccaucugggauuccugggcccuuuggaaaagaguuggugaaaugcgcagcc

SEQ ID NO: 611081 - RNA, 64 nt, hsa
cuagcaccugcuugcuacgcagcaaagggauagguuuggaaaccuaucauuuccuguccuuccu

SEQ ID NO: 611082 - RNA, 64 nt, hsa
ugugcauacauaaccuucuugugcaccaugaguauuuggaaaguuaauccuuguuuuugucgug

SEQ ID NO: 611083 - RNA, 64 nt, hsa
cuuguuuuuauuuuucuacuuugaauuguauacauuuggaaaguacccaaauaaaugagaagcu

SEQ ID NO: 611084 - RNA, 64 nt, hsa
ggguugagccugugacuugguuucucuuuguccuuuuggaaaaaugacaagcauugcaucccag

SEQ ID NO: 611085 - RNA, 64 nt, hsa
gugguuuacacguuaauagagguaguacaauuucuuuggaaaggugucuuuugaagccagcugu

SEQ ID NO: 611086 - RNA, 64 nt, hsa
guaacaugcgugugccagacaccgggcaguacacuuuggaaagaaugugaaauccuuuuaauuu

SEQ ID NO: 611087 - RNA, 64 nt, hsa
aaugagcugagaaaagacagagcauaucuguguauuuggaaaaauaauuguaacguaauugcag

SEQ ID NO: 611088 - RNA, 64 nt, hsa
ucuauuuggaccuguuucuaucucuaaaugaauuuuuggaaacauuaaugagguuuacauauuu

SEQ ID NO: 611089 - RNA, 64 nt, hsa
uuagcucugccaccaauauguaucuucauacacguuuggaaauguuuccugcagcauuagguau

SEQ ID NO: 611090 - RNA, 64 nt, hsa
gaguuguguauuuuguaaauguucaagggaacuguuuggaaacuucuuuccaccauucaggagg

SEQ ID NO: 611091 - RNA, 64 nt, hsa
ugaaacauuuagaaacuggauuugggaacccaauuuuggaaaaccagauucauagucaugaaaa

SEQ ID NO: 611092 - RNA, 64 nt, hsa
auaaaggauuuaaaauauauucauuaagauuuuauuuggaaagguggcuggagagagcugagga

SEQ ID NO: 611093 - RNA, 64 nt, hsa
auauaugcaaaguaauucaaaccuggccauguacuuuggaaaagaaagcauagagaugaauugu

SEQ ID NO: 611094 - RNA, 64 nt, hsa
uaacauauauaggccaaggaaaucugcauguauuuuuggaaauauucuuggcucuagauuuauc

SEQ ID NO: 611095 - RNA, 64 nt, hsa
aaagggcccccuaacccucuuguggcuccaguuauuuggaaacuaugaucugcauccuuaggaa

SEQ ID NO: 611096 - RNA, 64 nt, hsa
cauuaguuuuuuugaaaacucuugguuuuguuuuuuuggaaaugagugggccacuaagccacac

SEQ ID NO: 611097 - RNA, 64 nt, hsa
cuuuuuacuuugaagaaaucaguuucugccucuuuuuggaaaagaaaacaaagugcaauuguuu

SEQ ID NO: 611098 - RNA, 64 nt, hsa
cuauuuuguauacucucuuuaauaugugccuagcuuuggaaagucuagaaugggucccuggugc

SEQ ID NO: 611099 - RNA, 64 nt, hsa
gaaaagcccuuauuuggaaagugugaaauuuguauuuggaaaagcugccuggagagaagaacug

SEQ ID NO: 611100 - RNA, 64 nt, hsa
cccauaaucaguaaccuaucaagaaaagcccuuauuuggaaagugugaaauuuguauuuggaaa

SEQ ID NO: 611101 - RNA, 64 nt, hsa
cguuuuccccaaccucuuacacccuggaugucacuuuggaaaccaagcccuuggaagcaagugg

SEQ ID NO: 611102 - RNA, 64 nt, hsa
gacacugagcaggagggaggccugagcacacugcuuuggaaauuauucuaaacacaaaaaaggg

SEQ ID NO: 611103 - RNA, 64 nt, hsa
gagugcuguuacacuuaaggaaaauuagugccauuuuggaaaugagaucuugugccauaaauac

SEQ ID NO: 611104 - RNA, 64 nt, hsa
agauaauugauguaagaauccugacuuuuuuauauuuggaaacaucaaauaaaaauggaaaaaa

SEQ ID NO: 611105 - RNA, 64 nt, hsa
uguuuacccuuuggaaacccuggggugaccaagguuuggaaagccaccugagaccacuucauag

SEQ ID NO: 611106 - RNA, 64 nt, hsa
ucacccauguugaaugccugcugcuuguuuacccuuuggaaacccuggggugaccaagguuugg

SEQ ID NO: 611107 - RNA, 64 nt, hsa
aacaaauguaauuaauaacuuucucugugaaagcuuuggaaaaaucuuuuuuuuuuuuuuuggu

SEQ ID NO: 611108 - RNA, 64 nt, hsa
uaauagauggggcauauaauaaagaagcuacuauuuuggaaaaugacauuuuacuauuugccaa

SEQ ID NO: 611109 - RNA, 64 nt, hsa
aguacauaaucaguucuacuaaccaaagcuuguauuuggaaauuuacuuuuuguacaaauugaa

SEQ ID NO: 611110 - RNA, 64 nt, hsa
gugcuagucaaguuguuguuuuuccuugaacaacuuuggaaaaauggauuugacaguacauaau

SEQ ID NO: 611111 - RNA, 64 nt, hsa
uuuucuagaaacagaaaaucacuguauuaaauauuuuggaaagauuguucugaaagaagucugu

SEQ ID NO: 611112 - RNA, 64 nt, hsa
aagacuaaguugaguuauacuucuugguucacauuuuggaaaucagagauuacagauuacaugg

SEQ ID NO: 611113 - RNA, 64 nt, hsa
uggacauuuguuccacccgaccucugacugaugguuuggaaaauaacuuuaauuaggaucauau

SEQ ID NO: 611114 - RNA, 64 nt, hsa
aauacuuaaauauuuguaauugugagggguuucuuuuggaaauaauuacuuuugaaccauguau

SEQ ID NO: 611115 - RNA, 64 nt, hsa
aaauugacaagcuaggaaagaggaggcagaaagauuuggaaaauucacagaguuucacccuuaa

SEQ ID NO: 611116 - RNA, 64 nt, hsa
guauauuuugagagagauauuuuugggacauuauuuuggaaacuuauuacaaaucuaaauuugg

SEQ ID NO: 611117 - RNA, 64 nt, hsa
ggacauuauuuuggaaacuuauuacaaaucuaaauuuggaaaggagcuaguagcuuuaaggcca

SEQ ID NO: 611118 - RNA, 64 nt, hsa
ggacuauacuaguaggagaggaaaggaaaaaacauuuggaaaauaguaacauugauauuucuug

SEQ ID NO: 611119 - RNA, 64 nt, hsa
auggggcaugguggccucaggcugucuggagguguuuggaaaggcuucuugagugagguggccu

SEQ ID NO: 611120 - RNA, 64 nt, hsa
aucagcaaaguaauaguaaugugggccaaugcauuuuggaaauguccucauuauguagaaugga

SEQ ID NO: 611121 - RNA, 64 nt, hsa
augcaccuuacugccuagauuuuugggaaaaaacuuuggaaaguguguuaccuauauuucuagc

SEQ ID NO: 611122 - RNA, 64 nt, hsa
aaaguuugaugcauuuugagauggaaaacugaaauuuggaaaaagaaauacuuuacuauugagu

SEQ ID NO: 611123 - RNA, 64 nt, hsa
gagggcugcguauuuguaaauagccugaugcucauuuggaaaaauaaaccagugaacaauauuu

SEQ ID NO: 611124 - RNA, 64 nt, hsa
uuauuugcaguaaaccgaucuccaaagauuuccuuuuggaaacgcuuuuuccccuccuuaauuu

SEQ ID NO: 611125 - RNA, 64 nt, hsa
aagcaggacauggacaaggaugaucuaggaagacuuuggaaagaguaggaagacuuuggaaaga

SEQ ID NO: 611126 - RNA, 64 nt, hsa
ugaucuaggaagacuuuggaaagaguaggaagacuuuggaaagacuuuuccaacccucaucacc

SEQ ID NO: 611127 - RNA, 64 nt, hsa
gcccggcccagccccaggccagucagccgcagacuuuggaaagcccaacgaccauggagagaug

SEQ ID NO: 611128 - RNA, 64 nt, hsa
auauuaaaaagaaguacauguucauuguagagaauuuggaaacuguagaagagaaucaagaaga

SEQ ID NO: 611129 - RNA, 64 nt, hsa
aagaggcccucugggugaugaagugaccaucacauuuggaaagugaucaaccacuguuccuucu

SEQ ID NO: 611130 - RNA, 64 nt, hsa
aguugccgaaccaggccgccucacagccaggaaauuuggaaauccuagccaaggggauuucgug

SEQ ID NO: 611131 - RNA, 64 nt, hsa
ucuagaaaagccacaccugcaucuggggacacacuuuggaaagugggacccuccagccuggaga

SEQ ID NO: 611132 - RNA, 64 nt, hsa
ugaacucugaccugugaauagaagcagcaugcacuuuggaaauccggccuuuugaccagaacgc

SEQ ID NO: 611133 - RNA, 64 nt, hsa
cuuuauucgagggaaggaucaaugcuuauuaccauuuggaaaaacgaagaucagaagguaaaug

SEQ ID NO: 611134 - RNA, 64 nt, hsa
cccuucugacacagugugugcacuucaggcaauuuuuggaaaauauaaaaaauuccaaauucug

SEQ ID NO: 611135 - RNA, 64 nt, hsa
uuaugugaacuguuguccuugcuuuacaccaccauuuggaaaacuuaccaguuuuuagauguag

SEQ ID NO: 611136 - RNA, 64 nt, hsa
guuuacaaaaauaagucuuuuugccuuaagucauuuuggaaauaaguaauacugcaucugacuc

SEQ ID NO: 611137 - RNA, 64 nt, hsa
uaacaugaaaauuaguaggaagaugugguuacuauuuggaaaguguaauguaacaaaacucucu

SEQ ID NO: 611138 - RNA, 64 nt, hsa
caguauugaagacuuuacaaggagauuagaaaucuuuggaaaacauaugugaugaaauugagcu

SEQ ID NO: 611139 - RNA, 64 nt, hsa
gaagauccuuaucuauauucauuccuucauuacuuuuggaaaauucuuacuugugaauguuaaa

SEQ ID NO: 611140 - RNA, 64 nt, hsa
uuggagcaaauccuuuaauacuaucucucauuguuuuggaaacaaggugugauuaugcuauacu

SEQ ID NO: 611141 - RNA, 64 nt, hsa
caauuuuuuucauggugaaaucaaauaacgcaguuuuggaaaccuauaaccgcauuuugugcuu

SEQ ID NO: 611142 - RNA, 64 nt, hsa
cuuaugaaauguuucacugaguuauuugagguuuuuuggaaagccuacuauugcguuucaaugu

SEQ ID NO: 611143 - RNA, 64 nt, hsa
caaagcucgcuucuccagggagccuccucuuggcuuuggaaaagagcccagggacuuaacgugc

SEQ ID NO: 611144 - RNA, 64 nt, hsa
uuauuccuauuuaauguuauugacuauagcagauuuuggaaaucaguguuuuccaugugacccu

SEQ ID NO: 611145 - RNA, 64 nt, hsa
ggccacuuaccaaacucaggugauuccaggaugguuuggaaacuucuccugaaugcauccuuaa

SEQ ID NO: 611146 - RNA, 64 nt, hsa
ugcaauauuguaguucauauauuaccguuaugucuuuggaaaucggguucagaacacuuuuuau

SEQ ID NO: 611147 - RNA, 64 nt, hsa
uuugaaauacuuaaugccaaguaacaaugcaugcuuuggaaauuuggaagaugguuuuauucuu

SEQ ID NO: 611148 - RNA, 64 nt, hsa
ugguuucuauacaugaaucauagccaaaaacuuuuuuggaaacuguugguugagauaguugguu

SEQ ID NO: 611149 - RNA, 64 nt, hsa
guuguuuuacaucuuuugggaagccaggaaagcguuuggaaaacguaucaccuuucccagauuc

SEQ ID NO: 611150 - RNA, 64 nt, hsa
gaaaugaaacauuaaaagaacuuaaaaaguaauuuuuggaaaugaggcuucaauuagaauuauu

SEQ ID NO: 611151 - RNA, 64 nt, hsa
gacagcccuaugaaaaaauacccaauauauauuuuuuggaaaugaaacauuaaaagaacuuaaa

SEQ ID NO: 611152 - RNA, 64 nt, hsa
ucuggcuuuuuuuuuucuuuuguuuugguuugguuuuggaaaacuaauuaauuagacuugugug

SEQ ID NO: 611153 - RNA, 64 nt, hsa
agcaguugacucagagugcaagaagucuggccauuuuggaaagcaagguuuccuuucagcccug

SEQ ID NO: 611154 - RNA, 64 nt, hsa
uggucacccagacuagacaccuucugugcucauguuuggaaagcugaaagggaaggacagcugu

SEQ ID NO: 611155 - RNA, 64 nt, hsa
gcucacugagauagauacauaucugauugccuccuuuggaaaggcuaaucagaaacucaaaaga

SEQ ID NO: 611156 - RNA, 64 nt, hsa
acugagaccugucucggauuuucuggguucacauuuuggaaaccaugaauggauucugggugga

SEQ ID NO: 611157 - RNA, 64 nt, hsa
ugccucaaaauaauugagaucacauuucaggacauuuggaaaucaggucgauuugugguaacug

SEQ ID NO: 611158 - RNA, 64 nt, hsa
uuauucucucuucucuuuguuucaacuggauuccuuuggaaaaccaaacuaguaucagaacaaa

SEQ ID NO: 611159 - RNA, 64 nt, hsa
uguagcagaaaccaacaagaaccacuccuucauguuuggaaaauaauuucucuuguauuaucuc

SEQ ID NO: 611160 - RNA, 64 nt, hsa
caggggcucuguggcaaaaagagucagacauuucuuuggaaaacagcgaacagccuuagagcuc

SEQ ID NO: 611161 - RNA, 64 nt, hsa
ugcuugaaggaguagaugaaccagaaucugagaauuuggaaauaggucacagaaaaagccucca

SEQ ID NO: 611162 - RNA, 64 nt, hsa
uuugugagaauaaauguuagaaaaguuaguuuauuuuggaaaccugccgugaaaggaaauucua

SEQ ID NO: 611163 - RNA, 64 nt, hsa
cacggcaaucagaagaaaggagcugagaugagguuuuggaaaacccugacaccuuuaaaaagca

SEQ ID NO: 611164 - RNA, 64 nt, hsa
aggagaaauagcuguauagaugaguuuuucauuauuuggaaauuuagggguagaaaauguuuuc

SEQ ID NO: 611165 - RNA, 64 nt, hsa
cuguacuauuauuaauguuuauauuguaccuugauuuggaaaaguauuggaguuaaucuguauu

SEQ ID NO: 611166 - RNA, 64 nt, hsa
cauauaugcagugcuuuuucuuaaacuuggccaauuuggaaagggggaaggagccaccccaaaa

SEQ ID NO: 611167 - RNA, 64 nt, hsa; identical to SEQ ID NO: 455202

SEQ ID NO: 611168 - RNA, 64 nt, hsa; identical to SEQ ID NO: 455203

SEQ ID NO: 611169 - RNA, 64 nt, hsa; identical to SEQ ID NO: 455204

SEQ ID NO: 611170 - RNA, 64 nt, hsa; identical to SEQ ID NO: 455205

SEQ ID NO: 611171 - RNA, 64 nt, hsa; identical to SEQ ID NO: 455206

SEQ ID NO: 611172 - RNA, 64 nt, hsa; identical to SEQ ID NO: 455207

SEQ ID NO: 611173 - RNA, 64 nt, hsa; identical to SEQ ID NO: 455208

SEQ ID NO: 611174 - RNA, 64 nt, hsa; identical to SEQ ID NO: 455209

SEQ ID NO: 611175 - RNA, 64 nt, hsa; identical to SEQ ID NO: 455210

SEQ ID NO: 611176 - RNA, 64 nt, hsa; identical to SEQ ID NO: 455211

SEQ ID NO: 611177 - RNA, 64 nt, hsa; identical to SEQ ID NO: 115857

SEQ ID NO: 611178 - RNA, 64 nt, hsa; identical to SEQ ID NO: 115858

SEQ ID NO: 611179 - RNA, 64 nt, hsa; identical to SEQ ID NO: 115859

SEQ ID NO: 611180 - RNA, 64 nt, hsa; identical to SEQ ID NO: 115860

SEQ ID NO: 611181 - RNA, 64 nt, hsa
uaaaaguuugggcagagggaaccaggcacguuaaagaagacagaaagcggacuaugcagagugc

SEQ ID NO: 611182 - RNA, 64 nt, hsa
aguaaaaggaguugagagaaagaugggucaguucagaagacauacacaggagaaauuguaguga

SEQ ID NO: 611183 - RNA, 64 nt, hsa
ucuucaucagaagcuuuaaucaaagaagaugagcagaagacaaucacuggcucccuguuaccag

SEQ ID NO: 611184 - RNA, 64 nt, hsa
agauccaaagucaaagcaaccauacuucaccuagagaagacaguauuggcaaucaugacaccug

SEQ ID NO: 611185 - RNA, 64 nt, hsa
ggggacauacacuugcaucuuuguugaaagcagaagaagacagacccuuuccccaccuuccuua

SEQ ID NO: 611186 - RNA, 64 nt, hsa
aacaaacccaaauuggugaaaagaauaaucaaaaagaagacauuauccgguuaagagucugugc

SEQ ID NO: 611187 - RNA, 64 nt, hsa
ugaguuggaaacaaaaacaugaaggacuccaacuagaagacagauauuuacauuuaaauagauu

SEQ ID NO: 611188 - RNA, 64 nt, hsa
acauaccuucucuguuguaucaguacuuugagugagaagacaguuuauuuaaaacuugagcagg

SEQ ID NO: 611189 - RNA, 64 nt, hsa
gugaacuugaaguuugcgcaaaauguggaaagaaagaagacauuguuauuccgugaguguuucc

SEQ ID NO: 611190 - RNA, 64 nt, hsa
aaagugaugaugauuuagauuuugauauugauuuagaagacacaggaggagaccaucaaaugaa

SEQ ID NO: 611191 - RNA, 64 nt, hsa
ccaauagcacugaccuggugaucaaaaacacuugagaagacaucuauuggccaucucuggccaa

SEQ ID NO: 611192 - RNA, 64 nt, hsa
aaaauggugacaaagcuguacagauagagauaauagaagacaaagagauuaaaaggaaauaaaa

SEQ ID NO: 611193 - RNA, 64 nt, hsa
cucaguagguagacacaaacauaaagauuucccuagaagacauagagugggauuugauaacacu

SEQ ID NO: 611194 - RNA, 64 nt, hsa
gcaacucuuucaugaagagcuuagcuaugaccuuagaagacaaagccuguuugucauggcugcc

SEQ ID NO: 611195 - RNA, 64 nt, hsa
cuauucugagagucaucuguuuguauggucuuguagaagacaguccuguaagaucgagcaacca

SEQ ID NO: 611196 - RNA, 64 nt, hsa
ccuguuuuccaugaacauuucaagcuuaugggggagaagacacuguauacauuuucaucugcau

SEQ ID NO: 611197 - RNA, 64 nt, hsa
gaugaaaggcuucuauuuggaggaagaaaaauuaagaagacaacuuacaaaaucaagaugacaa

SEQ ID NO: 611198 - RNA, 64 nt, hsa
gagacuguugcucaaccaucaggaaacaguugucagaagacaucauugguucuguguuuccuac

SEQ ID NO: 611199 - RNA, 64 nt, hsa
agucgcauaggguuuuuuaaugcagaauuuugucagaagacaauggcgcugcauguuuuucuuu

SEQ ID NO: 611200 - RNA, 64 nt, hsa
gcucucgagggcagcacugacaaauguguuccuaagaagacauucagacccagguguuaugcag

SEQ ID NO: 611201 - RNA, 64 nt, hsa
gcugagcaaccacauauugcuacaaggcaaaucaagaagacaucaggaaaucagaugcacagga

SEQ ID NO: 611202 - RNA, 64 nt, hsa
acacacacacacacacucugacugucuuuauugcagaagacaguguguugccuuacccagaaug

SEQ ID NO: 611203 - RNA, 64 nt, hsa
acacacacacacacacacacacagucuuuauugcagaagacaguguguugccuuaccagaauga

SEQ ID NO: 611204 - RNA, 64 nt, hsa
acacacacauacacacacacagagucuuuauugcagaagacaguguguugccuuauaggcguga

SEQ ID NO: 611205 - RNA, 64 nt, hsa
acacacacacacacacacacacacacacuauuucagaagacaguguguugccuuacccagaaug

SEQ ID NO: 611206 - RNA, 64 nt, hsa
gcuacagcaauggucagcuuggaaaccacagugaagaagacagcacugaugaccaaagagaaga

SEQ ID NO: 611207 - RNA, 64 nt, hsa
accacagugaagaagacagcacugaugaccaaagagaagacacucauauuaagccuauuuauaa

SEQ ID NO: 611208 - RNA, 64 nt, hsa
gcaaguaagucaagguuuuauccugauuggaaauagaagacauuuccgguugagagaacagauu

SEQ ID NO: 611209 - RNA, 64 nt, hsa
guguguggggggcgugccucucagaaacgcggccagaagacaagcagggaagugaaagguccca

SEQ ID NO: 611210 - RNA, 64 nt, hsa
ugugugcgugcgugugugcgcacauagcuuuaaaagaagacauucaaaauuugaugugcuacaa

SEQ ID NO: 611211 - RNA, 64 nt, hsa
gcauuccugcaagacugugcagcucacggaauauagaagacauggcauuuuacucagaagucau

SEQ ID NO: 611212 - RNA, 64 nt, hsa
uacuccagcuuguggcauucccaugugacuggggagaagacaaaauugguguuuagauucugga

SEQ ID NO: 611213 - RNA, 64 nt, hsa
uuacucuguccaucuugguagcugucacuucaaaagaagacaguuucccugaguaaucaucacc

SEQ ID NO: 611214 - RNA, 64 nt, hsa
ggcacgauaccagggcagccucuugaaaacggccucgggagacgggagcugcgagcaggugggc

SEQ ID NO: 611215 - RNA, 64 nt, hsa
cucccaggucucccugcuucaggcuugggaagguucgggagaugcuuccuucuguaacaccaga

SEQ ID NO: 611216 - RNA, 64 nt, hsa; identical to SEQ ID NO: 45285

SEQ ID NO: 611217 - RNA, 64 nt, hsa; identical to SEQ ID NO: 45286

SEQ ID NO: 611218 - RNA, 64 nt, hsa; identical to SEQ ID NO: 45287

SEQ ID NO: 611219 - RNA, 64 nt, hsa; identical to SEQ ID NO: 45288

SEQ ID NO: 611220 - RNA, 64 nt, hsa; identical to SEQ ID NO: 45289

SEQ ID NO: 611221 - RNA, 64 nt, hsa; identical to SEQ ID NO: 45290

SEQ ID NO: 611222 - RNA, 64 nt, hsa; identical to SEQ ID NO: 45291

SEQ ID NO: 611223 - RNA, 64 nt, hsa; identical to SEQ ID NO: 45292

SEQ ID NO: 611224 - RNA, 64 nt, hsa; identical to SEQ ID NO: 45293

SEQ ID NO: 611225 - RNA, 64 nt, hsa; identical to SEQ ID NO: 45294

SEQ ID NO: 611226 - RNA, 64 nt, hsa; identical to SEQ ID NO: 45295

SEQ ID NO: 611227 - RNA, 64 nt, hsa; identical to SEQ ID NO: 45296

SEQ ID NO: 611228 - RNA, 64 nt, hsa; identical to SEQ ID NO: 45297

SEQ ID NO: 611229 - RNA, 64 nt, hsa; identical to SEQ ID NO: 45298

SEQ ID NO: 611230 - RNA, 64 nt, hsa; identical to SEQ ID NO: 45299

SEQ ID NO: 611231 - RNA, 64 nt, hsa; identical to SEQ ID NO: 45300

SEQ ID NO: 611232 - RNA, 64 nt, hsa; identical to SEQ ID NO: 45301

SEQ ID NO: 611233 - RNA, 64 nt, hsa; identical to SEQ ID NO: 45302

SEQ ID NO: 611234 - RNA, 64 nt, hsa; identical to SEQ ID NO: 45303

SEQ ID NO: 611235 - RNA, 64 nt, hsa; identical to SEQ ID NO: 45304

SEQ ID NO: 611236 - RNA, 64 nt, hsa; identical to SEQ ID NO: 45305

SEQ ID NO: 611237 - RNA, 64 nt, hsa; identical to SEQ ID NO: 45306

SEQ ID NO: 611238 - RNA, 64 nt, hsa; identical to SEQ ID NO: 45307

SEQ ID NO: 611239 - RNA, 64 nt, hsa; identical to SEQ ID NO: 45308

SEQ ID NO: 611240 - RNA, 64 nt, hsa; identical to SEQ ID NO: 45309

SEQ ID NO: 611241 - RNA, 64 nt, hsa; identical to SEQ ID NO: 45310

SEQ ID NO: 611242 - RNA, 64 nt, hsa; identical to SEQ ID NO: 45311

SEQ ID NO: 611243 - RNA, 64 nt, hsa; identical to SEQ ID NO: 45312

SEQ ID NO: 611244 - RNA, 64 nt, hsa; identical to SEQ ID NO: 45312

SEQ ID NO: 611245 - RNA, 64 nt, hsa; identical to SEQ ID NO: 45314

SEQ ID NO: 611246 - RNA, 64 nt, hsa; identical to SEQ ID NO: 45315

SEQ ID NO: 611247 - RNA, 64 nt, hsa; identical to SEQ ID NO: 45316

SEQ ID NO: 611248 - RNA, 64 nt, hsa; identical to SEQ ID NO: 45317

SEQ ID NO: 611249 - RNA, 64 nt, hsa; identical to SEQ ID NO: 45318

SEQ ID NO: 611250 - RNA, 64 nt, hsa; identical to SEQ ID NO: 45319

SEQ ID NO: 611251 - RNA, 64 nt, hsa; identical to SEQ ID NO: 247936

SEQ ID NO: 611252 - RNA, 64 nt, hsa; identical to SEQ ID NO: 247937

SEQ ID NO: 611253 - RNA, 64 nt, hsa; identical to SEQ ID NO: 247938

SEQ ID NO: 611254 - RNA, 64 nt, hsa; identical to SEQ ID NO: 247939

SEQ ID NO: 611255 - RNA, 64 nt, hsa; identical to SEQ ID NO: 247940

SEQ ID NO: 611256 - RNA, 64 nt, hsa; identical to SEQ ID NO: 247941

SEQ ID NO: 611257 - RNA, 64 nt, hsa; identical to SEQ ID NO: 247942

SEQ ID NO: 611258 - RNA, 64 nt, hsa; identical to SEQ ID NO: 247943

SEQ ID NO: 611259 - RNA, 64 nt, hsa; identical to SEQ ID NO: 247944

SEQ ID NO: 611260 - RNA, 64 nt, hsa; identical to SEQ ID NO: 247945

SEQ ID NO: 611261 - RNA, 64 nt, hsa; identical to SEQ ID NO: 247946

SEQ ID NO: 611262 - RNA, 64 nt, hsa; identical to SEQ ID NO: 247947

SEQ ID NO: 611263 - RNA, 64 nt, hsa; identical to SEQ ID NO: 247948

SEQ ID NO: 611264 - RNA, 64 nt, hsa; identical to SEQ ID NO: 247949

SEQ ID NO: 611265 - RNA, 64 nt, hsa; identical to SEQ ID NO: 247950

SEQ ID NO: 611266 - RNA, 64 nt, hsa; identical to SEQ ID NO: 247951

SEQ ID NO: 611267 - RNA, 64 nt, hsa; identical to SEQ ID NO: 247952

SEQ ID NO: 611268 - RNA, 64 nt, hsa; identical to SEQ ID NO: 247953

SEQ ID NO: 611269 - RNA, 64 nt, hsa; identical to SEQ ID NO: 247954

SEQ ID NO: 611270 - RNA, 64 nt, hsa; identical to SEQ ID NO: 247955

SEQ ID NO: 611271 - RNA, 64 nt, hsa; identical to SEQ ID NO: 247956

SEQ ID NO: 611272 - RNA, 64 nt, hsa; identical to SEQ ID NO: 247957

SEQ ID NO: 611273 - RNA, 64 nt, hsa; identical to SEQ ID NO: 247958

SEQ ID NO: 611274 - RNA, 64 nt, hsa; identical to SEQ ID NO: 247959

SEQ ID NO: 611275 - RNA, 64 nt, hsa; identical to SEQ ID NO: 247960

SEQ ID NO: 611276 - RNA, 64 nt, hsa; identical to SEQ ID NO: 247961

SEQ ID NO: 611277 - RNA, 64 nt, hsa; identical to SEQ ID NO: 247962

SEQ ID NO: 611278 - RNA, 64 nt, hsa; identical to SEQ ID NO: 247963

SEQ ID NO: 611279 - RNA, 64 nt, hsa; identical to SEQ ID NO: 247964

SEQ ID NO: 611280 - RNA, 64 nt, hsa; identical to SEQ ID NO: 247965

SEQ ID NO: 611281 - RNA, 64 nt, hsa; identical to SEQ ID NO: 247966

SEQ ID NO: 611282 - RNA, 64 nt, hsa; identical to SEQ ID NO: 247967

SEQ ID NO: 611283 - RNA, 64 nt, hsa; identical to SEQ ID NO: 247968

SEQ ID NO: 611284 - RNA, 64 nt, hsa; identical to SEQ ID NO: 247969

SEQ ID NO: 611285 - RNA, 64 nt, hsa; identical to SEQ ID NO: 247970

SEQ ID NO: 611286 - RNA, 64 nt, hsa; identical to SEQ ID NO: 247971

SEQ ID NO: 611287 - RNA, 64 nt, hsa; identical to SEQ ID NO: 247972

SEQ ID NO: 611288 - RNA, 64 nt, hsa; identical to SEQ ID NO: 247973

SEQ ID NO: 611289 - RNA, 64 nt, hsa; identical to SEQ ID NO: 247974

SEQ ID NO: 611290 - RNA, 64 nt, hsa; identical to SEQ ID NO: 247975

SEQ ID NO: 611291 - RNA, 64 nt, hsa; identical to SEQ ID NO: 247976

SEQ ID NO: 611292 - RNA, 64 nt, hsa; identical to SEQ ID NO: 247977

SEQ ID NO: 611293 - RNA, 64 nt, hsa; identical to SEQ ID NO: 247978

SEQ ID NO: 611294 - RNA, 64 nt, hsa; identical to SEQ ID NO: 580078

SEQ ID NO: 611295 - RNA, 64 nt, hsa; identical to SEQ ID NO: 580079

SEQ ID NO: 611296 - RNA, 64 nt, hsa; identical to SEQ ID NO: 580080

SEQ ID NO: 611297 - RNA, 64 nt, hsa; identical to SEQ ID NO: 580081

SEQ ID NO: 611298 - RNA, 64 nt, hsa; identical to SEQ ID NO: 580082

SEQ ID NO: 611299 - RNA, 64 nt, hsa; identical to SEQ ID NO: 580083

SEQ ID NO: 611300 - RNA, 64 nt, hsa; identical to SEQ ID NO: 580084

SEQ ID NO: 611301 - RNA, 64 nt, hsa; identical to SEQ ID NO: 580085

SEQ ID NO: 611302 - RNA, 64 nt, hsa; identical to SEQ ID NO: 580086

SEQ ID NO: 611303 - RNA, 64 nt, hsa; identical to SEQ ID NO: 580087

SEQ ID NO: 611304 - RNA, 64 nt, hsa; identical to SEQ ID NO: 580088

SEQ ID NO: 611305 - RNA, 64 nt, hsa; identical to SEQ ID NO: 580089

SEQ ID NO: 611306 - RNA, 64 nt, hsa; identical to SEQ ID NO: 580090

SEQ ID NO: 611307 - RNA, 64 nt, hsa; identical to SEQ ID NO: 580091

SEQ ID NO: 611308 - RNA, 64 nt, hsa; identical to SEQ ID NO: 374737

SEQ ID NO: 611309 - RNA, 64 nt, hsa; identical to SEQ ID NO: 374738

SEQ ID NO: 611310 - RNA, 64 nt, hsa; identical to SEQ ID NO: 374739

SEQ ID NO: 611311 - RNA, 64 nt, hsa; identical to SEQ ID NO: 374740

SEQ ID NO: 611312 - RNA, 64 nt, hsa; identical to SEQ ID NO: 374741

SEQ ID NO: 611313 - RNA, 64 nt, hsa; identical to SEQ ID NO: 374742

SEQ ID NO: 611314 - RNA, 64 nt, hsa; identical to SEQ ID NO: 374743

SEQ ID NO: 611315 - RNA, 64 nt, hsa; identical to SEQ ID NO: 374744

SEQ ID NO: 611316 - RNA, 64 nt, hsa; identical to SEQ ID NO: 374745

SEQ ID NO: 611317 - RNA, 64 nt, hsa; identical to SEQ ID NO: 374746

SEQ ID NO: 611318 - RNA, 64 nt, hsa; identical to SEQ ID NO: 374747

SEQ ID NO: 611319 - RNA, 64 nt, hsa; identical to SEQ ID NO: 374748

SEQ ID NO: 611320 - RNA, 64 nt, hsa; identical to SEQ ID NO: 374749

SEQ ID NO: 611321 - RNA, 64 nt, hsa; identical to SEQ ID NO: 374750

SEQ ID NO: 611322 - RNA, 64 nt, hsa; identical to SEQ ID NO: 374751

SEQ ID NO: 611323 - RNA, 64 nt, hsa; identical to SEQ ID NO: 374752

SEQ ID NO: 611324 - RNA, 64 nt, hsa; identical to SEQ ID NO: 374753

SEQ ID NO: 611325 - RNA, 64 nt, hsa; identical to SEQ ID NO: 374754

SEQ ID NO: 611326 - RNA, 64 nt, hsa; identical to SEQ ID NO: 374755

SEQ ID NO: 611327 - RNA, 64 nt, hsa; identical to SEQ ID NO: 374756

SEQ ID NO: 611328 - RNA, 64 nt, hsa; identical to SEQ ID NO: 374757

SEQ ID NO: 611329 - RNA, 64 nt, hsa; identical to SEQ ID NO: 374758

SEQ ID NO: 611330 - RNA, 64 nt, hsa; identical to SEQ ID NO: 374759

SEQ ID NO: 611331 - RNA, 64 nt, hsa; identical to SEQ ID NO: 374760

SEQ ID NO: 611332 - RNA, 64 nt, hsa; identical to SEQ ID NO: 374761

SEQ ID NO: 611333 - RNA, 64 nt, hsa; identical to SEQ ID NO: 374762

SEQ ID NO: 611334 - RNA, 64 nt, hsa; identical to SEQ ID NO: 374763

SEQ ID NO: 611335 - RNA, 64 nt, hsa; identical to SEQ ID NO: 374764

SEQ ID NO: 611336 - RNA, 64 nt, hsa; identical to SEQ ID NO: 374765

SEQ ID NO: 611337 - RNA, 64 nt, hsa; identical to SEQ ID NO: 374766

SEQ ID NO: 611338 - RNA, 64 nt, hsa; identical to SEQ ID NO: 374767

SEQ ID NO: 611339 - RNA, 64 nt, hsa; identical to SEQ ID NO: 374768

SEQ ID NO: 611340 - RNA, 64 nt, hsa; identical to SEQ ID NO: 374769

SEQ ID NO: 611341 - RNA, 64 nt, hsa; identical to SEQ ID NO: 374770

SEQ ID NO: 611342 - RNA, 64 nt, hsa; identical to SEQ ID NO: 374771

SEQ ID NO: 611343 - RNA, 64 nt, hsa; identical to SEQ ID NO: 374772

SEQ ID NO: 611344 - RNA, 64 nt, hsa; identical to SEQ ID NO: 374773

SEQ ID NO: 611345 - RNA, 64 nt, hsa; identical to SEQ ID NO: 374774

SEQ ID NO: 611346 - RNA, 64 nt, hsa; identical to SEQ ID NO: 374775

SEQ ID NO: 611347 - RNA, 64 nt, hsa; identical to SEQ ID NO: 374776

SEQ ID NO: 611348 - RNA, 64 nt, hsa; identical to SEQ ID NO: 374777

SEQ ID NO: 611349 - RNA, 64 nt, hsa; identical to SEQ ID NO: 374778

SEQ ID NO: 611350 - RNA, 64 nt, hsa; identical to SEQ ID NO: 374779

SEQ ID NO: 611351 - RNA, 64 nt, hsa; identical to SEQ ID NO: 374780

SEQ ID NO: 611352 - RNA, 64 nt, hsa; identical to SEQ ID NO: 374781

SEQ ID NO: 611353 - RNA, 64 nt, hsa; identical to SEQ ID NO: 374782

SEQ ID NO: 611354 - RNA, 64 nt, hsa; identical to SEQ ID NO: 374783

SEQ ID NO: 611355 - RNA, 64 nt, hsa; identical to SEQ ID NO: 374784

SEQ ID NO: 611356 - RNA, 64 nt, hsa; identical to SEQ ID NO: 374785

SEQ ID NO: 611357 - RNA, 64 nt, hsa; identical to SEQ ID NO: 374786

SEQ ID NO: 611358 - RNA, 64 nt, hsa; identical to SEQ ID NO: 374787

SEQ ID NO: 611359 - RNA, 64 nt, hsa; identical to SEQ ID NO: 374788

SEQ ID NO: 611360 - RNA, 64 nt, hsa; identical to SEQ ID NO: 374789

SEQ ID NO: 611361 - RNA, 64 nt, hsa; identical to SEQ ID NO: 374790

SEQ ID NO: 611362 - RNA, 64 nt, hsa; identical to SEQ ID NO: 374791

SEQ ID NO: 611363 - RNA, 64 nt, hsa; identical to SEQ ID NO: 374792

SEQ ID NO: 611364 - RNA, 64 nt, hsa; identical to SEQ ID NO: 374793

SEQ ID NO: 611365 - RNA, 64 nt, hsa; identical to SEQ ID NO: 374794

SEQ ID NO: 611366 - RNA, 64 nt, hsa; identical to SEQ ID NO: 374795

SEQ ID NO: 611367 - RNA, 64 nt, hsa; identical to SEQ ID NO: 374796

SEQ ID NO: 611368 - RNA, 64 nt, hsa; identical to SEQ ID NO: 374797

SEQ ID NO: 611369 - RNA, 64 nt, hsa; identical to SEQ ID NO: 374798

SEQ ID NO: 611370 - RNA, 64 nt, hsa; identical to SEQ ID NO: 374799

SEQ ID NO: 611371 - RNA, 64 nt, hsa; identical to SEQ ID NO: 374800

SEQ ID NO: 611372 - RNA, 64 nt, hsa; identical to SEQ ID NO: 374801

SEQ ID NO: 611373 - RNA, 64 nt, hsa; identical to SEQ ID NO: 374802

SEQ ID NO: 611374 - RNA, 64 nt, hsa; identical to SEQ ID NO: 374803

SEQ ID NO: 611375 - RNA, 64 nt, hsa; identical to SEQ ID NO: 374804

SEQ ID NO: 611376 - RNA, 64 nt, hsa; identical to SEQ ID NO: 374805

SEQ ID NO: 611377 - RNA, 64 nt, hsa; identical to SEQ ID NO: 374806

SEQ ID NO: 611378 - RNA, 64 nt, hsa; identical to SEQ ID NO: 374807

SEQ ID NO: 611379 - RNA, 64 nt, hsa; identical to SEQ ID NO: 374808

SEQ ID NO: 611380 - RNA, 64 nt, hsa; identical to SEQ ID NO: 374809

SEQ ID NO: 611381 - RNA, 64 nt, hsa; identical to SEQ ID NO: 374810

SEQ ID NO: 611382 - RNA, 64 nt, hsa; identical to SEQ ID NO: 374811

SEQ ID NO: 611383 - RNA, 64 nt, hsa; identical to SEQ ID NO: 374812

SEQ ID NO: 611384 - RNA, 64 nt, hsa; identical to SEQ ID NO: 374813

SEQ ID NO: 611385 - RNA, 64 nt, hsa; identical to SEQ ID NO: 374814

SEQ ID NO: 611386 - RNA, 64 nt, hsa; identical to SEQ ID NO: 374815

SEQ ID NO: 611387 - RNA, 64 nt, hsa; identical to SEQ ID NO: 274946

SEQ ID NO: 611388 - RNA, 64 nt, hsa; identical to SEQ ID NO: 274947

SEQ ID NO: 611389 - RNA, 64 nt, hsa; identical to SEQ ID NO: 274948

SEQ ID NO: 611390 - RNA, 64 nt, hsa; identical to SEQ ID NO: 274949

SEQ ID NO: 611391 - RNA, 64 nt, hsa; identical to SEQ ID NO: 274950

SEQ ID NO: 611392 - RNA, 64 nt, hsa; identical to SEQ ID NO: 274951

SEQ ID NO: 611393 - RNA, 64 nt, hsa; identical to SEQ ID NO: 274952

SEQ ID NO: 611394 - RNA, 64 nt, hsa; identical to SEQ ID NO: 274953

SEQ ID NO: 611395 - RNA, 64 nt, hsa; identical to SEQ ID NO: 274954

SEQ ID NO: 611396 - RNA, 64 nt, hsa; identical to SEQ ID NO: 274955

SEQ ID NO: 611397 - RNA, 64 nt, hsa; identical to SEQ ID NO: 274956

SEQ ID NO: 611398 - RNA, 64 nt, hsa; identical to SEQ ID NO: 274957

SEQ ID NO: 611399 - RNA, 64 nt, hsa; identical to SEQ ID NO: 274958

SEQ ID NO: 611400 - RNA, 64 nt, hsa; identical to SEQ ID NO: 274959

SEQ ID NO: 611401 - RNA, 64 nt, hsa; identical to SEQ ID NO: 274960

SEQ ID NO: 611402 - RNA, 64 nt, hsa; identical to SEQ ID NO: 274961

SEQ ID NO: 611403 - RNA, 64 nt, hsa; identical to SEQ ID NO: 274962

SEQ ID NO: 611404 - RNA, 64 nt, hsa; identical to SEQ ID NO: 274963

SEQ ID NO: 611405 - RNA, 64 nt, hsa; identical to SEQ ID NO: 274964

SEQ ID NO: 611406 - RNA, 64 nt, hsa; identical to SEQ ID NO: 274965

SEQ ID NO: 611407 - RNA, 64 nt, hsa; identical to SEQ ID NO: 274966

SEQ ID NO: 611408 - RNA, 64 nt, hsa; identical to SEQ ID NO: 274967

SEQ ID NO: 611409 - RNA, 64 nt, hsa; identical to SEQ ID NO: 274968

SEQ ID NO: 611410 - RNA, 64 nt, hsa; identical to SEQ ID NO: 274969

SEQ ID NO: 611411 - RNA, 64 nt, hsa; identical to SEQ ID NO: 274970

SEQ ID NO: 611412 - RNA, 64 nt, hsa; identical to SEQ ID NO: 274971

SEQ ID NO: 611413 - RNA, 64 nt, hsa; identical to SEQ ID NO: 274972

SEQ ID NO: 611414 - RNA, 64 nt, hsa; identical to SEQ ID NO: 274973

SEQ ID NO: 611415 - RNA, 64 nt, hsa; identical to SEQ ID NO: 274974

SEQ ID NO: 611416 - RNA, 64 nt, hsa; identical to SEQ ID NO: 274975

SEQ ID NO: 611417 - RNA, 64 nt, hsa; identical to SEQ ID NO: 274976

SEQ ID NO: 611418 - RNA, 64 nt, hsa; identical to SEQ ID NO: 274977

SEQ ID NO: 611419 - RNA, 64 nt, hsa; identical to SEQ ID NO: 274978

SEQ ID NO: 611420 - RNA, 64 nt, hsa; identical to SEQ ID NO: 274979

SEQ ID NO: 611421 - RNA, 64 nt, hsa; identical to SEQ ID NO: 274980

SEQ ID NO: 611422 - RNA, 64 nt, hsa; identical to SEQ ID NO: 274981

SEQ ID NO: 611423 - RNA, 59 nt, hsa; identical to SEQ ID NO: 274982

SEQ ID NO: 611424 - RNA, 64 nt, hsa
uuggcugcaugaagguuuucuuuagaaucagaauuguagccaguuucuuuggccagaaggauga

SEQ ID NO: 611425 - RNA, 64 nt, hsa
cuuagcauggugagcugaguucauggcuuuuuuuuguagccaguccugucccuggccauccaug

SEQ ID NO: 611426 - RNA, 64 nt, hsa
cuugggcugucuguacagcuccguacugccuauguguagccaucuuugccuuuugcugcaauag

SEQ ID NO: 611427 - RNA, 64 nt, hsa
gagguaacccaggggucagcccaggcugcugggcuguagccaauagccaugcaggacugguuca

SEQ ID NO: 611428 - RNA, 64 nt, hsa
gcuucagggcccaaguugggagaagugaccaaaguguagccaguuuucugaguucccgugugcu

SEQ ID NO: 611429 - RNA, 64 nt, hsa
uucucuagcccuuggcucugcuggguuuccugacuguagccacaucucucccgcucccuaaggg

SEQ ID NO: 611430 - RNA, 64 nt, hsa
ugugugauuaaagacaacuuuccaauguaguaucuguagccauguccccuaauggcuauuagug

SEQ ID NO: 611431 - RNA, 64 nt, hsa
guguuauuucuugacuuuuguacuauuaaaaaacuguagccagugaggcuucuacccuuaguac

SEQ ID NO: 611432 - RNA, 63 nt, hsa
ggacuggguucucaagacacgaccagguucucaagacacgaguccccuuguuccuccccauua

SEQ ID NO: 611433 - RNA, 63 nt, hsa
cagaggccugauucuguuuggacuggguucucaagacacgaccagguucucaagacacgaguc

SEQ ID NO: 611434 - RNA, 64 nt, hsa; identical to SEQ ID NO: 340884

SEQ ID NO: 611435 - RNA, 64 nt, hsa; identical to SEQ ID NO: 340885

SEQ ID NO: 611436 - RNA, 64 nt, hsa
cauuuacagcccucagcaaugugccuucuaaauggcaugacauauguagaugugcugcagcgcu

SEQ ID NO: 611437 - RNA, 64 nt, hsa
uuuuuuaauauuagugccguuaucauggagaacagcaugacagcugucuuuggcagucugucau

SEQ ID NO: 611438 - RNA, 56 nt, hsa
aacuuucauucacuucauagaacccagcaugacauaacagugcagggcaaaauauu

SEQ ID NO: 611439 - RNA, 64 nt, hsa
ccugcugcccuuaggccacaugggagcaguccaugcaugacagccucuauccuacaaggccuau

SEQ ID NO: 611440 - RNA, 64 nt, hsa; identical to SEQ ID NO: 395564

SEQ ID NO: 611441 - RNA, 64 nt, hsa; identical to SEQ ID NO: 395565

SEQ ID NO: 611442 - RNA, 64 nt, hsa; identical to SEQ ID NO: 395566

SEQ ID NO: 611443 - RNA, 64 nt, hsa; identical to SEQ ID NO: 395567

SEQ ID NO: 611444 - RNA, 64 nt, hsa; identical to SEQ ID NO: 395568

SEQ ID NO: 611445 - RNA, 64 nt, hsa; identical to SEQ ID NO: 395569

SEQ ID NO: 611446 - RNA, 64 nt, hsa; identical to SEQ ID NO: 395570

SEQ ID NO: 611447 - RNA, 64 nt, hsa; identical to SEQ ID NO: 395571

SEQ ID NO: 611448 - RNA, 64 nt, hsa; identical to SEQ ID NO: 395572

SEQ ID NO: 611449 - RNA, 64 nt, hsa; identical to SEQ ID NO: 395573

SEQ ID NO: 611450 - RNA, 64 nt, hsa; identical to SEQ ID NO: 395574

SEQ ID NO: 611451 - RNA, 64 nt, hsa; identical to SEQ ID NO: 395575

SEQ ID NO: 611452 - RNA, 64 nt, hsa; identical to SEQ ID NO: 395576

SEQ ID NO: 611453 - RNA, 64 nt, hsa; identical to SEQ ID NO: 395577

SEQ ID NO: 611454 - RNA, 64 nt, hsa; identical to SEQ ID NO: 395578

SEQ ID NO: 611455 - RNA, 64 nt, hsa; identical to SEQ ID NO: 395579

SEQ ID NO: 611456 - RNA, 64 nt, hsa; identical to SEQ ID NO: 395580

SEQ ID NO: 611457 - RNA, 64 nt, hsa; identical to SEQ ID NO: 395581

SEQ ID NO: 611458 - RNA, 64 nt, hsa; identical to SEQ ID NO: 395582

SEQ ID NO: 611459 - RNA, 64 nt, hsa; identical to SEQ ID NO: 395583

SEQ ID NO: 611460 - RNA, 64 nt, hsa; identical to SEQ ID NO: 395584

SEQ ID NO: 611461 - RNA, 64 nt, hsa; identical to SEQ ID NO: 395585

SEQ ID NO: 611462 - RNA, 64 nt, hsa; identical to SEQ ID NO: 395586

SEQ ID NO: 611463 - RNA, 64 nt, hsa; identical to SEQ ID NO: 395587

SEQ ID NO: 611464 - RNA, 64 nt, hsa; identical to SEQ ID NO: 395588

SEQ ID NO: 611465 - RNA, 64 nt, hsa; identical to SEQ ID NO: 395589

SEQ ID NO: 611466 - RNA, 64 nt, hsa; identical to SEQ ID NO: 395590

SEQ ID NO: 611467 - RNA, 64 nt, hsa; identical to SEQ ID NO: 395591

SEQ ID NO: 611468 - RNA, 64 nt, hsa; identical to SEQ ID NO: 395592

SEQ ID NO: 611469 - RNA, 64 nt, hsa; identical to SEQ ID NO: 395593

SEQ ID NO: 611470 - RNA, 64 nt, hsa; identical to SEQ ID NO: 395594

SEQ ID NO: 611471 - RNA, 64 nt, hsa; identical to SEQ ID NO: 395595

SEQ ID NO: 611472 - RNA, 64 nt, hsa; identical to SEQ ID NO: 395596

SEQ ID NO: 611473 - RNA, 64 nt, hsa; identical to SEQ ID NO: 395597

SEQ ID NO: 611474 - RNA, 64 nt, hsa; identical to SEQ ID NO: 395598

SEQ ID NO: 611475 - RNA, 64 nt, hsa; identical to SEQ ID NO: 395599

SEQ ID NO: 611476 - RNA, 64 nt, hsa; identical to SEQ ID NO: 395600

SEQ ID NO: 611477 - RNA, 64 nt, hsa; identical to SEQ ID NO: 395601

SEQ ID NO: 611478 - RNA, 64 nt, hsa; identical to SEQ ID NO: 395602

SEQ ID NO: 611479 - RNA, 64 nt, hsa; identical to SEQ ID NO: 395603

SEQ ID NO: 611480 - RNA, 64 nt, hsa; identical to SEQ ID NO: 143366

SEQ ID NO: 611481 - RNA, 64 nt, hsa; identical to SEQ ID NO: 143367

SEQ ID NO: 611482 - RNA, 64 nt, hsa; identical to SEQ ID NO: 143368

SEQ ID NO: 611483 - RNA, 64 nt, hsa; identical to SEQ ID NO: 143369

SEQ ID NO: 611484 - RNA, 64 nt, hsa
ucaggcagugcaguacucaguaagacagugcagugcucaguaaggcagugcaauacucaguaac

SEQ ID NO: 611485 - RNA, 64 nt, hsa
uaaggcaguaugguacucaguaaagcaaugcaaugcucaguaacacagugcagugcucaauaag

SEQ ID NO: 611486 - RNA, 64 nt, hsa
uaacacagugcagugcucaauaaggcagugcagugcucaguaaggcagugaauugcuuaguaac

SEQ ID NO: 611487 - RNA, 64 nt, hsa
uaaggcagugaauugcuuaguaacacaguguagugcucaguaggacagcauaguacucaguaac

SEQ ID NO: 611488 - RNA, 64 nt, hsa
uggggcccuggugucagaacuccccaaaggccugugcguccaaguggagucagguuuucuauuc

SEQ ID NO: 611489 - RNA, 64 nt, hsa
agggccaagccccgcugccuuccccaggccacagugcguccagucuccuguccugccacguguc

SEQ ID NO: 611490 - RNA, 64 nt, hsa; identical to SEQ ID NO: 284354

SEQ ID NO: 611491 - RNA, 64 nt, hsa; identical to SEQ ID NO: 284355

SEQ ID NO: 611492 - RNA, 64 nt, hsa; identical to SEQ ID NO: 284356

SEQ ID NO: 611493 - RNA, 64 nt, hsa; identical to SEQ ID NO: 284357

SEQ ID NO: 611494 - RNA, 64 nt, hsa; identical to SEQ ID NO: 284358

SEQ ID NO: 611495 - RNA, 64 nt, hsa; identical to SEQ ID NO: 284359

SEQ ID NO: 611496 - RNA, 64 nt, hsa; identical to SEQ ID NO: 284360

SEQ ID NO: 611497 - RNA, 64 nt, hsa; identical to SEQ ID NO: 284361

SEQ ID NO: 611498 - RNA, 64 nt, hsa; identical to SEQ ID NO: 284362

SEQ ID NO: 611499 - RNA, 64 nt, hsa; identical to SEQ ID NO: 284363

SEQ ID NO: 611500 - RNA, 64 nt, hsa; identical to SEQ ID NO: 284364

SEQ ID NO: 611501 - RNA, 64 nt, hsa; identical to SEQ ID NO: 284365

SEQ ID NO: 611502 - RNA, 64 nt, hsa; identical to SEQ ID NO: 284366

SEQ ID NO: 611503 - RNA, 64 nt, hsa; identical to SEQ ID NO: 284367

SEQ ID NO: 611504 - RNA, 64 nt, hsa; identical to SEQ ID NO: 284368

SEQ ID NO: 611505 - RNA, 64 nt, hsa; identical to SEQ ID NO: 284369

SEQ ID NO: 611506 - RNA, 64 nt, hsa; identical to SEQ ID NO: 284370

SEQ ID NO: 611507 - RNA, 64 nt, hsa; identical to SEQ ID NO: 284371

SEQ ID NO: 611508 - RNA, 64 nt, hsa; identical to SEQ ID NO: 284372

SEQ ID NO: 611509 - RNA, 64 nt, hsa; identical to SEQ ID NO: 284373

SEQ ID NO: 611510 - RNA, 64 nt, hsa; identical to SEQ ID NO: 284374

SEQ ID NO: 611511 - RNA, 59 nt, hsa; identical to SEQ ID NO: 284375

SEQ ID NO: 611512 - RNA, 64 nt, hsa; identical to SEQ ID NO: 284376

SEQ ID NO: 611513 - RNA, 64 nt, hsa; identical to SEQ ID NO: 284377

SEQ ID NO: 611514 - RNA, 64 nt, hsa; identical to SEQ ID NO: 284378

SEQ ID NO: 611515 - RNA, 64 nt, hsa; identical to SEQ ID NO: 284379

SEQ ID NO: 611516 - RNA, 64 nt, hsa; identical to SEQ ID NO: 219912

SEQ ID NO: 611517 - RNA, 64 nt, hsa; identical to SEQ ID NO: 219913

SEQ ID NO: 611518 - RNA, 64 nt, hsa; identical to SEQ ID NO: 219914

SEQ ID NO: 611519 - RNA, 64 nt, hsa; identical to SEQ ID NO: 219915

SEQ ID NO: 611520 - RNA, 64 nt, hsa; identical to SEQ ID NO: 219916

SEQ ID NO: 611521 - RNA, 64 nt, hsa; identical to SEQ ID NO: 219917

SEQ ID NO: 611522 - RNA, 64 nt, hsa; identical to SEQ ID NO: 219918

SEQ ID NO: 611523 - RNA, 64 nt, hsa; identical to SEQ ID NO: 219919

SEQ ID NO: 611524 - RNA, 64 nt, hsa; identical to SEQ ID NO: 219920

SEQ ID NO: 611525 - RNA, 64 nt, hsa; identical to SEQ ID NO: 219921

SEQ ID NO: 611526 - RNA, 64 nt, hsa; identical to SEQ ID NO: 219922

SEQ ID NO: 611527 - RNA, 64 nt, hsa; identical to SEQ ID NO: 219923

SEQ ID NO: 611528 - RNA, 64 nt, hsa; identical to SEQ ID NO: 219924

SEQ ID NO: 611529 - RNA, 64 nt, hsa; identical to SEQ ID NO: 219925

SEQ ID NO: 611530 - RNA, 64 nt, hsa; identical to SEQ ID NO: 219926

SEQ ID NO: 611531 - RNA, 64 nt, hsa; identical to SEQ ID NO: 219927

SEQ ID NO: 611532 - RNA, 64 nt, hsa; identical to SEQ ID NO: 219928

SEQ ID NO: 611533 - RNA, 64 nt, hsa; identical to SEQ ID NO: 219929

SEQ ID NO: 611534 - RNA, 64 nt, hsa; identical to SEQ ID NO: 219930

SEQ ID NO: 611535 - RNA, 64 nt, hsa; identical to SEQ ID NO: 219931

SEQ ID NO: 611536 - RNA, 64 nt, hsa; identical to SEQ ID NO: 219932

SEQ ID NO: 611537 - RNA, 64 nt, hsa; identical to SEQ ID NO: 219933

SEQ ID NO: 611538 - RNA, 53 nt, hsa; identical to SEQ ID NO: 168469

SEQ ID NO: 611539 - RNA, 64 nt, hsa; identical to SEQ ID NO: 219935

SEQ ID NO: 611540 - RNA, 64 nt, hsa; identical to SEQ ID NO: 219936

SEQ ID NO: 611541 - RNA, 64 nt, hsa; identical to SEQ ID NO: 219937

SEQ ID NO: 611542 - RNA, 64 nt, hsa; identical to SEQ ID NO: 219938

SEQ ID NO: 611543 - RNA, 64 nt, hsa; identical to SEQ ID NO: 219939

SEQ ID NO: 611544 - RNA, 64 nt, hsa; identical to SEQ ID NO: 219940

SEQ ID NO: 611545 - RNA, 64 nt, hsa; identical to SEQ ID NO: 219941

SEQ ID NO: 611546 - RNA, 64 nt, hsa; identical to SEQ ID NO: 219942

SEQ ID NO: 611547 - RNA, 64 nt, hsa; identical to SEQ ID NO: 219943

SEQ ID NO: 611548 - RNA, 64 nt, hsa; identical to SEQ ID NO: 219944

SEQ ID NO: 611549 - RNA, 64 nt, hsa; identical to SEQ ID NO: 219945

SEQ ID NO: 611550 - RNA, 64 nt, hsa; identical to SEQ ID NO: 219946

SEQ ID NO: 611551 - RNA, 64 nt, hsa; identical to SEQ ID NO: 219947

SEQ ID NO: 611552 - RNA, 64 nt, hsa; identical to SEQ ID NO: 219948

SEQ ID NO: 611553 - RNA, 64 nt, hsa; identical to SEQ ID NO: 219949

SEQ ID NO: 611554 - RNA, 64 nt, hsa; identical to SEQ ID NO: 219950

SEQ ID NO: 611555 - RNA, 64 nt, hsa; identical to SEQ ID NO: 219951

SEQ ID NO: 611556 - RNA, 64 nt, hsa; identical to SEQ ID NO: 219952

SEQ ID NO: 611557 - RNA, 64 nt, hsa; identical to SEQ ID NO: 219953

SEQ ID NO: 611558 - RNA, 64 nt, hsa; identical to SEQ ID NO: 219954

SEQ ID NO: 611559 - RNA, 64 nt, hsa; identical to SEQ ID NO: 219955

SEQ ID NO: 611560 - RNA, 64 nt, hsa; identical to SEQ ID NO: 219956

SEQ ID NO: 611561 - RNA, 64 nt, hsa; identical to SEQ ID NO: 219957

SEQ ID NO: 611562 - RNA, 64 nt, hsa; identical to SEQ ID NO: 219958

SEQ ID NO: 611563 - RNA, 64 nt, hsa; identical to SEQ ID NO: 219959

SEQ ID NO: 611564 - RNA, 64 nt, hsa; identical to SEQ ID NO: 219960

SEQ ID NO: 611565 - RNA, 64 nt, hsa; identical to SEQ ID NO: 219961

SEQ ID NO: 611566 - RNA, 64 nt, hsa; identical to SEQ ID NO: 219962

SEQ ID NO: 611567 - RNA, 64 nt, hsa; identical to SEQ ID NO: 219963

SEQ ID NO: 611568 - RNA, 64 nt, hsa; identical to SEQ ID NO: 219964

SEQ ID NO: 611569 - RNA, 64 nt, hsa; identical to SEQ ID NO: 219965

SEQ ID NO: 611570 - RNA, 64 nt, hsa; identical to SEQ ID NO: 219966

SEQ ID NO: 611571 - RNA, 64 nt, hsa; identical to SEQ ID NO: 219967

SEQ ID NO: 611572 - RNA, 64 nt, hsa; identical to SEQ ID NO: 219968

SEQ ID NO: 611573 - RNA, 64 nt, hsa; identical to SEQ ID NO: 219969

SEQ ID NO: 611574 - RNA, 64 nt, hsa; identical to SEQ ID NO: 219970

SEQ ID NO: 611575 - RNA, 64 nt, hsa; identical to SEQ ID NO: 219971

SEQ ID NO: 611576 - RNA, 64 nt, hsa; identical to SEQ ID NO: 74808

SEQ ID NO: 611577 - RNA, 64 nt, hsa; identical to SEQ ID NO: 74809

SEQ ID NO: 611578 - RNA, 64 nt, hsa; identical to SEQ ID NO: 74810

SEQ ID NO: 611579 - RNA, 64 nt, hsa; identical to SEQ ID NO: 74811

SEQ ID NO: 611580 - RNA, 64 nt, hsa; identical to SEQ ID NO: 74812

SEQ ID NO: 611581 - RNA, 64 nt, hsa; identical to SEQ ID NO: 74813

SEQ ID NO: 611582 - RNA, 64 nt, hsa; identical to SEQ ID NO: 74814

SEQ ID NO: 611583 - RNA, 64 nt, hsa; identical to SEQ ID NO: 74815

SEQ ID NO: 611584 - RNA, 64 nt, hsa; identical to SEQ ID NO: 74816

SEQ ID NO: 611585 - RNA, 64 nt, hsa; identical to SEQ ID NO: 74817

SEQ ID NO: 611586 - RNA, 64 nt, hsa; identical to SEQ ID NO: 74818

SEQ ID NO: 611587 - RNA, 64 nt, hsa; identical to SEQ ID NO: 74819

SEQ ID NO: 611588 - RNA, 64 nt, hsa; identical to SEQ ID NO: 74820

SEQ ID NO: 611589 - RNA, 64 nt, hsa; identical to SEQ ID NO: 74821

SEQ ID NO: 611590 - RNA, 64 nt, hsa; identical to SEQ ID NO: 74822

SEQ ID NO: 611591 - RNA, 64 nt, hsa; identical to SEQ ID NO: 74823

SEQ ID NO: 611592 - RNA, 64 nt, hsa; identical to SEQ ID NO: 74824

SEQ ID NO: 611593 - RNA, 64 nt, hsa; identical to SEQ ID NO: 74825

SEQ ID NO: 611594 - RNA, 64 nt, hsa; identical to SEQ ID NO: 74826

SEQ ID NO: 611595 - RNA, 64 nt, hsa; identical to SEQ ID NO: 74827

SEQ ID NO: 611596 - RNA, 64 nt, hsa; identical to SEQ ID NO: 74828

SEQ ID NO: 611597 - RNA, 64 nt, hsa; identical to SEQ ID NO: 74829

SEQ ID NO: 611598 - RNA, 64 nt, hsa; identical to SEQ ID NO: 74830

SEQ ID NO: 611599 - RNA, 64 nt, hsa; identical to SEQ ID NO: 74831

SEQ ID NO: 611600 - RNA, 64 nt, hsa; identical to SEQ ID NO: 74832

SEQ ID NO: 611601 - RNA, 64 nt, hsa; identical to SEQ ID NO: 74833

SEQ ID NO: 611602 - RNA, 64 nt, hsa; identical to SEQ ID NO: 74834

SEQ ID NO: 611603 - RNA, 64 nt, hsa; identical to SEQ ID NO: 74835

SEQ ID NO: 611604 - RNA, 64 nt, hsa; identical to SEQ ID NO: 74836

SEQ ID NO: 611605 - RNA, 64 nt, hsa
uuuuuccuuucaacuuaguugacauacgugccuuaaaaaggaaaacuaguguugcuauugugca

SEQ ID NO: 611606 - RNA, 64 nt, hsa
ggaaaacuaguguugcuauugugcauuuacuagaaaaaaggaauugguuguuuagggcacacug

SEQ ID NO: 611607 - RNA, 64 nt, hsa
caauuugcacuguguucauauuaauccucuuuuaaaaaaggaaauauacagaagacaaacauug

SEQ ID NO: 611608 - RNA, 64 nt, hsa
gcuugagugacagagcaagacuguaucucaaaggaaaaaggaaacuaggccaggcgugguggcu

SEQ ID NO: 611609 - RNA, 64 nt, hsa
cagcaaugcugaauuuucuucuacuuggucaucaaaaaaggaguguaauagaagugaggggagc

SEQ ID NO: 611610 - RNA, 64 nt, hsa
ccucccagcuuucuucuucuuuuuuuuuuucugaaaaaaggaaaaagcacacagcacacaauuu

SEQ ID NO: 611611 - RNA, 64 nt, hsa
uuguuaagggaccaagaaucaaguacaaaaaauuaaaaaggaacuguaaaaucccuuggucauu

SEQ ID NO: 611612 - RNA, 64 nt, hsa
ugcuugccucgcugauguugcaugggcagacuucaaaaaggauaguuagaaagguuuggguuga

SEQ ID NO: 611613 - RNA, 64 nt, hsa
uuaacaaaaaaaaaaagcuuuaaaaaaaaaagaaaaaaaggaaaagguuuuuagcucauuugcc

SEQ ID NO: 611614 - RNA, 64 nt, hsa
gcaagugguugcuccaggauuacucccuccuccaaaaaaggaaucaaauccacgaguggaaaag

SEQ ID NO: 611615 - RNA, 64 nt, hsa
cuuaaaaaaaaaaaaaaaggaaaaaggaaaaaaaaaaaaggaaaaccagaagcccugcugucug

SEQ ID NO: 611616 - RNA, 64 nt, hsa
cucuaugcuuucuucuuaaaaaaaaaaaaaaaggaaaaaggaaaaaaaaaaaaggaaaaccaga

SEQ ID NO: 611617 - RNA, 64 nt, hsa
aaucaaccucuaugcuuucuucuuaaaaaaaaaaaaaaaggaaaaaggaaaaaaaaaaaaggaa

SEQ ID NO: 611618 - RNA, 64 nt, hsa
uucacauaguccauaucaccacaaaucacacaacaaaaaggagaagagauauuuuggguugaaa

SEQ ID NO: 611619 - RNA, 64 nt, hsa
guaccuuggcuuggcucuugacguggacagaauuaaaaaggaccaagaagaggaagaagaccaa

SEQ ID NO: 611620 - RNA, 64 nt, hsa
gagaaaaaggagaaaagggaaaagcagaaaggaaaaaaaggaagagagaggaagggagaaggga

SEQ ID NO: 611621 - RNA, 64 nt, hsa
ggucacauagguagaugguaaagagaaugaggagaaaaaggagaaaagggaaaagcagaaagga

SEQ ID NO: 611622 - RNA, 64 nt, hsa
gcagcuugguagccuaguacagguuguuuuuuuaaaaaaggaaaagcaggaaggaggagugaau

SEQ ID NO: 611623 - RNA, 64 nt, hsa
uccuuuuggaaaacuuguauuaccauggguuuggaaaaaggacaacgaaaggcuuuucauguaa

SEQ ID NO: 611624 - RNA, 64 nt, hsa
ugagaaggauucuuuuucgaauauaaccagaggaaaaaaggauggagaaauaucuaggaaaggu

SEQ ID NO: 611625 - RNA, 64 nt, hsa
ugagaaggauucuuuuucgaauauaaccagagaaaaaaaggauggagaaauaucuaggaaaggu

SEQ ID NO: 611626 - RNA, 64 nt, hsa
ugaugauuaacaguaugucaccacuucauuuuuuaaaaaggaucacgucuaaugcccauuuucc

SEQ ID NO: 611627 - RNA, 64 nt, hsa
guguuaaaaugcuucucccugaaaaagagaaaaaaaaaaggaaaaaaagaaaagaaaagugaaa

SEQ ID NO: 611628 - RNA, 64 nt, hsa
agcuugauggugauuguauuguauuccuuuaaucaaaaaggaaacacaauauucuaaguaucuu

SEQ ID NO: 611629 - RNA, 64 nt, hsa
aucuagagacauuuuuauuuaugaauauuuauacaaaaaggaauucugucaagaugacugcucu

SEQ ID NO: 611630 - RNA, 56 nt, hsa
agaccgacgaggaugacuagacagcaaaaaaggaaaaguuaaacuaaaaaaaaaaa

SEQ ID NO: 611631 - RNA, 64 nt, hsa
uccaaggcccugcuuuuuuucuuaaaaguacuuuaaaaaggaaauuuguuuguauuuuuuauuu

SEQ ID NO: 611632 - RNA, 64 nt, hsa
acaauaccuugcagaggaaaggugggagagaggaaaaaaggaaauucuauagaaaucuauauau

SEQ ID NO: 611633 - RNA, 64 nt, hsa
ugaggauggagagaaguaucagcacccagaagagaaaaaggaauuuaaaacaaaaaccacagag

SEQ ID NO: 611634 - RNA, 64 nt, hsa
uguuaagugacugagaagauguuaauuacuuuugaaaaaggaucaugguuuuugcucuacuuua

SEQ ID NO: 611635 - RNA, 64 nt, hsa
ucccuauacuucacacugaacucaggaugggaagaaaaaggaaacaagcuuuggcuuuuuccau

SEQ ID NO: 611636 - RNA, 64 nt, hsa
gagccuuaccaauaauaagagcccugagcccagaaaaaaggacuguauaguuuaaagggaggau

SEQ ID NO: 611637 - RNA, 64 nt, hsa
cuugcccaacggcauauggaguguccuuauugcuaaaaaggauuccgucuccuucaaagaaguu

SEQ ID NO: 611638 - RNA, 64 nt, hsa
aagcuguuauaaauauauauuauauaaauauauuaaaaaggaaaauguuucagauguuuauuug

SEQ ID NO: 611639 - RNA, 64 nt, hsa
gcagagggcgguucuuuuuuuagauauuguuccuaaaaaggaauaaaugcauacaccuguuugu

SEQ ID NO: 611640 - RNA, 64 nt, hsa
ugggaguauuuuugauuuuucuacuuuuuguugaaaaaaggaauuuguacucugugcauuggau

SEQ ID NO: 611641 - RNA, 64 nt, hsa
aucggggcgggccaaccccgagaaugaagauuggaaaaaggaaaaaaaaaaaaacacgucaaaa

SEQ ID NO: 611642 - RNA, 64 nt, hsa
auucaugccccccaaagggugguauuaaaagaggaaaaaggacauaguagugguaguaaagaaa

SEQ ID NO: 611643 - RNA, 64 nt, hsa
agaggaaaaaggacauaguagugguaguaaagaaaaaaaggagaucuaacaaaaacacuugaau

SEQ ID NO: 611644 - RNA, 64 nt, hsa
agaaauggcaagagauaccuucaagaaguuaacaaaaaaggaauggauuucuuccaugguaaua

SEQ ID NO: 611645 - RNA, 64 nt, hsa
agcauacaugcuuaugcaugaaacaauucugcaaaaaaaggaugaauuuccuccaucacccaga

SEQ ID NO: 611646 - RNA, 64 nt, hsa
acagagugagacccugucucaaaaaaaaaaaaaaaaaaaggagagaagaaaauaaagaaggcua

SEQ ID NO: 611647 - RNA, 52 nt, hsa
cauccaagacuggacucugaaaaaaaaggaauuauacaaaggaacauaaaga

SEQ ID NO: 611648 - RNA, 64 nt, hsa
gguuaaaaugacuguuuucucucucuauggaaauaaaaaggaaaaaaaaaaaggaaacuuuuuu

SEQ ID NO: 611649 - RNA, 64 nt, hsa
guuuucucucucuauggaaauaaaaaggaaaaaaaaaaaggaaacuuuuuuuguuugcucuugc

SEQ ID NO: 611650 - RNA, 64 nt, hsa
auccaaaagugcagcaggagaacucuuuucccugaaaaaggaaaaauauugaacucaaugauag

SEQ ID NO: 611651 - RNA, 64 nt, hsa
auacggucaguuaugucaauguuucauggucaauaaaaaggaaguugcaaauugugauuuaagc

SEQ ID NO: 611652 - RNA, 64 nt, hsa
aaucaugguuucaugagcauuaaaaagcaaagggaaaaaggauguguaaugguguacacagucu

SEQ ID NO: 611653 - RNA, 64 nt, hsa
aaagcuuuacuacucuuagaggacacaugccuuaaaaaaggaggggaggaaccacgcugccacc

SEQ ID NO: 611654 - RNA, 64 nt, hsa
gcacaaucucuuauacuagugggacaaaagggagaaaaaggaagcaagauaaauggguauguag

SEQ ID NO: 611655 - RNA, 64 nt, hsa
cauugauacuuuaaaagccaaggugcccauauggaaaaaggaaauauacgaagagucaucaacu

SEQ ID NO: 611656 - RNA, 64 nt, hsa
uucgcuaauauuuuaaacaguccuguaaaaaaccaaaaaggacuuuuuguauagaaagcacuac

SEQ ID NO: 611657 - RNA, 64 nt, hsa
ccugcaggcauaucauuggcguauggcacucauuaaaaaggaucagagaccauuaaaagaggac

SEQ ID NO: 611658 - RNA, 64 nt, hsa
aauagcauccuuaagauuuaaaaaaaaaaaaaaaaaaaaggaaaaaaaagugauggaagccgua

SEQ ID NO: 611659 - RNA, 64 nt, hsa
ucaucuugucuauuuuuucucuucauguuguaacaaaaaggaaaaaagaaaaaaaaaucccauc

SEQ ID NO: 611660 - RNA, 64 nt, hsa
aucugaaaacuaauaccuggaaaaggauaaaaaaaaaaaggaauccgugacccacagagcuaga

SEQ ID NO: 611661 - RNA, 64 nt, hsa
aaaugcucuuuucccuauaaccucuuuucucaccaaaaaggagauaaauuugaaaacagauaaa

SEQ ID NO: 611662 - RNA, 64 nt, hsa
cuaggaccaucuaugugucuccccuccccuccacaaaaaggagaaagagugcauuaaaauguuu

SEQ ID NO: 611663 - RNA, 64 nt, hsa
ccaguuaggauagaauguguuucuuucugguuaaaaaaaggaaaaaccaucuaagaaaauauau

SEQ ID NO: 611664 - RNA, 64 nt, hsa
gagaugaauagaagaaagaaaauggaaagaaggaaaaaaggaggauagaaaaaggauggaagaa

SEQ ID NO: 611665 - RNA, 64 nt, hsa
aaagaaaauggaaagaaggaaaaaaggaggauagaaaaaggauggaagaaagaagcauugaaaa

SEQ ID NO: 611666 - RNA, 64 nt, hsa
agcuuucauaagaaaucccauggcaaaggguaauaaaaaggaccuaaucuuaaaaauacaauuu

SEQ ID NO: 611667 - RNA, 64 nt, hsa
cuagcaguaaaagaugaaguuuuauacacacagcaaaaaggagaaaaaauucuaguauauuuua

SEQ ID NO: 611668 - RNA, 64 nt, hsa
acacuuuuggauuaggguacaauauuagagcucuaaaaaggaauaguagaauaacuuagcucag

SEQ ID NO: 611669 - RNA, 64 nt, hsa
uaucuuuugguuaggggacaauauuagagcuuuuaaaaaggaaggguagacucacuuagcucag

SEQ ID NO: 611670 - RNA, 64 nt, hsa
cuucaaggacuguuucagugugagucagaaugugaaaaaggaauaaaaaauacuguugggcuca

SEQ ID NO: 611671 - RNA, 64 nt, hsa
agcacauguauugacaacaguuuuauaauuuaauaaaaaggaauacauugcaauccguaauuuu

SEQ ID NO: 611672 - RNA, 64 nt, hsa
auaaaccaggauccauuuagguaccacuugauauaaaaaggauauccauaaugaauauuuuaua

SEQ ID NO: 611673 - RNA, 64 nt, hsa
uuguuuaagaacuauuuuaaaguguuccagacccaaaaaggaaaaauaaaaaaaaaggaauauu

SEQ ID NO: 611674 - RNA, 64 nt, hsa
uaaaguguuccagacccaaaaaggaaaaauaaaaaaaaaggaauauuuguacccaacagcuaga

SEQ ID NO: 611675 - RNA, 64 nt, hsa
aagcacuuuuggacaaugcuaucccagcaggaaaaaaaaggauaauauaacuguuuuaaaacuc

SEQ ID NO: 611676 - RNA, 64 nt, hsa
uguuuauuaacucuccuuuauucuauauggaaauaaaaaggaggcagucauguuagcaaaugac

SEQ ID NO: 611677 - RNA, 64 nt, hsa
aaaaagaaaaaaugaaaaaaaaaggaaaaaaagaaaaaaggaaaaaaacaguuugaacacaaag

SEQ ID NO: 611678 - RNA, 64 nt, hsa
caguuugaaaucuuaaaaaaagaaaaaaugaaaaaaaaaggaaaaaaagaaaaaaggaaaaaaa

SEQ ID NO: 611679 - RNA, 64 nt, hsa
acaauaguuuaagaaauuuuuuuuuuaaauaaaaaaaaaggaaaagaggaagacuggacaaaac

SEQ ID NO: 611680 - RNA, 64 nt, hsa
gcauuucauugagaauuaugauguuauaaaaaggaaaaaggaagaaugucgucuacugcagucu

SEQ ID NO: 611681 - RNA, 64 nt, hsa
ugccaaagcauuucauugagaauuaugauguuauaaaaaggaaaaaggaagaaugucgucuacu

SEQ ID NO: 611682 - RNA, 64 nt, hsa
caaaagugcauuauuuaguuugagcucuguagguaaaaaggaggugggaaaaauuuuaaaacuu

SEQ ID NO: 611683 - RNA, 64 nt, hsa
guugaaaaaauaucauuugacuuuuuauagaaaaaaaaaggaaaaaauaauugagaaaguguuc

SEQ ID NO: 611684 - RNA, 64 nt, hsa
gagggccaaaacaggagcagguaacgaaccguaaaaaaaggagcagguaaugaaucguaaccaa

SEQ ID NO: 611685 - RNA, 64 nt, hsa
ggugugacaucagaguauuugaccugcaguauugaaaaaggagaauucagaaugauacaguauu

SEQ ID NO: 611686 - RNA, 64 nt, hsa
uuuugcaaacugcagcagaaaucgaauuuaaaacaaaaaggagggacuuuaaaauaccuucuug

SEQ ID NO: 611687 - RNA, 64 nt, hsa
agagggccaaggagguaugagccaucagacuggaaaaaaggaugacuauaugaugaggagaaac

SEQ ID NO: 611688 - RNA, 64 nt, hsa
acuaaugcccagcauuccucaaggucagccagacaaaaaggaacuuaggucuugggcagaggag

SEQ ID NO: 611689 - RNA, 64 nt, hsa
cugguugugauggagaagugacuuugcuuuaagaaaaaaggaggcaagguagggagagcgccca

SEQ ID NO: 611690 - RNA, 64 nt, hsa
uagagaaggggaaacuccuugaauuucuagguuuaaaaaggaacuuuuaaauuccuuaauguua

SEQ ID NO: 611691 - RNA, 64 nt, hsa
uuccuuaaacuucuuaguguuucugaaacuucuaaaaaaggauucaguuaauuuauaauguuua

SEQ ID NO: 611692 - RNA, 64 nt, hsa
uucugaauaagaugauagacgagaauuuuuuuuaaaaaaggaauuuaaaggaaucuugugcaac

SEQ ID NO: 611693 - RNA, 64 nt, hsa
aauagguguugccuauugcugugcuuauaaaaugaaaaaggaaauugaggacacuuuugcaaau

SEQ ID NO: 611694 - RNA, 64 nt, hsa
uuguaucuggggaaaaaaaacuuuuuuuuaaauuaaaaaggaaaauaaaagauauugaggucuu

SEQ ID NO: 611695 - RNA, 64 nt, hsa
uccuguuucuaaacuuucgcuacuauaaaaccaaaaaaaggaauugagauuucaccaaccccag

SEQ ID NO: 611696 - RNA, 64 nt, hsa
aaauauuuuuuucuuucucauuuuauguugaacuaaaaaggauuaaaaaaaaaaucuccagacu

SEQ ID NO: 611697 - RNA, 64 nt, hsa
uggcaucuuucauucucauuuuauauugugcuauaaaaaggauuguuucuccauauauauauua

SEQ ID NO: 611698 - RNA, 64 nt, hsa
ucccuuuguucucuguuuaaaaaaaucuaaaaagaaaaaggaaaaaaaaaaaagaacugcugug

SEQ ID NO: 611699 - RNA, 64 nt, hsa
gaaauagaagcauuaaauauuuuuaucuauauccaaaaaggagcacauuuuuauauuuacaaaa

SEQ ID NO: 611700 - RNA, 64 nt, hsa
accagagaacagcuccccuagacauggccucuggaaaaaggaaaucuuugguggccaaagauuu

SEQ ID NO: 611701 - RNA, 64 nt, hsa
uagccucuauugcccagauuggagucagaggucaaaaaaggauuccaagugauggaacuccagg

SEQ ID NO: 611702 - RNA, 64 nt, hsa
ugucucaggauagcacaggccaagguaggggaguaaaaaggaggucaggcaaaagggaggaguu

SEQ ID NO: 611703 - RNA, 64 nt, hsa
acugcugauuuaccgauguauuuaauguaaguaaaaaaaggaaaaaaagaaaagggcauuggag

SEQ ID NO: 611704 - RNA, 64 nt, hsa
ugaugcuuaaagagaaaagaaaaaaagagagaagaaaaaggagagaugaaaaaggaggaugagg

SEQ ID NO: 611705 - RNA, 64 nt, hsa
aaaagaaaaaaagagagaagaaaaaggagagaugaaaaaggaggaugaggagaagaauuaccuu

SEQ ID NO: 611706 - RNA, 64 nt, hsa
ugauuggggggaaaaacuggugaaaaagaaauauaaaaaggacccuaaaaagaauucugcaaaa

SEQ ID NO: 611707 - RNA, 64 nt, hsa
uccuugaggauagggauagguaagguaaacuuguaaaaaggaugucacagaagucacuuuuuaa

SEQ ID NO: 611708 - RNA, 64 nt, hsa
uucauuugcaaauugcaauaaaacacauuuuagaaaaaaggaaccuucaauuauuagcuuuguu

SEQ ID NO: 611709 - RNA, 64 nt, hsa
aguccacucgcuuggauuucugacacaguuuacaaaaaaggaaaaaggcacugcuccuauuuuc

SEQ ID NO: 611710 - RNA, 64 nt, hsa
aggaaaaaugcagcuuucaaaucauuggggggagaaaaaggaugucuuucaggauuauuuuaau

SEQ ID NO: 611711 - RNA, 64 nt, hsa
ugcuguaaaacaaaacaaaacaaaauaaaacaaaaaaaaggaaggaaaaaaaaagaaaaaauuu

SEQ ID NO: 611712 - RNA, 64 nt, hsa
uuuauuacccccccacuaugcccucauuuuuuuaaaaaaggaaaaaaaaaagaaacuggguucc

SEQ ID NO: 611713 - RNA, 64 nt, hsa
aaaaauaaaaaaauaaauaaaaauaaaaaaaauaaaaaaggaaaaaaaaaaaagaagaaacaag

SEQ ID NO: 611714 - RNA, 64 nt, hsa
aauguauugugucugugcagaaaaaaaaaaaaccaaaaaggauugcuuuacuccaagaggagag

SEQ ID NO: 611715 - RNA, 64 nt, hsa
aacaacaaagaaggcagagccaggauauaacuagaaaaaggaugucuuuuuuuuuuuuuuuacu

SEQ ID NO: 611716 - RNA, 64 nt, hsa
gccccaagaaggcuggggcuauuuaccaggguagaaaaaggagcuuaccucccaccuuuggucc

SEQ ID NO: 611717 - RNA, 64 nt, hsa
uacucugucucccuauaaugcuggagcggcuacuaaaaaggauaaaauguaucacuuaaauguu

SEQ ID NO: 611718 - RNA, 64 nt, hsa
guaguccuauugagaagacauuucgucucugagaaaaaaggauggaacuauggguucucuucgc

SEQ ID NO: 611719 - RNA, 64 nt, hsa
uuaugcugguucucagcuguuuaaaaaaaaaaaaaaaaaggaauagaaacaguuucaaccagau

SEQ ID NO: 611720 - RNA, 64 nt, hsa
acugcagugcccaaggaauuucugcucugguuagaaaaaggacucugcuucaguccacuucugc

SEQ ID NO: 611721 - RNA, 64 nt, hsa
ggacucugcuucaguccacuucugcucugguuagaaaaaggacucugcuucaguccacaguaca

SEQ ID NO: 611722 - RNA, 64 nt, hsa
gcuccauccuaggcaacagagugauacgcuguuuaaaaaggaaaaaauccuucccuagagcuag

SEQ ID NO: 611723 - RNA, 64 nt, hsa
ugacagagugagacuccaucucaacagaaggaaaaaaaaggaaaauaggagaagguggaaaugg

SEQ ID NO: 611724 - RNA, 64 nt, hsa
uaucaguagaaugauuucauuuagauguauaaugaaaaaggauaaugcaaaaauuauguaauag

SEQ ID NO: 611725 - RNA, 64 nt, hsa
cugauagcauuugcuaacaggaccaggaggaucuaaaaaggaccagccuaauguagaagguggu

SEQ ID NO: 611726 - RNA, 64 nt, hsa
guaucggcaagcaguguaaacggaggacuuggggaaaaaggaccacauaguccaucgaagaaga

SEQ ID NO: 611727 - RNA, 64 nt, hsa
ucuuuaacucuuaaauuguuugguccuauuuuuuaaaaaggaaagggcccuaaguagcucagau

SEQ ID NO: 611728 - RNA, 64 nt, hsa
aaacuuacugcaaaguuuguuuauacuuuugccuaaaaaggaaauuggaugggauacuguggca

SEQ ID NO: 611729 - RNA, 64 nt, hsa
aguauaugccugaaaagguuuuggauucagaaagaaaaaggaugguuaguuuaaucagugauuc

SEQ ID NO: 611730 - RNA, 64 nt, hsa
agccccaaucuucccgucuuuaugagagaaaaggaaaaaggaaucaaagguggaagaaaaaaaa

SEQ ID NO: 611731 - RNA, 64 nt, hsa
ggaagaaaaaaaaagccaaauucuguuuacggugaaaaaggauuuuguuuuucacccaauuugg

SEQ ID NO: 611732 - RNA, 64 nt, hsa
gguccauccauacaauggaguauuacacagccauaaaaaggaaugaagcagugauccccacuac

SEQ ID NO: 611733 - RNA, 64 nt, hsa
gagcuagauucucucucucaaaaaaaaaaaaaaaaaaaaggaaagaaagaaagaaaagaaaaga

SEQ ID NO: 611734 - RNA, 64 nt, hsa
ugaaugaacugugaaagcuccuguuuuuauuaucaaaaaggacacugucaagaaggcgcccccu

SEQ ID NO: 611735 - RNA, 64 nt, hsa
cuuauuuuuuuccuaaaagauaauguuuauuuuuaaaaaggaaggaaggagcaagugaaguuuc

SEQ ID NO: 611736 - RNA, 64 nt, hsa
uuuucaccuagccagucuugagucuucuccgugcaaaaaggauucacagaaauggaccaguucu

SEQ ID NO: 611737 - RNA, 64 nt, hsa
auuucauauguucuaaaaugacuagcaaugguuuaaaaaggaagaagaguggaagugaagaagg

SEQ ID NO: 611738 - RNA, 64 nt, hsa
auuccugcugggucuuaacaagcauaaaaaggaaaaaaaggaaacucaggcaaagggauccaua

SEQ ID NO: 611739 - RNA, 64 nt, hsa
gggacguccauuccugcugggucuuaacaagcauaaaaaggaaaaaaaggaaacucaggcaaag

SEQ ID NO: 611740 - RNA, 64 nt, hsa
aaagauaaguuaggcagcuagacccugcguucuaaaaaaggauugcuugcaauguugguuuggc

SEQ ID NO: 611741 - RNA, 64 nt, hsa
uugcuucucuuuuagaaauacuuguggggagagaaaaaaggaugguuugggcauauugguauag

SEQ ID NO: 611742 - RNA, 64 nt, hsa
ucaaacacaggagucgagagagugcaguucagggaaaaaggagaggaggaaacagugaggcagg

SEQ ID NO: 611743 - RNA, 64 nt, hsa
augcuucgcaggaagugggaaggacucacaucauaaaaaggaccauguagcuuuuucccugaaa

SEQ ID NO: 611744 - RNA, 64 nt, hsa; identical to SEQ ID NO: 96825

SEQ ID NO: 611745 - RNA, 64 nt, hsa; identical to SEQ ID NO: 96826

SEQ ID NO: 611746 - RNA, 64 nt, hsa; identical to SEQ ID NO: 96827

SEQ ID NO: 611747 - RNA, 64 nt, hsa; identical to SEQ ID NO: 96828

SEQ ID NO: 611748 - RNA, 64 nt, hsa; identical to SEQ ID NO: 96829

SEQ ID NO: 611749 - RNA, 64 nt, hsa; identical to SEQ ID NO: 96830

SEQ ID NO: 611750 - RNA, 64 nt, hsa; identical to SEQ ID NO: 96831

SEQ ID NO: 611751 - RNA, 64 nt, hsa; identical to SEQ ID NO: 96832

SEQ ID NO: 611752 - RNA, 64 nt, hsa; identical to SEQ ID NO: 96833

SEQ ID NO: 611753 - RNA, 64 nt, hsa; identical to SEQ ID NO: 96834

SEQ ID NO: 611754 - RNA, 64 nt, hsa; identical to SEQ ID NO: 96835

SEQ ID NO: 611755 - RNA, 64 nt, hsa; identical to SEQ ID NO: 326924

SEQ ID NO: 611756 - RNA, 64 nt, hsa; identical to SEQ ID NO: 326925

SEQ ID NO: 611757 - RNA, 64 nt, hsa; identical to SEQ ID NO: 326926

SEQ ID NO: 611758 - RNA, 64 nt, hsa; identical to SEQ ID NO: 326927

SEQ ID NO: 611759 - RNA, 64 nt, hsa; identical to SEQ ID NO: 326928

SEQ ID NO: 611760 - RNA, 64 nt, hsa; identical to SEQ ID NO: 326929

SEQ ID NO: 611761 - RNA, 64 nt, hsa; identical to SEQ ID NO: 326930

SEQ ID NO: 611762 - RNA, 64 nt, hsa; identical to SEQ ID NO: 326931

SEQ ID NO: 611763 - RNA, 64 nt, hsa; identical to SEQ ID NO: 326932

SEQ ID NO: 611764 - RNA, 64 nt, hsa; identical to SEQ ID NO: 326933

SEQ ID NO: 611765 - RNA, 64 nt, hsa; identical to SEQ ID NO: 326934

SEQ ID NO: 611766 - RNA, 64 nt, hsa; identical to SEQ ID NO: 326935

SEQ ID NO: 611767 - RNA, 64 nt, hsa; identical to SEQ ID NO: 326936

SEQ ID NO: 611768 - RNA, 64 nt, hsa; identical to SEQ ID NO: 326937

SEQ ID NO: 611769 - RNA, 64 nt, hsa; identical to SEQ ID NO: 326938

SEQ ID NO: 611770 - RNA, 64 nt, hsa; identical to SEQ ID NO: 326939

SEQ ID NO: 611771 - RNA, 64 nt, hsa; identical to SEQ ID NO: 326940

SEQ ID NO: 611772 - RNA, 56 nt, hsa; identical to SEQ ID NO: 326941

SEQ ID NO: 611773 - RNA, 64 nt, hsa; identical to SEQ ID NO: 326942

SEQ ID NO: 611774 - RNA, 64 nt, hsa; identical to SEQ ID NO: 326943

SEQ ID NO: 611775 - RNA, 64 nt, hsa; identical to SEQ ID NO: 326944

SEQ ID NO: 611776 - RNA, 64 nt, hsa; identical to SEQ ID NO: 326945

SEQ ID NO: 611777 - RNA, 64 nt, hsa; identical to SEQ ID NO: 326946

SEQ ID NO: 611778 - RNA, 64 nt, hsa; identical to SEQ ID NO: 326947

SEQ ID NO: 611779 - RNA, 64 nt, hsa; identical to SEQ ID NO: 326948

SEQ ID NO: 611780 - RNA, 64 nt, hsa; identical to SEQ ID NO: 326949

SEQ ID NO: 611781 - RNA, 64 nt, hsa; identical to SEQ ID NO: 326950

SEQ ID NO: 611782 - RNA, 64 nt, hsa; identical to SEQ ID NO: 326951

SEQ ID NO: 611783 - RNA, 64 nt, hsa; identical to SEQ ID NO: 326952

SEQ ID NO: 611784 - RNA, 64 nt, hsa; identical to SEQ ID NO: 326953

SEQ ID NO: 611785 - RNA, 64 nt, hsa; identical to SEQ ID NO: 326954

SEQ ID NO: 611786 - RNA, 64 nt, hsa; identical to SEQ ID NO: 326955

SEQ ID NO: 611787 - RNA, 64 nt, hsa
ugugauacugauugccacauuaagguugaacagcauggcucagagucuagagaaagugaucacc

SEQ ID NO: 611788 - RNA, 64 nt, hsa
ugugauacugauucccacauuaagguugaacaacauggcucagagucuuguucaagagaaagug

SEQ ID NO: 611789 - RNA, 64 nt, hsa
ccagggugggaagcacggggagcaauggaaucagauggcucauucucuccuuccagcucuuuac

SEQ ID NO: 611790 - RNA, 64 nt, hsa
aggguuugucucauggucagcucgccucucaaagauggcucaccaaucaccugccuguuuuuac

SEQ ID NO: 611791 - RNA, 64 nt, hsa
gagaaaacccuuuuacucuggggagaacccacugauggcucauuagaucugucccuuccccgag

SEQ ID NO: 611792 - RNA, 64 nt, hsa
ccacagggauccccagauggauuuuucaggacaaauggcucaugugccuguacuuauugucucu

SEQ ID NO: 611793 - RNA, 64 nt, hsa
gcuccugugguccaguggccggacacccccugggauggcucaaaggagucaggacuuggaagug

SEQ ID NO: 611794 - RNA, 64 nt, hsa
cccaggcugggagcuggauaccugcccuggcagcauggcucagacugcaugacagguacggcgu

SEQ ID NO: 611795 - RNA, 64 nt, hsa
uccccccaauguggagaagucuaucaagaaggaaauggcucaguaugcuagcaacaucacauca

SEQ ID NO: 611796 - RNA, 64 nt, hsa
cgacagucccccaacuccuauguggugaucaugaauggcucauguguagaaguagauguacauc

SEQ ID NO: 611797 - RNA, 64 nt, hsa
guggagggugcccagcagacgugguaugagagggauggcucacgaggcuuggaccugguggagg

SEQ ID NO: 611798 - RNA, 64 nt, hsa
gagggacggcucacagggcuuggaccggagagagauggcucaugaggcuuggaccugccgugga

SEQ ID NO: 611799 - RNA, 64 nt, hsa
ggcagcugggagacaggcucauggcucauggcucauggcucagggcggugccugcccugggccg

SEQ ID NO: 611800 - RNA, 64 nt, hsa
agggcugggcagcugggagacaggcucauggcucauggcucauggcucagggcggugccugccc

SEQ ID NO: 611801 - RNA, 64 nt, hsa
ugacuguagggcugggcagcugggagacaggcucauggcucauggcucauggcucagggcggug

SEQ ID NO: 611802 - RNA, 64 nt, hsa
ccuuauauugguuuugguuuggggcacuggaugucgcagcuacugcuaugguuucaggaggccu

SEQ ID NO: 611803 - RNA, 64 nt, hsa
aaauggaaaucccagaucccugguccugccgacacgcagcuacugagaagaccaaaagaggugu

SEQ ID NO: 611804 - RNA, 64 nt, hsa
ugcauuuggccuauguaauccugcccaugguggccgcagcuaaucagaaucagauggaaaauua

SEQ ID NO: 611805 - RNA, 64 nt, hsa
ucggaggggaaaaggacaggugaucuggggaaaacgcagcuacaccuggagcaaggucucuucc

SEQ ID NO: 611806 - RNA, 64 nt, hsa
aaauuagccaaguacaguggggcacaccuauagucgcagcuacuugggaggcuggggcaggaga

SEQ ID NO: 611807 - RNA, 64 nt, hsa
guuuuccguguucguaacagaagggaggggaaagcgcagcuacugacaaguagaacacugcuac

SEQ ID NO: 611808 - RNA, 64 nt, hsa
ccccuacuggauggcaccugagaugaucaacggccgcagcuaugaugagaagguggauguguuc

SEQ ID NO: 611809 - RNA, 64 nt, hsa
aaauuagccgagcaugguggcgcaugccuguagucgcagcuacucgcgagguugaggcaggaga

SEQ ID NO: 611810 - RNA, 64 nt, hsa
auacaaaaaauuagccgggcgugguggcuguagucgcagcuacucaggaggcugaggcgggaga

SEQ ID NO: 611811 - RNA, 64 nt, hsa
gccacuucugugccuccacagccugcuccaguuccgcagcuagagcugggccuaccuuccccag

SEQ ID NO: 611812 - RNA, 64 nt, hsa
cacuuaaagaaaaaacgaguucuuucguucugugcgcagcuaaaaggggcgcccuacaucuccg

SEQ ID NO: 611813 - RNA, 64 nt, hsa
agggaagcauuggaacuggaguugugcacagcaccgcagcuagugggccuggcugggggugcag

SEQ ID NO: 611814 - RNA, 64 nt, hsa
aaauuuuauaggacuguucuuugcuguuguuggucgcagcuacauaagacuggacauuuaacuu

SEQ ID NO: 611815 - RNA, 64 nt, hsa
aaaaaagcuggguaugguggcuuaugccuguagucgcagcuacucagaaggcugaggugggagg

SEQ ID NO: 611816 - RNA, 64 nt, hsa
cucccuguccccaccccagcgcagcagcccuccccgcagcuagcagcgagggcaccuugugauc

SEQ ID NO: 611817 - RNA, 64 nt, hsa
caccagguacaaauuacugguauguuuuauaagccgcagcuacuguacacagccuaucugauau

SEQ ID NO: 611818 - RNA, 64 nt, hsa
cuauugaguaaacuacaauauauuuagugcuacucgcagcuauuuauuauuuuguagaccugcc

SEQ ID NO: 611819 - RNA, 64 nt, hsa
ugaguagcugggauuacaggcacacgccaccacacgcagcuaauuuuuguauuuuuaguagaga

SEQ ID NO: 611820 - RNA, 64 nt, hsa
ggcuccacacagcaguguccccugccccagaggucgcagcuacccucagccuccaaugcauugg

SEQ ID NO: 611821 - RNA, 64 nt, hsa
ccccaacuccaaccucucggccccaucgccccaccgcagcuacuccccuuucuuccaaacuuuu

SEQ ID NO: 611822 - RNA, 64 nt, hsa
aauuaagauagaucgcguuagccaguuuuaccagcgcagcuaggcgcgauggcugucgccugua

SEQ ID NO: 611823 - RNA, 64 nt, hsa
auccuucccccagacacuguucccaaccugucaucgcagcuaaucuguagguucucuuucuuug

SEQ ID NO: 611824 - RNA, 64 nt, hsa
ugaguagcugggacuacaggcaccugccaccaugcgcagcuaauuuuuuguauuuuuaguagag

SEQ ID NO: 611825 - RNA, 64 nt, hsa
aagggcagggccaagaccgggcuugggagaggggcgcagcuaagacugggggcaggauggcgga

SEQ ID NO: 611826 - RNA, 64 nt, hsa
uccgcaucuccccaccaccaccagggcacucacucgcagcuauagcccaggacagaaaaacugu

SEQ ID NO: 611827 - RNA, 64 nt, hsa
accugcaaaacugcuagcguaaucucagcacauacgcagcuaggaaguuugucauaaaaucaac

SEQ ID NO: 611828 - RNA, 64 nt, hsa
agccgccaaggcugcucgccuucuccguggcuuccgcagcuaccgucugcacggugagagggca

SEQ ID NO: 611829 - RNA, 64 nt, hsa
cuuucauccuacaaauugggucauucauguccuacgcagcuaaaacagagcccaggagccaggg

SEQ ID NO: 611830 - RNA, 64 nt, hsa
ggaucuccacagcagcaaaggucaccaggcucuccgcagcuaucccgggcauccaguggcagcu

SEQ ID NO: 611831 - RNA, 64 nt, hsa
cugggagauacaauucaaguugagauuuguggggggacacaaccaaaccauaucagcauccuuu

SEQ ID NO: 611832 - RNA, 64 nt, hsa
uguuggccccuuucagccauggcuggaguggcugggacacaagacaccaagucccuaggcugca

SEQ ID NO: 611833 - RNA, 64 nt, hsa
uauggaccaacaccuccuucaagaaaaggugguaggacacaaaguucuucaguccugagcccua

SEQ ID NO: 611834 - RNA, 64 nt, hsa
aauuccucuaagaacagagaauggucuuucccagggacacaaagggagaaaugggacauggauu

SEQ ID NO: 611835 - RNA, 64 nt, hsa
gagucaucaccacucccuaaucucaaguacccagggacacaaacacugcggaaggcggcagggu

SEQ ID NO: 611836 - RNA, 64 nt, hsa
cauucauuaaagcugauugugugagagugaacugggacacaagcuagucuagcucacugcagcc

SEQ ID NO: 611837 - RNA, 64 nt, hsa
uucagaucugccucacaccuucaaauucaugaaaggacacaaacacacauaagaauacacucug

SEQ ID NO: 611838 - RNA, 64 nt, hsa
uucagaucugccaagaaccuucgaauucaugaaaggacacaaacacacguaagaaugcacucug

SEQ ID NO: 611839 - RNA, 64 nt, hsa
uuuaaauuuaaaccauugagacuucagaagagcaggacacaaugcuguggacaggcaccaauuu

SEQ ID NO: 611840 - RNA, 64 nt, hsa
ggaaucuggggguuucuucuggaacggggcgugaggacacaaggaggccucugggccacgccuc

SEQ ID NO: 611841 - RNA, 64 nt, hsa; identical to SEQ ID NO: 589611

SEQ ID NO: 611842 - RNA, 64 nt, hsa; identical to SEQ ID NO: 589612

SEQ ID NO: 611843 - RNA, 64 nt, hsa; identical to SEQ ID NO: 589613

SEQ ID NO: 611844 - RNA, 64 nt, hsa; identical to SEQ ID NO: 589614

SEQ ID NO: 611845 - RNA, 64 nt, hsa; identical to SEQ ID NO: 589615

SEQ ID NO: 611846 - RNA, 64 nt, hsa; identical to SEQ ID NO: 589616

SEQ ID NO: 611847 - RNA, 64 nt, hsa; identical to SEQ ID NO: 589617

SEQ ID NO: 611848 - RNA, 64 nt, hsa; identical to SEQ ID NO: 589618

SEQ ID NO: 611849 - RNA, 64 nt, hsa; identical to SEQ ID NO: 589619

SEQ ID NO: 611850 - RNA, 64 nt, hsa; identical to SEQ ID NO: 589620

SEQ ID NO: 611851 - RNA, 64 nt, hsa; identical to SEQ ID NO: 589621

SEQ ID NO: 611852 - RNA, 64 nt, hsa; identical to SEQ ID NO: 589622

SEQ ID NO: 611853 - RNA, 64 nt, hsa; identical to SEQ ID NO: 589623

SEQ ID NO: 611854 - RNA, 64 nt, hsa; identical to SEQ ID NO: 589624

SEQ ID NO: 611855 - RNA, 64 nt, hsa; identical to SEQ ID NO: 589625

SEQ ID NO: 611856 - RNA, 64 nt, hsa; identical to SEQ ID NO: 589626

SEQ ID NO: 611857 - RNA, 64 nt, hsa; identical to SEQ ID NO: 589627

SEQ ID NO: 611858 - RNA, 64 nt, hsa; identical to SEQ ID NO: 589628

SEQ ID NO: 611859 - RNA, 64 nt, hsa; identical to SEQ ID NO: 589629

SEQ ID NO: 611860 - RNA, 64 nt, hsa; identical to SEQ ID NO: 589630

SEQ ID NO: 611861 - RNA, 64 nt, hsa; identical to SEQ ID NO: 589631

SEQ ID NO: 611862 - RNA, 64 nt, hsa; identical to SEQ ID NO: 589632

SEQ ID NO: 611863 - RNA, 64 nt, hsa; identical to SEQ ID NO: 589633

SEQ ID NO: 611864 - RNA, 64 nt, hsa; identical to SEQ ID NO: 589634

SEQ ID NO: 611865 - RNA, 64 nt, hsa; identical to SEQ ID NO: 589635

SEQ ID NO: 611866 - RNA, 64 nt, hsa; identical to SEQ ID NO: 589636

SEQ ID NO: 611867 - RNA, 64 nt, hsa; identical to SEQ ID NO: 589637

SEQ ID NO: 611868 - RNA, 64 nt, hsa; identical to SEQ ID NO: 589638

SEQ ID NO: 611869 - RNA, 64 nt, hsa; identical to SEQ ID NO: 589639

SEQ ID NO: 611870 - RNA, 64 nt, hsa; identical to SEQ ID NO: 589640

SEQ ID NO: 611871 - RNA, 64 nt, hsa; identical to SEQ ID NO: 589641

SEQ ID NO: 611872 - RNA, 64 nt, hsa; identical to SEQ ID NO: 589642

SEQ ID NO: 611873 - RNA, 64 nt, hsa; identical to SEQ ID NO: 589643

SEQ ID NO: 611874 - RNA, 64 nt, hsa; identical to SEQ ID NO: 589644

SEQ ID NO: 611875 - RNA, 64 nt, hsa; identical to SEQ ID NO: 589645

SEQ ID NO: 611876 - RNA, 64 nt, hsa; identical to SEQ ID NO: 589646

SEQ ID NO: 611877 - RNA, 64 nt, hsa; identical to SEQ ID NO: 589647

SEQ ID NO: 611878 - RNA, 64 nt, hsa; identical to SEQ ID NO: 589648

SEQ ID NO: 611879 - RNA, 64 nt, hsa; identical to SEQ ID NO: 589649

SEQ ID NO: 611880 - RNA, 64 nt, hsa; identical to SEQ ID NO: 589650

SEQ ID NO: 611881 - RNA, 64 nt, hsa; identical to SEQ ID NO: 589651

SEQ ID NO: 611882 - RNA, 64 nt, hsa; identical to SEQ ID NO: 589652

SEQ ID NO: 611883 - RNA, 64 nt, hsa; identical to SEQ ID NO: 589653

SEQ ID NO: 611884 - RNA, 64 nt, hsa; identical to SEQ ID NO: 589654

SEQ ID NO: 611885 - RNA, 64 nt, hsa; identical to SEQ ID NO: 589655

SEQ ID NO: 611886 - RNA, 64 nt, hsa; identical to SEQ ID NO: 589656

SEQ ID NO: 611887 - RNA, 64 nt, hsa; identical to SEQ ID NO: 589657

SEQ ID NO: 611888 - RNA, 64 nt, hsa; identical to SEQ ID NO: 589658

SEQ ID NO: 611889 - RNA, 64 nt, hsa; identical to SEQ ID NO: 589659

SEQ ID NO: 611890 - RNA, 64 nt, hsa; identical to SEQ ID NO: 589660

SEQ ID NO: 611891 - RNA, 64 nt, hsa; identical to SEQ ID NO: 589661

SEQ ID NO: 611892 - RNA, 64 nt, hsa; identical to SEQ ID NO: 589662

SEQ ID NO: 611893 - RNA, 64 nt, hsa; identical to SEQ ID NO: 589663

SEQ ID NO: 611894 - RNA, 64 nt, hsa; identical to SEQ ID NO: 589664

SEQ ID NO: 611895 - RNA, 64 nt, hsa; identical to SEQ ID NO: 589665

SEQ ID NO: 611896 - RNA, 64 nt, hsa; identical to SEQ ID NO: 589666

SEQ ID NO: 611897 - RNA, 64 nt, hsa; identical to SEQ ID NO: 589667

SEQ ID NO: 611898 - RNA, 64 nt, hsa; identical to SEQ ID NO: 589668

SEQ ID NO: 611899 - RNA, 61 nt, hsa; identical to SEQ ID NO: 448102

SEQ ID NO: 611900 - RNA, 64 nt, hsa; identical to SEQ ID NO: 589670

SEQ ID NO: 611901 - RNA, 64 nt, hsa; identical to SEQ ID NO: 589671

SEQ ID NO: 611902 - RNA, 64 nt, hsa; identical to SEQ ID NO: 589672

SEQ ID NO: 611903 - RNA, 64 nt, hsa; identical to SEQ ID NO: 589673

SEQ ID NO: 611904 - RNA, 64 nt, hsa; identical to SEQ ID NO: 589674

SEQ ID NO: 611905 - RNA, 64 nt, hsa; identical to SEQ ID NO: 589675

SEQ ID NO: 611906 - RNA, 64 nt, hsa; identical to SEQ ID NO: 589676

SEQ ID NO: 611907 - RNA, 64 nt, hsa; identical to SEQ ID NO: 589677

SEQ ID NO: 611908 - RNA, 64 nt, hsa; identical to SEQ ID NO: 589678

SEQ ID NO: 611909 - RNA, 64 nt, hsa; identical to SEQ ID NO: 589679

SEQ ID NO: 611910 - RNA, 64 nt, hsa; identical to SEQ ID NO: 589680

SEQ ID NO: 611911 - RNA, 64 nt, hsa; identical to SEQ ID NO: 589681

SEQ ID NO: 611912 - RNA, 64 nt, hsa; identical to SEQ ID NO: 589682

SEQ ID NO: 611913 - RNA, 64 nt, hsa; identical to SEQ ID NO: 589683

SEQ ID NO: 611914 - RNA, 64 nt, hsa; identical to SEQ ID NO: 589684

SEQ ID NO: 611915 - RNA, 64 nt, hsa; identical to SEQ ID NO: 589685

SEQ ID NO: 611916 - RNA, 64 nt, hsa; identical to SEQ ID NO: 589686

SEQ ID NO: 611917 - RNA, 64 nt, hsa; identical to SEQ ID NO: 589687

SEQ ID NO: 611918 - RNA, 64 nt, hsa; identical to SEQ ID NO: 589688

SEQ ID NO: 611919 - RNA, 64 nt, hsa; identical to SEQ ID NO: 589689

SEQ ID NO: 611920 - RNA, 64 nt, hsa; identical to SEQ ID NO: 589690

SEQ ID NO: 611921 - RNA, 64 nt, hsa; identical to SEQ ID NO: 589691

SEQ ID NO: 611922 - RNA, 64 nt, hsa; identical to SEQ ID NO: 589692

SEQ ID NO: 611923 - RNA, 64 nt, hsa; identical to SEQ ID NO: 589693

SEQ ID NO: 611924 - RNA, 64 nt, hsa; identical to SEQ ID NO: 589694

SEQ ID NO: 611925 - RNA, 64 nt, hsa; identical to SEQ ID NO: 589695

SEQ ID NO: 611926 - RNA, 64 nt, hsa; identical to SEQ ID NO: 589696

SEQ ID NO: 611927 - RNA, 64 nt, hsa; identical to SEQ ID NO: 589697

SEQ ID NO: 611928 - RNA, 64 nt, hsa; identical to SEQ ID NO: 589698

SEQ ID NO: 611929 - RNA, 64 nt, hsa; identical to SEQ ID NO: 589699

SEQ ID NO: 611930 - RNA, 64 nt, hsa; identical to SEQ ID NO: 589700

SEQ ID NO: 611931 - RNA, 64 nt, hsa; identical to SEQ ID NO: 589701

SEQ ID NO: 611932 - RNA, 64 nt, hsa; identical to SEQ ID NO: 589702

SEQ ID NO: 611933 - RNA, 64 nt, hsa; identical to SEQ ID NO: 589703

SEQ ID NO: 611934 - RNA, 64 nt, hsa; identical to SEQ ID NO: 589704

SEQ ID NO: 611935 - RNA, 64 nt, hsa; identical to SEQ ID NO: 589705

SEQ ID NO: 611936 - RNA, 64 nt, hsa
uuguuuuuagaguccugaagucuggaggcuagacuuccugaaagcaagucaagaauauagagca

SEQ ID NO: 611937 - RNA, 64 nt, hsa
uaauuaguauaacauuuacucugaauuugaagauuuccugaaacaaaguuuguacaagaagccc

SEQ ID NO: 611938 - RNA, 64 nt, hsa
cuaggauccacggauaugagaccauuuuugucauuuccugaagucacacuggcguuuccagaag

SEQ ID NO: 611939 - RNA, 64 nt, hsa
uguuccuggacuucauuuucaaugaugaaccaaauuccugaauuauuuauaauugugucuaaag

SEQ ID NO: 611940 - RNA, 64 nt, hsa
ccccugcacagugccugucaaacagaugcaaaccuuccugaauaaagccuuggagaccagcgcu

SEQ ID NO: 611941 - RNA, 64 nt, hsa
ugugguggaugccagggcgugcuccaggcaccucuuccugaagucucugcauuuggagauucgu

SEQ ID NO: 611942 - RNA, 64 nt, hsa
ggggagaauauucccuaagcaacuggcaauaguauuccugaaauaccuagaaauuucuaucuga

SEQ ID NO: 611943 - RNA, 64 nt, hsa
acuugcuauauaguaguaugcaguauuuauauuauuccugaaaauaaaaugaggggagaauauu

SEQ ID NO: 611944 - RNA, 64 nt, hsa
uaguucuucaaguaacaguuuacugguuguuccauuccugaauaugcaggcuaauuuguacaga

SEQ ID NO: 611945 - RNA, 64 nt, hsa
ccauacaaaggugcuauccuagggauuuuaugaauuccugaaaggaaaauagaauaugaucaau

SEQ ID NO: 611946 - RNA, 64 nt, hsa
cuucugggguugcuccggggccagguucuccuauuuccugaacucagcugaggccuugccuuga

SEQ ID NO: 611947 - RNA, 64 nt, hsa
guuccaguaccgcccucggggcccggucauugacuuccugaacaaccagcugcuggccgcggug

SEQ ID NO: 611948 - RNA, 64 nt, hsa
ccagccagugugggagagguaucgcccugauagauuccugaauuccaacucagguaaaagugcc

SEQ ID NO: 611949 - RNA, 64 nt, hsa
ccuaucaagccaguacgugcuaacaggcucaauauuccugaaugaaauaucagacuagugacaa

SEQ ID NO: 611950 - RNA, 64 nt, hsa
agccuuuccauaaggaauguagcugguuuccucauuccugaaagaaacaguuaacuuucagaag

SEQ ID NO: 611951 - RNA, 64 nt, hsa
uuguaguugaaacacagaaaaugccacuuuucuguuccugaagaggcucuuuugugcauaauau

SEQ ID NO: 611952 - RNA, 64 nt, hsa
uuguaguuccaaaaacccaucuaaauuucuugaguuccugaauuuugaacaggauuaccuggag

SEQ ID NO: 611953 - RNA, 64 nt, hsa
gagaaaaagacugaauaaauaucucacguaaaccuuccugaaagauaaacguuuuccugaauuc

SEQ ID NO: 611954 - RNA, 64 nt, hsa
uaucucacguaaaccuuccugaaagauaaacguuuuccugaauucagaaacuaguagcuaacau

SEQ ID NO: 611955 - RNA, 64 nt, hsa
agucaucccaguuuccugaaaguaaugcccagucuuccugaauccuccuuaauagcagaaccuu

SEQ ID NO: 611956 - RNA, 64 nt, hsa
aacacucagcagugcuauuuugagucaucccaguuuccugaaaguaaugcccagucuuccugaa

SEQ ID NO: 611957 - RNA, 64 nt, hsa
ccacuuaaccauuccaugcguuggcacuuaucuauuccugaaauuucuuuuaugugauuagcuc

SEQ ID NO: 611958 - RNA, 64 nt, hsa
aaguguccccuuauacaguggagggaagucuuccuuccugaaggaaaauaaacugacacuuauu

SEQ ID NO: 611959 - RNA, 64 nt, hsa
aaauaaauaguauuuuugagccuucaagauacaguuccugaauauucuaauuuaaauuguuaua

SEQ ID NO: 611960 - RNA, 64 nt, hsa
uauuaaucauuauuucuucaguauaaaguuauucuuccugaaaaaguaagauauaccugggaaa

SEQ ID NO: 611961 - RNA, 64 nt, hsa
ugacuuuuccugaaggcuugcuuuucccucgccuuuccugaaggucgcauuagagcgagucaca

SEQ ID NO: 611962 - RNA, 64 nt, hsa
gcaucuccagauuccagacccugccgcaugacuuuuccugaaggcuugcuuuucccucgccuuu

SEQ ID NO: 611963 - RNA, 64 nt, hsa
uccaggaaaggggaaugaaucaacucuugguucuuuccugaagacggcaguguuguggauaagu

SEQ ID NO: 611964 - RNA, 64 nt, hsa
ggcaggaauugguuaauuucuccuuccacuucccuuccugaauagugaagggagcccuuuuaaa

SEQ ID NO: 611965 - RNA, 64 nt, hsa
uuacccaucccuuuucagauuaaucuuuuauccuuuccugaaguacaaagucuuaagagugucu

SEQ ID NO: 611966 - RNA, 64 nt, hsa
accugcuaaaugccuguauuugaagucucuccccuuccugaagugaccuuuuaugaggcucuuu

SEQ ID NO: 611967 - RNA, 64 nt, hsa
agggcacuguccuuucagacaaagcuuguacaaauuccugaaccgcaaauuugcugaagugacc

SEQ ID NO: 611968 - RNA, 64 nt, hsa
auugcuucuuaccagacauggggaaaagcuaccuuuccugaaaggggaggagggcacuguccuu

SEQ ID NO: 611969 - RNA, 64 nt, hsa
agcuuuacugcaaagugaaaagaugcuguggcaguuccugaagcccgccagagacagcucaggu

SEQ ID NO: 611970 - RNA, 64 nt, hsa
uugggagggcugcaccuuugcccuagugcccaucuuccugaaaggauguuaguuucugccacaa

SEQ ID NO: 611971 - RNA, 64 nt, hsa
aaauagcuuagcggcaagaagccguugaggcgguuuccugaauuuccccaucugccacaggcca

SEQ ID NO: 611972 - RNA, 64 nt, hsa
acaugcguguaccucacuuuacauaagaaauguauuccugaaaagcugcauuuaaaucaagucc

SEQ ID NO: 611973 - RNA, 64 nt, hsa
auuuugguuccacaagcaguguuuggguguugccuuccugaaggugaccaagcuuccaaagcuc

SEQ ID NO: 611974 - RNA, 64 nt, hsa
auguaguggcaaguguggcgauguuuacucucccuuccugaaccgcucuggucugcuccucaga

SEQ ID NO: 611975 - RNA, 64 nt, hsa
uuaaaauugaacccuaucaugaaaugauaauuucuuccugaauuuacacauaauccuuauguua

SEQ ID NO: 611976 - RNA, 64 nt, hsa
uugcaagcauuucuuguuacccaaaucuaaucuauuccugaaaauaugaugguuagcaaaguuu

SEQ ID NO: 611977 - RNA, 64 nt, hsa
aggagauuuaauuguaaauaugaaagccaaaguauuccugaauggucaaauacagcaauaaagg

SEQ ID NO: 611978 - RNA, 64 nt, hsa
caaauauuuuuuuaagggaacuauaaccuuaggauuccugaaaagaauuucaaaaaaaaaauaa

SEQ ID NO: 611979 - RNA, 64 nt, hsa
ccagccucccugaagccuuugcauuuuggagaguuuccugaaacaacuuggaaagauaacuagg

SEQ ID NO: 611980 - RNA, 64 nt, hsa
cugaugccugaguccucccaauuucagacucccauuccugaagaaccaguccccccacccucau

SEQ ID NO: 611981 - RNA, 64 nt, hsa
uagacggaaacagaaauugcuuuuccccucacuguuccugaaugcucuauacuuguuuuaacau

SEQ ID NO: 611982 - RNA, 64 nt, hsa
uucaguugugaauccuaugguguuauuuauuuuguuccugaaaugggauuuagugcaaaaaguu

SEQ ID NO: 611983 - RNA, 64 nt, hsa
ucuguuaacuucccaccaccaucaaucaucugauuuccugaaaguaauuaauugugcauuuaau

SEQ ID NO: 611984 - RNA, 64 nt, hsa
uuacucuucuacaauguggccggaucauuugucauuccugaauaggucuuucucucaaccugca

SEQ ID NO: 611985 - RNA, 64 nt, hsa
uucuaagccuacagcaucuugauucauaguauaauuccugaaguaugcugaauggacuuuuuaa

SEQ ID NO: 611986 - RNA, 64 nt, hsa
agauuuauugauuuggugaucaaaccugugcuauuuccugaauuucagcuaauggccaacugug

SEQ ID NO: 611987 - RNA, 64 nt, hsa
caccccuuggauggguuccuaguuuguuuacauuuuccugaacccuccugagcgcccguucuug

SEQ ID NO: 611988 - RNA, 64 nt, hsa
guggaaucggacagaggcagguuagugacaguuauuccugaaauacaggagcagaguacagucu

SEQ ID NO: 611989 - RNA, 64 nt, hsa
uccugaauuaccaacaucaacuucuuucucuccguuccugaaggaacuuuggggaaucaucuuc

SEQ ID NO: 611990 - RNA, 64 nt, hsa
acuuuggggaaucaucuucauccguaguuacgcuuuccugaaccuucucagugguuuacaugcc

SEQ ID NO: 611991 - RNA, 64 nt, hsa
accucaguggggaggcuuccuuaccaagaaugaguuccugaaacccagggccagagacaaggac

SEQ ID NO: 611992 - RNA, 64 nt, hsa
ggagccacacuggggccccccccccguggaaccguuccugaaaggccaccaggcgcccagugua

SEQ ID NO: 611993 - RNA, 64 nt, hsa
ugagguuuauggagccuccagaacagaugccaucuuccugaauguugacaugccagugggugug

SEQ ID NO: 611994 - RNA, 64 nt, hsa
gcagauuucggaaauuggcaagcuacgggauuccuuccugaaagaucaacugugucuuaaggcu

SEQ ID NO: 611995 - RNA, 64 nt, hsa
ucucggaggcucgaggucuaagagaaacgcugaguuccugaagagccacagacaggguggguga

SEQ ID NO: 611996 - RNA, 64 nt, hsa
ggaaagcucuccaacccaucuucuacagcacagcuuccugaacaggguauaaguaugcugagau

SEQ ID NO: 611997 - RNA, 64 nt, hsa
cuguggcuacuuuugggaccuaagauaagugacuuuccugaaccuccaugaccuccucauaugu

SEQ ID NO: 611998 - RNA, 64 nt, hsa
acaucucacacacccagcucgccaugccuacucauuccugaauuucaggugccaucacugcucu

SEQ ID NO: 611999 - RNA, 64 nt, hsa
ggaacaugcagguauuuucuacggguguuugauguuccugaaguggaagcuguguguuggcgug

SEQ ID NO: 612000 - RNA, 64 nt, hsa
ggaauuugagcugaauuccacagccuuacuuuguuuccugaagugauagccuacuaaugcuggc

SEQ ID NO: 612001 - RNA, 64 nt, hsa
uguuuauucugacggaguucacuucuucagaaccuuccugaaaugagcagaaauuguucacuag

SEQ ID NO: 612002 - RNA, 64 nt, hsa
ugggauuuuuguugauaauuuuuagaagcaaauuuuccugaaaguuuugaguagaggugagacc

SEQ ID NO: 612003 - RNA, 64 nt, hsa
aaagaggcaaaaauuaaaagcuuggagagauaguuuccugaauagaauuugaagcagucugaau

SEQ ID NO: 612004 - RNA, 64 nt, hsa; identical to SEQ ID NO: 418746

SEQ ID NO: 612005 - RNA, 64 nt, hsa; identical to SEQ ID NO: 418747

SEQ ID NO: 612006 - RNA, 64 nt, hsa; identical to SEQ ID NO: 418748

SEQ ID NO: 612007 - RNA, 64 nt, hsa; identical to SEQ ID NO: 418749

SEQ ID NO: 612008 - RNA, 64 nt, hsa; identical to SEQ ID NO: 418750

SEQ ID NO: 612009 - RNA, 64 nt, hsa; identical to SEQ ID NO: 418751

SEQ ID NO: 612010 - RNA, 64 nt, hsa; identical to SEQ ID NO: 418752

SEQ ID NO: 612011 - RNA, 64 nt, hsa; identical to SEQ ID NO: 418753

SEQ ID NO: 612012 - RNA, 64 nt, hsa; identical to SEQ ID NO: 418754

SEQ ID NO: 612013 - RNA, 64 nt, hsa; identical to SEQ ID NO: 418755

SEQ ID NO: 612014 - RNA, 64 nt, hsa; identical to SEQ ID NO: 418756

SEQ ID NO: 612015 - RNA, 64 nt, hsa; identical to SEQ ID NO: 418757

SEQ ID NO: 612016 - RNA, 64 nt, hsa; identical to SEQ ID NO: 418758

SEQ ID NO: 612017 - RNA, 64 nt, hsa; identical to SEQ ID NO: 418759

SEQ ID NO: 612018 - RNA, 64 nt, hsa; identical to SEQ ID NO: 418760

SEQ ID NO: 612019 - RNA, 64 nt, hsa; identical to SEQ ID NO: 418761

SEQ ID NO: 612020 - RNA, 64 nt, hsa; identical to SEQ ID NO: 418762

SEQ ID NO: 612021 - RNA, 64 nt, hsa; identical to SEQ ID NO: 418763

SEQ ID NO: 612022 - RNA, 64 nt, hsa; identical to SEQ ID NO: 418764

SEQ ID NO: 612023 - RNA, 64 nt, hsa; identical to SEQ ID NO: 418765

SEQ ID NO: 612024 - RNA, 64 nt, hsa; identical to SEQ ID NO: 418766

SEQ ID NO: 612025 - RNA, 64 nt, hsa; identical to SEQ ID NO: 418767

SEQ ID NO: 612026 - RNA, 64 nt, hsa; identical to SEQ ID NO: 418768

SEQ ID NO: 612027 - RNA, 64 nt, hsa; identical to SEQ ID NO: 418769

SEQ ID NO: 612028 - RNA, 64 nt, hsa; identical to SEQ ID NO: 418770

SEQ ID NO: 612029 - RNA, 64 nt, hsa; identical to SEQ ID NO: 418771

SEQ ID NO: 612030 - RNA, 64 nt, hsa; identical to SEQ ID NO: 418772

SEQ ID NO: 612031 - RNA, 64 nt, hsa; identical to SEQ ID NO: 418773

SEQ ID NO: 612032 - RNA, 64 nt, hsa; identical to SEQ ID NO: 418774

SEQ ID NO: 612033 - RNA, 64 nt, hsa; identical to SEQ ID NO: 418775

SEQ ID NO: 612034 - RNA, 64 nt, hsa; identical to SEQ ID NO: 418776

SEQ ID NO: 612035 - RNA, 64 nt, hsa; identical to SEQ ID NO: 418777

SEQ ID NO: 612036 - RNA, 64 nt, hsa; identical to SEQ ID NO: 418778

SEQ ID NO: 612037 - RNA, 64 nt, hsa; identical to SEQ ID NO: 418779

SEQ ID NO: 612038 - RNA, 64 nt, hsa; identical to SEQ ID NO: 418780

SEQ ID NO: 612039 - RNA, 64 nt, hsa; identical to SEQ ID NO: 418781

SEQ ID NO: 612040 - RNA, 64 nt, hsa; identical to SEQ ID NO: 418782

SEQ ID NO: 612041 - RNA, 64 nt, hsa; identical to SEQ ID NO: 418783

SEQ ID NO: 612042 - RNA, 64 nt, hsa; identical to SEQ ID NO: 418784

SEQ ID NO: 612043 - RNA, 64 nt, hsa; identical to SEQ ID NO: 418785

SEQ ID NO: 612044 - RNA, 64 nt, hsa; identical to SEQ ID NO: 418786

SEQ ID NO: 612045 - RNA, 64 nt, hsa; identical to SEQ ID NO: 418787

SEQ ID NO: 612046 - RNA, 64 nt, hsa; identical to SEQ ID NO: 418788

SEQ ID NO: 612047 - RNA, 64 nt, hsa; identical to SEQ ID NO: 418789

SEQ ID NO: 612048 - RNA, 64 nt, hsa; identical to SEQ ID NO: 418790

SEQ ID NO: 612049 - RNA, 64 nt, hsa; identical to SEQ ID NO: 418791

SEQ ID NO: 612050 - RNA, 64 nt, hsa; identical to SEQ ID NO: 418792

SEQ ID NO: 612051 - RNA, 64 nt, hsa; identical to SEQ ID NO: 418793

SEQ ID NO: 612052 - RNA, 64 nt, hsa; identical to SEQ ID NO: 418794

SEQ ID NO: 612053 - RNA, 64 nt, hsa; identical to SEQ ID NO: 418795

SEQ ID NO: 612054 - RNA, 64 nt, hsa; identical to SEQ ID NO: 418796

SEQ ID NO: 612055 - RNA, 64 nt, hsa; identical to SEQ ID NO: 418797

SEQ ID NO: 612056 - RNA, 64 nt, hsa; identical to SEQ ID NO: 418798

SEQ ID NO: 612057 - RNA, 64 nt, hsa; identical to SEQ ID NO: 418799

SEQ ID NO: 612058 - RNA, 64 nt, hsa; identical to SEQ ID NO: 418800

SEQ ID NO: 612059 - RNA, 64 nt, hsa; identical to SEQ ID NO: 102210

SEQ ID NO: 612060 - RNA, 64 nt, hsa; identical to SEQ ID NO: 102211

SEQ ID NO: 612061 - RNA, 64 nt, hsa; identical to SEQ ID NO: 102212

SEQ ID NO: 612062 - RNA, 64 nt, hsa; identical to SEQ ID NO: 102213

SEQ ID NO: 612063 - RNA, 64 nt, hsa; identical to SEQ ID NO: 102214

SEQ ID NO: 612064 - RNA, 64 nt, hsa; identical to SEQ ID NO: 102215

SEQ ID NO: 612065 - RNA, 64 nt, hsa; identical to SEQ ID NO: 102216

SEQ ID NO: 612066 - RNA, 64 nt, hsa; identical to SEQ ID NO: 102217

SEQ ID NO: 612067 - RNA, 64 nt, hsa; identical to SEQ ID NO: 102218

SEQ ID NO: 612068 - RNA, 64 nt, hsa; identical to SEQ ID NO: 102219

SEQ ID NO: 612069 - RNA, 64 nt, hsa; identical to SEQ ID NO: 102220

SEQ ID NO: 612070 - RNA, 64 nt, hsa; identical to SEQ ID NO: 102221

SEQ ID NO: 612071 - RNA, 64 nt, hsa; identical to SEQ ID NO: 102222

SEQ ID NO: 612072 - RNA, 64 nt, hsa; identical to SEQ ID NO: 102223

SEQ ID NO: 612073 - RNA, 64 nt, hsa; identical to SEQ ID NO: 102224

SEQ ID NO: 612074 - RNA, 64 nt, hsa; identical to SEQ ID NO: 102225

SEQ ID NO: 612075 - RNA, 64 nt, hsa; identical to SEQ ID NO: 102226

SEQ ID NO: 612076 - RNA, 64 nt, hsa; identical to SEQ ID NO: 102227

SEQ ID NO: 612077 - RNA, 64 nt, hsa; identical to SEQ ID NO: 102228

SEQ ID NO: 612078 - RNA, 64 nt, hsa; identical to SEQ ID NO: 102229

SEQ ID NO: 612079 - RNA, 64 nt, hsa; identical to SEQ ID NO: 102230

SEQ ID NO: 612080 - RNA, 64 nt, hsa; identical to SEQ ID NO: 102231

SEQ ID NO: 612081 - RNA, 64 nt, hsa; identical to SEQ ID NO: 102232

SEQ ID NO: 612082 - RNA, 64 nt, hsa; identical to SEQ ID NO: 102233

SEQ ID NO: 612083 - RNA, 64 nt, hsa; identical to SEQ ID NO: 102234

SEQ ID NO: 612084 - RNA, 64 nt, hsa; identical to SEQ ID NO: 102235

SEQ ID NO: 612085 - RNA, 64 nt, hsa; identical to SEQ ID NO: 102236

SEQ ID NO: 612086 - RNA, 64 nt, hsa; identical to SEQ ID NO: 102237

SEQ ID NO: 612087 - RNA, 64 nt, hsa; identical to SEQ ID NO: 102238

SEQ ID NO: 612088 - RNA, 64 nt, hsa; identical to SEQ ID NO: 102239

SEQ ID NO: 612089 - RNA, 64 nt, hsa; identical to SEQ ID NO: 102240

SEQ ID NO: 612090 - RNA, 64 nt, hsa; identical to SEQ ID NO: 102241

SEQ ID NO: 612091 - RNA, 64 nt, hsa; identical to SEQ ID NO: 102242

SEQ ID NO: 612092 - RNA, 64 nt, hsa; identical to SEQ ID NO: 589102

SEQ ID NO: 612093 - RNA, 64 nt, hsa; identical to SEQ ID NO: 589103

SEQ ID NO: 612094 - RNA, 64 nt, hsa; identical to SEQ ID NO: 589104

SEQ ID NO: 612095 - RNA, 64 nt, hsa; identical to SEQ ID NO: 589105

SEQ ID NO: 612096 - RNA, 64 nt, hsa; identical to SEQ ID NO: 589106

SEQ ID NO: 612097 - RNA, 64 nt, hsa; identical to SEQ ID NO: 589107

SEQ ID NO: 612098 - RNA, 64 nt, hsa; identical to SEQ ID NO: 589108

SEQ ID NO: 612099 - RNA, 64 nt, hsa; identical to SEQ ID NO: 589109

SEQ ID NO: 612100 - RNA, 64 nt, hsa; identical to SEQ ID NO: 589110

SEQ ID NO: 612101 - RNA, 64 nt, hsa; identical to SEQ ID NO: 589111

SEQ ID NO: 612102 - RNA, 64 nt, hsa; identical to SEQ ID NO: 589112

SEQ ID NO: 612103 - RNA, 64 nt, hsa; identical to SEQ ID NO: 589113

SEQ ID NO: 612104 - RNA, 64 nt, hsa; identical to SEQ ID NO: 589114

SEQ ID NO: 612105 - RNA, 64 nt, hsa; identical to SEQ ID NO: 589115

SEQ ID NO: 612106 - RNA, 64 nt, hsa; identical to SEQ ID NO: 589116

SEQ ID NO: 612107 - RNA, 64 nt, hsa; identical to SEQ ID NO: 589117

SEQ ID NO: 612108 - RNA, 64 nt, hsa; identical to SEQ ID NO: 589118

SEQ ID NO: 612109 - RNA, 64 nt, hsa; identical to SEQ ID NO: 589119

SEQ ID NO: 612110 - RNA, 64 nt, hsa; identical to SEQ ID NO: 589120

SEQ ID NO: 612111 - RNA, 64 nt, hsa; identical to SEQ ID NO: 537458

SEQ ID NO: 612112 - RNA, 64 nt, hsa; identical to SEQ ID NO: 537459

SEQ ID NO: 612113 - RNA, 64 nt, hsa; identical to SEQ ID NO: 537460

SEQ ID NO: 612114 - RNA, 64 nt, hsa; identical to SEQ ID NO: 537461

SEQ ID NO: 612115 - RNA, 64 nt, hsa; identical to SEQ ID NO: 537462

SEQ ID NO: 612116 - RNA, 64 nt, hsa; identical to SEQ ID NO: 537463

SEQ ID NO: 612117 - RNA, 64 nt, hsa; identical to SEQ ID NO: 537464

SEQ ID NO: 612118 - RNA, 64 nt, hsa; identical to SEQ ID NO: 537465

SEQ ID NO: 612119 - RNA, 64 nt, hsa; identical to SEQ ID NO: 537466

SEQ ID NO: 612120 - RNA, 64 nt, hsa; identical to SEQ ID NO: 537467

SEQ ID NO: 612121 - RNA, 64 nt, hsa; identical to SEQ ID NO: 537468

SEQ ID NO: 612122 - RNA, 64 nt, hsa; identical to SEQ ID NO: 537469

SEQ ID NO: 612123 - RNA, 64 nt, hsa; identical to SEQ ID NO: 537470

SEQ ID NO: 612124 - RNA, 64 nt, hsa; identical to SEQ ID NO: 537471

SEQ ID NO: 612125 - RNA, 64 nt, hsa; identical to SEQ ID NO: 22294

SEQ ID NO: 612126 - RNA, 64 nt, hsa; identical to SEQ ID NO: 22295

SEQ ID NO: 612127 - RNA, 64 nt, hsa; identical to SEQ ID NO: 22296

SEQ ID NO: 612128 - RNA, 64 nt, hsa; identical to SEQ ID NO: 22297

SEQ ID NO: 612129 - RNA, 64 nt, hsa; identical to SEQ ID NO: 22298

SEQ ID NO: 612130 - RNA, 64 nt, hsa; identical to SEQ ID NO: 22299

SEQ ID NO: 612131 - RNA, 64 nt, hsa; identical to SEQ ID NO: 22300

SEQ ID NO: 612132 - RNA, 64 nt, hsa; identical to SEQ ID NO: 22301

SEQ ID NO: 612133 - RNA, 64 nt, hsa; identical to SEQ ID NO: 22302

SEQ ID NO: 612134 - RNA, 64 nt, hsa; identical to SEQ ID NO: 22303

SEQ ID NO: 612135 - RNA, 64 nt, hsa; identical to SEQ ID NO: 22304

SEQ ID NO: 612136 - RNA, 64 nt, hsa; identical to SEQ ID NO: 22305

SEQ ID NO: 612137 - RNA, 64 nt, hsa; identical to SEQ ID NO: 22306

SEQ ID NO: 612138 - RNA, 64 nt, hsa; identical to SEQ ID NO: 22307

SEQ ID NO: 612139 - RNA, 64 nt, hsa; identical to SEQ ID NO: 22308

SEQ ID NO: 612140 - RNA, 64 nt, hsa; identical to SEQ ID NO: 22309

SEQ ID NO: 612141 - RNA, 64 nt, hsa; identical to SEQ ID NO: 22310

SEQ ID NO: 612142 - RNA, 64 nt, hsa; identical to SEQ ID NO: 22311

SEQ ID NO: 612143 - RNA, 64 nt, hsa; identical to SEQ ID NO: 22312

SEQ ID NO: 612144 - RNA, 64 nt, hsa; identical to SEQ ID NO: 22313

SEQ ID NO: 612145 - RNA, 64 nt, hsa; identical to SEQ ID NO: 22314

SEQ ID NO: 612146 - RNA, 64 nt, hsa; identical to SEQ ID NO: 22315

SEQ ID NO: 612147 - RNA, 64 nt, hsa; identical to SEQ ID NO: 22316

SEQ ID NO: 612148 - RNA, 64 nt, hsa; identical to SEQ ID NO: 22317

SEQ ID NO: 612149 - RNA, 64 nt, hsa; identical to SEQ ID NO: 22318

SEQ ID NO: 612150 - RNA, 64 nt, hsa; identical to SEQ ID NO: 22319

SEQ ID NO: 612151 - RNA, 64 nt, hsa; identical to SEQ ID NO: 22320

SEQ ID NO: 612152 - RNA, 64 nt, hsa; identical to SEQ ID NO: 22321

SEQ ID NO: 612153 - RNA, 64 nt, hsa; identical to SEQ ID NO: 22322

SEQ ID NO: 612154 - RNA, 64 nt, hsa; identical to SEQ ID NO: 22323

SEQ ID NO: 612155 - RNA, 64 nt, hsa; identical to SEQ ID NO: 22324

SEQ ID NO: 612156 - RNA, 64 nt, hsa; identical to SEQ ID NO: 22325

SEQ ID NO: 612157 - RNA, 64 nt, hsa; identical to SEQ ID NO: 22326

SEQ ID NO: 612158 - RNA, 64 nt, hsa; identical to SEQ ID NO: 22327

SEQ ID NO: 612159 - RNA, 64 nt, hsa; identical to SEQ ID NO: 22328

SEQ ID NO: 612160 - RNA, 64 nt, hsa; identical to SEQ ID NO: 22329

SEQ ID NO: 612161 - RNA, 64 nt, hsa; identical to SEQ ID NO: 22330

SEQ ID NO: 612162 - RNA, 64 nt, hsa; identical to SEQ ID NO: 22331

SEQ ID NO: 612163 - RNA, 64 nt, hsa; identical to SEQ ID NO: 22332

SEQ ID NO: 612164 - RNA, 64 nt, hsa; identical to SEQ ID NO: 22333

SEQ ID NO: 612165 - RNA, 64 nt, hsa; identical to SEQ ID NO: 22334

SEQ ID NO: 612166 - RNA, 64 nt, hsa; identical to SEQ ID NO: 22335

SEQ ID NO: 612167 - RNA, 64 nt, hsa; identical to SEQ ID NO: 22336

SEQ ID NO: 612168 - RNA, 64 nt, hsa; identical to SEQ ID NO: 22337

SEQ ID NO: 612169 - RNA, 64 nt, hsa; identical to SEQ ID NO: 22338

SEQ ID NO: 612170 - RNA, 64 nt, hsa; identical to SEQ ID NO: 22339

SEQ ID NO: 612171 - RNA, 64 nt, hsa; identical to SEQ ID NO: 22340

SEQ ID NO: 612172 - RNA, 64 nt, hsa; identical to SEQ ID NO: 22341

SEQ ID NO: 612173 - RNA, 64 nt, hsa; identical to SEQ ID NO: 22342

SEQ ID NO: 612174 - RNA, 64 nt, hsa; identical to SEQ ID NO: 22343

SEQ ID NO: 612175 - RNA, 64 nt, hsa; identical to SEQ ID NO: 22344

SEQ ID NO: 612176 - RNA, 64 nt, hsa; identical to SEQ ID NO: 22345

SEQ ID NO: 612177 - RNA, 64 nt, hsa; identical to SEQ ID NO: 22346

SEQ ID NO: 612178 - RNA, 64 nt, hsa; identical to SEQ ID NO: 22347

SEQ ID NO: 612179 - RNA, 64 nt, hsa; identical to SEQ ID NO: 22348

SEQ ID NO: 612180 - RNA, 64 nt, hsa; identical to SEQ ID NO: 22349

SEQ ID NO: 612181 - RNA, 64 nt, hsa; identical to SEQ ID NO: 22350

SEQ ID NO: 612182 - RNA, 64 nt, hsa; identical to SEQ ID NO: 22351

SEQ ID NO: 612183 - RNA, 64 nt, hsa; identical to SEQ ID NO: 22352

SEQ ID NO: 612184 - RNA, 64 nt, hsa; identical to SEQ ID NO: 22353

SEQ ID NO: 612185 - RNA, 64 nt, hsa; identical to SEQ ID NO: 22354

SEQ ID NO: 612186 - RNA, 64 nt, hsa; identical to SEQ ID NO: 22355

SEQ ID NO: 612187 - RNA, 64 nt, hsa; identical to SEQ ID NO: 22356

SEQ ID NO: 612188 - RNA, 64 nt, hsa; identical to SEQ ID NO: 22357

SEQ ID NO: 612189 - RNA, 64 nt, hsa; identical to SEQ ID NO: 22358

SEQ ID NO: 612190 - RNA, 64 nt, hsa; identical to SEQ ID NO: 22359

SEQ ID NO: 612191 - RNA, 64 nt, hsa; identical to SEQ ID NO: 22360

SEQ ID NO: 612192 - RNA, 64 nt, hsa; identical to SEQ ID NO: 22361

SEQ ID NO: 612193 - RNA, 64 nt, hsa; identical to SEQ ID NO: 22362

SEQ ID NO: 612194 - RNA, 64 nt, hsa; identical to SEQ ID NO: 22363

SEQ ID NO: 612195 - RNA, 64 nt, hsa; identical to SEQ ID NO: 22364

SEQ ID NO: 612196 - RNA, 64 nt, hsa; identical to SEQ ID NO: 22365

SEQ ID NO: 612197 - RNA, 64 nt, hsa; identical to SEQ ID NO: 22366

SEQ ID NO: 612198 - RNA, 64 nt, hsa; identical to SEQ ID NO: 22367

SEQ ID NO: 612199 - RNA, 64 nt, hsa; identical to SEQ ID NO: 22368

SEQ ID NO: 612200 - RNA, 64 nt, hsa; identical to SEQ ID NO: 22369

SEQ ID NO: 612201 - RNA, 64 nt, hsa; identical to SEQ ID NO: 22370

SEQ ID NO: 612202 - RNA, 64 nt, hsa; identical to SEQ ID NO: 22371

SEQ ID NO: 612203 - RNA, 64 nt, hsa; identical to SEQ ID NO: 22372

SEQ ID NO: 612204 - RNA, 64 nt, hsa; identical to SEQ ID NO: 22373

SEQ ID NO: 612205 - RNA, 64 nt, hsa; identical to SEQ ID NO: 22374

SEQ ID NO: 612206 - RNA, 64 nt, hsa; identical to SEQ ID NO: 22375

SEQ ID NO: 612207 - RNA, 64 nt, hsa; identical to SEQ ID NO: 22376

SEQ ID NO: 612208 - RNA, 64 nt, hsa; identical to SEQ ID NO: 22377

SEQ ID NO: 612209 - RNA, 64 nt, hsa; identical to SEQ ID NO: 22378

SEQ ID NO: 612210 - RNA, 64 nt, hsa; identical to SEQ ID NO: 22379

SEQ ID NO: 612211 - RNA, 64 nt, hsa; identical to SEQ ID NO: 22380

SEQ ID NO: 612212 - RNA, 64 nt, hsa; identical to SEQ ID NO: 22381

SEQ ID NO: 612213 - RNA, 64 nt, hsa; identical to SEQ ID NO: 22382

SEQ ID NO: 612214 - RNA, 64 nt, hsa; identical to SEQ ID NO: 22383

SEQ ID NO: 612215 - RNA, 64 nt, hsa; identical to SEQ ID NO: 22384

SEQ ID NO: 612216 - RNA, 64 nt, hsa; identical to SEQ ID NO: 22385

SEQ ID NO: 612217 - RNA, 64 nt, hsa; identical to SEQ ID NO: 22386

SEQ ID NO: 612218 - RNA, 64 nt, hsa; identical to SEQ ID NO: 22387

SEQ ID NO: 612219 - RNA, 64 nt, hsa; identical to SEQ ID NO: 22388

SEQ ID NO: 612220 - RNA, 64 nt, hsa; identical to SEQ ID NO: 22389

SEQ ID NO: 612221 - RNA, 64 nt, hsa; identical to SEQ ID NO: 22390

SEQ ID NO: 612222 - RNA, 64 nt, hsa; identical to SEQ ID NO: 22391

SEQ ID NO: 612223 - RNA, 64 nt, hsa
aaguuuauuuuuaauaguaucugucaaguuaauaucugucaacaguuaauaaucauguuauguu

SEQ ID NO: 612224 - RNA, 64 nt, hsa
aaugugagguaaaauaaguuuauuuuuaauaguaucugucaaguuaauaucugucaacaguuaa

SEQ ID NO: 612225 - RNA, 64 nt, hsa
uuaacaucaagcgcgcaguucaaaacuacugucuucugucaaaguuuucuccucuuaaauguua

SEQ ID NO: 612226 - RNA, 64 nt, hsa
uccuuagucuguuaguuaaacccauuaggaauuuucugucaacuaccaugcccaugagauguuu

SEQ ID NO: 612227 - RNA, 64 nt, hsa
uaguaugguaucaguuaauuccagucugagcuucucugucaacuucaguuucucucucaguuua

SEQ ID NO: 612228 - RNA, 64 nt, hsa
ccuuuuauauucucuuuccauaaauacguugauuucugucaauaaaauuuuugugucuuaggau

SEQ ID NO: 612229 - RNA, 64 nt, hsa
uacucuuauacccagaaaagaacauauuucagaaucugucaaacuuuuguguaucccacagauu

SEQ ID NO: 612230 - RNA, 64 nt, hsa
ugcagcuauuugagggacuaagggauggagauauucugucaaaugaaucucuucaguauaccag

SEQ ID NO: 612231 - RNA, 64 nt, hsa; identical to SEQ ID NO: 377221

SEQ ID NO: 612232 - RNA, 64 nt, hsa; identical to SEQ ID NO: 377222

SEQ ID NO: 612233 - RNA, 64 nt, hsa; identical to SEQ ID NO: 377223

SEQ ID NO: 612234 - RNA, 64 nt, hsa; identical to SEQ ID NO: 377224

SEQ ID NO: 612235 - RNA, 64 nt, hsa; identical to SEQ ID NO: 377225

SEQ ID NO: 612236 - RNA, 64 nt, hsa; identical to SEQ ID NO: 377226

SEQ ID NO: 612237 - RNA, 64 nt, hsa; identical to SEQ ID NO: 377227

SEQ ID NO: 612238 - RNA, 64 nt, hsa; identical to SEQ ID NO: 377228

SEQ ID NO: 612239 - RNA, 64 nt, hsa; identical to SEQ ID NO: 377229

SEQ ID NO: 612240 - RNA, 64 nt, hsa; identical to SEQ ID NO: 377230

SEQ ID NO: 612241 - RNA, 64 nt, hsa; identical to SEQ ID NO: 377231

SEQ ID NO: 612242 - RNA, 64 nt, hsa; identical to SEQ ID NO: 377232

SEQ ID NO: 612243 - RNA, 64 nt, hsa; identical to SEQ ID NO: 377233

SEQ ID NO: 612244 - RNA, 64 nt, hsa; identical to SEQ ID NO: 377234

SEQ ID NO: 612245 - RNA, 64 nt, hsa; identical to SEQ ID NO: 377235

SEQ ID NO: 612246 - RNA, 64 nt, hsa; identical to SEQ ID NO: 377236

SEQ ID NO: 612247 - RNA, 64 nt, hsa; identical to SEQ ID NO: 377237

SEQ ID NO: 612248 - RNA, 64 nt, hsa; identical to SEQ ID NO: 377238

SEQ ID NO: 612249 - RNA, 64 nt, hsa; identical to SEQ ID NO: 377239

SEQ ID NO: 612250 - RNA, 64 nt, hsa; identical to SEQ ID NO: 377240

SEQ ID NO: 612251 - RNA, 64 nt, hsa; identical to SEQ ID NO: 377241

SEQ ID NO: 612252 - RNA, 64 nt, hsa; identical to SEQ ID NO: 377242

SEQ ID NO: 612253 - RNA, 64 nt, hsa; identical to SEQ ID NO: 377243

SEQ ID NO: 612254 - RNA, 64 nt, hsa; identical to SEQ ID NO: 377244

SEQ ID NO: 612255 - RNA, 64 nt, hsa; identical to SEQ ID NO: 377245

SEQ ID NO: 612256 - RNA, 64 nt, hsa; identical to SEQ ID NO: 377246

SEQ ID NO: 612257 - RNA, 64 nt, hsa; identical to SEQ ID NO: 377247

SEQ ID NO: 612258 - RNA, 64 nt, hsa; identical to SEQ ID NO: 377248

SEQ ID NO: 612259 - RNA, 64 nt, hsa; identical to SEQ ID NO: 377249

SEQ ID NO: 612260 - RNA, 64 nt, hsa; identical to SEQ ID NO: 377250

SEQ ID NO: 612261 - RNA, 64 nt, hsa; identical to SEQ ID NO: 377251

SEQ ID NO: 612262 - RNA, 64 nt, hsa; identical to SEQ ID NO: 377252

SEQ ID NO: 612263 - RNA, 64 nt, hsa; identical to SEQ ID NO: 377253

SEQ ID NO: 612264 - RNA, 64 nt, hsa; identical to SEQ ID NO: 377254

SEQ ID NO: 612265 - RNA, 64 nt, hsa; identical to SEQ ID NO: 377255

SEQ ID NO: 612266 - RNA, 64 nt, hsa; identical to SEQ ID NO: 377256

SEQ ID NO: 612267 - RNA, 64 nt, hsa; identical to SEQ ID NO: 377257

SEQ ID NO: 612268 - RNA, 64 nt, hsa; identical to SEQ ID NO: 377258

SEQ ID NO: 612269 - RNA, 64 nt, hsa; identical to SEQ ID NO: 377259

SEQ ID NO: 612270 - RNA, 64 nt, hsa; identical to SEQ ID NO: 377260

SEQ ID NO: 612271 - RNA, 64 nt, hsa; identical to SEQ ID NO: 377261

SEQ ID NO: 612272 - RNA, 64 nt, hsa; identical to SEQ ID NO: 377262

SEQ ID NO: 612273 - RNA, 64 nt, hsa; identical to SEQ ID NO: 377263

SEQ ID NO: 612274 - RNA, 64 nt, hsa; identical to SEQ ID NO: 377260

SEQ ID NO: 612275 - RNA, 64 nt, hsa; identical to SEQ ID NO: 377259

SEQ ID NO: 612276 - RNA, 64 nt, hsa; identical to SEQ ID NO: 377266

SEQ ID NO: 612277 - RNA, 64 nt, hsa; identical to SEQ ID NO: 377267

SEQ ID NO: 612278 - RNA, 64 nt, hsa; identical to SEQ ID NO: 377268

SEQ ID NO: 612279 - RNA, 64 nt, hsa; identical to SEQ ID NO: 377269

SEQ ID NO: 612280 - RNA, 64 nt, hsa; identical to SEQ ID NO: 377270

SEQ ID NO: 612281 - RNA, 64 nt, hsa; identical to SEQ ID NO: 377271

SEQ ID NO: 612282 - RNA, 64 nt, hsa; identical to SEQ ID NO: 377272

SEQ ID NO: 612283 - RNA, 64 nt, hsa; identical to SEQ ID NO: 377273

SEQ ID NO: 612284 - RNA, 64 nt, hsa; identical to SEQ ID NO: 377274

SEQ ID NO: 612285 - RNA, 64 nt, hsa; identical to SEQ ID NO: 377275

SEQ ID NO: 612286 - RNA, 64 nt, hsa; identical to SEQ ID NO: 377276

SEQ ID NO: 612287 - RNA, 64 nt, hsa; identical to SEQ ID NO: 377277

SEQ ID NO: 612288 - RNA, 64 nt, hsa; identical to SEQ ID NO: 377278

SEQ ID NO: 612289 - RNA, 64 nt, hsa; identical to SEQ ID NO: 377279

SEQ ID NO: 612290 - RNA, 64 nt, hsa; identical to SEQ ID NO: 377280

SEQ ID NO: 612291 - RNA, 64 nt, hsa; identical to SEQ ID NO: 377281

SEQ ID NO: 612292 - RNA, 64 nt, hsa; identical to SEQ ID NO: 377282

SEQ ID NO: 612293 - RNA, 64 nt, hsa; identical to SEQ ID NO: 377283

SEQ ID NO: 612294 - RNA, 64 nt, hsa; identical to SEQ ID NO: 377284

SEQ ID NO: 612295 - RNA, 64 nt, hsa; identical to SEQ ID NO: 377285

SEQ ID NO: 612296 - RNA, 64 nt, hsa; identical to SEQ ID NO: 377286

SEQ ID NO: 612297 - RNA, 64 nt, hsa; identical to SEQ ID NO: 377287

SEQ ID NO: 612298 - RNA, 64 nt, hsa; identical to SEQ ID NO: 377288

SEQ ID NO: 612299 - RNA, 64 nt, hsa; identical to SEQ ID NO: 377289

SEQ ID NO: 612300 - RNA, 64 nt, hsa; identical to SEQ ID NO: 377290

SEQ ID NO: 612301 - RNA, 64 nt, hsa; identical to SEQ ID NO: 377291

SEQ ID NO: 612302 - RNA, 64 nt, hsa; identical to SEQ ID NO: 377292

SEQ ID NO: 612303 - RNA, 64 nt, hsa; identical to SEQ ID NO: 377293

SEQ ID NO: 612304 - RNA, 64 nt, hsa; identical to SEQ ID NO: 377294

SEQ ID NO: 612305 - RNA, 64 nt, hsa; identical to SEQ ID NO: 377295

SEQ ID NO: 612306 - RNA, 64 nt, hsa; identical to SEQ ID NO: 377296

SEQ ID NO: 612307 - RNA, 64 nt, hsa; identical to SEQ ID NO: 377297

SEQ ID NO: 612308 - RNA, 64 nt, hsa; identical to SEQ ID NO: 377298

SEQ ID NO: 612309 - RNA, 64 nt, hsa; identical to SEQ ID NO: 299149

SEQ ID NO: 612310 - RNA, 64 nt, hsa; identical to SEQ ID NO: 299150

SEQ ID NO: 612311 - RNA, 64 nt, hsa; identical to SEQ ID NO: 299151

SEQ ID NO: 612312 - RNA, 64 nt, hsa; identical to SEQ ID NO: 299152

SEQ ID NO: 612313 - RNA, 64 nt, hsa; identical to SEQ ID NO: 299153

SEQ ID NO: 612314 - RNA, 64 nt, hsa; identical to SEQ ID NO: 299154

SEQ ID NO: 612315 - RNA, 64 nt, hsa; identical to SEQ ID NO: 299155

SEQ ID NO: 612316 - RNA, 64 nt, hsa; identical to SEQ ID NO: 299156

SEQ ID NO: 612317 - RNA, 64 nt, hsa; identical to SEQ ID NO: 299157

SEQ ID NO: 612318 - RNA, 64 nt, hsa; identical to SEQ ID NO: 299158

SEQ ID NO: 612319 - RNA, 64 nt, hsa; identical to SEQ ID NO: 299159

SEQ ID NO: 612320 - RNA, 64 nt, hsa; identical to SEQ ID NO: 299160

SEQ ID NO: 612321 - RNA, 64 nt, hsa; identical to SEQ ID NO: 299161

SEQ ID NO: 612322 - RNA, 64 nt, hsa; identical to SEQ ID NO: 299162

SEQ ID NO: 612323 - RNA, 64 nt, hsa; identical to SEQ ID NO: 299163

SEQ ID NO: 612324 - RNA, 64 nt, hsa; identical to SEQ ID NO: 299164

SEQ ID NO: 612325 - RNA, 64 nt, hsa; identical to SEQ ID NO: 299165

SEQ ID NO: 612326 - RNA, 64 nt, hsa; identical to SEQ ID NO: 299166

SEQ ID NO: 612327 - RNA, 64 nt, hsa; identical to SEQ ID NO: 299167

SEQ ID NO: 612328 - RNA, 64 nt, hsa; identical to SEQ ID NO: 299168

SEQ ID NO: 612329 - RNA, 64 nt, hsa; identical to SEQ ID NO: 299169

SEQ ID NO: 612330 - RNA, 64 nt, hsa; identical to SEQ ID NO: 299170

SEQ ID NO: 612331 - RNA, 64 nt, hsa; identical to SEQ ID NO: 299171

SEQ ID NO: 612332 - RNA, 64 nt, hsa; identical to SEQ ID NO: 299172

SEQ ID NO: 612333 - RNA, 64 nt, hsa; identical to SEQ ID NO: 299173

SEQ ID NO: 612334 - RNA, 64 nt, hsa; identical to SEQ ID NO: 299174

SEQ ID NO: 612335 - RNA, 64 nt, hsa; identical to SEQ ID NO: 299175

SEQ ID NO: 612336 - RNA, 64 nt, hsa; identical to SEQ ID NO: 299176

SEQ ID NO: 612337 - RNA, 64 nt, hsa; identical to SEQ ID NO: 299177

SEQ ID NO: 612338 - RNA, 64 nt, hsa; identical to SEQ ID NO: 299178

SEQ ID NO: 612339 - RNA, 64 nt, hsa; identical to SEQ ID NO: 299179

SEQ ID NO: 612340 - RNA, 64 nt, hsa; identical to SEQ ID NO: 299180

SEQ ID NO: 612341 - RNA, 64 nt, hsa; identical to SEQ ID NO: 299181

SEQ ID NO: 612342 - RNA, 64 nt, hsa; identical to SEQ ID NO: 299182

SEQ ID NO: 612343 - RNA, 64 nt, hsa; identical to SEQ ID NO: 299183

SEQ ID NO: 612344 - RNA, 64 nt, hsa; identical to SEQ ID NO: 299184

SEQ ID NO: 612345 - RNA, 64 nt, hsa; identical to SEQ ID NO: 299185

SEQ ID NO: 612346 - RNA, 64 nt, hsa; identical to SEQ ID NO: 299186

SEQ ID NO: 612347 - RNA, 64 nt, hsa; identical to SEQ ID NO: 299187

SEQ ID NO: 612348 - RNA, 64 nt, hsa; identical to SEQ ID NO: 299188

SEQ ID NO: 612349 - RNA, 64 nt, hsa; identical to SEQ ID NO: 299189

SEQ ID NO: 612350 - RNA, 64 nt, hsa; identical to SEQ ID NO: 299190

SEQ ID NO: 612351 - RNA, 64 nt, hsa; identical to SEQ ID NO: 299191

SEQ ID NO: 612352 - RNA, 64 nt, hsa; identical to SEQ ID NO: 299192

SEQ ID NO: 612353 - RNA, 64 nt, hsa; identical to SEQ ID NO: 299193

SEQ ID NO: 612354 - RNA, 64 nt, hsa; identical to SEQ ID NO: 299194

SEQ ID NO: 612355 - RNA, 64 nt, hsa; identical to SEQ ID NO: 299195

SEQ ID NO: 612356 - RNA, 64 nt, hsa; identical to SEQ ID NO: 299196

SEQ ID NO: 612357 - RNA, 64 nt, hsa; identical to SEQ ID NO: 299197

SEQ ID NO: 612358 - RNA, 64 nt, hsa; identical to SEQ ID NO: 299198

SEQ ID NO: 612359 - RNA, 64 nt, hsa; identical to SEQ ID NO: 299199

SEQ ID NO: 612360 - RNA, 64 nt, hsa; identical to SEQ ID NO: 299200

SEQ ID NO: 612361 - RNA, 64 nt, hsa; identical to SEQ ID NO: 299201

SEQ ID NO: 612362 - RNA, 64 nt, hsa; identical to SEQ ID NO: 299202

SEQ ID NO: 612363 - RNA, 64 nt, hsa; identical to SEQ ID NO: 299203

SEQ ID NO: 612364 - RNA, 64 nt, hsa; identical to SEQ ID NO: 299204

SEQ ID NO: 612365 - RNA, 64 nt, hsa; identical to SEQ ID NO: 299205

SEQ ID NO: 612366 - RNA, 64 nt, hsa; identical to SEQ ID NO: 299206

SEQ ID NO: 612367 - RNA, 64 nt, hsa; identical to SEQ ID NO: 299207

SEQ ID NO: 612368 - RNA, 64 nt, hsa; identical to SEQ ID NO: 299208

SEQ ID NO: 612369 - RNA, 64 nt, hsa; identical to SEQ ID NO: 299209

SEQ ID NO: 612370 - RNA, 64 nt, hsa; identical to SEQ ID NO: 257770

SEQ ID NO: 612371 - RNA, 64 nt, hsa; identical to SEQ ID NO: 257771

SEQ ID NO: 612372 - RNA, 61 nt, hsa; identical to SEQ ID NO: 257772

SEQ ID NO: 612373 - RNA, 64 nt, hsa; identical to SEQ ID NO: 257773

SEQ ID NO: 612374 - RNA, 64 nt, hsa; identical to SEQ ID NO: 257774

SEQ ID NO: 612375 - RNA, 64 nt, hsa; identical to SEQ ID NO: 257775

SEQ ID NO: 612376 - RNA, 64 nt, hsa
cucugguguaaaaaagaugacugaaccuugcaguucugugaauuuuuauaaaacauacaaaaac

SEQ ID NO: 612377 - RNA, 64 nt, hsa
aaaacaaaacuuuccagccauuuuacugcagcagucugugaacuaaauuuguaaauauggcugc

SEQ ID NO: 612378 - RNA, 64 nt, hsa
ucacaguggucuaccugcauucauaauuccaggaucugugaagagcacauaugugucagggcac

SEQ ID NO: 612379 - RNA, 64 nt, hsa
ggacaccucaagaugaauaauaauucacaaaauuucugugaaaucaaauccaguuuuaagagga

SEQ ID NO: 612380 - RNA, 64 nt, hsa
cucuaacgacacacuauacuucuauaugcuuuuuucugugaauuuuccuugguacaugagagaa

SEQ ID NO: 612381 - RNA, 64 nt, hsa
cuguaaucacugcuacaaucagcucaccugaucaucugugaauucagguguucagagccuccug

SEQ ID NO: 612382 - RNA, 64 nt, hsa
cccuuggauguaacauacuaguuaguuaaugaauucugugaauucugugaagaguaaugugauu

SEQ ID NO: 612383 - RNA, 64 nt, hsa
guaacauacuaguuaguuaaugaauucugugaauucugugaagaguaaugugauugaaaauaag

SEQ ID NO: 612384 - RNA, 64 nt, hsa
cuucuacugaaucuauaaaaacugcaguuuuacaucugugaacuauggcuuaagggacaggauu

SEQ ID NO: 612385 - RNA, 64 nt, hsa
ggaguuaacuggaauagcaguacacuagcaaguaucugugaauccuuagcacugacggguuaac

SEQ ID NO: 612386 - RNA, 64 nt, hsa
gauaaaacuuacagcccccuacaccaagaguguaucugugaaagagcuccuacacuuugaaaac

SEQ ID NO: 612387 - RNA, 64 nt, hsa
uccuccacagaucucauaggaaauguucaacaauucugugaaaggucacaggacccaauuggag

SEQ ID NO: 612388 - RNA, 64 nt, hsa
ugauuugaucacacggguucuucgugggguuacaucugugaauagccuguuuuccacauguaaa

SEQ ID NO: 612389 - RNA, 64 nt, hsa
gaugccaacaugguuuuguccaugguucugacuuucugugaaggcaccagcuugcaauaugcca

SEQ ID NO: 612390 - RNA, 64 nt, hsa
gucauugugaggccaccaguccauucauuugaauucugugaaucuccaccuugccuaucuuugg

SEQ ID NO: 612391 - RNA, 64 nt, hsa
uccucuuccccuacaucccuggcacugguuguuuucugugaaaacagcagugaacagguucagu

SEQ ID NO: 612392 - RNA, 64 nt, hsa
caagcuacuuaacuugguagccucgauguccuccucugugaaacugggaugauaauaaugccua

SEQ ID NO: 612393 - RNA, 64 nt, hsa
uuuguaaacuuccaagucauucucaccuaaacccucugugaaauuuguaauauggggaaguagg

SEQ ID NO: 612394 - RNA, 64 nt, hsa
ccaaauuuuaggaacagaaucaaaagaauaaaaaucugugaagagauccuacuacucuuccuuc

SEQ ID NO: 612395 - RNA, 64 nt, hsa
uucaagcagugcacccgguggaagcugaaauccaucugugaauggaacugaagugaacgugaau

SEQ ID NO: 612396 - RNA, 64 nt, hsa
ccgccaacuccuauacccaucuucccuaggugaaucugugaaugguccuuucuggcagcaaucc

SEQ ID NO: 612397 - RNA, 64 nt, hsa
gagauaaacuauaucuuggcuaguggcuacugugucugugaauguaaccaguacuucuuuaagc

SEQ ID NO: 612398 - RNA, 64 nt, hsa
uaauaguggucaagauuccgaacuaggacuuuccucugugaagaggaugccucugaagaaauuu

SEQ ID NO: 612399 - RNA, 64 nt, hsa
aggguuuggacuagaugaguggcuuucaggguguucugugaaucuccucaugaauacuuuaggg

SEQ ID NO: 612400 - RNA, 64 nt, hsa
gcuaaugguuucaucugaaagcugccauagaaauucugugaaccagaaugagacaaggcagcag

SEQ ID NO: 612401 - RNA, 64 nt, hsa
aaucacucucuuaucccauccauuugugauaacaucugugaacaugcuguggcucuauuugcaa

SEQ ID NO: 612402 - RNA, 64 nt, hsa
gaacggcgaugaacaaauguaauuaauaacuuucucugugaaagcuuuggaaaaaucuuuuuuu

SEQ ID NO: 612403 - RNA, 64 nt, hsa
auagauaaccaauuuucagacacauuuuuggauuucugugaaguugaauaaacauaaaagcuaa

SEQ ID NO: 612404 - RNA, 64 nt, hsa
caagaaccuuaccuucaaggagcaagugaagaacucugugaaggauggaacuuucagauaucaa

SEQ ID NO: 612405 - RNA, 64 nt, hsa
ggagucuacuaauuuaccugaaugguguuugcauucugugaaaugccucuccacguugcauaug

SEQ ID NO: 612406 - RNA, 64 nt, hsa
ugugacgggucuaacagcccccggcuacucuuguucugugaaauguguauuuuagucucuguga

SEQ ID NO: 612407 - RNA, 64 nt, hsa
gcuacucuuguucugugaaauguguauuuuagucucugugaagccuuuacucucuaggugccuu

SEQ ID NO: 612408 - RNA, 64 nt, hsa
uacuaugaucuuguuugucaauaaaaagcagcuaucugugaaccagguaacuguguguuuugga

SEQ ID NO: 612409 - RNA, 64 nt, hsa
ccaacguuuuaaccaaagcguaucguaccaacgaucugugaaaaugcacuggaagcuucugguc

SEQ ID NO: 612410 - RNA, 64 nt, hsa
gccgaaagugcuaaaauauuuagugcgguauugcucugugaauucaaguucaacagacuucacu

SEQ ID NO: 612411 - RNA, 64 nt, hsa
ggugagggcuggaaauccaaacucaccaccaugaucugugaaauaaagcccuuagcggugugaa

SEQ ID NO: 612412 - RNA, 64 nt, hsa
aaguugucauuugaggucgcacuuggaaguuacaucugugaaguuucugucauucguccagauc

SEQ ID NO: 612413 - RNA, 64 nt, hsa
aaaugccccaguuuccuuugaaaaagccacuaguucugugaauuguccuuuucccuccugcccc

SEQ ID NO: 612414 - RNA, 64 nt, hsa
ugucuuauucuuaaagccaugguaaaaauagggaucugugaaggaaauuucuaaaauuggaugu

SEQ ID NO: 612415 - RNA, 64 nt, hsa
agcuuugggaaauuaaauugcuaaauuuguauucucugugaauuucacuggcaguuuugaacuu

SEQ ID NO: 612416 - RNA, 64 nt, hsa
acuugguaaaaacccacaggugcugcugcuuauaucugugaagcacuagcuuauucuaggaaug

SEQ ID NO: 612417 - RNA, 64 nt, hsa
ugaaugacuugaauuuuuuauucccugccuagggucugugaacgaggccugucucuucccuggg

SEQ ID NO: 612418 - RNA, 64 nt, hsa
ggaacugucagaaauccucaugccuuucaagacuucugugaaugacuugaauuuuuuauucccu

SEQ ID NO: 612419 - RNA, 64 nt, hsa
uuucuagauaguuugggaacgggguugauggguuucugugaaacacauuuuccaagucuugggc

SEQ ID NO: 612420 - RNA, 64 nt, hsa
ugugggagacaucacugcaucuguccccccagcuucugugaagggaagcuguggccucuuuuga

SEQ ID NO: 612421 - RNA, 64 nt, hsa
augauuucugugaaaucgaggccccuugauuguuucugugaaacacccugcaccccuaguccuu

SEQ ID NO: 612422 - RNA, 64 nt, hsa
ccucuucuacccacaaggagcccucuugaugauuucugugaaaucgaggccccuugauuguuuc

SEQ ID NO: 612423 - RNA, 64 nt, hsa
gguacugcauucugaaucagaaucucgcaguguuucugugaauagauuuuuuuguaaauaugac

SEQ ID NO: 612424 - RNA, 64 nt, hsa
guucaaauaguugacggaauuggguuucugaaugucugugaauuucagaggucucugcuagccu

SEQ ID NO: 612425 - RNA, 64 nt, hsa
uuugcuguuguauuacuuauucuuugccuuguucucugugaaguccuuuccuaaaaaagaaacu

SEQ ID NO: 612426 - RNA, 64 nt, hsa
agcauucacuuagccaggggcuuuuagauaauugucugugaagucugagaaaagacuaagauaa

SEQ ID NO: 612427 - RNA, 64 nt, hsa; identical to SEQ ID NO: 55732

SEQ ID NO: 612428 - RNA, 64 nt, hsa; identical to SEQ ID NO: 55733

SEQ ID NO: 612429 - RNA, 64 nt, hsa; identical to SEQ ID NO: 55734

SEQ ID NO: 612430 - RNA, 64 nt, hsa; identical to SEQ ID NO: 55735

SEQ ID NO: 612431 - RNA, 64 nt, hsa; identical to SEQ ID NO: 55736

SEQ ID NO: 612432 - RNA, 64 nt, hsa; identical to SEQ ID NO: 55737

SEQ ID NO: 612433 - RNA, 64 nt, hsa; identical to SEQ ID NO: 562946

SEQ ID NO: 612434 - RNA, 64 nt, hsa; identical to SEQ ID NO: 562947

SEQ ID NO: 612435 - RNA, 64 nt, hsa; identical to SEQ ID NO: 562948

SEQ ID NO: 612436 - RNA, 64 nt, hsa; identical to SEQ ID NO: 562949

SEQ ID NO: 612437 - RNA, 64 nt, hsa; identical to SEQ ID NO: 562950

SEQ ID NO: 612438 - RNA, 64 nt, hsa; identical to SEQ ID NO: 562951

SEQ ID NO: 612439 - RNA, 64 nt, hsa; identical to SEQ ID NO: 562952

SEQ ID NO: 612440 - RNA, 64 nt, hsa; identical to SEQ ID NO: 562953

SEQ ID NO: 612441 - RNA, 64 nt, hsa; identical to SEQ ID NO: 562954

SEQ ID NO: 612442 - RNA, 64 nt, hsa; identical to SEQ ID NO: 562955

SEQ ID NO: 612443 - RNA, 64 nt, hsa; identical to SEQ ID NO: 562956

SEQ ID NO: 612444 - RNA, 64 nt, hsa; identical to SEQ ID NO: 562957

SEQ ID NO: 612445 - RNA, 64 nt, hsa; identical to SEQ ID NO: 562958

SEQ ID NO: 612446 - RNA, 64 nt, hsa; identical to SEQ ID NO: 562959

SEQ ID NO: 612447 - RNA, 64 nt, hsa; identical to SEQ ID NO: 562960

SEQ ID NO: 612448 - RNA, 64 nt, hsa; identical to SEQ ID NO: 562961

SEQ ID NO: 612449 - RNA, 64 nt, hsa; identical to SEQ ID NO: 562962

SEQ ID NO: 612450 - RNA, 64 nt, hsa; identical to SEQ ID NO: 562963

SEQ ID NO: 612451 - RNA, 64 nt, hsa; identical to SEQ ID NO: 562964

SEQ ID NO: 612452 - RNA, 64 nt, hsa; identical to SEQ ID NO: 562965

SEQ ID NO: 612453 - RNA, 64 nt, hsa; identical to SEQ ID NO: 562966

SEQ ID NO: 612454 - RNA, 64 nt, hsa; identical to SEQ ID NO: 562967

SEQ ID NO: 612455 - RNA, 64 nt, hsa; identical to SEQ ID NO: 562968

SEQ ID NO: 612456 - RNA, 64 nt, hsa; identical to SEQ ID NO: 562969

SEQ ID NO: 612457 - RNA, 64 nt, hsa; identical to SEQ ID NO: 562970

SEQ ID NO: 612458 - RNA, 64 nt, hsa; identical to SEQ ID NO: 562970

SEQ ID NO: 612459 - RNA, 64 nt, hsa; identical to SEQ ID NO: 562972

SEQ ID NO: 612460 - RNA, 64 nt, hsa; identical to SEQ ID NO: 562973

SEQ ID NO: 612461 - RNA, 64 nt, hsa; identical to SEQ ID NO: 562974

SEQ ID NO: 612462 - RNA, 64 nt, hsa; identical to SEQ ID NO: 562975

SEQ ID NO: 612463 - RNA, 64 nt, hsa; identical to SEQ ID NO: 562976

SEQ ID NO: 612464 - RNA, 64 nt, hsa; identical to SEQ ID NO: 562977

SEQ ID NO: 612465 - RNA, 64 nt, hsa; identical to SEQ ID NO: 562978

SEQ ID NO: 612466 - RNA, 64 nt, hsa; identical to SEQ ID NO: 562979

SEQ ID NO: 612467 - RNA, 64 nt, hsa; identical to SEQ ID NO: 562980

SEQ ID NO: 612468 - RNA, 64 nt, hsa; identical to SEQ ID NO: 313220

SEQ ID NO: 612469 - RNA, 64 nt, hsa; identical to SEQ ID NO: 313221

SEQ ID NO: 612470 - RNA, 64 nt, hsa; identical to SEQ ID NO: 313222

SEQ ID NO: 612471 - RNA, 64 nt, hsa; identical to SEQ ID NO: 313223

SEQ ID NO: 612472 - RNA, 64 nt, hsa; identical to SEQ ID NO: 313224

SEQ ID NO: 612473 - RNA, 64 nt, hsa; identical to SEQ ID NO: 313225

SEQ ID NO: 612474 - RNA, 64 nt, hsa; identical to SEQ ID NO: 313226

SEQ ID NO: 612475 - RNA, 64 nt, hsa; identical to SEQ ID NO: 313227

SEQ ID NO: 612476 - RNA, 64 nt, hsa; identical to SEQ ID NO: 313228

SEQ ID NO: 612477 - RNA, 64 nt, hsa; identical to SEQ ID NO: 313229

SEQ ID NO: 612478 - RNA, 64 nt, hsa; identical to SEQ ID NO: 313230

SEQ ID NO: 612479 - RNA, 64 nt, hsa; identical to SEQ ID NO: 313231

SEQ ID NO: 612480 - RNA, 64 nt, hsa; identical to SEQ ID NO: 313232

SEQ ID NO: 612481 - RNA, 64 nt, hsa; identical to SEQ ID NO: 313233

SEQ ID NO: 612482 - RNA, 64 nt, hsa; identical to SEQ ID NO: 313234

SEQ ID NO: 612483 - RNA, 64 nt, hsa; identical to SEQ ID NO: 313235

SEQ ID NO: 612484 - RNA, 64 nt, hsa; identical to SEQ ID NO: 313236

SEQ ID NO: 612485 - RNA, 64 nt, hsa; identical to SEQ ID NO: 313237

SEQ ID NO: 612486 - RNA, 64 nt, hsa; identical to SEQ ID NO: 313238

SEQ ID NO: 612487 - RNA, 64 nt, hsa; identical to SEQ ID NO: 313239

SEQ ID NO: 612488 - RNA, 64 nt, hsa; identical to SEQ ID NO: 313240

SEQ ID NO: 612489 - RNA, 64 nt, hsa; identical to SEQ ID NO: 313241

SEQ ID NO: 612490 - RNA, 64 nt, hsa; identical to SEQ ID NO: 313242

SEQ ID NO: 612491 - RNA, 64 nt, hsa; identical to SEQ ID NO: 313243

SEQ ID NO: 612492 - RNA, 64 nt, hsa; identical to SEQ ID NO: 313244

SEQ ID NO: 612493 - RNA, 64 nt, hsa; identical to SEQ ID NO: 313245

SEQ ID NO: 612494 - RNA, 64 nt, hsa; identical to SEQ ID NO: 313246

SEQ ID NO: 612495 - RNA, 64 nt, hsa; identical to SEQ ID NO: 313247

SEQ ID NO: 612496 - RNA, 64 nt, hsa; identical to SEQ ID NO: 313248

SEQ ID NO: 612497 - RNA, 64 nt, hsa; identical to SEQ ID NO: 313249

SEQ ID NO: 612498 - RNA, 64 nt, hsa; identical to SEQ ID NO: 313250

SEQ ID NO: 612499 - RNA, 64 nt, hsa; identical to SEQ ID NO: 313251

SEQ ID NO: 612500 - RNA, 64 nt, hsa; identical to SEQ ID NO: 313252

SEQ ID NO: 612501 - RNA, 64 nt, hsa; identical to SEQ ID NO: 313253

SEQ ID NO: 612502 - RNA, 64 nt, hsa; identical to SEQ ID NO: 313254

SEQ ID NO: 612503 - RNA, 64 nt, hsa; identical to SEQ ID NO: 313255

SEQ ID NO: 612504 - RNA, 64 nt, hsa; identical to SEQ ID NO: 313256

SEQ ID NO: 612505 - RNA, 64 nt, hsa; identical to SEQ ID NO: 313257

SEQ ID NO: 612506 - RNA, 64 nt, hsa; identical to SEQ ID NO: 313258

SEQ ID NO: 612507 - RNA, 64 nt, hsa; identical to SEQ ID NO: 313259

SEQ ID NO: 612508 - RNA, 64 nt, hsa; identical to SEQ ID NO: 313260

SEQ ID NO: 612509 - RNA, 64 nt, hsa; identical to SEQ ID NO: 313261

SEQ ID NO: 612510 - RNA, 64 nt, hsa; identical to SEQ ID NO: 313262

SEQ ID NO: 612511 - RNA, 64 nt, hsa; identical to SEQ ID NO: 313263

SEQ ID NO: 612512 - RNA, 64 nt, hsa; identical to SEQ ID NO: 313264

SEQ ID NO: 612513 - RNA, 64 nt, hsa; identical to SEQ ID NO: 313265

SEQ ID NO: 612514 - RNA, 64 nt, hsa; identical to SEQ ID NO: 411771

SEQ ID NO: 612515 - RNA, 64 nt, hsa; identical to SEQ ID NO: 411772

SEQ ID NO: 612516 - RNA, 64 nt, hsa; identical to SEQ ID NO: 411773

SEQ ID NO: 612517 - RNA, 64 nt, hsa; identical to SEQ ID NO: 411774

SEQ ID NO: 612518 - RNA, 64 nt, hsa; identical to SEQ ID NO: 411775

SEQ ID NO: 612519 - RNA, 64 nt, hsa; identical to SEQ ID NO: 411776

SEQ ID NO: 612520 - RNA, 64 nt, hsa; identical to SEQ ID NO: 411777

SEQ ID NO: 612521 - RNA, 64 nt, hsa; identical to SEQ ID NO: 411778

SEQ ID NO: 612522 - RNA, 64 nt, hsa; identical to SEQ ID NO: 411779

SEQ ID NO: 612523 - RNA, 64 nt, hsa; identical to SEQ ID NO: 411780

SEQ ID NO: 612524 - RNA, 64 nt, hsa; identical to SEQ ID NO: 411781

SEQ ID NO: 612525 - RNA, 64 nt, hsa; identical to SEQ ID NO: 411782

SEQ ID NO: 612526 - RNA, 64 nt, hsa; identical to SEQ ID NO: 411783

SEQ ID NO: 612527 - RNA, 64 nt, hsa; identical to SEQ ID NO: 411784

SEQ ID NO: 612528 - RNA, 64 nt, hsa; identical to SEQ ID NO: 411785

SEQ ID NO: 612529 - RNA, 64 nt, hsa; identical to SEQ ID NO: 411786

SEQ ID NO: 612530 - RNA, 64 nt, hsa; identical to SEQ ID NO: 411787

SEQ ID NO: 612531 - RNA, 64 nt, hsa; identical to SEQ ID NO: 411788

SEQ ID NO: 612532 - RNA, 64 nt, hsa; identical to SEQ ID NO: 411789

SEQ ID NO: 612533 - RNA, 64 nt, hsa; identical to SEQ ID NO: 411790

SEQ ID NO: 612534 - RNA, 64 nt, hsa; identical to SEQ ID NO: 411791

SEQ ID NO: 612535 - RNA, 64 nt, hsa; identical to SEQ ID NO: 411792

SEQ ID NO: 612536 - RNA, 64 nt, hsa; identical to SEQ ID NO: 411793

SEQ ID NO: 612537 - RNA, 64 nt, hsa; identical to SEQ ID NO: 411794

SEQ ID NO: 612538 - RNA, 64 nt, hsa; identical to SEQ ID NO: 411795

SEQ ID NO: 612539 - RNA, 64 nt, hsa; identical to SEQ ID NO: 411796

SEQ ID NO: 612540 - RNA, 64 nt, hsa; identical to SEQ ID NO: 411797

SEQ ID NO: 612541 - RNA, 64 nt, hsa; identical to SEQ ID NO: 411798

SEQ ID NO: 612542 - RNA, 64 nt, hsa; identical to SEQ ID NO: 411799

SEQ ID NO: 612543 - RNA, 64 nt, hsa; identical to SEQ ID NO: 411800

SEQ ID NO: 612544 - RNA, 64 nt, hsa; identical to SEQ ID NO: 411801

SEQ ID NO: 612545 - RNA, 64 nt, hsa; identical to SEQ ID NO: 411802

SEQ ID NO: 612546 - RNA, 64 nt, hsa; identical to SEQ ID NO: 411803

SEQ ID NO: 612547 - RNA, 64 nt, hsa; identical to SEQ ID NO: 411804

SEQ ID NO: 612548 - RNA, 64 nt, hsa; identical to SEQ ID NO: 411805

SEQ ID NO: 612549 - RNA, 64 nt, hsa; identical to SEQ ID NO: 411806

SEQ ID NO: 612550 - RNA, 64 nt, hsa; identical to SEQ ID NO: 411807

SEQ ID NO: 612551 - RNA, 64 nt, hsa; identical to SEQ ID NO: 411808

SEQ ID NO: 612552 - RNA, 64 nt, hsa; identical to SEQ ID NO: 411809

SEQ ID NO: 612553 - RNA, 64 nt, hsa; identical to SEQ ID NO: 411810

SEQ ID NO: 612554 - RNA, 64 nt, hsa; identical to SEQ ID NO: 411811

SEQ ID NO: 612555 - RNA, 64 nt, hsa; identical to SEQ ID NO: 411812

SEQ ID NO: 612556 - RNA, 64 nt, hsa; identical to SEQ ID NO: 411813

SEQ ID NO: 612557 - RNA, 64 nt, hsa; identical to SEQ ID NO: 411814

SEQ ID NO: 612558 - RNA, 64 nt, hsa; identical to SEQ ID NO: 411815

SEQ ID NO: 612559 - RNA, 64 nt, hsa; identical to SEQ ID NO: 411816

SEQ ID NO: 612560 - RNA, 64 nt, hsa; identical to SEQ ID NO: 411817

SEQ ID NO: 612561 - RNA, 64 nt, hsa; identical to SEQ ID NO: 411818

SEQ ID NO: 612562 - RNA, 64 nt, hsa; identical to SEQ ID NO: 411819

SEQ ID NO: 612563 - RNA, 64 nt, hsa; identical to SEQ ID NO: 411820

SEQ ID NO: 612564 - RNA, 64 nt, hsa; identical to SEQ ID NO: 411821

SEQ ID NO: 612565 - RNA, 64 nt, hsa; identical to SEQ ID NO: 411822

SEQ ID NO: 612566 - RNA, 64 nt, hsa; identical to SEQ ID NO: 411823

SEQ ID NO: 612567 - RNA, 64 nt, hsa; identical to SEQ ID NO: 411824

SEQ ID NO: 612568 - RNA, 64 nt, hsa; identical to SEQ ID NO: 411825

SEQ ID NO: 612569 - RNA, 64 nt, hsa; identical to SEQ ID NO: 411826

SEQ ID NO: 612570 - RNA, 64 nt, hsa; identical to SEQ ID NO: 411827

SEQ ID NO: 612571 - RNA, 64 nt, hsa; identical to SEQ ID NO: 411828

SEQ ID NO: 612572 - RNA, 64 nt, hsa; identical to SEQ ID NO: 411829

SEQ ID NO: 612573 - RNA, 64 nt, hsa; identical to SEQ ID NO: 262967

SEQ ID NO: 612574 - RNA, 64 nt, hsa; identical to SEQ ID NO: 262968

SEQ ID NO: 612575 - RNA, 64 nt, hsa; identical to SEQ ID NO: 262969

SEQ ID NO: 612576 - RNA, 64 nt, hsa; identical to SEQ ID NO: 262970

SEQ ID NO: 612577 - RNA, 64 nt, hsa; identical to SEQ ID NO: 262971

SEQ ID NO: 612578 - RNA, 64 nt, hsa; identical to SEQ ID NO: 262972

SEQ ID NO: 612579 - RNA, 64 nt, hsa; identical to SEQ ID NO: 262973

SEQ ID NO: 612580 - RNA, 64 nt, hsa; identical to SEQ ID NO: 262974

SEQ ID NO: 612581 - RNA, 64 nt, hsa; identical to SEQ ID NO: 262975

SEQ ID NO: 612582 - RNA, 64 nt, hsa; identical to SEQ ID NO: 262976

SEQ ID NO: 612583 - RNA, 64 nt, hsa; identical to SEQ ID NO: 262977

SEQ ID NO: 612584 - RNA, 64 nt, hsa; identical to SEQ ID NO: 262978

SEQ ID NO: 612585 - RNA, 64 nt, hsa; identical to SEQ ID NO: 262979

SEQ ID NO: 612586 - RNA, 64 nt, hsa; identical to SEQ ID NO: 262980

SEQ ID NO: 612587 - RNA, 64 nt, hsa; identical to SEQ ID NO: 262981

SEQ ID NO: 612588 - RNA, 64 nt, hsa; identical to SEQ ID NO: 262982

SEQ ID NO: 612589 - RNA, 64 nt, hsa; identical to SEQ ID NO: 262983

SEQ ID NO: 612590 - RNA, 64 nt, hsa; identical to SEQ ID NO: 262984

SEQ ID NO: 612591 - RNA, 64 nt, hsa; identical to SEQ ID NO: 262985

SEQ ID NO: 612592 - RNA, 64 nt, hsa; identical to SEQ ID NO: 262986

SEQ ID NO: 612593 - RNA, 64 nt, hsa; identical to SEQ ID NO: 262987

SEQ ID NO: 612594 - RNA, 64 nt, hsa; identical to SEQ ID NO: 262988

SEQ ID NO: 612595 - RNA, 64 nt, hsa; identical to SEQ ID NO: 262989

SEQ ID NO: 612596 - RNA, 64 nt, hsa; identical to SEQ ID NO: 262990

SEQ ID NO: 612597 - RNA, 64 nt, hsa; identical to SEQ ID NO: 262991

SEQ ID NO: 612598 - RNA, 64 nt, hsa; identical to SEQ ID NO: 262992

SEQ ID NO: 612599 - RNA, 64 nt, hsa; identical to SEQ ID NO: 262993

SEQ ID NO: 612600 - RNA, 64 nt, hsa; identical to SEQ ID NO: 262994

SEQ ID NO: 612601 - RNA, 64 nt, hsa; identical to SEQ ID NO: 262995

SEQ ID NO: 612602 - RNA, 64 nt, hsa; identical to SEQ ID NO: 262996

SEQ ID NO: 612603 - RNA, 64 nt, hsa; identical to SEQ ID NO: 262997

SEQ ID NO: 612604 - RNA, 64 nt, hsa; identical to SEQ ID NO: 262998

SEQ ID NO: 612605 - RNA, 64 nt, hsa; identical to SEQ ID NO: 262999

SEQ ID NO: 612606 - RNA, 64 nt, hsa; identical to SEQ ID NO: 263000

SEQ ID NO: 612607 - RNA, 64 nt, hsa; identical to SEQ ID NO: 263001

SEQ ID NO: 612608 - RNA, 64 nt, hsa; identical to SEQ ID NO: 263002

SEQ ID NO: 612609 - RNA, 64 nt, hsa; identical to SEQ ID NO: 263003

SEQ ID NO: 612610 - RNA, 64 nt, hsa; identical to SEQ ID NO: 263004

SEQ ID NO: 612611 - RNA, 64 nt, hsa; identical to SEQ ID NO: 263005

SEQ ID NO: 612612 - RNA, 64 nt, hsa; identical to SEQ ID NO: 263006

SEQ ID NO: 612613 - RNA, 64 nt, hsa; identical to SEQ ID NO: 263007

SEQ ID NO: 612614 - RNA, 64 nt, hsa; identical to SEQ ID NO: 263008

SEQ ID NO: 612615 - RNA, 64 nt, hsa; identical to SEQ ID NO: 263009

SEQ ID NO: 612616 - RNA, 50 nt, hsa; identical to SEQ ID NO: 263010

SEQ ID NO: 612617 - RNA, 64 nt, hsa; identical to SEQ ID NO: 263011

SEQ ID NO: 612618 - RNA, 64 nt, hsa; identical to SEQ ID NO: 263012

SEQ ID NO: 612619 - RNA, 64 nt, hsa; identical to SEQ ID NO: 263013

SEQ ID NO: 612620 - RNA, 64 nt, hsa; identical to SEQ ID NO: 263014

SEQ ID NO: 612621 - RNA, 64 nt, hsa; identical to SEQ ID NO: 263015

SEQ ID NO: 612622 - RNA, 64 nt, hsa; identical to SEQ ID NO: 263016

SEQ ID NO: 612623 - RNA, 64 nt, hsa; identical to SEQ ID NO: 263017

SEQ ID NO: 612624 - RNA, 64 nt, hsa; identical to SEQ ID NO: 263018

SEQ ID NO: 612625 - RNA, 64 nt, hsa; identical to SEQ ID NO: 263019

SEQ ID NO: 612626 - RNA, 64 nt, hsa; identical to SEQ ID NO: 263020

SEQ ID NO: 612627 - RNA, 64 nt, hsa; identical to SEQ ID NO: 263021

SEQ ID NO: 612628 - RNA, 64 nt, hsa; identical to SEQ ID NO: 263022

SEQ ID NO: 612629 - RNA, 64 nt, hsa; identical to SEQ ID NO: 263023

SEQ ID NO: 612630 - RNA, 64 nt, hsa; identical to SEQ ID NO: 263024

SEQ ID NO: 612631 - RNA, 64 nt, hsa; identical to SEQ ID NO: 263025

SEQ ID NO: 612632 - RNA, 64 nt, hsa; identical to SEQ ID NO: 263026

SEQ ID NO: 612633 - RNA, 64 nt, hsa; identical to SEQ ID NO: 263027

SEQ ID NO: 612634 - RNA, 64 nt, hsa; identical to SEQ ID NO: 263028

SEQ ID NO: 612635 - RNA, 64 nt, hsa; identical to SEQ ID NO: 263029

SEQ ID NO: 612636 - RNA, 64 nt, hsa; identical to SEQ ID NO: 263030

SEQ ID NO: 612637 - RNA, 64 nt, hsa; identical to SEQ ID NO: 263031

SEQ ID NO: 612638 - RNA, 64 nt, hsa; identical to SEQ ID NO: 263032

SEQ ID NO: 612639 - RNA, 64 nt, hsa; identical to SEQ ID NO: 263033

SEQ ID NO: 612640 - RNA, 64 nt, hsa; identical to SEQ ID NO: 263034

SEQ ID NO: 612641 - RNA, 64 nt, hsa; identical to SEQ ID NO: 263035

SEQ ID NO: 612642 - RNA, 64 nt, hsa; identical to SEQ ID NO: 263036

SEQ ID NO: 612643 - RNA, 64 nt, hsa; identical to SEQ ID NO: 263037

SEQ ID NO: 612644 - RNA, 64 nt, hsa; identical to SEQ ID NO: 263038

SEQ ID NO: 612645 - RNA, 64 nt, hsa; identical to SEQ ID NO: 263039

SEQ ID NO: 612646 - RNA, 64 nt, hsa; identical to SEQ ID NO: 263040

SEQ ID NO: 612647 - RNA, 64 nt, hsa; identical to SEQ ID NO: 263041

SEQ ID NO: 612648 - RNA, 64 nt, hsa; identical to SEQ ID NO: 263042

SEQ ID NO: 612649 - RNA, 64 nt, hsa; identical to SEQ ID NO: 263043

SEQ ID NO: 612650 - RNA, 64 nt, hsa; identical to SEQ ID NO: 263044

SEQ ID NO: 612651 - RNA, 64 nt, hsa; identical to SEQ ID NO: 263045

SEQ ID NO: 612652 - RNA, 64 nt, hsa; identical to SEQ ID NO: 263046

SEQ ID NO: 612653 - RNA, 64 nt, hsa; identical to SEQ ID NO: 48734

SEQ ID NO: 612654 - RNA, 64 nt, hsa; identical to SEQ ID NO: 48735

SEQ ID NO: 612655 - RNA, 64 nt, hsa; identical to SEQ ID NO: 48736

SEQ ID NO: 612656 - RNA, 64 nt, hsa; identical to SEQ ID NO: 48737

SEQ ID NO: 612657 - RNA, 64 nt, hsa; identical to SEQ ID NO: 48738

SEQ ID NO: 612658 - RNA, 64 nt, hsa; identical to SEQ ID NO: 48739

SEQ ID NO: 612659 - RNA, 64 nt, hsa; identical to SEQ ID NO: 48740

SEQ ID NO: 612660 - RNA, 64 nt, hsa; identical to SEQ ID NO: 48741

SEQ ID NO: 612661 - RNA, 64 nt, hsa; identical to SEQ ID NO: 48742

SEQ ID NO: 612662 - RNA, 64 nt, hsa; identical to SEQ ID NO: 48743

SEQ ID NO: 612663 - RNA, 64 nt, hsa; identical to SEQ ID NO: 48744

SEQ ID NO: 612664 - RNA, 64 nt, hsa; identical to SEQ ID NO: 48745

SEQ ID NO: 612665 - RNA, 64 nt, hsa; identical to SEQ ID NO: 48746

SEQ ID NO: 612666 - RNA, 64 nt, hsa; identical to SEQ ID NO: 48747

SEQ ID NO: 612667 - RNA, 64 nt, hsa; identical to SEQ ID NO: 48748

SEQ ID NO: 612668 - RNA, 64 nt, hsa
aguaugguuuccaccuaucucuaacaccacuauuaagguacaccaguguuaagguacauuaaua

SEQ ID NO: 612669 - RNA, 64 nt, hsa
aucucuaacaccacuauuaagguacaccaguguuaagguacauuaauaacuacacaaaauuuua

SEQ ID NO: 612670 - RNA, 64 nt, hsa
aguaauuauuaaaccaacuuaaugauucuuauguaagguacacuuuuuauuuuaauacauuggu

SEQ ID NO: 612671 - RNA, 64 nt, hsa
uuaaaaaacccaaguauguccauguguuucuuauaagguacacuugaaacuagugaguguuugu

SEQ ID NO: 612672 - RNA, 64 nt, hsa
guuaucuugaacauucugacguguaaaggaccauaagguacaucauuuaucuugaacauuccga

SEQ ID NO: 612673 - RNA, 64 nt, hsa
ccuggaaguauugagucuuccuuucaaggaccauaagguacaucaguuaucuugaacauucuga

SEQ ID NO: 612674 - RNA, 64 nt, hsa
uuauuuaagcacuuaggcagaguagacacaauuaaagguacaaagcccagaggaagugguagag

SEQ ID NO: 612675 - RNA, 64 nt, hsa
aauuuucaauguuuucccagccuauaaaaaaaggaagguacacguuguccuuuuaaagguugug

SEQ ID NO: 612676 - RNA, 64 nt, hsa
uaaucuuauucuguagucaucagaauguuaauguaagguacauuugauuuuuauuuuuuacaug

SEQ ID NO: 612677 - RNA, 64 nt, hsa
aaaggcaugucuuaggaacuguuucuguuucuguaagguacaugaauggucaaacaccagucua

SEQ ID NO: 612678 - RNA, 64 nt, hsa
cggcacauuuucugcaggucagcaguaagguuucaagguacaguuauggaggaaagaagaaaau

SEQ ID NO: 612679 - RNA, 64 nt, hsa
guauuuguguaucuaaacauaucuaaacauagaaaagguacaguaaaaauauauauauagauau

SEQ ID NO: 612680 - RNA, 64 nt, hsa; identical to SEQ ID NO: 368571

SEQ ID NO: 612681 - RNA, 64 nt, hsa; identical to SEQ ID NO: 368572

SEQ ID NO: 612682 - RNA, 64 nt, hsa; identical to SEQ ID NO: 368573

SEQ ID NO: 612683 - RNA, 64 nt, hsa; identical to SEQ ID NO: 368574

SEQ ID NO: 612684 - RNA, 64 nt, hsa; identical to SEQ ID NO: 368575

SEQ ID NO: 612685 - RNA, 64 nt, hsa; identical to SEQ ID NO: 368576

SEQ ID NO: 612686 - RNA, 64 nt, hsa; identical to SEQ ID NO: 368577

SEQ ID NO: 612687 - RNA, 64 nt, hsa; identical to SEQ ID NO: 368578

SEQ ID NO: 612688 - RNA, 64 nt, hsa; identical to SEQ ID NO: 368579

SEQ ID NO: 612689 - RNA, 64 nt, hsa; identical to SEQ ID NO: 368580

SEQ ID NO: 612690 - RNA, 64 nt, hsa; identical to SEQ ID NO: 368581

SEQ ID NO: 612691 - RNA, 64 nt, hsa; identical to SEQ ID NO: 368582

SEQ ID NO: 612692 - RNA, 64 nt, hsa; identical to SEQ ID NO: 368583

SEQ ID NO: 612693 - RNA, 64 nt, hsa; identical to SEQ ID NO: 368584

SEQ ID NO: 612694 - RNA, 64 nt, hsa; identical to SEQ ID NO: 368585

SEQ ID NO: 612695 - RNA, 64 nt, hsa; identical to SEQ ID NO: 368586

SEQ ID NO: 612696 - RNA, 64 nt, hsa; identical to SEQ ID NO: 368587

SEQ ID NO: 612697 - RNA, 64 nt, hsa; identical to SEQ ID NO: 368588

SEQ ID NO: 612698 - RNA, 64 nt, hsa; identical to SEQ ID NO: 368589

SEQ ID NO: 612699 - RNA, 64 nt, hsa; identical to SEQ ID NO: 368590

SEQ ID NO: 612700 - RNA, 64 nt, hsa; identical to SEQ ID NO: 368591

SEQ ID NO: 612701 - RNA, 64 nt, hsa; identical to SEQ ID NO: 368592

SEQ ID NO: 612702 - RNA, 64 nt, hsa; identical to SEQ ID NO: 368593

SEQ ID NO: 612703 - RNA, 64 nt, hsa; identical to SEQ ID NO: 368594

SEQ ID NO: 612704 - RNA, 64 nt, hsa; identical to SEQ ID NO: 368595

SEQ ID NO: 612705 - RNA, 64 nt, hsa; identical to SEQ ID NO: 368596

SEQ ID NO: 612706 - RNA, 64 nt, hsa; identical to SEQ ID NO: 368597

SEQ ID NO: 612707 - RNA, 64 nt, hsa; identical to SEQ ID NO: 368598

SEQ ID NO: 612708 - RNA, 64 nt, hsa; identical to SEQ ID NO: 368599

SEQ ID NO: 612709 - RNA, 64 nt, hsa; identical to SEQ ID NO: 368600

SEQ ID NO: 612710 - RNA, 64 nt, hsa; identical to SEQ ID NO: 368601

SEQ ID NO: 612711 - RNA, 64 nt, hsa; identical to SEQ ID NO: 368602

SEQ ID NO: 612712 - RNA, 64 nt, hsa; identical to SEQ ID NO: 368603

SEQ ID NO: 612713 - RNA, 64 nt, hsa; identical to SEQ ID NO: 368604

SEQ ID NO: 612714 - RNA, 64 nt, hsa; identical to SEQ ID NO: 368605

SEQ ID NO: 612715 - RNA, 64 nt, hsa; identical to SEQ ID NO: 368606

SEQ ID NO: 612716 - RNA, 64 nt, hsa; identical to SEQ ID NO: 368607

SEQ ID NO: 612717 - RNA, 64 nt, hsa; identical to SEQ ID NO: 368608

SEQ ID NO: 612718 - RNA, 64 nt, hsa; identical to SEQ ID NO: 368609

SEQ ID NO: 612719 - RNA, 64 nt, hsa; identical to SEQ ID NO: 368610

SEQ ID NO: 612720 - RNA, 64 nt, hsa; identical to SEQ ID NO: 368611

SEQ ID NO: 612721 - RNA, 64 nt, hsa; identical to SEQ ID NO: 368612

SEQ ID NO: 612722 - RNA, 64 nt, hsa; identical to SEQ ID NO: 368613

SEQ ID NO: 612723 - RNA, 64 nt, hsa; identical to SEQ ID NO: 247598

SEQ ID NO: 612724 - RNA, 64 nt, hsa; identical to SEQ ID NO: 247599

SEQ ID NO: 612725 - RNA, 64 nt, hsa; identical to SEQ ID NO: 247600

SEQ ID NO: 612726 - RNA, 64 nt, hsa; identical to SEQ ID NO: 247601

SEQ ID NO: 612727 - RNA, 64 nt, hsa; identical to SEQ ID NO: 247602

SEQ ID NO: 612728 - RNA, 64 nt, hsa; identical to SEQ ID NO: 247603

SEQ ID NO: 612729 - RNA, 64 nt, hsa; identical to SEQ ID NO: 247604

SEQ ID NO: 612730 - RNA, 64 nt, hsa; identical to SEQ ID NO: 247605

SEQ ID NO: 612731 - RNA, 64 nt, hsa; identical to SEQ ID NO: 247606

SEQ ID NO: 612732 - RNA, 64 nt, hsa; identical to SEQ ID NO: 247607

SEQ ID NO: 612733 - RNA, 64 nt, hsa; identical to SEQ ID NO: 247608

SEQ ID NO: 612734 - RNA, 64 nt, hsa; identical to SEQ ID NO: 247609

SEQ ID NO: 612735 - RNA, 64 nt, hsa; identical to SEQ ID NO: 247610

SEQ ID NO: 612736 - RNA, 64 nt, hsa; identical to SEQ ID NO: 247611

SEQ ID NO: 612737 - RNA, 64 nt, hsa; identical to SEQ ID NO: 247612

SEQ ID NO: 612738 - RNA, 64 nt, hsa; identical to SEQ ID NO: 247613

SEQ ID NO: 612739 - RNA, 64 nt, hsa
cagaggcuuuaaaauuuaaaaccucagcaaaauaauccaugaauuuacugauucuucuguaucg

SEQ ID NO: 612740 - RNA, 64 nt, hsa
caugaguuuugucucagcaggauagaauaagcaaauccaugaacuggucuucuauuaauacuuu

SEQ ID NO: 612741 - RNA, 64 nt, hsa
cuuuccuguaaaagggguucaucuuaacaaagucauccaugaugagggaaaaaguggcauuuca

SEQ ID NO: 612742 - RNA, 64 nt, hsa
gaugagggaaaaaguggcauuucauuuuuggggaauccaugagcuuccuuuauuucuggcucac

SEQ ID NO: 612743 - RNA, 64 nt, hsa
ucagccucauuuggacuaaaaaaagaaagcagaaauccaugaacacauugcuucucggccuuuu

SEQ ID NO: 612744 - RNA, 64 nt, hsa
cuucucggccuuuuggcuaagaucaaguguagaaauccaugaacacuaaaggacuucauugauu

SEQ ID NO: 612745 - RNA, 64 nt, hsa; identical to SEQ ID NO: 239152

SEQ ID NO: 612746 - RNA, 64 nt, hsa; identical to SEQ ID NO: 239153

SEQ ID NO: 612747 - RNA, 64 nt, hsa; identical to SEQ ID NO: 239154

SEQ ID NO: 612748 - RNA, 64 nt, hsa; identical to SEQ ID NO: 239155

SEQ ID NO: 612749 - RNA, 64 nt, hsa; identical to SEQ ID NO: 239156

SEQ ID NO: 612750 - RNA, 64 nt, hsa; identical to SEQ ID NO: 239157

SEQ ID NO: 612751 - RNA, 64 nt, hsa; identical to SEQ ID NO: 239158

SEQ ID NO: 612752 - RNA, 64 nt, hsa; identical to SEQ ID NO: 239159

SEQ ID NO: 612753 - RNA, 64 nt, hsa; identical to SEQ ID NO: 239160

SEQ ID NO: 612754 - RNA, 64 nt, hsa; identical to SEQ ID NO: 239161

SEQ ID NO: 612755 - RNA, 64 nt, hsa; identical to SEQ ID NO: 239162

SEQ ID NO: 612756 - RNA, 64 nt, hsa; identical to SEQ ID NO: 239163

SEQ ID NO: 612757 - RNA, 64 nt, hsa; identical to SEQ ID NO: 239164

SEQ ID NO: 612758 - RNA, 64 nt, hsa; identical to SEQ ID NO: 239165

SEQ ID NO: 612759 - RNA, 64 nt, hsa; identical to SEQ ID NO: 239166

SEQ ID NO: 612760 - RNA, 64 nt, hsa; identical to SEQ ID NO: 239167

SEQ ID NO: 612761 - RNA, 64 nt, hsa; identical to SEQ ID NO: 239168

SEQ ID NO: 612762 - RNA, 64 nt, hsa; identical to SEQ ID NO: 239169

SEQ ID NO: 612763 - RNA, 64 nt, hsa; identical to SEQ ID NO: 239170

SEQ ID NO: 612764 - RNA, 64 nt, hsa; identical to SEQ ID NO: 239171

SEQ ID NO: 612765 - RNA, 64 nt, hsa; identical to SEQ ID NO: 239172

SEQ ID NO: 612766 - RNA, 64 nt, hsa; identical to SEQ ID NO: 239173

SEQ ID NO: 612767 - RNA, 64 nt, hsa; identical to SEQ ID NO: 239174

SEQ ID NO: 612768 - RNA, 64 nt, hsa; identical to SEQ ID NO: 239175

SEQ ID NO: 612769 - RNA, 64 nt, hsa; identical to SEQ ID NO: 239176

SEQ ID NO: 612770 - RNA, 64 nt, hsa; identical to SEQ ID NO: 239177

SEQ ID NO: 612771 - RNA, 64 nt, hsa; identical to SEQ ID NO: 239178

SEQ ID NO: 612772 - RNA, 64 nt, hsa; identical to SEQ ID NO: 239179

SEQ ID NO: 612773 - RNA, 64 nt, hsa; identical to SEQ ID NO: 239180

SEQ ID NO: 612774 - RNA, 64 nt, hsa; identical to SEQ ID NO: 239181

SEQ ID NO: 612775 - RNA, 64 nt, hsa; identical to SEQ ID NO: 239182

SEQ ID NO: 612776 - RNA, 64 nt, hsa; identical to SEQ ID NO: 239183

SEQ ID NO: 612777 - RNA, 64 nt, hsa; identical to SEQ ID NO: 239184

SEQ ID NO: 612778 - RNA, 64 nt, hsa; identical to SEQ ID NO: 239185

SEQ ID NO: 612779 - RNA, 64 nt, hsa; identical to SEQ ID NO: 239186

SEQ ID NO: 612780 - RNA, 64 nt, hsa; identical to SEQ ID NO: 239187

SEQ ID NO: 612781 - RNA, 64 nt, hsa; identical to SEQ ID NO: 239188

SEQ ID NO: 612782 - RNA, 64 nt, hsa; identical to SEQ ID NO: 239189

SEQ ID NO: 612783 - RNA, 64 nt, hsa; identical to SEQ ID NO: 239190

SEQ ID NO: 612784 - RNA, 64 nt, hsa; identical to SEQ ID NO: 239191

SEQ ID NO: 612785 - RNA, 64 nt, hsa; identical to SEQ ID NO: 239192

SEQ ID NO: 612786 - RNA, 64 nt, hsa; identical to SEQ ID NO: 239193

SEQ ID NO: 612787 - RNA, 64 nt, hsa; identical to SEQ ID NO: 239194

SEQ ID NO: 612788 - RNA, 64 nt, hsa; identical to SEQ ID NO: 239195

SEQ ID NO: 612789 - RNA, 64 nt, hsa; identical to SEQ ID NO: 239196

SEQ ID NO: 612790 - RNA, 64 nt, hsa; identical to SEQ ID NO: 239197

SEQ ID NO: 612791 - RNA, 64 nt, hsa; identical to SEQ ID NO: 239198

SEQ ID NO: 612792 - RNA, 64 nt, hsa; identical to SEQ ID NO: 239199

SEQ ID NO: 612793 - RNA, 64 nt, hsa; identical to SEQ ID NO: 239200

SEQ ID NO: 612794 - RNA, 64 nt, hsa; identical to SEQ ID NO: 239201

SEQ ID NO: 612795 - RNA, 64 nt, hsa; identical to SEQ ID NO: 239202

SEQ ID NO: 612796 - RNA, 64 nt, hsa; identical to SEQ ID NO: 239203

SEQ ID NO: 612797 - RNA, 64 nt, hsa; identical to SEQ ID NO: 239204

SEQ ID NO: 612798 - RNA, 64 nt, hsa; identical to SEQ ID NO: 239205

SEQ ID NO: 612799 - RNA, 64 nt, hsa; identical to SEQ ID NO: 239206

SEQ ID NO: 612800 - RNA, 64 nt, hsa; identical to SEQ ID NO: 239207

SEQ ID NO: 612801 - RNA, 64 nt, hsa; identical to SEQ ID NO: 255843

SEQ ID NO: 612802 - RNA, 64 nt, hsa; identical to SEQ ID NO: 255844

SEQ ID NO: 612803 - RNA, 64 nt, hsa; identical to SEQ ID NO: 255845

SEQ ID NO: 612804 - RNA, 64 nt, hsa; identical to SEQ ID NO: 255846

SEQ ID NO: 612805 - RNA, 64 nt, hsa; identical to SEQ ID NO: 255847

SEQ ID NO: 612806 - RNA, 64 nt, hsa; identical to SEQ ID NO: 255848

SEQ ID NO: 612807 - RNA, 64 nt, hsa; identical to SEQ ID NO: 255849

SEQ ID NO: 612808 - RNA, 64 nt, hsa; identical to SEQ ID NO: 255850

SEQ ID NO: 612809 - RNA, 64 nt, hsa; identical to SEQ ID NO: 255851

SEQ ID NO: 612810 - RNA, 64 nt, hsa; identical to SEQ ID NO: 255852

SEQ ID NO: 612811 - RNA, 64 nt, hsa; identical to SEQ ID NO: 344518

SEQ ID NO: 612812 - RNA, 64 nt, hsa; identical to SEQ ID NO: 344519

SEQ ID NO: 612813 - RNA, 64 nt, hsa; identical to SEQ ID NO: 344520

SEQ ID NO: 612814 - RNA, 64 nt, hsa; identical to SEQ ID NO: 344521

SEQ ID NO: 612815 - RNA, 64 nt, hsa; identical to SEQ ID NO: 344522

SEQ ID NO: 612816 - RNA, 64 nt, hsa; identical to SEQ ID NO: 344523

SEQ ID NO: 612817 - RNA, 64 nt, hsa; identical to SEQ ID NO: 344524

SEQ ID NO: 612818 - RNA, 64 nt, hsa; identical to SEQ ID NO: 344525

SEQ ID NO: 612819 - RNA, 64 nt, hsa; identical to SEQ ID NO: 344526

SEQ ID NO: 612820 - RNA, 64 nt, hsa; identical to SEQ ID NO: 344527

SEQ ID NO: 612821 - RNA, 64 nt, hsa; identical to SEQ ID NO: 344528

SEQ ID NO: 612822 - RNA, 64 nt, hsa; identical to SEQ ID NO: 344529

SEQ ID NO: 612823 - RNA, 64 nt, hsa; identical to SEQ ID NO: 344530

SEQ ID NO: 612824 - RNA, 64 nt, hsa; identical to SEQ ID NO: 344531

SEQ ID NO: 612825 - RNA, 64 nt, hsa; identical to SEQ ID NO: 344532

SEQ ID NO: 612826 - RNA, 64 nt, hsa; identical to SEQ ID NO: 344533

SEQ ID NO: 612827 - RNA, 64 nt, hsa; identical to SEQ ID NO: 344534

SEQ ID NO: 612828 - RNA, 64 nt, hsa; identical to SEQ ID NO: 344535

SEQ ID NO: 612829 - RNA, 64 nt, hsa; identical to SEQ ID NO: 344536

SEQ ID NO: 612830 - RNA, 64 nt, hsa; identical to SEQ ID NO: 344537

SEQ ID NO: 612831 - RNA, 64 nt, hsa; identical to SEQ ID NO: 344538

SEQ ID NO: 612832 - RNA, 64 nt, hsa; identical to SEQ ID NO: 344539

SEQ ID NO: 612833 - RNA, 64 nt, hsa; identical to SEQ ID NO: 344540

SEQ ID NO: 612834 - RNA, 64 nt, hsa; identical to SEQ ID NO: 344541

SEQ ID NO: 612835 - RNA, 64 nt, hsa; identical to SEQ ID NO: 344542

SEQ ID NO: 612836 - RNA, 64 nt, hsa; identical to SEQ ID NO: 217273

SEQ ID NO: 612837 - RNA, 64 nt, hsa; identical to SEQ ID NO: 217274

SEQ ID NO: 612838 - RNA, 64 nt, hsa; identical to SEQ ID NO: 217275

SEQ ID NO: 612839 - RNA, 64 nt, hsa; identical to SEQ ID NO: 217276

SEQ ID NO: 612840 - RNA, 64 nt, hsa; identical to SEQ ID NO: 217277

SEQ ID NO: 612841 - RNA, 64 nt, hsa; identical to SEQ ID NO: 217278

SEQ ID NO: 612842 - RNA, 64 nt, hsa; identical to SEQ ID NO: 217279

SEQ ID NO: 612843 - RNA, 64 nt, hsa; identical to SEQ ID NO: 217280

SEQ ID NO: 612844 - RNA, 64 nt, hsa; identical to SEQ ID NO: 217281

SEQ ID NO: 612845 - RNA, 64 nt, hsa; identical to SEQ ID NO: 217282

SEQ ID NO: 612846 - RNA, 64 nt, hsa; identical to SEQ ID NO: 217283

SEQ ID NO: 612847 - RNA, 64 nt, hsa; identical to SEQ ID NO: 217284

SEQ ID NO: 612848 - RNA, 64 nt, hsa; identical to SEQ ID NO: 217285

SEQ ID NO: 612849 - RNA, 64 nt, hsa; identical to SEQ ID NO: 217286

SEQ ID NO: 612850 - RNA, 64 nt, hsa; identical to SEQ ID NO: 217287

SEQ ID NO: 612851 - RNA, 64 nt, hsa; identical to SEQ ID NO: 217288

SEQ ID NO: 612852 - RNA, 64 nt, hsa; identical to SEQ ID NO: 217289

SEQ ID NO: 612853 - RNA, 64 nt, hsa; identical to SEQ ID NO: 217290

SEQ ID NO: 612854 - RNA, 64 nt, hsa; identical to SEQ ID NO: 217291

SEQ ID NO: 612855 - RNA, 64 nt, hsa; identical to SEQ ID NO: 217292

SEQ ID NO: 612856 - RNA, 64 nt, hsa; identical to SEQ ID NO: 217293

SEQ ID NO: 612857 - RNA, 64 nt, hsa; identical to SEQ ID NO: 217294

SEQ ID NO: 612858 - RNA, 64 nt, hsa; identical to SEQ ID NO: 217295

SEQ ID NO: 612859 - RNA, 62 nt, hsa
augcaggacuacccccuuaccauuuuaagaagguacuuuauacauuuauuuaauccuacuaa

SEQ ID NO: 612860 - RNA, 62 nt, hsa
aguaugaaugauuagagaaaauuugagucaguguacuuuauagugugaauccugugagcuaa

SEQ ID NO: 612861 - RNA, 62 nt, hsa
gaaacugucgcugaagcacuuaagaaauaaagguacuuuacagcaacauucgccauacuagc

SEQ ID NO: 612862 - RNA, 62 nt, hsa
acuagauguuuuucaagguaaguucaccuuuuguacuuuacuauuuauuucagaaauguuga

SEQ ID NO: 612863 - RNA, 62 nt, hsa
aagguaugguguucagaacuauauuauaccaaguacuuuauuuaucguuuucacaaaacuau

SEQ ID NO: 612864 - RNA, 62 nt, hsa
uacagcaguccuuggcauuuguaugguaauuuguacuuuacaaauacuuugauauauuauaa

SEQ ID NO: 612865 - RNA, 62 nt, hsa
uaacuguguuuagcucauuuaaaucaaaauguguacuuuaaucuaaaauguuuuaauaaucu

SEQ ID NO: 612866 - RNA, 62 nt, hsa
uuuugguuuauuuauacuauauucugcauacaguacuuuaaaugccaauuacagugcaaucu

SEQ ID NO: 612867 - RNA, 62 nt, hsa
cuaauugguugaauuuuuuuuuuaaguaaauaguacuuuaggccaaaauuuauaugaauauu

SEQ ID NO: 612868 - RNA, 62 nt, hsa
agcccacgggaauaucuccaccauuucucuauguacuuuauaugcacgggugugcaugccug

SEQ ID NO: 612869 - RNA, 62 nt, hsa
acaacuauuuuuugguuugguuguaauauauuguacuuuauuaagauugccaaaaacuguua

SEQ ID NO: 612870 - RNA, 62 nt, hsa
gagggauucugaugugcuaggcaugguucuaaguacuuuacuuguauuaucccauuuaauac

SEQ ID NO: 612871 - RNA, 62 nt, hsa
guucuccugccugcauaaccauucauuagggaguacuuuacaagcaugaaggauauuagggu

SEQ ID NO: 612872 - RNA, 62 nt, hsa
cugggauuacuccccgugcccggccacucucuguacuuuaaacauuucgcuauacucucuuc

SEQ ID NO: 612873 - RNA, 62 nt, hsa
uauaauucuaguugaugaauuuuuuucucucuguacuuuauuuaauuuauuauuauuauuuu

SEQ ID NO: 612874 - RNA, 62 nt, hsa
ucgguccuuuuuaaucugggguauuauaggcaguacuuuaaauugcaaagucuuccgggccu

SEQ ID NO: 612875 - RNA, 62 nt, hsa
aaagaauguguuucaguaucagugcuuuuuugguacuuuaacaaguauuguaggcacggugg

SEQ ID NO: 612876 - RNA, 62 nt, hsa
aacaaaauauaauuauuuaugguacaauucuuguacuuuagcaaaucuggaguuaguucaua

SEQ ID NO: 612877 - RNA, 62 nt, hsa
aacuugauccuauuaauuuauaugcugauauuguacuuuagacauacgcuugucuccugaau

SEQ ID NO: 612878 - RNA, 62 nt, hsa
agaauguacauuuucuuuuuagaaaaccaaauguacuuuagacaugaaugcaacuauuuaaa

SEQ ID NO: 612879 - RNA, 62 nt, hsa
gauauauauuguauguguuuauucuucauaugguacuuuaccauauuuauauauuguuuuau

SEQ ID NO: 612880 - RNA, 64 nt, hsa; identical to SEQ ID NO: 526504

SEQ ID NO: 612881 - RNA, 64 nt, hsa; identical to SEQ ID NO: 526505

SEQ ID NO: 612882 - RNA, 64 nt, hsa; identical to SEQ ID NO: 526506

SEQ ID NO: 612883 - RNA, 64 nt, hsa; identical to SEQ ID NO: 526507

SEQ ID NO: 612884 - RNA, 64 nt, hsa; identical to SEQ ID NO: 526508

SEQ ID NO: 612885 - RNA, 64 nt, hsa; identical to SEQ ID NO: 526509

SEQ ID NO: 612886 - RNA, 64 nt, hsa; identical to SEQ ID NO: 526510

SEQ ID NO: 612887 - RNA, 64 nt, hsa; identical to SEQ ID NO: 526511

SEQ ID NO: 612888 - RNA, 64 nt, hsa; identical to SEQ ID NO: 526512

SEQ ID NO: 612889 - RNA, 64 nt, hsa; identical to SEQ ID NO: 526513

SEQ ID NO: 612890 - RNA, 64 nt, hsa; identical to SEQ ID NO: 526514

SEQ ID NO: 612891 - RNA, 64 nt, hsa; identical to SEQ ID NO: 526515

SEQ ID NO: 612892 - RNA, 64 nt, hsa; identical to SEQ ID NO: 526516

SEQ ID NO: 612893 - RNA, 64 nt, hsa; identical to SEQ ID NO: 526517

SEQ ID NO: 612894 - RNA, 64 nt, hsa; identical to SEQ ID NO: 526518

SEQ ID NO: 612895 - RNA, 64 nt, hsa; identical to SEQ ID NO: 526519

SEQ ID NO: 612896 - RNA, 64 nt, hsa; identical to SEQ ID NO: 526520

SEQ ID NO: 612897 - RNA, 64 nt, hsa; identical to SEQ ID NO: 582350

SEQ ID NO: 612898 - RNA, 64 nt, hsa; identical to SEQ ID NO: 582351

SEQ ID NO: 612899 - RNA, 64 nt, hsa; identical to SEQ ID NO: 582352

SEQ ID NO: 612900 - RNA, 64 nt, hsa; identical to SEQ ID NO: 582353

SEQ ID NO: 612901 - RNA, 64 nt, hsa; identical to SEQ ID NO: 582354

SEQ ID NO: 612902 - RNA, 64 nt, hsa; identical to SEQ ID NO: 582355

SEQ ID NO: 612903 - RNA, 64 nt, hsa; identical to SEQ ID NO: 582356

SEQ ID NO: 612904 - RNA, 64 nt, hsa; identical to SEQ ID NO: 582357

SEQ ID NO: 612905 - RNA, 64 nt, hsa; identical to SEQ ID NO: 582358

SEQ ID NO: 612906 - RNA, 64 nt, hsa; identical to SEQ ID NO: 582359

SEQ ID NO: 612907 - RNA, 64 nt, hsa; identical to SEQ ID NO: 582360

SEQ ID NO: 612908 - RNA, 64 nt, hsa; identical to SEQ ID NO: 582361

SEQ ID NO: 612909 - RNA, 64 nt, hsa; identical to SEQ ID NO: 582362

SEQ ID NO: 612910 - RNA, 64 nt, hsa; identical to SEQ ID NO: 582363

SEQ ID NO: 612911 - RNA, 64 nt, hsa; identical to SEQ ID NO: 582364

SEQ ID NO: 612912 - RNA, 64 nt, hsa; identical to SEQ ID NO: 582365

SEQ ID NO: 612913 - RNA, 64 nt, hsa; identical to SEQ ID NO: 582366

SEQ ID NO: 612914 - RNA, 64 nt, hsa; identical to SEQ ID NO: 582367

SEQ ID NO: 612915 - RNA, 64 nt, hsa; identical to SEQ ID NO: 582368

SEQ ID NO: 612916 - RNA, 64 nt, hsa; identical to SEQ ID NO: 582369

SEQ ID NO: 612917 - RNA, 64 nt, hsa; identical to SEQ ID NO: 582370

SEQ ID NO: 612918 - RNA, 64 nt, hsa; identical to SEQ ID NO: 582371

SEQ ID NO: 612919 - RNA, 64 nt, hsa; identical to SEQ ID NO: 364294

SEQ ID NO: 612920 - RNA, 64 nt, hsa; identical to SEQ ID NO: 364295

SEQ ID NO: 612921 - RNA, 64 nt, hsa; identical to SEQ ID NO: 364296

SEQ ID NO: 612922 - RNA, 64 nt, hsa; identical to SEQ ID NO: 364297

SEQ ID NO: 612923 - RNA, 64 nt, hsa; identical to SEQ ID NO: 48789

SEQ ID NO: 612924 - RNA, 64 nt, hsa; identical to SEQ ID NO: 48790

SEQ ID NO: 612925 - RNA, 64 nt, hsa; identical to SEQ ID NO: 48791

SEQ ID NO: 612926 - RNA, 64 nt, hsa; identical to SEQ ID NO: 48792

SEQ ID NO: 612927 - RNA, 64 nt, hsa; identical to SEQ ID NO: 164139

SEQ ID NO: 612928 - RNA, 64 nt, hsa; identical to SEQ ID NO: 164140

SEQ ID NO: 612929 - RNA, 64 nt, hsa; identical to SEQ ID NO: 164141

SEQ ID NO: 612930 - RNA, 64 nt, hsa; identical to SEQ ID NO: 164142

SEQ ID NO: 612931 - RNA, 64 nt, hsa; identical to SEQ ID NO: 164143

SEQ ID NO: 612932 - RNA, 64 nt, hsa; identical to SEQ ID NO: 164144

SEQ ID NO: 612933 - RNA, 64 nt, hsa; identical to SEQ ID NO: 164145

SEQ ID NO: 612934 - RNA, 64 nt, hsa; identical to SEQ ID NO: 164146

SEQ ID NO: 612935 - RNA, 64 nt, hsa; identical to SEQ ID NO: 164147

SEQ ID NO: 612936 - RNA, 64 nt, hsa; identical to SEQ ID NO: 164148

SEQ ID NO: 612937 - RNA, 64 nt, hsa
ccuucauccuccccaccuaaugcauuuuugaaaccaaagguaccuagccucagagacagagaag

SEQ ID NO: 612938 - RNA, 64 nt, hsa
uuauuaaagcaacauuugccacauguuuaagccgcaaagguauuagcaaugcuugcaucauuaa

SEQ ID NO: 612939 - RNA, 64 nt, hsa
acugacaaaaugaucugacuacuccauuuaagagcaaagguaacucauguuuagguaauuaacu

SEQ ID NO: 612940 - RNA, 64 nt, hsa
uuccaaugcucccuuuaaccauauaauuaaauuacaaagguauacauaauuaaucuaauaaagg

SEQ ID NO: 612941 - RNA, 64 nt, hsa
aaaauauuuauuuuauuuuuuuuuugggugucugcaaagguaaaaauccauuaaaaccuuaagu

SEQ ID NO: 612942 - RNA, 64 nt, hsa
aaaaaaaagcauacauaugugauuauggcuaaaucaaagguaacuggaauguauauacuuuugc

SEQ ID NO: 612943 - RNA, 64 nt, hsa
aaacacguggucaugaauagaaaaaaaacaaacccaaagguaggaaggucaaggucauuucuua

SEQ ID NO: 612944 - RNA, 64 nt, hsa
caguauuacucucgagaggcaauucaguccugggcaaagguauuaguacaauaagcguuaaggg

SEQ ID NO: 612945 - RNA, 64 nt, hsa; identical to SEQ ID NO: 463735

SEQ ID NO: 612946 - RNA, 64 nt, hsa; identical to SEQ ID NO: 463736

SEQ ID NO: 612947 - RNA, 64 nt, hsa; identical to SEQ ID NO: 463737

SEQ ID NO: 612948 - RNA, 64 nt, hsa; identical to SEQ ID NO: 463738

SEQ ID NO: 612949 - RNA, 64 nt, hsa; identical to SEQ ID NO: 463739

SEQ ID NO: 612950 - RNA, 64 nt, hsa; identical to SEQ ID NO: 463740

SEQ ID NO: 612951 - RNA, 64 nt, hsa
acgcccggggcgcgccggcucagggaggcucggggccgcccaugcagacuuuuggccuggcgcg

SEQ ID NO: 612952 - RNA, 64 nt, hsa
cgauucccugggcuccaggcucccccgcgcgggcgccgcccaccgccauacuaaacgaucgagg

SEQ ID NO: 612953 - RNA, 64 nt, hsa
uccagguggcgugagaggcaaugacucguuaccugccgcccaucaccuuggaggccuucccugg

SEQ ID NO: 612954 - RNA, 64 nt, hsa
uccugguucaaacgggugccuggucagaaggccagccgcccacuucccguuuccucuuuaacug

SEQ ID NO: 612955 - RNA, 64 nt, hsa
ugaggagccagcggccaccugcggggagaccaccgccgcccagacuacugacggcaggggcugc

SEQ ID NO: 612956 - RNA, 64 nt, hsa
ggagucacccugagggccccgggcaguugcccuggccgcccagugacgcccaccggcucccucc

SEQ ID NO: 612957 - RNA, 53 nt, hsa
accaggagacggcuguguagcgggccgcccacgggcagcaggagggacaaugc

SEQ ID NO: 612958 - RNA, 64 nt, hsa
cccagggaaagagccccaugccgcccccuaaggagccgcccagaccuagggcuggacucaggag

SEQ ID NO: 612959 - RNA, 64 nt, hsa
ggagacgccccuccaacuggcgggugugaaggaagccgcccagggguccgggcuguccuuggcc

SEQ ID NO: 612960 - RNA, 64 nt, hsa
cuccgggugacaccagccccgucuccagccuugagccgcccaugcugaugcgaccucggcugac

SEQ ID NO: 612961 - RNA, 64 nt, hsa
cgugcucaugaagcgcuccaucacggcaccgcuggccgcccacaucuccuuggugaacaaggcc

SEQ ID NO: 612962 - RNA, 64 nt, hsa
agcgguacccggacaguuacgaguccauguccgagccgcccauugcucaucuuuugcgccccgu

SEQ ID NO: 612963 - RNA, 64 nt, hsa; identical to SEQ ID NO: 132800

SEQ ID NO: 612964 - RNA, 64 nt, hsa; identical to SEQ ID NO: 132801

SEQ ID NO: 612965 - RNA, 64 nt, hsa; identical to SEQ ID NO: 132802

SEQ ID NO: 612966 - RNA, 64 nt, hsa; identical to SEQ ID NO: 132803

SEQ ID NO: 612967 - RNA, 64 nt, hsa; identical to SEQ ID NO: 132804

SEQ ID NO: 612968 - RNA, 64 nt, hsa; identical to SEQ ID NO: 132805

SEQ ID NO: 612969 - RNA, 64 nt, hsa; identical to SEQ ID NO: 132806

SEQ ID NO: 612970 - RNA, 64 nt, hsa; identical to SEQ ID NO: 132807

SEQ ID NO: 612971 - RNA, 64 nt, hsa; identical to SEQ ID NO: 132808

SEQ ID NO: 612972 - RNA, 64 nt, hsa; identical to SEQ ID NO: 132809

SEQ ID NO: 612973 - RNA, 64 nt, hsa; identical to SEQ ID NO: 132810

SEQ ID NO: 612974 - RNA, 64 nt, hsa; identical to SEQ ID NO: 132811

SEQ ID NO: 612975 - RNA, 64 nt, hsa; identical to SEQ ID NO: 132812

SEQ ID NO: 612976 - RNA, 64 nt, hsa; identical to SEQ ID NO: 132813

SEQ ID NO: 612977 - RNA, 64 nt, hsa; identical to SEQ ID NO: 132814

SEQ ID NO: 612978 - RNA, 64 nt, hsa; identical to SEQ ID NO: 132815

SEQ ID NO: 612979 - RNA, 64 nt, hsa; identical to SEQ ID NO: 132816

SEQ ID NO: 612980 - RNA, 64 nt, hsa; identical to SEQ ID NO: 132817

SEQ ID NO: 612981 - RNA, 64 nt, hsa; identical to SEQ ID NO: 132818

SEQ ID NO: 612982 - RNA, 64 nt, hsa; identical to SEQ ID NO: 132819

SEQ ID NO: 612983 - RNA, 64 nt, hsa; identical to SEQ ID NO: 132820

SEQ ID NO: 612984 - RNA, 64 nt, hsa; identical to SEQ ID NO: 132821

SEQ ID NO: 612985 - RNA, 64 nt, hsa; identical to SEQ ID NO: 132822

SEQ ID NO: 612986 - RNA, 64 nt, hsa; identical to SEQ ID NO: 132823

SEQ ID NO: 612987 - RNA, 64 nt, hsa; identical to SEQ ID NO: 132824

SEQ ID NO: 612988 - RNA, 64 nt, hsa; identical to SEQ ID NO: 132825

SEQ ID NO: 612989 - RNA, 64 nt, hsa; identical to SEQ ID NO: 132826

SEQ ID NO: 612990 - RNA, 64 nt, hsa; identical to SEQ ID NO: 132827

SEQ ID NO: 612991 - RNA, 64 nt, hsa; identical to SEQ ID NO: 132828

SEQ ID NO: 612992 - RNA, 64 nt, hsa; identical to SEQ ID NO: 132829

SEQ ID NO: 612993 - RNA, 64 nt, hsa; identical to SEQ ID NO: 132830

SEQ ID NO: 612994 - RNA, 64 nt, hsa; identical to SEQ ID NO: 132831

SEQ ID NO: 612995 - RNA, 64 nt, hsa; identical to SEQ ID NO: 132832

SEQ ID NO: 612996 - RNA, 64 nt, hsa; identical to SEQ ID NO: 132833

SEQ ID NO: 612997 - RNA, 64 nt, hsa; identical to SEQ ID NO: 132834

SEQ ID NO: 612998 - RNA, 64 nt, hsa; identical to SEQ ID NO: 132835

SEQ ID NO: 612999 - RNA, 64 nt, hsa; identical to SEQ ID NO: 132836

SEQ ID NO: 613000 - RNA, 64 nt, hsa; identical to SEQ ID NO: 132837

SEQ ID NO: 613001 - RNA, 64 nt, hsa; identical to SEQ ID NO: 132838

SEQ ID NO: 613002 - RNA, 64 nt, hsa; identical to SEQ ID NO: 132839

SEQ ID NO: 613003 - RNA, 64 nt, hsa; identical to SEQ ID NO: 132840

SEQ ID NO: 613004 - RNA, 64 nt, hsa; identical to SEQ ID NO: 132841

SEQ ID NO: 613005 - RNA, 64 nt, hsa; identical to SEQ ID NO: 132842

SEQ ID NO: 613006 - RNA, 64 nt, hsa; identical to SEQ ID NO: 132843

SEQ ID NO: 613007 - RNA, 64 nt, hsa; identical to SEQ ID NO: 132844

SEQ ID NO: 613008 - RNA, 58 nt, hsa; identical to SEQ ID NO: 132845

SEQ ID NO: 613009 - RNA, 64 nt, hsa; identical to SEQ ID NO: 132846

SEQ ID NO: 613010 - RNA, 64 nt, hsa; identical to SEQ ID NO: 132847

SEQ ID NO: 613011 - RNA, 64 nt, hsa; identical to SEQ ID NO: 132848

SEQ ID NO: 613012 - RNA, 64 nt, hsa; identical to SEQ ID NO: 132849

SEQ ID NO: 613013 - RNA, 64 nt, hsa; identical to SEQ ID NO: 132850

SEQ ID NO: 613014 - RNA, 64 nt, hsa; identical to SEQ ID NO: 132851

SEQ ID NO: 613015 - RNA, 64 nt, hsa; identical to SEQ ID NO: 132852

SEQ ID NO: 613016 - RNA, 64 nt, hsa; identical to SEQ ID NO: 132853

SEQ ID NO: 613017 - RNA, 64 nt, hsa; identical to SEQ ID NO: 132854

SEQ ID NO: 613018 - RNA, 64 nt, hsa; identical to SEQ ID NO: 132855

SEQ ID NO: 613019 - RNA, 64 nt, hsa; identical to SEQ ID NO: 132856

SEQ ID NO: 613020 - RNA, 64 nt, hsa; identical to SEQ ID NO: 132857

SEQ ID NO: 613021 - RNA, 64 nt, hsa; identical to SEQ ID NO: 132858

SEQ ID NO: 613022 - RNA, 64 nt, hsa; identical to SEQ ID NO: 132859

SEQ ID NO: 613023 - RNA, 64 nt, hsa; identical to SEQ ID NO: 132860

SEQ ID NO: 613024 - RNA, 64 nt, hsa; identical to SEQ ID NO: 132861

SEQ ID NO: 613025 - RNA, 64 nt, hsa; identical to SEQ ID NO: 132862

SEQ ID NO: 613026 - RNA, 64 nt, hsa; identical to SEQ ID NO: 132863

SEQ ID NO: 613027 - RNA, 64 nt, hsa; identical to SEQ ID NO: 132864

SEQ ID NO: 613028 - RNA, 64 nt, hsa; identical to SEQ ID NO: 132865

SEQ ID NO: 613029 - RNA, 64 nt, hsa; identical to SEQ ID NO: 132866

SEQ ID NO: 613030 - RNA, 64 nt, hsa; identical to SEQ ID NO: 132867

SEQ ID NO: 613031 - RNA, 64 nt, hsa; identical to SEQ ID NO: 132868

SEQ ID NO: 613032 - RNA, 64 nt, hsa; identical to SEQ ID NO: 132869

SEQ ID NO: 613033 - RNA, 64 nt, hsa; identical to SEQ ID NO: 132870

SEQ ID NO: 613034 - RNA, 64 nt, hsa; identical to SEQ ID NO: 132871

SEQ ID NO: 613035 - RNA, 64 nt, hsa; identical to SEQ ID NO: 132872

SEQ ID NO: 613036 - RNA, 64 nt, hsa; identical to SEQ ID NO: 132873

SEQ ID NO: 613037 - RNA, 64 nt, hsa; identical to SEQ ID NO: 132874

SEQ ID NO: 613038 - RNA, 64 nt, hsa; identical to SEQ ID NO: 132875

SEQ ID NO: 613039 - RNA, 64 nt, hsa; identical to SEQ ID NO: 132876

SEQ ID NO: 613040 - RNA, 64 nt, hsa; identical to SEQ ID NO: 132877

SEQ ID NO: 613041 - RNA, 64 nt, hsa; identical to SEQ ID NO: 132878

SEQ ID NO: 613042 - RNA, 64 nt, hsa; identical to SEQ ID NO: 132879

SEQ ID NO: 613043 - RNA, 64 nt, hsa; identical to SEQ ID NO: 132880

SEQ ID NO: 613044 - RNA, 64 nt, hsa; identical to SEQ ID NO: 132881

SEQ ID NO: 613045 - RNA, 64 nt, hsa; identical to SEQ ID NO: 132882

SEQ ID NO: 613046 - RNA, 64 nt, hsa; identical to SEQ ID NO: 132883

SEQ ID NO: 613047 - RNA, 64 nt, hsa; identical to SEQ ID NO: 132884

SEQ ID NO: 613048 - RNA, 64 nt, hsa; identical to SEQ ID NO: 132885

SEQ ID NO: 613049 - RNA, 64 nt, hsa; identical to SEQ ID NO: 132886

SEQ ID NO: 613050 - RNA, 64 nt, hsa; identical to SEQ ID NO: 132887

SEQ ID NO: 613051 - RNA, 64 nt, hsa; identical to SEQ ID NO: 132888

SEQ ID NO: 613052 - RNA, 64 nt, hsa; identical to SEQ ID NO: 132889

SEQ ID NO: 613053 - RNA, 64 nt, hsa
ggcagggcagcacacggccagccccgcggccuggcgcuccgacugcccucugaggccuccggac

SEQ ID NO: 613054 - RNA, 64 nt, hsa
gggguugcugcuuucccagugccaggagaacccccgcuccgagucagccugugugggucaugag

SEQ ID NO: 613055 - RNA, 64 nt, hsa
agugcgcaggccagagugagugagcccagcacggcgcuccgacuggcuuccucucucaggugcu

SEQ ID NO: 613056 - RNA, 64 nt, hsa
aaaguauuaacuagcuaacagugaugggccaagacgcuccgagaacucuaccgggauugucugu

SEQ ID NO: 613057 - RNA, 64 nt, hsa
uugacguggaaugcugugucugcuuuagcacgcacgcuccgaaugacuccuggugcuaggccau

SEQ ID NO: 613058 - RNA, 64 nt, hsa
gcgcgcgccuccgcggggguggguguccggcagccgcuccgagccucggcccugccccaaguag

SEQ ID NO: 613059 - RNA, 64 nt, hsa
gaccuggugcuggcugucugggaccgcagccugccgcuccgaacugagcccguaggcaaggugc

SEQ ID NO: 613060 - RNA, 64 nt, hsa
cagcaccuguaggaacucccggaagagccggauccgcuccgacuccagggugaucugcucaaag

SEQ ID NO: 613061 - RNA, 64 nt, hsa
cagagucgccgaagcucaggggagcucuccagcccgcuccgaaagcccaagaggcucucccggg

SEQ ID NO: 613062 - RNA, 64 nt, hsa
ccaauuccauuuauagaccaccuccagccagugacgcuccgaguugaggauguugaacaacaug

SEQ ID NO: 613063 - RNA, 64 nt, hsa
cagaagccgcgcccaccgccugccaguucacaaccgcuccgagcgugggucuccgcccagcucc

SEQ ID NO: 613064 - RNA, 64 nt, hsa
ggcgcccgcggcgcgacccuccccggcggugccgcgcuccgaaccccgggcccgggcccccgcc

SEQ ID NO: 613065 - RNA, 64 nt, hsa
gggcgacucccuccccauuggccgaguuauggagcgcuccgaccagacagcgucucauuggcca

SEQ ID NO: 613066 - RNA, 64 nt, hsa
gagagauauugaacagaucaucagaaacuacgcccgcuccgagagccacacagauuugacuuuc

SEQ ID NO: 613067 - RNA, 64 nt, hsa; identical to SEQ ID NO: 276789

SEQ ID NO: 613068 - RNA, 64 nt, hsa; identical to SEQ ID NO: 276790

SEQ ID NO: 613069 - RNA, 64 nt, hsa; identical to SEQ ID NO: 276791

SEQ ID NO: 613070 - RNA, 64 nt, hsa; identical to SEQ ID NO: 276792

SEQ ID NO: 613071 - RNA, 64 nt, hsa; identical to SEQ ID NO: 276793

SEQ ID NO: 613072 - RNA, 64 nt, hsa; identical to SEQ ID NO: 276794

SEQ ID NO: 613073 - RNA, 64 nt, hsa; identical to SEQ ID NO: 276795

SEQ ID NO: 613074 - RNA, 64 nt, hsa; identical to SEQ ID NO: 276796

SEQ ID NO: 613075 - RNA, 64 nt, hsa; identical to SEQ ID NO: 276797

SEQ ID NO: 613076 - RNA, 64 nt, hsa; identical to SEQ ID NO: 276798

SEQ ID NO: 613077 - RNA, 64 nt, hsa; identical to SEQ ID NO: 276799

SEQ ID NO: 613078 - RNA, 64 nt, hsa; identical to SEQ ID NO: 276800

SEQ ID NO: 613079 - RNA, 64 nt, hsa; identical to SEQ ID NO: 276801

SEQ ID NO: 613080 - RNA, 64 nt, hsa; identical to SEQ ID NO: 276802

SEQ ID NO: 613081 - RNA, 64 nt, hsa; identical to SEQ ID NO: 276803

SEQ ID NO: 613082 - RNA, 64 nt, hsa; identical to SEQ ID NO: 276804

SEQ ID NO: 613083 - RNA, 64 nt, hsa; identical to SEQ ID NO: 276805

SEQ ID NO: 613084 - RNA, 64 nt, hsa; identical to SEQ ID NO: 276806

SEQ ID NO: 613085 - RNA, 64 nt, hsa; identical to SEQ ID NO: 276807

SEQ ID NO: 613086 - RNA, 64 nt, hsa; identical to SEQ ID NO: 276808

SEQ ID NO: 613087 - RNA, 64 nt, hsa; identical to SEQ ID NO: 276809

SEQ ID NO: 613088 - RNA, 64 nt, hsa; identical to SEQ ID NO: 276810

SEQ ID NO: 613089 - RNA, 64 nt, hsa; identical to SEQ ID NO: 276811

SEQ ID NO: 613090 - RNA, 64 nt, hsa; identical to SEQ ID NO: 276812

SEQ ID NO: 613091 - RNA, 64 nt, hsa; identical to SEQ ID NO: 276813

SEQ ID NO: 613092 - RNA, 64 nt, hsa; identical to SEQ ID NO: 276814

SEQ ID NO: 613093 - RNA, 64 nt, hsa; identical to SEQ ID NO: 276815

SEQ ID NO: 613094 - RNA, 64 nt, hsa; identical to SEQ ID NO: 276816

SEQ ID NO: 613095 - RNA, 64 nt, hsa; identical to SEQ ID NO: 276817

SEQ ID NO: 613096 - RNA, 64 nt, hsa; identical to SEQ ID NO: 276818

SEQ ID NO: 613097 - RNA, 64 nt, hsa; identical to SEQ ID NO: 276819

SEQ ID NO: 613098 - RNA, 64 nt, hsa; identical to SEQ ID NO: 276820

SEQ ID NO: 613099 - RNA, 64 nt, hsa; identical to SEQ ID NO: 276821

SEQ ID NO: 613100 - RNA, 64 nt, hsa; identical to SEQ ID NO: 276822

SEQ ID NO: 613101 - RNA, 64 nt, hsa; identical to SEQ ID NO: 276823

SEQ ID NO: 613102 - RNA, 64 nt, hsa; identical to SEQ ID NO: 276824

SEQ ID NO: 613103 - RNA, 64 nt, hsa; identical to SEQ ID NO: 276825

SEQ ID NO: 613104 - RNA, 64 nt, hsa; identical to SEQ ID NO: 276826

SEQ ID NO: 613105 - RNA, 64 nt, hsa; identical to SEQ ID NO: 276827

SEQ ID NO: 613106 - RNA, 64 nt, hsa; identical to SEQ ID NO: 276828

SEQ ID NO: 613107 - RNA, 64 nt, hsa; identical to SEQ ID NO: 276829

SEQ ID NO: 613108 - RNA, 64 nt, hsa; identical to SEQ ID NO: 276830

SEQ ID NO: 613109 - RNA, 64 nt, hsa; identical to SEQ ID NO: 276831

SEQ ID NO: 613110 - RNA, 64 nt, hsa; identical to SEQ ID NO: 276832

SEQ ID NO: 613111 - RNA, 64 nt, hsa; identical to SEQ ID NO: 276833

SEQ ID NO: 613112 - RNA, 64 nt, hsa; identical to SEQ ID NO: 276834

SEQ ID NO: 613113 - RNA, 64 nt, hsa; identical to SEQ ID NO: 276835

SEQ ID NO: 613114 - RNA, 64 nt, hsa; identical to SEQ ID NO: 276836

SEQ ID NO: 613115 - RNA, 64 nt, hsa; identical to SEQ ID NO: 276837

SEQ ID NO: 613116 - RNA, 64 nt, hsa; identical to SEQ ID NO: 276838

SEQ ID NO: 613117 - RNA, 64 nt, hsa; identical to SEQ ID NO: 276839

SEQ ID NO: 613118 - RNA, 64 nt, hsa; identical to SEQ ID NO: 276840

SEQ ID NO: 613119 - RNA, 64 nt, hsa; identical to SEQ ID NO: 276841

SEQ ID NO: 613120 - RNA, 64 nt, hsa; identical to SEQ ID NO: 276842

SEQ ID NO: 613121 - RNA, 64 nt, hsa; identical to SEQ ID NO: 276843

SEQ ID NO: 613122 - RNA, 64 nt, hsa; identical to SEQ ID NO: 276844

SEQ ID NO: 613123 - RNA, 64 nt, hsa; identical to SEQ ID NO: 276845

SEQ ID NO: 613124 - RNA, 64 nt, hsa; identical to SEQ ID NO: 276846

SEQ ID NO: 613125 - RNA, 64 nt, hsa; identical to SEQ ID NO: 276847

SEQ ID NO: 613126 - RNA, 64 nt, hsa; identical to SEQ ID NO: 276848

SEQ ID NO: 613127 - RNA, 64 nt, hsa; identical to SEQ ID NO: 276849

SEQ ID NO: 613128 - RNA, 64 nt, hsa; identical to SEQ ID NO: 276850

SEQ ID NO: 613129 - RNA, 64 nt, hsa; identical to SEQ ID NO: 276851

SEQ ID NO: 613130 - RNA, 64 nt, hsa; identical to SEQ ID NO: 276852

SEQ ID NO: 613131 - RNA, 64 nt, hsa; identical to SEQ ID NO: 276853

SEQ ID NO: 613132 - RNA, 64 nt, hsa; identical to SEQ ID NO: 276854

SEQ ID NO: 613133 - RNA, 64 nt, hsa; identical to SEQ ID NO: 276855

SEQ ID NO: 613134 - RNA, 64 nt, hsa; identical to SEQ ID NO: 276856

SEQ ID NO: 613135 - RNA, 64 nt, hsa; identical to SEQ ID NO: 276857

SEQ ID NO: 613136 - RNA, 64 nt, hsa; identical to SEQ ID NO: 502943

SEQ ID NO: 613137 - RNA, 64 nt, hsa; identical to SEQ ID NO: 502944

SEQ ID NO: 613138 - RNA, 64 nt, hsa; identical to SEQ ID NO: 502945

SEQ ID NO: 613139 - RNA, 64 nt, hsa; identical to SEQ ID NO: 502946

SEQ ID NO: 613140 - RNA, 64 nt, hsa; identical to SEQ ID NO: 502947

SEQ ID NO: 613141 - RNA, 64 nt, hsa; identical to SEQ ID NO: 502948

SEQ ID NO: 613142 - RNA, 64 nt, hsa; identical to SEQ ID NO: 502949

SEQ ID NO: 613143 - RNA, 64 nt, hsa; identical to SEQ ID NO: 502950

SEQ ID NO: 613144 - RNA, 64 nt, hsa; identical to SEQ ID NO: 502951

SEQ ID NO: 613145 - RNA, 64 nt, hsa; identical to SEQ ID NO: 502952

SEQ ID NO: 613146 - RNA, 64 nt, hsa; identical to SEQ ID NO: 502953

SEQ ID NO: 613147 - RNA, 64 nt, hsa; identical to SEQ ID NO: 502954

SEQ ID NO: 613148 - RNA, 64 nt, hsa; identical to SEQ ID NO: 502955

SEQ ID NO: 613149 - RNA, 64 nt, hsa; identical to SEQ ID NO: 502956

SEQ ID NO: 613150 - RNA, 64 nt, hsa; identical to SEQ ID NO: 502957

SEQ ID NO: 613151 - RNA, 64 nt, hsa; identical to SEQ ID NO: 502958

SEQ ID NO: 613152 - RNA, 64 nt, hsa; identical to SEQ ID NO: 502959

SEQ ID NO: 613153 - RNA, 64 nt, hsa; identical to SEQ ID NO: 502960

SEQ ID NO: 613154 - RNA, 64 nt, hsa; identical to SEQ ID NO: 502961

SEQ ID NO: 613155 - RNA, 64 nt, hsa; identical to SEQ ID NO: 502962

SEQ ID NO: 613156 - RNA, 64 nt, hsa; identical to SEQ ID NO: 502963

SEQ ID NO: 613157 - RNA, 64 nt, hsa; identical to SEQ ID NO: 502964

SEQ ID NO: 613158 - RNA, 64 nt, hsa; identical to SEQ ID NO: 502965

SEQ ID NO: 613159 - RNA, 64 nt, hsa; identical to SEQ ID NO: 502966

SEQ ID NO: 613160 - RNA, 64 nt, hsa; identical to SEQ ID NO: 502967

SEQ ID NO: 613161 - RNA, 64 nt, hsa; identical to SEQ ID NO: 502968

SEQ ID NO: 613162 - RNA, 64 nt, hsa; identical to SEQ ID NO: 502969

SEQ ID NO: 613163 - RNA, 64 nt, hsa; identical to SEQ ID NO: 502970

SEQ ID NO: 613164 - RNA, 64 nt, hsa; identical to SEQ ID NO: 502971

SEQ ID NO: 613165 - RNA, 64 nt, hsa; identical to SEQ ID NO: 502972

SEQ ID NO: 613166 - RNA, 64 nt, hsa; identical to SEQ ID NO: 502973

SEQ ID NO: 613167 - RNA, 64 nt, hsa; identical to SEQ ID NO: 502974

SEQ ID NO: 613168 - RNA, 64 nt, hsa; identical to SEQ ID NO: 502975

SEQ ID NO: 613169 - RNA, 64 nt, hsa; identical to SEQ ID NO: 502976

SEQ ID NO: 613170 - RNA, 64 nt, hsa; identical to SEQ ID NO: 502977

SEQ ID NO: 613171 - RNA, 64 nt, hsa; identical to SEQ ID NO: 502978

SEQ ID NO: 613172 - RNA, 64 nt, hsa; identical to SEQ ID NO: 502979

SEQ ID NO: 613173 - RNA, 64 nt, hsa; identical to SEQ ID NO: 342144

SEQ ID NO: 613174 - RNA, 64 nt, hsa; identical to SEQ ID NO: 342145

SEQ ID NO: 613175 - RNA, 64 nt, hsa; identical to SEQ ID NO: 342146

SEQ ID NO: 613176 - RNA, 64 nt, hsa; identical to SEQ ID NO: 342147

SEQ ID NO: 613177 - RNA, 64 nt, hsa; identical to SEQ ID NO: 342148

SEQ ID NO: 613178 - RNA, 64 nt, hsa; identical to SEQ ID NO: 342149

SEQ ID NO: 613179 - RNA, 64 nt, hsa; identical to SEQ ID NO: 342150

SEQ ID NO: 613180 - RNA, 64 nt, hsa; identical to SEQ ID NO: 342151

SEQ ID NO: 613181 - RNA, 64 nt, hsa; identical to SEQ ID NO: 342152

SEQ ID NO: 613182 - RNA, 64 nt, hsa; identical to SEQ ID NO: 342153

SEQ ID NO: 613183 - RNA, 64 nt, hsa; identical to SEQ ID NO: 342154

SEQ ID NO: 613184 - RNA, 64 nt, hsa; identical to SEQ ID NO: 342155

SEQ ID NO: 613185 - RNA, 64 nt, hsa; identical to SEQ ID NO: 342156

SEQ ID NO: 613186 - RNA, 55 nt, hsa; identical to SEQ ID NO: 342157

SEQ ID NO: 613187 - RNA, 64 nt, hsa; identical to SEQ ID NO: 342158

SEQ ID NO: 613188 - RNA, 64 nt, hsa; identical to SEQ ID NO: 342159

SEQ ID NO: 613189 - RNA, 64 nt, hsa; identical to SEQ ID NO: 342160

SEQ ID NO: 613190 - RNA, 64 nt, hsa; identical to SEQ ID NO: 342161

SEQ ID NO: 613191 - RNA, 64 nt, hsa; identical to SEQ ID NO: 342162

SEQ ID NO: 613192 - RNA, 64 nt, hsa; identical to SEQ ID NO: 342163

SEQ ID NO: 613193 - RNA, 64 nt, hsa; identical to SEQ ID NO: 342164

SEQ ID NO: 613194 - RNA, 64 nt, hsa; identical to SEQ ID NO: 342165

SEQ ID NO: 613195 - RNA, 64 nt, hsa; identical to SEQ ID NO: 342166

SEQ ID NO: 613196 - RNA, 64 nt, hsa; identical to SEQ ID NO: 342167

SEQ ID NO: 613197 - RNA, 64 nt, hsa; identical to SEQ ID NO: 342168

SEQ ID NO: 613198 - RNA, 64 nt, hsa; identical to SEQ ID NO: 342169

SEQ ID NO: 613199 - RNA, 64 nt, hsa; identical to SEQ ID NO: 342170

SEQ ID NO: 613200 - RNA, 64 nt, hsa; identical to SEQ ID NO: 342171

SEQ ID NO: 613201 - RNA, 64 nt, hsa; identical to SEQ ID NO: 342172

SEQ ID NO: 613202 - RNA, 64 nt, hsa; identical to SEQ ID NO: 342173

SEQ ID NO: 613203 - RNA, 64 nt, hsa; identical to SEQ ID NO: 342174

SEQ ID NO: 613204 - RNA, 64 nt, hsa; identical to SEQ ID NO: 342175

SEQ ID NO: 613205 - RNA, 64 nt, hsa; identical to SEQ ID NO: 342176

SEQ ID NO: 613206 - RNA, 64 nt, hsa; identical to SEQ ID NO: 342177

SEQ ID NO: 613207 - RNA, 64 nt, hsa; identical to SEQ ID NO: 342178

SEQ ID NO: 613208 - RNA, 64 nt, hsa; identical to SEQ ID NO: 342179

SEQ ID NO: 613209 - RNA, 64 nt, hsa; identical to SEQ ID NO: 342180

SEQ ID NO: 613210 - RNA, 64 nt, hsa; identical to SEQ ID NO: 342181

SEQ ID NO: 613211 - RNA, 64 nt, hsa; identical to SEQ ID NO: 342182

SEQ ID NO: 613212 - RNA, 64 nt, hsa; identical to SEQ ID NO: 342183

SEQ ID NO: 613213 - RNA, 64 nt, hsa; identical to SEQ ID NO: 342184

SEQ ID NO: 613214 - RNA, 64 nt, hsa; identical to SEQ ID NO: 342185

SEQ ID NO: 613215 - RNA, 64 nt, hsa; identical to SEQ ID NO: 342186

SEQ ID NO: 613216 - RNA, 64 nt, hsa; identical to SEQ ID NO: 342187

SEQ ID NO: 613217 - RNA, 64 nt, hsa; identical to SEQ ID NO: 342188

SEQ ID NO: 613218 - RNA, 64 nt, hsa; identical to SEQ ID NO: 342189

SEQ ID NO: 613219 - RNA, 64 nt, hsa; identical to SEQ ID NO: 342190

SEQ ID NO: 613220 - RNA, 64 nt, hsa; identical to SEQ ID NO: 342191

SEQ ID NO: 613221 - RNA, 64 nt, hsa; identical to SEQ ID NO: 342192

SEQ ID NO: 613222 - RNA, 64 nt, hsa; identical to SEQ ID NO: 342193

SEQ ID NO: 613223 - RNA, 64 nt, hsa; identical to SEQ ID NO: 342194

SEQ ID NO: 613224 - RNA, 64 nt, hsa; identical to SEQ ID NO: 342195

SEQ ID NO: 613225 - RNA, 64 nt, hsa; identical to SEQ ID NO: 342196

SEQ ID NO: 613226 - RNA, 64 nt, hsa; identical to SEQ ID NO: 342197

SEQ ID NO: 613227 - RNA, 64 nt, hsa; identical to SEQ ID NO: 342198

SEQ ID NO: 613228 - RNA, 64 nt, hsa; identical to SEQ ID NO: 342199

SEQ ID NO: 613229 - RNA, 64 nt, hsa; identical to SEQ ID NO: 342200

SEQ ID NO: 613230 - RNA, 64 nt, hsa; identical to SEQ ID NO: 342201

SEQ ID NO: 613231 - RNA, 64 nt, hsa; identical to SEQ ID NO: 342202

SEQ ID NO: 613232 - RNA, 64 nt, hsa; identical to SEQ ID NO: 342203

SEQ ID NO: 613233 - RNA, 64 nt, hsa; identical to SEQ ID NO: 342204

SEQ ID NO: 613234 - RNA, 64 nt, hsa; identical to SEQ ID NO: 342205

SEQ ID NO: 613235 - RNA, 64 nt, hsa; identical to SEQ ID NO: 342206

SEQ ID NO: 613236 - RNA, 64 nt, hsa; identical to SEQ ID NO: 342207

SEQ ID NO: 613237 - RNA, 64 nt, hsa; identical to SEQ ID NO: 342208

SEQ ID NO: 613238 - RNA, 64 nt, hsa; identical to SEQ ID NO: 342209

SEQ ID NO: 613239 - RNA, 64 nt, hsa; identical to SEQ ID NO: 342210

SEQ ID NO: 613240 - RNA, 64 nt, hsa; identical to SEQ ID NO: 342211

SEQ ID NO: 613241 - RNA, 64 nt, hsa; identical to SEQ ID NO: 342212

SEQ ID NO: 613242 - RNA, 64 nt, hsa; identical to SEQ ID NO: 342213

SEQ ID NO: 613243 - RNA, 64 nt, hsa; identical to SEQ ID NO: 342214

SEQ ID NO: 613244 - RNA, 64 nt, hsa; identical to SEQ ID NO: 342215

SEQ ID NO: 613245 - RNA, 64 nt, hsa; identical to SEQ ID NO: 342216

SEQ ID NO: 613246 - RNA, 64 nt, hsa; identical to SEQ ID NO: 342217

SEQ ID NO: 613247 - RNA, 64 nt, hsa; identical to SEQ ID NO: 342218

SEQ ID NO: 613248 - RNA, 64 nt, hsa; identical to SEQ ID NO: 342219

SEQ ID NO: 613249 - RNA, 64 nt, hsa; identical to SEQ ID NO: 342220

SEQ ID NO: 613250 - RNA, 64 nt, hsa; identical to SEQ ID NO: 342221

SEQ ID NO: 613251 - RNA, 64 nt, hsa; identical to SEQ ID NO: 342222

SEQ ID NO: 613252 - RNA, 64 nt, hsa; identical to SEQ ID NO: 342223

SEQ ID NO: 613253 - RNA, 64 nt, hsa; identical to SEQ ID NO: 342224

SEQ ID NO: 613254 - RNA, 64 nt, hsa; identical to SEQ ID NO: 342225

SEQ ID NO: 613255 - RNA, 64 nt, hsa; identical to SEQ ID NO: 342226

SEQ ID NO: 613256 - RNA, 64 nt, hsa; identical to SEQ ID NO: 342227

SEQ ID NO: 613257 - RNA, 64 nt, hsa; identical to SEQ ID NO: 342228

SEQ ID NO: 613258 - RNA, 64 nt, hsa; identical to SEQ ID NO: 342229

SEQ ID NO: 613259 - RNA, 64 nt, hsa; identical to SEQ ID NO: 342230

SEQ ID NO: 613260 - RNA, 64 nt, hsa; identical to SEQ ID NO: 342231

SEQ ID NO: 613261 - RNA, 64 nt, hsa; identical to SEQ ID NO: 342232

SEQ ID NO: 613262 - RNA, 64 nt, hsa; identical to SEQ ID NO: 342233

SEQ ID NO: 613263 - RNA, 64 nt, hsa; identical to SEQ ID NO: 342234

SEQ ID NO: 613264 - RNA, 64 nt, hsa; identical to SEQ ID NO: 342235

SEQ ID NO: 613265 - RNA, 64 nt, hsa; identical to SEQ ID NO: 342236

SEQ ID NO: 613266 - RNA, 64 nt, hsa; identical to SEQ ID NO: 342237

SEQ ID NO: 613267 - RNA, 64 nt, hsa; identical to SEQ ID NO: 342238

SEQ ID NO: 613268 - RNA, 64 nt, hsa; identical to SEQ ID NO: 342239

SEQ ID NO: 613269 - RNA, 64 nt, hsa; identical to SEQ ID NO: 342240

SEQ ID NO: 613270 - RNA, 64 nt, hsa; identical to SEQ ID NO: 342241

SEQ ID NO: 613271 - RNA, 64 nt, hsa; identical to SEQ ID NO: 342242

SEQ ID NO: 613272 - RNA, 64 nt, hsa; identical to SEQ ID NO: 342243

SEQ ID NO: 613273 - RNA, 64 nt, hsa; identical to SEQ ID NO: 342244

SEQ ID NO: 613274 - RNA, 64 nt, hsa; identical to SEQ ID NO: 342245

SEQ ID NO: 613275 - RNA, 64 nt, hsa; identical to SEQ ID NO: 342246

SEQ ID NO: 613276 - RNA, 64 nt, hsa; identical to SEQ ID NO: 342247

SEQ ID NO: 613277 - RNA, 62 nt, hsa; identical to SEQ ID NO: 342248

SEQ ID NO: 613278 - RNA, 64 nt, hsa; identical to SEQ ID NO: 342249

SEQ ID NO: 613279 - RNA, 64 nt, hsa; identical to SEQ ID NO: 342250

SEQ ID NO: 613280 - RNA, 64 nt, hsa; identical to SEQ ID NO: 342251

SEQ ID NO: 613281 - RNA, 64 nt, hsa; identical to SEQ ID NO: 342252

SEQ ID NO: 613282 - RNA, 64 nt, hsa; identical to SEQ ID NO: 342253

SEQ ID NO: 613283 - RNA, 64 nt, hsa; identical to SEQ ID NO: 342254

SEQ ID NO: 613284 - RNA, 64 nt, hsa; identical to SEQ ID NO: 342255

SEQ ID NO: 613285 - RNA, 64 nt, hsa; identical to SEQ ID NO: 342256

SEQ ID NO: 613286 - RNA, 64 nt, hsa; identical to SEQ ID NO: 342257

SEQ ID NO: 613287 - RNA, 64 nt, hsa; identical to SEQ ID NO: 342258

SEQ ID NO: 613288 - RNA, 64 nt, hsa; identical to SEQ ID NO: 342259

SEQ ID NO: 613289 - RNA, 64 nt, hsa; identical to SEQ ID NO: 342260

SEQ ID NO: 613290 - RNA, 64 nt, hsa; identical to SEQ ID NO: 342261

SEQ ID NO: 613291 - RNA, 64 nt, hsa; identical to SEQ ID NO: 342262

SEQ ID NO: 613292 - RNA, 64 nt, hsa; identical to SEQ ID NO: 342263

SEQ ID NO: 613293 - RNA, 64 nt, hsa; identical to SEQ ID NO: 342264

SEQ ID NO: 613294 - RNA, 64 nt, hsa; identical to SEQ ID NO: 342265

SEQ ID NO: 613295 - RNA, 64 nt, hsa; identical to SEQ ID NO: 342266

SEQ ID NO: 613296 - RNA, 64 nt, hsa; identical to SEQ ID NO: 342267

SEQ ID NO: 613297 - RNA, 64 nt, hsa; identical to SEQ ID NO: 342268

SEQ ID NO: 613298 - RNA, 64 nt, hsa; identical to SEQ ID NO: 342269

SEQ ID NO: 613299 - RNA, 64 nt, hsa; identical to SEQ ID NO: 342270

SEQ ID NO: 613300 - RNA, 64 nt, hsa; identical to SEQ ID NO: 342271

SEQ ID NO: 613301 - RNA, 64 nt, hsa; identical to SEQ ID NO: 342272

SEQ ID NO: 613302 - RNA, 64 nt, hsa; identical to SEQ ID NO: 342273

SEQ ID NO: 613303 - RNA, 64 nt, hsa; identical to SEQ ID NO: 342274

SEQ ID NO: 613304 - RNA, 64 nt, hsa; identical to SEQ ID NO: 342275

SEQ ID NO: 613305 - RNA, 64 nt, hsa; identical to SEQ ID NO: 342276

SEQ ID NO: 613306 - RNA, 64 nt, hsa; identical to SEQ ID NO: 342277

SEQ ID NO: 613307 - RNA, 64 nt, hsa; identical to SEQ ID NO: 342278

SEQ ID NO: 613308 - RNA, 64 nt, hsa; identical to SEQ ID NO: 342279

SEQ ID NO: 613309 - RNA, 64 nt, hsa; identical to SEQ ID NO: 342280

SEQ ID NO: 613310 - RNA, 62 nt, hsa; identical to SEQ ID NO: 342281

SEQ ID NO: 613311 - RNA, 64 nt, hsa; identical to SEQ ID NO: 342282

SEQ ID NO: 613312 - RNA, 64 nt, hsa; identical to SEQ ID NO: 342283

SEQ ID NO: 613313 - RNA, 64 nt, hsa; identical to SEQ ID NO: 342284

SEQ ID NO: 613314 - RNA, 64 nt, hsa; identical to SEQ ID NO: 342285

SEQ ID NO: 613315 - RNA, 64 nt, hsa; identical to SEQ ID NO: 342286

SEQ ID NO: 613316 - RNA, 64 nt, hsa; identical to SEQ ID NO: 342287

SEQ ID NO: 613317 - RNA, 64 nt, hsa; identical to SEQ ID NO: 342288

SEQ ID NO: 613318 - RNA, 64 nt, hsa; identical to SEQ ID NO: 342289

SEQ ID NO: 613319 - RNA, 64 nt, hsa; identical to SEQ ID NO: 342290

SEQ ID NO: 613320 - RNA, 64 nt, hsa; identical to SEQ ID NO: 342291

SEQ ID NO: 613321 - RNA, 64 nt, hsa; identical to SEQ ID NO: 342292

SEQ ID NO: 613322 - RNA, 64 nt, hsa; identical to SEQ ID NO: 342293

SEQ ID NO: 613323 - RNA, 64 nt, hsa; identical to SEQ ID NO: 342294

SEQ ID NO: 613324 - RNA, 64 nt, hsa; identical to SEQ ID NO: 342295

SEQ ID NO: 613325 - RNA, 64 nt, hsa; identical to SEQ ID NO: 342296

SEQ ID NO: 613326 - RNA, 64 nt, hsa; identical to SEQ ID NO: 342297

SEQ ID NO: 613327 - RNA, 64 nt, hsa; identical to SEQ ID NO: 342298

SEQ ID NO: 613328 - RNA, 64 nt, hsa; identical to SEQ ID NO: 342299

SEQ ID NO: 613329 - RNA, 64 nt, hsa; identical to SEQ ID NO: 342300

SEQ ID NO: 613330 - RNA, 64 nt, hsa; identical to SEQ ID NO: 342301

SEQ ID NO: 613331 - RNA, 64 nt, hsa; identical to SEQ ID NO: 342302

SEQ ID NO: 613332 - RNA, 64 nt, hsa; identical to SEQ ID NO: 342303

SEQ ID NO: 613333 - RNA, 64 nt, hsa; identical to SEQ ID NO: 342304

SEQ ID NO: 613334 - RNA, 64 nt, hsa; identical to SEQ ID NO: 342305

SEQ ID NO: 613335 - RNA, 64 nt, hsa; identical to SEQ ID NO: 342306

SEQ ID NO: 613336 - RNA, 64 nt, hsa; identical to SEQ ID NO: 342307

SEQ ID NO: 613337 - RNA, 64 nt, hsa; identical to SEQ ID NO: 342308

SEQ ID NO: 613338 - RNA, 64 nt, hsa; identical to SEQ ID NO: 342309

SEQ ID NO: 613339 - RNA, 64 nt, hsa; identical to SEQ ID NO: 342310

SEQ ID NO: 613340 - RNA, 64 nt, hsa; identical to SEQ ID NO: 342311

SEQ ID NO: 613341 - RNA, 64 nt, hsa; identical to SEQ ID NO: 342312

SEQ ID NO: 613342 - RNA, 64 nt, hsa; identical to SEQ ID NO: 342313

SEQ ID NO: 613343 - RNA, 64 nt, hsa; identical to SEQ ID NO: 342314

SEQ ID NO: 613344 - RNA, 64 nt, hsa; identical to SEQ ID NO: 342315

SEQ ID NO: 613345 - RNA, 64 nt, hsa; identical to SEQ ID NO: 342316

SEQ ID NO: 613346 - RNA, 64 nt, hsa; identical to SEQ ID NO: 342317

SEQ ID NO: 613347 - RNA, 64 nt, hsa
uacacacaacacuaagugccuagacuuuaaauagaucuagcaauuggaaaguuaguaagccuaa

SEQ ID NO: 613348 - RNA, 64 nt, hsa
ccaggaaagaauuuucucacccaaggaacauuugaucuagcagcagggaugagaggaaagcaga

SEQ ID NO: 613349 - RNA, 64 nt, hsa
ugccaugcuggugcgcugcacccacuaaugugucaucuagcauuagguauaucucccagugcua

SEQ ID NO: 613350 - RNA, 64 nt, hsa
uaugcaaguuuuuuuuccccauuauaucacacuuaucuagcaagggaccuugugguuuguggcu

SEQ ID NO: 613351 - RNA, 64 nt, hsa; identical to SEQ ID NO: 212929

SEQ ID NO: 613352 - RNA, 64 nt, hsa; identical to SEQ ID NO: 212930

SEQ ID NO: 613353 - RNA, 64 nt, hsa; identical to SEQ ID NO: 212931

SEQ ID NO: 613354 - RNA, 64 nt, hsa; identical to SEQ ID NO: 212932

SEQ ID NO: 613355 - RNA, 64 nt, hsa; identical to SEQ ID NO: 212933

SEQ ID NO: 613356 - RNA, 64 nt, hsa; identical to SEQ ID NO: 212934

SEQ ID NO: 613357 - RNA, 64 nt, hsa; identical to SEQ ID NO: 212935

SEQ ID NO: 613358 - RNA, 64 nt, hsa; identical to SEQ ID NO: 212936

SEQ ID NO: 613359 - RNA, 64 nt, hsa; identical to SEQ ID NO: 212937

SEQ ID NO: 613360 - RNA, 64 nt, hsa; identical to SEQ ID NO: 212938

SEQ ID NO: 613361 - RNA, 64 nt, hsa; identical to SEQ ID NO: 212939

SEQ ID NO: 613362 - RNA, 64 nt, hsa; identical to SEQ ID NO: 212940

SEQ ID NO: 613363 - RNA, 64 nt, hsa; identical to SEQ ID NO: 212941

SEQ ID NO: 613364 - RNA, 64 nt, hsa; identical to SEQ ID NO: 212942

SEQ ID NO: 613365 - RNA, 64 nt, hsa; identical to SEQ ID NO: 212943

SEQ ID NO: 613366 - RNA, 64 nt, hsa; identical to SEQ ID NO: 212944

SEQ ID NO: 613367 - RNA, 64 nt, hsa; identical to SEQ ID NO: 212945

SEQ ID NO: 613368 - RNA, 64 nt, hsa; identical to SEQ ID NO: 212946

SEQ ID NO: 613369 - RNA, 64 nt, hsa; identical to SEQ ID NO: 212947

SEQ ID NO: 613370 - RNA, 64 nt, hsa; identical to SEQ ID NO: 212948

SEQ ID NO: 613371 - RNA, 64 nt, hsa; identical to SEQ ID NO: 212949

SEQ ID NO: 613372 - RNA, 64 nt, hsa; identical to SEQ ID NO: 212950

SEQ ID NO: 613373 - RNA, 64 nt, hsa; identical to SEQ ID NO: 212951

SEQ ID NO: 613374 - RNA, 64 nt, hsa; identical to SEQ ID NO: 212952

SEQ ID NO: 613375 - RNA, 64 nt, hsa; identical to SEQ ID NO: 212953

SEQ ID NO: 613376 - RNA, 64 nt, hsa; identical to SEQ ID NO: 212954

SEQ ID NO: 613377 - RNA, 64 nt, hsa; identical to SEQ ID NO: 212955

SEQ ID NO: 613378 - RNA, 64 nt, hsa; identical to SEQ ID NO: 212956

SEQ ID NO: 613379 - RNA, 64 nt, hsa; identical to SEQ ID NO: 212957

SEQ ID NO: 613380 - RNA, 64 nt, hsa; identical to SEQ ID NO: 119910

SEQ ID NO: 613381 - RNA, 64 nt, hsa; identical to SEQ ID NO: 119911

SEQ ID NO: 613382 - RNA, 64 nt, hsa; identical to SEQ ID NO: 119912

SEQ ID NO: 613383 - RNA, 64 nt, hsa; identical to SEQ ID NO: 119913

SEQ ID NO: 613384 - RNA, 64 nt, hsa; identical to SEQ ID NO: 119914

SEQ ID NO: 613385 - RNA, 64 nt, hsa; identical to SEQ ID NO: 119915

SEQ ID NO: 613386 - RNA, 64 nt, hsa; identical to SEQ ID NO: 119916

SEQ ID NO: 613387 - RNA, 64 nt, hsa; identical to SEQ ID NO: 119917

SEQ ID NO: 613388 - RNA, 64 nt, hsa; identical to SEQ ID NO: 119918

SEQ ID NO: 613389 - RNA, 64 nt, hsa; identical to SEQ ID NO: 119919

SEQ ID NO: 613390 - RNA, 64 nt, hsa; identical to SEQ ID NO: 119920

SEQ ID NO: 613391 - RNA, 64 nt, hsa; identical to SEQ ID NO: 119921

SEQ ID NO: 613392 - RNA, 64 nt, hsa; identical to SEQ ID NO: 119922

SEQ ID NO: 613393 - RNA, 64 nt, hsa; identical to SEQ ID NO: 119923

SEQ ID NO: 613394 - RNA, 64 nt, hsa; identical to SEQ ID NO: 119924

SEQ ID NO: 613395 - RNA, 64 nt, hsa; identical to SEQ ID NO: 119925

SEQ ID NO: 613396 - RNA, 64 nt, hsa; identical to SEQ ID NO: 119926

SEQ ID NO: 613397 - RNA, 64 nt, hsa; identical to SEQ ID NO: 119927

SEQ ID NO: 613398 - RNA, 64 nt, hsa; identical to SEQ ID NO: 119928

SEQ ID NO: 613399 - RNA, 64 nt, hsa; identical to SEQ ID NO: 119929

SEQ ID NO: 613400 - RNA, 64 nt, hsa; identical to SEQ ID NO: 119930

SEQ ID NO: 613401 - RNA, 64 nt, hsa; identical to SEQ ID NO: 119931

SEQ ID NO: 613402 - RNA, 64 nt, hsa; identical to SEQ ID NO: 119932

SEQ ID NO: 613403 - RNA, 64 nt, hsa; identical to SEQ ID NO: 119933

SEQ ID NO: 613404 - RNA, 64 nt, hsa; identical to SEQ ID NO: 119934

SEQ ID NO: 613405 - RNA, 64 nt, hsa; identical to SEQ ID NO: 119935

SEQ ID NO: 613406 - RNA, 64 nt, hsa; identical to SEQ ID NO: 119936

SEQ ID NO: 613407 - RNA, 64 nt, hsa; identical to SEQ ID NO: 119937

SEQ ID NO: 613408 - RNA, 64 nt, hsa; identical to SEQ ID NO: 119938

SEQ ID NO: 613409 - RNA, 64 nt, hsa; identical to SEQ ID NO: 119939

SEQ ID NO: 613410 - RNA, 64 nt, hsa; identical to SEQ ID NO: 119940

SEQ ID NO: 613411 - RNA, 64 nt, hsa; identical to SEQ ID NO: 119941

SEQ ID NO: 613412 - RNA, 64 nt, hsa; identical to SEQ ID NO: 119942

SEQ ID NO: 613413 - RNA, 64 nt, hsa; identical to SEQ ID NO: 119943

SEQ ID NO: 613414 - RNA, 64 nt, hsa; identical to SEQ ID NO: 119944

SEQ ID NO: 613415 - RNA, 64 nt, hsa; identical to SEQ ID NO: 119945

SEQ ID NO: 613416 - RNA, 64 nt, hsa; identical to SEQ ID NO: 119946

SEQ ID NO: 613417 - RNA, 64 nt, hsa; identical to SEQ ID NO: 119947

SEQ ID NO: 613418 - RNA, 64 nt, hsa; identical to SEQ ID NO: 119948

SEQ ID NO: 613419 - RNA, 64 nt, hsa; identical to SEQ ID NO: 119949

SEQ ID NO: 613420 - RNA, 64 nt, hsa; identical to SEQ ID NO: 119950

SEQ ID NO: 613421 - RNA, 64 nt, hsa; identical to SEQ ID NO: 119951

SEQ ID NO: 613422 - RNA, 64 nt, hsa; identical to SEQ ID NO: 119952

SEQ ID NO: 613423 - RNA, 64 nt, hsa; identical to SEQ ID NO: 119953

SEQ ID NO: 613424 - RNA, 64 nt, hsa; identical to SEQ ID NO: 119954

SEQ ID NO: 613425 - RNA, 64 nt, hsa; identical to SEQ ID NO: 119955

SEQ ID NO: 613426 - RNA, 64 nt, hsa; identical to SEQ ID NO: 119956

SEQ ID NO: 613427 - RNA, 64 nt, hsa; identical to SEQ ID NO: 119957

SEQ ID NO: 613428 - RNA, 64 nt, hsa; identical to SEQ ID NO: 119958

SEQ ID NO: 613429 - RNA, 64 nt, hsa; identical to SEQ ID NO: 119959

SEQ ID NO: 613430 - RNA, 64 nt, hsa; identical to SEQ ID NO: 119960

SEQ ID NO: 613431 - RNA, 64 nt, hsa; identical to SEQ ID NO: 119961

SEQ ID NO: 613432 - RNA, 58 nt, hsa; identical to SEQ ID NO: 119962

SEQ ID NO: 613433 - RNA, 64 nt, hsa; identical to SEQ ID NO: 119963

SEQ ID NO: 613434 - RNA, 64 nt, hsa; identical to SEQ ID NO: 119964

SEQ ID NO: 613435 - RNA, 64 nt, hsa; identical to SEQ ID NO: 119965

SEQ ID NO: 613436 - RNA, 64 nt, hsa; identical to SEQ ID NO: 119966

SEQ ID NO: 613437 - RNA, 64 nt, hsa; identical to SEQ ID NO: 119967

SEQ ID NO: 613438 - RNA, 64 nt, hsa; identical to SEQ ID NO: 119968

SEQ ID NO: 613439 - RNA, 64 nt, hsa; identical to SEQ ID NO: 119969

SEQ ID NO: 613440 - RNA, 64 nt, hsa; identical to SEQ ID NO: 119970

SEQ ID NO: 613441 - RNA, 55 nt, hsa; identical to SEQ ID NO: 119971

SEQ ID NO: 613442 - RNA, 64 nt, hsa; identical to SEQ ID NO: 119972

SEQ ID NO: 613443 - RNA, 64 nt, hsa; identical to SEQ ID NO: 119973

SEQ ID NO: 613444 - RNA, 64 nt, hsa; identical to SEQ ID NO: 119974

SEQ ID NO: 613445 - RNA, 64 nt, hsa; identical to SEQ ID NO: 119975

SEQ ID NO: 613446 - RNA, 64 nt, hsa; identical to SEQ ID NO: 119976

SEQ ID NO: 613447 - RNA, 64 nt, hsa; identical to SEQ ID NO: 119977

SEQ ID NO: 613448 - RNA, 64 nt, hsa; identical to SEQ ID NO: 119978

SEQ ID NO: 613449 - RNA, 64 nt, hsa; identical to SEQ ID NO: 119979

SEQ ID NO: 613450 - RNA, 64 nt, hsa; identical to SEQ ID NO: 119980

SEQ ID NO: 613451 - RNA, 64 nt, hsa; identical to SEQ ID NO: 119981

SEQ ID NO: 613452 - RNA, 64 nt, hsa; identical to SEQ ID NO: 119982

SEQ ID NO: 613453 - RNA, 64 nt, hsa; identical to SEQ ID NO: 119983

SEQ ID NO: 613454 - RNA, 64 nt, hsa; identical to SEQ ID NO: 119984

SEQ ID NO: 613455 - RNA, 64 nt, hsa; identical to SEQ ID NO: 119985

SEQ ID NO: 613456 - RNA, 64 nt, hsa; identical to SEQ ID NO: 119986

SEQ ID NO: 613457 - RNA, 64 nt, hsa; identical to SEQ ID NO: 119987

SEQ ID NO: 613458 - RNA, 55 nt, hsa; identical to SEQ ID NO: 119988

SEQ ID NO: 613459 - RNA, 64 nt, hsa; identical to SEQ ID NO: 119989

SEQ ID NO: 613460 - RNA, 64 nt, hsa; identical to SEQ ID NO: 119990

SEQ ID NO: 613461 - RNA, 64 nt, hsa; identical to SEQ ID NO: 119991

SEQ ID NO: 613462 - RNA, 64 nt, hsa; identical to SEQ ID NO: 119992

SEQ ID NO: 613463 - RNA, 64 nt, hsa; identical to SEQ ID NO: 119993

SEQ ID NO: 613464 - RNA, 64 nt, hsa; identical to SEQ ID NO: 119994

SEQ ID NO: 613465 - RNA, 64 nt, hsa; identical to SEQ ID NO: 119995

SEQ ID NO: 613466 - RNA, 64 nt, hsa; identical to SEQ ID NO: 119996

SEQ ID NO: 613467 - RNA, 64 nt, hsa; identical to SEQ ID NO: 119997

SEQ ID NO: 613468 - RNA, 64 nt, hsa; identical to SEQ ID NO: 119998

SEQ ID NO: 613469 - RNA, 62 nt, hsa; identical to SEQ ID NO: 119999

SEQ ID NO: 613470 - RNA, 64 nt, hsa; identical to SEQ ID NO: 120000

SEQ ID NO: 613471 - RNA, 64 nt, hsa; identical to SEQ ID NO: 120001

SEQ ID NO: 613472 - RNA, 64 nt, hsa; identical to SEQ ID NO: 120002

SEQ ID NO: 613473 - RNA, 64 nt, hsa; identical to SEQ ID NO: 120003

SEQ ID NO: 613474 - RNA, 64 nt, hsa; identical to SEQ ID NO: 120004

SEQ ID NO: 613475 - RNA, 64 nt, hsa; identical to SEQ ID NO: 120005

SEQ ID NO: 613476 - RNA, 64 nt, hsa; identical to SEQ ID NO: 120006

SEQ ID NO: 613477 - RNA, 64 nt, hsa; identical to SEQ ID NO: 120007

SEQ ID NO: 613478 - RNA, 64 nt, hsa; identical to SEQ ID NO: 120008

SEQ ID NO: 613479 - RNA, 64 nt, hsa; identical to SEQ ID NO: 166853

SEQ ID NO: 613480 - RNA, 64 nt, hsa; identical to SEQ ID NO: 166854

SEQ ID NO: 613481 - RNA, 64 nt, hsa; identical to SEQ ID NO: 166855

SEQ ID NO: 613482 - RNA, 64 nt, hsa; identical to SEQ ID NO: 166856

SEQ ID NO: 613483 - RNA, 64 nt, hsa; identical to SEQ ID NO: 166857

SEQ ID NO: 613484 - RNA, 64 nt, hsa; identical to SEQ ID NO: 166858

SEQ ID NO: 613485 - RNA, 64 nt, hsa; identical to SEQ ID NO: 166859

SEQ ID NO: 613486 - RNA, 64 nt, hsa; identical to SEQ ID NO: 166860

SEQ ID NO: 613487 - RNA, 64 nt, hsa; identical to SEQ ID NO: 166861

SEQ ID NO: 613488 - RNA, 64 nt, hsa; identical to SEQ ID NO: 166862

SEQ ID NO: 613489 - RNA, 64 nt, hsa; identical to SEQ ID NO: 166863

SEQ ID NO: 613490 - RNA, 64 nt, hsa; identical to SEQ ID NO: 166864

SEQ ID NO: 613491 - RNA, 64 nt, hsa; identical to SEQ ID NO: 166865

SEQ ID NO: 613492 - RNA, 64 nt, hsa; identical to SEQ ID NO: 166866

SEQ ID NO: 613493 - RNA, 64 nt, hsa; identical to SEQ ID NO: 166867

SEQ ID NO: 613494 - RNA, 64 nt, hsa; identical to SEQ ID NO: 166868

SEQ ID NO: 613495 - RNA, 64 nt, hsa; identical to SEQ ID NO: 166869

SEQ ID NO: 613496 - RNA, 64 nt, hsa; identical to SEQ ID NO: 166870

SEQ ID NO: 613497 - RNA, 64 nt, hsa; identical to SEQ ID NO: 166871

SEQ ID NO: 613498 - RNA, 64 nt, hsa; identical to SEQ ID NO: 166872

SEQ ID NO: 613499 - RNA, 64 nt, hsa; identical to SEQ ID NO: 166873

SEQ ID NO: 613500 - RNA, 64 nt, hsa; identical to SEQ ID NO: 166874

SEQ ID NO: 613501 - RNA, 64 nt, hsa; identical to SEQ ID NO: 166875

SEQ ID NO: 613502 - RNA, 64 nt, hsa; identical to SEQ ID NO: 166876

SEQ ID NO: 613503 - RNA, 64 nt, hsa; identical to SEQ ID NO: 166877

SEQ ID NO: 613504 - RNA, 64 nt, hsa; identical to SEQ ID NO: 166878

SEQ ID NO: 613505 - RNA, 64 nt, hsa; identical to SEQ ID NO: 166879

SEQ ID NO: 613506 - RNA, 64 nt, hsa; identical to SEQ ID NO: 166880

SEQ ID NO: 613507 - RNA, 64 nt, hsa; identical to SEQ ID NO: 166881

SEQ ID NO: 613508 - RNA, 64 nt, hsa; identical to SEQ ID NO: 166882

SEQ ID NO: 613509 - RNA, 64 nt, hsa; identical to SEQ ID NO: 166883

SEQ ID NO: 613510 - RNA, 64 nt, hsa; identical to SEQ ID NO: 166884

SEQ ID NO: 613511 - RNA, 64 nt, hsa; identical to SEQ ID NO: 166885

SEQ ID NO: 613512 - RNA, 64 nt, hsa; identical to SEQ ID NO: 166886

SEQ ID NO: 613513 - RNA, 64 nt, hsa; identical to SEQ ID NO: 166887

SEQ ID NO: 613514 - RNA, 64 nt, hsa; identical to SEQ ID NO: 166888

SEQ ID NO: 613515 - RNA, 64 nt, hsa; identical to SEQ ID NO: 227857

SEQ ID NO: 613516 - RNA, 64 nt, hsa; identical to SEQ ID NO: 227858

SEQ ID NO: 613517 - RNA, 57 nt, hsa; identical to SEQ ID NO: 227859

SEQ ID NO: 613518 - RNA, 64 nt, hsa; identical to SEQ ID NO: 227860

SEQ ID NO: 613519 - RNA, 64 nt, hsa; identical to SEQ ID NO: 227861

SEQ ID NO: 613520 - RNA, 64 nt, hsa; identical to SEQ ID NO: 227862

SEQ ID NO: 613521 - RNA, 64 nt, hsa; identical to SEQ ID NO: 227863

SEQ ID NO: 613522 - RNA, 64 nt, hsa; identical to SEQ ID NO: 227864

SEQ ID NO: 613523 - RNA, 64 nt, hsa; identical to SEQ ID NO: 227865

SEQ ID NO: 613524 - RNA, 64 nt, hsa; identical to SEQ ID NO: 227866

SEQ ID NO: 613525 - RNA, 64 nt, hsa; identical to SEQ ID NO: 227867

SEQ ID NO: 613526 - RNA, 64 nt, hsa; identical to SEQ ID NO: 227868

SEQ ID NO: 613527 - RNA, 64 nt, hsa; identical to SEQ ID NO: 227869

SEQ ID NO: 613528 - RNA, 64 nt, hsa; identical to SEQ ID NO: 227870

SEQ ID NO: 613529 - RNA, 64 nt, hsa; identical to SEQ ID NO: 227871

SEQ ID NO: 613530 - RNA, 64 nt, hsa; identical to SEQ ID NO: 166853

SEQ ID NO: 613531 - RNA, 64 nt, hsa; identical to SEQ ID NO: 166854

SEQ ID NO: 613532 - RNA, 64 nt, hsa; identical to SEQ ID NO: 166855

SEQ ID NO: 613533 - RNA, 64 nt, hsa; identical to SEQ ID NO: 166856

SEQ ID NO: 613534 - RNA, 64 nt, hsa; identical to SEQ ID NO: 166857

SEQ ID NO: 613535 - RNA, 64 nt, hsa; identical to SEQ ID NO: 166858

SEQ ID NO: 613536 - RNA, 64 nt, hsa; identical to SEQ ID NO: 166859

SEQ ID NO: 613537 - RNA, 64 nt, hsa; identical to SEQ ID NO: 166860

SEQ ID NO: 613538 - RNA, 64 nt, hsa; identical to SEQ ID NO: 166861

SEQ ID NO: 613539 - RNA, 64 nt, hsa; identical to SEQ ID NO: 166862

SEQ ID NO: 613540 - RNA, 64 nt, hsa; identical to SEQ ID NO: 166863

SEQ ID NO: 613541 - RNA, 64 nt, hsa; identical to SEQ ID NO: 166864

SEQ ID NO: 613542 - RNA, 64 nt, hsa; identical to SEQ ID NO: 166865

SEQ ID NO: 613543 - RNA, 64 nt, hsa; identical to SEQ ID NO: 166866

SEQ ID NO: 613544 - RNA, 64 nt, hsa; identical to SEQ ID NO: 166867

SEQ ID NO: 613545 - RNA, 64 nt, hsa; identical to SEQ ID NO: 166868

SEQ ID NO: 613546 - RNA, 64 nt, hsa; identical to SEQ ID NO: 166869

SEQ ID NO: 613547 - RNA, 64 nt, hsa; identical to SEQ ID NO: 166870

SEQ ID NO: 613548 - RNA, 64 nt, hsa; identical to SEQ ID NO: 166871

SEQ ID NO: 613549 - RNA, 64 nt, hsa; identical to SEQ ID NO: 166872

SEQ ID NO: 613550 - RNA, 64 nt, hsa; identical to SEQ ID NO: 166873

SEQ ID NO: 613551 - RNA, 64 nt, hsa; identical to SEQ ID NO: 166874

SEQ ID NO: 613552 - RNA, 64 nt, hsa; identical to SEQ ID NO: 166875

SEQ ID NO: 613553 - RNA, 64 nt, hsa; identical to SEQ ID NO: 166876

SEQ ID NO: 613554 - RNA, 64 nt, hsa; identical to SEQ ID NO: 166877

SEQ ID NO: 613555 - RNA, 64 nt, hsa; identical to SEQ ID NO: 166878

SEQ ID NO: 613556 - RNA, 64 nt, hsa; identical to SEQ ID NO: 166879

SEQ ID NO: 613557 - RNA, 64 nt, hsa; identical to SEQ ID NO: 166880

SEQ ID NO: 613558 - RNA, 64 nt, hsa; identical to SEQ ID NO: 166881

SEQ ID NO: 613559 - RNA, 64 nt, hsa; identical to SEQ ID NO: 166882

SEQ ID NO: 613560 - RNA, 64 nt, hsa; identical to SEQ ID NO: 166883

SEQ ID NO: 613561 - RNA, 64 nt, hsa; identical to SEQ ID NO: 166884

SEQ ID NO: 613562 - RNA, 64 nt, hsa; identical to SEQ ID NO: 166885

SEQ ID NO: 613563 - RNA, 64 nt, hsa; identical to SEQ ID NO: 166886

SEQ ID NO: 613564 - RNA, 64 nt, hsa; identical to SEQ ID NO: 166887

SEQ ID NO: 613565 - RNA, 64 nt, hsa; identical to SEQ ID NO: 166888

SEQ ID NO: 613566 - RNA, 64 nt, hsa; identical to SEQ ID NO: 227857

SEQ ID NO: 613567 - RNA, 64 nt, hsa; identical to SEQ ID NO: 227858

SEQ ID NO: 613568 - RNA, 57 nt, hsa; identical to SEQ ID NO: 227859

SEQ ID NO: 613569 - RNA, 64 nt, hsa; identical to SEQ ID NO: 227860

SEQ ID NO: 613570 - RNA, 64 nt, hsa; identical to SEQ ID NO: 227861

SEQ ID NO: 613571 - RNA, 64 nt, hsa; identical to SEQ ID NO: 227862

SEQ ID NO: 613572 - RNA, 64 nt, hsa; identical to SEQ ID NO: 227863

SEQ ID NO: 613573 - RNA, 64 nt, hsa; identical to SEQ ID NO: 227864

SEQ ID NO: 613574 - RNA, 64 nt, hsa; identical to SEQ ID NO: 227865

SEQ ID NO: 613575 - RNA, 64 nt, hsa; identical to SEQ ID NO: 227866

SEQ ID NO: 613576 - RNA, 64 nt, hsa; identical to SEQ ID NO: 227867

SEQ ID NO: 613577 - RNA, 64 nt, hsa; identical to SEQ ID NO: 227868

SEQ ID NO: 613578 - RNA, 64 nt, hsa; identical to SEQ ID NO: 227869

SEQ ID NO: 613579 - RNA, 64 nt, hsa; identical to SEQ ID NO: 227870

SEQ ID NO: 613580 - RNA, 64 nt, hsa; identical to SEQ ID NO: 227871

SEQ ID NO: 613581 - RNA, 64 nt, hsa
uuuuaauaaaguuuuauaacucacugacaaaacauauuucaauaguauaugaguaugagauuuc

SEQ ID NO: 613582 - RNA, 64 nt, hsa
gcuugccauuaugaagaacagcuggguauaccauuauuucaaguaauaaaucugaauucuauua

SEQ ID NO: 613583 - RNA, 64 nt, hsa
cccuuggcauaucagauugagcuaauggugauguuauuucaaucuaacagccaccaaucugaaa

SEQ ID NO: 613584 - RNA, 64 nt, hsa
uuauuucaaucuaacagccaccaaucugaaauuguauuucaaauguugauucuguaguucuuua

SEQ ID NO: 613585 - RNA, 64 nt, hsa
gauaagagcagagcucacacuuuuacaguugcaguauuucaaagucccuauccaggucacucca

SEQ ID NO: 613586 - RNA, 64 nt, hsa
ggcuuugugcuaaaugugguuuuguguuuugcuguauuucaaaauuuuccuucuguuaaaggaa

SEQ ID NO: 613587 - RNA, 64 nt, hsa
aguggaaaggguauuagaaguguaacugugcuauuauuucaauaaagaccucuugacauuuaaa

SEQ ID NO: 613588 - RNA, 64 nt, hsa
uuuacuuuaaauuauuuaaauaggcuauuuuauuuauuucaaaugcaguuguauuaguucucau

SEQ ID NO: 613589 - RNA, 64 nt, hsa
cuuacugaagaacaaauuauuaauauuggaugaguauuucaacagugugacuaauguuugaaau

SEQ ID NO: 613590 - RNA, 64 nt, hsa
cuguaguuuuauagaaaguauuaaugcuuuuauguauuucaaaacuuucauauguuaaauggaa

SEQ ID NO: 613591 - RNA, 64 nt, hsa
agccaugaaagugucuacgcuuuuguuuuuccauuauuucaauugggggaaaauauuaacuuug

SEQ ID NO: 613592 - RNA, 64 nt, hsa
ugucuuaucccuuauuuauggagcuagacugacauauuucaaaccaaucucuucuguggucuuc

SEQ ID NO: 613593 - RNA, 64 nt, hsa
augaaagaaaaacuugaaaugcuacuuaacuuacuauuucaaagggaaguauauuucuuuuuaa

SEQ ID NO: 613594 - RNA, 64 nt, hsa
ugcacacaaaaaauaacuuauaguuagacuuuucuauuucaaguaaagcuuugaguuacuuguu

SEQ ID NO: 613595 - RNA, 64 nt, hsa
aaaaaaaaaaaaaagccuacauucuccaguugauuauuucaacuaauguguauuaugugccuaa

SEQ ID NO: 613596 - RNA, 64 nt, hsa
guuucaaagcacaauaacuaguaauaccaaagacuauuucaaaauguccagauguaggggaaga

SEQ ID NO: 613597 - RNA, 64 nt, hsa
ucaaaauuacauauggacuuuggaagauugcuccuauuucaacaaauaguugcugcaagaauuu

SEQ ID NO: 613598 - RNA, 64 nt, hsa
aacuagggugguaaccggaaaaaaauauugucaguauuucaagcuguguuccuuucuuaguuug

SEQ ID NO: 613599 - RNA, 64 nt, hsa
uuaugcaugccaaauguaaggccaugaaaaucaguauuucaaauaacuuaaaaaaugcuuuacu

SEQ ID NO: 613600 - RNA, 64 nt, hsa
ucuuacaaaguauuuuucccaaagauagcuuuacuauuucaaaaauugucaaauuaaugcaugc

SEQ ID NO: 613601 - RNA, 64 nt, hsa
uagaaauuuagcagucagauuagguaggugguuuuauuucaaagggaaacuuuaauccaaagaa

SEQ ID NO: 613602 - RNA, 64 nt, hsa
uuuucacguaucuuccaaguacucagcuuuuucguauuucaaauaaggucagaccuuuuauacu

SEQ ID NO: 613603 - RNA, 64 nt, hsa
aaaacacuggauucauuucaucuugcaaauguuguauuucaaaccaguuucacauaaguuauuu

SEQ ID NO: 613604 - RNA, 64 nt, hsa
auuuuuuauuuaauuauauuaugaauaaaauuguuauuucaauaguacccaaccaaagaugcuu

SEQ ID NO: 613605 - RNA, 64 nt, hsa
uacacauauauauacacauacacaaauauaugcauauuucaaauggauuguaugcacuugcaaa

SEQ ID NO: 613606 - RNA, 64 nt, hsa
guauguaaauuauauuuauacaucuucugaaauauauuucaaaauauguguguacguguguaua

SEQ ID NO: 613607 - RNA, 64 nt, hsa
aaaaagauuucucacagcuuuuuguucuguuuuguauuucaauuaggaacuugcaguauuauuu

SEQ ID NO: 613608 - RNA, 64 nt, hsa
aggaucaaagauucaaaugguuucagagagguuuuauuucaauuaauuuguucuagugcuuuca

SEQ ID NO: 613609 - RNA, 64 nt, hsa
uuuacaagccaaauacaugugucaauguuucuaguauuucaaagaagcaauuauguaaaguugu

SEQ ID NO: 613610 - RNA, 64 nt, hsa
uaaucauccuuaugaaaacagauguaaacaacuauauuucaacuaacuucaucuucacugcaua

SEQ ID NO: 613611 - RNA, 64 nt, hsa
acuggaaaguaguuguguggcucugaauguuuuguauuucaaucgagaauccuuagucgauaga

SEQ ID NO: 613612 - RNA, 64 nt, hsa
uuaguucauuuucuguguugacauuugcaauuaauauuucaauauuuuaugugcuuauauuggc

SEQ ID NO: 613613 - RNA, 64 nt, hsa
gacauuuuauuuucccugguaaagaggauucuaauauuucaagaauguuucacuggaauugaug

SEQ ID NO: 613614 - RNA, 64 nt, hsa
ccaauuguuccucggcuggauuuucaucaucagauauuucaacucaucucaucaguuucuugua

SEQ ID NO: 613615 - RNA, 64 nt, hsa
ugaacuauuuuuauaacuucuugugagucuuaaguauuucaaaauaaaagugguuuuaaaguaa

SEQ ID NO: 613616 - RNA, 64 nt, hsa
gcuagauauauuaacaugaaggaauggggaagcuuauuucaaucaaagcuaaaauuuucagaag

SEQ ID NO: 613617 - RNA, 64 nt, hsa
acauuuuagguauuucauauugaauuaugcuguauauuucaauuccaaguuuauuuauuuucca

SEQ ID NO: 613618 - RNA, 64 nt, hsa
ucuaaauaccauuaaggcuugacugguuaauuccuauuucaaggauuuggauuuauucagguaa

SEQ ID NO: 613619 - RNA, 64 nt, hsa
ucuaagauguuucugguucaagacugucauuuucuauuucaaccgaaaaguaagcauuuaaccc

SEQ ID NO: 613620 - RNA, 64 nt, hsa
ugagauacacuuaguacaaaaaaugaaaaucugguauuucaaaauugcauuucuuguauaauag

SEQ ID NO: 613621 - RNA, 64 nt, hsa
uucuauuaaaauauuuauauuucuaaauccgagguauuucaagguguaguauccuauuucaaag

SEQ ID NO: 613622 - RNA, 64 nt, hsa
uucuaaauccgagguauuucaagguguaguauccuauuucaaaggagauauagcaguuuugcca

SEQ ID NO: 613623 - RNA, 64 nt, hsa
agggcggagaggcugcacuugugagagaaaauacuauuucaagucauauucugcguaggaaaau

SEQ ID NO: 613624 - RNA, 64 nt, hsa
cucaaacggcaacauuccucagaaaccaaagcuuuauuucaaaucucuuccuucccuggcuggu

SEQ ID NO: 613625 - RNA, 64 nt, hsa
ucuuaauauuacauacaagaaaaugcaguuagguuauuucaauugacaauucugccuccucuuu

SEQ ID NO: 613626 - RNA, 64 nt, hsa
guuuuugacaauuuuguuugaaauucauauaucuuauuucaaaggauagcauaauaucugcauu

SEQ ID NO: 613627 - RNA, 64 nt, hsa
ucgauuucauucaugugauuaaaacaaguugccauauuucaaagccuugaacuaagacucaauu

SEQ ID NO: 613628 - RNA, 64 nt, hsa
auagucaucuaagaaugaauaccugucugccauguauuucaaucuuagugagccaaaauuguuu

SEQ ID NO: 613629 - RNA, 64 nt, hsa
uuuccugcugagcuccaguauuuugauaguuaauuauuucaacuaauauaucuaugucuauauc

SEQ ID NO: 613630 - RNA, 64 nt, hsa
accuaugaaacuauugauaugugaauagauggguuauuucaaccuguuuuggucacaucacuau

SEQ ID NO: 613631 - RNA, 64 nt, hsa
gucaaguagaggcaaugcaaagauucacauaguuuauuucaacuauuuauugaaugauuacuau

SEQ ID NO: 613632 - RNA, 64 nt, hsa
ucaauuuaucauuuaucaggauucauugaucaaauauuucaaccuuucauauuuuuaagaaaac

SEQ ID NO: 613633 - RNA, 64 nt, hsa
acaaaaauguucaaguccuggcugaugguccaaauauuucaaaaauauucaguacaacagaaaa

SEQ ID NO: 613634 - RNA, 64 nt, hsa
ugauuuauacucagaaucgacauucuuaaaaaguuauuucaagggauggcauaacuguaagagg

SEQ ID NO: 613635 - RNA, 64 nt, hsa
aacuucaaagauaguuauugaccuuauaaauaaauauuucaaaauuuugauucggaagacuaag

SEQ ID NO: 613636 - RNA, 64 nt, hsa
aagcacucuaaaauuuagaguauaaauugucuuauauuucaaauuagaaaaguucaaaugaagu

SEQ ID NO: 613637 - RNA, 64 nt, hsa
auauucuucuuccuuuuccuaaaugaaauuauauuauuucaacuacuaaaacuucccgccaccc

SEQ ID NO: 613638 - RNA, 64 nt, hsa
aacuauggucucuuucaaauaaauaguaguuuuauauuucaacacaaguugcuauaagcagucc

SEQ ID NO: 613639 - RNA, 64 nt, hsa
agauuguauuucucugcuuucauuucaauuucauuauuucaaauugcuugucaaaauggcccaa

SEQ ID NO: 613640 - RNA, 64 nt, hsa
caacuagcuguauucguauuaaaaugaagucucuuauuucaauuaccuaguguuguugggaacu

SEQ ID NO: 613641 - RNA, 64 nt, hsa
agaugugugguauagauaguauauauuucaagcuuauuucaaaauuggugguuuuuuuaaaaaa

SEQ ID NO: 613642 - RNA, 64 nt, hsa
ccuuacuuuuaagaugugugguauagauaguauauauuucaagcuuauuucaaaauuggugguu

SEQ ID NO: 613643 - RNA, 64 nt, hsa
aaagaugauuuaaauaugaaucuuaugaguaaauuauuucaauuuuauuuuagacgguauaacu

SEQ ID NO: 613644 - RNA, 64 nt, hsa
uaaauuauuucaauuuuauuuuagacgguauaacuauuucaauuugauuaauccacuauuauau

SEQ ID NO: 613645 - RNA, 64 nt, hsa
caugccauacuuuuaggaagucugagaugauaaauauuucaaggucagugaagucuaucaauca

SEQ ID NO: 613646 - RNA, 64 nt, hsa
guacacuguauuguaaaaauaaaaaguaaaauuauauuucaaauuuuaaaagccacuaagcaau

SEQ ID NO: 613647 - RNA, 64 nt, hsa
auauaaugggauuuaaaaaaagugcuaucuuuucuauuucaaguuaauuacaaacaguuuugua

SEQ ID NO: 613648 - RNA, 64 nt, hsa
uuuaugacaccuuuguuuuucucccucuguucaguauuucaaggaaaauuauggaugccagucu

SEQ ID NO: 613649 - RNA, 64 nt, hsa
agagacauaaugacagcugauguuaaacuuuucauauuucaaauuagauucccuaggagguaua

SEQ ID NO: 613650 - RNA, 64 nt, hsa
gagauauaccgugugaagcuauugucagcuucucuauuucaaaaugcaaucagcauauaacuau

SEQ ID NO: 613651 - RNA, 64 nt, hsa
ccaaucuagaauauggaacucuaaucacuucuaguauuucaacuuccuagcagaaaugaacuug

SEQ ID NO: 613652 - RNA, 64 nt, hsa
uaugaguuaaaaugucccuucuuccuagcgagcauauuucaacuguucuucauaaauguuuaug

SEQ ID NO: 613653 - RNA, 64 nt, hsa
uccccaguccaaaacacagucauuucaccuggacuauuucaaucauuacacagguguccaaccu

SEQ ID NO: 613654 - RNA, 64 nt, hsa
uaacugaagaaagagaaauugaauaauauaguucuauuucaacauguggguucacagauuuauu

SEQ ID NO: 613655 - RNA, 64 nt, hsa
aguuuguuuugcugccaaccugucuccaccccuguauuucaagaucauugauaagcccuaaauu

SEQ ID NO: 613656 - RNA, 64 nt, hsa
gguggcccacaaugagugaguagugauuuuuggauauuucaaaauagucuagaccagcuagugc

SEQ ID NO: 613657 - RNA, 64 nt, hsa
agugucuagaauuguucuccuguuuguagcuggauauuucaaagaaacauugcagguauuuuau

SEQ ID NO: 613658 - RNA, 64 nt, hsa
guuaauacuaguuuucagaacauuaguccaaggcuauuucaaguuuuccauugaauauaugcuu

SEQ ID NO: 613659 - RNA, 64 nt, hsa
caugggcaaggccauucucuacaucauugcuuaauauuucaaaaauagguauuagagcacuauc

SEQ ID NO: 613660 - RNA, 64 nt, hsa
uauggaugcaacuuauuaaaaauguuggccuggguauuucaaaggguauauauaaaagguaaaa

SEQ ID NO: 613661 - RNA, 64 nt, hsa
guguauaguuucauuuauuugaagugauuucaaauauuucaaauucaugaauaagaauauuccg

SEQ ID NO: 613662 - RNA, 64 nt, hsa
uauagaagaugacacagaaauuggaaccaacaaaacugcuaacaccuuguugacuguucugagu

SEQ ID NO: 613663 - RNA, 64 nt, hsa
ugggauuuuuaggucagcccaggggagaaagauaacugcuaaaauuccccuguaccccauccuu

SEQ ID NO: 613664 - RNA, 64 nt, hsa
cagggaguaacuuuaaacaauguuugaauaauuaacugcuaagucuuauauuuuauguguaucu

SEQ ID NO: 613665 - RNA, 64 nt, hsa
uaaauauuacaaauuuguucaguucauagcguagacugcuaaauacuguaauguuucaaaacau

SEQ ID NO: 613666 - RNA, 64 nt, hsa
guacuuauacauuuuaaaaugaguacuaauuuucacugcuaauaauucuguaaggacacaucaa

SEQ ID NO: 613667 - RNA, 64 nt, hsa
gcuuuauuuucaccuuguguacaacauggcaaagacugcuaagauuaaaauccgucucccauuu

SEQ ID NO: 613668 - RNA, 64 nt, hsa
ugauuugcuguaauauaaaacuuagaaguaaaccacugcuaauuaaucauuuuaaacuuucaaa

SEQ ID NO: 613669 - RNA, 64 nt, hsa
accacugcuaauuaaucauuuuaaacuuucaaaaacugcuaaaacaggugccaugaaucaggua

SEQ ID NO: 613670 - RNA, 64 nt, hsa
cguuuggagauucaaaacuucugucuucguccucucccccgagcccccucucccaaauuuuuaa

SEQ ID NO: 613671 - RNA, 64 nt, hsa
gucugcucugagcggacguuaaaaugggcccccgucccccgacccgcacccuccuuccucaggg

SEQ ID NO: 613672 - RNA, 64 nt, hsa
uggcccugcaagcugcuuuaucccugcgcuagucucccccgaggguuuaggcuggcccagcaca

SEQ ID NO: 613673 - RNA, 64 nt, hsa
aauaagaacguggccaccugcccagcuucacaccucccccgacuucagcccuuccuaaacccag

SEQ ID NO: 613674 - RNA, 64 nt, hsa; identical to SEQ ID NO: 128948

SEQ ID NO: 613675 - RNA, 64 nt, hsa; identical to SEQ ID NO: 128949

SEQ ID NO: 613676 - RNA, 64 nt, hsa; identical to SEQ ID NO: 128950

SEQ ID NO: 613677 - RNA, 64 nt, hsa; identical to SEQ ID NO: 128951

SEQ ID NO: 613678 - RNA, 64 nt, hsa; identical to SEQ ID NO: 128952

SEQ ID NO: 613679 - RNA, 64 nt, hsa; identical to SEQ ID NO: 128953

SEQ ID NO: 613680 - RNA, 64 nt, hsa; identical to SEQ ID NO: 128954

SEQ ID NO: 613681 - RNA, 64 nt, hsa; identical to SEQ ID NO: 128955

SEQ ID NO: 613682 - RNA, 64 nt, hsa; identical to SEQ ID NO: 128956

SEQ ID NO: 613683 - RNA, 64 nt, hsa; identical to SEQ ID NO: 128957

SEQ ID NO: 613684 - RNA, 64 nt, hsa; identical to SEQ ID NO: 128958

SEQ ID NO: 613685 - RNA, 64 nt, hsa; identical to SEQ ID NO: 128959

SEQ ID NO: 613686 - RNA, 64 nt, hsa; identical to SEQ ID NO: 128960

SEQ ID NO: 613687 - RNA, 64 nt, hsa; identical to SEQ ID NO: 128961

SEQ ID NO: 613688 - RNA, 64 nt, hsa; identical to SEQ ID NO: 128962

SEQ ID NO: 613689 - RNA, 64 nt, hsa; identical to SEQ ID NO: 128963

SEQ ID NO: 613690 - RNA, 64 nt, hsa; identical to SEQ ID NO: 128964

SEQ ID NO: 613691 - RNA, 64 nt, hsa; identical to SEQ ID NO: 128965

SEQ ID NO: 613692 - RNA, 64 nt, hsa; identical to SEQ ID NO: 128966

SEQ ID NO: 613693 - RNA, 64 nt, hsa; identical to SEQ ID NO: 128967

SEQ ID NO: 613694 - RNA, 64 nt, hsa; identical to SEQ ID NO: 128968

SEQ ID NO: 613695 - RNA, 64 nt, hsa; identical to SEQ ID NO: 128969

SEQ ID NO: 613696 - RNA, 64 nt, hsa; identical to SEQ ID NO: 128970

SEQ ID NO: 613697 - RNA, 64 nt, hsa; identical to SEQ ID NO: 128971

SEQ ID NO: 613698 - RNA, 64 nt, hsa; identical to SEQ ID NO: 128972

SEQ ID NO: 613699 - RNA, 64 nt, hsa; identical to SEQ ID NO: 128973

SEQ ID NO: 613700 - RNA, 64 nt, hsa; identical to SEQ ID NO: 128974

SEQ ID NO: 613701 - RNA, 64 nt, hsa; identical to SEQ ID NO: 128975

SEQ ID NO: 613702 - RNA, 64 nt, hsa; identical to SEQ ID NO: 128976

SEQ ID NO: 613703 - RNA, 64 nt, hsa; identical to SEQ ID NO: 128977

SEQ ID NO: 613704 - RNA, 64 nt, hsa; identical to SEQ ID NO: 128978

SEQ ID NO: 613705 - RNA, 64 nt, hsa; identical to SEQ ID NO: 128979

SEQ ID NO: 613706 - RNA, 64 nt, hsa; identical to SEQ ID NO: 128980

SEQ ID NO: 613707 - RNA, 64 nt, hsa; identical to SEQ ID NO: 128981

SEQ ID NO: 613708 - RNA, 64 nt, hsa; identical to SEQ ID NO: 128982

SEQ ID NO: 613709 - RNA, 64 nt, hsa; identical to SEQ ID NO: 128983

SEQ ID NO: 613710 - RNA, 64 nt, hsa; identical to SEQ ID NO: 128984

SEQ ID NO: 613711 - RNA, 64 nt, hsa; identical to SEQ ID NO: 128985

SEQ ID NO: 613712 - RNA, 64 nt, hsa; identical to SEQ ID NO: 128986

SEQ ID NO: 613713 - RNA, 64 nt, hsa; identical to SEQ ID NO: 128987

SEQ ID NO: 613714 - RNA, 64 nt, hsa; identical to SEQ ID NO: 128988

SEQ ID NO: 613715 - RNA, 64 nt, hsa; identical to SEQ ID NO: 128989

SEQ ID NO: 613716 - RNA, 64 nt, hsa; identical to SEQ ID NO: 128990

SEQ ID NO: 613717 - RNA, 64 nt, hsa; identical to SEQ ID NO: 128991

SEQ ID NO: 613718 - RNA, 64 nt, hsa; identical to SEQ ID NO: 128992

SEQ ID NO: 613719 - RNA, 64 nt, hsa; identical to SEQ ID NO: 128993

SEQ ID NO: 613720 - RNA, 64 nt, hsa; identical to SEQ ID NO: 128994

SEQ ID NO: 613721 - RNA, 56 nt, hsa; identical to SEQ ID NO: 128995

SEQ ID NO: 613722 - RNA, 64 nt, hsa
uuagcuaucaagcacucaccauugugaagaauaguugaucgacucugcuuuuacuaacagauuu

SEQ ID NO: 613723 - RNA, 64 nt, hsa
agucccagcuacuuaggaggcugagaugggaggauugaucgaucgcuugagccugggaggugga

SEQ ID NO: 613724 - RNA, 64 nt, hsa
uuccaaauucaagaagaagcaguauuaacaucaauugaucgacacaaaguaauuuuuaauuuaa

SEQ ID NO: 613725 - RNA, 64 nt, hsa
auaagaaaaaugaguuucaaauuuaagauguuuauugaucgaagcaauugaaguaucauggauu

SEQ ID NO: 613726 - RNA, 64 nt, hsa
cauguccaguaugagugguggauggggaauguaauugaucgauccugaucacugacucuugguc

SEQ ID NO: 613727 - RNA, 64 nt, hsa
uuucacauaaaacaauuauccuaaagguuaauaguugaucgaaacagaauaauagaaaaauucu

SEQ ID NO: 613728 - RNA, 64 nt, hsa
uguaguuuagaguggaaaaguuuuugcacacauuuugaucgaacuauauucuaagcacacaaaa

SEQ ID NO: 613729 - RNA, 64 nt, hsa
ugcauguuugaauuaaaagaaaguaauggaagaauugaucgaugaauuaagugagguggaauuc

SEQ ID NO: 613730 - RNA, 64 nt, hsa
agucucacauggaaaagugaguucugccuuuccuuugaucgagggucaaaauacaaagacauuu

SEQ ID NO: 613731 - RNA, 64 nt, hsa
acucguuuccuaauuuuuacuggauuccaaagcuuugaucgaggauauuuuuuaagagguucaa

SEQ ID NO: 613732 - RNA, 64 nt, hsa
gauaucacacagcuuugcagaaggaaggaagaccuugaucgacauuguuuuuuauuuuuuuaac

SEQ ID NO: 613733 - RNA, 64 nt, hsa
aaccucguugacaugcacaguuugcaaucuuauguugaucgauguuaaacgucacagcaguacu

SEQ ID NO: 613734 - RNA, 64 nt, hsa
augagcaacuauaagcaaagccauaagaagugguuugaucgauauauuagggguagcucuugau

SEQ ID NO: 613735 - RNA, 64 nt, hsa
caccaaacuuaccauccuuuauuuuacaauauuuuugaucgaccaaauaaaauguccuaauaau

SEQ ID NO: 613736 - RNA, 64 nt, hsa
aauaucaagaagauucagaaaauuauuucuaaaguugaucgauucaugucguauugauagaauc

SEQ ID NO: 613737 - RNA, 64 nt, hsa
gagaagauuagugcucggggucaccaugaugccuuugaucgaugcugcuccaguaacuacagug

SEQ ID NO: 613738 - RNA, 64 nt, hsa
uuagauguucucagucaaguacucacugaacucauugaucgagugcugucugcuaaaucuccaa

SEQ ID NO: 613739 - RNA, 64 nt, hsa
aguguacagccacagcaaggagcccgacacugauuugaucgauucugugacacaaaccccacca

SEQ ID NO: 613740 - RNA, 64 nt, hsa
uccuaagaaaaaggcuugaauuuauguaaauacuuugaucgauugcuaauuuucaaaggcuucu

SEQ ID NO: 613741 - RNA, 64 nt, hsa
auagggaaaauaaguauuuaguuggagggauaauuugaucgaaucaccugaauguucuauguaa

SEQ ID NO: 613742 - RNA, 64 nt, hsa
ucagauaaaaugugcuuauguucugcuaugacguuugaucgaauccuaaccacagugagcucuu

SEQ ID NO: 613743 - RNA, 64 nt, hsa
accacucaaaaggaaacuugaauaauuuauaauuuugaucgaguuucuuaaaagacccuggaga

SEQ ID NO: 613744 - RNA, 64 nt, hsa
gaauuauuuugugaugcaaauaaauauccuuuaauugaucgacuugccaaauuuagauuugugu

SEQ ID NO: 613745 - RNA, 64 nt, hsa
uucugcgggcucccuccucuggcaggcuucccccuugaucgacuucuugguuuucucucuggau

SEQ ID NO: 613746 - RNA, 64 nt, hsa
agaacucgggggcccccugcccgcacccggacacuugaucgauccccaccgacgcccccugcac

SEQ ID NO: 613747 - RNA, 64 nt, hsa
cuccgcugcaucucagcaaagccccucccaggguuugaucgauugagcaggacagcccugcucc

SEQ ID NO: 613748 - RNA, 64 nt, hsa
caucaguucauguucuguauugaaauaggucugguugaucgaugucagucagucaguagaaccu

SEQ ID NO: 613749 - RNA, 64 nt, hsa
cucuuccuggcccaccuccucuuccucguggggauugaucgaacugaacccaagguacugacag

SEQ ID NO: 613750 - RNA, 64 nt, hsa
ugcaagugaccacaaugugaaagaauuuaagucuuugaucgaaggaaaauagaucuaugagacu

SEQ ID NO: 613751 - RNA, 63 nt, hsa
ugcauccuuagccuuggcaaaauaaacuucuccauugaucgaggccugggucggguacuuuuu

SEQ ID NO: 613752 - RNA, 64 nt, hsa
gugugaauaaaugcuugcagcucuuagcucuuuuuugaucgaugaagcacuuuuuuauuaauau

SEQ ID NO: 613753 - RNA, 64 nt, hsa
ucccucacaaugcuuuuaaaguccuuuuuuuuuuuugaucgauugaaaucuuuugccaacuaag

SEQ ID NO: 613754 - RNA, 64 nt, hsa
auacagguuuucugacauuaacuuaugugaugacuugaucgaggcaggcuuuuccagcaucacu

SEQ ID NO: 613755 - RNA, 64 nt, hsa
cugggucguugcaauuuugcaucuaggaguuaguuugaucgaguuauucucuuuuuucaaguca

SEQ ID NO: 613756 - RNA, 60 nt, hsa
cuggaaaagaaccagaaggaggcugggcagaaccagaacaaccugcacuucugccaaggc

SEQ ID NO: 613757 - RNA, 60 nt, hsa
gagccuggaaaagaaccaggccuggaaaagaaccagaaggaggcugggcagaaccagaac

SEQ ID NO: 613758 - RNA, 60 nt, hsa
auaguguuguauauuguaaauuguaauuucaaccagaaguaaauuuuuuucuuuugaagg

SEQ ID NO: 613759 - RNA, 60 nt, hsa
cucacuggcccacuggcaaauccaaccagcaaccagaaauguucuaguguagagucugag

SEQ ID NO: 613760 - RNA, 60 nt, hsa
auuuaggauaauuucaucacuuuuaauucaaaccagaauaugugaauaagcagacagaaa

SEQ ID NO: 613761 - RNA, 60 nt, hsa
guggggguuacccaaauagguucacagaagaaccagaaauaaaaccugccuuucuagacu

SEQ ID NO: 613762 - RNA, 60 nt, hsa
cagguggugggaauaauuuacaaucuguccaaccagaaaagaauguguguguuugagcag

SEQ ID NO: 613763 - RNA, 60 nt, hsa
cagggcacugagacacccguccguguuccuaaccagaaauccuaaagaagaggaauuaua

SEQ ID NO: 613764 - RNA, 60 nt, hsa
gucagcagagauuucaguuucccagggcuuaaccagaaccgccaccucaaugcauuguca

SEQ ID NO: 613765 - RNA, 60 nt, hsa
guuggcagagauuucaguuucccagggcuuaaccagaaccgccaccucaaugcauuguca

SEQ ID NO: 613766 - RNA, 60 nt, hsa
auucuuaauuguuaauuugaagaacacauuaaccagaaagcuuaaacauuauuauuaaaa

SEQ ID NO: 613767 - RNA, 60 nt, hsa
cacccuaaauuucccaguggcacuacccuuaaccagaauuguuuauuagaugucauaugc

SEQ ID NO: 613768 - RNA, 60 nt, hsa
caguucuugacuuuggacaauccaagagugaaccagaaugcaguuuuccuugagauaccu

SEQ ID NO: 613769 - RNA, 60 nt, hsa
aauuccccuguggccugcuggacugguuggaaccagaacaggcuaaggcauacaguucuu

SEQ ID NO: 613770 - RNA, 60 nt, hsa
cauuaguagauuuuauaagccacagagacaaaccagaaacggaauaauguuacuuuggau

SEQ ID NO: 613771 - RNA, 60 nt, hsa
acacauacuagguugaaagagaguugaggaaaccagaaggccaaguggaucugcuggcaa

SEQ ID NO: 613772 - RNA, 60 nt, hsa
cuggcugcuucacucaggaaagggaacuaaaaccagaauacacuaagaaguuucuaguuu

SEQ ID NO: 613773 - RNA, 60 nt, hsa
uaaaguucucuuucuuugagaaaacugaggaaccagaaugcuuagaguucauaaaauaau

SEQ ID NO: 613774 - RNA, 60 nt, hsa
uaauuuauugaauacuguacugaaggugaaaaccagaaugguuguauggauaugcgaagu

SEQ ID NO: 613775 - RNA, 60 nt, hsa
ucaucugaaagcugccauagaaauucugugaaccagaaugagacaaggcagcaggcauac

SEQ ID NO: 613776 - RNA, 60 nt, hsa
acagccaugaugaaacuuuuuaaaaaacuaaaccagaagagacuuuaaaauaagagaaag

SEQ ID NO: 613777 - RNA, 60 nt, hsa
ugaauacuuggagaaacuaggugaagaugcaaccagaaaggagaauauguaugcgugaag

SEQ ID NO: 613778 - RNA, 60 nt, hsa
ccggccgagcauaagaaguuuaaucaaaguaaccagaaucccauguuuguuacuaggauu

SEQ ID NO: 613779 - RNA, 60 nt, hsa
uuauugaaaaggcuacuauuuauaacuuccaaccagaacuuugcaaugugcugauuuuau

SEQ ID NO: 613780 - RNA, 60 nt, hsa
aggcaaaucuccuuuguccauuuaccuggaaaccagaaugauuuugacauacaggagagc

SEQ ID NO: 613781 - RNA, 60 nt, hsa
uuucuuuauuucugucucauaauugucaaaaaccagaauuaggucaaguucauaguuucu

SEQ ID NO: 613782 - RNA, 60 nt, hsa
uccguagcucgcucuaugaaggccuggagaaaccagaauccaagaccuccauucacaacu

SEQ ID NO: 613783 - RNA, 60 nt, hsa
cgccuccgggcccccccgcccccgucccccaaccagaacaacaacgccauagacagcggc

SEQ ID NO: 613784 - RNA, 64 nt, hsa; identical to SEQ ID NO: 326924

SEQ ID NO: 613785 - RNA, 64 nt, hsa; identical to SEQ ID NO: 326925

SEQ ID NO: 613786 - RNA, 64 nt, hsa; identical to SEQ ID NO: 326926

SEQ ID NO: 613787 - RNA, 64 nt, hsa; identical to SEQ ID NO: 326927

SEQ ID NO: 613788 - RNA, 64 nt, hsa; identical to SEQ ID NO: 326928

SEQ ID NO: 613789 - RNA, 64 nt, hsa; identical to SEQ ID NO: 326929

SEQ ID NO: 613790 - RNA, 64 nt, hsa; identical to SEQ ID NO: 326930

SEQ ID NO: 613791 - RNA, 64 nt, hsa; identical to SEQ ID NO: 326931

SEQ ID NO: 613792 - RNA, 64 nt, hsa; identical to SEQ ID NO: 326932

SEQ ID NO: 613793 - RNA, 64 nt, hsa; identical to SEQ ID NO: 326933

SEQ ID NO: 613794 - RNA, 64 nt, hsa; identical to SEQ ID NO: 326934

SEQ ID NO: 613795 - RNA, 64 nt, hsa; identical to SEQ ID NO: 326935

SEQ ID NO: 613796 - RNA, 64 nt, hsa; identical to SEQ ID NO: 326936

SEQ ID NO: 613797 - RNA, 64 nt, hsa; identical to SEQ ID NO: 326937

SEQ ID NO: 613798 - RNA, 64 nt, hsa; identical to SEQ ID NO: 326938

SEQ ID NO: 613799 - RNA, 64 nt, hsa; identical to SEQ ID NO: 326939

SEQ ID NO: 613800 - RNA, 64 nt, hsa; identical to SEQ ID NO: 326940

SEQ ID NO: 613801 - RNA, 56 nt, hsa; identical to SEQ ID NO: 326941

SEQ ID NO: 613802 - RNA, 64 nt, hsa; identical to SEQ ID NO: 326942

SEQ ID NO: 613803 - RNA, 64 nt, hsa; identical to SEQ ID NO: 326943

SEQ ID NO: 613804 - RNA, 64 nt, hsa; identical to SEQ ID NO: 326944

SEQ ID NO: 613805 - RNA, 64 nt, hsa; identical to SEQ ID NO: 326945

SEQ ID NO: 613806 - RNA, 64 nt, hsa; identical to SEQ ID NO: 326946

SEQ ID NO: 613807 - RNA, 64 nt, hsa; identical to SEQ ID NO: 326947

SEQ ID NO: 613808 - RNA, 64 nt, hsa; identical to SEQ ID NO: 326948

SEQ ID NO: 613809 - RNA, 64 nt, hsa; identical to SEQ ID NO: 326949

SEQ ID NO: 613810 - RNA, 64 nt, hsa; identical to SEQ ID NO: 326950

SEQ ID NO: 613811 - RNA, 64 nt, hsa; identical to SEQ ID NO: 326951

SEQ ID NO: 613812 - RNA, 64 nt, hsa; identical to SEQ ID NO: 326952

SEQ ID NO: 613813 - RNA, 64 nt, hsa; identical to SEQ ID NO: 326953

SEQ ID NO: 613814 - RNA, 64 nt, hsa; identical to SEQ ID NO: 326954

SEQ ID NO: 613815 - RNA, 64 nt, hsa; identical to SEQ ID NO: 326955

SEQ ID NO: 613816 - RNA, 64 nt, hsa
aaugagcauuuaaaugcaacagauaucauuucaggugacuuaacaugaaugaauaaaagucaau

SEQ ID NO: 613817 - RNA, 64 nt, hsa
uuuggugugggaguugucaugaggcuguguugaagugacuuaucuaugugggauauugaguauc

SEQ ID NO: 613818 - RNA, 64 nt, hsa
ggcuguuggcugucaucuugaacucuauuugaaugugacuuaaaucacaaguaacguguuuugu

SEQ ID NO: 613819 - RNA, 64 nt, hsa
ccauucagcuguuuuaacacagaaauucaaaauagugacuuaacauggaagcuauuucucucuu

SEQ ID NO: 613820 - RNA, 64 nt, hsa
aagccauuggauaauacugaaucuguuucccuaagugacuuaaccuuagagcaagcacaacauc

SEQ ID NO: 613821 - RNA, 64 nt, hsa
ggcugugccugugacuccagaguccuaucuuacugugacuuaaaguuugauggagagaaagcug

SEQ ID NO: 613822 - RNA, 64 nt, hsa
gcugagggucuguggaacuccagcagcucugcacuggguagagcugggccuagagcucagucac

SEQ ID NO: 613823 - RNA, 64 nt, hsa
agcucagucacaggccugggcuuccuggccugaguggguagacgcaggcggcagaggugcugga

SEQ ID NO: 613824 - RNA, 64 nt, hsa
uguacucacaaauugacuggacacccuaugaaaguggguagaccucucagcggaaaauaagaag

SEQ ID NO: 613825 - RNA, 64 nt, hsa
ccugcugaauacaugccauuucacauucugaaacuggguagagugguuggguguucugccaaca

SEQ ID NO: 613826 - RNA, 64 nt, hsa
gcugcagagcucuguugagggaacugcccagggcuggguagaggcagcaaggggacagggcugg

SEQ ID NO: 613827 - RNA, 64 nt, hsa
ggccucugggggccccuccccucgacccccagccuggguagagccaccagguacgacgaccagg

SEQ ID NO: 613828 - RNA, 64 nt, hsa
acgcuuauggauguguguaccauugagaugagaauggguagauggaacggagaccaucaagcca

SEQ ID NO: 613829 - RNA, 64 nt, hsa
aaccgugcaaaggaaacuggaaacuuuuccccgcuggguagagcauguugcugauacucuucug

SEQ ID NO: 613830 - RNA, 64 nt, hsa
acccuuguaaucccagcacuuugggaggcugagguggguagauuacuugagcccaggaauucaa

SEQ ID NO: 613831 - RNA, 64 nt, hsa
guacuaaauugaauaacgaguaaauaaucuuacuuggguagagauggccuuugccaacaaagug

SEQ ID NO: 613832 - RNA, 64 nt, hsa
acaggauuuuaaaguuagaauauauuugaaugcauggguagaaaauaucauauuuuaaaacuau

SEQ ID NO: 613833 - RNA, 64 nt, hsa
aauugagauuuugauacaccuaaggucacgcagcuggguagauauacagcugucacaagagucu

SEQ ID NO: 613834 - RNA, 64 nt, hsa
gccgugauucuaaaggaaaaugugugcucuuuaguggguagaacaaauggaaauuugguuucag

SEQ ID NO: 613835 - RNA, 64 nt, hsa
uagcuuuuaauuacauuucagagagguguaauuuuggguagaugcucauuacauuuuugaaagg

SEQ ID NO: 613836 - RNA, 64 nt, hsa
agaagagcgaaacuccgucucaaaaaaaaauaaaaaugaagaggggaaaccagaauaaauuauc

SEQ ID NO: 613837 - RNA, 63 nt, hsa
aggcugugagcuuguguuacaugguaauaaagccaaugaagagacaugucuguguaauucuga

SEQ ID NO: 613838 - RNA, 64 nt, hsa
gggacccagugugcuucaguguuaagaguggggcaaugaagagugaaccccaaugaagagugau

SEQ ID NO: 613839 - RNA, 64 nt, hsa
aguguuaagaguggggcaaugaagagugaaccccaaugaagagugaucccaacuuuggaaacua

SEQ ID NO: 613840 - RNA, 64 nt, hsa
uugguauggaguuggcagacaggauguucaacuuaaugaagaaauacagcuaaggccuugccag

SEQ ID NO: 613841 - RNA, 64 nt, hsa
uuucuggcuuuuaagccaauauaaugggcugcaaaaugaagacaccagaguguaugcauacaaa

SEQ ID NO: 613842 - RNA, 64 nt, hsa
cauuuuauuccccucaauucucaauauauucaguaaugaagaauggugccaccacucaagcaac

SEQ ID NO: 613843 - RNA, 64 nt, hsa
cgaaggaugaagacgaagaagcaagggaggaacaaaugaagaaccaucuuuguucaugaauagg

SEQ ID NO: 613844 - RNA, 64 nt, hsa
gagggaggaagaaagggagagagaagaaaagaaaaaugaagaaaaguaauuagaauauuuucaa

SEQ ID NO: 613845 - RNA, 64 nt, hsa
cuaauuaguuuauaugagaauaauucuugcaauaaaugaagaaggaauaaaagaaauaggaagc

SEQ ID NO: 613846 - RNA, 64 nt, hsa
cccuuucaagcauaaguccaaauagacucucaggaaugaagauuugugaagacaucagauagga

SEQ ID NO: 613847 - RNA, 64 nt, hsa
cacccaggaggugggagggugaauuuuauguuuaaaugaagaagugaauuauggaagaagagua

SEQ ID NO: 613848 - RNA, 64 nt, hsa
uaaauaaggauggugauagagagguugaagaagaaaugaagaagcaugaaaguaauaauguggg

SEQ ID NO: 613849 - RNA, 64 nt, hsa
uuuuccagcuagaaaauuuuauggcuaucgaagaaaugaagaagcacggaaguacucaugucgg

SEQ ID NO: 613850 - RNA, 64 nt, hsa
aacaccugaaagccagcaauuuccugacacugagaaugaagaguaucacagguaagccuauggc

SEQ ID NO: 613851 - RNA, 64 nt, hsa
auucuucuuccaugccaugucaggaguuaauacaaaugaagaaauuccguggguuccccuggga

SEQ ID NO: 613852 - RNA, 64 nt, hsa
guccucccugcugauuuguuucuaaaucaaaagaaaugaagaaaaaaguacugugaccugagag

SEQ ID NO: 613853 - RNA, 55 nt, hsa
gcguagacuacauuuugugaggaucaaugaagacuaaauauaaaaaacauuuucu

SEQ ID NO: 613854 - RNA, 64 nt, hsa
gauucugaaucaaggugauugugauuauagugacaaugaagaugaugcuauuaauacugcauaa

SEQ ID NO: 613855 - RNA, 64 nt, hsa
uggguaacuuuuauccacauauuacuaauugaaaaaugaagacaaguucuuuguaacuagggac

SEQ ID NO: 613856 - RNA, 64 nt, hsa
acucaccccugcagugcaugggacagccuggcacaaugaagaauuagcccucccaaaauguaga

SEQ ID NO: 613857 - RNA, 64 nt, hsa
uaaacucauucagaucauucaguuggauuuucccaaugaagaggaaaaggaaaguaguuauucc

SEQ ID NO: 613858 - RNA, 64 nt, hsa
gacuaauaagaaaguuggcauaaacuuucaaucaaaugaagaguuugccuagaggagacuaauu

SEQ ID NO: 613859 - RNA, 64 nt, hsa
ccccccacccugccccaugaaacuugagcauucaaaugaagauucagcagugucuguucuucau

SEQ ID NO: 613860 - RNA, 64 nt, hsa
aguugagguuguuaaaacagaaaagguucugaauaaugaagauuaaccuaaugcagaauugcua

SEQ ID NO: 613861 - RNA, 64 nt, hsa
ggcaguugcugucugcaguuuacaauguauuguaaaugaagauuuuuuaaauucuaucuugcug

SEQ ID NO: 613862 - RNA, 64 nt, hsa
ccucucauaccaaaggaugacuguauauuucuuaaaugaagagacuuucauucuuuaaauauua

SEQ ID NO: 613863 - RNA, 64 nt, hsa
gguccgagagggaagcuggcugggcuggcugaagaaugaagaccacuggacucuccguuaaucu

SEQ ID NO: 613864 - RNA, 64 nt, hsa
aauaugagauuucuacuucggagaggccaagucuaaugaagagaaaaaaaggaaaagaaguugc

SEQ ID NO: 613865 - RNA, 64 nt, hsa
gcaguugcccuggccaacgugacucagcgccucaaaugaagagacugguguggggaggagagag

SEQ ID NO: 613866 - RNA, 64 nt, hsa
cuuggcugugguaaugcucuacugggcccuucagaaugaagacagucugccuuagagccugcua

SEQ ID NO: 613867 - RNA, 64 nt, hsa
auauaaaaucuaguccaguucucucauuuaaaaaaaugaagacacugaaauacagacuuaaaua

SEQ ID NO: 613868 - RNA, 64 nt, hsa
auuauugggcuuauucucugcucuauaguugugaaaugaagaguaaaaacaaauuuguuugacu

SEQ ID NO: 613869 - RNA, 64 nt, hsa
ugacaaccuccuaugugcaugucuaaauagucacaaugaagaugaaaauaaggaugauggggac

SEQ ID NO: 613870 - RNA, 64 nt, hsa
cagugacaggugcugccuguuuacucguaccaaaaaugaagacaagccccacacccaccucagc

SEQ ID NO: 613871 - RNA, 64 nt, hsa
cagagcauucauaccaaagagaacucaugaauguaaugaagaugggaagauauuuaucaaauuc

SEQ ID NO: 613872 - RNA, 64 nt, hsa
auucacaccagagagaaacccucugaaugugacgaaugaagaaaagguauuaguguuaaacucu

SEQ ID NO: 613873 - RNA, 64 nt, hsa
uguauaaacguuuucagggaaugcagaagguauuaaugaagagacaaaaccuuuauuccaugug

SEQ ID NO: 613874 - RNA, 64 nt, hsa
ccacacucuaguuguuuuccaugaaagguauacaaaugaagaauuuucuagcaaaacauguuuu

SEQ ID NO: 613875 - RNA, 64 nt, hsa
gauaagcaaaagaggauguucaccauaacccaggaaugaagauaccaucagcaaagaauuucaa

SEQ ID NO: 613876 - RNA, 64 nt, hsa
uuuuagaacagaaaacaacaaaaaauaaccccaaaaugaagauuauuuuuuaugaggagugaac

SEQ ID NO: 613877 - RNA, 64 nt, hsa
aguaguauuuuguauauuuuuguaacaaaauauaaaugaagauauuuuaccaugaagagauugc

SEQ ID NO: 613878 - RNA, 64 nt, hsa
gauugcacuuauccuugagaacagucuaaauauaaaugaagauauuuuaccaugaagagauugc

SEQ ID NO: 613879 - RNA, 64 nt, hsa
ugcagaaaaaaaugaggccgaaaauuuagaggaaaaugaagagcccuucguugcccccuuagga

SEQ ID NO: 613880 - RNA, 64 nt, hsa
gauuuugauuucagaaucaggagucagcucugacaaugaagaugaugaugaugaagaagauggg

SEQ ID NO: 613881 - RNA, 64 nt, hsa
gacauacuggcauggagagugagaacgacaaaggaaugaagagcuacaggagcauuuaggccau

SEQ ID NO: 613882 - RNA, 64 nt, hsa
cauuuuguauacagagaaccggaugaauauaagcaaugaagaugaacauuuauugaucuucuac

SEQ ID NO: 613883 - RNA, 64 nt, hsa
uuuagaaauuauuuuccuucaaguguucaagucuaaugaagaaugaagauaacauuuuaucacu

SEQ ID NO: 613884 - RNA, 64 nt, hsa
auuauuuuccuucaaguguucaagucuaaugaagaaugaagauaacauuuuaucacuucugucc

SEQ ID NO: 613885 - RNA, 64 nt, hsa
auaguccugagugcaaguaauuacuauacuuguaaaugaagaucaguauuucugccuagaucug

SEQ ID NO: 613886 - RNA, 64 nt, hsa
aagagacugaaauaaauuguauaguuacuuaacuaaugaagacauuucagaacucugggaugau

SEQ ID NO: 613887 - RNA, 64 nt, hsa
uaucacuaugugaagaaaguuuuggaaaagaaacaaugaagacugaauuaaauuaaaaauguug

SEQ ID NO: 613888 - RNA, 64 nt, hsa
aaaaauuuuacagaaauugcaucgauguaaucagaaugaagaccgcaugccaucccaagauuau

SEQ ID NO: 613889 - RNA, 64 nt, hsa
gccaaucacgguuaaacacaaaguguuuuuauagaaugaagaaacagucuuuaacagaaaaaag

SEQ ID NO: 613890 - RNA, 64 nt, hsa
uuuuacuguauaguaauucuggaaagagcaaauaaaugaagauuguuuuuauuugccugauaaa

SEQ ID NO: 613891 - RNA, 64 nt, hsa
uagauggaagcaaaauuaaguugucuuuguagaaaaugaagagccuuucuuccagcaaaaaucc

SEQ ID NO: 613892 - RNA, 64 nt, hsa
agauugucugugauuggacagacuaugaugagcgaaugaagaaguuggucaguauuguggcuga

SEQ ID NO: 613893 - RNA, 64 nt, hsa; identical to SEQ ID NO: 72506

SEQ ID NO: 613894 - RNA, 64 nt, hsa; identical to SEQ ID NO: 72507

SEQ ID NO: 613895 - RNA, 64 nt, hsa; identical to SEQ ID NO: 72508

SEQ ID NO: 613896 - RNA, 64 nt, hsa; identical to SEQ ID NO: 72509

SEQ ID NO: 613897 - RNA, 64 nt, hsa; identical to SEQ ID NO: 72510

SEQ ID NO: 613898 - RNA, 64 nt, hsa; identical to SEQ ID NO: 72511

SEQ ID NO: 613899 - RNA, 64 nt, hsa; identical to SEQ ID NO: 72512

SEQ ID NO: 613900 - RNA, 64 nt, hsa; identical to SEQ ID NO: 72513

SEQ ID NO: 613901 - RNA, 64 nt, hsa; identical to SEQ ID NO: 72514

SEQ ID NO: 613902 - RNA, 64 nt, hsa; identical to SEQ ID NO: 72515

SEQ ID NO: 613903 - RNA, 64 nt, hsa; identical to SEQ ID NO: 72516

SEQ ID NO: 613904 - RNA, 64 nt, hsa; identical to SEQ ID NO: 72517

SEQ ID NO: 613905 - RNA, 64 nt, hsa; identical to SEQ ID NO: 72518

SEQ ID NO: 613906 - RNA, 64 nt, hsa; identical to SEQ ID NO: 72519

SEQ ID NO: 613907 - RNA, 64 nt, hsa; identical to SEQ ID NO: 72520

SEQ ID NO: 613908 - RNA, 64 nt, hsa; identical to SEQ ID NO: 72521

SEQ ID NO: 613909 - RNA, 64 nt, hsa; identical to SEQ ID NO: 72522

SEQ ID NO: 613910 - RNA, 64 nt, hsa; identical to SEQ ID NO: 72523

SEQ ID NO: 613911 - RNA, 64 nt, hsa; identical to SEQ ID NO: 72524

SEQ ID NO: 613912 - RNA, 64 nt, hsa; identical to SEQ ID NO: 72525

SEQ ID NO: 613913 - RNA, 64 nt, hsa; identical to SEQ ID NO: 72526

SEQ ID NO: 613914 - RNA, 64 nt, hsa; identical to SEQ ID NO: 72527

SEQ ID NO: 613915 - RNA, 64 nt, hsa; identical to SEQ ID NO: 72528

SEQ ID NO: 613916 - RNA, 64 nt, hsa; identical to SEQ ID NO: 72529

SEQ ID NO: 613917 - RNA, 64 nt, hsa; identical to SEQ ID NO: 72530

SEQ ID NO: 613918 - RNA, 64 nt, hsa; identical to SEQ ID NO: 72531

SEQ ID NO: 613919 - RNA, 64 nt, hsa; identical to SEQ ID NO: 72532

SEQ ID NO: 613920 - RNA, 64 nt, hsa; identical to SEQ ID NO: 72533

SEQ ID NO: 613921 - RNA, 64 nt, hsa; identical to SEQ ID NO: 72534

SEQ ID NO: 613922 - RNA, 64 nt, hsa; identical to SEQ ID NO: 72535

SEQ ID NO: 613923 - RNA, 64 nt, hsa; identical to SEQ ID NO: 72536

SEQ ID NO: 613924 - RNA, 64 nt, hsa; identical to SEQ ID NO: 72537

SEQ ID NO: 613925 - RNA, 64 nt, hsa; identical to SEQ ID NO: 72538

SEQ ID NO: 613926 - RNA, 64 nt, hsa; identical to SEQ ID NO: 72539

SEQ ID NO: 613927 - RNA, 64 nt, hsa; identical to SEQ ID NO: 72540

SEQ ID NO: 613928 - RNA, 64 nt, hsa; identical to SEQ ID NO: 72541

SEQ ID NO: 613929 - RNA, 64 nt, hsa; identical to SEQ ID NO: 72542

SEQ ID NO: 613930 - RNA, 64 nt, hsa; identical to SEQ ID NO: 72543

SEQ ID NO: 613931 - RNA, 64 nt, hsa; identical to SEQ ID NO: 72544

SEQ ID NO: 613932 - RNA, 64 nt, hsa; identical to SEQ ID NO: 72545

SEQ ID NO: 613933 - RNA, 64 nt, hsa; identical to SEQ ID NO: 72546

SEQ ID NO: 613934 - RNA, 64 nt, hsa; identical to SEQ ID NO: 72547

SEQ ID NO: 613935 - RNA, 64 nt, hsa; identical to SEQ ID NO: 72548

SEQ ID NO: 613936 - RNA, 64 nt, hsa; identical to SEQ ID NO: 72549

SEQ ID NO: 613937 - RNA, 64 nt, hsa; identical to SEQ ID NO: 72550

SEQ ID NO: 613938 - RNA, 64 nt, hsa; identical to SEQ ID NO: 72551

SEQ ID NO: 613939 - RNA, 64 nt, hsa; identical to SEQ ID NO: 72552

SEQ ID NO: 613940 - RNA, 64 nt, hsa; identical to SEQ ID NO: 72553

SEQ ID NO: 613941 - RNA, 64 nt, hsa; identical to SEQ ID NO: 72554

SEQ ID NO: 613942 - RNA, 64 nt, hsa; identical to SEQ ID NO: 72555

SEQ ID NO: 613943 - RNA, 64 nt, hsa; identical to SEQ ID NO: 72556

SEQ ID NO: 613944 - RNA, 64 nt, hsa; identical to SEQ ID NO: 72557

SEQ ID NO: 613945 - RNA, 64 nt, hsa; identical to SEQ ID NO: 72558

SEQ ID NO: 613946 - RNA, 64 nt, hsa; identical to SEQ ID NO: 72559

SEQ ID NO: 613947 - RNA, 64 nt, hsa; identical to SEQ ID NO: 72560

SEQ ID NO: 613948 - RNA, 64 nt, hsa; identical to SEQ ID NO: 72561

SEQ ID NO: 613949 - RNA, 64 nt, hsa; identical to SEQ ID NO: 72562

SEQ ID NO: 613950 - RNA, 64 nt, hsa; identical to SEQ ID NO: 72563

SEQ ID NO: 613951 - RNA, 64 nt, hsa; identical to SEQ ID NO: 72564

SEQ ID NO: 613952 - RNA, 64 nt, hsa; identical to SEQ ID NO: 72565

SEQ ID NO: 613953 - RNA, 64 nt, hsa; identical to SEQ ID NO: 72566

SEQ ID NO: 613954 - RNA, 64 nt, hsa; identical to SEQ ID NO: 72567

SEQ ID NO: 613955 - RNA, 64 nt, hsa; identical to SEQ ID NO: 72568

SEQ ID NO: 613956 - RNA, 64 nt, hsa; identical to SEQ ID NO: 72569

SEQ ID NO: 613957 - RNA, 64 nt, hsa; identical to SEQ ID NO: 72570

SEQ ID NO: 613958 - RNA, 64 nt, hsa; identical to SEQ ID NO: 72571

SEQ ID NO: 613959 - RNA, 64 nt, hsa; identical to SEQ ID NO: 72572

SEQ ID NO: 613960 - RNA, 64 nt, hsa; identical to SEQ ID NO: 72573

SEQ ID NO: 613961 - RNA, 64 nt, hsa; identical to SEQ ID NO: 72574

SEQ ID NO: 613962 - RNA, 64 nt, hsa; identical to SEQ ID NO: 72575

SEQ ID NO: 613963 - RNA, 64 nt, hsa; identical to SEQ ID NO: 72576

SEQ ID NO: 613964 - RNA, 64 nt, hsa; identical to SEQ ID NO: 72577

SEQ ID NO: 613965 - RNA, 64 nt, hsa; identical to SEQ ID NO: 72578

SEQ ID NO: 613966 - RNA, 64 nt, hsa; identical to SEQ ID NO: 72579

SEQ ID NO: 613967 - RNA, 64 nt, hsa; identical to SEQ ID NO: 72580

SEQ ID NO: 613968 - RNA, 64 nt, hsa; identical to SEQ ID NO: 72581

SEQ ID NO: 613969 - RNA, 64 nt, hsa; identical to SEQ ID NO: 72582

SEQ ID NO: 613970 - RNA, 64 nt, hsa; identical to SEQ ID NO: 72583

SEQ ID NO: 613971 - RNA, 64 nt, hsa; identical to SEQ ID NO: 72584

SEQ ID NO: 613972 - RNA, 64 nt, hsa; identical to SEQ ID NO: 72585

SEQ ID NO: 613973 - RNA, 64 nt, hsa; identical to SEQ ID NO: 72586

SEQ ID NO: 613974 - RNA, 64 nt, hsa; identical to SEQ ID NO: 72587

SEQ ID NO: 613975 - RNA, 64 nt, hsa; identical to SEQ ID NO: 72588

SEQ ID NO: 613976 - RNA, 64 nt, hsa; identical to SEQ ID NO: 72589

SEQ ID NO: 613977 - RNA, 64 nt, hsa; identical to SEQ ID NO: 72590

SEQ ID NO: 613978 - RNA, 64 nt, hsa; identical to SEQ ID NO: 72591

SEQ ID NO: 613979 - RNA, 64 nt, hsa; identical to SEQ ID NO: 72592

SEQ ID NO: 613980 - RNA, 64 nt, hsa; identical to SEQ ID NO: 72593

SEQ ID NO: 613981 - RNA, 64 nt, hsa; identical to SEQ ID NO: 72594

SEQ ID NO: 613982 - RNA, 64 nt, hsa; identical to SEQ ID NO: 72595

SEQ ID NO: 613983 - RNA, 64 nt, hsa; identical to SEQ ID NO: 72596

SEQ ID NO: 613984 - RNA, 64 nt, hsa; identical to SEQ ID NO: 72597

SEQ ID NO: 613985 - RNA, 64 nt, hsa; identical to SEQ ID NO: 72598

SEQ ID NO: 613986 - RNA, 64 nt, hsa; identical to SEQ ID NO: 72599

SEQ ID NO: 613987 - RNA, 64 nt, hsa; identical to SEQ ID NO: 72600

SEQ ID NO: 613988 - RNA, 64 nt, hsa; identical to SEQ ID NO: 72601

SEQ ID NO: 613989 - RNA, 64 nt, hsa
cagauuacacaaauguaagugauaagaauaagauuagacagauuuugcuuucacaguagagucu

SEQ ID NO: 613990 - RNA, 64 nt, hsa
aacauuuuaccccuacucccaaagguagcuuaaauagacagauuacacaaauguaagugauaag

SEQ ID NO: 613991 - RNA, 64 nt, hsa
uuauggaguuaugggucuagacguguuaauaaguuagacagaacuuuggcacuuuagaacaaau

SEQ ID NO: 613992 - RNA, 64 nt, hsa
uaauuaccauuuguugaacacauuaaugcuauacuagacagauacaguggagauagcuuucaaa

SEQ ID NO: 613993 - RNA, 64 nt, hsa
ucugaaaaaacaucaagcauaguaauugucuggguagacagauuucagaauuuuuaaaaugcuu

SEQ ID NO: 613994 - RNA, 64 nt, hsa
auuuuuagaagaacuguuguaaagccuuugagauuagacagacuagagcuacauuacugaaauu

SEQ ID NO: 613995 - RNA, 64 nt, hsa
ggaccaggcagcccccauggcaguaaaagcagccuagacagaaccugcagcucuguggaaagag

SEQ ID NO: 613996 - RNA, 64 nt, hsa
gcagugggccuguguggguuaugauucuagauccuagacagaggcugggucagcuguggauggg

SEQ ID NO: 613997 - RNA, 64 nt, hsa; identical to SEQ ID NO: 193920

SEQ ID NO: 613998 - RNA, 64 nt, hsa; identical to SEQ ID NO: 193921

SEQ ID NO: 613999 - RNA, 64 nt, hsa; identical to SEQ ID NO: 193922

SEQ ID NO: 614000 - RNA, 64 nt, hsa; identical to SEQ ID NO: 193923

SEQ ID NO: 614001 - RNA, 64 nt, hsa; identical to SEQ ID NO: 193924

SEQ ID NO: 614002 - RNA, 64 nt, hsa; identical to SEQ ID NO: 193925

SEQ ID NO: 614003 - RNA, 64 nt, hsa; identical to SEQ ID NO: 193926

SEQ ID NO: 614004 - RNA, 64 nt, hsa; identical to SEQ ID NO: 193927

SEQ ID NO: 614005 - RNA, 64 nt, hsa; identical to SEQ ID NO: 193928

SEQ ID NO: 614006 - RNA, 64 nt, hsa; identical to SEQ ID NO: 193929

SEQ ID NO: 614007 - RNA, 64 nt, hsa; identical to SEQ ID NO: 193930

SEQ ID NO: 614008 - RNA, 64 nt, hsa; identical to SEQ ID NO: 193931

SEQ ID NO: 614009 - RNA, 64 nt, hsa; identical to SEQ ID NO: 193932

SEQ ID NO: 614010 - RNA, 64 nt, hsa; identical to SEQ ID NO: 193933

SEQ ID NO: 614011 - RNA, 64 nt, hsa; identical to SEQ ID NO: 193934

SEQ ID NO: 614012 - RNA, 64 nt, hsa; identical to SEQ ID NO: 193935

SEQ ID NO: 614013 - RNA, 64 nt, hsa; identical to SEQ ID NO: 193936

SEQ ID NO: 614014 - RNA, 64 nt, hsa; identical to SEQ ID NO: 193937

SEQ ID NO: 614015 - RNA, 64 nt, hsa; identical to SEQ ID NO: 193938

SEQ ID NO: 614016 - RNA, 64 nt, hsa; identical to SEQ ID NO: 193939

SEQ ID NO: 614017 - RNA, 64 nt, hsa; identical to SEQ ID NO: 193940

SEQ ID NO: 614018 - RNA, 64 nt, hsa; identical to SEQ ID NO: 193941

SEQ ID NO: 614019 - RNA, 64 nt, hsa; identical to SEQ ID NO: 193942

SEQ ID NO: 614020 - RNA, 64 nt, hsa; identical to SEQ ID NO: 193943

SEQ ID NO: 614021 - RNA, 64 nt, hsa; identical to SEQ ID NO: 193944

SEQ ID NO: 614022 - RNA, 64 nt, hsa; identical to SEQ ID NO: 193945

SEQ ID NO: 614023 - RNA, 64 nt, hsa; identical to SEQ ID NO: 193946

SEQ ID NO: 614024 - RNA, 64 nt, hsa; identical to SEQ ID NO: 193947

SEQ ID NO: 614025 - RNA, 64 nt, hsa; identical to SEQ ID NO: 193948

SEQ ID NO: 614026 - RNA, 64 nt, hsa; identical to SEQ ID NO: 193949

SEQ ID NO: 614027 - RNA, 64 nt, hsa; identical to SEQ ID NO: 193950

SEQ ID NO: 614028 - RNA, 64 nt, hsa; identical to SEQ ID NO: 193951

SEQ ID NO: 614029 - RNA, 64 nt, hsa; identical to SEQ ID NO: 193952

SEQ ID NO: 614030 - RNA, 64 nt, hsa; identical to SEQ ID NO: 193953

SEQ ID NO: 614031 - RNA, 64 nt, hsa; identical to SEQ ID NO: 193954

SEQ ID NO: 614032 - RNA, 64 nt, hsa; identical to SEQ ID NO: 193955

SEQ ID NO: 614033 - RNA, 64 nt, hsa; identical to SEQ ID NO: 193956

SEQ ID NO: 614034 - RNA, 64 nt, hsa; identical to SEQ ID NO: 193957

SEQ ID NO: 614035 - RNA, 64 nt, hsa; identical to SEQ ID NO: 193958

SEQ ID NO: 614036 - RNA, 64 nt, hsa; identical to SEQ ID NO: 193959

SEQ ID NO: 614037 - RNA, 64 nt, hsa; identical to SEQ ID NO: 193960

SEQ ID NO: 614038 - RNA, 54 nt, hsa; identical to SEQ ID NO: 193961

SEQ ID NO: 614039 - RNA, 64 nt, hsa; identical to SEQ ID NO: 193962

SEQ ID NO: 614040 - RNA, 64 nt, hsa; identical to SEQ ID NO: 193963

SEQ ID NO: 614041 - RNA, 64 nt, hsa; identical to SEQ ID NO: 193964

SEQ ID NO: 614042 - RNA, 64 nt, hsa; identical to SEQ ID NO: 193965

SEQ ID NO: 614043 - RNA, 64 nt, hsa
uguccaaacuuuuccauuuuagauuccuuuauagacacgucagccuaaaaaucagccuauucgg

SEQ ID NO: 614044 - RNA, 64 nt, hsa
aaaaaucucauguguucaaauuaacauaaauauuacacgucaauacacuguacauggugguaau

SEQ ID NO: 614045 - RNA, 64 nt, hsa
agaaaccuuaaaggauuugaauauuucaaauugcacacgucacuccagcaucucuguaaaauaa

SEQ ID NO: 614046 - RNA, 64 nt, hsa
uccgucggaagcauuuggcacacacaccuucaauacacgucaaggucgcuuccaguuuuagaaa

SEQ ID NO: 614047 - RNA, 64 nt, hsa
uaugcgauuuaaaacaaacuggaaaggaaacuucacacgucaaaauccauagaagcgccuggac

SEQ ID NO: 614048 - RNA, 64 nt, hsa
uccaacaaauuuuaaacgaauccaaaguguucucacacgucacauacgauugagcaucuccauc

SEQ ID NO: 614049 - RNA, 64 nt, hsa
ugcugcuuggugccucucugauacgaauacacugacacgucaaaguaaccuaauguggacacca

SEQ ID NO: 614050 - RNA, 64 nt, hsa
ccuggaucugucacuaacuugcugcgugaccugaacacgucacuuuaccucucugugccucagu

SEQ ID NO: 614051 - RNA, 64 nt, hsa
gagaaugaagauuggaaaaaggaaaaaaaaaaaaacacgucaaaaguuagcagugaaauuguuc

SEQ ID NO: 614052 - RNA, 64 nt, hsa
acucuuccacaccugccuauacucacuaauguuaacacgucauuuccuuuuuguauuuuuaaac

SEQ ID NO: 614053 - RNA, 64 nt, hsa
uacuugaaaacauuuggauugguaggauuuuguaacacgucaaccauuugaugcuucugaaaag

SEQ ID NO: 614054 - RNA, 64 nt, hsa
ugcuguuaccuuugugaccugauuguuuuuuggaacacgucaagacgugggaucagaaucuucc

SEQ ID NO: 614055 - RNA, 64 nt, hsa
cgguacccaggguugcuucaaguauuuguucaugacacgucaacucgaugauuaaaauccuuca

SEQ ID NO: 614056 - RNA, 64 nt, hsa
cuuauucauacuagcaugcucaugaccaacacauacacgucauagaagaaaauaguggugcuuc

SEQ ID NO: 614057 - RNA, 64 nt, hsa
aaguguggauuccuacuuccugcucuaagcuuugacacgucaaaaugugggaucagaaagaaaa

SEQ ID NO: 614058 - RNA, 64 nt, hsa
guuaguuacuaguuauuacagcuguaaggauaaaacacgucauguggauucauuuugaauuggu

SEQ ID NO: 614059 - RNA, 64 nt, hsa
caugccucacugacagaccagcauuuuuuuuuuaacacgucaauaaaaaaauaaucucccagaa

SEQ ID NO: 614060 - RNA, 64 nt, hsa
uccuucucucucuccccccaccacccacccccacacacgucaucugcauuguuauuggagccug

SEQ ID NO: 614061 - RNA, 64 nt, hsa
aggcacacuccaggaagacugccacgucgcgccaacacgucauacucaaugccucagacuuuca

SEQ ID NO: 614062 - RNA, 64 nt, hsa
ggcacuucagcacauguggguacugccacuacacacacgucauuuuauaugaccuuaaggacaa

SEQ ID NO: 614063 - RNA, 64 nt, hsa
aguugcauagauuucucauuguuuggguuggaauacacgucauuguuuauuuuuguuccuuugu

SEQ ID NO: 614064 - RNA, 56 nt, hsa
gaccacaaguguauuuuuagucaucuacacgucaaauaucccaagacagauuaugc

SEQ ID NO: 614065 - RNA, 64 nt, hsa
cucaagggcguaacucuggaagcacagcuugacuacacgucauuuuuaccaaugauuuucaggu

SEQ ID NO: 614066 - RNA, 64 nt, hsa
ugagugguuccacugccuggauaacccuugaggaacacgucaguuacugucacgauggggcagg

SEQ ID NO: 614067 - RNA, 64 nt, hsa
aguugaaugggcacagcaacucuaagacuacagcacacgucauuucuuagcuaagcggaccagc

SEQ ID NO: 614068 - RNA, 64 nt, hsa
uggccaaaaccuggccgucucuucuauucacaguacacgucacaguauugaugugauucaaaau

SEQ ID NO: 614069 - RNA, 64 nt, hsa
ggcauguguccucugcagggcgcugcguuuuuauacacgucaaagcuguuaagaaugugcccua

SEQ ID NO: 614070 - RNA, 64 nt, hsa
agucacaggaugagacaggaggucagcacaagauacacgucacaaagaccuugcugauaaaaca

SEQ ID NO: 614071 - RNA, 64 nt, hsa
guaauggccucguaaguacaggugaugguuuuggacacgucaggaauuccuaaaggcugaaaga

SEQ ID NO: 614072 - RNA, 64 nt, hsa
ggaugagcaugcuucauuggauucauuuuauuuuacacgucaguauuguuuuaaaguuucuguc

SEQ ID NO: 614073 - RNA, 64 nt, hsa
agauuucaaacagugauagacuugccauuuuaauacacgucauuggagggcugcguauuuguaa

SEQ ID NO: 614074 - RNA, 64 nt, hsa
acacuuccaccagccugcacuacucccucaaagcacacgucauguuucuucauccggcagccug

SEQ ID NO: 614075 - RNA, 64 nt, hsa
gaggauggucuccacccaucuuucuauuuccaguacacgucacauuauuuuaccggugagauga

SEQ ID NO: 614076 - RNA, 64 nt, hsa
gaaguugcucgcuucuguguugacuuagaucaagacacgucacgcauccuuucugggguaguac

SEQ ID NO: 614077 - RNA, 64 nt, hsa
gaagagcauugccaucacuggcccuccuaggcucacacgucaauuccagggcagcuacacgugg

SEQ ID NO: 614078 - RNA, 64 nt, hsa
ggccugggcaggggcccgcuuggcgggccgggcaacacgucaacauucuuuucuguucuuggca

SEQ ID NO: 614079 - RNA, 64 nt, hsa
agcuggagcaaccaaaacugcuucugguuuaggcacacgucacgggugcgggagacccgggcac

SEQ ID NO: 614080 - RNA, 64 nt, hsa
cgugagagcccaaucacugccuauaccccucaucacacgucacaaugucccgaauucccagccu

SEQ ID NO: 614081 - RNA, 64 nt, hsa
ugaagggguaugucaggcggggaaggggccaaggacacgucauuguacccugagcguccccagg

SEQ ID NO: 614082 - RNA, 64 nt, hsa
gggcacccgcucucccucccucccugcuggaggaacacgucauaucagaugagaggaagauggc

SEQ ID NO: 614083 - RNA, 64 nt, hsa
cgcucaauggcccggaggggcagcaaccccccgcacacgucagccaacagcagugccucugcag

SEQ ID NO: 614084 - RNA, 64 nt, hsa
uucuacuguuaugugagaacauuaggccccagcaacacgucauuguguaaggaaaaauaaaagu

SEQ ID NO: 614085 - RNA, 64 nt, hsa
uucuuggacaucuugacccagcgaguggucuccuacacgucaccugcaacacucgcuccucuuc

SEQ ID NO: 614086 - RNA, 64 nt, hsa
aagaaaaugaguuacacugagaaugaauaugggaacacgucauugauagcaaaagaaagguaca

SEQ ID NO: 614087 - RNA, 64 nt, hsa
aaagccauaaaugacugugagauguaugagaaugacacgucacauuaguaagaagagaaaaauu

SEQ ID NO: 614088 - RNA, 64 nt, hsa
gugaugauuguggcaaagccuuugcuucacguucacacgucauuagacaucagagaaucuauac

SEQ ID NO: 614089 - RNA, 64 nt, hsa
ugugaaaccaaacugcagccucaacaccauggacacacgucaucaggaccuccugagguucgug

SEQ ID NO: 614090 - RNA, 64 nt, hsa
agggcuuaguuaguaccuugccacucuacccccaacacgucacccgaguagaagcugggcaagg

SEQ ID NO: 614091 - RNA, 64 nt, hsa
gccaaguucaccaucacggagugcuucauaucagacacgucaucggagcaguugacggcaggga

SEQ ID NO: 614092 - RNA, 64 nt, hsa
cacacugugaaagugaaaagagaaugugugcaaaacacgucacaguccugguuucugaguaaag

SEQ ID NO: 614093 - RNA, 64 nt, hsa
ccaucccucuccaccccuuccccccaaaagguuuucuuugcaagugcuuuuggaacuaagagcu

SEQ ID NO: 614094 - RNA, 64 nt, hsa
gccagucccugaacauaucauugaaaguuaauuuucuuugcauuuuaaaauaucuggauuauga

SEQ ID NO: 614095 - RNA, 64 nt, hsa
uauggaaacuugauauuaaaaacuagucugugguucuuugcaguuucuuguaaauuuauaaacc

SEQ ID NO: 614096 - RNA, 64 nt, hsa
cugggcagguuuccugugucaguauucccccuccucuuugcauuaaucaagguauuugguagag

SEQ ID NO: 614097 - RNA, 64 nt, hsa
aaauucuuuggcuaguuauuaauucuuuuacgugucuuugcauuugagaggcacuguuaaaaau

SEQ ID NO: 614098 - RNA, 64 nt, hsa
cagcucuucauguuacacuaaugacaguuuguucucuuugcaagagaggggcauuacugucacc

SEQ ID NO: 614099 - RNA, 64 nt, hsa
agcagagagauugaacuuugaggaggaagcagaaucuuugcaagaaagucagaccuguuucuug

SEQ ID NO: 614100 - RNA, 64 nt, hsa
ccuguacaagcugauguuuuguauuuuguguuccucuuugcaugaucugucaaagugagauauu

SEQ ID NO: 614101 - RNA, 64 nt, hsa
gacuagaugaaagguguccaugguuagaauuugaucuuugcaaacuguauauaauuguuauuuu

SEQ ID NO: 614102 - RNA, 64 nt, hsa
aaaaaaaaaaaagaaaaucucauuagugaacuuaucuuugcagcugaguacuuaaauucuuuuu

SEQ ID NO: 614103 - RNA, 64 nt, hsa
uaaaagaacugacuuuugauaguuuuaaaauuaaucuuugcaugaagguugguuucgcuuuuuu

SEQ ID NO: 614104 - RNA, 64 nt, hsa
uugagugcuaugcaaauaacauaguaguaauuucucuuugcaugccauguguaauauaccuagc

SEQ ID NO: 614105 - RNA, 64 nt, hsa
gguagguaacaucuuacauucuguuuucuuccagucuuugcaguauucacuagagguucccuuu

SEQ ID NO: 614106 - RNA, 64 nt, hsa
ccugucccgugggcuguguuucuuguuguuuuucucuuugcaaagacauagcuaggaaagcgaa

SEQ ID NO: 614107 - RNA, 64 nt, hsa
uauggugacguccuuuugcugugaauaaaggugcucuuugcagcaauccuggggguccuggucu

SEQ ID NO: 614108 - RNA, 64 nt, hsa
cuggcuuuugccuggagcacuauuuguuuaguucucuuugcaggacaagaauucucucagggug

SEQ ID NO: 614109 - RNA, 64 nt, hsa
auuaggcacaaagggauucccauaucccuccucuucuuugcauauuucccccucuaauuagcau

SEQ ID NO: 614110 - RNA, 64 nt, hsa
aggauuuggggggaucuuagggaccuaaucgacuucuuugcacacuaaaaacaucagacaaugg

SEQ ID NO: 614111 - RNA, 64 nt, hsa
ucuaaauuuaaaaaggaaaacaaaacaaacuuguucuuugcagcuuaucaccuugugaaugucg

SEQ ID NO: 614112 - RNA, 64 nt, hsa
gcagcagcaccuccagacuggaaaaauauguuaaucuuugcaucauauuggacucuugaaggca

SEQ ID NO: 614113 - RNA, 64 nt, hsa
ucccugaauccuacuugaacauuguauaaauuucucuuugcauauaauacauauuugugaauga

SEQ ID NO: 614114 - RNA, 64 nt, hsa
uuugccauagaacuaaauauucugguggucugucucuuugcaggacauauuuucuuuacuguaa

SEQ ID NO: 614115 - RNA, 64 nt, hsa
ccaaugauggcaugacaauccagagaucauaacuucuuugcaagaaaacagcuucuccacacau

SEQ ID NO: 614116 - RNA, 64 nt, hsa
gccauguggcugccccauuuauccaccuccaucuucuuugcagccuggguggcuauggguacuu

SEQ ID NO: 614117 - RNA, 64 nt, hsa
cuaggagggggcucgcugcugcgcccugggcucgucuuugcagaguggucccugcccucaucuc

SEQ ID NO: 614118 - RNA, 64 nt, hsa
cucaguuacuccauuggugaaauggcccuuucccucuuugcaguucagucuaagucucguauuu

SEQ ID NO: 614119 - RNA, 64 nt, hsa
gcuuuguguguuuaacugagcuuauaguaggacuucuuugcauauguaugguacugaaaaaucu

SEQ ID NO: 614120 - RNA, 64 nt, hsa
caacugucaccaucuuugcaccaaacugucaccaucuuugcagcagaaggucacuacucacauu

SEQ ID NO: 614121 - RNA, 64 nt, hsa
gcucuaauuccauccaucuacccaacugucaccaucuuugcaccaaacugucaccaucuuugca

SEQ ID NO: 614122 - RNA, 64 nt, hsa
uaaggaggucucaugugcuguaggaguaaaaaagucuuugcauaaaacaguauuuauuuuuacu

SEQ ID NO: 614123 - RNA, 64 nt, hsa
uuuuguuuuuuguuauugauauuaaacaguguaaucuuugcaagcguauauugaagauuauucu

SEQ ID NO: 614124 - RNA, 64 nt, hsa
acauaauuaacacuuaagguugggugcugcuaauucuuugcaaaaauccaaauauuguuaaggg

SEQ ID NO: 614125 - RNA, 64 nt, hsa
uacuguaaaaugcaaaaaaucuuaauacuguuauucuuugcacuuuuucuuaaucauuuuuuau

SEQ ID NO: 614126 - RNA, 64 nt, hsa
uucauauuccaguggucaauguagauuucaaguugaaaggcagucccuuuaguugggggcuguc

SEQ ID NO: 614127 - RNA, 64 nt, hsa
aagcgagguuucaugacacaaccuuucaugucgugaaaggcagagggugacugugugugaugug

SEQ ID NO: 614128 - RNA, 64 nt, hsa
acagugcugaucgugucucagcaucaggaaaggagaaaggcagagggagagcgcugagaagacu

SEQ ID NO: 614129 - RNA, 64 nt, hsa
cugugcccccgcugaaccuggcuggaccgcgugugaaaggcagaacuaacgugcggaaacauuu

SEQ ID NO: 614130 - RNA, 64 nt, hsa
gaauggucucaauuacuguugucgcaauagcaaugaaaggcauaagaauuacuugguggccuca

SEQ ID NO: 614131 - RNA, 64 nt, hsa
aaauggcccuacuguagacagcuuauggggcccagaaaggcacugggcuuuaaagagcgaaaug

SEQ ID NO: 614132 - RNA, 63 nt, hsa
caaugaguuuguacaaauaacuggggucaucgggaaaggcaaagaaacugaaggcagaguccu

SEQ ID NO: 614133 - RNA, 64 nt, hsa
cauugucuuuccugaaugacuuucuaacugugcagaaaggcagaaaagucaucauauguauaug

SEQ ID NO: 614134 - RNA, 64 nt, hsa
aaaaggauguauguguauaaaaacagauucaagggaaaggcacuaaaugguuuuuuccucugga

SEQ ID NO: 614135 - RNA, 64 nt, hsa
cccagaacaggauccccagaagcaggcugaagaggaaaggcaggaggaaccugaguaugagaau

SEQ ID NO: 614136 - RNA, 64 nt, hsa
gcuuguaaauacuguaauauauuuauuaauauuugaaaggcauucauucaguggacagugggaa

SEQ ID NO: 614137 - RNA, 64 nt, hsa
gucuguagucagcaccacgauagcaccguuucaugaaaggcauggcggcugcauuucauaccac

SEQ ID NO: 614138 - RNA, 64 nt, hsa
aauugcuuuugcuccugaaaccugggaaucaauggaaaggcagggaaugugccucuucuguggc

SEQ ID NO: 614139 - RNA, 64 nt, hsa
uuuccugacaagguauauuuguuuucuagugacagaaaggcaaaggaacaaguccuaguuguug

SEQ ID NO: 614140 - RNA, 64 nt, hsa
cuguuggugauugcauggugucucggugcauggggaaaggcaaggucuucugagcucaucuuaa

SEQ ID NO: 614141 - RNA, 64 nt, hsa
cacugcacuaauuggcaugucagccuccagcucagaaaggcauuugcucaugguuacaggcauc

SEQ ID NO: 614142 - RNA, 64 nt, hsa
ugacucuugacucuugccugccuaacaaaauauugaaaggcaaacauuugaaggagggaggggg

SEQ ID NO: 614143 - RNA, 64 nt, hsa
acccacucagagaugcauuuggaacagugcuacugaaaggcaguagucauuuucaagacugaau

SEQ ID NO: 614144 - RNA, 64 nt, hsa
acuugaggagaaaaccuuuacaauuuccuaugggugucagaaguacucucagcgaaaacugaug

SEQ ID NO: 614145 - RNA, 64 nt, hsa
caaaugggcauuuauauaaacuugugauguuucuugucagaauucugaguacucugugaagaac

SEQ ID NO: 614146 - RNA, 64 nt, hsa
agaaugggaaggagaccauuggguaacccucaagugucagaaguuguuucuaaaguaacuauac

SEQ ID NO: 614147 - RNA, 64 nt, hsa
uccuguucuaauaaaugcacggcuuuaccuuuccugucagaaauaaaccaaggcucuaaaagau

SEQ ID NO: 614148 - RNA, 64 nt, hsa
acucaaaucucagccccauguuguucuuuguuauugucagaaccuggugaguuguuuugaacag

SEQ ID NO: 614149 - RNA, 64 nt, hsa
aauggaaaugggaagagcaacaguaacuccaaagugucagaaaauaguuaacauucaaaaaacu

SEQ ID NO: 614150 - RNA, 64 nt, hsa
agcauuggaaaaagccacuuggacuucacagagcugucagaagacuuaggaagcuuugccagua

SEQ ID NO: 614151 - RNA, 64 nt, hsa
cucucuggagauagcuaccuggacuuuacagagcugucagaagacuugggaagguuugccagca

SEQ ID NO: 614152 - RNA, 64 nt, hsa
uggauugagugcugucagaaaguggauugagugcugucagaaagugggagugauuuugcaacug

SEQ ID NO: 614153 - RNA, 64 nt, hsa
ucaagugagcaaggguuucuucuggauugagugcugucagaaaguggauugagugcugucagaa

SEQ ID NO: 614154 - RNA, 64 nt, hsa
aauuaggauucaugugguuucuaagauuuggacaugucagaauuuugugagucauggauggggc

SEQ ID NO: 614155 - RNA, 64 nt, hsa
agugauuacugcuauuacuauauuuacuugcauaugucagaaugaugugauagacuaucucugu

SEQ ID NO: 614156 - RNA, 64 nt, hsa
gaauagcuaagagauaaauugggcuggggaaacuugucagaaagcacugaacaauuaagaaauu

SEQ ID NO: 614157 - RNA, 64 nt, hsa
acuguaaggcagaugaucguccccguaugaugauugucagaagacaggacuaaguagcagagaa

SEQ ID NO: 614158 - RNA, 64 nt, hsa
accuauauccagauuuucuuucugcugaagcuguugucagaaucuuccuuuggacaaaacauca

SEQ ID NO: 614159 - RNA, 64 nt, hsa
agcaaaauacaggaaaagaacuauccaguauaaaugucagaagacagauuuccuaaacaaguaa

SEQ ID NO: 614160 - RNA, 64 nt, hsa
guuaguguugugcuuugccuucuuuggcgaugaaugucagaaauugaaugccacaugcuuucau

SEQ ID NO: 614161 - RNA, 64 nt, hsa
agugauuuaccuguccauuuccaacccaaaagccugucagaaagcauucuuuagagaaaaccac

SEQ ID NO: 614162 - RNA, 64 nt, hsa
cuguugaccuguaaggaagcagucgauccuagagugucagaacagagccauucucuccuccuga

SEQ ID NO: 614163 - RNA, 64 nt, hsa
auguucaaggaguguuacuguuccgcccucucuuugucagaagggacacaggugguaauuugga

SEQ ID NO: 614164 - RNA, 64 nt, hsa
uguaguucaggcacagaaagaauagcaaagcugcugucagaaguuugucaggcagagauguuua

SEQ ID NO: 614165 - RNA, 64 nt, hsa
aauaaggaaggaagggaggcagggaggcaaagcaugucagaaacggaccuugguuuccuguuca

SEQ ID NO: 614166 - RNA, 64 nt, hsa
aagggagacuguugcucaaccaucaggaaacaguugucagaagacaucauugguucuguguuuc

SEQ ID NO: 614167 - RNA, 64 nt, hsa
agaaagucgcauaggguuuuuuaaugcagaauuuugucagaagacaauggcgcugcauguuuuu

SEQ ID NO: 614168 - RNA, 64 nt, hsa
gaugaagcaaaccuuugaauuuuugcacagcucuugucagaaagcccugaguucccccuggaua

SEQ ID NO: 614169 - RNA, 64 nt, hsa
cacaagagaaagcaaacugcccaagaagucaucaugucagaaacucaaucucaacaaaauaauu

SEQ ID NO: 614170 - RNA, 64 nt, hsa
ccaauuggugugggagaauuagagaauuuauuugugucagaaaauacuccagaacaaccacccc

SEQ ID NO: 614171 - RNA, 64 nt, hsa
acuuguggagucugcacuaacuuggagaaguuagugucagaauugaauuauagaacacccaguu

SEQ ID NO: 614172 - RNA, 64 nt, hsa
augguuucagugaaacaaucuagcagagaauuaaugucagaaccuuuuuaaauaauagucugau

SEQ ID NO: 614173 - RNA, 64 nt, hsa
ucguaaagagguaccaacugucgcugaugugauaugucagaacugaagaguaaaucuacuuguu

SEQ ID NO: 614174 - RNA, 64 nt, hsa
ugugcagugagcaauuuuugugucagaaauucuuugucagaacaaauauauguaacaggcucaa

SEQ ID NO: 614175 - RNA, 64 nt, hsa
ucucugagauucugugugcagugagcaauuuuugugucagaaauucuuugucagaacaaauaua

SEQ ID NO: 614176 - RNA, 64 nt, hsa; identical to SEQ ID NO: 344312

SEQ ID NO: 614177 - RNA, 64 nt, hsa; identical to SEQ ID NO: 344313

SEQ ID NO: 614178 - RNA, 64 nt, hsa; identical to SEQ ID NO: 344314

SEQ ID NO: 614179 - RNA, 64 nt, hsa; identical to SEQ ID NO: 344315

SEQ ID NO: 614180 - RNA, 64 nt, hsa; identical to SEQ ID NO: 344316

SEQ ID NO: 614181 - RNA, 64 nt, hsa; identical to SEQ ID NO: 344317

SEQ ID NO: 614182 - RNA, 64 nt, hsa; identical to SEQ ID NO: 344318

SEQ ID NO: 614183 - RNA, 64 nt, hsa; identical to SEQ ID NO: 344319

SEQ ID NO: 614184 - RNA, 64 nt, hsa; identical to SEQ ID NO: 344320

SEQ ID NO: 614185 - RNA, 64 nt, hsa; identical to SEQ ID NO: 344321

SEQ ID NO: 614186 - RNA, 64 nt, hsa; identical to SEQ ID NO: 344322

SEQ ID NO: 614187 - RNA, 58 nt, hsa; identical to SEQ ID NO: 344323

SEQ ID NO: 614188 - RNA, 64 nt, hsa; identical to SEQ ID NO: 344324

SEQ ID NO: 614189 - RNA, 64 nt, hsa
gagauaugggaacacuggcagacuguguaaaauguaaugcaacuacccaaaacaagccugguag

SEQ ID NO: 614190 - RNA, 64 nt, hsa
uuuggucaucaagggugcgucugggagguugguuuaaugcaauagaagugcuccccucugaaag

SEQ ID NO: 614191 - RNA, 64 nt, hsa
cuaugcgccucacuagcuuaccacccugugcagguaaugcaacugacuuugucucaucagucuu

SEQ ID NO: 614192 - RNA, 64 nt, hsa
ucugaguaaaauucuuaagccaaauggaaauucuuaaugcaaucaugaggacuucuauugucuc

SEQ ID NO: 614193 - RNA, 64 nt, hsa
ugaguucccuaauauauucuuauauguagagcaauaaugcaaaagcuguucuauaugcaaacau

SEQ ID NO: 614194 - RNA, 64 nt, hsa
accuuuuuguaauguaguaucaaaguuuuuuagguaaugcaaaauuuuacaaaucauuugugga

SEQ ID NO: 614195 - RNA, 64 nt, hsa
ucauuagugauauuuuuucucuuuagagcauuuuuaaugcaacuagccccuauauuuuaaugua

SEQ ID NO: 614196 - RNA, 64 nt, hsa
auguuuguauaaaaaaaaacaguguaaaccuuuuuaaugcaaauuuauuuuuuucauugcauau

SEQ ID NO: 614197 - RNA, 64 nt, hsa
auggaacuaucacuuuauaagaaucauuuucuaguaaugcaaacaaauuauuuuuuacaaaaaa

SEQ ID NO: 614198 - RNA, 64 nt, hsa
gacaaacuuuuauguuuacagggcacgucuguuguaaugcaaagcauauuuggcaagcaguuca

SEQ ID NO: 614199 - RNA, 64 nt, hsa
auucaucaaggcaugauuuuuguuucacuacaaauaaugcaaacuguuuucaauaaaaagagga

SEQ ID NO: 614200 - RNA, 64 nt, hsa
ccuacugaagauagguucucuauguauucaacaauaaugcaacuuuagaaguauuccacacugc

SEQ ID NO: 614201 - RNA, 64 nt, hsa
augccgaagaggaauaugguauaauuuuaaauuuuaaugcaaaauuuuaauuugucuuuauuuu

SEQ ID NO: 614202 - RNA, 64 nt, hsa
auacaaaauaggugaugaaccucugguuuuaccauaaugcaaugugccacggaaaguuuggggg

SEQ ID NO: 614203 - RNA, 65 nt, hsa; identical to SEQ ID NO: 192314

SEQ ID NO: 614204 - RNA, 65 nt, hsa; identical to SEQ ID NO: 192315

SEQ ID NO: 614205 - RNA, 65 nt, hsa; identical to SEQ ID NO: 192316

SEQ ID NO: 614206 - RNA, 65 nt, hsa; identical to SEQ ID NO: 192317

SEQ ID NO: 614207 - RNA, 65 nt, hsa; identical to SEQ ID NO: 192346

SEQ ID NO: 614208 - RNA, 65 nt, hsa; identical to SEQ ID NO: 192347

SEQ ID NO: 614209 - RNA, 65 nt, hsa; identical to SEQ ID NO: 192359

SEQ ID NO: 614210 - RNA, 65 nt, hsa; identical to SEQ ID NO: 192360

SEQ ID NO: 614211 - RNA, 65 nt, hsa; identical to SEQ ID NO: 192372

SEQ ID NO: 614212 - RNA, 65 nt, hsa; identical to SEQ ID NO: 192373

SEQ ID NO: 614213 - RNA, 65 nt, hsa; identical to SEQ ID NO: 192406

SEQ ID NO: 614214 - RNA, 65 nt, hsa; identical to SEQ ID NO: 192407

SEQ ID NO: 614215 - RNA, 65 nt, hsa; identical to SEQ ID NO: 192416

SEQ ID NO: 614216 - RNA, 65 nt, hsa; identical to SEQ ID NO: 192417

SEQ ID NO: 614217 - RNA, 65 nt, hsa; identical to SEQ ID NO: 192438

SEQ ID NO: 614218 - RNA, 65 nt, hsa; identical to SEQ ID NO: 192439

SEQ ID NO: 614219 - RNA, 65 nt, hsa; identical to SEQ ID NO: 192440

SEQ ID NO: 614220 - RNA, 65 nt, hsa; identical to SEQ ID NO: 192459

SEQ ID NO: 614221 - RNA, 65 nt, hsa; identical to SEQ ID NO: 192460

SEQ ID NO: 614222 - RNA, 65 nt, hsa; identical to SEQ ID NO: 192545

SEQ ID NO: 614223 - RNA, 65 nt, hsa; identical to SEQ ID NO: 192546

SEQ ID NO: 614224 - RNA, 65 nt, hsa; identical to SEQ ID NO: 192550

SEQ ID NO: 614225 - RNA, 65 nt, hsa; identical to SEQ ID NO: 192551

SEQ ID NO: 614226 - RNA, 65 nt, hsa; identical to SEQ ID NO: 192564

SEQ ID NO: 614227 - RNA, 65 nt, hsa; identical to SEQ ID NO: 192565

SEQ ID NO: 614228 - RNA, 65 nt, hsa; identical to SEQ ID NO: 192611

SEQ ID NO: 614229 - RNA, 65 nt, hsa; identical to SEQ ID NO: 192612

SEQ ID NO: 614230 - RNA, 65 nt, hsa; identical to SEQ ID NO: 192632

SEQ ID NO: 614231 - RNA, 65 nt, hsa; identical to SEQ ID NO: 192633

SEQ ID NO: 614232 - RNA, 65 nt, hsa; identical to SEQ ID NO: 192653

SEQ ID NO: 614233 - RNA, 65 nt, hsa; identical to SEQ ID NO: 192654

SEQ ID NO: 614234 - RNA, 65 nt, hsa; identical to SEQ ID NO: 192659

SEQ ID NO: 614235 - RNA, 65 nt, hsa; identical to SEQ ID NO: 192660

SEQ ID NO: 614236 - RNA, 60 nt, hsa
aaugcuguaugaauggaaaucauuuugcaauugagugacacuucauuguaauucacagug

SEQ ID NO: 614237 - RNA, 60 nt, hsa
auuucuccagacaggaaagcuuuagaaaacuugagugaaauggagcaagcuugaaggagu

SEQ ID NO: 614238 - RNA, 60 nt, hsa
aaaggccucgggcuuggcaaauggaagaacuugagugagaguucagucugcaguccucug

SEQ ID NO: 614239 - RNA, 60 nt, hsa
cauucuuucauugacagcugacauaauucauugagugaaauauuuuaagccaaaaaaaaa

SEQ ID NO: 614240 - RNA, 60 nt, hsa
ucagauggagauaaggauuccagauggcacuugagugaagaugagaauagauccuaugug

SEQ ID NO: 614241 - RNA, 60 nt, hsa
ccacugacccccguugaccaggcugccuucuugagugaggugcugcggcggaccugccac

SEQ ID NO: 614242 - RNA, 60 nt, hsa
caggcucuccccaucuccccugcuuugguguugagugaugagcugagucagggauaggga

SEQ ID NO: 614243 - RNA, 60 nt, hsa
uuuaaugaaucuugcuuucuaauaaauaaauugagugauucugguugcauuccuauuucc

SEQ ID NO: 614244 - RNA, 60 nt, hsa
uacuuacucauagugguuguuucucuggucuugagugacuguguccacaguucauuuuuu

SEQ ID NO: 614245 - RNA, 60 nt, hsa
uguuuuuaauggcucaacugucugauguaauugagugaagguuugcacugagaaauuagc

SEQ ID NO: 614246 - RNA, 60 nt, hsa
aauuuugagcuuaucugucuuauuuaugcuuugagugaaucaucuguugaggucuaaugc

SEQ ID NO: 614247 - RNA, 60 nt, hsa
agcacuggaaacaguuucauggaguuuaaguugagugaacaucggccaugaaaauccauc

SEQ ID NO: 614248 - RNA, 60 nt, hsa
ccuuuugagaugacauuauugucuccauaauugagugauagcuuuaaaaaaaagauuagu

SEQ ID NO: 614249 - RNA, 60 nt, hsa
gacuaaacguuucgguagaaugcuucauacuugagugaugcuggauaagguauuguauuu

SEQ ID NO: 614250 - RNA, 60 nt, hsa
uugaaaucauuccaguauauuugggaagaauugagugaaugagaaugcucuuccuuauuc

SEQ ID NO: 614251 - RNA, 60 nt, hsa
gagccaugguugcaccacugcucuccaggcuugagugacagagcaagacuguaucucaaa

SEQ ID NO: 614252 - RNA, 60 nt, hsa
uuuggguauaggguugaggggaaauaaguuuugagugagaaauaaacguuuuagcugaaa

SEQ ID NO: 614253 - RNA, 60 nt, hsa
uugcacaauuuuuaugucuaguauguaugcuugagugaaugugcgaguaugaaugauuag

SEQ ID NO: 614254 - RNA, 60 nt, hsa
ccugucuucugggcaauauuucuaaaauauuugagugacauugauguuuaagugaccucc

SEQ ID NO: 614255 - RNA, 60 nt, hsa
aacaucucaaguacguaaauuaaguugucauugagugaaagguucacuuggaccuagugc

SEQ ID NO: 614256 - RNA, 60 nt, hsa
cauagguuauauuucccaaaucuuuaauuauugagugaaagagcuauagaugaauugaua

SEQ ID NO: 614257 - RNA, 60 nt, hsa
ccauuugacugagaccacauggugugccccuugagugaggcuaaucuuuagguuuuuccu

SEQ ID NO: 614258 - RNA, 60 nt, hsa
caucauugugcguugugugcgguuaccugcuugagugauccugaacuuguugcgacagag

SEQ ID NO: 614259 - RNA, 60 nt, hsa
caggcacuugaccuggcuguagccuaggucuugagugaaccccaaaaacuugcuuucucu

SEQ ID NO: 614260 - RNA, 60 nt, hsa
uugccuccugcagaacuuugaaaagcuggguugagugaggcuaucagcacagccuuccuu

SEQ ID NO: 614261 - RNA, 60 nt, hsa
ugggcccaggacccagucuuggccauucaguugagugaggcugaaggcuggguuugaaaa

SEQ ID NO: 614262 - RNA, 60 nt, hsa
gcauuuccuugcacaaacaguaagaugacuuugagugauggcacugggagaucagggcag

SEQ ID NO: 614263 - RNA, 60 nt, hsa
ucuuacaaauucuucaauaaagacacauucuugagugaaaucccaaucauguccuguuuu

SEQ ID NO: 614264 - RNA, 60 nt, hsa
ucaaagaaguggauaagagggaggagaucauugagugacccagaaagcucuuuugaaaag

SEQ ID NO: 614265 - RNA, 60 nt, hsa
uuugugagccacauauugggaguucuagauuugagugaauggcaggaaagggccaucucc

SEQ ID NO: 614266 - RNA, 60 nt, hsa
guuugcaguauucuccccugauuggaaugguugagugaggguaagggaaagaauaucuua

SEQ ID NO: 614267 - RNA, 60 nt, hsa
ugaacuauaguuuuuacuaguaucaccaaauugagugauacaaauuucaucuauuuuauu

SEQ ID NO: 614268 - RNA, 60 nt, hsa
gguggaagaaaccaugggcaggaguaggaauugagugauaaacaauugggcuaaugaaga

SEQ ID NO: 614269 - RNA, 60 nt, hsa
cguauguuuggcucauuacugguuuaccccuugagugaaugccuguuuaugaugacugag

SEQ ID NO: 614270 - RNA, 60 nt, hsa
cauaucugugcagaacacgguguuuuaagcuugagugaaaggagggugaggcugccgaug

SEQ ID NO: 614271 - RNA, 60 nt, hsa
ccauuugccuucgguccucaaugcaugucuuugagugacuucuuaucugaaauuuugcua

SEQ ID NO: 614272 - RNA, 60 nt, hsa
ucagccagaccugcguugugugucuguguguugagugagcuggucagcuaacaagucuuc

SEQ ID NO: 614273 - RNA, 60 nt, hsa
guguauauauuuauauauaaauauaucuauuugagugaaaccuugugaacucuuuaauua

SEQ ID NO: 614274 - RNA, 60 nt, hsa
auauucauucuuuaugcaaugaggguauuuuugagugaauuuuaacugcucugaacuaag

SEQ ID NO: 614275 - RNA, 60 nt, hsa
uaacaguuugguuuuuaauggcugugguauuugagugaggcaacucuggggcauuuguua

SEQ ID NO: 614276 - RNA, 60 nt, hsa
uuugucacuuagaauaauauguacuacuacuugagugagcgcuuuuggaaguuauaucaa

SEQ ID NO: 614277 - RNA, 60 nt, hsa
auggaccaggaaggcauauguauuuugaacuugagugaaaagguugaaguuacagacuuu

SEQ ID NO: 614278 - RNA, 60 nt, hsa
aaugaaggaaauuuuuuucugaauguagguuugagugaggggcaccucugcuuucccuua

SEQ ID NO: 614279 - RNA, 60 nt, hsa
cccaaggagacccugccacaugcuggcccuuugagugagaaugcugcaucuuucuacaua

SEQ ID NO: 614280 - RNA, 60 nt, hsa
uuaugccaguaauauaguguuguaugccuauugagugauuguggcaagaaaagcuacagc

SEQ ID NO: 614281 - RNA, 60 nt, hsa
uaaaaaauaaauuaggcccaauccaagaaauugagugagaaggaaacacuuguuuuauuc

SEQ ID NO: 614282 - RNA, 60 nt, hsa
ucaguccaauugccagagaagacuguccuuuugagugacucaaccugcaaaccuuuaaga

SEQ ID NO: 614283 - RNA, 60 nt, hsa
cauguauagaagagaucugauccaguguuguugagugaaaaucugacagaucauucuaga

SEQ ID NO: 614284 - RNA, 60 nt, hsa
cauuccucugaaagcaaaacaaauucauaauugagugauauuaaauagagagguuuucgg

SEQ ID NO: 614285 - RNA, 60 nt, hsa
gaacauuguucgguucacacguuccaaacuuugagugauuucuggaguuagacauagauu

SEQ ID NO: 614286 - RNA, 60 nt, hsa
cacgaggaguugggagccugccugguggaguugagugaugcccgucaugugcacuugggu

SEQ ID NO: 614287 - RNA, 60 nt, hsa
acuggauauucauauaaacuuuuuaaagaguugagugauagagcuaacccuuaucuguaa

SEQ ID NO: 614288 - RNA, 60 nt, hsa
uauagauauaaagcuuuacuuagauauaacuugagugaguagggaaaaaaaucuacagua

SEQ ID NO: 614289 - RNA, 60 nt, hsa
aauuacuacuagguaauaauaaugggagacuugagugauaauaggggauuuuaaaacucu

SEQ ID NO: 614290 - RNA, 60 nt, hsa
auauuccuugauuuaaauuggcuuuugugauugagugaaacuuuauaaagcauaugguca

SEQ ID NO: 614291 - RNA, 60 nt, hsa
aagggcgguauggaaggcaggcuguacugguugagugaauggaaaguuggggaguagaac

SEQ ID NO: 614292 - RNA, 60 nt, hsa
aggaguaggugugaguugauaauguugaaguugagugaucaguacguggguuuauuacac

SEQ ID NO: 614293 - RNA, 60 nt, hsa
agaauuuauugcugaaucaugcuccaguauuugagugauguuuuaaauauccuaugucug

SEQ ID NO: 614294 - RNA, 60 nt, hsa
guuaaccucagugcucaacuauuugaacuguugagugauaaaggaaacaaauauaacugu

SEQ ID NO: 614295 - RNA, 60 nt, hsa
cgugggauaggucccaugucaaaggaacuuuugagugaugacucugagaaguugaauugc

SEQ ID NO: 614296 - RNA, 60 nt, hsa
uuuuuuagcuauuuuuuccaugugugaaccuugagugauacuaaucauguaaaguaagag

SEQ ID NO: 614297 - RNA, 60 nt, hsa
agagacugauguauaauggacagguguuccuugagugacagacuuacaaagggaguguuu

SEQ ID NO: 614298 - RNA, 60 nt, hsa
uuaauaaaauuaguuugcaucauguagucauugagugagggggagauauaagccaaggau

SEQ ID NO: 614299 - RNA, 60 nt, hsa
uuccccugcagcagucgaggacugagcagauugagugaugcuggggcagagaggccuggg

SEQ ID NO: 614300 - RNA, 60 nt, hsa
uagaggcaauauuuucuacuugcaaucaauuugagugacucaggugaaauuuagagucau

SEQ ID NO: 614301 - RNA, 60 nt, hsa
acucugaaguuuucuacaacaaaaaaagaguugagugaaucuguuuacauuuagaauaau

SEQ ID NO: 614302 - RNA, 60 nt, hsa
gcaggcgcacguugguuucuuggucguccuuugagugacaacuucuccgugaaccugcug

SEQ ID NO: 614303 - RNA, 60 nt, hsa
ucugcugaagguuguaaguggucgcuuacuuugagugauccuccaacuucauuugaugcu

SEQ ID NO: 614304 - RNA, 60 nt, hsa
ucucaagacuggaaaacaauagcauuugucuugagugaggaagugaagcccgcuguguuc

SEQ ID NO: 614305 - RNA, 60 nt, hsa
agcacacaacacacacugaguaaauauuuguugagugaaauaaaaucaagaaacaaguaa

SEQ ID NO: 614306 - RNA, 60 nt, hsa
agagaaaaagagguugauugaauugugccuuugagugaacccaguuuuuaaauaccgcug

SEQ ID NO: 614307 - RNA, 60 nt, hsa
uauuuuguuaauuacaguguuuuugguucauugagugaagauucugccgggugggaucuu

SEQ ID NO: 614308 - RNA, 60 nt, hsa
guagcccucacuuucaugccauuuccauuguugagugaagcguauuugaaguaacugaga

SEQ ID NO: 614309 - RNA, 60 nt, hsa
aucacucauuucuauucauuccucaggcacuugagugacaguuguuuaccaggcacugug

SEQ ID NO: 614310 - RNA, 60 nt, hsa
uuccuuauguaucaucuaauacaaugaugguugagugaaaauacagaagggguguuugag

SEQ ID NO: 614311 - RNA, 60 nt, hsa
gguuagcucucaccuguagguuuaaucaccuugagugacugggcagcagcgguggagucu

SEQ ID NO: 614312 - RNA, 60 nt, hsa
aaauauguuacuguauuaauuaaucuaauauugagugauuauuuguaaaauuaugaauau

SEQ ID NO: 614313 - RNA, 60 nt, hsa
uuucuucagauuauguuuuauuucuuugcauugagugaggaacauaaaauggcuugguaa

SEQ ID NO: 614314 - RNA, 60 nt, hsa
uauuuuuguguguaguugauuacucuuccauugagugaaugaugaauaccugugaggaua

SEQ ID NO: 614315 - RNA, 60 nt, hsa
uaauagucaaaaauguguuuaccugucugauugagugagccuuuuggugagcucagcuga

SEQ ID NO: 614316 - RNA, 60 nt, hsa
caguguaacugcauuucuaauaaaaauuuauugagugaaacaaucuuuguacaaugacua

SEQ ID NO: 614317 - RNA, 60 nt, hsa
acuuuuuuuuaaugugcauuauuaaaaauauugagugaagcuaauugucaacuuuauuaa

SEQ ID NO: 614318 - RNA, 60 nt, hsa
guuucucuccccuauggauuuugcuaaugguugagugauaccuaaaggccuuguugcauu

SEQ ID NO: 614319 - RNA, 60 nt, hsa
gguuuccucuagaacugaauuccucuggaauugagugauggacuucacaacaacuagcca

SEQ ID NO: 614320 - RNA, 60 nt, hsa
uuuuaagcuguaaaaagagagaaaacuuauuugagugauuauuuguuauuuguacaguuc

SEQ ID NO: 614321 - RNA, 60 nt, hsa
agacgcugcauuccagaaacgucuuaacacuugagugaaucuucaaaggacccugacauu

SEQ ID NO: 614322 - RNA, 58 nt, hsa; identical to SEQ ID NO: 502655

SEQ ID NO: 614323 - RNA, 60 nt, hsa
caacaggugcuagagaccacuguuguuguuuugagugaauggugguuaggagaaagacuu

SEQ ID NO: 614324 - RNA, 60 nt, hsa
cagccugucaugauauguuuuagauaaaguuugagugaguucauugggauaaauggucca

SEQ ID NO: 614325 - RNA, 60 nt, hsa
aacauuaucaauauaccaauguuuuaaaaauugagugaggguuauuauuuguauuugaug

SEQ ID NO: 614326 - RNA, 60 nt, hsa
uuauaagacaguauguauaguaauaguagcuugagugaauaugcaaaaguuuaauuuuua

SEQ ID NO: 614327 - RNA, 60 nt, hsa
guguuaaagcauuagccugugucaaguucuuugagugauacuagugaaaccaaauagaaa

SEQ ID NO: 614328 - RNA, 60 nt, hsa
cacaaauaaagaauucaauucuuuacaugauugagugagaguauguauaaccuggugggu

SEQ ID NO: 614329 - RNA, 60 nt, hsa
aggacuugauacccucugagaugaguggcuuugagugacaugcuaacagcaauuucauag

SEQ ID NO: 614330 - RNA, 60 nt, hsa
cagaacuggaaggagacaucugucccgucuuugagugacaagcccgggacaacagccagu

SEQ ID NO: 614331 - RNA, 60 nt, hsa
augugcaucuggagguguugcggcagagguuugagugaacccucuuucaaagacaauaaa

SEQ ID NO: 614332 - RNA, 60 nt, hsa
cauuuuauaaaugaggaaacggaggcuuaguugagugagcugaccaauaucacccagcca

SEQ ID NO: 614333 - RNA, 60 nt, hsa
gaguuaucaugauggugcugauugcccaccuugagugagggguggauaaacuaccccugc

SEQ ID NO: 614334 - RNA, 60 nt, hsa
uuugcugcgggaguuuggcuggccaggaacuugagugacauugaccucauggcaccucag

SEQ ID NO: 614335 - RNA, 60 nt, hsa
aaaggcccuucuaacuuccagauuguaugcuugagugauggguccccagcccaagcccac

SEQ ID NO: 614336 - RNA, 60 nt, hsa
agaggaagaguuucuauuaaaaucugucacuugagugaugucauucaaguccuauuuuag

SEQ ID NO: 614337 - RNA, 60 nt, hsa
agcaaaaccaaauaaaguggagaugagugauugagugagguagauugcugucccguuaac

SEQ ID NO: 614338 - RNA, 60 nt, hsa
gaaauugcuggacuauuuguggcuccugaguugagugauuuuggugaaagaaagcacauc

SEQ ID NO: 614339 - RNA, 60 nt, hsa
ucggcucacugcaaccucugccucccggguuugagugauucuccugcgucagccucccga

SEQ ID NO: 614340 - RNA, 60 nt, hsa
caaaaccagugucaggccuuugcaguaggcuugagugaacuucugaucuagauuugaaag

SEQ ID NO: 614341 - RNA, 60 nt, hsa
ugguguggacggaaaggguggccaaauggauugagugaugagcagacauguuuaaggguc

SEQ ID NO: 614342 - RNA, 60 nt, hsa
cucaacuauuuaaucaucaugauucauauuuugagugaauacaucaggcacagaccuuca

SEQ ID NO: 614343 - RNA, 60 nt, hsa
auacaaaaaagaaugauguuuaaaauugcuuugagugauucauacagagauguauauaug

SEQ ID NO: 614344 - RNA, 60 nt, hsa
gaagaggcuguuuguguuuaacuuauaauauugagugauccaugaaguagguuuucagag

SEQ ID NO: 614345 - RNA, 60 nt, hsa
uagagaggcucuugugguuaacugauaauauugagugaugcaugagguagguguucagag

SEQ ID NO: 614346 - RNA, 60 nt, hsa
gccgacuucccccuugcuguucucgugauauugagugagcgcuugugggaucugguuguu

SEQ ID NO: 614347 - RNA, 60 nt, hsa
uaguauacuagggcaugauaugguauccuuuugagugagguauauacucaucucacaagu

SEQ ID NO: 614348 - RNA, 60 nt, hsa
uuggagagaauccccuccagauaagagauuuugagugaaaaacauaaugauccugccauu

SEQ ID NO: 614349 - RNA, 60 nt, hsa
uacuuugauagaacuaaggaaauagugguuuugagugaagggaaaggaaacccagaaaca

SEQ ID NO: 614350 - RNA, 60 nt, hsa
auagaugggucuggcugagcugaacccauuuugagugacucgaggguuggguucaucuga

SEQ ID NO: 614351 - RNA, 60 nt, hsa
gaaggugcugacaaagaugaccugcugcuguugagugagaucuucaaugcuuccuccuug

SEQ ID NO: 614352 - RNA, 60 nt, hsa
ucuccuguauauuggauuuugugauuauauuugagugaauaggagaaaacaauauauaac

SEQ ID NO: 614353 - RNA, 60 nt, hsa
ccaguucuuccaucgguguaguuguugcauuugagugaauacucucuugauuuauguauu

SEQ ID NO: 614354 - RNA, 60 nt, hsa
aaguaaacacuuauugucaggugccuagucuugagugaauuguuagaugugcacugaacu

SEQ ID NO: 614355 - RNA, 60 nt, hsa
uuugggggaaaacaggaaaucuuguuaggcuugagugagguguuugcuuccuucuugccc

SEQ ID NO: 614356 - RNA, 60 nt, hsa
uaauuguaaaaauuuuuguugauccagcauuugagugacacuguugaauguuucuaaaaa

SEQ ID NO: 614357 - RNA, 60 nt, hsa
uaaguugggaaacagaaugggccagggagguugagugacugaagaccaaggguuggugca

SEQ ID NO: 614358 - RNA, 60 nt, hsa
uucuuagucccucugcccucuguaaauguguugagugauauagcuaucagauguauugaa

SEQ ID NO: 614359 - RNA, 60 nt, hsa
acucauagugugguuuuuaaauauaugcaguugagugaugauuggauacuauucaucaua

SEQ ID NO: 614360 - RNA, 60 nt, hsa
cuuuuaaagaaggauacauuuuuaauauauuugagugauugcugggaagugugaaaauau

SEQ ID NO: 614361 - RNA, 60 nt, hsa
cagaagcacgaggcccuugagaacuguguguugagugaacuaauaacuguauuauagaaa

SEQ ID NO: 614362 - RNA, 60 nt, hsa
uuuacauaccuucucuguuguaucaguacuuugagugagaagacaguuuauuuaaaacuu

SEQ ID NO: 614363 - RNA, 60 nt, hsa
uacaaucagguauuauguuuuuaaaccaaguugagugaauugguaguggacuugggaaau

SEQ ID NO: 614364 - RNA, 60 nt, hsa
ucacuaauauuuugcauguaauuugcucauuugagugagggcacuuuuuuuguacauaug

SEQ ID NO: 614365 - RNA, 60 nt, hsa
ccugcgccaauugugagggcgcuuuagcauuugagugauucaauaguuacgaugaccagu

SEQ ID NO: 614366 - RNA, 60 nt, hsa
ugcugccuauugccauugcugucucaaaaguugagugaauuuugaggcgucuuuuuuuuu

SEQ ID NO: 614367 - RNA, 60 nt, hsa
ccagcucacugcagccucgaccucccuggcuugagugauccucccgccccagccuccuga

SEQ ID NO: 614368 - RNA, 60 nt, hsa
uggagaacggcugugauaaguagguuuugauugagugaaagcaugagcuuguucagagug

SEQ ID NO: 614369 - RNA, 60 nt, hsa
auuuaaucacaaaucauuuuuuaugaaugauugagugaaaauaguguuuauaaagguuaa

SEQ ID NO: 614370 - RNA, 60 nt, hsa
agucugaguuaauauucaagugaucagacuuugagugacaucaagaaaagaugauaucag

SEQ ID NO: 614371 - RNA, 60 nt, hsa
ccaaaaucacagauauucaugaguuucuacuugagugagaaaacugggugaaggaauaga

SEQ ID NO: 614372 - RNA, 60 nt, hsa
ucggcuuccaggucccaacccaggguuggguugagugagucccacaaagggcaagugggg

SEQ ID NO: 614373 - RNA, 60 nt, hsa
ccucaacucacugcaaccuccgcucccgguuugagugauucucaugccucagccucccga

SEQ ID NO: 614374 - RNA, 60 nt, hsa
ucucuuuaauguuuagcaugcuugucaaccuugagugagugucauuuuuaagaacaguug

SEQ ID NO: 614375 - RNA, 60 nt, hsa
auuccuagccuucaaauuauuaaacacuccuugagugaaauaauuuugcauugcaaagug

SEQ ID NO: 614376 - RNA, 60 nt, hsa
aauaagcacacacauuuucaauucucauguuugagugauuuuaaaauguuuuggugaaug

SEQ ID NO: 614377 - RNA, 60 nt, hsa
cauccccuccuagcacaaggagugcccgccuugagugacaugcggcugcccacgcuccug

SEQ ID NO: 614378 - RNA, 60 nt, hsa
uaauuuucuaaaaacacacacagaaaucgcuugagugaggaaaaguccacauggcagaga

SEQ ID NO: 614379 - RNA, 60 nt, hsa
ucaucuauacuucaucuuacaucgucaugauugagugaucuuuacauuugauuccagagg

SEQ ID NO: 614380 - RNA, 60 nt, hsa
uuuccaggguucuuccugagagaggcagauuugagugaggugcauaggauugccaaaacu

SEQ ID NO: 614381 - RNA, 60 nt, hsa
agcaauuuauuugaaacuucuaauggauuuuugagugauaaaacauuuacuaccuugucc

SEQ ID NO: 614382 - RNA, 60 nt, hsa
aucagcuccacccauggccaacagcccuuguugagugacgggagucggaaugugcuaccc

SEQ ID NO: 614383 - RNA, 60 nt, hsa
uggaaauauugcuuaauuuuucuucaaucauugagugaaaaaccuuuaacuuuggccugc

SEQ ID NO: 614384 - RNA, 60 nt, hsa
uuaugaggaagaagugauuccuuccugguuuugagugacaccacagcugucagccuucaa

SEQ ID NO: 614385 - RNA, 60 nt, hsa
acuuuuaaagucuuaaacuuuucaauaaaauugagugagacuuauaggcccaaagaauug

SEQ ID NO: 614386 - RNA, 60 nt, hsa
aagauaacaucugucaucuuccuugguuuauugagugaaaugccucucagucuuagggga

SEQ ID NO: 614387 - RNA, 60 nt, hsa
acucucuuuaugcgcaggaacaaacagcuguugagugagcugcuaugacuuugguagaga

SEQ ID NO: 614388 - RNA, 60 nt, hsa
cgaggucaccccgacuuuucuaaaucuuguuugagugaagucauuuuuucauguguucau

SEQ ID NO: 614389 - RNA, 60 nt, hsa
uacuuauuuauggaagauuacugcucuaauuugagugaaauaaaaguuauuagugcgagg

SEQ ID NO: 614390 - RNA, 60 nt, hsa
gucaucuuucaaaagagaaaaauuggacacuugagugacuuuguuuuuaguuuuguuuuu

SEQ ID NO: 614391 - RNA, 60 nt, hsa
auucuguacuucucaguuaagacuuguucuuugagugauguauuaaaugcugcuagaaaa

SEQ ID NO: 614392 - RNA, 60 nt, hsa
uuuugugcaccaggcccggcugcguagcaguugagugaugcugguuagcuauuaaggugg

SEQ ID NO: 614393 - RNA, 60 nt, hsa
caggaugauggaauuagaugcagucugucuuugagugagacuggucaccaucagaggagu

SEQ ID NO: 614394 - RNA, 60 nt, hsa
caguagucaguacacuuuucuagauaaaucuugagugaaaaccagcaauuucuuuuuccu

SEQ ID NO: 614395 - RNA, 60 nt, hsa
gggugcuccauauauauucauauauauuuguugagugaauuaaugaauuaagaguggcug

SEQ ID NO: 614396 - RNA, 60 nt, hsa
ccuuuucuauauuuauaagaagagaagaucuugagugaagcagcacgcgacccaggugug

SEQ ID NO: 614397 - RNA, 60 nt, hsa
cucaaauuaaccagguugugagccaguggcuugagugaauguuaggccuugggggcugag

SEQ ID NO: 614398 - RNA, 60 nt, hsa
gggaggaauccguuuuugcuccaccucuuuuugagugaacagaggacaaaccuuggguca

SEQ ID NO: 614399 - RNA, 60 nt, hsa
gcagaugaggaaauccguaggcaggagcgguugagugauuuuccuaaggucacccagcug

SEQ ID NO: 614400 - RNA, 60 nt, hsa
cuguauuaccaagcuuaagaaauaaaacaguugagugaucucucauuuaugacuaaauua

SEQ ID NO: 614401 - RNA, 60 nt, hsa
agggaccaguccaccaccaucuccuccacguugagugaagcucaucccaagcaaggagcc

SEQ ID NO: 614402 - RNA, 60 nt, hsa
cccuguuaguuuuguaaaaacugaagaauuuugagugaauuagaccuuuauuuuucuauc

SEQ ID NO: 614403 - RNA, 60 nt, hsa
guucucugucgcugcuaaauuauucuucacuugagugaagcaaauauuuagcuuccaaau

SEQ ID NO: 614404 - RNA, 60 nt, hsa
aauaguuuaccucauagaguuuggggagaauugagugaauuaaugugugugaggacacua

SEQ ID NO: 614405 - RNA, 60 nt, hsa
gagaaugcugacacuuuuucagggcugugauugagugagggcauggguaaaaauauuucu

SEQ ID NO: 614406 - RNA, 60 nt, hsa
uggaguugcacagaaucauggaauuuuguguugagugacauaauagguauggaaauauga

SEQ ID NO: 614407 - RNA, 60 nt, hsa
gcauauucuuuuuaaacuauaaauaccauuuugagugagaaaguacuuuuaaacaagaaa

SEQ ID NO: 614408 - RNA, 60 nt, hsa
aaaugccagucagugaugaucgcaucacaguugagugaaauggccuuccuguucagcugu

SEQ ID NO: 614409 - RNA, 60 nt, hsa
cuuuuucaaacuguccaugggaaggcugaauugagugacuccccagaaugaagaugagaa

SEQ ID NO: 614410 - RNA, 60 nt, hsa
cugguguggaagagcuccuugauauccucuuugagugaagcugggagaaccaaaaagagg

SEQ ID NO: 614411 - RNA, 60 nt, hsa
guuuauucucugccuaaaaaguggaagaaauugagugaaugacaauuuuguaauuuagga

SEQ ID NO: 614412 - RNA, 60 nt, hsa
gaagaauauagcagacguauauuguaucauuugagugaauguucccaaguaggcauucua

SEQ ID NO: 614413 - RNA, 60 nt, hsa
gguugauaccaagugcauaagauucaaacuuugagugacauuuaguccauuuaugguuga

SEQ ID NO: 614414 - RNA, 60 nt, hsa
aggaugggagggaagguuaaaguugccagcuugagugaugugcuugggugacuugggggu

SEQ ID NO: 614415 - RNA, 60 nt, hsa
uguaggcccaugggucccuuacuagagagguugagugaauuugccuucaguuaacauggg

SEQ ID NO: 614416 - RNA, 60 nt, hsa
uuacuuuguugaauuuuuuuuuuuggcauuuugagugaaauauaacuaucauuaauucuc

SEQ ID NO: 614417 - RNA, 60 nt, hsa
ccgaggccugagccgcaaugccugcccguguugagugagacuucuccauccuggauccug

SEQ ID NO: 614418 - RNA, 60 nt, hsa
gcuuaagcaacuggauggauaaugaugccauugagugagugaaaaacuugauggaagugg

SEQ ID NO: 614419 - RNA, 60 nt, hsa
gugugaagugacuuauuaaauccacagacauugagugacuucuuacaacauccacauaag

SEQ ID NO: 614420 - RNA, 60 nt, hsa
accccauuuuuauauacugaauguggccuuuugagugaaauaggaagcuucaugguguug

SEQ ID NO: 614421 - RNA, 60 nt, hsa
ggagcccucugaugugaggagggacuugaguugagugacgcuguggugugagguguucug

SEQ ID NO: 614422 - RNA, 60 nt, hsa
cuuaccauucaccucccaaagccaaggaacuugagugagcuuccuuggcaagccucccau

SEQ ID NO: 614423 - RNA, 60 nt, hsa
uuuuuaucaauaaauauuuuuauacuuacauugagugauguguuuaacaacaaauuguga

SEQ ID NO: 614424 - RNA, 60 nt, hsa
gaucugcauccaaggccuucucaggcuggcuugagugaauuguguaccugaaguacagua

SEQ ID NO: 614425 - RNA, 60 nt, hsa
cauggggaucccagcacaucacuguagaauuugagugaucuaugcugaauaaacagugga

SEQ ID NO: 614426 - RNA, 60 nt, hsa
aaauguguuuugggguggguaacuaaauuuuugagugaaauaucauaagaugagaaugga

SEQ ID NO: 614427 - RNA, 60 nt, hsa
uucuguaaauccaguugcauuuuauaauacuugagugacuaacugaauugaaaccuauua

SEQ ID NO: 614428 - RNA, 60 nt, hsa
uugcucucugguccaugaacucauuuccauuugagugaguucccuuagugaauuuugucu

SEQ ID NO: 614429 - RNA, 60 nt, hsa
gcucaucagcagagagcaacagauguuuuauugagugaagccuuaaaaagcacacaccac

SEQ ID NO: 614430 - RNA, 60 nt, hsa
gguguugugacuuauucguccugagcacaguugagugauuuauccucaccagacauuccu

SEQ ID NO: 614431 - RNA, 60 nt, hsa
uaaccuguguugcgcaaaugccgcauaaauuugagugauuguuaauguugucuuaaaauu

SEQ ID NO: 614432 - RNA, 60 nt, hsa
uuuccucuagcuuuucuauuuuugauuguguugagugaaguuuggagauuuuucauacuu

SEQ ID NO: 614433 - RNA, 60 nt, hsa
aaguuuuuucaaaaauggaguaucacaaaauugagugaaacacaauacuuaauguauugu

SEQ ID NO: 614434 - RNA, 60 nt, hsa
aaucauugaaauucauuuggggucaaagacuugagugacccaguauugagccaugaauaa

SEQ ID NO: 614435 - RNA, 60 nt, hsa
uggauuucaccucacccuuuguaccagauguugagugaccagcucuguggcccugugucg

SEQ ID NO: 614436 - RNA, 60 nt, hsa
ucuaaaauccuuaaaaauacucuaauagccuugagugaccaacuuuuuuuuuaaagcaca

SEQ ID NO: 614437 - RNA, 60 nt, hsa
agaauuuugguaccuacaacaugcuugauuuugagugauuaaaaaaaaauaauuuggcug

SEQ ID NO: 614438 - RNA, 60 nt, hsa
ccaccggcccccuccccccagacucuuuuuuugagugacagcuuucugggaugucacagu

SEQ ID NO: 614439 - RNA, 60 nt, hsa
aauuugacauuguccaaaccuuuuucauuuuugagugauuaaaaaugaaauguccuuugu

SEQ ID NO: 614440 - RNA, 60 nt, hsa
ucuuuaaagagaacuagaagaauuuuuuguuugagugauuccaggcuguaguaugaucau

SEQ ID NO: 614441 - RNA, 60 nt, hsa
agcgggcuauugugcugccuuuaauaaaauuugagugauguauacauaacauuguuuuug

SEQ ID NO: 614442 - RNA, 60 nt, hsa
uuggugaugacacguuucuuaaguaggaguuugagugaauuauuugauauauuacuuugu

SEQ ID NO: 614443 - RNA, 60 nt, hsa
uuucaaaugaauauuauuugggggauuagauugagugaaauuaaccugcuauuaaauagu

SEQ ID NO: 614444 - RNA, 60 nt, hsa
guuacauuucccaagagagucaggugacacuugagugaguuugauggauaaugagcuaau

SEQ ID NO: 614445 - RNA, 60 nt, hsa
ugugaggacaagaaugcaaauggcucuuccuugagugaaagaaauggggagucuagagcc

SEQ ID NO: 614446 - RNA, 60 nt, hsa
aggcugucuggagguguuuggaaaggcuucuugagugagguggccuuugaacugaacuua

SEQ ID NO: 614447 - RNA, 60 nt, hsa
ccaaggaguagggcacagggacaucuuucuuugagugaccgucugugcaggcccuguagu

SEQ ID NO: 614448 - RNA, 60 nt, hsa
uuucugggaguccauccagcuggaguggcuuugagugaguuacacagcuagaaggugcca

SEQ ID NO: 614449 - RNA, 60 nt, hsa
gucuuuucuguauucgcuguucaauaaacauugagugagcaccuccccagauggagcaug

SEQ ID NO: 614450 - RNA, 60 nt, hsa
aaaauuuucuuaaaauauccacaauauuccuugagugagucagaaucuauagccgguuag

SEQ ID NO: 614451 - RNA, 60 nt, hsa
ucagacagacaccucccucuggagaugcaguugagugacaaccuuguuacauuguagccu

SEQ ID NO: 614452 - RNA, 60 nt, hsa
uuuuccucaaccgagagugaauuuauguaauugagugaaagucuacgaaucauaauugua

SEQ ID NO: 614453 - RNA, 60 nt, hsa
ugggcccccuguucuuucuuucccauuaacuugagugaccugugugagagacagacagau

SEQ ID NO: 614454 - RNA, 60 nt, hsa
cuguggcaggaggcaaagaguaggguguaauugagugaaggaauccuggguagagaccau

SEQ ID NO: 614455 - RNA, 60 nt, hsa
cauucuggacuccugagaggcaguggccucuugagugaacaggggaggccaguagaugcc

SEQ ID NO: 614456 - RNA, 60 nt, hsa
gauaucauugaugugcugucacacuauauauugagugacuuucugaacaaauuuauccag

SEQ ID NO: 614457 - RNA, 60 nt, hsa
ccuuuugcacugaagauagagaccaccuuuuugagugacuugagcccaaaggcaagcgua

SEQ ID NO: 614458 - RNA, 60 nt, hsa
ccaagacccggacagagcuucagaggaguguugagugacaccugaggaugcggcugcaca

SEQ ID NO: 614459 - RNA, 60 nt, hsa
caguccugggguccgagaugcuagggacgcuugagugagggagguggugugagggccagg

SEQ ID NO: 614460 - RNA, 60 nt, hsa
ugucuguauuuuauauuugauuauuugggcuugagugaaagguagauuuauuuccauuug

SEQ ID NO: 614461 - RNA, 60 nt, hsa
cuguuggaaccuuacccagccaugaacauguugagugagcaugcuggagaaugagagacc

SEQ ID NO: 614462 - RNA, 60 nt, hsa
ugacuauuagggcuuggucuuaaaacccaauugagugauuugcaaacccagauauuguac

SEQ ID NO: 614463 - RNA, 60 nt, hsa
gugcccacguccgcccaggacccagccguguugagugaagcucuuggggccagcgugcgu

SEQ ID NO: 614464 - RNA, 60 nt, hsa
aguaaguucuagccccacccucccgccuucuugagugauaccuauuacggaugaguucug

SEQ ID NO: 614465 - RNA, 60 nt, hsa
uccucugcuuucucccugccuugauugagcuugagugauguggaauaaauuguccgucuc

SEQ ID NO: 614466 - RNA, 60 nt, hsa
uguacuaugucugaacauagaaacucgggcuugagugagaagagcuugcacagccaacga

SEQ ID NO: 614467 - RNA, 60 nt, hsa
guuaucuguauuuagcagaguauuuucaacuugagugaucugagcugaauuugaagacua

SEQ ID NO: 614468 - RNA, 60 nt, hsa
ccauguccuuagcacaggggggccgccgguuugagugaggguuucugagcugcucugaau

SEQ ID NO: 614469 - RNA, 60 nt, hsa
gagaucuucuuagcccagagagcaguggaguugagugaggaggcagauguccugucugug

SEQ ID NO: 614470 - RNA, 60 nt, hsa
gacuccaagaugaagauguggucccugcccuugagugacagcccagggacuuaauguggc

SEQ ID NO: 614471 - RNA, 60 nt, hsa
gcuguguaagaaaaagccaagagacugcuuuugagugacauuuauuuagcagcuaguaac

SEQ ID NO: 614472 - RNA, 60 nt, hsa
cuuuggcucuaccccuagaaauguccaguuuugagugacuguaguauggauggguuuucu

SEQ ID NO: 614473 - RNA, 60 nt, hsa
ucccugaggaccagaacugcucauuuuagcuugagugauggcuucagggguuggaaguuc

SEQ ID NO: 614474 - RNA, 60 nt, hsa
cugcggccuuugguuuguggcugaaagcuguugagugacucaucgccaagauuugcugua

SEQ ID NO: 614475 - RNA, 60 nt, hsa
ggagaaucgcuugaaccugggaaguggagguugagugagccgggaccgugccauuguacu

SEQ ID NO: 614476 - RNA, 60 nt, hsa
aagagauaauaaauguuuuaauuuggcaguuugagugauugggaaaaggaaucuuaaacu

SEQ ID NO: 614477 - RNA, 60 nt, hsa
gugggcugcgaggagaagcuguacuuuggcuugagugaguacagcaagucucugcagugg

SEQ ID NO: 614478 - RNA, 60 nt, hsa
accaccguguugugcucaaagagacacuacuugagugaagauuucuucuuucccuguacc

SEQ ID NO: 614479 - RNA, 60 nt, hsa
cauuuacauuuuucugguuuuuuuuuuuuuuugagugagguacgaguauuaccaaaugau

SEQ ID NO: 614480 - RNA, 60 nt, hsa
cuuucugcacuaguuuuccuuguaaaugauuugagugaguagguuugguuucugacgaaa

SEQ ID NO: 614481 - RNA, 60 nt, hsa
ugauaaucuuuacugcaaguguaaugauauuugagugaauuaaaaugcaugacagacaag

SEQ ID NO: 614482 - RNA, 60 nt, hsa
ccuuuuuggggaugagguucacaguagacuuugagugaccgucccaccgugaagugaauu

SEQ ID NO: 614483 - RNA, 60 nt, hsa
cacaugucuagcuuucaccuccaggaucuauugagugaacagaauugcaaauagucucua

SEQ ID NO: 614484 - RNA, 60 nt, hsa
gcuggcuccaggggcggcuuuuguuggaaguugagugaagcccucccccuguccucagcg

SEQ ID NO: 614485 - RNA, 60 nt, hsa
agagaggcucuuugugguuaacuuauaauauugagugaugcaugagguagguguucagaa

SEQ ID NO: 614486 - RNA, 60 nt, hsa
auggacaagcaguaaugauauuuaaauauuuugagugagggggagugggucaaagaggaa

SEQ ID NO: 614487 - RNA, 60 nt, hsa
uuggaaacccucuccucccuccuccacaccuugagugaugaccacaccaaucacuguauu

SEQ ID NO: 614488 - RNA, 60 nt, hsa
cuuuuuuuaaauagagggauugacucggauuugagugaucauuagggcugaggucuguuu

SEQ ID NO: 614489 - RNA, 60 nt, hsa
ggcccccacccaagccugcgucagcggaacuugagugaggggcguugugcaauuuguggc

SEQ ID NO: 614490 - RNA, 60 nt, hsa
guuggaaggacucauauaugcauacauuccuugagugacuaugaaugacugccgggcagu

SEQ ID NO: 614491 - RNA, 60 nt, hsa
ggugcuuuuuuguuuguguguguguguaauuugagugauuguaaauggcauugauguuug

SEQ ID NO: 614492 - RNA, 60 nt, hsa
ugaaucaggacugaaugugaaagggaaguauugagugaggacauucccaaaaccaaagga

SEQ ID NO: 614493 - RNA, 60 nt, hsa
cuucuugacauccaccaagauaccagacauuugagugaaauuuuggauccaccagaccag

SEQ ID NO: 614494 - RNA, 60 nt, hsa
acccuccccuucugguagucauaggcaggauugagugacgguugggaagggggcucagaa

SEQ ID NO: 614495 - RNA, 60 nt, hsa
gcugcuguaaacuauuuguggcugugcugcuugagugacgucucugucgugugggugcca

SEQ ID NO: 614496 - RNA, 60 nt, hsa
ucaaauaauccagaaauauaccuaauaagauugagugaaaaauuugagucaaauaucuag

SEQ ID NO: 614497 - RNA, 60 nt, hsa
guuuuaaaccccaggaacagagacuccuaguugagugauagcugggaaaguuuuacauug

SEQ ID NO: 614498 - RNA, 60 nt, hsa
ucuuucagucaaucucuuccacucuaaggauugagugagcgcgagcuggggacucucuca

SEQ ID NO: 614499 - RNA, 60 nt, hsa
aacagaagugaagaguuucagagcaucagauugagugaaaaguugucagauucuguauuu

SEQ ID NO: 614500 - RNA, 60 nt, hsa
ccugcugaaucugguacuuucugcacagccuugagugauuggaguccccuaaugacuaau

SEQ ID NO: 614501 - RNA, 60 nt, hsa
ugguguuuccaguuugauguugcugggugguugagugagugaauuuucauguggcugggu

SEQ ID NO: 614502 - RNA, 60 nt, hsa
gcgguuggccgguguuagaacucgcucucuuugagugacuggcuacaagggccugagagg

SEQ ID NO: 614503 - RNA, 60 nt, hsa
ugugaauuugcugauguucuuccaacucaguugagugauuuuaagguuuuccaaaucuuc

SEQ ID NO: 614504 - RNA, 60 nt, hsa
aagugaguugggggagggcacaggguggguuugagugaagggagagcacgguccuaaguc

SEQ ID NO: 614505 - RNA, 60 nt, hsa
gugggacgguucguuugaauggaggagguguugagugagcaacacgcagaagcucgccua

SEQ ID NO: 614506 - RNA, 60 nt, hsa
agcugggcuguuuucugucuuauuucucaguugagugagcaaggauacgaaaacagugug

SEQ ID NO: 614507 - RNA, 60 nt, hsa
uggaaagcacuugauuguacccguaaguguuugagugaugacaugugaugauuuucagaa

SEQ ID NO: 614508 - RNA, 60 nt, hsa
ccuacucugaaaugcaaaacuucuauucuguugagugaaagaauaaaauguagacaaaau

SEQ ID NO: 614509 - RNA, 60 nt, hsa
uucuaguucugauucugucacucauuggcuuugagugacauauuuuuauuuccugggccu

SEQ ID NO: 614510 - RNA, 60 nt, hsa
ugaaaacuuaucuuaaacugacccuucccuuugagugagucuucauuccucucccaugug

SEQ ID NO: 614511 - RNA, 60 nt, hsa
gguaaaaauaugaaguguuuuaguuguauguugagugauugguugguauuaucaacacug

SEQ ID NO: 614512 - RNA, 60 nt, hsa
caacuuaaaugaacaagcuuacaucccauuuugagugaagauuuugagguuuuuaauuua

SEQ ID NO: 614513 - RNA, 60 nt, hsa
uuucagggacaguagaaaguguuuuguuuuuugagugaaacaacuuauuaauaaaaaucc

SEQ ID NO: 614514 - RNA, 60 nt, hsa
ucacuuuaauuuagaagauaggugagcaacuugagugaucccaaaccaaacuaacagugc

SEQ ID NO: 614515 - RNA, 60 nt, hsa
gaaagucugucuguacugcagugggaauucuugagugaggucuuaccucuucuuuaaacc

SEQ ID NO: 614516 - RNA, 60 nt, hsa
ugugagaacuuaguaaacaagaaaauacucuugagugaaaugcaauguauuucuuuugua

SEQ ID NO: 614517 - RNA, 60 nt, hsa
cuuucagggucuuucaugaaguuccaauaguugagugaguuaaaagguuuguuucccaga

SEQ ID NO: 614518 - RNA, 60 nt, hsa
uguaaaccauuaaugaaaacuuuuucacaguugagugaaauuaaaaucacuauaucucaa

SEQ ID NO: 614519 - RNA, 60 nt, hsa
augaaaaaauucucuuaaaccacagcacuauugagugaaacauugaacucauaucuguaa

SEQ ID NO: 614520 - RNA, 60 nt, hsa
caaugacuacauuggcuguugguuauuugcuugagugagcccuugaaaaaugaacugccc

SEQ ID NO: 614521 - RNA, 60 nt, hsa
cagggggaaauggguaugagagacugaggcuugagugaacugaaggcaaacagagccaag

SEQ ID NO: 614522 - RNA, 60 nt, hsa
uaaucguuaaucuuuaguugcauucucucuuugagugauucauacauucuguuucuuuaa

SEQ ID NO: 614523 - RNA, 60 nt, hsa
ccuccaauucugaccuuacaaaagugucccuugagugaggcagugaccacgcauugucac

SEQ ID NO: 614524 - RNA, 60 nt, hsa
agcugacucagucuguucacugguugagcuuugagugaaaagauaacacaggucuauuga

SEQ ID NO: 614525 - RNA, 64 nt, hsa
cgucaggcgggacucgugucccagagaggaaggggcugcugaggucugauggggcccuuccucc

SEQ ID NO: 614526 - RNA, 64 nt, hsa
ugcguugcucccgugcugccugcgccagccccaggcugcugaggagcagaggccagaccagggc

SEQ ID NO: 614527 - RNA, 64 nt, hsa
aggcgggcccugugcugggggugguagaaaggaugcugcugaggcagcuggaggagugggagua

SEQ ID NO: 614528 - RNA, 64 nt, hsa
uuucugaaagaaguauggccaaaagcacuuuaaugcugcugacauuguuguuuuuauguucauu

SEQ ID NO: 614529 - RNA, 64 nt, hsa
cuuaaagcccaguucuugcugucuucuaccaggggcugcugacuccaguuacccauggaaugca

SEQ ID NO: 614530 - RNA, 64 nt, hsa
uaaaaacuuugaaaagugucaauauuccauguaugcugcugaaaugaaguuaaguuuggaaaga

SEQ ID NO: 614531 - RNA, 64 nt, hsa
ccuccugucucaguucuucagagagcuuccaccagcugcugaguuugugaagacaguggaguuc

SEQ ID NO: 614532 - RNA, 64 nt, hsa
guacauuuugugcuuuuagaacagggaauugauagcugcugagcugaagcaguggguucagcug

SEQ ID NO: 614533 - RNA, 64 nt, hsa
cugguaccaauuuacuguauuaguccguuuucacgcugcugauaaagacauacccgagacuggg

SEQ ID NO: 614534 - RNA, 64 nt, hsa
cuugcuucaagcaucuguauuagucuguauuaaugcugcugauaaagacguacccgagacuggg

SEQ ID NO: 614535 - RNA, 64 nt, hsa
gggacuccucucaggugcacccgcuagcugugcugcugcugaccgacggggacgugcacauccg

SEQ ID NO: 614536 - RNA, 64 nt, hsa
ugcugcggcuggagggugacucgcguaccgugcggcugcugaaggagcugcggcgggcccuggg

SEQ ID NO: 614537 - RNA, 64 nt, hsa
gggcccguggugacggccacacggacuucguggcgcugcugacagggccgaggucgcaggcggu

SEQ ID NO: 614538 - RNA, 64 nt, hsa
uccuugggccuccuggaacgccagggccucggcggcugcugaagggauucuauggcucagaggu

SEQ ID NO: 614539 - RNA, 64 nt, hsa
uuuuacuaguccaaucacccccaggaccucuucagcugcugacaauccuauuuagcauaugcaa

SEQ ID NO: 614540 - RNA, 64 nt, hsa
augcccugcggcucuggaaagcaacuucaucccagcugcugaggcgaaauauaaaacugagacu

SEQ ID NO: 614541 - RNA, 64 nt, hsa
aaaccaggagguggaacugaaucagccuggaauggcugcugagagcucagcugcaaguugcugg

SEQ ID NO: 614542 - RNA, 64 nt, hsa
uucaacaaugaaccagaggcuuggucagugugcagcugcugagcaaaaggguuagagggugggg

SEQ ID NO: 614543 - RNA, 64 nt, hsa
auuaaaauggaaguggauucuggauggccgggcugcugcugauguaggagcuggauuugggagc

SEQ ID NO: 614544 - RNA, 64 nt, hsa
acguguaggagugagaagaaggaagaucuugagagcugcugagggaccuuggagagcucaggau

SEQ ID NO: 614545 - RNA, 64 nt, hsa
aaugcugcugaagaggagggaggccucguggacugcugcugagaaaccgaguucagaccgagca

SEQ ID NO: 614546 - RNA, 64 nt, hsa
aaguaaaauuccaaggauauaugccccaacgaaugcugcugaagaggagggaggccucguggac

SEQ ID NO: 614547 - RNA, 64 nt, hsa
ugcuaauguccauaucuagccaucuauuacaccagcugcugaggauuuacuuggugcccucauc

SEQ ID NO: 614548 - RNA, 64 nt, hsa
ucucaccucccuucccucccuggcuuugggaagagcugcugagcucuuugccugccacucaggg

SEQ ID NO: 614549 - RNA, 64 nt, hsa
aagcugugcuuugucauugaauccuaaguucuuagcugcugaugcaaguugucccccaaggcca

SEQ ID NO: 614550 - RNA, 64 nt, hsa
aauuccauaacccucuguauugacugcaauguaagcugcugaggagacugguucuguuggucag

SEQ ID NO: 614551 - RNA, 64 nt, hsa
cagucguggagcgccaucaugucuuaccagugacgcugcugacaccccugacuuuuauuaaaga

SEQ ID NO: 614552 - RNA, 64 nt, hsa
caccaagcccgaccgggccaggccugggugaucugcugcugagacgccacggagggcuggggau

SEQ ID NO: 614553 - RNA, 64 nt, hsa
ggccuucugagaccaccuuccccacugagccccagcugcugagaaggccuugagggaaguagag

SEQ ID NO: 614554 - RNA, 64 nt, hsa
gucaagucagagcaccuggacagguguccucccugcugcugacccugcagagggaagggguggg

SEQ ID NO: 614555 - RNA, 64 nt, hsa; identical to SEQ ID NO: 394451

SEQ ID NO: 614556 - RNA, 64 nt, hsa; identical to SEQ ID NO: 394452

SEQ ID NO: 614557 - RNA, 64 nt, hsa; identical to SEQ ID NO: 394453

SEQ ID NO: 614558 - RNA, 64 nt, hsa; identical to SEQ ID NO: 394454

SEQ ID NO: 614559 - RNA, 64 nt, hsa; identical to SEQ ID NO: 394455

SEQ ID NO: 614560 - RNA, 64 nt, hsa; identical to SEQ ID NO: 394456

SEQ ID NO: 614561 - RNA, 64 nt, hsa; identical to SEQ ID NO: 394457

SEQ ID NO: 614562 - RNA, 64 nt, hsa; identical to SEQ ID NO: 394458

SEQ ID NO: 614563 - RNA, 64 nt, hsa; identical to SEQ ID NO: 394459

SEQ ID NO: 614564 - RNA, 64 nt, hsa; identical to SEQ ID NO: 394460

SEQ ID NO: 614565 - RNA, 64 nt, hsa; identical to SEQ ID NO: 394461

SEQ ID NO: 614566 - RNA, 64 nt, hsa; identical to SEQ ID NO: 394462

SEQ ID NO: 614567 - RNA, 64 nt, hsa; identical to SEQ ID NO: 394463

SEQ ID NO: 614568 - RNA, 64 nt, hsa; identical to SEQ ID NO: 394464

SEQ ID NO: 614569 - RNA, 64 nt, hsa; identical to SEQ ID NO: 394465

SEQ ID NO: 614570 - RNA, 64 nt, hsa; identical to SEQ ID NO: 394466

SEQ ID NO: 614571 - RNA, 64 nt, hsa; identical to SEQ ID NO: 394467

SEQ ID NO: 614572 - RNA, 64 nt, hsa; identical to SEQ ID NO: 394468

SEQ ID NO: 614573 - RNA, 64 nt, hsa; identical to SEQ ID NO: 394469

SEQ ID NO: 614574 - RNA, 64 nt, hsa; identical to SEQ ID NO: 394470

SEQ ID NO: 614575 - RNA, 64 nt, hsa; identical to SEQ ID NO: 394471

SEQ ID NO: 614576 - RNA, 64 nt, hsa; identical to SEQ ID NO: 394472

SEQ ID NO: 614577 - RNA, 64 nt, hsa; identical to SEQ ID NO: 394473

SEQ ID NO: 614578 - RNA, 64 nt, hsa; identical to SEQ ID NO: 394474

SEQ ID NO: 614579 - RNA, 64 nt, hsa; identical to SEQ ID NO: 394475

SEQ ID NO: 614580 - RNA, 64 nt, hsa; identical to SEQ ID NO: 394476

SEQ ID NO: 614581 - RNA, 64 nt, hsa; identical to SEQ ID NO: 394477

SEQ ID NO: 614582 - RNA, 64 nt, hsa; identical to SEQ ID NO: 394478

SEQ ID NO: 614583 - RNA, 64 nt, hsa; identical to SEQ ID NO: 394479

SEQ ID NO: 614584 - RNA, 64 nt, hsa; identical to SEQ ID NO: 394480

SEQ ID NO: 614585 - RNA, 64 nt, hsa; identical to SEQ ID NO: 394481

SEQ ID NO: 614586 - RNA, 64 nt, hsa; identical to SEQ ID NO: 394482

SEQ ID NO: 614587 - RNA, 64 nt, hsa; identical to SEQ ID NO: 394483

SEQ ID NO: 614588 - RNA, 64 nt, hsa; identical to SEQ ID NO: 394484

SEQ ID NO: 614589 - RNA, 64 nt, hsa; identical to SEQ ID NO: 394485

SEQ ID NO: 614590 - RNA, 64 nt, hsa; identical to SEQ ID NO: 394486

SEQ ID NO: 614591 - RNA, 64 nt, hsa; identical to SEQ ID NO: 394487

SEQ ID NO: 614592 - RNA, 64 nt, hsa; identical to SEQ ID NO: 394488

SEQ ID NO: 614593 - RNA, 64 nt, hsa; identical to SEQ ID NO: 394489

SEQ ID NO: 614594 - RNA, 64 nt, hsa; identical to SEQ ID NO: 394490

SEQ ID NO: 614595 - RNA, 64 nt, hsa
guaaguaugugaaugugcgcauuuugcauuccauaugaaaaaaaugccacgucuguuuaaauua

SEQ ID NO: 614596 - RNA, 64 nt, hsa
acuaaaagguuuuauugaaauaaagccucuuaaaaugaaaaaucauauacuuuuaacaucacuu

SEQ ID NO: 614597 - RNA, 64 nt, hsa
uuuaacaaauaaaaggcauuuaaguaaaacuaaaaugaaaaaaguaggccuucugacauugugu

SEQ ID NO: 614598 - RNA, 64 nt, hsa
uauaaacacuaacauuuuccccuucuguaguuguaugaaaaaacaaauauuguuagcauaguag

SEQ ID NO: 614599 - RNA, 64 nt, hsa
caugaaccugggcuaaugggagacuguagagaaaaugaaaaaagauccaccagaggacaucuug

SEQ ID NO: 614600 - RNA, 64 nt, hsa
uguugcuacucccauggcaaagaaaaaaaaaagaaugaaaaaaagaaaaaaauuuggaaaaaaa

SEQ ID NO: 614601 - RNA, 64 nt, hsa
augaguaagacacagugcccacccccaaguuaggaugaaaaaaguuccagagguuuuuaagaaa

SEQ ID NO: 614602 - RNA, 64 nt, hsa
ucaacacacuucacaguacaggaaauaaaguaauaugaaaaacacccugcgugaacucaacggu

SEQ ID NO: 614603 - RNA, 64 nt, hsa
uucuugaagaauuucucgcaaacucacaacccucaugaaaaauuaauccucaguuccacgagac

SEQ ID NO: 614604 - RNA, 64 nt, hsa
uuaauuuuaauuuagcaaaagagccagucauuuuaugaaaaaucaaaauuauaagugauuuuaa

SEQ ID NO: 614605 - RNA, 64 nt, hsa
uggccagucccugguguuuguaauguucuuuaauaugaaaaaguaguucuccaacucuaucaua

SEQ ID NO: 614606 - RNA, 64 nt, hsa
uaaaacaagcugagcuuugguccacuaaaacaagaugaaaaauacaagagugacucuauaacuc

SEQ ID NO: 614607 - RNA, 64 nt, hsa
acuugcuuugaaagccaaugggggaaaaaaauccaugaaaaaaaaaagauugauaaaguagaug

SEQ ID NO: 614608 - RNA, 64 nt, hsa
cauugcagcaaaguucauugaggaaaauuguaccaugaaaaagcauuuugauuauuucauuucu

SEQ ID NO: 614609 - RNA, 64 nt, hsa
uuugaaauuccauuuacaauguaguauguuuucaaugaaaaaccauaaaguaacauccaagugu

SEQ ID NO: 614610 - RNA, 64 nt, hsa
cucuggauucaucuaugucuacaauguugcauuuaugaaaaacuacacugugcuaggcgcauuc

SEQ ID NO: 614611 - RNA, 64 nt, hsa
gauagcaucaaagguugaacuuuuugagcuuucuaugaaaaaccccaggaccuucuuucuuugg

SEQ ID NO: 614612 - RNA, 64 nt, hsa
aucaacacauuagagguacaggagcggcucagucaugaaaaaagaaggucuuuugccccauuuc

SEQ ID NO: 614613 - RNA, 64 nt, hsa
aagcacaaauuuuggugaauugggauuugcagagaugaaaaagacugggugaccuggaucucug

SEQ ID NO: 614614 - RNA, 64 nt, hsa
uagagaagggggauaaagagagagaaggacuguuaugaaaaacagaagcacaaauuuuggugaa

SEQ ID NO: 614615 - RNA, 64 nt, hsa
aaaggaaucuccaguuuucaguugaucacuggcaaugaaaaauucucagucaguaauugccaaa

SEQ ID NO: 614616 - RNA, 64 nt, hsa
ucagauauuuuuucagaaauaugugguuuccacgaugaaaaacuuccaugaggccaaacguuuu

SEQ ID NO: 614617 - RNA, 64 nt, hsa
aaaguauuuauuauaguugucaacuaguaacucaaugaaaaaguugaugcccaagggagaaaug

SEQ ID NO: 614618 - RNA, 64 nt, hsa
uuccuucaacacccagaaugagccagaagacaugaugaaaaaagagaaaaagucugaagcucug

SEQ ID NO: 614619 - RNA, 64 nt, hsa
uaucugaucaaguuaucaaggagauaauucuagaaugaaaaagaaaauccucuuguuggaaaca

SEQ ID NO: 614620 - RNA, 64 nt, hsa
acaaauucuuuuaauucaacgggugcuuuacauaaugaaaaaaccacuuguggcacacgauggg

SEQ ID NO: 614621 - RNA, 64 nt, hsa
caaacagaugaaaaaaguuaacauucaguacuuuaugaaaaaaauauauuuuucccuguuugcc

SEQ ID NO: 614622 - RNA, 64 nt, hsa
aacacacuuuugcacauauauuuuuuacaaacagaugaaaaaaguuaacauucaguacuuuaug

SEQ ID NO: 614623 - RNA, 64 nt, hsa
uuguuuccugaaauaauuagagaaaagucguuuaaugaaaaagagacuguguaccuugaauucu

SEQ ID NO: 614624 - RNA, 64 nt, hsa
ucaaguuauuuuuuauucuaaaacuggucucuugaugaaaaaaauuauaagucaccugagaggc

SEQ ID NO: 614625 - RNA, 64 nt, hsa
acagaauuauauuucuauuuaguuaaaauuguuaaugaaaaacagauaaaugugcccuggucua

SEQ ID NO: 614626 - RNA, 64 nt, hsa
caaugucuacuguacugugggucauuuagaugagaugaaaaacuuaauuaaaucugaaguguca

SEQ ID NO: 614627 - RNA, 64 nt, hsa
cugcuaauagaaauuauguuuucauguguuucacaugaaaaaguauauauauacaaaguuaaua

SEQ ID NO: 614628 - RNA, 64 nt, hsa
gcuaguauguuguaaaaccugccaccugaauaaaaugaaaaaaaaaguguuuuuuugagacaga

SEQ ID NO: 614629 - RNA, 64 nt, hsa
aaauuacugucaccacuaguuuuaauauaguacaaugaaaaaauaauauauauauauauaguac

SEQ ID NO: 614630 - RNA, 64 nt, hsa
aaaaauaaaagaaacauaagauaaguaccucucaaugaaaaauguaaaaguaccuagaaauuca

SEQ ID NO: 614631 - RNA, 64 nt, hsa
cacugguuaugaaauuguauuuuuuuaaguauuaaugaaaaaagagccauaagcauuccaggag

SEQ ID NO: 614632 - RNA, 64 nt, hsa
uucaucgaaauugccugugugcacauauuuuuagaugaaaaaugaaacuaccuuacaauauuau

SEQ ID NO: 614633 - RNA, 64 nt, hsa
gaguuagucauggaauaaagcacuguccuugcagaugaaaaaagucuccagagcagacuucuga

SEQ ID NO: 614634 - RNA, 64 nt, hsa
uucaguuguuuuuggaaaaauucuagaaaucaggaugaaaaaugcagcuuuuccaggguugcug

SEQ ID NO: 614635 - RNA, 64 nt, hsa
ggcaaagucauaaauucuccacuugaaugcgcucaugaaaaauaaggccaaaacaagaguucug

SEQ ID NO: 614636 - RNA, 64 nt, hsa
caaggauuucaucagcaaucugcugaagaaagauaugaaaaaccgccuggacugcacgcagugc

SEQ ID NO: 614637 - RNA, 64 nt, hsa
agaaagaagagguauacuuauuuaaaaaacuaagaugaaaaaagugcgcagcugggaaguucac

SEQ ID NO: 614638 - RNA, 64 nt, hsa
ggacucuugcauagaaaaaaaaaucuuguuaacaaugaaaaaaugagcaaacaaaaaaaucgaa

SEQ ID NO: 614639 - RNA, 64 nt, hsa
gcucuuguaauacucauauuuaugauuguccuauaugaaaaacaacuucaguuaaaacuauaau

SEQ ID NO: 614640 - RNA, 64 nt, hsa
ggucagugugcuggcuuacacugaacugaaacucaugaaaaacccagacuggagacuggagggu

SEQ ID NO: 614641 - RNA, 64 nt, hsa
gauuuuuuuguaaauauaaagaggaacuucaauuaugaaaaauuuuuaaaagauauauauaucu

SEQ ID NO: 614642 - RNA, 64 nt, hsa
ggcaaaucacauguguuguugaugugaguaucugaugaaaaaacaaugucagaauaaccgacau

SEQ ID NO: 614643 - RNA, 64 nt, hsa
uaggagcaaucuaagcuguguuacuccaaaggacaugaaaaagcucaagaguaaaauuaaaauu

SEQ ID NO: 614644 - RNA, 64 nt, hsa
ccucgcuggagaggcuccugucugauagcgguagaugaaaaauaaggucguuaugacuuuggca

SEQ ID NO: 614645 - RNA, 56 nt, hsa
auuuauuauaucguacauaaguuaguaugaaaaacagacuaucaccuuuauugaga

SEQ ID NO: 614646 - RNA, 64 nt, hsa
ucagaaucaaaauuaagaaaguuggacugaaaauaugaaaaaugcuuaacuauuguucucuucc

SEQ ID NO: 614647 - RNA, 64 nt, hsa
cacaaguucaaucuguuuuucauguaaauuuuguaugaaaaaucaaugucaaguaccaaaaugu

SEQ ID NO: 614648 - RNA, 64 nt, hsa
uugucuuuuuuucaagaugcuuuguuucuuucauaugaaaaaaaugcauuuuauaaauucagaa

SEQ ID NO: 614649 - RNA, 64 nt, hsa
aguacuuuuuaacaacaaaauaauaauuuuaagaaugaaaaauuuaaucaucgggaagaacguc

SEQ ID NO: 614650 - RNA, 64 nt, hsa
cccaaagaauuauagauauuuuucaugaugacccaugaaaaauaucacucaucuacauaaagga

SEQ ID NO: 614651 - RNA, 64 nt, hsa
cacagaagagagaaugcaaauggccacuaaguauaugaaaaaagucguaucuuaacagugaaca

SEQ ID NO: 614652 - RNA, 64 nt, hsa
augacucagaaaaaagaagcugccaguucuuggaaugaaaaagaaauacagucuuacaccauca

SEQ ID NO: 614653 - RNA, 64 nt, hsa
ucucuagcuuaucccugcacaauuauuagagugaaugaaaaaccacuuuccugcuuuccauugu

SEQ ID NO: 614654 - RNA, 64 nt, hsa
ccuccacagcucauuucuuuguaauauaaucagaaugaaaaauaauuuaagaggacagaagacu

SEQ ID NO: 614655 - RNA, 64 nt, hsa
uuggguauccuguaauuuaguuguaacauagaaaaugaaaaaacaguuaaaaaaagugaaguag

SEQ ID NO: 614656 - RNA, 64 nt, hsa
auuuaagaaauagucuauguaaagucacaaauuaaugaaaaaaauucgcaugaaaaugacagau

SEQ ID NO: 614657 - RNA, 64 nt, hsa
auauuuucuaaaaagauaaaaaauauacauaacgaugaaaaauaauacaaauuuaaaaaccaau

SEQ ID NO: 614658 - RNA, 64 nt, hsa
augaaguguagaucauuguauucagagauuguaaaugaaaaaaauauagaaacuauuuaguuuu

SEQ ID NO: 614659 - RNA, 64 nt, hsa
uuguccuacauucauucuccugcuuguaaugaaaaugaaaaaaucauuguaacacuugauggag

SEQ ID NO: 614660 - RNA, 64 nt, hsa
cuggucaucaaaagacucgacagcaagacuuagaaugaaaaaggguacuuguuuauauuaauau

SEQ ID NO: 614661 - RNA, 64 nt, hsa
cagaccccuuggucaaugguguucuggcuuacuuaugaaaaaaucagagagaugaguggaguca

SEQ ID NO: 614662 - RNA, 64 nt, hsa
augacuuccucugacagccacacaccgaaucuugaugaaaaaagagaagagcauuugccuuguu

SEQ ID NO: 614663 - RNA, 64 nt, hsa
aauuccauauuuuagaagcuaugaaaguccuuuuaugaaaaaguuacugauugcuucucaguua

SEQ ID NO: 614664 - RNA, 64 nt, hsa
aguuguuauaccauacugguuagugaauaauuacaugaaaaaaaagagucuguacaucuucaga

SEQ ID NO: 614665 - RNA, 64 nt, hsa
uuuucaaaagaagaccuacaauuggccaacaaacaugaaaaaaugcucaguaucacuaaucauc

SEQ ID NO: 614666 - RNA, 64 nt, hsa
gaaucaaucuaagugcccaacaacaguaaauucaaugaaaaaaaaugugguacauagauacgau

SEQ ID NO: 614667 - RNA, 64 nt, hsa
aaauagaucuggugcacccgaacauuaggagaaaaugaaaaauauacaaccaaccguucgugag

SEQ ID NO: 614668 - RNA, 64 nt, hsa
gcaagggucaaaacuagauuggaucuugguuugaaugaaaaaaagcauaaaauauucuugcaau

SEQ ID NO: 614669 - RNA, 64 nt, hsa
augaucuacagugaucuuuaacauacucagaaauaugaaaaauguuugaauaugaucuuuaggg

SEQ ID NO: 614670 - RNA, 64 nt, hsa
uuauccauuuccuaugcguuuuacuccucagagaaugaaaaaaacugcaucccaucacccaaag

SEQ ID NO: 614671 - RNA, 64 nt, hsa
gaaaaugguuaccaguacagucaaaaaagagaaaaugaaaaaaauacaacuaaaaggaagaaac

SEQ ID NO: 614672 - RNA, 64 nt, hsa
uauuaauugaccacuuccuuggcccccagcuacaaugaaaaagaagaauuaugcacacaucuaa

SEQ ID NO: 614673 - RNA, 64 nt, hsa
uugaaauaggaaguauccuaguauguauuuagauaugaaaaacuuaugugcuaguguugacuuu

SEQ ID NO: 614674 - RNA, 64 nt, hsa
caucaguagaaucuauuuuggucacuucuagucaaugaaaaauguaaacuuuuaggagagaaug

SEQ ID NO: 614675 - RNA, 64 nt, hsa
auaugggaucccguguguguguguguguguuugaaugaaaaaugcuuauguauugacagaacac

SEQ ID NO: 614676 - RNA, 64 nt, hsa
cccuuauauauuuucugaaaaugaaaacaguuacaugaaaaaaauuuccaaugaagaugucagc

SEQ ID NO: 614677 - RNA, 64 nt, hsa
ugaaaaaaauuuccaaugaagaugucagcauuuuaugaaaaaccagaaguuauuagaugaaagc

SEQ ID NO: 614678 - RNA, 64 nt, hsa
gggcaacauagcaacaccccccaugucuacaaaaaugaaaaaccaaaaagcaaaccaaaagaaa

SEQ ID NO: 614679 - RNA, 64 nt, hsa
gagaugacaaaacuaaguucaggggccauggaaaaugaaaaaguccgcuauauugugauuuggg

SEQ ID NO: 614680 - RNA, 64 nt, hsa
uccucuuguuccugcuuaugcagagcucagauauaugaaaaauuuguaugcuuugaaggcugcc

SEQ ID NO: 614681 - RNA, 64 nt, hsa
aucaauuuaguuaccucccaacuaaaaaguaaaaaugaaaaagacgacauggcagaaguugaaa

SEQ ID NO: 614682 - RNA, 64 nt, hsa
ccacugacuauuuuaucaaauuugccuuaaaauaaugaaaaagaaaaguauaguuaaugguuuc

SEQ ID NO: 614683 - RNA, 64 nt, hsa
cuguuuugccuuuucacgcccuuuauagugugaaaugaaaaauuagucacuuccucacauggaa

SEQ ID NO: 614684 - RNA, 64 nt, hsa
agauuaaauuggagaaacguguuaauuguguggaaugaaaaaauacauauauuuuuggaaaagc

SEQ ID NO: 614685 - RNA, 64 nt, hsa
uguguugugugacauucaaaugucauuuuuuugaaugaaaaauacuuuccccuuuguguuuugg

SEQ ID NO: 614686 - RNA, 64 nt, hsa
auuuaaauaacacaaaauugaccacagugauuagaugaaaaaauuauuuguagauaggauaauc

SEQ ID NO: 614687 - RNA, 64 nt, hsa
guaucagugcuaaaugcucuguaugucacuacauaugaaaaaacaucaaaaaacaauuagcauu

SEQ ID NO: 614688 - RNA, 64 nt, hsa
cugaauugcaucagaucauggaugcauuuuuauuaugaaaaaauaaaaugacuuuucaaauuau

SEQ ID NO: 614689 - RNA, 64 nt, hsa
cauaacucugguguguuaacauugcaaugaaaaaaugaaaaaaagaaggaaaaaagaauaagaa

SEQ ID NO: 614690 - RNA, 64 nt, hsa
aaaaaucacauaacucugguguguuaacauugcaaugaaaaaaugaaaaaaagaaggaaaaaag

SEQ ID NO: 614691 - RNA, 64 nt, hsa
uuuugguaugcgauacagacagcuaacuuuucuuaugaaaaauacauauuugcauguaaacaau

SEQ ID NO: 614692 - RNA, 64 nt, hsa
uacagcuuacauuuccauuccauuauuacaagugaugaaaaacaaaaaauugcaaguaguaugc

SEQ ID NO: 614693 - RNA, 64 nt, hsa
auguauuccacuguuauuacuguuaccugcacaaaugaaaaacaauacucaacaguaauuccac

SEQ ID NO: 614694 - RNA, 64 nt, hsa
guugacuggaaaggaauggaaaauauaguaacacaugaaaaaaugcuacuccaaucugaaugau

SEQ ID NO: 614695 - RNA, 64 nt, hsa
uagauuuguacuuagcaaauacaaacacauccaaaugaaaaauuuuguagauaccauauccccu

SEQ ID NO: 614696 - RNA, 64 nt, hsa
gucauaucagaucguuggcaacucguaucccaagaugaaaaauaagacuuggugugaccagcca

SEQ ID NO: 614697 - RNA, 64 nt, hsa
auuuaaaugcuuuuuaucgcuaaaugacuugcagaugaaaaaaacuaaggugacucgaguguuu

SEQ ID NO: 614698 - RNA, 64 nt, hsa
aacugcuuuauuuuuauaaaacugccugacaauuaugaaaaaauguucaaauucacguucuagu

SEQ ID NO: 614699 - RNA, 64 nt, hsa
uucuuuuuuccaccuuuuuggucaguaaaacuuaaugaaaaaagcaaagaaaaaaauauucuga

SEQ ID NO: 614700 - RNA, 64 nt, hsa
ucugaaaauguauuuaacauagcuguuuuaacaaaugaaaaaaagacguagaaaaauguuuaga

SEQ ID NO: 614701 - RNA, 64 nt, hsa
agagugagacucugucucaaaaaaaaaaaaaauuaugaaaaaaguuaugggauuaaagaaaguc

SEQ ID NO: 614702 - RNA, 64 nt, hsa
aaaaagguuauggguaacuuaugguauaaaaguuaugaaaaaaggccaggugcaguggcucacg

SEQ ID NO: 614703 - RNA, 64 nt, hsa
cuauaaguaguucaaagguuuauugcuuagccauaugaaaaauaagggaagauuuuuuagcaag

SEQ ID NO: 614704 - RNA, 64 nt, hsa
gggaccagaaaccagaagaacaaucaagacugcaaugaaaaaaauggauacauuaggagcuuca

SEQ ID NO: 614705 - RNA, 64 nt, hsa
aagagaggagggaaguugugcacucugaaaaugcaugaaaaacaaaggcaaaaacuagugggaa

SEQ ID NO: 614706 - RNA, 64 nt, hsa
ccuaaacccuuaugccacauagugguaaauaauuaugaaaaauggucuguucauaauugguagg

SEQ ID NO: 614707 - RNA, 64 nt, hsa
uauaguuuugcccuuaagaagucaugauuaacuuaugaaaaaauuauuuggggacaggagugug

SEQ ID NO: 614708 - RNA, 64 nt, hsa
aggauuuuuuuuuuuuuuuaagaaaaaccuauagaugaaaaauuacuaaugaaacuguguguac

SEQ ID NO: 614709 - RNA, 64 nt, hsa
gccuaaguagauuuaggcaacggguaucauauccaugaaaaaugucauuuuaagacacuaauau

SEQ ID NO: 614710 - RNA, 64 nt, hsa
uaaaauagguguugccuauugcugugcuuauaaaaugaaaaaggaaauugaggacacuuuugca

SEQ ID NO: 614711 - RNA, 64 nt, hsa
cauauauucugcaaagugguauaauguuguauauaugaaaaacagguauauuugguuuaguucu

SEQ ID NO: 614712 - RNA, 64 nt, hsa
aauuggcaagaaaaugguacuuuccuugauuguuaugaaaaagugucauugugacaucacaggu

SEQ ID NO: 614713 - RNA, 64 nt, hsa
uauauuuuuuaaaagcugaaaauuuagaagcaagaugaaaaaaaggaaaagcaggugcuuuuua

SEQ ID NO: 614714 - RNA, 64 nt, hsa
agaauacuuuuuuuuuaagcugagaaguauagggaugaaaaagauguuauauuguguuugacua

SEQ ID NO: 614715 - RNA, 64 nt, hsa
gacuaauguguccaaucauuuuuaaaaaucauccaugaaaaagugucuugaguuguggacccau

SEQ ID NO: 614716 - RNA, 64 nt, hsa
uaaaacacaggaaaggggaauucugugauggcaaaugaaaaaaauguuaacauuugguagacau

SEQ ID NO: 614717 - RNA, 64 nt, hsa
uauuauuuuuuucuuaacagaaauauuuuuaaaaaugaaaaaguacucaaaagugagaagaguu

SEQ ID NO: 614718 - RNA, 64 nt, hsa
cuccacauuuguucuuccuuccucaggguuagugaugaaaaaaaguaaauaucuuuuucauaug

SEQ ID NO: 614719 - RNA, 64 nt, hsa
aguaaauaucuuuuucauauguccauuagaauguaugaaaaaaaucauuuuaacuaaaagcaaa

SEQ ID NO: 614720 - RNA, 64 nt, hsa
accagccugggcaacauggugaaagcucaucucuaugaaaaaauuugaauauacauauauauau

SEQ ID NO: 614721 - RNA, 64 nt, hsa
aacauuuauauaccucauucuuuaguguuguuaaaugaaaaauuaaaauuuguguuuauuauaa

SEQ ID NO: 614722 - RNA, 64 nt, hsa
ccuauucucuuaaaaaguaugugaaaagaaaauuaugaaaaaauaugcauaccuaaugaaguau

SEQ ID NO: 614723 - RNA, 64 nt, hsa
gaugacaguuuucaauguagugacacaaaagggcaugaaaaacuaacugcuagcuuuccuuuca

SEQ ID NO: 614724 - RNA, 64 nt, hsa
agaaacaauuuucuucuuccuuauuucacugaagaugaaaaaaagcuaauccaggguaccuuug

SEQ ID NO: 614725 - RNA, 64 nt, hsa
ggcacuauaauuucuguaacacacuaacaaaagcaugaaaaauaggaaccacaccaaugcaaca

SEQ ID NO: 614726 - RNA, 64 nt, hsa
cgucgcuuaauaccuaauaucauaguuguacaauaugaaaaaaaagaauaaaaaguagcaguaa

SEQ ID NO: 614727 - RNA, 64 nt, hsa
acuaaacugagugugacuauuuucacugcaacaaaugaaaaaacaaaaugugccuguuuaaagc

SEQ ID NO: 614728 - RNA, 64 nt, hsa
ugcaaauuuucuaguauaacagaaauuuuuguagaugaaaaaaaucauuauguuuagaggucua

SEQ ID NO: 614729 - RNA, 64 nt, hsa
uauauaauauagaacuaugaauauguagaauaacaugaaaaauuggaggugcuggugguauggc

SEQ ID NO: 614730 - RNA, 64 nt, hsa
aaauugaaucuuuuacuuaccucuugcaaaaaaaaugaaaaaugaaaaaacaaauucaaaaccu

SEQ ID NO: 614731 - RNA, 64 nt, hsa
aucuuuuacuuaccucuugcaaaaaaaaugaaaaaugaaaaaacaaauucaaaaccuauucaaa

SEQ ID NO: 614732 - RNA, 64 nt, hsa
ucuaaauauuuuucagugagccaagaaauucaccaugaaaaaacaagaauaacaaauagaaggg

SEQ ID NO: 614733 - RNA, 64 nt, hsa
uugucuccauauauacuaucugugccuguuaugaaugaaaaauccauccacucugcugccauuc

SEQ ID NO: 614734 - RNA, 64 nt, hsa
auauuuuucaaauagauuuuugauucagcucauuaugaaaaacaucccaaacuuuaaaaugcga

SEQ ID NO: 614735 - RNA, 64 nt, hsa
augaaauccuaugacaguaagcaaaaacagaaccaugaaaaaugauuggacauacaccuuuuca

SEQ ID NO: 614736 - RNA, 64 nt, hsa
aaaggccuuuauucugccaagucauuucgaagacaugaaaaaacucacacuggagagaaacccu

SEQ ID NO: 614737 - RNA, 64 nt, hsa
aaaggcuuuuauucucccacgucauuucaaagacaugaaaaaacucacacugcagagaaacccu

SEQ ID NO: 614738 - RNA, 64 nt, hsa
aaagcuuucagucagagacaaaaucuucuugagcaugaaaaaauucauacuggagagaaaccau

SEQ ID NO: 614739 - RNA, 64 nt, hsa
uauuguguaacauggauaguuaaaacaauguugaaugaaaaaaaucaaaauacaaaugaaacau

SEQ ID NO: 614740 - RNA, 64 nt, hsa
agcaucauucuaauaccaaaaccugacaggcacaaugaaaaaagaaaacuucaggcugguacuc

SEQ ID NO: 614741 - RNA, 64 nt, hsa
ucucaaaagaauacauacauguggcaauaagcauaugaaaaaaaugguuaauaucgcuaaucau

SEQ ID NO: 614742 - RNA, 64 nt, hsa
cauguacacauacuccuugaaccuaaaauaaaacaugaaaaaaagcaaauuucacaccuuguaa

SEQ ID NO: 614743 - RNA, 64 nt, hsa
uacaugaaucuuggccacaaugagaaaaauaaaaaugaaaaaagagcaggcauccauuuccaua

SEQ ID NO: 614744 - RNA, 64 nt, hsa
ucaaucaauguaauucaguauuuuaacaaaaggaaugaaaaauuaucaucucaauagacaaagc

SEQ ID NO: 614745 - RNA, 64 nt, hsa
guccacaggggaucugucaguuuggguccuccaaaugaaaaaugucaagacagaauuggacaug

SEQ ID NO: 614746 - RNA, 64 nt, hsa
uuuuccauauaauauuauuuaaaaugcugagaaaaugaaaaaaucuaaauggugaaauauauac

SEQ ID NO: 614747 - RNA, 64 nt, hsa
agaauauaauuugacuaucaagacuuuuagcauaaugaaaaacccucucucuauauauauaugu

SEQ ID NO: 614748 - RNA, 64 nt, hsa
uuuaagccugcuguaguugaguugcagacagugcaugaaaaaguauuccgcugggaauugagcc

SEQ ID NO: 614749 - RNA, 64 nt, hsa
aguuagacuacauaucuuuuggcacuaacaucucaugaaaaauuaugguuaauaaaauaucacc

SEQ ID NO: 614750 - RNA, 64 nt, hsa
uauuagaaugcauguaaggucuucuuguguccugaugaaaaauaugugcuugaaaugagaaacu

SEQ ID NO: 614751 - RNA, 64 nt, hsa
aacugaagaccuccacauuaaguggcuuuuuaacaugaaaaacacggcagcuguagcucccgag

SEQ ID NO: 614752 - RNA, 64 nt, hsa
uguauuuuuuuuuugguugucuucagcugacaguaugaaaaaugaaacugcugaaaaagcugag

SEQ ID NO: 614753 - RNA, 64 nt, hsa
uaugguuggucugaguaaguaacuuccugucuucaugaaaaaaguugacuuugaaucccaggua

SEQ ID NO: 614754 - RNA, 64 nt, hsa
auaaaaggcucuaauuaugguuacuuuccuugugaugaaaaacuuggccuuacagggcucuagu

SEQ ID NO: 614755 - RNA, 64 nt, hsa
uaaacaauacggaaggggagauaggugagaugauaugaaaaacaaauuuucucacugucauaaa

SEQ ID NO: 614756 - RNA, 64 nt, hsa
ucaucacuuuuugaauuucuuuggggguuauuuaaugaaaaacaugcuauguuuuguuuuaagc

SEQ ID NO: 614757 - RNA, 64 nt, hsa
ucugucuaccuuuagccaggcacaggacagcccuaugaaaaaauacccaauauauauuuuuugg

SEQ ID NO: 614758 - RNA, 64 nt, hsa
uuuucuuaguagugcagaccuuuaccccuagucuaugaaaaaacaaaccaaaauaugcucuugc

SEQ ID NO: 614759 - RNA, 64 nt, hsa
uauuacauuucauuucugaauagcuuuugaauuuaugaaaaauuauuaacaaugaaaaauuggu

SEQ ID NO: 614760 - RNA, 64 nt, hsa
gaauagcuuuugaauuuaugaaaaauuauuaacaaugaaaaauugguaauuuuauuaaguuaua

SEQ ID NO: 614761 - RNA, 64 nt, hsa
uucugucugcacaacucuucuuuuuuuaauuacaaugaaaaauuuuguguuccaaggcaacugu

SEQ ID NO: 614762 - RNA, 64 nt, hsa
aagccuaguuaucuccaguuguuuuaaggguguuaugaaaaauucuuaaaauauauaugaauuu

SEQ ID NO: 614763 - RNA, 64 nt, hsa
aaacauauaauauaggaggagucugaauguagagaugaaaaauacagaauguaauggcuucucu

SEQ ID NO: 614764 - RNA, 64 nt, hsa
accaucugaaaauucacaaaacuucuugcuucaaaugaaaaaaucccaacuauugagcauguuu

SEQ ID NO: 614765 - RNA, 64 nt, hsa
uaaaauauauuuuugacuaaauuauugauucgauaugaaaaaucaacuaagauuacacagcuuu

SEQ ID NO: 614766 - RNA, 64 nt, hsa
uaccauaauacauggcuaucaucaaaaguguauagaauauuauaguuuaaaaguauuuaguuga

SEQ ID NO: 614767 - RNA, 64 nt, hsa
uuauuccuaggcaacuauuaauaaucuauccugagaauauuaauugugguauucuggugauggg

SEQ ID NO: 614768 - RNA, 64 nt, hsa
gcuaauuauuuuaaacacuuuaauguugguauuagaauauuaucuucauaaguuaauaaauaag

SEQ ID NO: 614769 - RNA, 64 nt, hsa
ucaauaagagauuaggagccuaaaagcuauuagugaauauuaagguaguuauucacaaaaauug

SEQ ID NO: 614770 - RNA, 64 nt, hsa
uuauuaucaaggauguuuuacagggaaaucaaaagaauauuaucauacuuuaucuuucguaugc

SEQ ID NO: 614771 - RNA, 64 nt, hsa
uguuaauucaauauaaaugaccuuugauuucauggaauauuaaaguugguuuaaaguccaauag

SEQ ID NO: 614772 - RNA, 64 nt, hsa
ugugcacaguuucucgguaucucuauuggucaaagaauauuaaaucugucucugaauuacuuca

SEQ ID NO: 614773 - RNA, 64 nt, hsa
guccaggcccagcaaaaccaaaaugcuaagcaaugaauauuaaggacucucuagcugccugggc

SEQ ID NO: 614774 - RNA, 64 nt, hsa
gcugaugcuuauacaucuauucuauaacagugaugaauauuaacacaaaggaaauauggagaac

SEQ ID NO: 614775 - RNA, 64 nt, hsa
cugaacuagaugaauuggccauaauuaugaauaggaauauuaaugaaccagaggacauacuagu

SEQ ID NO: 614776 - RNA, 64 nt, hsa
gucuuaauacacucagguuugaacagauuauucugaauauuaaaauuuaauccauucuuaauau

SEQ ID NO: 614777 - RNA, 64 nt, hsa
gaccuagguauagagaucugauaacuugaauucagaauauuaagaaaaugaaguaacugauuuu

SEQ ID NO: 614778 - RNA, 64 nt, hsa
agaaggaaugaggaguuagggaagcagcauacuugaauauuagagaaggagaggagcugugggu

SEQ ID NO: 614779 - RNA, 64 nt, hsa
cauaguguagucaucuauuauuauuguuuaauuagaauauuaaacccuacccuuuaacucagca

SEQ ID NO: 614780 - RNA, 64 nt, hsa
uaagacuauaugaagguaaauuagaaauaaguaugaauauuaauaaaauagcauuuaucuuauu

SEQ ID NO: 614781 - RNA, 64 nt, hsa
aaugcuauauauaguauaugccauaguuuagaaagaauauuaaccuuucuaaacuaaauuuagg

SEQ ID NO: 614782 - RNA, 64 nt, hsa
gaauucuaugagucaaucuuuuuggcagaauucagaauauuaaaaaguucauacauuugcgggc

SEQ ID NO: 614783 - RNA, 64 nt, hsa
aagccaaaguguacgguagaaauuucuacaaaaugaauauuaucaagaguuucaugugaucacu

SEQ ID NO: 614784 - RNA, 64 nt, hsa
aauucucaaaacaucauuucaaaggcugccuacagaauauuaucacuugacagauagaguuaau

SEQ ID NO: 614785 - RNA, 64 nt, hsa
aguuucuaaauguuuuacauuguaagagcauagagaauauuaauaauggcuuauagagagagac

SEQ ID NO: 614786 - RNA, 64 nt, hsa
ucaaauuaaucuuucuauauuuuuuaaauuuacagaauauuauauaacccacugcugaaaaaga

SEQ ID NO: 614787 - RNA, 64 nt, hsa
ucauuacuaacuucuuccacuuuuuccagaauuugaauauuaacgcuaaagguguaagacuuca

SEQ ID NO: 614788 - RNA, 64 nt, hsa
uuuuuggugaaccugacuuguggcagaugguaaggaauauuauaaaacauuuggaugagaacaa

SEQ ID NO: 614789 - RNA, 64 nt, hsa
uagcuauaggcacaagaaaaacaacaguuugagagaauauuauauaagaugaugugcccuguua

SEQ ID NO: 614790 - RNA, 64 nt, hsa
cacuuaacccuuugugauaaugaugacacaaaaugaauauuaauggaggauauuccucggaaaa

SEQ ID NO: 614791 - RNA, 64 nt, hsa
acauagaauacuauugguaugugugcaauuucaugaauauuaaauuauguuucgaaguccaguu

SEQ ID NO: 614792 - RNA, 64 nt, hsa
gcagaaauaauuacugaaagugccagacacuaaggaauauuauuguuuauuauuuuaauacaua

SEQ ID NO: 614793 - RNA, 64 nt, hsa
uuuauucaagacauugaaacuacuuugcacauaugaauauuaauguaacuuguaauuuaaaagu

SEQ ID NO: 614794 - RNA, 64 nt, hsa
uugcaaaaggauguauaauauuucugucugcucagaauauuaauuuguaaauucugcaaguuua

SEQ ID NO: 614795 - RNA, 64 nt, hsa
cucuuuuaauguaauggacaaaaauaagauaugagaauauuauugaugaauuuucauaaggugg

SEQ ID NO: 614796 - RNA, 64 nt, hsa
ucuuuuacugcuaagcagccuggaaaggauaaaugaauauuagacuaagauuuguuuuccagga

SEQ ID NO: 614797 - RNA, 64 nt, hsa
caugauacauccuauggguauuaaaaagccaauagaauauuaugaauaauuuuaugcuaauaaa

SEQ ID NO: 614798 - RNA, 64 nt, hsa
aaucccacugugguauagauuccauaauaugcuugaauauuaugauauagccauuuaauaacau

SEQ ID NO: 614799 - RNA, 64 nt, hsa
guuacuaugguuugugguacaacuucauucuauagaauauuaaguggaagugggugaauucuac

SEQ ID NO: 614800 - RNA, 64 nt, hsa
ugaauauuauagaagaaugggggaagaaaggauagaauauuaaaacugcuuugcauggguuuuc

SEQ ID NO: 614801 - RNA, 64 nt, hsa
uuuuguggauuuguguauccggucaccaaacggugaauauuauagaagaaugggggaagaaagg

SEQ ID NO: 614802 - RNA, 64 nt, hsa; identical to SEQ ID NO: 210459

SEQ ID NO: 614803 - RNA, 64 nt, hsa; identical to SEQ ID NO: 210460

SEQ ID NO: 614804 - RNA, 64 nt, hsa; identical to SEQ ID NO: 210461

SEQ ID NO: 614805 - RNA, 64 nt, hsa; identical to SEQ ID NO: 210462

SEQ ID NO: 614806 - RNA, 64 nt, hsa; identical to SEQ ID NO: 210463

SEQ ID NO: 614807 - RNA, 64 nt, hsa; identical to SEQ ID NO: 210464

SEQ ID NO: 614808 - RNA, 64 nt, hsa; identical to SEQ ID NO: 210465

SEQ ID NO: 614809 - RNA, 64 nt, hsa; identical to SEQ ID NO: 210466

SEQ ID NO: 614810 - RNA, 64 nt, hsa; identical to SEQ ID NO: 210467

SEQ ID NO: 614811 - RNA, 64 nt, hsa; identical to SEQ ID NO: 210468

SEQ ID NO: 614812 - RNA, 64 nt, hsa; identical to SEQ ID NO: 210469

SEQ ID NO: 614813 - RNA, 64 nt, hsa; identical to SEQ ID NO: 210470

SEQ ID NO: 614814 - RNA, 64 nt, hsa; identical to SEQ ID NO: 210471

SEQ ID NO: 614815 - RNA, 64 nt, hsa; identical to SEQ ID NO: 210472

SEQ ID NO: 614816 - RNA, 64 nt, hsa; identical to SEQ ID NO: 210473

SEQ ID NO: 614817 - RNA, 64 nt, hsa; identical to SEQ ID NO: 210474

SEQ ID NO: 614818 - RNA, 64 nt, hsa; identical to SEQ ID NO: 210475

SEQ ID NO: 614819 - RNA, 64 nt, hsa; identical to SEQ ID NO: 210476

SEQ ID NO: 614820 - RNA, 64 nt, hsa; identical to SEQ ID NO: 210477

SEQ ID NO: 614821 - RNA, 64 nt, hsa; identical to SEQ ID NO: 210478

SEQ ID NO: 614822 - RNA, 64 nt, hsa; identical to SEQ ID NO: 210479

SEQ ID NO: 614823 - RNA, 64 nt, hsa; identical to SEQ ID NO: 210480

SEQ ID NO: 614824 - RNA, 64 nt, hsa; identical to SEQ ID NO: 210481

SEQ ID NO: 614825 - RNA, 64 nt, hsa; identical to SEQ ID NO: 210482

SEQ ID NO: 614826 - RNA, 64 nt, hsa; identical to SEQ ID NO: 210483

SEQ ID NO: 614827 - RNA, 64 nt, hsa; identical to SEQ ID NO: 210484

SEQ ID NO: 614828 - RNA, 64 nt, hsa; identical to SEQ ID NO: 210485

SEQ ID NO: 614829 - RNA, 64 nt, hsa; identical to SEQ ID NO: 210486

SEQ ID NO: 614830 - RNA, 64 nt, hsa; identical to SEQ ID NO: 210487

SEQ ID NO: 614831 - RNA, 64 nt, hsa; identical to SEQ ID NO: 210488

SEQ ID NO: 614832 - RNA, 57 nt, hsa; identical to SEQ ID NO: 210489

SEQ ID NO: 614833 - RNA, 64 nt, hsa; identical to SEQ ID NO: 210490

SEQ ID NO: 614834 - RNA, 64 nt, hsa; identical to SEQ ID NO: 210491

SEQ ID NO: 614835 - RNA, 64 nt, hsa; identical to SEQ ID NO: 210492

SEQ ID NO: 614836 - RNA, 64 nt, hsa; identical to SEQ ID NO: 210493

SEQ ID NO: 614837 - RNA, 64 nt, hsa; identical to SEQ ID NO: 210494

SEQ ID NO: 614838 - RNA, 64 nt, hsa; identical to SEQ ID NO: 210495

SEQ ID NO: 614839 - RNA, 64 nt, hsa; identical to SEQ ID NO: 210496

SEQ ID NO: 614840 - RNA, 64 nt, hsa; identical to SEQ ID NO: 210497

SEQ ID NO: 614841 - RNA, 64 nt, hsa; identical to SEQ ID NO: 210498

SEQ ID NO: 614842 - RNA, 64 nt, hsa; identical to SEQ ID NO: 210499

SEQ ID NO: 614843 - RNA, 64 nt, hsa; identical to SEQ ID NO: 210500

SEQ ID NO: 614844 - RNA, 64 nt, hsa; identical to SEQ ID NO: 210501

SEQ ID NO: 614845 - RNA, 64 nt, hsa; identical to SEQ ID NO: 210502

SEQ ID NO: 614846 - RNA, 64 nt, hsa; identical to SEQ ID NO: 210503

SEQ ID NO: 614847 - RNA, 64 nt, hsa; identical to SEQ ID NO: 210504

SEQ ID NO: 614848 - RNA, 64 nt, hsa; identical to SEQ ID NO: 210505

SEQ ID NO: 614849 - RNA, 64 nt, hsa; identical to SEQ ID NO: 210506

SEQ ID NO: 614850 - RNA, 64 nt, hsa; identical to SEQ ID NO: 210507

SEQ ID NO: 614851 - RNA, 64 nt, hsa; identical to SEQ ID NO: 210508

SEQ ID NO: 614852 - RNA, 64 nt, hsa; identical to SEQ ID NO: 210509

SEQ ID NO: 614853 - RNA, 64 nt, hsa; identical to SEQ ID NO: 210510

SEQ ID NO: 614854 - RNA, 64 nt, hsa; identical to SEQ ID NO: 210511

SEQ ID NO: 614855 - RNA, 64 nt, hsa; identical to SEQ ID NO: 210512

SEQ ID NO: 614856 - RNA, 64 nt, hsa; identical to SEQ ID NO: 210513

SEQ ID NO: 614857 - RNA, 64 nt, hsa; identical to SEQ ID NO: 210514

SEQ ID NO: 614858 - RNA, 64 nt, hsa; identical to SEQ ID NO: 210515

SEQ ID NO: 614859 - RNA, 64 nt, hsa; identical to SEQ ID NO: 210516

SEQ ID NO: 614860 - RNA, 64 nt, hsa; identical to SEQ ID NO: 210517

SEQ ID NO: 614861 - RNA, 64 nt, hsa; identical to SEQ ID NO: 210518

SEQ ID NO: 614862 - RNA, 64 nt, hsa; identical to SEQ ID NO: 210519

SEQ ID NO: 614863 - RNA, 64 nt, hsa; identical to SEQ ID NO: 210520

SEQ ID NO: 614864 - RNA, 64 nt, hsa; identical to SEQ ID NO: 210521

SEQ ID NO: 614865 - RNA, 64 nt, hsa; identical to SEQ ID NO: 210522

SEQ ID NO: 614866 - RNA, 64 nt, hsa; identical to SEQ ID NO: 210523

SEQ ID NO: 614867 - RNA, 64 nt, hsa; identical to SEQ ID NO: 210524

SEQ ID NO: 614868 - RNA, 64 nt, hsa; identical to SEQ ID NO: 210525

SEQ ID NO: 614869 - RNA, 64 nt, hsa; identical to SEQ ID NO: 210526

SEQ ID NO: 614870 - RNA, 64 nt, hsa; identical to SEQ ID NO: 210527

SEQ ID NO: 614871 - RNA, 64 nt, hsa; identical to SEQ ID NO: 210528

SEQ ID NO: 614872 - RNA, 64 nt, hsa; identical to SEQ ID NO: 210529

SEQ ID NO: 614873 - RNA, 64 nt, hsa; identical to SEQ ID NO: 210530

SEQ ID NO: 614874 - RNA, 64 nt, hsa; identical to SEQ ID NO: 210531

SEQ ID NO: 614875 - RNA, 64 nt, hsa; identical to SEQ ID NO: 210532

SEQ ID NO: 614876 - RNA, 64 nt, hsa; identical to SEQ ID NO: 210533

SEQ ID NO: 614877 - RNA, 64 nt, hsa; identical to SEQ ID NO: 210534

SEQ ID NO: 614878 - RNA, 64 nt, hsa; identical to SEQ ID NO: 210535

SEQ ID NO: 614879 - RNA, 64 nt, hsa; identical to SEQ ID NO: 210536

SEQ ID NO: 614880 - RNA, 64 nt, hsa; identical to SEQ ID NO: 210537

SEQ ID NO: 614881 - RNA, 64 nt, hsa; identical to SEQ ID NO: 210538

SEQ ID NO: 614882 - RNA, 64 nt, hsa; identical to SEQ ID NO: 210539

SEQ ID NO: 614883 - RNA, 64 nt, hsa; identical to SEQ ID NO: 210540

SEQ ID NO: 614884 - RNA, 64 nt, hsa; identical to SEQ ID NO: 210541

SEQ ID NO: 614885 - RNA, 64 nt, hsa; identical to SEQ ID NO: 210542

SEQ ID NO: 614886 - RNA, 64 nt, hsa; identical to SEQ ID NO: 210543

SEQ ID NO: 614887 - RNA, 64 nt, hsa; identical to SEQ ID NO: 210544

SEQ ID NO: 614888 - RNA, 64 nt, hsa; identical to SEQ ID NO: 210545

SEQ ID NO: 614889 - RNA, 64 nt, hsa; identical to SEQ ID NO: 210546

SEQ ID NO: 614890 - RNA, 64 nt, hsa; identical to SEQ ID NO: 210547

SEQ ID NO: 614891 - RNA, 64 nt, hsa; identical to SEQ ID NO: 210548

SEQ ID NO: 614892 - RNA, 64 nt, hsa; identical to SEQ ID NO: 210549

SEQ ID NO: 614893 - RNA, 64 nt, hsa; identical to SEQ ID NO: 210550

SEQ ID NO: 614894 - RNA, 64 nt, hsa; identical to SEQ ID NO: 210551

SEQ ID NO: 614895 - RNA, 64 nt, hsa; identical to SEQ ID NO: 210552

SEQ ID NO: 614896 - RNA, 64 nt, hsa; identical to SEQ ID NO: 210553

SEQ ID NO: 614897 - RNA, 64 nt, hsa; identical to SEQ ID NO: 210554

SEQ ID NO: 614898 - RNA, 64 nt, hsa; identical to SEQ ID NO: 210555

SEQ ID NO: 614899 - RNA, 64 nt, hsa; identical to SEQ ID NO: 210556

SEQ ID NO: 614900 - RNA, 64 nt, hsa; identical to SEQ ID NO: 210557

SEQ ID NO: 614901 - RNA, 64 nt, hsa; identical to SEQ ID NO: 210558

SEQ ID NO: 614902 - RNA, 64 nt, hsa; identical to SEQ ID NO: 210559

SEQ ID NO: 614903 - RNA, 64 nt, hsa; identical to SEQ ID NO: 210560

SEQ ID NO: 614904 - RNA, 64 nt, hsa; identical to SEQ ID NO: 210561

SEQ ID NO: 614905 - RNA, 64 nt, hsa; identical to SEQ ID NO: 210562

SEQ ID NO: 614906 - RNA, 64 nt, hsa; identical to SEQ ID NO: 210563

SEQ ID NO: 614907 - RNA, 64 nt, hsa; identical to SEQ ID NO: 210564

SEQ ID NO: 614908 - RNA, 64 nt, hsa; identical to SEQ ID NO: 210565

SEQ ID NO: 614909 - RNA, 64 nt, hsa; identical to SEQ ID NO: 210566

SEQ ID NO: 614910 - RNA, 64 nt, hsa; identical to SEQ ID NO: 210567

SEQ ID NO: 614911 - RNA, 64 nt, hsa; identical to SEQ ID NO: 210568

SEQ ID NO: 614912 - RNA, 64 nt, hsa; identical to SEQ ID NO: 210569

SEQ ID NO: 614913 - RNA, 64 nt, hsa; identical to SEQ ID NO: 210570

SEQ ID NO: 614914 - RNA, 64 nt, hsa; identical to SEQ ID NO: 210571

SEQ ID NO: 614915 - RNA, 64 nt, hsa; identical to SEQ ID NO: 210572

SEQ ID NO: 614916 - RNA, 61 nt, hsa; identical to SEQ ID NO: 210573

SEQ ID NO: 614917 - RNA, 64 nt, hsa; identical to SEQ ID NO: 210574

SEQ ID NO: 614918 - RNA, 64 nt, hsa; identical to SEQ ID NO: 210575

SEQ ID NO: 614919 - RNA, 64 nt, hsa; identical to SEQ ID NO: 210576

SEQ ID NO: 614920 - RNA, 64 nt, hsa; identical to SEQ ID NO: 210577

SEQ ID NO: 614921 - RNA, 64 nt, hsa; identical to SEQ ID NO: 210578

SEQ ID NO: 614922 - RNA, 64 nt, hsa; identical to SEQ ID NO: 210579

SEQ ID NO: 614923 - RNA, 64 nt, hsa; identical to SEQ ID NO: 210580

SEQ ID NO: 614924 - RNA, 64 nt, hsa; identical to SEQ ID NO: 210581

SEQ ID NO: 614925 - RNA, 64 nt, hsa; identical to SEQ ID NO: 210582

SEQ ID NO: 614926 - RNA, 64 nt, hsa; identical to SEQ ID NO: 210583

SEQ ID NO: 614927 - RNA, 64 nt, hsa; identical to SEQ ID NO: 210584

SEQ ID NO: 614928 - RNA, 64 nt, hsa; identical to SEQ ID NO: 210585

SEQ ID NO: 614929 - RNA, 64 nt, hsa; identical to SEQ ID NO: 210586

SEQ ID NO: 614930 - RNA, 64 nt, hsa; identical to SEQ ID NO: 210587

SEQ ID NO: 614931 - RNA, 64 nt, hsa; identical to SEQ ID NO: 210588

SEQ ID NO: 614932 - RNA, 64 nt, hsa; identical to SEQ ID NO: 210589

SEQ ID NO: 614933 - RNA, 64 nt, hsa; identical to SEQ ID NO: 210590

SEQ ID NO: 614934 - RNA, 64 nt, hsa; identical to SEQ ID NO: 210591

SEQ ID NO: 614935 - RNA, 64 nt, hsa; identical to SEQ ID NO: 210592

SEQ ID NO: 614936 - RNA, 64 nt, hsa; identical to SEQ ID NO: 210593

SEQ ID NO: 614937 - RNA, 64 nt, hsa; identical to SEQ ID NO: 210594

SEQ ID NO: 614938 - RNA, 55 nt, hsa; identical to SEQ ID NO: 210595

SEQ ID NO: 614939 - RNA, 64 nt, hsa; identical to SEQ ID NO: 210596

SEQ ID NO: 614940 - RNA, 64 nt, hsa; identical to SEQ ID NO: 210597

SEQ ID NO: 614941 - RNA, 64 nt, hsa; identical to SEQ ID NO: 210598

SEQ ID NO: 614942 - RNA, 64 nt, hsa; identical to SEQ ID NO: 210599

SEQ ID NO: 614943 - RNA, 64 nt, hsa; identical to SEQ ID NO: 210600

SEQ ID NO: 614944 - RNA, 64 nt, hsa; identical to SEQ ID NO: 210601

SEQ ID NO: 614945 - RNA, 64 nt, hsa; identical to SEQ ID NO: 210602

SEQ ID NO: 614946 - RNA, 64 nt, hsa; identical to SEQ ID NO: 210603

SEQ ID NO: 614947 - RNA, 64 nt, hsa; identical to SEQ ID NO: 210604

SEQ ID NO: 614948 - RNA, 64 nt, hsa; identical to SEQ ID NO: 210605

SEQ ID NO: 614949 - RNA, 64 nt, hsa; identical to SEQ ID NO: 210606

SEQ ID NO: 614950 - RNA, 64 nt, hsa; identical to SEQ ID NO: 210607

SEQ ID NO: 614951 - RNA, 64 nt, hsa; identical to SEQ ID NO: 210608

SEQ ID NO: 614952 - RNA, 64 nt, hsa; identical to SEQ ID NO: 210609

SEQ ID NO: 614953 - RNA, 64 nt, hsa; identical to SEQ ID NO: 210610

SEQ ID NO: 614954 - RNA, 64 nt, hsa; identical to SEQ ID NO: 210611

SEQ ID NO: 614955 - RNA, 64 nt, hsa; identical to SEQ ID NO: 210612

SEQ ID NO: 614956 - RNA, 64 nt, hsa; identical to SEQ ID NO: 210613

SEQ ID NO: 614957 - RNA, 64 nt, hsa; identical to SEQ ID NO: 210614

SEQ ID NO: 614958 - RNA, 64 nt, hsa; identical to SEQ ID NO: 210615

SEQ ID NO: 614959 - RNA, 64 nt, hsa; identical to SEQ ID NO: 210616

SEQ ID NO: 614960 - RNA, 64 nt, hsa; identical to SEQ ID NO: 210617

SEQ ID NO: 614961 - RNA, 64 nt, hsa; identical to SEQ ID NO: 210618

SEQ ID NO: 614962 - RNA, 64 nt, hsa; identical to SEQ ID NO: 210619

SEQ ID NO: 614963 - RNA, 64 nt, hsa; identical to SEQ ID NO: 210620

SEQ ID NO: 614964 - RNA, 64 nt, hsa; identical to SEQ ID NO: 210621

SEQ ID NO: 614965 - RNA, 64 nt, hsa; identical to SEQ ID NO: 210622

SEQ ID NO: 614966 - RNA, 64 nt, hsa; identical to SEQ ID NO: 210623

SEQ ID NO: 614967 - RNA, 64 nt, hsa; identical to SEQ ID NO: 210624

SEQ ID NO: 614968 - RNA, 64 nt, hsa; identical to SEQ ID NO: 210625

SEQ ID NO: 614969 - RNA, 64 nt, hsa; identical to SEQ ID NO: 210626

SEQ ID NO: 614970 - RNA, 64 nt, hsa; identical to SEQ ID NO: 210627

SEQ ID NO: 614971 - RNA, 64 nt, hsa; identical to SEQ ID NO: 210628

SEQ ID NO: 614972 - RNA, 64 nt, hsa; identical to SEQ ID NO: 210629

SEQ ID NO: 614973 - RNA, 64 nt, hsa; identical to SEQ ID NO: 210630

SEQ ID NO: 614974 - RNA, 64 nt, hsa; identical to SEQ ID NO: 210631

SEQ ID NO: 614975 - RNA, 64 nt, hsa; identical to SEQ ID NO: 210632

SEQ ID NO: 614976 - RNA, 64 nt, hsa; identical to SEQ ID NO: 210633

SEQ ID NO: 614977 - RNA, 63 nt, hsa; identical to SEQ ID NO: 210634

SEQ ID NO: 614978 - RNA, 64 nt, hsa; identical to SEQ ID NO: 210635

SEQ ID NO: 614979 - RNA, 64 nt, hsa; identical to SEQ ID NO: 210636

SEQ ID NO: 614980 - RNA, 64 nt, hsa; identical to SEQ ID NO: 210637

SEQ ID NO: 614981 - RNA, 64 nt, hsa; identical to SEQ ID NO: 210638

SEQ ID NO: 614982 - RNA, 64 nt, hsa; identical to SEQ ID NO: 210639

SEQ ID NO: 614983 - RNA, 64 nt, hsa; identical to SEQ ID NO: 210640

SEQ ID NO: 614984 - RNA, 64 nt, hsa; identical to SEQ ID NO: 210641

SEQ ID NO: 614985 - RNA, 64 nt, hsa; identical to SEQ ID NO: 210642

SEQ ID NO: 614986 - RNA, 64 nt, hsa; identical to SEQ ID NO: 210643

SEQ ID NO: 614987 - RNA, 64 nt, hsa; identical to SEQ ID NO: 210644

SEQ ID NO: 614988 - RNA, 64 nt, hsa; identical to SEQ ID NO: 210645

SEQ ID NO: 614989 - RNA, 64 nt, hsa; identical to SEQ ID NO: 210646

SEQ ID NO: 614990 - RNA, 64 nt, hsa; identical to SEQ ID NO: 210647

SEQ ID NO: 614991 - RNA, 64 nt, hsa; identical to SEQ ID NO: 210648

SEQ ID NO: 614992 - RNA, 64 nt, hsa; identical to SEQ ID NO: 210649

SEQ ID NO: 614993 - RNA, 64 nt, hsa; identical to SEQ ID NO: 210650

SEQ ID NO: 614994 - RNA, 64 nt, hsa; identical to SEQ ID NO: 210651

SEQ ID NO: 614995 - RNA, 64 nt, hsa; identical to SEQ ID NO: 210652

SEQ ID NO: 614996 - RNA, 64 nt, hsa; identical to SEQ ID NO: 210653

SEQ ID NO: 614997 - RNA, 64 nt, hsa; identical to SEQ ID NO: 210654

SEQ ID NO: 614998 - RNA, 64 nt, hsa; identical to SEQ ID NO: 210655

SEQ ID NO: 614999 - RNA, 64 nt, hsa; identical to SEQ ID NO: 210656

SEQ ID NO: 615000 - RNA, 64 nt, hsa; identical to SEQ ID NO: 210657

SEQ ID NO: 615001 - RNA, 64 nt, hsa; identical to SEQ ID NO: 210658

SEQ ID NO: 615002 - RNA, 64 nt, hsa; identical to SEQ ID NO: 210659

SEQ ID NO: 615003 - RNA, 64 nt, hsa; identical to SEQ ID NO: 210660

SEQ ID NO: 615004 - RNA, 64 nt, hsa; identical to SEQ ID NO: 210661

SEQ ID NO: 615005 - RNA, 64 nt, hsa; identical to SEQ ID NO: 210662

SEQ ID NO: 615006 - RNA, 64 nt, hsa; identical to SEQ ID NO: 210663

SEQ ID NO: 615007 - RNA, 64 nt, hsa; identical to SEQ ID NO: 210664

SEQ ID NO: 615008 - RNA, 64 nt, hsa; identical to SEQ ID NO: 210665

SEQ ID NO: 615009 - RNA, 64 nt, hsa; identical to SEQ ID NO: 210666

SEQ ID NO: 615010 - RNA, 64 nt, hsa; identical to SEQ ID NO: 210667

SEQ ID NO: 615011 - RNA, 64 nt, hsa; identical to SEQ ID NO: 210668

SEQ ID NO: 615012 - RNA, 64 nt, hsa; identical to SEQ ID NO: 210669

SEQ ID NO: 615013 - RNA, 62 nt, hsa; identical to SEQ ID NO: 210670

SEQ ID NO: 615014 - RNA, 64 nt, hsa; identical to SEQ ID NO: 210671

SEQ ID NO: 615015 - RNA, 64 nt, hsa; identical to SEQ ID NO: 210672

SEQ ID NO: 615016 - RNA, 64 nt, hsa; identical to SEQ ID NO: 210673

SEQ ID NO: 615017 - RNA, 64 nt, hsa; identical to SEQ ID NO: 210674

SEQ ID NO: 615018 - RNA, 64 nt, hsa; identical to SEQ ID NO: 210675

SEQ ID NO: 615019 - RNA, 64 nt, hsa; identical to SEQ ID NO: 210676

SEQ ID NO: 615020 - RNA, 64 nt, hsa; identical to SEQ ID NO: 210677

SEQ ID NO: 615021 - RNA, 64 nt, hsa; identical to SEQ ID NO: 210678

SEQ ID NO: 615022 - RNA, 64 nt, hsa; identical to SEQ ID NO: 210679

SEQ ID NO: 615023 - RNA, 64 nt, hsa; identical to SEQ ID NO: 210680

SEQ ID NO: 615024 - RNA, 64 nt, hsa; identical to SEQ ID NO: 210681

SEQ ID NO: 615025 - RNA, 64 nt, hsa; identical to SEQ ID NO: 210682

SEQ ID NO: 615026 - RNA, 64 nt, hsa; identical to SEQ ID NO: 210683

SEQ ID NO: 615027 - RNA, 64 nt, hsa; identical to SEQ ID NO: 210684

SEQ ID NO: 615028 - RNA, 64 nt, hsa; identical to SEQ ID NO: 210685

SEQ ID NO: 615029 - RNA, 64 nt, hsa; identical to SEQ ID NO: 210686

SEQ ID NO: 615030 - RNA, 64 nt, hsa; identical to SEQ ID NO: 210687

SEQ ID NO: 615031 - RNA, 64 nt, hsa; identical to SEQ ID NO: 210688

SEQ ID NO: 615032 - RNA, 64 nt, hsa; identical to SEQ ID NO: 210689

SEQ ID NO: 615033 - RNA, 64 nt, hsa; identical to SEQ ID NO: 210690

SEQ ID NO: 615034 - RNA, 64 nt, hsa; identical to SEQ ID NO: 210691

SEQ ID NO: 615035 - RNA, 64 nt, hsa; identical to SEQ ID NO: 210692

SEQ ID NO: 615036 - RNA, 64 nt, hsa; identical to SEQ ID NO: 210693

SEQ ID NO: 615037 - RNA, 64 nt, hsa; identical to SEQ ID NO: 210694

SEQ ID NO: 615038 - RNA, 64 nt, hsa; identical to SEQ ID NO: 210695

SEQ ID NO: 615039 - RNA, 64 nt, hsa; identical to SEQ ID NO: 210696

SEQ ID NO: 615040 - RNA, 64 nt, hsa; identical to SEQ ID NO: 210697

SEQ ID NO: 615041 - RNA, 64 nt, hsa; identical to SEQ ID NO: 210698

SEQ ID NO: 615042 - RNA, 64 nt, hsa; identical to SEQ ID NO: 210699

SEQ ID NO: 615043 - RNA, 64 nt, hsa; identical to SEQ ID NO: 210700

SEQ ID NO: 615044 - RNA, 64 nt, hsa; identical to SEQ ID NO: 210701

SEQ ID NO: 615045 - RNA, 64 nt, hsa; identical to SEQ ID NO: 210702

SEQ ID NO: 615046 - RNA, 64 nt, hsa; identical to SEQ ID NO: 210703

SEQ ID NO: 615047 - RNA, 64 nt, hsa; identical to SEQ ID NO: 210704

SEQ ID NO: 615048 - RNA, 64 nt, hsa; identical to SEQ ID NO: 210705

SEQ ID NO: 615049 - RNA, 64 nt, hsa; identical to SEQ ID NO: 210706

SEQ ID NO: 615050 - RNA, 64 nt, hsa; identical to SEQ ID NO: 210707

SEQ ID NO: 615051 - RNA, 64 nt, hsa; identical to SEQ ID NO: 210708

SEQ ID NO: 615052 - RNA, 64 nt, hsa; identical to SEQ ID NO: 210709

SEQ ID NO: 615053 - RNA, 64 nt, hsa; identical to SEQ ID NO: 210710

SEQ ID NO: 615054 - RNA, 64 nt, hsa; identical to SEQ ID NO: 210711

SEQ ID NO: 615055 - RNA, 64 nt, hsa; identical to SEQ ID NO: 210712

SEQ ID NO: 615056 - RNA, 64 nt, hsa; identical to SEQ ID NO: 210713

SEQ ID NO: 615057 - RNA, 64 nt, hsa; identical to SEQ ID NO: 210714

SEQ ID NO: 615058 - RNA, 64 nt, hsa; identical to SEQ ID NO: 210715

SEQ ID NO: 615059 - RNA, 64 nt, hsa; identical to SEQ ID NO: 210716

SEQ ID NO: 615060 - RNA, 64 nt, hsa; identical to SEQ ID NO: 210717

SEQ ID NO: 615061 - RNA, 64 nt, hsa; identical to SEQ ID NO: 210718

SEQ ID NO: 615062 - RNA, 64 nt, hsa; identical to SEQ ID NO: 210719

SEQ ID NO: 615063 - RNA, 64 nt, hsa; identical to SEQ ID NO: 210720

SEQ ID NO: 615064 - RNA, 64 nt, hsa; identical to SEQ ID NO: 210721

SEQ ID NO: 615065 - RNA, 64 nt, hsa; identical to SEQ ID NO: 210722

SEQ ID NO: 615066 - RNA, 64 nt, hsa; identical to SEQ ID NO: 210723

SEQ ID NO: 615067 - RNA, 64 nt, hsa; identical to SEQ ID NO: 210724

SEQ ID NO: 615068 - RNA, 64 nt, hsa; identical to SEQ ID NO: 210725

SEQ ID NO: 615069 - RNA, 64 nt, hsa; identical to SEQ ID NO: 210726

SEQ ID NO: 615070 - RNA, 64 nt, hsa; identical to SEQ ID NO: 210727

SEQ ID NO: 615071 - RNA, 64 nt, hsa; identical to SEQ ID NO: 351043

SEQ ID NO: 615072 - RNA, 64 nt, hsa; identical to SEQ ID NO: 351044

SEQ ID NO: 615073 - RNA, 64 nt, hsa; identical to SEQ ID NO: 351045

SEQ ID NO: 615074 - RNA, 64 nt, hsa; identical to SEQ ID NO: 351046

SEQ ID NO: 615075 - RNA, 64 nt, hsa; identical to SEQ ID NO: 351047

SEQ ID NO: 615076 - RNA, 64 nt, hsa; identical to SEQ ID NO: 351048

SEQ ID NO: 615077 - RNA, 64 nt, hsa; identical to SEQ ID NO: 351049

SEQ ID NO: 615078 - RNA, 64 nt, hsa; identical to SEQ ID NO: 351050

SEQ ID NO: 615079 - RNA, 64 nt, hsa; identical to SEQ ID NO: 351051

SEQ ID NO: 615080 - RNA, 64 nt, hsa; identical to SEQ ID NO: 351052

SEQ ID NO: 615081 - RNA, 64 nt, hsa; identical to SEQ ID NO: 351053

SEQ ID NO: 615082 - RNA, 64 nt, hsa; identical to SEQ ID NO: 351054

SEQ ID NO: 615083 - RNA, 64 nt, hsa; identical to SEQ ID NO: 351055

SEQ ID NO: 615084 - RNA, 50 nt, hsa; identical to SEQ ID NO: 351056

SEQ ID NO: 615085 - RNA, 64 nt, hsa; identical to SEQ ID NO: 351057

SEQ ID NO: 615086 - RNA, 64 nt, hsa; identical to SEQ ID NO: 351058

SEQ ID NO: 615087 - RNA, 64 nt, hsa; identical to SEQ ID NO: 351059

SEQ ID NO: 615088 - RNA, 64 nt, hsa; identical to SEQ ID NO: 351060

SEQ ID NO: 615089 - RNA, 64 nt, hsa; identical to SEQ ID NO: 351061

SEQ ID NO: 615090 - RNA, 64 nt, hsa; identical to SEQ ID NO: 351062

SEQ ID NO: 615091 - RNA, 64 nt, hsa; identical to SEQ ID NO: 351063

SEQ ID NO: 615092 - RNA, 64 nt, hsa; identical to SEQ ID NO: 351064

SEQ ID NO: 615093 - RNA, 64 nt, hsa
uaagguacuucucccucagggacguagaacaauggaaugucagucagucucuguaguuaaaacu

SEQ ID NO: 615094 - RNA, 64 nt, hsa; identical to SEQ ID NO: 615093

SEQ ID NO: 615095 - RNA, 64 nt, hsa
cugcaguuuacaauuuuuguucuucuccuguaaagaaugucaaugguuaucaccuucaauaguu

SEQ ID NO: 615096 - RNA, 64 nt, hsa
uaggguuuuuuauuugcaguuuaggaacuauuaggaaugucaggacuuuaucagcagggguaaa

SEQ ID NO: 615097 - RNA, 64 nt, hsa
auauuuauuaggcuauuucaaagccacagcauaagaaugucagccuagccacagagucugagau

SEQ ID NO: 615098 - RNA, 62 nt, hsa
augugcuucugaaauauauuuugagauagguuuagaaugucaaaaaaaaggaauuagcuaga

SEQ ID NO: 615099 - RNA, 64 nt, hsa
ggcgauguuggcugauuugggucugccauugacagaaugucaaauaaaaaggaauuagcuagaa

SEQ ID NO: 615100 - RNA, 64 nt, hsa
aaugaagcagaauuuaaguugguaauauuaaggugaaugucauuuaagggaguuacaucuuuau

SEQ ID NO: 615101 - RNA, 64 nt, hsa
accuuacuuuuccucauucuuaauaggugucuaagaaugucagggcaaaaguaugggcauuuuu

SEQ ID NO: 615102 - RNA, 64 nt, hsa
uauuuucuaaaucauuuuuaagggaaugaaacaggaaugucaucagagauuuuuuaguacaggc

SEQ ID NO: 615103 - RNA, 64 nt, hsa
auucuauggacccaagucuaugcucaguuccacagaaugucaggaccaaauaacuucacagcua

SEQ ID NO: 615104 - RNA, 64 nt, hsa
agcccuccaaagauaccauucaaauaaccugggagaaugucauaaauuauucagauaauuaaca

SEQ ID NO: 615105 - RNA, 64 nt, hsa
ucguggguauuaggaaagccuguauucuuucaaugaaugucaguaggaccuuccuuuagcugua

SEQ ID NO: 615106 - RNA, 64 nt, hsa
auguguacaaacugcagugcaaucuacuguuggugaaugucaguguauuaucaggaaacauguc

SEQ ID NO: 615107 - RNA, 64 nt, hsa
uauggauuaaaucacauacuggcauauuuaagcugaaugucaaucuggaaaauaaauugacugu

SEQ ID NO: 615108 - RNA, 64 nt, hsa
uguggauuaaaucacauacuggcauauuuaagcugaaugucaaucuggaaaauaaauugacugu

SEQ ID NO: 615109 - RNA, 64 nt, hsa; identical to SEQ ID NO: 615106

SEQ ID NO: 615110 - RNA, 64 nt, hsa
acaccagagaauucacacuggugagaaacccuuugaaugucaggaauguaggaaggccuuuagg

SEQ ID NO: 615111 - RNA, 64 nt, hsa
aacacuauagaacucauacuaaugagaaaccuaugaaugucaggaaugcagcaaggccuuuaag

SEQ ID NO: 615112 - RNA, 64 nt, hsa
agagccaaggaguagugaguuguagauaaaaaaagaaugucagcuuuggagacagucuggguuu

SEQ ID NO: 615113 - RNA, 64 nt, hsa
cacaugaaauaccaaaugucacagcauuauuacugaaugucagucauuuccccuacuugaucug

SEQ ID NO: 615114 - RNA, 64 nt, hsa
aauugauucuuagugacacagaagauugccuuacgcucgugagcgugagaagccauaagagaga

SEQ ID NO: 615115 - RNA, 64 nt, hsa
ggcccugggacaaagacccagaauagaacucguagcucgugacugcacgguuuacgccacaaaa

SEQ ID NO: 615116 - RNA, 64 nt, hsa
gagccuugccgcacugccuuguggguggcuuggcgcucgugauugcuuccugugaacgccuccc

SEQ ID NO: 615117 - RNA, 64 nt, hsa
augugcuuugcuucauucuguacauagcucuuuggcucgugaaccuaauuguaaacuuucaggu

SEQ ID NO: 615118 - RNA, 64 nt, hsa
ucaacaucaagcugggguuugacacccuucaugggcucgugagcacacucagugcccagcccag

SEQ ID NO: 615119 - RNA, 64 nt, hsa
guuaaaacaaaucacaaaaggaaaacuaauguuagcucgugaaaaaaaaugcuguugaaauaaa

SEQ ID NO: 615120 - RNA, 64 nt, hsa
agcaccuuugaaauguacguggaaaacgucggcugcucgugagaaucaugugugacuuacguuc

SEQ ID NO: 615121 - RNA, 64 nt, hsa
ugcgaguguuugggggccacggagagaagggagagcucgugagaugggaagaaguuuccgcugg

SEQ ID NO: 615122 - RNA, 64 nt, hsa
ccgaguggacagcccagggugcagcucugcccgggcucgugaagccucagauguccccaaucca

SEQ ID NO: 615123 - RNA, 64 nt, hsa
cauucuuucuggaccuuaaaugguagaggaaaaggcucgugagccauuuguuucuuuugcuggu

SEQ ID NO: 615124 - RNA, 64 nt, hsa
cugggggccggagggcaggcaaggccuggggggugcucgugauaugugcucaagccaguugugg

SEQ ID NO: 615125 - RNA, 64 nt, hsa
guccugccagagcauggaugaaguuucgcugggugcucgugacuggccaguuuugugcagcuga

SEQ ID NO: 615126 - RNA, 64 nt, hsa
aaguuugaucccaggaacuugaguucuaagcagugcucgugaaaaaaaaaagcagaaagaauua

SEQ ID NO: 615127 - RNA, 64 nt, hsa
cuuggcucucaggaacucugcuuccuggcccagcgcucgugaccaaggauacaccaaagcccuu

SEQ ID NO: 615128 - RNA, 64 nt, hsa
ugugcccagccaggccuccagcacccccagugcagcucgugauuggaaacucaccaucggcagg

SEQ ID NO: 615129 - RNA, 64 nt, hsa
aguucucccauccugggacggcggcaguauugaagcucgugacaagugccuucacacagacccc

SEQ ID NO: 615130 - RNA, 64 nt, hsa
cacccgcuccacccuuuuuaaaccccccagcccugcucgugagauugggcuggguagggacaga

SEQ ID NO: 615131 - RNA, 64 nt, hsa
ggagauccagcccugccuggcagagagccgggcugcucgugagaaagagagcuucaaccucaag

SEQ ID NO: 615132 - RNA, 64 nt, hsa
gccgugaucaagggaauguaacugcugaaaacuagcucgugauuggcauauaauggaguuaacg

SEQ ID NO: 615133 - RNA, 64 nt, hsa
caccucccuccccuggggccgccaccccuucugggcucgugaugguggagcuaagguccaggcc

SEQ ID NO: 615134 - RNA, 64 nt, hsa
uaaucacuccaguuugcuuucuagguccucaagugcucgugacacauaaucauuccauccaaug

SEQ ID NO: 615135 - RNA, 64 nt, hsa
ccgagccucgccagacccccagggggccucugacgcucgugaccaccaccucccucaaaccuug

SEQ ID NO: 615136 - RNA, 64 nt, hsa
gcugaagagggaagacccaaggcuggguggcguggcucgugaauccacuuagaauucuuggcuu

SEQ ID NO: 615137 - RNA, 64 nt, hsa
ccagcacaagagccgugagcuuggcacaugugcugcucgugagcaggaaaaucagaggagccac

SEQ ID NO: 615138 - RNA, 64 nt, hsa
caccguauuagccaggauggucuugaucuccugagcucgugaucugcccgccucggccucccaa

SEQ ID NO: 615139 - RNA, 64 nt, hsa
acaggaguuugugugcaacagaguccuguagcuagcucgugacuacauugaaacuugaguuugu

SEQ ID NO: 615140 - RNA, 64 nt, hsa
ugccggcuucucaucgucagggagcccgcccagagcucgugacgagcaagugcuggguccccgc

SEQ ID NO: 615141 - RNA, 64 nt, hsa
gcuccaggcugacaccagcagaguccugcauggggcucgugaggaugaaucucuacacucacug

SEQ ID NO: 615142 - RNA, 64 nt, hsa
gauaguccauaauguucugcuaaauuucaaaugggcucgugacccaaaaaagucaagaaccaca

SEQ ID NO: 615143 - RNA, 64 nt, hsa
gaagaaauagucucccuucaauuaagaaauuuucauaauggaaugauuuaaauugaagugacaa

SEQ ID NO: 615144 - RNA, 64 nt, hsa
cuaguuagcugucuguugucuguagcccagcuugauaauggaacuauacagcgaagagacaauc

SEQ ID NO: 615145 - RNA, 64 nt, hsa
uggcaggcaggcacucaagaaaugaauuaacuacauaauggaaaaguaugguuuaaugugucca

SEQ ID NO: 615146 - RNA, 64 nt, hsa
uuauuaauaucaaauucacuuaugaauaaacuugauaauggaaacggacaaaaaaaaucaagug

SEQ ID NO: 615147 - RNA, 64 nt, hsa
accucuuccaacccuccauuagcucaauuuugagauaauggaaaauugacuggaaauucaaaac

SEQ ID NO: 615148 - RNA, 64 nt, hsa
uuucaguauuuugagaauugccauauuaauuuuuauaauggaaaacuuaauaaauugcuacugu

SEQ ID NO: 615149 - RNA, 64 nt, hsa
uaaauucucaauuucacuucaaauuagagaauccauaauggacuagaauauaaauuacaaacac

SEQ ID NO: 615150 - RNA, 64 nt, hsa
auuugcaaugacacaugaauuuaauuuuauaaauauaauggaaaacagauuuuucaucauauca

SEQ ID NO: 615151 - RNA, 64 nt, hsa
gugccuuaucugaguuuucgguauaaauauguagauaauggauuuuuuuuuuuuagauaauguu

SEQ ID NO: 615152 - RNA, 64 nt, hsa
cauguacagaaagaauuuuugguguaaauuuguaauaauggauaauucuuuuacauauuguuua

SEQ ID NO: 615153 - RNA, 64 nt, hsa
caggcuuuuggacuuuguauuaccuguauguuuuauaauggaucaugcauaauuucucaggaga

SEQ ID NO: 615154 - RNA, 64 nt, hsa
augaguugggaaaagagguggcauuucugaucggauaauggaauacucucauuuauuuuaugac

SEQ ID NO: 615155 - RNA, 64 nt, hsa
aaaagaaagcaauuacuacugcuaaaugugggaaauaauggacuagaccuguacuaauauaugg

SEQ ID NO: 615156 - RNA, 64 nt, hsa
auauuagaaaaacuauuguguaacacauaaugaaauaauggaucuaggcaugauucucuguaca

SEQ ID NO: 615157 - RNA, 64 nt, hsa
uuaaugugacuuaggugcugucaacauuagcaagauaauggaaaucacgacgccagugggugcu

SEQ ID NO: 615158 - RNA, 64 nt, hsa
uccuggugaguguuucuccugugcuugguuguguauaauggagcuaacuccuaagcgguggggu

SEQ ID NO: 615159 - RNA, 64 nt, hsa
gugacugugaagccugcuguucccugaaaaucugauaauggagcaguggagguuuuuuucuuuc

SEQ ID NO: 615160 - RNA, 64 nt, hsa
uccccauccuugcuaugccuuucuguccucuuuuauaauggauauaucuuuuuccugccauuau

SEQ ID NO: 615161 - RNA, 64 nt, hsa; identical to SEQ ID NO: 264240

SEQ ID NO: 615162 - RNA, 64 nt, hsa; identical to SEQ ID NO: 264241

SEQ ID NO: 615163 - RNA, 64 nt, hsa; identical to SEQ ID NO: 264242

SEQ ID NO: 615164 - RNA, 64 nt, hsa; identical to SEQ ID NO: 264243

SEQ ID NO: 615165 - RNA, 64 nt, hsa; identical to SEQ ID NO: 264244

SEQ ID NO: 615166 - RNA, 64 nt, hsa; identical to SEQ ID NO: 264245

SEQ ID NO: 615167 - RNA, 64 nt, hsa; identical to SEQ ID NO: 264246

SEQ ID NO: 615168 - RNA, 64 nt, hsa; identical to SEQ ID NO: 264247

SEQ ID NO: 615169 - RNA, 64 nt, hsa; identical to SEQ ID NO: 264248

SEQ ID NO: 615170 - RNA, 64 nt, hsa; identical to SEQ ID NO: 264249

SEQ ID NO: 615171 - RNA, 64 nt, hsa; identical to SEQ ID NO: 264250

SEQ ID NO: 615172 - RNA, 64 nt, hsa; identical to SEQ ID NO: 264251

SEQ ID NO: 615173 - RNA, 64 nt, hsa; identical to SEQ ID NO: 264252

SEQ ID NO: 615174 - RNA, 64 nt, hsa; identical to SEQ ID NO: 264253

SEQ ID NO: 615175 - RNA, 64 nt, hsa; identical to SEQ ID NO: 264254

SEQ ID NO: 615176 - RNA, 64 nt, hsa; identical to SEQ ID NO: 264255

SEQ ID NO: 615177 - RNA, 50 nt, hsa; identical to SEQ ID NO: 264256

SEQ ID NO: 615178 - RNA, 64 nt, hsa; identical to SEQ ID NO: 264257

SEQ ID NO: 615179 - RNA, 64 nt, hsa; identical to SEQ ID NO: 264258

SEQ ID NO: 615180 - RNA, 64 nt, hsa; identical to SEQ ID NO: 264259

SEQ ID NO: 615181 - RNA, 64 nt, hsa; identical to SEQ ID NO: 264260

SEQ ID NO: 615182 - RNA, 64 nt, hsa; identical to SEQ ID NO: 264261

SEQ ID NO: 615183 - RNA, 64 nt, hsa; identical to SEQ ID NO: 264262

SEQ ID NO: 615184 - RNA, 64 nt, hsa; identical to SEQ ID NO: 264263

SEQ ID NO: 615185 - RNA, 64 nt, hsa; identical to SEQ ID NO: 264264

SEQ ID NO: 615186 - RNA, 64 nt, hsa; identical to SEQ ID NO: 264265

SEQ ID NO: 615187 - RNA, 64 nt, hsa; identical to SEQ ID NO: 264266

SEQ ID NO: 615188 - RNA, 64 nt, hsa; identical to SEQ ID NO: 264267

SEQ ID NO: 615189 - RNA, 64 nt, hsa; identical to SEQ ID NO: 264268

SEQ ID NO: 615190 - RNA, 64 nt, hsa; identical to SEQ ID NO: 264269

SEQ ID NO: 615191 - RNA, 64 nt, hsa; identical to SEQ ID NO: 264270

SEQ ID NO: 615192 - RNA, 64 nt, hsa; identical to SEQ ID NO: 264271

SEQ ID NO: 615193 - RNA, 64 nt, hsa; identical to SEQ ID NO: 264272

SEQ ID NO: 615194 - RNA, 64 nt, hsa; identical to SEQ ID NO: 264273

SEQ ID NO: 615195 - RNA, 64 nt, hsa; identical to SEQ ID NO: 112183

SEQ ID NO: 615196 - RNA, 64 nt, hsa; identical to SEQ ID NO: 112184

SEQ ID NO: 615197 - RNA, 64 nt, hsa; identical to SEQ ID NO: 112185

SEQ ID NO: 615198 - RNA, 64 nt, hsa; identical to SEQ ID NO: 112186

SEQ ID NO: 615199 - RNA, 64 nt, hsa; identical to SEQ ID NO: 112187

SEQ ID NO: 615200 - RNA, 64 nt, hsa; identical to SEQ ID NO: 112188

SEQ ID NO: 615201 - RNA, 64 nt, hsa; identical to SEQ ID NO: 112189

SEQ ID NO: 615202 - RNA, 64 nt, hsa; identical to SEQ ID NO: 112190

SEQ ID NO: 615203 - RNA, 64 nt, hsa; identical to SEQ ID NO: 112191

SEQ ID NO: 615204 - RNA, 64 nt, hsa; identical to SEQ ID NO: 112192

SEQ ID NO: 615205 - RNA, 64 nt, hsa; identical to SEQ ID NO: 112193

SEQ ID NO: 615206 - RNA, 64 nt, hsa; identical to SEQ ID NO: 112194

SEQ ID NO: 615207 - RNA, 64 nt, hsa; identical to SEQ ID NO: 112195

SEQ ID NO: 615208 - RNA, 64 nt, hsa; identical to SEQ ID NO: 112196

SEQ ID NO: 615209 - RNA, 64 nt, hsa; identical to SEQ ID NO: 112197

SEQ ID NO: 615210 - RNA, 64 nt, hsa; identical to SEQ ID NO: 112198

SEQ ID NO: 615211 - RNA, 64 nt, hsa; identical to SEQ ID NO: 112199

SEQ ID NO: 615212 - RNA, 64 nt, hsa; identical to SEQ ID NO: 112200

SEQ ID NO: 615213 - RNA, 64 nt, hsa; identical to SEQ ID NO: 112201

SEQ ID NO: 615214 - RNA, 64 nt, hsa; identical to SEQ ID NO: 112202

SEQ ID NO: 615215 - RNA, 64 nt, hsa; identical to SEQ ID NO: 112203

SEQ ID NO: 615216 - RNA, 64 nt, hsa; identical to SEQ ID NO: 112204

SEQ ID NO: 615217 - RNA, 64 nt, hsa; identical to SEQ ID NO: 112205

SEQ ID NO: 615218 - RNA, 64 nt, hsa; identical to SEQ ID NO: 112206

SEQ ID NO: 615219 - RNA, 64 nt, hsa; identical to SEQ ID NO: 112207

SEQ ID NO: 615220 - RNA, 64 nt, hsa; identical to SEQ ID NO: 112208

SEQ ID NO: 615221 - RNA, 64 nt, hsa; identical to SEQ ID NO: 112209

SEQ ID NO: 615222 - RNA, 64 nt, hsa; identical to SEQ ID NO: 112210

SEQ ID NO: 615223 - RNA, 64 nt, hsa; identical to SEQ ID NO: 112211

SEQ ID NO: 615224 - RNA, 64 nt, hsa; identical to SEQ ID NO: 112212

SEQ ID NO: 615225 - RNA, 64 nt, hsa; identical to SEQ ID NO: 112213

SEQ ID NO: 615226 - RNA, 64 nt, hsa; identical to SEQ ID NO: 112214

SEQ ID NO: 615227 - RNA, 64 nt, hsa; identical to SEQ ID NO: 112215

SEQ ID NO: 615228 - RNA, 64 nt, hsa; identical to SEQ ID NO: 112216

SEQ ID NO: 615229 - RNA, 64 nt, hsa; identical to SEQ ID NO: 112217

SEQ ID NO: 615230 - RNA, 64 nt, hsa; identical to SEQ ID NO: 112218

SEQ ID NO: 615231 - RNA, 64 nt, hsa; identical to SEQ ID NO: 112219

SEQ ID NO: 615232 - RNA, 64 nt, hsa; identical to SEQ ID NO: 112220

SEQ ID NO: 615233 - RNA, 64 nt, hsa; identical to SEQ ID NO: 112221

SEQ ID NO: 615234 - RNA, 64 nt, hsa; identical to SEQ ID NO: 112222

SEQ ID NO: 615235 - RNA, 64 nt, hsa; identical to SEQ ID NO: 112223

SEQ ID NO: 615236 - RNA, 64 nt, hsa; identical to SEQ ID NO: 112224

SEQ ID NO: 615237 - RNA, 64 nt, hsa; identical to SEQ ID NO: 112225

SEQ ID NO: 615238 - RNA, 64 nt, hsa; identical to SEQ ID NO: 112226

SEQ ID NO: 615239 - RNA, 64 nt, hsa; identical to SEQ ID NO: 112227

SEQ ID NO: 615240 - RNA, 64 nt, hsa; identical to SEQ ID NO: 112228

SEQ ID NO: 615241 - RNA, 64 nt, hsa; identical to SEQ ID NO: 112229

SEQ ID NO: 615242 - RNA, 64 nt, hsa; identical to SEQ ID NO: 532503

SEQ ID NO: 615243 - RNA, 64 nt, hsa; identical to SEQ ID NO: 532504

SEQ ID NO: 615244 - RNA, 64 nt, hsa; identical to SEQ ID NO: 532505

SEQ ID NO: 615245 - RNA, 64 nt, hsa; identical to SEQ ID NO: 532506

SEQ ID NO: 615246 - RNA, 64 nt, hsa; identical to SEQ ID NO: 532507

SEQ ID NO: 615247 - RNA, 64 nt, hsa; identical to SEQ ID NO: 532508

SEQ ID NO: 615248 - RNA, 64 nt, hsa; identical to SEQ ID NO: 532509

SEQ ID NO: 615249 - RNA, 64 nt, hsa; identical to SEQ ID NO: 532510

SEQ ID NO: 615250 - RNA, 64 nt, hsa; identical to SEQ ID NO: 532511

SEQ ID NO: 615251 - RNA, 54 nt, hsa; identical to SEQ ID NO: 532512

SEQ ID NO: 615252 - RNA, 61 nt, hsa; identical to SEQ ID NO: 532513

SEQ ID NO: 615253 - RNA, 64 nt, hsa; identical to SEQ ID NO: 532514

SEQ ID NO: 615254 - RNA, 64 nt, hsa; identical to SEQ ID NO: 532515

SEQ ID NO: 615255 - RNA, 64 nt, hsa; identical to SEQ ID NO: 532516

SEQ ID NO: 615256 - RNA, 64 nt, hsa; identical to SEQ ID NO: 378074

SEQ ID NO: 615257 - RNA, 64 nt, hsa; identical to SEQ ID NO: 378075

SEQ ID NO: 615258 - RNA, 64 nt, hsa; identical to SEQ ID NO: 378076

SEQ ID NO: 615259 - RNA, 64 nt, hsa; identical to SEQ ID NO: 378077

SEQ ID NO: 615260 - RNA, 64 nt, hsa; identical to SEQ ID NO: 378078

SEQ ID NO: 615261 - RNA, 64 nt, hsa; identical to SEQ ID NO: 378079

SEQ ID NO: 615262 - RNA, 64 nt, hsa
auguuuuaauaaucuguauuucuuauaauuuuaacacuaugagcugccuguauaagaaaucaag

SEQ ID NO: 615263 - RNA, 64 nt, hsa
aacucacccccuuauuuaaaugugugcuaugacccacuaugaccacagcaucugcauuuucuaa

SEQ ID NO: 615264 - RNA, 64 nt, hsa
cucaauuugaaguacuaaugcuucucaaguucuccacuaugagaguuacccuguauuagaccgu

SEQ ID NO: 615265 - RNA, 64 nt, hsa
agcuaggucuuaaugcguaggcaaccucccagcucacuaugaacgcugacagaagaguguuuuc

SEQ ID NO: 615266 - RNA, 64 nt, hsa; identical to SEQ ID NO: 166152

SEQ ID NO: 615267 - RNA, 64 nt, hsa; identical to SEQ ID NO: 166153

SEQ ID NO: 615268 - RNA, 64 nt, hsa; identical to SEQ ID NO: 166154

SEQ ID NO: 615269 - RNA, 64 nt, hsa; identical to SEQ ID NO: 166155

SEQ ID NO: 615270 - RNA, 64 nt, hsa; identical to SEQ ID NO: 166156

SEQ ID NO: 615271 - RNA, 64 nt, hsa; identical to SEQ ID NO: 166157

SEQ ID NO: 615272 - RNA, 64 nt, hsa; identical to SEQ ID NO: 166158

SEQ ID NO: 615273 - RNA, 64 nt, hsa; identical to SEQ ID NO: 166159

SEQ ID NO: 615274 - RNA, 64 nt, hsa; identical to SEQ ID NO: 166160

SEQ ID NO: 615275 - RNA, 61 nt, hsa; identical to SEQ ID NO: 166161

SEQ ID NO: 615276 - RNA, 64 nt, hsa; identical to SEQ ID NO: 166162

SEQ ID NO: 615277 - RNA, 64 nt, hsa; identical to SEQ ID NO: 166163

SEQ ID NO: 615278 - RNA, 64 nt, hsa; identical to SEQ ID NO: 166164

SEQ ID NO: 615279 - RNA, 64 nt, hsa; identical to SEQ ID NO: 166165

SEQ ID NO: 615280 - RNA, 64 nt, hsa; identical to SEQ ID NO: 166166

SEQ ID NO: 615281 - RNA, 64 nt, hsa; identical to SEQ ID NO: 166167

SEQ ID NO: 615282 - RNA, 64 nt, hsa; identical to SEQ ID NO: 166168

SEQ ID NO: 615283 - RNA, 53 nt, hsa
ugucuuucuaggaauauuaguuagagacugauuaucucaugugagccaggaca

SEQ ID NO: 615284 - RNA, 64 nt, hsa
gauuagauuggaucucccaaguuuuaauugaaaggagacugaacgaaaaccuuucugcuuucug

SEQ ID NO: 615285 - RNA, 64 nt, hsa
uggagcuaagcucaggagcccgaagggagagacugagacugacucccuuaucucuucauauucu

SEQ ID NO: 615286 - RNA, 64 nt, hsa
uuccccuggagcuaagcucaggagcccgaagggagagacugagacugacucccuuaucucuuca

SEQ ID NO: 615287 - RNA, 64 nt, hsa
gagaguaagacaugcucugcugucucuuccucuggagacugaacuuggguugguugugaugagc

SEQ ID NO: 615288 - RNA, 64 nt, hsa
gugguggcgggcaccuguaaucccagcuacuugggagacugaggcaggagaaucgcuugaaccu

SEQ ID NO: 615289 - RNA, 64 nt, hsa
gugauggcacgugucuguaaucccagcuacucuggagacugaggugggagaaucgcuugagacu

SEQ ID NO: 615290 - RNA, 64 nt, hsa
cucauuucauuauguuucuuccaaggaaacaggagagacugaauuaauaauucucucuuuccuc

SEQ ID NO: 615291 - RNA, 64 nt, hsa
uuucugcccugccccaccagggcccugcauguuggagacugagcugggugcacuggccaugccc

SEQ ID NO: 615292 - RNA, 62 nt, hsa
cauguacccacucacagugaugccagcaagaagagacugauugaggauacugaagacuggcg

SEQ ID NO: 615293 - RNA, 64 nt, hsa
uguuuuucacuuggaggauggugaacccuacugugagacugauuauuaugcccucuuugguacu

SEQ ID NO: 615294 - RNA, 64 nt, hsa
ucucccagucccacuaccagcacccccgaucccugagacugagggguuuacgggcugugaaugg

SEQ ID NO: 615295 - RNA, 64 nt, hsa
gcaugcccucaacucuugcuuggcagggguaccagagacugaaagacacggcacaaaucucaau

SEQ ID NO: 615296 - RNA, 64 nt, hsa
gggccacuggcugcuggggacuggggacugggcagagacugagccaggcaggaaggcagcagcc

SEQ ID NO: 615297 - RNA, 64 nt, hsa
ucucugccucacccgcuucagcccagggccccuggagacugauccccucugaguccucugcccc

SEQ ID NO: 615298 - RNA, 64 nt, hsa
ucuguuauaaauggagcuucagcccucugggucagagacugacaacccuccuucuucuuccuaa

SEQ ID NO: 615299 - RNA, 64 nt, hsa
ccugccgccuaagcuuuacuggaauucagguuuugagacugagaugcguguucguauuuuucca

SEQ ID NO: 615300 - RNA, 64 nt, hsa
cgguaaaugggcgaaauccaggccaggagccucagagacugaagcagaacagaguaagacucau

SEQ ID NO: 615301 - RNA, 64 nt, hsa
acaaccucgucaucauccccacuuuaaaccccaggagacugaaacucaaacaacccugggcaag

SEQ ID NO: 615302 - RNA, 64 nt, hsa
uucuuggccugagcuaugccuguugaggcaucuggagacugagaaagaaucaaaggcagagaag

SEQ ID NO: 615303 - RNA, 64 nt, hsa
agcagcugcaagccucgcaaggguggaguggggggagacugaggaccaguaguaccugcagggu

SEQ ID NO: 615304 - RNA, 64 nt, hsa
ccaagcccugucuuaaggcccagggggagguuaggagacugauagcaugugauggcucaggcug

SEQ ID NO: 615305 - RNA, 64 nt, hsa
auggggcugucccagccguaagucaggcucgagggagacugauccccugaccaauucaccugau

SEQ ID NO: 615306 - RNA, 64 nt, hsa
aagcacagaggcuccccggacucggagggggccagagacugagcucuggucaccuguucauucc

SEQ ID NO: 615307 - RNA, 64 nt, hsa
agacaaggccagagggugcgauugaaugaguauugagacugaggagaaugauagagagugaagc

SEQ ID NO: 615308 - RNA, 64 nt, hsa
caacccacgaggaccaucgggggcagagucguuggagacugaagaggaagaggaggaggagaag

SEQ ID NO: 615309 - RNA, 64 nt, hsa
cggaggguccagacuguccacucggggguggagugagacugacugcaagccccacccuccuuga

SEQ ID NO: 615310 - RNA, 64 nt, hsa
cauucccucuaugucaagaguaaauagaggcacagagacugaugagaaacguucauaacaugaa

SEQ ID NO: 615311 - RNA, 64 nt, hsa
cagagagggccacauaucgugugccagaggcugagagacugagagggaugacaggcuuagggga

SEQ ID NO: 615312 - RNA, 64 nt, hsa; identical to SEQ ID NO: 415214

SEQ ID NO: 615313 - RNA, 64 nt, hsa; identical to SEQ ID NO: 415215

SEQ ID NO: 615314 - RNA, 64 nt, hsa; identical to SEQ ID NO: 415216

SEQ ID NO: 615315 - RNA, 64 nt, hsa; identical to SEQ ID NO: 415217

SEQ ID NO: 615316 - RNA, 64 nt, hsa; identical to SEQ ID NO: 415218

SEQ ID NO: 615317 - RNA, 64 nt, hsa; identical to SEQ ID NO: 415219

SEQ ID NO: 615318 - RNA, 64 nt, hsa; identical to SEQ ID NO: 415220

SEQ ID NO: 615319 - RNA, 64 nt, hsa; identical to SEQ ID NO: 415221

SEQ ID NO: 615320 - RNA, 55 nt, hsa; identical to SEQ ID NO: 415222

SEQ ID NO: 615321 - RNA, 64 nt, hsa; identical to SEQ ID NO: 415223

SEQ ID NO: 615322 - RNA, 64 nt, hsa; identical to SEQ ID NO: 415224

SEQ ID NO: 615323 - RNA, 64 nt, hsa; identical to SEQ ID NO: 415225

SEQ ID NO: 615324 - RNA, 64 nt, hsa; identical to SEQ ID NO: 415226

SEQ ID NO: 615325 - RNA, 64 nt, hsa; identical to SEQ ID NO: 415227

SEQ ID NO: 615326 - RNA, 64 nt, hsa; identical to SEQ ID NO: 415228

SEQ ID NO: 615327 - RNA, 50 nt, hsa; identical to SEQ ID NO: 415229

SEQ ID NO: 615328 - RNA, 64 nt, hsa; identical to SEQ ID NO: 415230

SEQ ID NO: 615329 - RNA, 64 nt, hsa; identical to SEQ ID NO: 415231

SEQ ID NO: 615330 - RNA, 64 nt, hsa; identical to SEQ ID NO: 415232

SEQ ID NO: 615331 - RNA, 64 nt, hsa; identical to SEQ ID NO: 415233

SEQ ID NO: 615332 - RNA, 64 nt, hsa; identical to SEQ ID NO: 415234

SEQ ID NO: 615333 - RNA, 64 nt, hsa; identical to SEQ ID NO: 415235

SEQ ID NO: 615334 - RNA, 64 nt, hsa; identical to SEQ ID NO: 415236

SEQ ID NO: 615335 - RNA, 64 nt, hsa; identical to SEQ ID NO: 415237

SEQ ID NO: 615336 - RNA, 64 nt, hsa; identical to SEQ ID NO: 415238

SEQ ID NO: 615337 - RNA, 64 nt, hsa; identical to SEQ ID NO: 415239

SEQ ID NO: 615338 - RNA, 64 nt, hsa; identical to SEQ ID NO: 415240

SEQ ID NO: 615339 - RNA, 64 nt, hsa; identical to SEQ ID NO: 415241

SEQ ID NO: 615340 - RNA, 64 nt, hsa; identical to SEQ ID NO: 415242

SEQ ID NO: 615341 - RNA, 64 nt, hsa; identical to SEQ ID NO: 415243

SEQ ID NO: 615342 - RNA, 64 nt, hsa; identical to SEQ ID NO: 415244

SEQ ID NO: 615343 - RNA, 64 nt, hsa; identical to SEQ ID NO: 415245

SEQ ID NO: 615344 - RNA, 64 nt, hsa; identical to SEQ ID NO: 415246

SEQ ID NO: 615345 - RNA, 64 nt, hsa; identical to SEQ ID NO: 415247

SEQ ID NO: 615346 - RNA, 64 nt, hsa; identical to SEQ ID NO: 415248

SEQ ID NO: 615347 - RNA, 64 nt, hsa; identical to SEQ ID NO: 415249

SEQ ID NO: 615348 - RNA, 64 nt, hsa; identical to SEQ ID NO: 415250

SEQ ID NO: 615349 - RNA, 64 nt, hsa; identical to SEQ ID NO: 415251

SEQ ID NO: 615350 - RNA, 64 nt, hsa; identical to SEQ ID NO: 415252

SEQ ID NO: 615351 - RNA, 64 nt, hsa; identical to SEQ ID NO: 415253

SEQ ID NO: 615352 - RNA, 64 nt, hsa; identical to SEQ ID NO: 415254

SEQ ID NO: 615353 - RNA, 64 nt, hsa; identical to SEQ ID NO: 415255

SEQ ID NO: 615354 - RNA, 64 nt, hsa; identical to SEQ ID NO: 415256

SEQ ID NO: 615355 - RNA, 64 nt, hsa
ggcagcaguggacuaagugcugggugugauaaagaggaaugacuuaauuaugagacuguauaua

SEQ ID NO: 615356 - RNA, 64 nt, hsa
aacucuggguucacacacaagcugagaugagaagaggaaugagccauauauuggggaaaaucau

SEQ ID NO: 615357 - RNA, 64 nt, hsa
uaccuuaaaagacauucuguuuauuagucugauuaggaaugauggcacugguuguauuuuagcc

SEQ ID NO: 615358 - RNA, 64 nt, hsa
agacaaagaacaggugccauagaaguagauuucuaggaaugaaguggggcagaucuuaucuuug

SEQ ID NO: 615359 - RNA, 64 nt, hsa
uggucaagccccauuuggucuacagcccaugagaaggaaugaggcugguucugcacucucagca

SEQ ID NO: 615360 - RNA, 64 nt, hsa
auugaguuguacuguaccuuauuuggaaggaugaaggaaugaaucuuuuuuuccuaaaucaaga

SEQ ID NO: 615361 - RNA, 64 nt, hsa
uuugaucucuuccaaccugcccagucacagaaggaggaaugacucaaaugcccaaaaccaagaa

SEQ ID NO: 615362 - RNA, 64 nt, hsa
aguaguuagcauccaagagacuuugcagaggcguaggaaugaggcuggacagauggcggaagca

SEQ ID NO: 615363 - RNA, 64 nt, hsa
uuaaacuuggcuuagugaagaagagagaugccaaaggaaugaaccaacccuucacauaaaggag

SEQ ID NO: 615364 - RNA, 64 nt, hsa
aagcaacaucucagcaucucuuaaaguugccugcaggaaugaagcaugacauaccuguugaggg

SEQ ID NO: 615365 - RNA, 64 nt, hsa
aaggcugagggaaagaauccuaacaaggaaaggcaggaaugaggguuucagaauucacuggaga

SEQ ID NO: 615366 - RNA, 64 nt, hsa
gcauuguaguaaauugaucauauuacauguacuaaggaaugagauuauaugcaguaaacccaac

SEQ ID NO: 615367 - RNA, 64 nt, hsa
aauccacucucuaugugugggaaaagaggcagggaggaaugaagagagcucugaaucgagaauc

SEQ ID NO: 615368 - RNA, 64 nt, hsa
ccagggcucccugaguguguccagauaccaagugaggaaugaggugugauuugcuguaucauuu

SEQ ID NO: 615369 - RNA, 64 nt, hsa
auugaaacugacaaaauugcccuuguuugaugagaggaaugagcagagcauugauguggugaac

SEQ ID NO: 615370 - RNA, 64 nt, hsa
acuuuuuaucauuaggaaacaaaaagaauuuagaaggaaugaaagcagcccguaaggugaauuc

SEQ ID NO: 615371 - RNA, 64 nt, hsa
agauuucuccauuagagaagguauuuauaaaaauaggaaugaggagagcuagaaaaccuggagu

SEQ ID NO: 615372 - RNA, 64 nt, hsa
aaauucauacaucuauggugaccacuuuugacaaaggaaugaagaacauacacuggggaaaaga

SEQ ID NO: 615373 - RNA, 64 nt, hsa
ucaccaggcuucuucugccucccuugguaacccaaggaaugauggaaucaacacaacauaguau

SEQ ID NO: 615374 - RNA, 64 nt, hsa
uucuacccuccccaagaaaaagggccuucaaggcaggaaugagaaagcaaagccaaucucucau

SEQ ID NO: 615375 - RNA, 64 nt, hsa
ugacuucagagauguguuccaugcucucuagcacaggaaugaauaaauuuauaacaccugcuuu

SEQ ID NO: 615376 - RNA, 64 nt, hsa
uaguaaaaugaaaauugagaaauauaagaugaaaaggaaugauaaaaauaucuuuuagggggcu

SEQ ID NO: 615377 - RNA, 64 nt, hsa
aaccauguaaacauuaggaaugaacagaggccuuaggaaugaauagagaguuugccuuauacaa

SEQ ID NO: 615378 - RNA, 64 nt, hsa
ggugcccuucagaguagagaaccauguaaacauuaggaaugaacagaggccuuaggaaugaaua

SEQ ID NO: 615379 - RNA, 64 nt, hsa
agaacacaaggaaugauucaagauccaccuugagaggaaugaacuuuguuguugaacaauuagu

SEQ ID NO: 615380 - RNA, 64 nt, hsa
uaccuuuuuuauucagaacgaggaagagaacacaaggaaugauucaagauccaccuugagagga

SEQ ID NO: 615381 - RNA, 64 nt, hsa
uacuuaaucuuuucaguuuuccaguuuacgucucaggaaugaaguguagucuaugguugacaau

SEQ ID NO: 615382 - RNA, 64 nt, hsa
ccuuuucucauggccuaagaaauaaggaucaauaaggaaugauuugaauguaauuuugugaaug

SEQ ID NO: 615383 - RNA, 64 nt, hsa
uauugucauugcaagcuucuuauggaaacuuuauaggaaugaaaauauacauguuaagaagauu

SEQ ID NO: 615384 - RNA, 64 nt, hsa
aaaaucuucaggaaugacauucucuagcaauaaaaggaaugaaccguuauguuucuaagcugaa

SEQ ID NO: 615385 - RNA, 64 nt, hsa
uuccuucauauuugccuuuguuuauaaaaucuucaggaaugacauucucuagcaauaaaaggaa

SEQ ID NO: 615386 - RNA, 64 nt, hsa
ccagcccucuggggcauugugggagaugccugccaggaaugagcaagcucuguugcucgggagc

SEQ ID NO: 615387 - RNA, 64 nt, hsa
acauauguugugaauuuuccuugguucuuuuuaaaggaaugauaauaaaguuacuugcuuuagg

SEQ ID NO: 615388 - RNA, 64 nt, hsa
gauaaaacacaggucaccaauuuucucauuucaccccauuuaccuuguauagaggauuguucau

SEQ ID NO: 615389 - RNA, 64 nt, hsa
gcauguagauagcauuuauuucugugcccuuaaacccauuuagaaaauaacuacaaaguaaaaa

SEQ ID NO: 615390 - RNA, 64 nt, hsa
cugugcuucuucccaucuccugugaucccccucucccauuuauucccuugaaggugcccuugua

SEQ ID NO: 615391 - RNA, 64 nt, hsa
uauucuuccaaauauuuggaacacucuuagaauucccauuuaauaaaccauaugagaaaacccu

SEQ ID NO: 615392 - RNA, 64 nt, hsa
ggcuuagaauaaaagauguagcacauuuugcuuucccauuuauuguuuggccagcuaugccaau

SEQ ID NO: 615393 - RNA, 64 nt, hsa
ucccuggaucucugaauauaugcaaaaagaaggccccauuuaguggagccagcaauccuguuca

SEQ ID NO: 615394 - RNA, 64 nt, hsa
auccuuucagugacaggacugcugcuccuggaaacccauuuagagccaagucugaagaaucaga

SEQ ID NO: 615395 - RNA, 64 nt, hsa
gucaaucccaggaaaauaugcgaaguucuccaaacccauuuauuacuggcuugaccaggacaaa

SEQ ID NO: 615396 - RNA, 64 nt, hsa; identical to SEQ ID NO: 357989

SEQ ID NO: 615397 - RNA, 64 nt, hsa; identical to SEQ ID NO: 357990

SEQ ID NO: 615398 - RNA, 64 nt, hsa; identical to SEQ ID NO: 357991

SEQ ID NO: 615399 - RNA, 64 nt, hsa; identical to SEQ ID NO: 357992

SEQ ID NO: 615400 - RNA, 64 nt, hsa; identical to SEQ ID NO: 357993

SEQ ID NO: 615401 - RNA, 64 nt, hsa; identical to SEQ ID NO: 357994

SEQ ID NO: 615402 - RNA, 64 nt, hsa; identical to SEQ ID NO: 357995

SEQ ID NO: 615403 - RNA, 64 nt, hsa; identical to SEQ ID NO: 357996

SEQ ID NO: 615404 - RNA, 64 nt, hsa; identical to SEQ ID NO: 357997

SEQ ID NO: 615405 - RNA, 64 nt, hsa; identical to SEQ ID NO: 357998

SEQ ID NO: 615406 - RNA, 64 nt, hsa; identical to SEQ ID NO: 357999

SEQ ID NO: 615407 - RNA, 64 nt, hsa; identical to SEQ ID NO: 358000

SEQ ID NO: 615408 - RNA, 64 nt, hsa; identical to SEQ ID NO: 358001

SEQ ID NO: 615409 - RNA, 64 nt, hsa; identical to SEQ ID NO: 358002

SEQ ID NO: 615410 - RNA, 64 nt, hsa; identical to SEQ ID NO: 358003

SEQ ID NO: 615411 - RNA, 64 nt, hsa; identical to SEQ ID NO: 358004

SEQ ID NO: 615412 - RNA, 64 nt, hsa; identical to SEQ ID NO: 358005

SEQ ID NO: 615413 - RNA, 64 nt, hsa; identical to SEQ ID NO: 358006

SEQ ID NO: 615414 - RNA, 64 nt, hsa; identical to SEQ ID NO: 358007

SEQ ID NO: 615415 - RNA, 64 nt, hsa; identical to SEQ ID NO: 358008

SEQ ID NO: 615416 - RNA, 64 nt, hsa; identical to SEQ ID NO: 358009

SEQ ID NO: 615417 - RNA, 64 nt, hsa; identical to SEQ ID NO: 358010

SEQ ID NO: 615418 - RNA, 64 nt, hsa; identical to SEQ ID NO: 358011

SEQ ID NO: 615419 - RNA, 64 nt, hsa; identical to SEQ ID NO: 358012

SEQ ID NO: 615420 - RNA, 64 nt, hsa; identical to SEQ ID NO: 358013

SEQ ID NO: 615421 - RNA, 64 nt, hsa; identical to SEQ ID NO: 358014

SEQ ID NO: 615422 - RNA, 64 nt, hsa; identical to SEQ ID NO: 358015

SEQ ID NO: 615423 - RNA, 64 nt, hsa; identical to SEQ ID NO: 358016

SEQ ID NO: 615424 - RNA, 64 nt, hsa; identical to SEQ ID NO: 358017

SEQ ID NO: 615425 - RNA, 64 nt, hsa; identical to SEQ ID NO: 358018

SEQ ID NO: 615426 - RNA, 64 nt, hsa; identical to SEQ ID NO: 358019

SEQ ID NO: 615427 - RNA, 64 nt, hsa; identical to SEQ ID NO: 358020

SEQ ID NO: 615428 - RNA, 64 nt, hsa; identical to SEQ ID NO: 358021

SEQ ID NO: 615429 - RNA, 64 nt, hsa; identical to SEQ ID NO: 358022

SEQ ID NO: 615430 - RNA, 64 nt, hsa; identical to SEQ ID NO: 358023

SEQ ID NO: 615431 - RNA, 64 nt, hsa; identical to SEQ ID NO: 358024

SEQ ID NO: 615432 - RNA, 64 nt, hsa; identical to SEQ ID NO: 358025

SEQ ID NO: 615433 - RNA, 64 nt, hsa; identical to SEQ ID NO: 358026

SEQ ID NO: 615434 - RNA, 64 nt, hsa; identical to SEQ ID NO: 358027

SEQ ID NO: 615435 - RNA, 64 nt, hsa; identical to SEQ ID NO: 358028

SEQ ID NO: 615436 - RNA, 64 nt, hsa; identical to SEQ ID NO: 358029

SEQ ID NO: 615437 - RNA, 64 nt, hsa; identical to SEQ ID NO: 358030

SEQ ID NO: 615438 - RNA, 64 nt, hsa; identical to SEQ ID NO: 358031

SEQ ID NO: 615439 - RNA, 64 nt, hsa; identical to SEQ ID NO: 358032

SEQ ID NO: 615440 - RNA, 64 nt, hsa; identical to SEQ ID NO: 358033

SEQ ID NO: 615441 - RNA, 64 nt, hsa; identical to SEQ ID NO: 358034

SEQ ID NO: 615442 - RNA, 64 nt, hsa; identical to SEQ ID NO: 358035

SEQ ID NO: 615443 - RNA, 64 nt, hsa; identical to SEQ ID NO: 358036

SEQ ID NO: 615444 - RNA, 64 nt, hsa; identical to SEQ ID NO: 358037

SEQ ID NO: 615445 - RNA, 64 nt, hsa; identical to SEQ ID NO: 358038

SEQ ID NO: 615446 - RNA, 64 nt, hsa; identical to SEQ ID NO: 358039

SEQ ID NO: 615447 - RNA, 64 nt, hsa; identical to SEQ ID NO: 358040

SEQ ID NO: 615448 - RNA, 64 nt, hsa; identical to SEQ ID NO: 358041

SEQ ID NO: 615449 - RNA, 64 nt, hsa; identical to SEQ ID NO: 358042

SEQ ID NO: 615450 - RNA, 64 nt, hsa; identical to SEQ ID NO: 358043

SEQ ID NO: 615451 - RNA, 64 nt, hsa; identical to SEQ ID NO: 358044

SEQ ID NO: 615452 - RNA, 64 nt, hsa; identical to SEQ ID NO: 358045

SEQ ID NO: 615453 - RNA, 64 nt, hsa; identical to SEQ ID NO: 358046

SEQ ID NO: 615454 - RNA, 64 nt, hsa; identical to SEQ ID NO: 358047

SEQ ID NO: 615455 - RNA, 64 nt, hsa; identical to SEQ ID NO: 358048

SEQ ID NO: 615456 - RNA, 64 nt, hsa; identical to SEQ ID NO: 358049

SEQ ID NO: 615457 - RNA, 64 nt, hsa; identical to SEQ ID NO: 358050

SEQ ID NO: 615458 - RNA, 64 nt, hsa; identical to SEQ ID NO: 358051

SEQ ID NO: 615459 - RNA, 64 nt, hsa; identical to SEQ ID NO: 358052

SEQ ID NO: 615460 - RNA, 64 nt, hsa; identical to SEQ ID NO: 358053

SEQ ID NO: 615461 - RNA, 64 nt, hsa; identical to SEQ ID NO: 358054

SEQ ID NO: 615462 - RNA, 64 nt, hsa; identical to SEQ ID NO: 358055

SEQ ID NO: 615463 - RNA, 64 nt, hsa; identical to SEQ ID NO: 358056

SEQ ID NO: 615464 - RNA, 64 nt, hsa; identical to SEQ ID NO: 358057

SEQ ID NO: 615465 - RNA, 64 nt, hsa; identical to SEQ ID NO: 358058

SEQ ID NO: 615466 - RNA, 64 nt, hsa; identical to SEQ ID NO: 358059

SEQ ID NO: 615467 - RNA, 64 nt, hsa; identical to SEQ ID NO: 358060

SEQ ID NO: 615468 - RNA, 64 nt, hsa; identical to SEQ ID NO: 358061

SEQ ID NO: 615469 - RNA, 64 nt, hsa
ucagguuccuaagacuucaguccuggucugcucaggaauugaagauguaaggaauugaagauag

SEQ ID NO: 615470 - RNA, 64 nt, hsa
ucaguccuggucugcucaggaauugaagauguaaggaauugaagauaggagagauaccuugaaa

SEQ ID NO: 615471 - RNA, 64 nt, hsa
uuugggaugccugagacuccgagacuaucagaagggaauugacccaccccagucuagcaccacc

SEQ ID NO: 615472 - RNA, 64 nt, hsa
ugugcagucuaagguuuaaucugaccaagaaauuggaauugaaaacaggaggugacuagggagg

SEQ ID NO: 615473 - RNA, 64 nt, hsa
uuaauaaauguauguguggggcugagguucuaaaggaauugaaaagagacgauaaacauugaau

SEQ ID NO: 615474 - RNA, 64 nt, hsa
aaagaggauucuaauauuucaagaauguuucacuggaauugaugggaaaugguuucuaaauggc

SEQ ID NO: 615475 - RNA, 64 nt, hsa
ucuguaaugucuguccuuucccccacuuuuacugggaauugauaguccagcuuccuugggcagu

SEQ ID NO: 615476 - RNA, 64 nt, hsa
caaucccucauccucuuagaagcaccugugaaugggaauugagccaacuguuauagaaaauugg

SEQ ID NO: 615477 - RNA, 64 nt, hsa
acugcccggggcagcugccagagaagcaucggagggaauugaggucugcucggccgucuucacu

SEQ ID NO: 615478 - RNA, 64 nt, hsa
agaaaagugggccagugugggaaugcggcaagaaggaauugacuucgacugugaccugugggga

SEQ ID NO: 615479 - RNA, 64 nt, hsa
gauagauuuuagaggcagcagacagaauuacugaggaauugaguguaagaguggaauaaaguua

SEQ ID NO: 615480 - RNA, 64 nt, hsa
ugugaacaaacagacaaaaaaucugugcccucguggaauugacguucugcuugggaacacagaa

SEQ ID NO: 615481 - RNA, 62 nt, hsa
aguggggcucccagucugaaagaucuaggaggaacugggaucaaagcuacaaagucccacgu

SEQ ID NO: 615482 - RNA, 62 nt, hsa
uaucacccucaaucuagugauccaagucagaaaacugggaguuaucgcuacucuguuucaua

SEQ ID NO: 615483 - RNA, 62 nt, hsa
uauggaggaguucucuuaauaucagcaaggugaacugggacauucuucuuucucagaagaag

SEQ ID NO: 615484 - RNA, 62 nt, hsa
accuacugcagguccagagacuucuguuuuacaacugggaaacagcuuguguacuaaaguaa

SEQ ID NO: 615485 - RNA, 62 nt, hsa
ggguggcucccuuuguuguuugcauuuuaaggaacugggagugaggcucagagaaguugagg

SEQ ID NO: 615486 - RNA, 62 nt, hsa
cgaggccaccugccucucugagggaucuaaacaacugggagggaggggaccgcucccccuuu

SEQ ID NO: 615487 - RNA, 62 nt, hsa
gcuagugguggcuucuccagccuuuuucagggaacugggaacuuaggggacugagcugggga

SEQ ID NO: 615488 - RNA, 62 nt, hsa
cuaggccaguacuacugcucucaaaagagauuaacugggauuaagugagaugacgcauguaa

SEQ ID NO: 615489 - RNA, 62 nt, hsa
ggauguugacuuuguucugcugcagccugauaaacugggaccacugugugguuaguaaugca

SEQ ID NO: 615490 - RNA, 62 nt, hsa
guggggcagcugcaggacauguagagaaaccaaacugggaaaucuuacaaggaguugaaaag

SEQ ID NO: 615491 - RNA, 62 nt, hsa
cacgggcaccaggaccccuaagaccaagugacaacugggagagccucagcauauacucuucu

SEQ ID NO: 615492 - RNA, 62 nt, hsa
ccaggugaggcccuuucuccaguuugcccauuaacugggagagguacuuucgccuccaagga

SEQ ID NO: 615493 - RNA, 62 nt, hsa
uagagaauagagucuaugccuuuggcaaauuuaacugggaguuuggauucccacuuaagggu

SEQ ID NO: 615494 - RNA, 62 nt, hsa
auaggcugcccaccuaaugguggagagcaugaaacugggagcauccuguggggggcuugugg

SEQ ID NO: 615495 - RNA, 62 nt, hsa
uccccuuuagcugucuucuauccccagcuccuaacugggacucugugucuaugcagggggcc

SEQ ID NO: 615496 - RNA, 62 nt, hsa
auucacgcugagcccaaguccccacacuggaaaacugggaaauggccagcugugugucccag

SEQ ID NO: 615497 - RNA, 62 nt, hsa
uuccauggcgacagcuagaugaguguuugaauaacugggacuguagcccguccaaguugaca

SEQ ID NO: 615498 - RNA, 62 nt, hsa
ucaaucgauccucccaccucugccucccaaguaacugggacuauagcaugccaccacaccca

SEQ ID NO: 615499 - RNA, 62 nt, hsa
ucaauugauccucccacuucugccucccaaguaacugggacuauagcaugccaccacaccca

SEQ ID NO: 615500 - RNA, 62 nt, hsa
guuugacuucguuccugaauacaaucuugaguaacugggaaagucugagugaaaggauggcc

SEQ ID NO: 615501 - RNA, 62 nt, hsa
cacacagcugagaagccggcguccugcucacaaacugggaaagugugaaaacuauuuaagau

SEQ ID NO: 615502 - RNA, 64 nt, hsa; identical to SEQ ID NO: 571472

SEQ ID NO: 615503 - RNA, 64 nt, hsa; identical to SEQ ID NO: 571473

SEQ ID NO: 615504 - RNA, 64 nt, hsa; identical to SEQ ID NO: 571474

SEQ ID NO: 615505 - RNA, 64 nt, hsa; identical to SEQ ID NO: 571475

SEQ ID NO: 615506 - RNA, 64 nt, hsa; identical to SEQ ID NO: 571476

SEQ ID NO: 615507 - RNA, 64 nt, hsa; identical to SEQ ID NO: 571477

SEQ ID NO: 615508 - RNA, 64 nt, hsa; identical to SEQ ID NO: 571478

SEQ ID NO: 615509 - RNA, 64 nt, hsa; identical to SEQ ID NO: 571479

SEQ ID NO: 615510 - RNA, 64 nt, hsa; identical to SEQ ID NO: 571480

SEQ ID NO: 615511 - RNA, 64 nt, hsa; identical to SEQ ID NO: 571481

SEQ ID NO: 615512 - RNA, 64 nt, hsa; identical to SEQ ID NO: 571482

SEQ ID NO: 615513 - RNA, 64 nt, hsa; identical to SEQ ID NO: 571483

SEQ ID NO: 615514 - RNA, 64 nt, hsa; identical to SEQ ID NO: 571484

SEQ ID NO: 615515 - RNA, 64 nt, hsa; identical to SEQ ID NO: 571485

SEQ ID NO: 615516 - RNA, 64 nt, hsa; identical to SEQ ID NO: 571486

SEQ ID NO: 615517 - RNA, 64 nt, hsa; identical to SEQ ID NO: 571487

SEQ ID NO: 615518 - RNA, 64 nt, hsa; identical to SEQ ID NO: 571488

SEQ ID NO: 615519 - RNA, 64 nt, hsa; identical to SEQ ID NO: 571489

SEQ ID NO: 615520 - RNA, 64 nt, hsa; identical to SEQ ID NO: 571490

SEQ ID NO: 615521 - RNA, 64 nt, hsa; identical to SEQ ID NO: 571491

SEQ ID NO: 615522 - RNA, 64 nt, hsa; identical to SEQ ID NO: 571492

SEQ ID NO: 615523 - RNA, 64 nt, hsa; identical to SEQ ID NO: 571493

SEQ ID NO: 615524 - RNA, 64 nt, hsa; identical to SEQ ID NO: 571494

SEQ ID NO: 615525 - RNA, 64 nt, hsa; identical to SEQ ID NO: 571495

SEQ ID NO: 615526 - RNA, 64 nt, hsa; identical to SEQ ID NO: 571496

SEQ ID NO: 615527 - RNA, 64 nt, hsa; identical to SEQ ID NO: 571497

SEQ ID NO: 615528 - RNA, 64 nt, hsa; identical to SEQ ID NO: 571498

SEQ ID NO: 615529 - RNA, 64 nt, hsa; identical to SEQ ID NO: 571499

SEQ ID NO: 615530 - RNA, 64 nt, hsa; identical to SEQ ID NO: 571500

SEQ ID NO: 615531 - RNA, 64 nt, hsa; identical to SEQ ID NO: 571501

SEQ ID NO: 615532 - RNA, 60 nt, hsa; identical to SEQ ID NO: 571502

SEQ ID NO: 615533 - RNA, 64 nt, hsa; identical to SEQ ID NO: 571503

SEQ ID NO: 615534 - RNA, 64 nt, hsa; identical to SEQ ID NO: 571504

SEQ ID NO: 615535 - RNA, 64 nt, hsa; identical to SEQ ID NO: 571505

SEQ ID NO: 615536 - RNA, 64 nt, hsa; identical to SEQ ID NO: 571506

SEQ ID NO: 615537 - RNA, 64 nt, hsa; identical to SEQ ID NO: 571507

SEQ ID NO: 615538 - RNA, 64 nt, hsa; identical to SEQ ID NO: 571508

SEQ ID NO: 615539 - RNA, 63 nt, hsa; identical to SEQ ID NO: 87681

SEQ ID NO: 615540 - RNA, 63 nt, hsa; identical to SEQ ID NO: 87682

SEQ ID NO: 615541 - RNA, 63 nt, hsa; identical to SEQ ID NO: 87683

SEQ ID NO: 615542 - RNA, 63 nt, hsa; identical to SEQ ID NO: 87684

SEQ ID NO: 615543 - RNA, 63 nt, hsa; identical to SEQ ID NO: 87685

SEQ ID NO: 615544 - RNA, 63 nt, hsa; identical to SEQ ID NO: 87686

SEQ ID NO: 615545 - RNA, 63 nt, hsa; identical to SEQ ID NO: 87687

SEQ ID NO: 615546 - RNA, 63 nt, hsa; identical to SEQ ID NO: 87688

SEQ ID NO: 615547 - RNA, 63 nt, hsa; identical to SEQ ID NO: 87689

SEQ ID NO: 615548 - RNA, 63 nt, hsa; identical to SEQ ID NO: 87690

SEQ ID NO: 615549 - RNA, 63 nt, hsa; identical to SEQ ID NO: 87691

SEQ ID NO: 615550 - RNA, 63 nt, hsa; identical to SEQ ID NO: 87692

SEQ ID NO: 615551 - RNA, 63 nt, hsa; identical to SEQ ID NO: 87693

SEQ ID NO: 615552 - RNA, 63 nt, hsa; identical to SEQ ID NO: 87694

SEQ ID NO: 615553 - RNA, 63 nt, hsa; identical to SEQ ID NO: 87695

SEQ ID NO: 615554 - RNA, 63 nt, hsa; identical to SEQ ID NO: 87696

SEQ ID NO: 615555 - RNA, 63 nt, hsa; identical to SEQ ID NO: 87697

SEQ ID NO: 615556 - RNA, 63 nt, hsa; identical to SEQ ID NO: 87698

SEQ ID NO: 615557 - RNA, 63 nt, hsa; identical to SEQ ID NO: 87699

SEQ ID NO: 615558 - RNA, 63 nt, hsa; identical to SEQ ID NO: 87700

SEQ ID NO: 615559 - RNA, 63 nt, hsa; identical to SEQ ID NO: 87701

SEQ ID NO: 615560 - RNA, 63 nt, hsa; identical to SEQ ID NO: 87702

SEQ ID NO: 615561 - RNA, 63 nt, hsa; identical to SEQ ID NO: 87703

SEQ ID NO: 615562 - RNA, 63 nt, hsa; identical to SEQ ID NO: 87702

SEQ ID NO: 615563 - RNA, 63 nt, hsa; identical to SEQ ID NO: 87703

SEQ ID NO: 615564 - RNA, 61 nt, hsa
guugaggccuuggggucacuccuuuuuugcaugugcaaaugugcuggucacccuucaacgc

SEQ ID NO: 615565 - RNA, 61 nt, hsa
aacagaugacuugugaaccccacaguguggaugugcaaaugaaaauugaaggaaagaauau

SEQ ID NO: 615566 - RNA, 61 nt, hsa
ucugaugcacuggacugaauuuuuaccucaaugugcaaaggcugaucagccugaacuuucu

SEQ ID NO: 615567 - RNA, 61 nt, hsa
ugaauaaucaaagugauuuuucagaauuaugugugcaaaaaauuaaugugcauucauauau

SEQ ID NO: 615568 - RNA, 61 nt, hsa
gcucaggugcuccccuccaccaugggcaggcugugcaaaaagccacuggcuuuucucagca

SEQ ID NO: 615569 - RNA, 61 nt, hsa
agcacuuugccuaaaagaaaggacugacaagugugcaaaauguuuacaaucuuuugugaaa

SEQ ID NO: 615570 - RNA, 61 nt, hsa
uugauauguucaacuggagacacuauuuaucugugcaaauccuugauacugcucaucauuc

SEQ ID NO: 615571 - RNA, 61 nt, hsa
ugggucaggaacagagccaacaggaugaacgugugcaaaagccuuggacuuggcugugauc

SEQ ID NO: 615572 - RNA, 61 nt, hsa
agcaagguuggccucuggauggugaacgggcugugcaaaaaagcccugcuucuucccuugu

SEQ ID NO: 615573 - RNA, 61 nt, hsa
cucuauaucauuuuucaauauaaaauguauuugugcaaauucuagucaauacuacuuuaug

SEQ ID NO: 615574 - RNA, 61 nt, hsa
aaauggcucugugaaaucagaagugcaaaggugugcaaacuuguaucugaagaccuaccag

SEQ ID NO: 615575 - RNA, 61 nt, hsa
ucagggcugccacuaaccuguagaacaccccugugcaaauuuuaaaaaggaacccuuuucc

SEQ ID NO: 615576 - RNA, 61 nt, hsa
aagucagcagauauuuauugaguuccuguggugugcaaagcauuaugauaggcaccguggg

SEQ ID NO: 615577 - RNA, 61 nt, hsa
ucuauccacauccaacugauggcaccauugaugugcaaauaaugagauucccuaucuccuu

SEQ ID NO: 615578 - RNA, 61 nt, hsa
guguugcagggagguguuaagaagagaacucugugcaaacagugauggaaggcuguugucu

SEQ ID NO: 615579 - RNA, 61 nt, hsa
gcucgucuaucaccaggaucgcuuuguacuuugugcaaaagggucuggcugucccuugcug

SEQ ID NO: 615580 - RNA, 61 nt, hsa
ggaaagugguaggauuuuuuuuuuuuaauccugugcaaaggaaaagaggugcuuuguggga

SEQ ID NO: 615581 - RNA, 61 nt, hsa
cauuaaucuuaacacagaacaugagguuaugugugcaaauugagucuuuuaggacagauuc

SEQ ID NO: 615582 - RNA, 61 nt, hsa
gauacagugauuucauauuggaaucauuauuugugcaaagggacagacagaucacuuagau

SEQ ID NO: 615583 - RNA, 61 nt, hsa
gagaguguauagacugacucuaaguuaauaaugugcaaaauaucuuaaacaucccuccccu

SEQ ID NO: 615584 - RNA, 61 nt, hsa
ggcuccgcaguguuggguuuuguccugaaucugugcaaaugugcagggaaauaaccuccug

SEQ ID NO: 615585 - RNA, 61 nt, hsa
ccuuggggcuaccccuuggccccuccuggucugugcaaacucccucagggagccccccugc

SEQ ID NO: 615586 - RNA, 61 nt, hsa
ucaucuccagccuccccaccccagugggaacugugcaaagggcugccuugcuguucuugaa

SEQ ID NO: 615587 - RNA, 61 nt, hsa
gucucuaaggaaaaccagcagaacauuagccugugcaaaaccaucuguuuggggagcacac

SEQ ID NO: 615588 - RNA, 61 nt, hsa
gaauauugagaaugagggccuggaggugaaaugugcaaaacccaccccucacacugcagcc

SEQ ID NO: 615589 - RNA, 61 nt, hsa
agcuuguugacugcugucuguugaugacgugugugcaaagcaggcucuagcaacaugauca

SEQ ID NO: 615590 - RNA, 61 nt, hsa
ccccuagggggagaagaagccgagagccuuuugugcaaagccaaaaccuucguccuuuuaa

SEQ ID NO: 615591 - RNA, 61 nt, hsa
ucuuuugugucucucugguugccucuagcacugugcaaacucugcaagaaauugcugccuu

SEQ ID NO: 615592 - RNA, 61 nt, hsa
ggaaagcuuacuguuuuugauaaaguaauaaugugcaaaucugacaauauacaagcuuuua

SEQ ID NO: 615593 - RNA, 61 nt, hsa
uuaugagcccugaggaguuauuggcaagauuugugcaaaauaaaauauggggagacuuggg

SEQ ID NO: 615594 - RNA, 61 nt, hsa
caugaagaaaaaaauauauuuuaggaaaacaugugcaaaaagcaucuaagcaucuguuaac

SEQ ID NO: 615595 - RNA, 61 nt, hsa
uauuuuucuguccagaagagcuuuaccaggcugugcaaaguaaaauucuucucaggcaaca

SEQ ID NO: 615596 - RNA, 61 nt, hsa
aaaaugagaaauuauauuuauuagaauaaaaugugcaaauaaugacaauuauuugaaugua

SEQ ID NO: 615597 - RNA, 61 nt, hsa
uucucaaucuuuuagcacauguguaagacacugugcaaauuuuuugaaaauagagcaauac

SEQ ID NO: 615598 - RNA, 61 nt, hsa
uguggcaacauucugucagccucuuucauagugugcaaacauuuuaucauucuaaauggug

SEQ ID NO: 615599 - RNA, 61 nt, hsa
cucugugugucucugacccuggcugggugugugugcaaaucugugugacuggagcucuagg

SEQ ID NO: 615600 - RNA, 61 nt, hsa
uuuguuuaacugugaguggcugcacaggcacugugcaaacaaugaaaagccccuucacuuc

SEQ ID NO: 615601 - RNA, 61 nt, hsa
uauucauugaacugcugcuacauccagacacugugcaaauaaauuauuucugcuaccuucu

SEQ ID NO: 615602 - RNA, 61 nt, hsa
ugcuggucucauccuccccaguuuauauuuuugugcaaaugaacuucuccuuuugaccagu

SEQ ID NO: 615603 - RNA, 61 nt, hsa
auuggaugccaguuuuguaaucacugacuuaugugcaaacuggugcagaaauucuauaaac

SEQ ID NO: 615604 - RNA, 61 nt, hsa
agacugaaagcauuccaaauuaggcuuagacugugcaaagggcuuagcuaaguuaucgagc

SEQ ID NO: 615605 - RNA, 61 nt, hsa
aucacuaucaauuuuaaggaaacuuuuuaauugugcaaaggauaaauuuuuugaccuauuu

SEQ ID NO: 615606 - RNA, 61 nt, hsa
auaaauaggucagugggcagagaggcagaugugugcaaaaagcacaaccccaaucacacac

SEQ ID NO: 615607 - RNA, 61 nt, hsa
aaaacugcuguuuguggcaggaaccccuggcugugcaaauaaauggggcugaggccccugu

SEQ ID NO: 615608 - RNA, 61 nt, hsa
uuccaguccucugcacuguacacugcagcagugugcaaacuaugggacuuagaggguuucu

SEQ ID NO: 615609 - RNA, 61 nt, hsa
cuccccagauaccuccuauauuuccauauugugugcaaaggaugggcagaaaagaaagugc

SEQ ID NO: 615610 - RNA, 61 nt, hsa
guaggcuaagaaggaaggacccuccugucagugugcaaagcuguaaucucauggacuagag

SEQ ID NO: 615611 - RNA, 61 nt, hsa
acuuucuuucauaagugugcauuauuuuacaugugcaaaucagaauauauuuaaaaaaaag

SEQ ID NO: 615612 - RNA, 61 nt, hsa
cugccuaggaaaacauuuuauggcagucuuaugugcaaagaucguaaaaggacaaaaaauu

SEQ ID NO: 615613 - RNA, 61 nt, hsa
ggcuucuugugcaauaauaugauguuuuaagugugcaaacaaguuagagcuggcagcugaa

SEQ ID NO: 615614 - RNA, 61 nt, hsa
auucuaaguaguauuacccuaugaagcacagugugcaaagguaugcuacaaggucucuuua

SEQ ID NO: 615615 - RNA, 61 nt, hsa
ggacaaauuuuaauaaucagcaagacugguuugugcaaagcguugagucaucagguauuua

SEQ ID NO: 615616 - RNA, 61 nt, hsa
caaugggucuuggugggugggagguggggcaugugcaaagcaagcaaggaacauuuggggu

SEQ ID NO: 615617 - RNA, 61 nt, hsa
uuugguaauucauuuuuuuuuaagaucauuaugugcaaaacaccaaguuuuaaaaauaacu

SEQ ID NO: 615618 - RNA, 61 nt, hsa
gaaggcuaaaaaauuaccucuuuuuaaauuaugugcaaaauaauucuggcuaacuguaaaa

SEQ ID NO: 615619 - RNA, 61 nt, hsa
cccccauuuuugugccacuugcuuggggggaugugcaaacccacccugccccuuggauggg

SEQ ID NO: 615620 - RNA, 61 nt, hsa
gagcauuuauguagacauuguaaauaaauuuugugcaaaaaggacuggaaaaaugaacugu

SEQ ID NO: 615621 - RNA, 61 nt, hsa
agcaaaacuucagaacuaguucugcaucuacugugcaaagaucaugauuaacugucaagac

SEQ ID NO: 615622 - RNA, 61 nt, hsa
cuuuucuugguggugcaaagugguauaacugugugcaaauaggagguuugagguccaaauu

SEQ ID NO: 615623 - RNA, 61 nt, hsa
agccucuaggcuagcggcugcauucguggucugugcaaacacuucgugguucuauauauca

SEQ ID NO: 615624 - RNA, 61 nt, hsa
acacuucgugguucuauauaucagcagcaagugugcaaaauaaaggaccuguuaacucaga

SEQ ID NO: 615625 - RNA, 61 nt, hsa
ugccuguguaauuuuaaaaaauuaauagagcugugcaaacccuguuauuuuuguaaaaaaa

SEQ ID NO: 615626 - RNA, 61 nt, hsa
aggaaaaauuaugcaucuagcacauuuaaacugugcaaauaugaaaauuuuucgaggauua

SEQ ID NO: 615627 - RNA, 61 nt, hsa
ggcauguauuaucacaucaagcaugcaauaaugugcaaauuuugcauuuaguuuuauggca

SEQ ID NO: 615628 - RNA, 61 nt, hsa
gccugcauuguguauuaaacaccagguaauaugugcaaaaccgagggcuccaguaacaccu

SEQ ID NO: 615629 - RNA, 61 nt, hsa
cuucucggagucucauauuuugugggacuccugugcaaacauauguuauuaaaauuuuuuu

SEQ ID NO: 615630 - RNA, 61 nt, hsa
cuucuuggagucucauauuucguggaacuccugugcaaacauauauuauuaaauuuuuuuu

SEQ ID NO: 615631 - RNA, 61 nt, hsa
ugaguaaaaggguuccuguucacucugacucugugcaaauuguauuacaguagaccgcuga

SEQ ID NO: 615632 - RNA, 61 nt, hsa
caaaaauuuauuuggcucuuucguuaaaaacugugcaaauuaaaaaaaaaaaaaaaaaagu

SEQ ID NO: 615633 - RNA, 61 nt, hsa
cuaauuuaguucucagcucuucugacuuaagugugcaaaauauuuuuauagauuugaccua

SEQ ID NO: 615634 - RNA, 61 nt, hsa
uuuuuaaacaaugauuaaauugaauguguaaugugcaaaagcccuggaacgcaauuaaaua

SEQ ID NO: 615635 - RNA, 61 nt, hsa
auuguucuuuucuugguaauguugaucauuaugugcaaagacugacuacuaaggccuuguu

SEQ ID NO: 615636 - RNA, 61 nt, hsa
aaaaauguuuaauuuaugcaacaagcauguuugugcaaauuucaugggacuuuaaaaagaa

SEQ ID NO: 615637 - RNA, 61 nt, hsa
auagcuggaccuaaguucucagaagcguagaugugcaaacaagcgauugaguugggcuuua

SEQ ID NO: 615638 - RNA, 61 nt, hsa
gggagcgggaguccguguucucuuuuguuccugugcaaauaaugaaagagcucgguaaagc

SEQ ID NO: 615639 - RNA, 61 nt, hsa
ugguaccagggaagagggagaauuaauuuauugugcaaaugcugguauuucuuacaugauu

SEQ ID NO: 615640 - RNA, 61 nt, hsa
caaauuaaaagcagcuuugugaacuuuuaugugugcaaaggaucaaguucacauguuccaa

SEQ ID NO: 615641 - RNA, 61 nt, hsa
acccaauggcuaccuagacuauagggauaguugugcaaagugaacauuguaacuacaccaa

SEQ ID NO: 615642 - RNA, 61 nt, hsa
guuccuaaguucuuagauaucuuuuuauugaugugcaaaaauuuuuggauugacaguaacu

SEQ ID NO: 615643 - RNA, 61 nt, hsa
acucugagcugcuaggaaccucauuuguccaugugcaaacgcuguauuccaaggccuguga

SEQ ID NO: 615644 - RNA, 61 nt, hsa
uuucuaagcuguuucuugaugggagagguucugugcaaaacuaccacauucuguccccaaa

SEQ ID NO: 615645 - RNA, 61 nt, hsa
guugagccuugcuggacaagugguuuguuugugugcaaaccaaacuuucuuuacccagugc

SEQ ID NO: 615646 - RNA, 61 nt, hsa
cccaaguccauucccacuguaggccgaugccugugcaaaggacgcagugccauaucagaga

SEQ ID NO: 615647 - RNA, 61 nt, hsa
acauacaaagaaaaguagugguauuuugguaugugcaaauauuuccauauguuagccauuu

SEQ ID NO: 615648 - RNA, 61 nt, hsa
cuuacccaaugaaagcaaaguuuuuaugugcugugcaaauggucuucauguggucugacaa

SEQ ID NO: 615649 - RNA, 61 nt, hsa
acugggcugauuugaccuccgacucauugguugugcaaaugccaugugcagccuuuccuga

SEQ ID NO: 615650 - RNA, 61 nt, hsa
acaccaagaggguguugugaugaggugccggugugcaaagggaacuuuaguuuuuccacug

SEQ ID NO: 615651 - RNA, 61 nt, hsa
ugucaucacauuucaggccccaagcaaucucugugcaaagcaucagaaagaccugcuuccc

SEQ ID NO: 615652 - RNA, 61 nt, hsa
gagugaauggcuugacguacuugcaguuaacugugcaaaauuggcuggcugccucuguucc

SEQ ID NO: 615653 - RNA, 61 nt, hsa
caaaucaaggaccaacuuaaacguuaauuuuugugcaaaaacaaaccugaaaaauaugcuu

SEQ ID NO: 615654 - RNA, 61 nt, hsa
aauuccagugguccauggaaugcuugaaaaaugugcaaaacagcguuuaagacuguaauga

SEQ ID NO: 615655 - RNA, 61 nt, hsa
gaagucuucaaguucaugucacugagaagcuugugcaaagcagccaccuuggaccauaauu

SEQ ID NO: 615656 - RNA, 61 nt, hsa
gccccucuugauguaagcaacuguccauccuugugcaaagauugaugguagagaguuugac

SEQ ID NO: 615657 - RNA, 61 nt, hsa
ccagugaggguggggugggacugaagcguugugugcaaauccagcuuccauccccucccca

SEQ ID NO: 615658 - RNA, 61 nt, hsa
cuggcuuuaccaaauugaaugaaaaggagcuugugcaaaaaaauuuaaaaauggaugucaa

SEQ ID NO: 615659 - RNA, 61 nt, hsa
gggaaaaaaaaagaagaaaaaccuguuuccgugugcaaaagcacacauauguaugucugug

SEQ ID NO: 615660 - RNA, 61 nt, hsa
ucaaaguuuacguaaugaaaauuauagcgugugugcaaacucuugaggguugauuaugcug

SEQ ID NO: 615661 - RNA, 61 nt, hsa
ucccucuauuaaccccaccccaucaggcacgugugcaaaccucuugacuuuaccccacauu

SEQ ID NO: 615662 - RNA, 61 nt, hsa
guucucagagcugaauguuuauaucuuuugcugugcaaaagaaacauguaaaauguuguuc

SEQ ID NO: 615663 - RNA, 61 nt, hsa
aaagaaugagguuggaccuuuacucacacuaugugcaaaaaucaacucaaaacgcauccaa

SEQ ID NO: 615664 - RNA, 61 nt, hsa
uuccacagcaaaauuacucuacuguuaaaauugugcaaaauaaaauaaacauuuaaaauga

SEQ ID NO: 615665 - RNA, 61 nt, hsa
uugaaaugcuaaacuuggcuguaugucaaauugugcaaaauauugguauuaaagaaugcug

SEQ ID NO: 615666 - RNA, 61 nt, hsa
uguccagugcaaccacacaccucaccagaauugugcaaauggaagacaaaauguuuucuuc

SEQ ID NO: 615667 - RNA, 61 nt, hsa
uauuucuaaacauucuaaucaaauuuuaaaaugugcaaagaaugaagugaaaaacugaauu

SEQ ID NO: 615668 - RNA, 61 nt, hsa
ggcuaacauuuaggagaaguuggucuuacuuugugcaaaagcaggcuugugcuuuauaccc

SEQ ID NO: 615669 - RNA, 61 nt, hsa
gggacucauucacauuucaagauccaaaugcugugcaaacaguguaagcuuagauuuucug

SEQ ID NO: 615670 - RNA, 61 nt, hsa
cucccugcaaguguaaauauuaaggaugaccugugcaaaauuauacccacaccagcacuag

SEQ ID NO: 615671 - RNA, 61 nt, hsa
uuuaaguggcagguauuguaacuguuuuuugugugcaaaauacugaguaaccacugggaaa

SEQ ID NO: 615672 - RNA, 61 nt, hsa
caggguaaaauuugaaacaaaaaauuuuaccugugcaaaauaguuuuuuaaaaauuauaca

SEQ ID NO: 615673 - RNA, 61 nt, hsa
aucaacaaauauauuuauuggagaccgacuuugugcaaagcaaugcuaaucaggguucucc

SEQ ID NO: 615674 - RNA, 61 nt, hsa
gcuuaacaaaugagcauuccaagcucaguuuugugcaaaucgccuuucugacucuugagua

SEQ ID NO: 615675 - RNA, 61 nt, hsa
augagccaggacgguccccccacagucagccugugcaaaggccccguggccagggguggag

SEQ ID NO: 615676 - RNA, 61 nt, hsa
ucauuuacauguaacuucugacauuucacucugugcaaauaaagaacaugaggauaccugu

SEQ ID NO: 615677 - RNA, 61 nt, hsa
cuuccuucacucacccagcaggucaguuuucugugcaaacaaaccuguuuaggauucuucc

SEQ ID NO: 615678 - RNA, 61 nt, hsa
uucacuaaaaaacuugguuauuccauggaguugugcaaagcuauggcuuccuuggugcaau

SEQ ID NO: 615679 - RNA, 61 nt, hsa
acagaugaaaguugcaaugaucuagcaguugugugcaaaggcaaggcuugcuuuuccuguc

SEQ ID NO: 615680 - RNA, 61 nt, hsa
gcauugccagcggcgaauaccugagcaacugugugcaaaucauagaccguggcuauaacca

SEQ ID NO: 615681 - RNA, 61 nt, hsa
accucaaaagacagauaaaaggaugcagagcugugcaaauuguuccucaaaugaagcagug

SEQ ID NO: 615682 - RNA, 61 nt, hsa
aacauuuuccaauuaucuggucuuuuccuguugugcaaaaaugacucauugcuccgaaugu

SEQ ID NO: 615683 - RNA, 61 nt, hsa
uauuuaugggcugguaaacucauuguacauaugugcaaaacugcuacugaguggggagcuu

SEQ ID NO: 615684 - RNA, 61 nt, hsa
ggguggcccgccauccccuggaguaaaugccugugcaaagcccuccucauccuugucugag

SEQ ID NO: 615685 - RNA, 61 nt, hsa
uuuccaguguucaguaaauagcagcuaugugugugcaaaauaaaagaaugauuucagaaau

SEQ ID NO: 615686 - RNA, 61 nt, hsa
cuuauaaugguuguuuuugauaccugaaaauugugcaaaugccaaauauuaauuguaaguc

SEQ ID NO: 615687 - RNA, 61 nt, hsa
uuuauaucuugggauuuuucacaacugauaaugugcaaagauauaaacugauuaacuuguc

SEQ ID NO: 615688 - RNA, 61 nt, hsa
auaaguucaggauauuucuuuucuauuugguugugcaaaauguuuuucccaguuauuuaau

SEQ ID NO: 615689 - RNA, 61 nt, hsa
ugugagcaccuuuccugaaauucugacaccaugugcaaacugauccauccuguuuuuccuu

SEQ ID NO: 615690 - RNA, 61 nt, hsa
ugaaaacuucuuguauuuccugauguaaaauugugcaaacaccuacaauaaagccaucuac

SEQ ID NO: 615691 - RNA, 61 nt, hsa
uauugugcuuuuuagaacaaaucuggauaaaugugcaaaaguaccccuuugcacagauagu

SEQ ID NO: 615692 - RNA, 61 nt, hsa
uaacagaaacucaacucuaaauucaacaagaugugcaaaccggacaugcaggugaauauuu

SEQ ID NO: 615693 - RNA, 61 nt, hsa
aaguuugccugcaaguaaagaauugagagugugugcaaagcuuauuuucuuuuaucugggc

SEQ ID NO: 615694 - RNA, 61 nt, hsa
uauguuauaaauuaguuuuggggggaauaauugugcaaagaggauaauuuaauuuacgugc

SEQ ID NO: 615695 - RNA, 61 nt, hsa
auuuaauuguuuagaauauuaaguuuuccucugugcaaauuuaaaacaaauaacaagagau

SEQ ID NO: 615696 - RNA, 61 nt, hsa
auggccugccugccuucccuguccguucaccugugcaaaggcuuccucagacaugccacuc

SEQ ID NO: 615697 - RNA, 61 nt, hsa
ccuauugggguuaaguuuguaaguguuuaauugugcaaauugccacccuguguaccuccuc

SEQ ID NO: 615698 - RNA, 61 nt, hsa
aauaugcuguuuacauuuauuuucuucagccugugcaaaacaaagcaauggaaaaggaaac

SEQ ID NO: 615699 - RNA, 61 nt, hsa
uuuaauuacauacacagugaauugaaaccauugugcaaaauggauuacacauguauacaaa

SEQ ID NO: 615700 - RNA, 61 nt, hsa
aggaaaaaauacggaggauaaccacuauuuuugugcaaauaauaugaaagugaaguaaaag

SEQ ID NO: 615701 - RNA, 61 nt, hsa
aggagaugcuuauagaugauaguuguacauaugugcaaaaaaaaauccacuugcaauggua

SEQ ID NO: 615702 - RNA, 61 nt, hsa
ggaggcacaaacucugcacgggggaacugugugugcaaaggugagcugggggcgagaaagg

SEQ ID NO: 615703 - RNA, 61 nt, hsa
aucggacgggacaggguggagcggggaggccugugcaaagugggaaagagcugccgguggc

SEQ ID NO: 615704 - RNA, 61 nt, hsa
ggggaggguauuucuggaaaguggaccagcaugugcaaaaauauggaacugagcacgggug

SEQ ID NO: 615705 - RNA, 61 nt, hsa
ugcacuguugaacuaaguaacuguguaaaucugugcaaagguacguauguuuaucuuacuc

SEQ ID NO: 615706 - RNA, 61 nt, hsa
aucuuggcuuaauuuaauguauuaaucuguuugugcaaacauaauaccaccauuuaaaaau

SEQ ID NO: 615707 - RNA, 61 nt, hsa
cuuuuaucuucucugcaguguuauauguuggugugcaaaaauguuaaauuuauuuuuccua

SEQ ID NO: 615708 - RNA, 61 nt, hsa
aaauuagugaaccaaaaauagaaauuagauuugugcaaacauggagaaaucuacugaauug

SEQ ID NO: 615709 - RNA, 61 nt, hsa
cagaguugcucuucaccaguguuuuucuucaugugcaaagugacuauuuguucuauaauac

SEQ ID NO: 615710 - RNA, 61 nt, hsa
agcuccagagagugucaaacccagagaaaugugugcaaaaaugauacucuuuucugcauua

SEQ ID NO: 615711 - RNA, 61 nt, hsa
uaauuuauuuacgauaucuagagcuguguuuugugcaaaaacuuagugaugaaagccuguc

SEQ ID NO: 615712 - RNA, 61 nt, hsa
auuucccuaaaaguaucuccauggaaugaacugugcaaaaucuguaggaaacugaaugguu

SEQ ID NO: 615713 - RNA, 61 nt, hsa
ccuucaggugaucacacacaguggacgaguaugugcaaacauggacauaauaguucacuua

SEQ ID NO: 615714 - RNA, 61 nt, hsa
aaguaaaucugcaaauuccuucuaaauuucaugugcaaauaauuauauauaaauauauuua

SEQ ID NO: 615715 - RNA, 61 nt, hsa
auuauguucaaguuauuucaggauugccauaugugcaaacaaaucaugcaaugcagccaag

SEQ ID NO: 615716 - RNA, 61 nt, hsa
gaagggaaaacuccaaaccaguugggagacuugugcaaaggacuuugcagauuaaaaaaaa

SEQ ID NO: 615717 - RNA, 61 nt, hsa
uauaucugcuucaguggagaauuauauagguugugcaaauuaacaguccuaacugguauag

SEQ ID NO: 615718 - RNA, 61 nt, hsa
gcuuuuaaaaugggaauaauuuguauguaucugugcaaauaauaaaugcgcauuuggaaaa

SEQ ID NO: 615719 - RNA, 61 nt, hsa
ccaaaauucaugguuaaauuagaacuuacuaugugcaaauauagaagcacggguccacaga

SEQ ID NO: 615720 - RNA, 61 nt, hsa
gcucacacacgaaauggcuaaaaguuacaagugugcaaauuaugacugcgugagccuuaga

SEQ ID NO: 615721 - RNA, 61 nt, hsa
acaauacugcuuucucagguucuuaacagccugugcaaacucccugacuagauggucuguc

SEQ ID NO: 615722 - RNA, 61 nt, hsa
ugggagccaggaugagugucgggcucucgugugugcaaaaggucagaugugacugcugcug

SEQ ID NO: 615723 - RNA, 61 nt, hsa
cauucaaaauggggcagggcaagggugggagugugcaaagcccugaucuggaguuaccuga

SEQ ID NO: 615724 - RNA, 61 nt, hsa
auggauacauggcuguucgugacauucuuuaugugcaaauuugugauuucaaaaauguccu

SEQ ID NO: 615725 - RNA, 61 nt, hsa
uggguugaacugaacaagaggaugggggaauugugcaaauacguuguuaguagaaggucaa

SEQ ID NO: 615726 - RNA, 61 nt, hsa
aucugaucuuuguuuuguauuuuugugcuaaugugcaaacauguacagaagaaauagaaua

SEQ ID NO: 615727 - RNA, 61 nt, hsa
aauuauuuuuagcaaaauguugccuuugucuugugcaaacauguagaauaugcucuuuaau

SEQ ID NO: 615728 - RNA, 61 nt, hsa
caagaaaugggaggcuucaccuuaaaaacagugugcaaauggcagcuagagguuuugauag

SEQ ID NO: 615729 - RNA, 61 nt, hsa
gccagaauguuuccuguggaaauaugcaaccugugcaaaauaaaaugaguuaccucaugcc

SEQ ID NO: 615730 - RNA, 61 nt, hsa
auguuuacauacugguuuacaauguuauuuaugugcaaauugucaaaauguaaauuaaaua

SEQ ID NO: 615731 - RNA, 61 nt, hsa
ggggugcuaaaacuuuaaaaaaaaucucuacugugcaaauaucauuauucacucagacuuc

SEQ ID NO: 615732 - RNA, 61 nt, hsa
aaugagcccggaacgcaggcccccaugucucugugcaaagccucccugcuucccucugcug

SEQ ID NO: 615733 - RNA, 61 nt, hsa
acaagccagagaucucccacaccuccagagaugugcaaacagcugggaggaaaagccuggg

SEQ ID NO: 615734 - RNA, 61 nt, hsa
gaucucuuauugaguugggagauucaccuugugugcaaagaaacacagauaguaguaaaaa

SEQ ID NO: 615735 - RNA, 61 nt, hsa
uuacaaguagcuaauuauuuuagcacaaagaugugcaaagaaaggagacuuuauggagagu

SEQ ID NO: 615736 - RNA, 61 nt, hsa
accaccguggguacauuguugggcaggagugugugcaaacacaggucugugugugcaaucu

SEQ ID NO: 615737 - RNA, 61 nt, hsa
agacgccgucucaaaaaaaaaaaaagaaaauugugcaaagcauagguaaauauuuuucuuu

SEQ ID NO: 615738 - RNA, 61 nt, hsa
uauaagacuacuggcuuugugagggaauguuugugcaaaauuuuuuccucuaauguauaau

SEQ ID NO: 615739 - RNA, 61 nt, hsa
aacagaacaggagguaucaaacuagcugcuaugugcaaacagcguccauuuuuucauauua

SEQ ID NO: 615740 - RNA, 61 nt, hsa
gagcucugacacaucugaaaaaguaaucugaugugcaaauuauaauuuaaauauguuaauu

SEQ ID NO: 615741 - RNA, 61 nt, hsa
cuuuagcuauuaauggggcauugugaggaacugugcaaagacauuuuuguuacaaaccugu

SEQ ID NO: 615742 - RNA, 61 nt, hsa
gacucaaaguagaucguuauuuugaucaaacugugcaaacaguaguaccacguguagcauu

SEQ ID NO: 615743 - RNA, 61 nt, hsa
caggccugcuuuuugcuuauaauugacaacaugugcaaaaauaccaaauuuguguccugug

SEQ ID NO: 615744 - RNA, 61 nt, hsa
ugaaucuuaaaaggaagaagaaaagaaaagcugugcaaauucauaguaaaguucguuuuuu

SEQ ID NO: 615745 - RNA, 61 nt, hsa
caauuacauaguaccgauaacagccaugcacugugcaaagcaugcccuucugcacaggaga

SEQ ID NO: 615746 - RNA, 61 nt, hsa
augccaacacuuccuuuugccuuuuguuuccugugcaaacaagugagucaccccuuugauc

SEQ ID NO: 615747 - RNA, 61 nt, hsa
ucucgcuuuggaaaaagacggccaucccuuuugugcaaaacaaauguaaauauuuucuuga

SEQ ID NO: 615748 - RNA, 61 nt, hsa
acaugcaauuagccuuuugaaauccaacuucugugcaaaauuuuaguaucagaaaauacga

SEQ ID NO: 615749 - RNA, 61 nt, hsa
uggcagcuuuagcccuccuccagaucacaugugugcaaauuauggcuucagagguggaaga

SEQ ID NO: 615750 - RNA, 61 nt, hsa
acagucuccucguguaucuccagagacugcaugugcaaaguaaaaugcuucauuugccaca

SEQ ID NO: 615751 - RNA, 61 nt, hsa
ccauaggcguuuuguucauaugagccugguuugugcaaaauuaaaucagaggcuucuacaa

SEQ ID NO: 615752 - RNA, 61 nt, hsa
uuuuuuguauauaaauguauuuauggaauauugugcaaauguuauuugaguuuuuuacugu

SEQ ID NO: 615753 - RNA, 61 nt, hsa
cagcagacagccauggcucuucccagcagccugugcaaauucugaugauggccccaccccc

SEQ ID NO: 615754 - RNA, 61 nt, hsa
gaguuacugauacagauucauuuaaggcuugugugcaaauuuugucucaaucuuuuuuccc

SEQ ID NO: 615755 - RNA, 61 nt, hsa
cuaggaauuagcuguauaguuaaguuaugccugugcaaagaagaggcucaaaugcuguccc

SEQ ID NO: 615756 - RNA, 61 nt, hsa
gccccagggguuggcccaugcuuucccuaacugugcaaaaaugguuugggauaggcugggu

SEQ ID NO: 615757 - RNA, 61 nt, hsa
aagaaaacuucuuguagccucacauuccccuugugcaaagagcucuuuuggaccuacauac

SEQ ID NO: 615758 - RNA, 61 nt, hsa
agaccuuuucuuuuuuuuuuuuuuuuuaaugugugcaaaagcccaaagguuccuaagccug

SEQ ID NO: 615759 - RNA, 61 nt, hsa
acaagcugaguguucauguuccauggugggcugugcaaauaaacuccuuuuagaccugcag

SEQ ID NO: 615760 - RNA, 61 nt, hsa
auuucuauauguaaauaaaagauauaaugauugugcaaauuuauauuccuagugucuuccu

SEQ ID NO: 615761 - RNA, 61 nt, hsa
aucugcacccucuggagggcaucuguacuccugugcaaaaugcccaguccagagacaaaac

SEQ ID NO: 615762 - RNA, 61 nt, hsa
acucaauuuuauguuuccuuuuggcauucuuugugcaaaaagaagcaugugguggcucuca

SEQ ID NO: 615763 - RNA, 61 nt, hsa
aaaccuugggaagauguaucaauggagcaugugugcaaaaaaauguaagaggaaaaaaagu

SEQ ID NO: 615764 - RNA, 61 nt, hsa
cagcagacagccauggcucuucccagcagccugugcaaauucugaugaugaccccaccccc

SEQ ID NO: 615765 - RNA, 61 nt, hsa
aaagaaauguuaguaucucaauuacaccaacugugcaaaugaacuuugauaaaauagaaau

SEQ ID NO: 615766 - RNA, 61 nt, hsa
cccacauuuuccugagagaagccacaaaagaugugcaaaugcccuucagcacaggaccugg

SEQ ID NO: 615767 - RNA, 61 nt, hsa
uucauuuguuaucuacauuuugaaggguuuaugugcaaagugaaaacaaauuuugaaaaau

SEQ ID NO: 615768 - RNA, 61 nt, hsa
cauguagcggacuuuaacugcuccaaggaguugugcaaacuuuucauuccauaacagucuu

SEQ ID NO: 615769 - RNA, 61 nt, hsa
auuguggcugguuucuugaacacauucuaacugugcaaaauuaucuuggccuuggccgugu

SEQ ID NO: 615770 - RNA, 61 nt, hsa
auaaugggagcauguggauggggugucugcgugugcaaacggguucccuagcaaaguauuu

SEQ ID NO: 615771 - RNA, 61 nt, hsa
acuggggcucuccugaggcccccuucuagccugugcaaacccuguaugugcauuaaaaauc

SEQ ID NO: 615772 - RNA, 61 nt, hsa
cucgauuuaaacuccagcauuuagauaaucuugugcaaaauguguuucagccguauagugg

SEQ ID NO: 615773 - RNA, 61 nt, hsa
ucuccacacccuagagcuuuucucuaaauauugugcaaaguuuuugcuaguuuuaucuucu

SEQ ID NO: 615774 - RNA, 61 nt, hsa
uaauuuuauuuuguacaauguuuuuuuuaaaugugcaaauacuguauucaagugaaaaaaa

SEQ ID NO: 615775 - RNA, 61 nt, hsa
uacagaggguaggaauggguauaccucuaacugugcaaagcagagugaaauucaauucaua

SEQ ID NO: 615776 - RNA, 61 nt, hsa
gucaacacccacaggagagaauaaaauuaccugugcaaagguguauugugguguguguaac

SEQ ID NO: 615777 - RNA, 61 nt, hsa
gccuuauauuuugauguaaagauuaaaagaaugugcaaaacagucagaaauuuuuauugcc

SEQ ID NO: 615778 - RNA, 61 nt, hsa
auucauagaccuugacuggaauauguaagacugugcaaaaaaaaaaaaaaaauuuaugugu

SEQ ID NO: 615779 - RNA, 61 nt, hsa
acuugguuuugacccacagaauauagcacguugugcaaacugucgauucagcgaaacuuaa

SEQ ID NO: 615780 - RNA, 61 nt, hsa
aaaggaacucacauuuauugagggccuacugugugcaaaguguuucauguauaucucauug

SEQ ID NO: 615781 - RNA, 61 nt, hsa
guccuuacugcugugaagaacaaauaccaacugugcaaauugcaaaacugacuacauuuuu

SEQ ID NO: 615782 - RNA, 61 nt, hsa
aguagcauuuuuuuucccucuccugugaaucugugcaaaacauugaagguagaaguuuucu

SEQ ID NO: 615783 - RNA, 61 nt, hsa
caaccagaaguacacauuuacaauagauagaugugcaaaagaccuuuuuguagccaaacaa

SEQ ID NO: 615784 - RNA, 61 nt, hsa
auauuuaaacuuacagauggaaauugcccaaugugcaaauuguuaaguaccacacuuuaca

SEQ ID NO: 615785 - RNA, 61 nt, hsa
uuauucuuuaaaauugaacuccaacccugauugugcaaacugauuaaagaauggaugguac

SEQ ID NO: 615786 - RNA, 61 nt, hsa
cugcacugaaaggaccugcauagacuaugucugugcaaagugccugagugucugcuuucac

SEQ ID NO: 615787 - RNA, 61 nt, hsa
aaggauuucagauuauagucuaugugagauaugugcaaacauguacauauuuccccuagaa

SEQ ID NO: 615788 - RNA, 61 nt, hsa
auugaaaagcucucugaugagcaccuccuuuugugcaaaguuaauuuuuucucgacaauaa

SEQ ID NO: 615789 - RNA, 61 nt, hsa
accugggccagcggcugagcuguacauaccgugugcaaaguguauaugaaguuauuuauuc

SEQ ID NO: 615790 - RNA, 61 nt, hsa
cagcugaccuccggucaccugcuuccccuucugugcaaauaaaccaggcuguuaucugggg

SEQ ID NO: 615791 - RNA, 61 nt, hsa
gugcuaggacagcucuaaacagugagcucgaugugcaaaacgcaguccaugaaaaccagaa

SEQ ID NO: 615792 - RNA, 61 nt, hsa
gcaucuucauugagggaaagaaaacagucauugugcaaaauucuguuagucagugauucuu

SEQ ID NO: 615793 - RNA, 61 nt, hsa
agaaaagaaaaagggcauuccagcuggggcaugugcaaaggcagcacguaauguguaaguu

SEQ ID NO: 615794 - RNA, 61 nt, hsa
ggggaagagcauuccagggagagggaggaguugugcaaaggcccuggggcuccuucuagcu

SEQ ID NO: 615795 - RNA, 61 nt, hsa
uguacuuugggaagucacagaaauacauuuuugugcaaaauggaaaacagagcgucuuuuu

SEQ ID NO: 615796 - RNA, 61 nt, hsa
aggaagugugaaguuuuguguguaugauuucugugcaaaaacaaaagcaacacuccugagu

SEQ ID NO: 615797 - RNA, 61 nt, hsa
auuuauuguuuucaucuauuuggguacgaagugugcaaagucacagaccuuuugcaaagag

SEQ ID NO: 615798 - RNA, 61 nt, hsa
acaugcuguuuuaccuuccaagaauaggacaugugcaaaaacuaggcuuccagaucgugag

SEQ ID NO: 615799 - RNA, 61 nt, hsa
uuuucuccagacagaaaugcaaagaucaaacugugcaaauauuaaaaaaaugcacaugcug

SEQ ID NO: 615800 - RNA, 61 nt, hsa
ccuccauuacggagaguuuccuauguuucacugugcaaauauaucugcuauucuccauacu

SEQ ID NO: 615801 - RNA, 61 nt, hsa
uuuucauugugaucagauuaaaauuacuauuugugcaaaacaaauuccacaccacauguac

SEQ ID NO: 615802 - RNA, 61 nt, hsa
uguauguguaaaacaaucuguuuuggcuuuaugugcaaaaucuguuauagcuuuaaaauau

SEQ ID NO: 615803 - RNA, 61 nt, hsa
ugcaguguucguccccuauucauuaacagugugugcaaaugcaaccccaggacacauuauu

SEQ ID NO: 615804 - RNA, 61 nt, hsa
aucauuaaauuuuucucauaguucagaaaaaugugcaaaggaaacuauugucucgcuccuu

SEQ ID NO: 615805 - RNA, 61 nt, hsa
guacccgcgacuaacuagacuuuucugcuguugugcaaaguucaguuucuucucagcaaca

SEQ ID NO: 615806 - RNA, 61 nt, hsa
gcaaaaagaagccauguguaacaaagagaaaugugcaaauauuuuuuaaggcaguauuaag

SEQ ID NO: 615807 - RNA, 61 nt, hsa
ccugcagccuggacucggcacucacagcugcugugcaaacucaggcagaucuccugcccuc

SEQ ID NO: 615808 - RNA, 61 nt, hsa
uugacauccaauucaaacugcauuugcaaaaugugcaaagaccucuuaugagggaccaauu

SEQ ID NO: 615809 - RNA, 61 nt, hsa
ggaggagcuuaguaaguggugcuacaauugcugugcaaagaaauuccagaggggagaagaa

SEQ ID NO: 615810 - RNA, 61 nt, hsa
cucucugcccauuacagcuucuagccuguguugugcaaaagaauuggaaggauguggugug

SEQ ID NO: 615811 - RNA, 61 nt, hsa
acagcaaaguuaaccugacacagaaaauccuugugcaaauaaaugcuuaguaaguacacag

SEQ ID NO: 615812 - RNA, 61 nt, hsa
auagucaaauguacuguaaagugaaaagggaugugcaaaaaaauaaaaaaaaacaacaaaa

SEQ ID NO: 615813 - RNA, 61 nt, hsa
aacaggaugcucauagcuuaauaauaaaagcugugcaaaggccaugaaugaaugaauuuuc

SEQ ID NO: 615814 - RNA, 61 nt, hsa
cuaacguauuaucuuuuucaaaccagauuuaugugcaaagguuaaacauguaacuguuacu

SEQ ID NO: 615815 - RNA, 61 nt, hsa
caucacuggaugaagauucuccugugcuagaugugcaaaugcaagcuaguggcuucaaaau

SEQ ID NO: 615816 - RNA, 61 nt, hsa
aguaagcaagauuuaacuguuugauuauaacugugcaaauacagaaaaaaagaaggcuggc

SEQ ID NO: 615817 - RNA, 61 nt, hsa
auaacaaagcaguuacgaagccuacagauuuugugcaaaauaaaauacaaacaaggugaau

SEQ ID NO: 615818 - RNA, 61 nt, hsa
gugacuuuugggcccggggccaugcccgggcugugcaaagcuggccagggccuccuguagg

SEQ ID NO: 615819 - RNA, 61 nt, hsa
cagggaauguguuccacagagagggacagcaugugcaaaggcugagcaccaacacauagug

SEQ ID NO: 615820 - RNA, 61 nt, hsa
aggugcuuguugugugaaaguucuguagaugugugcaaauuuaacgaaaugaaauuguaug

SEQ ID NO: 615821 - RNA, 61 nt, hsa
auggacaauccaagaagaaauugguauacuuugugcaaaucugccauaagcucaaggcugu

SEQ ID NO: 615822 - RNA, 61 nt, hsa
gacugaaacucaaacaacccugggcaaguaaugugcaaaagauggcaggguggggauuuga

SEQ ID NO: 615823 - RNA, 61 nt, hsa
acuccucugcagggagcgccaucugugugcgugugcaaauaugacucaauucacguaaaga

SEQ ID NO: 615824 - RNA, 61 nt, hsa
auuucauuguuucuguuacuaacauuaaaagugugcaaauuguauaaaauuagguacuucg

SEQ ID NO: 615825 - RNA, 61 nt, hsa
auuuuuaccuggaaauuccaugaccaauacaugugcaaaagaaaaugauggguugaauuua

SEQ ID NO: 615826 - RNA, 61 nt, hsa
augagccccccgggccggacaggggcacacgugugcaaagagacggugguguguguucucu

SEQ ID NO: 615827 - RNA, 61 nt, hsa
gcugacuaaagaaccagccaaagccuuaaauugugcaaaacauacuguugcuaugauguaa

SEQ ID NO: 615828 - RNA, 61 nt, hsa
ucucaguagaaaggaacagaaaacaaacaucugugcaaaacccuauaaaagugauauuccu

SEQ ID NO: 615829 - RNA, 61 nt, hsa
uuuuaaccaauagauauucucucuaaaauuaugugcaaaucaauuuuuaaaaaucaaaauc

SEQ ID NO: 615830 - RNA, 61 nt, hsa
uagguaaagaguuccaaguucguccagcccaugugcaaagucaacaguauuugccuuaaga

SEQ ID NO: 615831 - RNA, 61 nt, hsa
cagcauacugacucaauucuuaagucugauuugugcaaauuuuuaucguacuuuuuaaaua

SEQ ID NO: 615832 - RNA, 61 nt, hsa
guauccaaggcaaacucuaauacccauccauugugcaaaaccacaagcacgcaaguauuaa

SEQ ID NO: 615833 - RNA, 61 nt, hsa
ugaggagcgacacacacaccuguaggcauccugugcaaacacuuugucauuaucaagagag

SEQ ID NO: 615834 - RNA, 61 nt, hsa
aguguagucauuauuguuguauugggugaugugugcaaaacugcagaagcucacugccuau

SEQ ID NO: 615835 - RNA, 61 nt, hsa
gauacuaccauccaaaucuaucuagauaucuugugcaaauauuuuauugauuacaagggcu

SEQ ID NO: 615836 - RNA, 61 nt, hsa
uuaacuuaaaaacaacuguuaauguucuaguugugcaaagcaguuugccuguggauaagau

SEQ ID NO: 615837 - RNA, 61 nt, hsa
uacacaauggacccucaauaaauggccuauaugugcaaagaaagaauguguagcaaaugaa

SEQ ID NO: 615838 - RNA, 61 nt, hsa
gaaauuucuguaccuucaaccugguguuaggugugcaaaguccguguccuaccuccgucuu

SEQ ID NO: 615839 - RNA, 61 nt, hsa
gucaggagaaaaccaccuucauaaacugcucugugcaaagaggaauaaaacauuuuuucca

SEQ ID NO: 615840 - RNA, 61 nt, hsa
caaaacaggacaucuuauggccugcuuuacaugugcaaagaagcuaaagaaaaggaauaag

SEQ ID NO: 615841 - RNA, 61 nt, hsa
aaggaccugaauucuguuuacuucuucuggcugugcaaaagcacacucaagugaaugacua

SEQ ID NO: 615842 - RNA, 61 nt, hsa
ggaccugagucaaugcgcaaaaugcagcuugugugcaaaagcagugggcuccuggcagaag

SEQ ID NO: 615843 - RNA, 61 nt, hsa
gggaauacuucaugcaaagaaaaaaguaacaugugcaaaagcuccccguccagcuuugaca

SEQ ID NO: 615844 - RNA, 61 nt, hsa
uucagagugacuauguaugacuaucaggccaugugcaaacccucgagucaccaccacagug

SEQ ID NO: 615845 - RNA, 61 nt, hsa
aaaugucugaagccaguuaguuugauuacccugugcaaaaccuuggacauacuucugcuau

SEQ ID NO: 615846 - RNA, 61 nt, hsa
guuagaugccccgaucccacuggcauuugagugugcaaaccuugacauuaacagcugaaug

SEQ ID NO: 615847 - RNA, 61 nt, hsa
agagcaguguuucggacgcugggaagcgcgcugugcaaagcgcucucggggucuuuccuca

SEQ ID NO: 615848 - RNA, 61 nt, hsa
uccuagaaauccuggguagaagugguggaccugugcaaaggagguuuuagaacucugcagu

SEQ ID NO: 615849 - RNA, 61 nt, hsa
ugguugaauuuguucaguauaagcucguucuugugcaaaauuaaauaaauauuucucuuac

SEQ ID NO: 615850 - RNA, 61 nt, hsa
gugggcacaaaagaaggggcaccagagucccugugcaaacaccuagacucacuucauggau

SEQ ID NO: 615851 - RNA, 61 nt, hsa
uuaguguuuuuuuauuucuacugucaaaugaugugcaaaaccuuuuacugguugcauggaa

SEQ ID NO: 615852 - RNA, 61 nt, hsa
uagaggugauuaaaaccaacaaggaguuucaugugcaaaggagauaaggaaugaauauaaa

SEQ ID NO: 615853 - RNA, 61 nt, hsa
ugauccacaauauaaaaaccaaaaacuacugugugcaaauuauaccuuggaccauauaggc

SEQ ID NO: 615854 - RNA, 61 nt, hsa
uugccaacucaaaauaacauuauuuaaugcaugugcaaaguuaggucuucccaguugucuc

SEQ ID NO: 615855 - RNA, 61 nt, hsa
gcccaccccugacccuuacuaauuuuucuaaugugcaaacuuuuucauugaaaaauaaaau

SEQ ID NO: 615856 - RNA, 61 nt, hsa
aagaaaagcuggugacauauuuauacguuuuugugcaaaaauaaaugaauggcaauagauu

SEQ ID NO: 615857 - RNA, 61 nt, hsa
cccucaugugacaugaacccauccaauggauugugcaaauccccuccccaaacccacccau

SEQ ID NO: 615858 - RNA, 61 nt, hsa
caaaucuaguuauguauuggccuaaauuauuugugcaaaauuugaaauguuuuuuauuuaa

SEQ ID NO: 615859 - RNA, 61 nt, hsa
cacuuaggaauguguaaaugguaaagucugaugugcaaacguuuuaccauaguuagagcca

SEQ ID NO: 615860 - RNA, 61 nt, hsa
aacaauacauuccacaaagccauuuucuuuuugugcaaaccugacauguucaaauauauuc

SEQ ID NO: 615861 - RNA, 61 nt, hsa
aguuaauagauuuuuucagacuugucaagccugugcaaaaaaauuaaaauggaugccuuga

SEQ ID NO: 615862 - RNA, 61 nt, hsa
uggguuaggcauuaauguuucuaucugauuuugugcaaaagcuucaaauuaaaacagcugc

SEQ ID NO: 615863 - RNA, 61 nt, hsa
uugcauaguugcacuacaagaagaauguaguugugcaaaucuaugcaaaacugaugguggc

SEQ ID NO: 615864 - RNA, 61 nt, hsa
cagguuugcauccagcugugugauauucugcugugcaaauccaugcaaaacugacuguggu

SEQ ID NO: 615865 - RNA, 61 nt, hsa
agaugcuguugugaagcuaaugucacaauuaugugcaaaggugugcuuccugcuguaugug

SEQ ID NO: 615866 - RNA, 61 nt, hsa
cuuuuaggcauuuaaauuguuucuguuacucugugcaaaauaacuuugagauuggacaaga

SEQ ID NO: 615867 - RNA, 61 nt, hsa
acaacaacuuacuaaaccagcuaaaaucacuugugcaaauugcaaaaagccuuuacagaag

SEQ ID NO: 615868 - RNA, 61 nt, hsa
cauauagcauaugugucauuacaugugaugcugugcaaaacuuuguauaauucuguguuau

SEQ ID NO: 615869 - RNA, 61 nt, hsa
auuuaaaauuuucaaaaugaaauuccauauaugugcaaacagauaugggcaccacgaaaua

SEQ ID NO: 615870 - RNA, 61 nt, hsa
aucaguuauuguacaugauugcuuugugaaaugugcaaaugauaucaccuaugcagccuug

SEQ ID NO: 615871 - RNA, 61 nt, hsa
ugaugucacauucugacacaagaugcaagucugugcaaaacccaccaaaaugcuccuaucc

SEQ ID NO: 615872 - RNA, 61 nt, hsa
aauugauuacacucuccagagaucucuccauugugcaaauuuuuuuuauuauugcauuuua

SEQ ID NO: 615873 - RNA, 61 nt, hsa
acuugucacacggaccucgggcuaguuaaggugugcaaagaucucuagaguuuaguccuua

SEQ ID NO: 615874 - RNA, 61 nt, hsa
agucguauacucaaaugaugauaaaccuacaugugcaaaggcucacguuuaagauugucaa

SEQ ID NO: 615875 - RNA, 61 nt, hsa
cuguacauucucuuucuaguuuaguaaaagaugugcaaaggccagagagggccgaaaauga

SEQ ID NO: 615876 - RNA, 61 nt, hsa
ccuccauuaucagccagaagugcaacauguaugugcaaaagcuaaaauggcuuaacaucau

SEQ ID NO: 615877 - RNA, 61 nt, hsa
uuguuuuuuaaaacaauucuguagaaauguuugugcaaauucaguaauucaacuuaaaaua

SEQ ID NO: 615878 - RNA, 61 nt, hsa
gguaauaugccucugcccuuuagucagacucugugcaaauugugaaauauuauuuuauuau

SEQ ID NO: 615879 - RNA, 61 nt, hsa
acuauuuuauaaacaaacuacagagccuaaaugugcaaauuacaggcaagacaacaaagcc

SEQ ID NO: 615880 - RNA, 61 nt, hsa
uguuuccugcaguaaagaaaaauucuucauuugugcaaaauuugaacaaagaggaaaucau

SEQ ID NO: 615881 - RNA, 61 nt, hsa
cguugcagucacucgguuaucuaugaaggguugugcaaaacaggaaggucugggaaugacc

SEQ ID NO: 615882 - RNA, 61 nt, hsa
agcuauuuuucugaucuuauucaacuuuaguugugcaaaagaaauucuaagugaaugcgcg

SEQ ID NO: 615883 - RNA, 61 nt, hsa
ccuggugggugaggggcaggggcaguggcagugugcaaagaauugauuacuccuugcagag

SEQ ID NO: 615884 - RNA, 61 nt, hsa
uuccaucaugucaaggucacaggcauccaugugugcaaaccaucugccccagcugccucca

SEQ ID NO: 615885 - RNA, 61 nt, hsa
guuaauuuaauuuuuaaaugcuuuauccauuugugcaaagguaaacgcagauuguaucuuu

SEQ ID NO: 615886 - RNA, 61 nt, hsa
uauucaccuuuuguuuaugaauggaaagcuuugugcaaaauauacauauaagcagaguaag

SEQ ID NO: 615887 - RNA, 61 nt, hsa
gaaagaaacagaagucaggcagaggcgugucugugcaaacuggaggacuccuuccaacuuc

SEQ ID NO: 615888 - RNA, 61 nt, hsa
gcacugguucgggagcccccaucagccuccuugugcaaacugggcccccaugccacagucu

SEQ ID NO: 615889 - RNA, 61 nt, hsa
uuuuuagaucuggccuuuucuuaacaaaaucugugcaaaagaugcagguggaugucccuag

SEQ ID NO: 615890 - RNA, 61 nt, hsa
uauauaucccuguuaaaaacugggaugaagaugugcaaagucacagaauguaauggaaguc

SEQ ID NO: 615891 - RNA, 61 nt, hsa
cuucgaccugcugauccuuggauccugaaucugugcaaacaguaacgugugcgcacgcgca

SEQ ID NO: 615892 - RNA, 61 nt, hsa
cuguucccuacaaugggaaaugucacaagaaugugcaaaaauaaaaaucugaggaaaaaac

SEQ ID NO: 615893 - RNA, 61 nt, hsa
uuacacacaugcacacacauaugcacacacaugugcaaacauagccacuuuuuugucaaga

SEQ ID NO: 615894 - RNA, 61 nt, hsa
uuacugcuguucuagcccccaaagaguuuucugugcaaaaucuugagaaucaaucaauaaa

SEQ ID NO: 615895 - RNA, 61 nt, hsa
uuuucauuauuaauuuuuaggguaugggcacugugcaaagacuccauagcugugccuagga

SEQ ID NO: 615896 - RNA, 61 nt, hsa
caucuuuggucaucuaagauuuguuuacaaaugugcaaauuauuuagagcauagacuuuau

SEQ ID NO: 615897 - RNA, 61 nt, hsa
uguuacuaauauccaugacauucaguggccuugugcaaauacgauauguugcuuaggcaua

SEQ ID NO: 615898 - RNA, 61 nt, hsa
ugugcugaccgucagauugugucaagucaggugugcaaauugaccacacucccaaagaauc

SEQ ID NO: 615899 - RNA, 61 nt, hsa
acuguuugaaucuugucucacuaguuuuuccugugcaaaaauaaaauggacagaauugcag

SEQ ID NO: 615900 - RNA, 61 nt, hsa
uacauuuucuucuggccuaaaugaauauuuaugugcaaacauaggcaacuguuaaaggcug

SEQ ID NO: 615901 - RNA, 61 nt, hsa
guagcacuugugcaucugaguugaaugaagcugugcaaacccacccuuuaaaccauuccac

SEQ ID NO: 615902 - RNA, 61 nt, hsa
uauguugaagccuuuguaaauugucagaugcugugcaaauguuauuauuuuaaacauuaug

SEQ ID NO: 615903 - RNA, 61 nt, hsa
cccugacuucuggaggcuucccuugaagcucugugcaaaaggugggagacagagcuggacc

SEQ ID NO: 615904 - RNA, 61 nt, hsa
aaaauucuggcuccaaaaauagcauuuucuuugugcaaauaaaaacguguguaucaaguau

SEQ ID NO: 615905 - RNA, 61 nt, hsa
gucuucagaagaccucgcuuuaaaacaaauuugugcaaacacugcuagagucauuuugaag

SEQ ID NO: 615906 - RNA, 61 nt, hsa
uccaugcacuaguacauguaggcuucucccuugugcaaagcuuagcaauuuguaggaaacu

SEQ ID NO: 615907 - RNA, 61 nt, hsa
agugguugaauccugugagacuuggcaagugugugcaaaucaaguauacuugacuuuucaa

SEQ ID NO: 615908 - RNA, 61 nt, hsa
ugacaagauggagaaagcaagaucaugaaggugugcaaaugauucuuacggcauggacaag

SEQ ID NO: 615909 - RNA, 61 nt, hsa
ucagccuggauuucuggucuuugguuauuucugugcaaacaaaaggugugccuggcagcca

SEQ ID NO: 615910 - RNA, 61 nt, hsa
cagacuguuccuuuaccaauauguaaaagaaugugcaaaauuaguaaaaauauacccaaaa

SEQ ID NO: 615911 - RNA, 61 nt, hsa
ggaacggugaucuucuugaaugauguuucagugugcaaaaacuauagagccugucagcacc

SEQ ID NO: 615912 - RNA, 61 nt, hsa
caaaauguuuggauguaauguuaaagcgcaaugugcaaaauuuaaaauaaagaauauuuau

SEQ ID NO: 615913 - RNA, 61 nt, hsa
gccugguuguaauuuguaaccauuuucuauuugugcaaacucuguaaauauguguuuaaac

SEQ ID NO: 615914 - RNA, 61 nt, hsa
uguuugucuuuuauaaugucuucagucugagugugcaaagucaauuuguaauauuuugcaa

SEQ ID NO: 615915 - RNA, 61 nt, hsa
cuggugcuccaguuccaguuccacgaaacacugugcaaagccucgggccacauggguccac

SEQ ID NO: 615916 - RNA, 61 nt, hsa
uuugggagcacaccugcuuugccuugcugccugugcaaauguuggacaagcagacacacuc

SEQ ID NO: 615917 - RNA, 61 nt, hsa
accauacauugucccaaaagugucugugcauugugcaaaaaguaaacuuaggaaacauuug

SEQ ID NO: 615918 - RNA, 61 nt, hsa
cagaagcucagggugcauaguaggagagaccugugcaaaucugagcuccggcuccgacccc

SEQ ID NO: 615919 - RNA, 61 nt, hsa
ugacaagauggagaaagcaagaucaugaaggugugcaaaugauucuuacggcaugggcgag

SEQ ID NO: 615920 - RNA, 61 nt, hsa
gcaucaccuccuccucuugcaguggaaacuuugugcaaagaauagauaguucugccucuuu

SEQ ID NO: 615921 - RNA, 61 nt, hsa
ccacagacagaagcuguggugguuuuuacuuugugcaaaaaggcagugaguuucgugaagc

SEQ ID NO: 615922 - RNA, 61 nt, hsa
ugacaagauggagaaagcaagaucacgaaggugugcaaaugauucuuaaggcauggacgag

SEQ ID NO: 615923 - RNA, 61 nt, hsa
ugauacuguacacauggaugucuuguuucuaugugcaaaaaaaaaaaaaaaaaaaaguuug

SEQ ID NO: 615924 - RNA, 61 nt, hsa
caggcuggaccugcccuguccucagcacgcgugugcaaaagugaacaauaaaucauuucaa

SEQ ID NO: 615925 - RNA, 61 nt, hsa
auaccacaaagccaagacguuccaugguauuugugcaaaagagaugaagacuucucaauau

SEQ ID NO: 615926 - RNA, 61 nt, hsa
gguaauuccagcuaaugggagagaauguaaaugugcaaagguacauauuaagcuuagggau

SEQ ID NO: 615927 - RNA, 61 nt, hsa
acugaaaguauggucgggugucagauauaaaugugcaaaugccuucuugcuguccugucgg

SEQ ID NO: 615928 - RNA, 61 nt, hsa
cagacccuguaguccaguggugcugcccuguugugcaaacugcuccuuuuucucguguuuu

SEQ ID NO: 615929 - RNA, 61 nt, hsa
cugugguaucuuuuauaaaaccucuugcuugugugcaaaaguuccuaaaaggaaacacaag

SEQ ID NO: 615930 - RNA, 61 nt, hsa
ucaguucuacggaucaucaacaagauuuccuugugcaaaauauuugacuauucuguaucuu

SEQ ID NO: 615931 - RNA, 61 nt, hsa
cugacugaaugccaggagcugaacauuaauaugugcaaagauuggcucuccaacaagaagg

SEQ ID NO: 615932 - RNA, 61 nt, hsa
gcccagcccugugugugaaucguuugugacgugugcaaaugggaaaggagggguuuuuaca

SEQ ID NO: 615933 - RNA, 61 nt, hsa
uuauuuuauucuuguaaugugaccuuuucacugugcaaagggagauuucuagccaggcauu

SEQ ID NO: 615934 - RNA, 61 nt, hsa
auauuuuguauauaugugauauaaauuaaugugugcaaauuguuuaaaaauuagauguguu

SEQ ID NO: 615935 - RNA, 61 nt, hsa
guccuccaguuuguauuuauuaauucugucaugugcaaaugguuguccugcauauaaaagu

SEQ ID NO: 615936 - RNA, 61 nt, hsa
gggacgacuuucuuuaacauaucauucagaaugugcaaagcaguauguacaggcugagaca

SEQ ID NO: 615937 - RNA, 61 nt, hsa
auccuguacaucuaaguaaugggggaaaaccugugcaaauuaauucacauacaugguucag

SEQ ID NO: 615938 - RNA, 61 nt, hsa
cuccccacgaagguaucucugugucuuacucugugcaaagacgcggcaaaacccagugccc

SEQ ID NO: 615939 - RNA, 61 nt, hsa
cagucaaugggggaccgcccgugucuaagcaugugcaaaggagaggagggagaugagguca

SEQ ID NO: 615940 - RNA, 61 nt, hsa
cacuagggagaaacccuaucaauguaagcaaugugcaaaagccuuuauuucuuccacuucu

SEQ ID NO: 615941 - RNA, 61 nt, hsa
ggaucacuugaggucaggaguuugagaccagugugcaaaacauagcaagaccucaucucag

SEQ ID NO: 615942 - RNA, 61 nt, hsa
caggguaggacaggcaagaccagauacccaaugugcaaagugaaaacacugggcucccugu

SEQ ID NO: 615943 - RNA, 61 nt, hsa
guucaacaucagggaauuuauauugaaaaauugugcaaauauaauaaauuuggaaaaacaa

SEQ ID NO: 615944 - RNA, 61 nt, hsa
gugugcacgcgugugagugugcaugugugugugugcaaagguccagccaccccguccucca

SEQ ID NO: 615945 - RNA, 61 nt, hsa
gggaguggggcaggcagugguugguggguggugugcaaagggaaugaagagcguccugggc

SEQ ID NO: 615946 - RNA, 61 nt, hsa
gcagggaugagacaauauugugcccugggucugugcaaacguugggaccagaauccacuau

SEQ ID NO: 615947 - RNA, 61 nt, hsa
cuucuccuuauucaccggggaggcugugucuugugcaaacaagucauagaaacuugauggg

SEQ ID NO: 615948 - RNA, 61 nt, hsa
ccuacuacucaggguugaugagaagauuaaaugugcaaaaccugcuugacugugcccacaa

SEQ ID NO: 615949 - RNA, 61 nt, hsa
uacugcagagcggucuuaacaauguaaagaaugugcaaauguccucagacaagaugcacac

SEQ ID NO: 615950 - RNA, 59 nt, hsa
uggcuauuacaaauaaaccucugaagauuugugugcaaauuauggcugaaugauauucc

SEQ ID NO: 615951 - RNA, 61 nt, hsa
gugcccggccgacgcgccuuugcaggagaaaugugcaaaccucuguggauaccauuucauu

SEQ ID NO: 615952 - RNA, 61 nt, hsa
uuuuauuagggauuuucaaaaggggagggagugugcaaauaggugugggucacagacauca

SEQ ID NO: 615953 - RNA, 61 nt, hsa
aauugagagccgcucucuguaaguguuugcuugugcaaaagggaauagugccguggaggug

SEQ ID NO: 615954 - RNA, 61 nt, hsa
gaagacucaauugguucauauuacucugaguugugcaaagcucauggagccuuuuggggua

SEQ ID NO: 615955 - RNA, 61 nt, hsa
cagcucucaggguugacucuguuccauccucugugcaaaauccucccgugcuucccuuugg

SEQ ID NO: 615956 - RNA, 61 nt, hsa
cagacaugacaacacacacacuggaaugaaaugugcaaacaugggggugacaccacagaga

SEQ ID NO: 615957 - RNA, 61 nt, hsa
uguggaaaacuguucuugggacugucucaacugugcaaaaaacaaaagauggaguguuuac

SEQ ID NO: 615958 - RNA, 61 nt, hsa
auagaggaugauguaauuaaaaaauggucagugugcaaagaaaagaacugcuugcauuucu

SEQ ID NO: 615959 - RNA, 61 nt, hsa
augguuacacauuucaguaacucauagcugcugugcaaauugguagaccuuauaagaaggc

SEQ ID NO: 615960 - RNA, 61 nt, hsa
acuucuauuucaacuuugaauuuccucuuccugugcaaauuccucuagucaagugugauau

SEQ ID NO: 615961 - RNA, 61 nt, hsa
augauguggggcuaagaaaaauaauuguccaugugcaaagaugugggcaagaauggccucu

SEQ ID NO: 615962 - RNA, 61 nt, hsa
acaaaacuccucuaaguacuucuaaauauucugugcaaauaucuugagaacuucaacaucc

SEQ ID NO: 615963 - RNA, 61 nt, hsa
ccugcuuucuuccuuucucuuuuuauuuuauugugcaaacauuucucaaauauggaaaaga

SEQ ID NO: 615964 - RNA, 61 nt, hsa
aaaaagaaugagagaaaagcccaguuaguggugugcaaacuuacuuccuuuaaauguccca

SEQ ID NO: 615965 - RNA, 61 nt, hsa
agggacagauagcuuuccaaggacaugagacugugcaaagccucuuugcuguuucucuggg

SEQ ID NO: 615966 - RNA, 61 nt, hsa
gauuuuacccaagccuaaguauuaaaguauaugugcaaaaacaguugugagccauucuauu

SEQ ID NO: 615967 - RNA, 61 nt, hsa
aauguaauguauauuguauugaaauuuacagugugcaaaaguauuuuaccuuugcauaagu

SEQ ID NO: 615968 - RNA, 61 nt, hsa
cacccaacuauugguuguaucaguuuguguaugugcaaaugucaaauaaucuuuugcuuua

SEQ ID NO: 615969 - RNA, 61 nt, hsa
uagcuagaaaguggagaagcucacuguucacugugcaaagccccaguagucggauuccggg

SEQ ID NO: 615970 - RNA, 61 nt, hsa
aaaaaaaauaauaaucccagugccauuugucugugcaaagagaauuaggagagagguuaau

SEQ ID NO: 615971 - RNA, 61 nt, hsa
ugacacauuugaaaaguguuugaaaaauucuugugcaaaugaucaagauaauucuauaauu

SEQ ID NO: 615972 - RNA, 61 nt, hsa
aguucacuuuuuuuguucuaggggaaaugaaugugcaaaaaaagaaaaagaacuguugguu

SEQ ID NO: 615973 - RNA, 61 nt, hsa
gcuagggagugguggaaguaggaaggauuugugugcaaaggaaaaucgugguugaguuuca

SEQ ID NO: 615974 - RNA, 61 nt, hsa
ucagugaacucuguaugaaugcaguagugugugugcaaaauccgcuuccugagcguagggu

SEQ ID NO: 615975 - RNA, 61 nt, hsa
uggaaggucacucaggaacacccucccugccugugcaaagagaaaacaagcgccuuguuuc

SEQ ID NO: 615976 - RNA, 61 nt, hsa
agcugaugagcuaaaacaaaaaacaaugguuugugcaaaaaucucauaauguuuuaauaaa

SEQ ID NO: 615977 - RNA, 61 nt, hsa
cagguacccauuuuaggacccuacacucaaaugugcaaaauaaaauuucuaucauuuugcu

SEQ ID NO: 615978 - RNA, 61 nt, hsa
cuuauuuaugauguauauuuaauguuaauauugugcaaacuuauauuuaaaacuugccugg

SEQ ID NO: 615979 - RNA, 61 nt, hsa
agucacacacugugaaagugaaaagagaaugugugcaaaacacgucacaguccugguuucu

SEQ ID NO: 615980 - RNA, 61 nt, hsa
cuaguuuuccuuggguucugaagaaaauggaugugcaaaggcuuggcuccgcuacuuguaa

SEQ ID NO: 615981 - RNA, 61 nt, hsa
uuagacuagcugaauuugucuuuaaaauauuugugcaaagcuauuaauauacacauuuugu

SEQ ID NO: 615982 - RNA, 59 nt, hsa
gaaaaugcuuugaaaauugaaaaaauccuugugcaaauuuagauugggccaacuucuag

SEQ ID NO: 615983 - RNA, 61 nt, hsa
guugcuuuuguuaugucaaguugaaagauuuugugcaaaauuaaauaaaugguguuuuggg

SEQ ID NO: 615984 - RNA, 61 nt, hsa
gagacugaccuuucucaggaauauuuggagcugugcaaauguuaaaauuuaaagauuugau

SEQ ID NO: 615985 - RNA, 61 nt, hsa
cuaacagauuuuccaucaacaaauauuguuaugugcaaaaguauugccuauguuguuuuac

SEQ ID NO: 615986 - RNA, 61 nt, hsa
uauauagguguacuuugcuucucacaaugauugugcaaaaagucacguguaaauugaacuu

SEQ ID NO: 615987 - RNA, 61 nt, hsa
ugaaguguaaauccucaccugggguucucugugugcaaagcuguccuuuugaagaacaguu

SEQ ID NO: 615988 - RNA, 61 nt, hsa
cagacgcccacccaccgcuagccguuguuccugugcaaaguagugugcuaugcacccaccc

SEQ ID NO: 615989 - RNA, 61 nt, hsa
aauggacugugcagcgaaaucuguacgguucugugcaaagagguguuuugccagccugaac

SEQ ID NO: 615990 - RNA, 61 nt, hsa
ggccucgcugaugucugauaaguauugucagugugcaaaaggcuuuacuucagaaugguuu

SEQ ID NO: 615991 - RNA, 61 nt, hsa
ucucugcuaagcaccauaguugucaaugugcugugcaaaugcuaaguuccuuuuagcaauu

SEQ ID NO: 615992 - RNA, 61 nt, hsa
aagagauagagagugaguacaugcacacucaugugcaaacccacucagagaugcauuugga

SEQ ID NO: 615993 - RNA, 61 nt, hsa
agcacugccuauuugguauccaguuucugaaugugcaaaaugguuaacguccaaaacgcuu

SEQ ID NO: 615994 - RNA, 61 nt, hsa
ugccgcuggaauuggcuugugggucacuuguugugcaaaagugaauuaauuucaaauagga

SEQ ID NO: 615995 - RNA, 61 nt, hsa
uaacaauuggaaaaugaacaaacugauugauugugcaaacuacuuuuuaugacaagccuaa

SEQ ID NO: 615996 - RNA, 61 nt, hsa
aauuuaaaacuguuauuuuuacagcaaaagaugugcaaaaucacuggauuauaaguucuau

SEQ ID NO: 615997 - RNA, 61 nt, hsa
ucccugcccccuggagggcacuguguuugguugugcaaauguauuuacuaugcguguuucc

SEQ ID NO: 615998 - RNA, 61 nt, hsa
auucugugguuagucaauggcuugcaauaaaugugcaaacugcaucuauaggaaacauuuu

SEQ ID NO: 615999 - RNA, 61 nt, hsa
ggaaccacaguggauaugcuagcauuuuagcugugcaaagggagguagugugggaaaagug

SEQ ID NO: 616000 - RNA, 59 nt, hsa
uaaaauaaugauuguaaaauguuuuacaaguaauguaaaagcuaguaucauucuuacau

SEQ ID NO: 616001 - RNA, 59 nt, hsa
uugacuuagcuauagcaguacaaugauuaguaauguaaaaauuaacacagaaauuaacc

SEQ ID NO: 616002 - RNA, 59 nt, hsa
uuuacuuuuaccaaaaauucugugaacauguaauguaacuggcuuuugagggucuccca

SEQ ID NO: 616003 - RNA, 59 nt, hsa
caacaaaaugugauuggucuaaaauauuuguaauguauauuaaaagguucaaaaauauu

SEQ ID NO: 616004 - RNA, 59 nt, hsa
aucuauuuagugaucuguaaauaauugaaguaauguaacacuuaauguuuuaauauguc

SEQ ID NO: 616005 - RNA, 59 nt, hsa
auauccuguacaaaacaagacuauugccaguaauguauacaaauugucuuuuuguguac

SEQ ID NO: 616006 - RNA, 59 nt, hsa
gccucuuaauuuuaugcuuucucaucgaaguaauguacccuuuuuuucugaaacugaau

SEQ ID NO: 616007 - RNA, 59 nt, hsa
caauuuuauuuuuuucugcaagaaaaaguguaauguaugaaauaaaccaaagucacuug

SEQ ID NO: 616008 - RNA, 59 nt, hsa
uugucuagcuccaguuaucuguauuuuauguaauguaauugacaggauggcugcugcag

SEQ ID NO: 616009 - RNA, 59 nt, hsa
ugauuguacaauuguacauuuguauaccuguaauguaaauguggagaaguuugaaucaa

SEQ ID NO: 616010 - RNA, 59 nt, hsa
ugguaacaauuaugcacuguguaauuuuaguaauguauaacaugcaaugaugcacuuua

SEQ ID NO: 616011 - RNA, 59 nt, hsa
guuagauauauuuuggccuagguaucaggguaauguauauacauauuuuuuauuuccaa

SEQ ID NO: 616012 - RNA, 59 nt, hsa
ggggaaaaugccaauuuuuacuguaauaaguaauguaucauaauuaaaaauuauuuauu

SEQ ID NO: 616013 - RNA, 59 nt, hsa
uuuaaguuuguaucuaaauagcacuuacuguaauguauuauaccuaaauguuuauuaaa

SEQ ID NO: 616014 - RNA, 59 nt, hsa
gauagauguuacagggcuucuuauucuuuguaauguacucuuuuuaaaucccuuuaguu

SEQ ID NO: 616015 - RNA, 59 nt, hsa
ccauuauagauuucuuguuucuguuuuuaguaauguagugaguagcuccaggugccaca

SEQ ID NO: 616016 - RNA, 59 nt, hsa
cugugauucugcugggggcugcugagaagguaauguagguugaaaaggggcucuaaguu

SEQ ID NO: 616017 - RNA, 59 nt, hsa
ucucaggauaaaguuugcuaaguaaauuaguaauguacuauagauauaacuguacaaaa

SEQ ID NO: 616018 - RNA, 59 nt, hsa
ugugagcugucuucuguauaauguauuuuguaauguauuuuucucaucuaccaaaggau

SEQ ID NO: 616019 - RNA, 59 nt, hsa
cccuuucucuuaccuaucaucaaauuguaguaauguauuucaccccacuggacuuaucu

SEQ ID NO: 616020 - RNA, 59 nt, hsa
aguuuuaauuuuuuuuuuuucuuggcagaguaauguaaaauuuaaauggggaaagauau

SEQ ID NO: 616021 - RNA, 59 nt, hsa
caguguaguucauuuauucauugauuuuuguaauguaauauucuggaaaaaauuuuguu

SEQ ID NO: 616022 - RNA, 59 nt, hsa
acagauuucauagaagucgugaauacuaaguaauguauacaaaagaaauaugugaugau

SEQ ID NO: 616023 - RNA, 59 nt, hsa
aaagaaauauguuguuucuugucuguaauguaauguaaaggguggaaaggccucaagcu

SEQ ID NO: 616024 - RNA, 59 nt, hsa
aauuuaaagaaauauguuguuucuugucuguaauguaauguaaaggguggaaaggccuc

SEQ ID NO: 616025 - RNA, 59 nt, hsa
gagcuacaacaaaaggacuucaggaacaaguaauguauuaguaugguucaagauuguug

SEQ ID NO: 616026 - RNA, 59 nt, hsa
ggguuccauauuagcaacucagcuuaaagguaauguauuugcuaaugaucuucagauuu

SEQ ID NO: 616027 - RNA, 59 nt, hsa
agacuuugacauuauuuaaacgagcauguguaauguaacuuuucucuuugaaucauaua

SEQ ID NO: 616028 - RNA, 59 nt, hsa
auaauguuaguagcacugagacccccaugguaauguaacuuaauuauaagcuaugucac

SEQ ID NO: 616029 - RNA, 59 nt, hsa
uagcuuaaguuuauuuuagcuacucaguaguaauguauucuauuaaucuacuaauauau

SEQ ID NO: 616030 - RNA, 59 nt, hsa
ugguaagccgcacuagaaagguauacauaguaauguauauuuauuuacauacugaaguc

SEQ ID NO: 616031 - RNA, 59 nt, hsa
uugauuaggggugaaauuuagaagucuuaguaauguaacuugaagauguuaaacaaaaa

SEQ ID NO: 616032 - RNA, 59 nt, hsa
cuugacauguaaugaauggucaguuguacguaauguauuuauauguuaauuuguuaugu

SEQ ID NO: 616033 - RNA, 59 nt, hsa
cagagaaaaguauauguaaugaugcuacaguaauguauuucuguauaacaaaugacucc

SEQ ID NO: 616034 - RNA, 59 nt, hsa
gacaguacuauacaaauagaaugcaagcuguaauguaauuuuauauuuucuuauagcca

SEQ ID NO: 616035 - RNA, 59 nt, hsa
guuugagccucauuuacaucaauagagguguaauguacugcauuucuucauuugguaac

SEQ ID NO: 616036 - RNA, 59 nt, hsa
aagaggcgucuuguauuuucuucccauuuguaauguaucuuauuuauauaugaaguaag

SEQ ID NO: 616037 - RNA, 59 nt, hsa
cucaaaguaaagccugagcaguguucucaguaauguauuugaaggaaaaauacccugau

SEQ ID NO: 616038 - RNA, 59 nt, hsa
caugaagacacagucagacacuggacaauguaauguaugcaacugcaaacguuacaacu

SEQ ID NO: 616039 - RNA, 59 nt, hsa
aaaaauauuaaaauuuauuucacuggaugguaauguaaccuuaaaagcaucauaauagg

SEQ ID NO: 616040 - RNA, 59 nt, hsa
gagcuugugucugcaaauugauuuuguuuguaauguauuuugauagcaaaucaugcugc

SEQ ID NO: 616041 - RNA, 59 nt, hsa
aauucauaucagagagagauccuaaagguguaauguaugugggaagaccacaucuuguu

SEQ ID NO: 616042 - RNA, 59 nt, hsa
auuguggguaaaauguuagaacuguaacuguaauguaauggaaauuaacuagugcugug

SEQ ID NO: 616043 - RNA, 59 nt, hsa
ugaagaaagaggccuaggagagcagcccuguaauguauccagucagcugcaugguacug

SEQ ID NO: 616044 - RNA, 59 nt, hsa
auaguauacauugucuugauguuuuuucuguaauguaaauaaacuauuuauaucacaca

SEQ ID NO: 616045 - RNA, 59 nt, hsa
uauuaaaauacuguuuuggaauguuggcuguaauguaacagcaauuuucauaauaaaag

SEQ ID NO: 616046 - RNA, 59 nt, hsa
acuaccaccuaacccaacagacaauauuuguaauguauuaacuccauguuauguuuuua

SEQ ID NO: 616047 - RNA, 59 nt, hsa
agaggucuugaucuuuggaaugcaugccaguaauguauuuuacaguacauguuuauuau

SEQ ID NO: 616048 - RNA, 59 nt, hsa
aguguacuaaacucuacgcucugguuaauguaauguacucuccuggacugaaugcagug

SEQ ID NO: 616049 - RNA, 59 nt, hsa
uuauauuauuaaauguugauugauggcuuguaauguacugcacacaauauauguuaacu

SEQ ID NO: 616050 - RNA, 59 nt, hsa
uggauuguuuauacuccaguguacauaguguaauguagcguguuuacauguguagccua

SEQ ID NO: 616051 - RNA, 59 nt, hsa
caaaauugcuuuguauauuuggugauuuuguaauguaagugaauugauucuuauuucac

SEQ ID NO: 616052 - RNA, 59 nt, hsa
gucuuuuuuggacuagcacugacugaacuguaauguaggggaaaguuucaugaugguau

SEQ ID NO: 616053 - RNA, 59 nt, hsa
uauuucagcuacuguauuuccuuuuucuuguaauguaagcagcucagauaccaugugcu

SEQ ID NO: 616054 - RNA, 59 nt, hsa
cuuucucaucuauauuuaaguaccuuuuuguaauguaguaucaaaguuuuuuagguaau

SEQ ID NO: 616055 - RNA, 59 nt, hsa
cacacucucacauguuuagaguugcaaucguaauguacagaugguuuuauaaucugauu

SEQ ID NO: 616056 - RNA, 59 nt, hsa
auaaaaugcuggauugaaaauuuuauauuguaauguagagauaaaagcaguaggagaaa

SEQ ID NO: 616057 - RNA, 59 nt, hsa
gacaucuuccuuggacccaaagcuuaaaaguaauguaugcuuugcugaccacuguuugu

SEQ ID NO: 616058 - RNA, 59 nt, hsa
ucuguuuauguagaaugauuuuguuaagaguaauguaaacuauuauugaguagaggccu

SEQ ID NO: 616059 - RNA, 59 nt, hsa
uccaucauucuguguagaagcuuaaauauguaauguaaccaaacuccaguauuaaaaau

SEQ ID NO: 616060 - RNA, 59 nt, hsa
uaugcauuuauuagacaucuguuuaaaugguaauguagcauuuauuuugcuaaauugaa

SEQ ID NO: 616061 - RNA, 59 nt, hsa
cugacuaauauuuuguuguaaaccauuaaguaauguaacgcauguaagaugcuuagggu

SEQ ID NO: 616062 - RNA, 59 nt, hsa
uucuucaaacacucuuaaauuuuucuuaaguaauguaaaaauggaacugccaauuuuau

SEQ ID NO: 616063 - RNA, 59 nt, hsa
ggcagaaaaagaaguugagcaauuucuauguaauguacagauacuagcauugcacauau

SEQ ID NO: 616064 - RNA, 59 nt, hsa
gaaaauuuauuuauuugacaggauuuugaguaauguaggaauacaaaagguaaauuagc

SEQ ID NO: 616065 - RNA, 59 nt, hsa
gcacguagcauuuacauuagguauuacaaguaauguaaagaugauuuaaguauacagga

SEQ ID NO: 616066 - RNA, 59 nt, hsa
uuuuauuaauagaugguuuauuuacuaugguaauguauuaauuuauuuuugguguuguu

SEQ ID NO: 616067 - RNA, 59 nt, hsa
gguguaagacuuuaagaagcgaacaaaaaguaauguauaucuguaauauauaaucaaau

SEQ ID NO: 616068 - RNA, 59 nt, hsa
uuuguuuaaauauaaucuauaauuguuuuguaauguaagacuaauuacuaauauuuaug

SEQ ID NO: 616069 - RNA, 59 nt, hsa
uuuauugaaagcuaaaaauagguucuaaaguaauguaaaaauauaaagcacaaauauac

SEQ ID NO: 616070 - RNA, 59 nt, hsa
auguaaaagaaaguaagcauaaaaaucgaguaauguauauaucaauuugucuucuuuuu

SEQ ID NO: 616071 - RNA, 59 nt, hsa
uauauuccauccacuugaaacaauaaacaguaauguauccaagaagauuauguguccua

SEQ ID NO: 616072 - RNA, 59 nt, hsa
aauugucuuuacuguauuuuuguucucugguaauguaauaagcaugauggugccuucua

SEQ ID NO: 616073 - RNA, 59 nt, hsa
ugguaggaauguuaauguaaauaguggugguaauguaaaaucauuucauuuaucauuca

SEQ ID NO: 616074 - RNA, 59 nt, hsa
aaguaaugaucucaaacuaugacagaaaaguaauguaaaauccauccaaucuauuauuu

SEQ ID NO: 616075 - RNA, 59 nt, hsa
uaauuaauugagaguauuuuuuagugaguguaauguauaauguacguaugcaaaguuca

SEQ ID NO: 616076 - RNA, 59 nt, hsa
uuuaggggauuuucggggaggggaaauagguaauguauggagcauuuucacuucuaaau

SEQ ID NO: 616077 - RNA, 59 nt, hsa
guaaauuucuugucauauaguggcucuacguaauguagccuguauuaaugugaaauauu

SEQ ID NO: 616078 - RNA, 59 nt, hsa
uuuguuuguuuuuuaucaucugagauucuguaauguauuugcaaauaauggaucaauua

SEQ ID NO: 616079 - RNA, 59 nt, hsa
cacuucuuuucagguguagcuacaauuguguaauguacaauauuagagaaaggacaggc

SEQ ID NO: 616080 - RNA, 59 nt, hsa
acagcauugugcuugggucuggguucucaguaauguagccauuugagaaacuuacuugg

SEQ ID NO: 616081 - RNA, 59 nt, hsa
uuuucuugguaauuugauauaagcaaguuguaauguacauaguaauuauuuaauuacug

SEQ ID NO: 616082 - RNA, 59 nt, hsa
uuauaauuugaugugcuguggucuccuugguaauguauaauuugguauugcacagguga

SEQ ID NO: 616083 - RNA, 59 nt, hsa
uuaggauaaucuuuaugguucuacuuccuguaauguacaauuuuauauaauucugaaau

SEQ ID NO: 616084 - RNA, 59 nt, hsa
aaggcuaauauggaaccaaacucuuguaaguaauguaaauagaaagguggguggauaaa

SEQ ID NO: 616085 - RNA, 59 nt, hsa
auauggcuccaugaaggugcuacuuuuaaguaauguaugugcgcucuguaaagugauua

SEQ ID NO: 616086 - RNA, 59 nt, hsa
aggugcaucgacauuaacccacucauuuaguaauguaccuugaguuaaaaagccugaga

SEQ ID NO: 616087 - RNA, 59 nt, hsa
uuuuuguauaaaguuugcuuucaauaacaguaauguauaauaaaaccauguaaaguuuu

SEQ ID NO: 616088 - RNA, 59 nt, hsa
gaagacaaaaaauauugauagucacuagaguaauguauucuuaaccuuuguaagaacug

SEQ ID NO: 616089 - RNA, 59 nt, hsa
aacuacggucauguucagcuucauugcauguaauguagaccuaguccaucagaucaugu

SEQ ID NO: 616090 - RNA, 59 nt, hsa
acaaaaaacaaaaacaaaaaaaaaagaggguaauguacaaguuucuguauguauaaagu

SEQ ID NO: 616091 - RNA, 59 nt, hsa
ggaaggauguauaaaguguuacugcaugaguaauguagacaaaaaaaaaagccagcugu

SEQ ID NO: 616092 - RNA, 59 nt, hsa
gauuucuuaaucuugauaaauauagcaggguaauguaagaugauaacguuagagaaacu

SEQ ID NO: 616093 - RNA, 59 nt, hsa
uauuuuuuguuacuauacaauuaugaaauguaauguaagacaccaacagaaaugauaua

SEQ ID NO: 616094 - RNA, 59 nt, hsa
uuuggcauugaaacuugugcaauaucuguguaauguagaauguggggugugcaugcaga

SEQ ID NO: 616095 - RNA, 59 nt, hsa
ggcuuuuuucuucguuguucccaagucauguaauguauagugaauuuauccaaaacgcc

SEQ ID NO: 616096 - RNA, 59 nt, hsa
uacauuuuacauauggaaauauaggcuauguaauguaaauacaucaaaaauggguaauu

SEQ ID NO: 616097 - RNA, 59 nt, hsa
aggaaauguaaaaacuuagagcucccauuguaauguaaggggcaagaaauuuguguucu

SEQ ID NO: 616098 - RNA, 59 nt, hsa
uguugucuuacuugauauuucuugcccuaguaauguacuugacauuuauguuccuaagc

SEQ ID NO: 616099 - RNA, 59 nt, hsa
cuaguauauuuaaacuuacaggcuuauuuguaauguaaaccaccauuuuaauguacugu

SEQ ID NO: 616100 - RNA, 59 nt, hsa
gccaauuuuaauaagaaacuaagcuuuauguaauguaacaccguaauuuaugaauuugu

SEQ ID NO: 616101 - RNA, 59 nt, hsa
uauaaucagauaaggcugguuauaaaagaguaauguauuaccucaauuuuugacugacu

SEQ ID NO: 616102 - RNA, 59 nt, hsa
cagcaacugggcaugguggcucacugucuguaauguauuaccugaggcagaagaccacc

SEQ ID NO: 616103 - RNA, 59 nt, hsa
ucuguuucauuuggaggauuuucuucuuuguaauguaaagaaauucaaaguuaucaaag

SEQ ID NO: 616104 - RNA, 59 nt, hsa
aaguggaagaggccugcaucacaauugagguaauguagagcaacauguuaaagaaugau

SEQ ID NO: 616105 - RNA, 59 nt, hsa
cacaaaacauguuuauaaaugaacaggauguaauguacauagaugacauuaagaaaauu

SEQ ID NO: 616106 - RNA, 59 nt, hsa
uuuacaggaucauguaaaugcucaaagauguaauguaguucuuuguuccugcuuucucu

SEQ ID NO: 616107 - RNA, 59 nt, hsa
ggagugacaugaaguuugaacacuaaacaguaauguaugagaauuacuacagauacaug

SEQ ID NO: 616108 - RNA, 59 nt, hsa
aaucauuggacaucaauuauuuuuagagaguaauguauaauuucauagcauuuuaaauu

SEQ ID NO: 616109 - RNA, 59 nt, hsa
uguuuuguuuuauacagcaguaggauuguguaauguauucucucuuguagccuauucuu

SEQ ID NO: 616110 - RNA, 59 nt, hsa
acuuguguucugagggucauuaugguaucguaauguaaagcuuggaugauguuccugau

SEQ ID NO: 616111 - RNA, 59 nt, hsa
aaggaagaacaaucacaaauaaagugagaguaauguaauggagcucuuuucacuagggu

SEQ ID NO: 616112 - RNA, 59 nt, hsa
ugaguccauguuuauucugcaaauaaaugguaauguauuggaccccauguguggcuucu

SEQ ID NO: 616113 - RNA, 59 nt, hsa
guuaaaguauuuuaaaauacauuauccuuguaauguauuuuacaaggauaauguauuuu

SEQ ID NO: 616114 - RNA, 59 nt, hsa
guuuucuuuuucguccaacuaaaacaacuguaauguacuugauacauuuauaucaaguu

SEQ ID NO: 616115 - RNA, 59 nt, hsa
auaagaaguggaaauugccuuuuuauuguguaauguagaaaacccucaaguguuuuuuc

SEQ ID NO: 616116 - RNA, 59 nt, hsa
caaaucagguaaaauagucaugauucuauguaauguaaaccagaaaaaauaaauguuca

SEQ ID NO: 616117 - RNA, 59 nt, hsa
gcaauuucauacuuaggaacauacaaaagguaauguaaacucugccacuuuuuuguguu

SEQ ID NO: 616118 - RNA, 59 nt, hsa
auguucaucuggaaguauuuuccuccaaaguaauguagcaugauuuuucaaggauuguu

SEQ ID NO: 616119 - RNA, 59 nt, hsa
caaggccccagccaaccucucguugacauguaauguaagaagaugucaacucaugcuua

SEQ ID NO: 616120 - RNA, 59 nt, hsa
ugcauccuugauuucuugugcaugucucuguaauguaacucacccuccucagcauuauu

SEQ ID NO: 616121 - RNA, 59 nt, hsa
gguaaauauuuuuuucucaaaugaaauaaguaauguauacaaaagugccuaagacagua

SEQ ID NO: 616122 - RNA, 59 nt, hsa
uaaaagaggucacuggcugaccccuccuuguaauguagacagacuuuguauaguucacu

SEQ ID NO: 616123 - RNA, 59 nt, hsa
ccuauccuuuguucucuacuguuuucuuuguaauguaugacuacgagagugauacuuug

SEQ ID NO: 616124 - RNA, 59 nt, hsa
gugaucuggcaguuuaugcauucuucagaguaauguaauaauaccuaugugaugcugua

SEQ ID NO: 616125 - RNA, 59 nt, hsa
gauuuuguaaauguucuugguguuugacuguaauguaacuaucucaccuaaugguugua

SEQ ID NO: 616126 - RNA, 59 nt, hsa
aauuaacucuuuguuucccuucauaaaauguaauguacauuguaaucuuuuaaaagaaa

SEQ ID NO: 616127 - RNA, 59 nt, hsa
gagucugccucccagacuggcuacuguauguaauguauuuauguauguauuuguaaaug

SEQ ID NO: 616128 - RNA, 59 nt, hsa
acacauuugauauucucuuauauguuauaguaauguaacguauaaacucaagccuuuuu

SEQ ID NO: 616129 - RNA, 59 nt, hsa
gaauuaucuuuuguuuagaaagcaugcauguaauguauguaugcaguaugccuuacuua

SEQ ID NO: 616130 - RNA, 59 nt, hsa
uuaaacacuaaaaagaaagagagauauauguaauguacaacugacacugccauuuuucc

SEQ ID NO: 616131 - RNA, 59 nt, hsa
guguaguugaaacagucaaacuuauuuuuguaauguauguuauugugugaugcaguuuu

SEQ ID NO: 616132 - RNA, 59 nt, hsa
ccuggagagcagcuguaccuaacaauacuguaauguacauuaacauuacagccucucaa

SEQ ID NO: 616133 - RNA, 59 nt, hsa
uuaacacacuaaucuucaguuggaugaauguaauguauaacuauguuuucagcaacaau

SEQ ID NO: 616134 - RNA, 59 nt, hsa
aaguaggcuggauaaauggugcuuaaaugguaauguacuccacuucuuccuauuggaag

SEQ ID NO: 616135 - RNA, 59 nt, hsa
auguuuuuaaaguaauuuuuuaaaauaugguaauguauuaaacuuauuuuuauaguuau

SEQ ID NO: 616136 - RNA, 59 nt, hsa
auucuucuaauccaauguagaaauuguacguaauguauuuaaaucaacgcaaauguaug

SEQ ID NO: 616137 - RNA, 59 nt, hsa
uugguuaaaaaauuuuguuuuuuaauuacguaauguaaaagcccaacaaacacuuuaug

SEQ ID NO: 616138 - RNA, 59 nt, hsa
gcccccgcaagggaauggucagccuaaggguaauguacagcccgugcuuggagaaccau

SEQ ID NO: 616139 - RNA, 59 nt, hsa
agguuuuucagcuaccucugggucauucuguaauguaaauguuguuaauaagaaugguu

SEQ ID NO: 616140 - RNA, 59 nt, hsa
cgggugguugaagauaauucauuuuaaucguaauguauuuuagugugaauuuaaaaauu

SEQ ID NO: 616141 - RNA, 59 nt, hsa
cuuuucuucaugcugguauuuuuucaauaguaauguagccuuuguacugagacaaauuu

SEQ ID NO: 616142 - RNA, 59 nt, hsa
gauguauuuuuuguuaaauacuauguaguguaauguauaauugcucuuguuuauugcuu

SEQ ID NO: 616143 - RNA, 59 nt, hsa
uagcaaaguacauaagaaucuaucacuaaguaauguauccuucagaauguguugguuua

SEQ ID NO: 616144 - RNA, 59 nt, hsa
gagagccaaugucagauaaaguaagcauaguaauguagcaggaacuacaauagaagaca

SEQ ID NO: 616145 - RNA, 59 nt, hsa
aaggucuuaagagaaaagucacauuacaaguaauguaauggcucuaccauucauucuuc

SEQ ID NO: 616146 - RNA, 59 nt, hsa
acuguagcaguguguucugggcaguaucuguaauguaugaaauagagucuggaauaggu

SEQ ID NO: 616147 - RNA, 59 nt, hsa
gaaagcaaaggauaacgaauucagaauuaguaauguaaaaucuugauacccuaaucuug

SEQ ID NO: 616148 - RNA, 59 nt, hsa
guugagugccuggacccaaaggcaauacuguaauguaaagacauuuauaguacuaggca

SEQ ID NO: 616149 - RNA, 59 nt, hsa
gucuauuuuauucuacauaagagccauauguaauguacuguaacaaaggagcuucuugu

SEQ ID NO: 616150 - RNA, 59 nt, hsa
cuuaguuuggguacaaaaaugucauuucaguaauguacugaaaucuuauaagugaauag

SEQ ID NO: 616151 - RNA, 59 nt, hsa
auuguguauauauuauacaaugagcacauguaauguauuaaaggcuacuuacuauuguu

SEQ ID NO: 616152 - RNA, 59 nt, hsa
uuauauuuuagcauggucugccucaaauaguaauguauuuuucugcauucacuuggaua

SEQ ID NO: 616153 - RNA, 59 nt, hsa
uauuaguauuuuacucuagugguguaauuguaauguagaacaguugugugguaguguga

SEQ ID NO: 616154 - RNA, 59 nt, hsa
gaguugaauguuuauuauuaaagaaaaaaguaauguacauauggcuggauuuuuuugcu

SEQ ID NO: 616155 - RNA, 59 nt, hsa
acaguugugauauuuggugguuucaugugguaauguaauuuucuguuuaauuacaguac

SEQ ID NO: 616156 - RNA, 59 nt, hsa
cagcuuuaauagccauggguucuuuugggguaauguacacaccuaacugcauuuguuuu

SEQ ID NO: 616157 - RNA, 59 nt, hsa
uacauuucugaguaccauuaucuuaucuaguaauguagauuuacauagaauuaagaguu

SEQ ID NO: 616158 - RNA, 59 nt, hsa
auguacagauaguuauaggccacuguuuuguaauguaguacauuucuaaucuauuauuc

SEQ ID NO: 616159 - RNA, 59 nt, hsa
uuaauaauaauuccaacaaggaauucagaguaauguaaaagacuaaauaucauuccuuc

SEQ ID NO: 616160 - RNA, 59 nt, hsa
aauuugaucgaaucaccugaauguucuauguaauguaaaauauucuuuucuugcuuucu

SEQ ID NO: 616161 - RNA, 59 nt, hsa
aaaagauguaucuuuguauauuaauagcuguaauguagcuuccugaugcuugacuaauu

SEQ ID NO: 616162 - RNA, 59 nt, hsa
cgcuguaggucucuucuugcauguccacaguaauguauuugugguuuuuauuuugaacg

SEQ ID NO: 616163 - RNA, 59 nt, hsa
gcuguaacccggcaucgagugcugaccuuguaauguaugaguucacggaagaagcacaa

SEQ ID NO: 616164 - RNA, 59 nt, hsa
uaguuuucaaauuauaucuuuaauauauaguaauguaacauauucaguauuaauguaua

SEQ ID NO: 616165 - RNA, 59 nt, hsa
ugaaaagggaauuguaaauggacugcaauguaauguacacuguaauuugaauacaauua

SEQ ID NO: 616166 - RNA, 59 nt, hsa
ggucauuuuaagaaucuggaaugcuugcuguaauguauauggcuuuacucaagcagauc

SEQ ID NO: 616167 - RNA, 59 nt, hsa
aauacauaauugcauuugcucuguuuauuguaauguauucuaaauuaaugcagaaccau

SEQ ID NO: 616168 - RNA, 59 nt, hsa
ucucuguauguucaguuaacaaauuauuuguaauguauuuuuuuagaaaucuuaaaauu

SEQ ID NO: 616169 - RNA, 59 nt, hsa
aaugauaugcuuguaacuaaaauaauuuuguaauguaucaaauacauuuaaaacauuaa

SEQ ID NO: 616170 - RNA, 59 nt, hsa
uaucuaaaggugagagcugcauagauccaguaauguacauaaagccugaaugaugagcc

SEQ ID NO: 616171 - RNA, 59 nt, hsa
cgauuuggauaugccaucugaaagaaacuguaauguauauuuugauuuguaacaaauau

SEQ ID NO: 616172 - RNA, 59 nt, hsa
uucuucuaauguguaucucacaaugucauguaauguaaaggaaacccuuuuggaauuag

SEQ ID NO: 616173 - RNA, 59 nt, hsa
uuucuuaguguuuuuaaccuguacauuguguaauguaauguuuguauauaaugaaauuu

SEQ ID NO: 616174 - RNA, 59 nt, hsa
ggaucuaauauauaauauucaauacaauuguaauguagaaauauaagaauuuagaaaaa

SEQ ID NO: 616175 - RNA, 59 nt, hsa
uuccaguugcaccucaguauguuaaacagguaauguaagaaguucucugaaaugucagc

SEQ ID NO: 616176 - RNA, 59 nt, hsa
uagacuuacuuauucuuugaggaaaaaagguaauguaggagcucauuguucucuagagc

SEQ ID NO: 616177 - RNA, 59 nt, hsa
aaaugaccauuugccaaccuggcugugagguaauguauguaaagcaccgagucaggugc

SEQ ID NO: 616178 - RNA, 59 nt, hsa
acucauagagaaaacuguuacuuucugacguaauguaauucaggaagacagacgcugca

SEQ ID NO: 616179 - RNA, 59 nt, hsa
aucucuguaguuccucaaauuggcaucugguaauguacauugugagguagacugauaau

SEQ ID NO: 616180 - RNA, 59 nt, hsa
uagccacugcccccuccccuggaugcccaguaauguaugucuacuggugggagacugug

SEQ ID NO: 616181 - RNA, 59 nt, hsa
cuuauuuauuaaucucuugcuggagugguguaauguaucuaacuuuuagcaaaggaggg

SEQ ID NO: 616182 - RNA, 55 nt, hsa
cucucacaggaagaaaguaaguacaguaauguaaaggaagacuuggaguuuacaa

SEQ ID NO: 616183 - RNA, 59 nt, hsa
uacaugguugguugucucuucuugaaacuguaauguaaaucuaggguccagucauaucc

SEQ ID NO: 616184 - RNA, 59 nt, hsa
cauggucuguuccuaguuacauguuggcuguaauguauguugagaagucaguccaagga

SEQ ID NO: 616185 - RNA, 59 nt, hsa
gaaugggcaugaauggagaugcccgcacaguaauguagaaauguuucauacagcuauua

SEQ ID NO: 616186 - RNA, 59 nt, hsa
cauaugcuuauaaaagaagugauguaucaguaauguaucaauaaucccagcccagucaa

SEQ ID NO: 616187 - RNA, 59 nt, hsa
gcauuauugacugcuggugugaugcuacuguaauguaauaaauuauuaaguuguugcaa

SEQ ID NO: 616188 - RNA, 59 nt, hsa
gaaagaucagugcugauuuuaaucagacuguaauguaccaacuagauacagacagggcc

SEQ ID NO: 616189 - RNA, 59 nt, hsa
ucugcaauggauuuuuuuuuaaugcagaaguaauguauacucuaguauucugguguuuu

SEQ ID NO: 616190 - RNA, 59 nt, hsa
uaacuuacugaacugaacuuucugaaaacguaauguagcaguaucaauauacuuuuggg

SEQ ID NO: 616191 - RNA, 59 nt, hsa; identical to SEQ ID NO: 616187

SEQ ID NO: 616192 - RNA, 59 nt, hsa
aguauuauucaugguuccaagcaaugaguguaauguauuuucucccaauaguaauuguu

SEQ ID NO: 616193 - RNA, 59 nt, hsa
aagcaacacagucacugcuguggucauuuguaauguaaagaucaguuauauauauauau

SEQ ID NO: 616194 - RNA, 59 nt, hsa
aaccuuaaaauagcuacacucugcccucuguaauguagcauucauaaaaauuuggaagu

SEQ ID NO: 616195 - RNA, 59 nt, hsa
uauuguuggcuucuuguguuggaaacuuuguaauguaaaaggaaaaacuggaaaucccc

SEQ ID NO: 616196 - RNA, 59 nt, hsa
cucugcugcaaaugcucagcccugcuguuguaauguaaaagcugccacagacacuacau

SEQ ID NO: 616197 - RNA, 59 nt, hsa
uaaaauugcucuuuuguaacuuuaucuuaguaauguaaagauucaguaaauugaugagu

SEQ ID NO: 616198 - RNA, 59 nt, hsa
ccucuagccuacauuagcauauuucucauguaauguauuuugcugguaagcucauccau

SEQ ID NO: 616199 - RNA, 59 nt, hsa
acaggauaauaucuccugcauaguuuucaguaauguaaguguggacuagugcauauuuc

SEQ ID NO: 616200 - RNA, 59 nt, hsa
aagcaccucaggcacauaacauuaaucuaguaauguaauucucugcacauccagcuggu

SEQ ID NO: 616201 - RNA, 59 nt, hsa
augguggaagauaauguacuacugaagauguaauguagcuuuccacuggagucugggau

SEQ ID NO: 616202 - RNA, 59 nt, hsa
uuuuuuccccuucaguuuuaauguuauguguaauguauuuaaacccuuauuuaaauaaa

SEQ ID NO: 616203 - RNA, 59 nt, hsa
ccuccuccucacccuaucacccauggaucguaauguaaaauucuuuuaccaugucaaga

SEQ ID NO: 616204 - RNA, 59 nt, hsa
uauuuuuuuaaacaaaauuucacaguucuguaauguaggcacuuuuauuuucauuguga

SEQ ID NO: 616205 - RNA, 59 nt, hsa
uuuuauuuucauugugauuuauauauaagguaauguaggguuauauuugggagugacug

SEQ ID NO: 616206 - RNA, 59 nt, hsa
caaacaugguuuuccuuuacuuugacaaaguaauguaauuuuuaccuuauuuaucugua

SEQ ID NO: 616207 - RNA, 59 nt, hsa
aggagcuggcugaaagccacuuuguacauguaauguauuauauggggucugggcuccag

SEQ ID NO: 616208 - RNA, 59 nt, hsa
agaggaauaggucagauagaagaagcuguguaauguauuaauacauccguucaugugcu

SEQ ID NO: 616209 - RNA, 59 nt, hsa
uuuuuuuauaaauagacuuauuuuccuuuguaauguauuggccuuuuagugaguaaggc

SEQ ID NO: 616210 - RNA, 59 nt, hsa
ugggaaaaacaguaugggaagaguucuuuguaauguaaggaaauaacaauguaguucuc

SEQ ID NO: 616211 - RNA, 59 nt, hsa
auucaucugaacuggaccaguguugaucuguaauguaauagaaaaucugauagaccagc

SEQ ID NO: 616212 - RNA, 59 nt, hsa
ugagcaguguuaaaaucuccuauuaauguguaauguaccugucagugccuccuuuauua

SEQ ID NO: 616213 - RNA, 59 nt, hsa
aacauuucagggaggagucugccaccaguguaauguaucaauaaacuucaugcaagcau

SEQ ID NO: 616214 - RNA, 59 nt, hsa
uucuagucugcuuuuuuuguuuaauucuuguaauguaagcaauaaauauggagugucag

SEQ ID NO: 616215 - RNA, 59 nt, hsa
ggaaagaaaaugacauuuaaauaauguguguaauguauaauguacuauugacaugggca

SEQ ID NO: 616216 - RNA, 59 nt, hsa
uaggaagaugugguuacuauuuggaaaguguaauguaacaaaacucucuuuuguuacca

SEQ ID NO: 616217 - RNA, 59 nt, hsa
aaguugaauggugguuuuuaaauuauaaaguaauguauuaaaaggugcauuaggcugua

SEQ ID NO: 616218 - RNA, 59 nt, hsa
auuaauaacaguaguaguuauguguacagguaauguaucaugauccaguaucacaguau

SEQ ID NO: 616219 - RNA, 59 nt, hsa
uauuugaagguauauaaaaaugagaugauguaauguauuuauaaauuuauccaaguacu

SEQ ID NO: 616220 - RNA, 59 nt, hsa
gagaauggcuuuuauagguauuuugccugguaauguauucauucaugauugcccauauu

SEQ ID NO: 616221 - RNA, 59 nt, hsa
uuuuuagacuuucuuaucacuuauaguuaguaauguacaccuacucuaucagagaaaaa

SEQ ID NO: 616222 - RNA, 59 nt, hsa
uaugcagauagaugugugaaaucuaagcaguaauguacuuucucccuuuguaaagacuu

SEQ ID NO: 616223 - RNA, 59 nt, hsa
aucuacaguuugguuuuucuuuaaguauuguaauguacauaccagagagauaaugcaga

SEQ ID NO: 616224 - RNA, 59 nt, hsa
gagaucagauaguugcuguuuuguaaaauguaauguauaugugguuuuuaguaaaauag

SEQ ID NO: 616225 - RNA, 59 nt, hsa
uaacuuuuagaaucuaaauaaaaucagagguaauguauuuuggcagcuuguuuagguga

SEQ ID NO: 616226 - RNA, 59 nt, hsa
agcaucaaauuauugggaccagaaaccaaguaauguauaauguggcuuuuguugaguua

SEQ ID NO: 616227 - RNA, 59 nt, hsa
gauggacugcggguuuggauaccacugcuguaauguaacccucuuuguuuagaugagga

SEQ ID NO: 616228 - RNA, 59 nt, hsa
guuagagcuaguguauguuacugugaauuguaauguaguuggauuguacaaauuacugc

SEQ ID NO: 616229 - RNA, 59 nt, hsa
caauuuuccagauauuauauaaugaacucguaauguaacauuuccuucuagcuuccuac

SEQ ID NO: 616230 - RNA, 59 nt, hsa
gucagagaaacuuuaugcauauuaaaaauguaauguaauuauaagcgauuccccucaac

SEQ ID NO: 616231 - RNA, 59 nt, hsa
cuuugaaaauaaaggacuucacaaaaacgguaauguaaaugugcuuccaaguugggggg

SEQ ID NO: 616232 - RNA, 59 nt, hsa
caccuuucauaaguuguuaucuagucaauguaauguauauuguauugaaauuuacagug

SEQ ID NO: 616233 - RNA, 59 nt, hsa
gugucgucagccugggagccuuccccaguguaauguagcuuucucucuuaccuucugga

SEQ ID NO: 616234 - RNA, 59 nt, hsa
ugccugaacuugaauuaauccacacaucaguaauguauucuaucucucuuuacauuuug

SEQ ID NO: 616235 - RNA, 59 nt, hsa
cugauccaccuaagcacauucagggaagaguaauguaauugacaaaauaucugauaauc

SEQ ID NO: 616236 - RNA, 57 nt, hsa
ugugaugcagauuaaaggagauggcauguguaauguauacagcuggugccugguaaa

SEQ ID NO: 616237 - RNA, 59 nt, hsa
ccaagacagugcccaugaaugggacaccuguaauguaacccacacagcgguuugcagag

SEQ ID NO: 616238 - RNA, 59 nt, hsa
cuucucuguaggaugcaaaacauccaguuguaauguauaagcaugcacuucauacuagc

SEQ ID NO: 616239 - RNA, 59 nt, hsa
ggcauuuuagaauuacuagcugaaaaauuguaauguaccaacagaaauauuauuguaag

SEQ ID NO: 616240 - RNA, 59 nt, hsa
cccaccaauacaaaccaguuacagcaacuguaauguaacauaaaaagggcaucuugaag

SEQ ID NO: 616241 - RNA, 59 nt, hsa
uccuauugauuaacuuagacauagauuuuguaauguauaacuugauauuuaauuuauga

SEQ ID NO: 616242 - RNA, 59 nt, hsa
ucuccaggugcuuauauugaucuggaauuguaauguaaaaagcaaugcaaacuuaggcg

SEQ ID NO: 616243 - RNA, 59 nt, hsa
aucuuucuuaaguaguaaaaaugacagugguaauguagauguuuuuauaacauacuaug

SEQ ID NO: 616244 - RNA, 59 nt, hsa
uagauaauuaaccaagguagaaugaccuuguaauguaacugcucuugggcaauauucuc

SEQ ID NO: 616245 - RNA, 59 nt, hsa
acuacugaguaucucuuuuguuuucugcuguaauguaggaguguuuuauggcauauuca

SEQ ID NO: 616246 - RNA, 59 nt, hsa
gaggauugauaauuuagauguuuauacauguaauguacuuagaucagugucugcucuuu

SEQ ID NO: 616247 - RNA, 59 nt, hsa
uugccaagcugccuagcauacaucaguauguaauguaaaagacauaugagcaagaaaaa

SEQ ID NO: 616248 - RNA, 59 nt, hsa
uuuauguuuucacagucaccaaguguauuguaauguauacuugaaaaauguuauaacuu

SEQ ID NO: 616249 - RNA, 59 nt, hsa; identical to SEQ ID NO: 616241

SEQ ID NO: 616250 - RNA, 64 nt, hsa
cuaccaguguaaccuaccaguacaacugugaauccuaggcaaggcaaaaaugcacuuccacuga

SEQ ID NO: 616251 - RNA, 64 nt, hsa
accugggagcuugguagaaaugcagaaucuuagccuaggcaacauagggagaccucaucucugc

SEQ ID NO: 616252 - RNA, 64 nt, hsa
agaaaacccaaggagugaagggacaggauuuugccuaggcaaaaaucuaagacucgugcccucc

SEQ ID NO: 616253 - RNA, 64 nt, hsa
uucaaucaaaugaaacguuauccuauuggauagacuaggcaauucaucagcucaccugaaauca

SEQ ID NO: 616254 - RNA, 64 nt, hsa
uucaucaggcuguggugggcggggguguuggccacuaggcaaugguaugggcagggcuucaccu

SEQ ID NO: 616255 - RNA, 64 nt, hsa
uuuuuuuuuugagauggagucucacucuugucaccuaggcaagagugcaauggcacaaucucag

SEQ ID NO: 616256 - RNA, 64 nt, hsa
gugggggcugggaguagaggauguuccugcuucucuaggcaaggucccgucauagcaauuauau

SEQ ID NO: 616257 - RNA, 64 nt, hsa
gcagugagcugagauggcaccacugcacuccggccuaggcaacgagagcaaaacuccaauacaa

SEQ ID NO: 616258 - RNA, 64 nt, hsa
cccaagaaaagaggccaaagcaagagcagauucccuaggcaagagcagcagcacaacuaggaaa

SEQ ID NO: 616259 - RNA, 64 nt, hsa
auacagugucugacuauaaccuuguuccaaaaaccuaggcaaagaguauauguaggagguggga

SEQ ID NO: 616260 - RNA, 64 nt, hsa
gcuguuauguccagaaauugugugugcaagaaaacuaggcaauguacucuuccgauguuugugu

SEQ ID NO: 616261 - RNA, 64 nt, hsa
uaccugagugucugcagcacccuccacuucucuccuaggcaaugagacccaguggcuagaaauu

SEQ ID NO: 616262 - RNA, 64 nt, hsa
acaaugcuugauuugaaaacaguguggagaaaaacuaggcaaacuacacccuguucauuguuac

SEQ ID NO: 616263 - RNA, 64 nt, hsa
agguccuuauuuacaaggcugcguuaaaguuguacuaggcaaacacacugauguaggaagcacg

SEQ ID NO: 616264 - RNA, 64 nt, hsa
guucauguuaguuucuucaaaacccuaucuaauacuaggcaaaguagccaagagccuuuuguuu

SEQ ID NO: 616265 - RNA, 64 nt, hsa
cuccauguggcuuaagccuuccagcugagugaagcuaggcaaauggagugggggcaggcaucua

SEQ ID NO: 616266 - RNA, 64 nt, hsa
uaucagaacuuggguugauuucaauguuaauaaacuaggcaaaacaaauaacuguuagaaggua

SEQ ID NO: 616267 - RNA, 64 nt, hsa
cauaugaaaaagcuucuuaugaauauuguuauuccuaggcaaaccccccuuggaagcugucaaa

SEQ ID NO: 616268 - RNA, 64 nt, hsa
uagccuccuuuaagcugaaugggauuuaaccauucuaggcaacaccccugaagggcauaccuaa

SEQ ID NO: 616269 - RNA, 64 nt, hsa
aaauuucuaucauugccacauaccauucuuauuccuaggcaacuauuaauaaucuauccugaga

SEQ ID NO: 616270 - RNA, 64 nt, hsa
uggguucccauuuauccugcuuucuuugggauugcuaggcaaggucuggccaggccccccuuuu

SEQ ID NO: 616271 - RNA, 53 nt, hsa
cugaugcuggccaggagugagugcuaggcaaggcuacuucaaugcacagaacc

SEQ ID NO: 616272 - RNA, 64 nt, hsa
ggugaaaccguauacuacuuucacugccaugacacuaggcaaaaaauauuuccuguuaaaagaa

SEQ ID NO: 616273 - RNA, 64 nt, hsa
ccgucagcuucuucauaacguuuucaaggaaauucuaggcaaucauuccugucaccaaagaacu

SEQ ID NO: 616274 - RNA, 64 nt, hsa
agaagugaccugaaguuucugugcaacacucacacuaggcaaugccauuucaaugcauuacuaa

SEQ ID NO: 616275 - RNA, 64 nt, hsa
cuaggacugguuuggggacgggugggaaugaccccuaggcaaggggaugagaccgcaggaggaa

SEQ ID NO: 616276 - RNA, 64 nt, hsa
aucaacacacacaaaauggaauaauucugagucacuaggcaaucaaucuacugugguuuuacua

SEQ ID NO: 616277 - RNA, 64 nt, hsa
gcagugagccaagaucgugccauugcacuccagccuaggcaacaagagugaaacuccaucucaa

SEQ ID NO: 616278 - RNA, 62 nt, hsa
ccgaaauugaccagagauaaugugaacuucuacuaggcaaagcaauacaucgguccaaggau

SEQ ID NO: 616279 - RNA, 64 nt, hsa
gcagugagcugagauggcgccacugcacuccagccuaggcaacagagcaagacuccgucucaaa

SEQ ID NO: 616280 - RNA, 64 nt, hsa
uucuuugagacagggucuuucucugcacuccagccuaggcaacagagcaagacuccgucucaaa

SEQ ID NO: 616281 - RNA, 64 nt, hsa
auucauuauuuuauuaauauugcccuaaguacaacuaggcaagugauugccaccuaaaucagaa

SEQ ID NO: 616282 - RNA, 64 nt, hsa
ugcuccuuuugaguugcuuuugcguuucucaugccuaggcaaguguaauagaaauuauguagcu

SEQ ID NO: 616283 - RNA, 64 nt, hsa
ugacuauuacaacaaaguuccaguuaguaaaauucuaggcaaguguguggucauguuugucaag

SEQ ID NO: 616284 - RNA, 64 nt, hsa
uauaagaguuguauaaaagauauuuuuggcauuucuaggcaaguaucagccaauaaguauguua

SEQ ID NO: 616285 - RNA, 64 nt, hsa
gaggauugcuugagcccaggaguucaagaucagccuaggcaacauagggagacccuaucccuac

SEQ ID NO: 616286 - RNA, 64 nt, hsa
ucuucucucucugcauaggauuccggaucuuuggcuaggcaaaaugaaacuauaacugaucuaa

SEQ ID NO: 616287 - RNA, 64 nt, hsa
gaagggugagggagaauaaggguaagggaguauucuaggcaaggaacuaaggaaggaauccccu

SEQ ID NO: 616288 - RNA, 64 nt, hsa
uauggguacguauaaaaagcaagaauucuguuuccuaggcaaacauugcaacucagggcuaaag

SEQ ID NO: 616289 - RNA, 64 nt, hsa
gcagugagccauaaucgugccacugcaguccagccuaggcaacagagugagacuuugucucaaa

SEQ ID NO: 616290 - RNA, 64 nt, hsa
uuaaaauuuuuugagaguguuaaaaaaaauuuuacuaggcaaaauguuugaaguauguucagua

SEQ ID NO: 616291 - RNA, 64 nt, hsa
guggauugcuugagccuaggaguucgagaccagccuaggcaacauggagaaaccccgucucuau

SEQ ID NO: 616292 - RNA, 64 nt, hsa
aauauauaaucaaaugauucauuuuucuguuagacuaggcaaauuguucaaaaauaaccuuuuu

SEQ ID NO: 616293 - RNA, 64 nt, hsa
gaugcagucaccagcaugagaagcaguccagagucuaggcaauuuuuacaaccugaguucaagu

SEQ ID NO: 616294 - RNA, 64 nt, hsa
caagaacugacagcuugaggaauucucuccacaccuaggcaauaauuacguaaguuucccaauu

SEQ ID NO: 616295 - RNA, 64 nt, hsa
cacaaggaggcgaggcuaugcguucgaggccaaccuaggcaaaauuggaaaaaaaaaaaaaaau

SEQ ID NO: 616296 - RNA, 64 nt, hsa
gaaguacuuaaacuuccacaagagugaauuugaccuaggcaaguuuguucaaaagguagauccu

SEQ ID NO: 616297 - RNA, 64 nt, hsa
gaagauugcuugagcccaggaguuugagaccaaucuaggcaauguagugagacccugucucuaa

SEQ ID NO: 616298 - RNA, 64 nt, hsa
gguuauauuuuuuaaaauaaugaauuuucuaucucuaggcaacaugucuuuauuauucaagcug

SEQ ID NO: 616299 - RNA, 64 nt, hsa
caacuguguuugccagaaacaucauucaugugaacuaggcaaguuaccuuuuuuccccccuucu

SEQ ID NO: 616300 - RNA, 64 nt, hsa
cacuugaaagagcguguguacauguauuuuuuuucuaggcaaacauugaaugcaaacguguauu

SEQ ID NO: 616301 - RNA, 64 nt, hsa
gguuuuggggucauauauaaggacuaaagccaagcuaggcaaaacaaugacagcaccguuuuuu

SEQ ID NO: 616302 - RNA, 64 nt, hsa
uuucuuggcauuauuugcugaggguaggaaaguccuaggcaauggaguccagauuuuaguaagu

SEQ ID NO: 616303 - RNA, 64 nt, hsa
guggugagcugagaugacgccauugcacuccagccuaggcaauaagagcaaaacucugccucaa

SEQ ID NO: 616304 - RNA, 64 nt, hsa
aucuuacguggagacaggucaaccaaagagggagcuaggcaaagcugaagaccgcagugaguca

SEQ ID NO: 616305 - RNA, 64 nt, hsa
cuuacuccugugagucccagagcuaaagaaccuucuaggcaaguacaccgaaugacucagucca

SEQ ID NO: 616306 - RNA, 64 nt, hsa
uauuugugaaucaguaaccagaugcagcaaauaucuaggcaauguggacuaccucauucaguaa

SEQ ID NO: 616307 - RNA, 64 nt, hsa
accguagcagggccccugggccccucuuauuccucuaggcaagcaggaccuggcaucauggugg

SEQ ID NO: 616308 - RNA, 64 nt, hsa
caggaucugagccaucgagggaagaguggggcugcuaggcaaguggauuagggggucuggauag

SEQ ID NO: 616309 - RNA, 64 nt, hsa
gccugccagagucgucuugcucuuccucuugcuucuaggcaaccacacuuggcaaguuaaaugu

SEQ ID NO: 616310 - RNA, 64 nt, hsa
gaauguaagaccugaaagaguuaugaaucuaucacuaggcaaaaacuucucuuuuccuauugcu

SEQ ID NO: 616311 - RNA, 64 nt, hsa
cauauuuugcagcuaucaugauccuaguucaaugcuaggcaaauaauggcacuuguuaauuauu

SEQ ID NO: 616312 - RNA, 64 nt, hsa
uuggaauugagaaggguagacaaacuucaggauacuaggcaagaauauauaaagaauauuuccc

SEQ ID NO: 616313 - RNA, 64 nt, hsa
guggaucacuugaguucaggaguucgagaucagccuaggcaacauggugaaauccugucuuuac

SEQ ID NO: 616314 - RNA, 64 nt, hsa
gcuaucuaaccagaauacauaggggaacugugggcuaggcaaacaaaauagaaaaaagugugaa

SEQ ID NO: 616315 - RNA, 64 nt, hsa
guagcagggggggaaaugcauuuauagaucauuucuaggcaaaauugugaagcuaaugaccaac

SEQ ID NO: 616316 - RNA, 64 nt, hsa
gcuaucaaucauuaaggucauuacucucaaccaccuaggcaaugaagaauauaccauuucaaau

SEQ ID NO: 616317 - RNA, 64 nt, hsa
uugaacuuaaauuauauucuauauguguaucuuccuaggcaaaagcuguaauuuccagagagac

SEQ ID NO: 616318 - RNA, 64 nt, hsa
gaaaacucccagugguucaaacauccugaucauccuaggcaaacauugacaaauacugcucuga

SEQ ID NO: 616319 - RNA, 64 nt, hsa
uugcguuaaaucuuuugagaguguaaaugccgggcuaggcaauugcaguuaauacauacagggg

SEQ ID NO: 616320 - RNA, 53 nt, hsa
agcacuucuugggagccugacaccuaggcaaaacaugcucuuccuugcauacg

SEQ ID NO: 616321 - RNA, 64 nt, hsa
caggaaugcugucagaccagccagccagcgagcucuaggcaaaaggacauggaaacugucacgu

SEQ ID NO: 616322 - RNA, 64 nt, hsa
gcaaugagccgagaucacaccacuacacuccagccuaggcaacagagcaagacucugucucaaa

SEQ ID NO: 616323 - RNA, 64 nt, hsa
uuuauuucuguuaaacugaauauacaauuguucccuaggcaaccaacuuuugcuuauaacuaca

SEQ ID NO: 616324 - RNA, 64 nt, hsa
gaggaucgcuugagcccagaaguuugagaccagccuaggcaacauugcaagacuccaucucuac

SEQ ID NO: 616325 - RNA, 64 nt, hsa
acauguaaaaaauguaaaauggagaccaauugcacuaggcaaguguauauuuuguauuuuauau

SEQ ID NO: 616326 - RNA, 64 nt, hsa
gaggaucacuugaguccaggaguuugaaaccuaccuaggcaacauggugaaaccuugucucuac

SEQ ID NO: 616327 - RNA, 64 nt, hsa
uaaaccaaggacuaugaauacuaaauguuaaguucuaggcaauuauacggggacucagaaggac

SEQ ID NO: 616328 - RNA, 64 nt, hsa
gaggaucacuugagccuaugaguucaagaccagccuaggcaauguagugacaccucauuucuau

SEQ ID NO: 616329 - RNA, 64 nt, hsa
cacaaaaacaggcagucaucuuuaagggcuaugccuaggcaaacuacuaacaugcauugugaga

SEQ ID NO: 616330 - RNA, 64 nt, hsa
acacuuacaaaugagaauuucucagaauuucauucuaggcaaguuccacucaacaccagaucaa

SEQ ID NO: 616331 - RNA, 64 nt, hsa
ugcagugcagaugagcaccauuuaguuauaugugcuaggcaaaucuccaacacaguugaugugu

SEQ ID NO: 616332 - RNA, 64 nt, hsa
ucaguguucauauagcaccuggcccauuacauaucuaggcaacuaaaaacaaacauuguaagaa

SEQ ID NO: 616333 - RNA, 64 nt, hsa
uuugcuguucuggauaaugagguucaaaagucaccuaggcaacugccaaaauagcugaaaugga

SEQ ID NO: 616334 - RNA, 64 nt, hsa
gaacagcaugugcagaucuuaaucaucccaguuccuaggcaacuuguucaccagguacgcaagg

SEQ ID NO: 616335 - RNA, 64 nt, hsa
gacuguaugauuccauuuauaugaaauauacauacuaggcaaauccauggagauggaacauaga

SEQ ID NO: 616336 - RNA, 64 nt, hsa
aucgugucuaguccagcccugucugggcccugugcuaggcaauaacucuugcagcccugaagga

SEQ ID NO: 616337 - RNA, 64 nt, hsa
ugccacuccccacccccagccucugccggcuccccuaggcaaccccuuucuccccaggagcggg

SEQ ID NO: 616338 - RNA, 64 nt, hsa
agaugacaccuuuuguuauguugaaauuaacuugcuaggcaacccuaaauugggaagcaaguag

SEQ ID NO: 616339 - RNA, 64 nt, hsa
cacauuguguaaaggucucuggugcucaaaguuucuaggcaaagaagugaaaauuuggaauuuu

SEQ ID NO: 616340 - RNA, 64 nt, hsa
guuucauauuucuuaucaccacaguaaguuccuacuaggcaaaaugagagggcaguguuuccuu

SEQ ID NO: 616341 - RNA, 64 nt, hsa
gcagugagcugagaucacaccacugcacuucauccuaggcaacagagcgagacucugucucccc

SEQ ID NO: 616342 - RNA, 64 nt, hsa
agcugcuauagauagcacugccuucuuguuccagcuaggcaaugccuuuuuuuuuuuuuuuuga

SEQ ID NO: 616343 - RNA, 64 nt, hsa
uguuaaguguuuuguauaugauauugcaguuuuacuaggcaaaucuucaaaagaugcacuuuag

SEQ ID NO: 616344 - RNA, 64 nt, hsa
cuggaugcugagaauggucugauauucgugcuaccuaggcaauccauugacauuucuccaauca

SEQ ID NO: 616345 - RNA, 64 nt, hsa
gcuggagcuuggcgccugccagaaaaauuuggggcuaggcaagccccagguugcagacauggug

SEQ ID NO: 616346 - RNA, 64 nt, hsa
caggugagccaugaucgugucacugcacuccagccuaggcaacagagcaagacccugucucuua

SEQ ID NO: 616347 - RNA, 64 nt, hsa
cugcauuucacuuucccgguguuccccacuguaucuaggcaacauaguauucaugacuauggau

SEQ ID NO: 616348 - RNA, 64 nt, hsa
cgaagcucugagucauucagcccuggggacaccccuaggcaacgauuccgacagcgccauccag

SEQ ID NO: 616349 - RNA, 64 nt, hsa
gggggguugguugguugguugguuuugucggaaccuaggcaaaugaccauauuagugaaucugu

SEQ ID NO: 616350 - RNA, 64 nt, hsa
uuuuaguauaaauuugagacaauaacuguccagacuaggcaaauuuuuuuaguuuauaauguuu

SEQ ID NO: 616351 - RNA, 64 nt, hsa
aaggcaauacuguaauguaaagacauuuauaguacuaggcaaacagcaccccagguacuccagg

SEQ ID NO: 616352 - RNA, 64 nt, hsa
ugugcucucgcuaucaagaaugcaucucaaggggcuaggcaaggggaaaacugcuguguguggu

SEQ ID NO: 616353 - RNA, 64 nt, hsa
uuaaaaccacuaaaauagauugauguucuucaaacuaggcaaaacaacucauauguuaagacca

SEQ ID NO: 616354 - RNA, 64 nt, hsa
gaggauuacuugaggccagaaguuugagacuagccuaggcaauauaaugagacccugucucuac

SEQ ID NO: 616355 - RNA, 64 nt, hsa
aguggauuaauacagcaagagugccacauuauaacuaggcaauuauccauucuucaagacuuag

SEQ ID NO: 616356 - RNA, 64 nt, hsa
uuuguaucuucauaaggccaugcuccugacaggucuaggcaaccugggggaugacuuagguuaa

SEQ ID NO: 616357 - RNA, 64 nt, hsa
uguauucuuuauggaaaauguuguccuguacuuacuaggcaaaacguaugaaucggauuaacug

SEQ ID NO: 616358 - RNA, 64 nt, hsa
acauuucccagacuuucaugaagcuguugagguccuaggcaauuaaugcagcaguugcgauaaa

SEQ ID NO: 616359 - RNA, 64 nt, hsa
guaucacugaggccaccgaaaaggacauuucuaccuaggcaaucagucagauucacagaaaaaa

SEQ ID NO: 616360 - RNA, 64 nt, hsa
auucauuuugaaaaacacaaugauuccuucuuuucuaggcaauauaaggaaagugauccaaaau

SEQ ID NO: 616361 - RNA, 64 nt, hsa
auguauugcauaagcuaaagcaacacagacacuccuaggcaaaguuuuuguuugugaauaguac

SEQ ID NO: 616362 - RNA, 64 nt, hsa
uuaaguuuuugauuuuguagaaauuagcuuuugucuaggcaacuagugguuauacucugcaaau

SEQ ID NO: 616363 - RNA, 64 nt, hsa
ugagagguagcaagucuaggguggugaguuccugcuaggcaaccaaauuuaagcuccucacuuu

SEQ ID NO: 616364 - RNA, 64 nt, hsa
ugucgaagaaggaaggcgaagaaucaaguaaucucuaggcaaaugccuucaaguuuuccaguuc

SEQ ID NO: 616365 - RNA, 51 nt, hsa
gggcuuugcucuuucagugagcuaggcaaucaagucucacagauugcugcc

SEQ ID NO: 616366 - RNA, 64 nt, hsa
augaaauguguuuuccccuguguacuaacacauucuaggcaaaauucaaacuuauagugguaaa

SEQ ID NO: 616367 - RNA, 64 nt, hsa
cugagcccccugcagcucccaucuccagcuauuccuaggcaaagagccucauggcuaaggcagc

SEQ ID NO: 616368 - RNA, 64 nt, hsa
augccuagaugccucggagagcaucauucucugccuaggcaaggcccugcaucccuugccucag

SEQ ID NO: 616369 - RNA, 64 nt, hsa
uacauuucaguuaaaaggcacacuacagucaucacuaggcaauucugcuuucuaagcaguugua

SEQ ID NO: 616370 - RNA, 64 nt, hsa
gauggcaagccuuaugucuugggagccuguuuugcuaggcaaaguuacaagugaccuaauggga

SEQ ID NO: 616371 - RNA, 64 nt, hsa
uauuuuuauacuuuuauuuucacuaguuuugcuucuaggcaaaaagcaaaauaaacuuuucauc

SEQ ID NO: 616372 - RNA, 64 nt, hsa
uuauuggauccugaaaccaaucaauuacuuagaacuaggcaaagaugaaaguauagccaacuau

SEQ ID NO: 616373 - RNA, 64 nt, hsa
gcagugagucgagaucaugccauugcauuccagccuaggcaacacgagcaaaacuuccucucaa

SEQ ID NO: 616374 - RNA, 64 nt, hsa
gaggaucacuugagcccaggaguucaagacuagccuaggcaacauagugagacccugucucuac

SEQ ID NO: 616375 - RNA, 64 nt, hsa
ugggaacugauguagaaggcaggauuuagcccuucuaggcaaaagaaaagcucaguuggguuuc

SEQ ID NO: 616376 - RNA, 64 nt, hsa
aaaaccccaaacuauaaaaacucuggaagauaaccuaggcaauaccauucuggacauaggaacg

SEQ ID NO: 616377 - RNA, 64 nt, hsa
cacuguucagggggcugguggccgucuccacucccuaggcaaguucucugaggcagaagggggu

SEQ ID NO: 616378 - RNA, 64 nt, hsa
cuggauggccuugugaacuugagcucaguguaugcuaggcaacaauucucccgcuccagacccu

SEQ ID NO: 616379 - RNA, 64 nt, hsa
uugcguuaaaucuuuugagaauguaaaugccgggcuaggcaauugcaguuaauacauacagagg

SEQ ID NO: 616380 - RNA, 64 nt, hsa
cagagaggggaagugauuggccuaaagucaggaacuaggcaaguggucaagccaugcuuuguga

SEQ ID NO: 616381 - RNA, 64 nt, hsa
gaaagucuugguuacuuaagaggcagagaagccccuaggcaaagacuggccugauugcagagua

SEQ ID NO: 616382 - RNA, 64 nt, hsa
augucuucugucauuucuuaauaaauauuauauacuaggcaaagaaaccauugucuuuguuuuc

SEQ ID NO: 616383 - RNA, 64 nt, hsa
gcagugagcuaugagggugccucugugcuccauccuaggcaacagagugauacgcuguuuaaaa

SEQ ID NO: 616384 - RNA, 64 nt, hsa
gaggaucacuugaggccaggagucugagacaagccuaggcaacaaaacaagacucugucucuac

SEQ ID NO: 616385 - RNA, 64 nt, hsa
ggccucucccucucagugugaggcuucacccaugcuaggcaagcccagggcacagaugccggga

SEQ ID NO: 616386 - RNA, 64 nt, hsa
auccuagccgugaguuggaacuuaaagguuuuuacuaggcaaggagaaauuuucuuucuuucua

SEQ ID NO: 616387 - RNA, 64 nt, hsa
auagaugaggugugugugugcgcugcuucuugaucuaggcaaaccuuuauaaaguugcaguacc

SEQ ID NO: 616388 - RNA, 64 nt, hsa
ggggggagccuagauugcgcuacugcacuccagccuaggcaacagagggagacucugucucauu

SEQ ID NO: 616389 - RNA, 64 nt, hsa
cuuugguuuuccuucagacauuauuaugucuguacuaggcaacuaauucagacuguccugguug

SEQ ID NO: 616390 - RNA, 64 nt, hsa
uagaccuaaaaccauaaaaacccuagaagaaaaccuaggcaauaccauucaggacauaggcaug

SEQ ID NO: 616391 - RNA, 64 nt, hsa
gaggaucgcuugaggccaggaguuugagacuagccuaggcaacacagugaggccuuaucucaac

SEQ ID NO: 616392 - RNA, 64 nt, hsa
gaggaucgcuuaagcccaggaauucgaaaucagccuaggcaacauaguaagaccucaucucuac

SEQ ID NO: 616393 - RNA, 64 nt, hsa
uuacagcuugugaggccaggaguuugagaccauccuaggcaacauaaugagacaccgucucuaa

SEQ ID NO: 616394 - RNA, 64 nt, hsa
ccuuucucucagugcucgccuucccccagaaucccuaggcaaccacugaguaguuuucacugua

SEQ ID NO: 616395 - RNA, 64 nt, hsa
ccuccgcgagccccaucgucgcgccuguggacgccuaggcaagagcggcccucugcagccaaga

SEQ ID NO: 616396 - RNA, 64 nt, hsa
gaagccgaaauuccuagaaaucagguuucuacugcuaggcaauugaaguauaaacuauuuuaua

SEQ ID NO: 616397 - RNA, 64 nt, hsa
gcagugaaccaagaucacaccacugcacuccagccuaggcaacagagacucugucucaaaaaaa

SEQ ID NO: 616398 - RNA, 64 nt, hsa
auguaauugcuauauuuuguuuuguuuuuccuuacuaggcaaaguuaaaauguuccaugcuuug

SEQ ID NO: 616399 - RNA, 64 nt, hsa
uuaacgauggggauacauucuuagaaaugugucacuaggcaauucugucauuguguaaacauua

SEQ ID NO: 616400 - RNA, 64 nt, hsa
gugguggggcaagaucgcaccauugcacccgagccuaggcaacaagagugaaauuccgucucaa

SEQ ID NO: 616401 - RNA, 64 nt, hsa
aauaucaaacuuccugcauaucuccauuuuugcucuaggcaaauuaauuauccuuaaaaaaguu

SEQ ID NO: 616402 - RNA, 64 nt, hsa
caaauucugcaguggaauggagaggaaaauacuucuaggcaagcagcuagacuggugaauuggg

SEQ ID NO: 616403 - RNA, 64 nt, hsa
ugacucugcaagcagacaccucgaggcagguguucuaggcaaagggaugggcaugagcgaaggc

SEQ ID NO: 616404 - RNA, 64 nt, hsa
gaggaucacuugagcccaggaguucgagaccagccuaggcaacauagcaagacccugucuguac

SEQ ID NO: 616405 - RNA, 64 nt, hsa
gcaucuuugauaaacuucucagugaaaauguuggcuaggcaaguucaguuaaaauauaguagaa

SEQ ID NO: 616406 - RNA, 64 nt, hsa
ggucggggccccaguuaagcugugccccaccacccuaggcaaugaggggcaggaaagggguaca

SEQ ID NO: 616407 - RNA, 64 nt, hsa
cugccggaugugaaauccaggcgucagcuguuuccuaggcaagggcaggaaaguggucuccagc

SEQ ID NO: 616408 - RNA, 64 nt, hsa
gaaugggggacauaaagccuguccugucucuauucuaggcaagagagaguggguucaaaagacu

SEQ ID NO: 616409 - RNA, 64 nt, hsa
uuaaaacauguuuugauaaguaauuacacuggaccuaggcaaaaccacugaagaacaaguguuc

SEQ ID NO: 616410 - RNA, 64 nt, hsa
gcugcucccagauuacuccuuccuuccaauauaacuaggcaaaaagaagugaggagaaaccugc

SEQ ID NO: 616411 - RNA, 64 nt, hsa
cuuuaaauuacuuuuuggauuguagccaguucagcuaggcaaaagccauacuuuucacaauuaa

SEQ ID NO: 616412 - RNA, 64 nt, hsa
uuucucauguaauguuuagggaguuuauucuaaccuaggcaaacggcaugcuaucacaagaaag

SEQ ID NO: 616413 - RNA, 64 nt, hsa
aggacugauugaguccggguguucaagggccaaccuaggcaacacagugagaacucaucucugu

SEQ ID NO: 616414 - RNA, 64 nt, hsa
uuaaauugccagaaaacaaaugaugaggcaacuacagucagauuuauagccagccaucuaucac

SEQ ID NO: 616415 - RNA, 64 nt, hsa
ucucaaauuacaauuccaaagagccgccacucaacagucagaugaacccaacagucagaugaga

SEQ ID NO: 616416 - RNA, 64 nt, hsa
aaagagccgccacucaacagucagaugaacccaacagucagaugagagaaaugaacccuacuug

SEQ ID NO: 616417 - RNA, 64 nt, hsa
ggggagggagggacaaacacucccaaucauccaccagucagacugaauguguagcuggcgagga

SEQ ID NO: 616418 - RNA, 64 nt, hsa
uucugccuccaguuggagcuuucagcuguuaaaacagucagaaacuauugauucuucccuuuag

SEQ ID NO: 616419 - RNA, 64 nt, hsa
agcccuacaaauguaaagaaugugaaaagucuuucagucagagcucaagucuuagucgacauaa

SEQ ID NO: 616420 - RNA, 64 nt, hsa
aagccuuugauugugauguaugggaaaagaacuccagucagagagcacaucuaguucaacauca

SEQ ID NO: 616421 - RNA, 64 nt, hsa
gaggcccaggauccccaaaauauuauaagcauugcagucagaugauauagcacuagcaaagcau

SEQ ID NO: 616422 - RNA, 64 nt, hsa
cuuucauccuuuccaauuuuucuauuccagaagacagucagaauaaugcauucuguacuacauc

SEQ ID NO: 616423 - RNA, 64 nt, hsa
cuuuucaccugagccuuucuucugagaaaugcugcagucagaagggugugcugguaaaguauuu

SEQ ID NO: 616424 - RNA, 64 nt, hsa
acaaaaugcagagccaggucccucagcccagacucagucagacauguucacuaaugacucaagu

SEQ ID NO: 616425 - RNA, 64 nt, hsa
ucccaagggacccucaaggaccucgagguuacugcagucagaugccaucucauccccugugggg

SEQ ID NO: 616426 - RNA, 64 nt, hsa
cuugauguaaaucccauguuaauuuauuaaauuucagucagaaggucagcauuuacaugacaga

SEQ ID NO: 616427 - RNA, 64 nt, hsa
uuugugcuaagggcccugguugacugaguggccccagucagaugagaggcaaguccuaagcuuc

SEQ ID NO: 616428 - RNA, 64 nt, hsa
aaguccccuccugggcugucuucaucauacuccgcagucagacugggcugguaguaagcugccg

SEQ ID NO: 616429 - RNA, 64 nt, hsa
auuuuucuugcugccuuuuucacccaagauucagcagucagauguuuacugcacaccuauuacc

SEQ ID NO: 616430 - RNA, 64 nt, hsa
ggauuucuuuggaugcugaaugcagugauguuaucagucagauucuuuccuuggcucaguugug

SEQ ID NO: 616431 - RNA, 64 nt, hsa
ucuccugcgguuaccagcccugcaccaaccaccacagucagaauaaucucaaaacugcuagugg

SEQ ID NO: 616432 - RNA, 64 nt, hsa
aggacuugggccccagcaggccuuuuguggcauccagucagaaguuaggaaacacccucuaggg

SEQ ID NO: 616433 - RNA, 64 nt, hsa; identical to SEQ ID NO: 492451

SEQ ID NO: 616434 - RNA, 64 nt, hsa; identical to SEQ ID NO: 492452

SEQ ID NO: 616435 - RNA, 64 nt, hsa; identical to SEQ ID NO: 492453

SEQ ID NO: 616436 - RNA, 64 nt, hsa; identical to SEQ ID NO: 492454

SEQ ID NO: 616437 - RNA, 64 nt, hsa; identical to SEQ ID NO: 492455

SEQ ID NO: 616438 - RNA, 64 nt, hsa; identical to SEQ ID NO: 492456

SEQ ID NO: 616439 - RNA, 64 nt, hsa; identical to SEQ ID NO: 492457

SEQ ID NO: 616440 - RNA, 64 nt, hsa; identical to SEQ ID NO: 492458

SEQ ID NO: 616441 - RNA, 64 nt, hsa; identical to SEQ ID NO: 492459

SEQ ID NO: 616442 - RNA, 64 nt, hsa; identical to SEQ ID NO: 492460

SEQ ID NO: 616443 - RNA, 64 nt, hsa; identical to SEQ ID NO: 492461

SEQ ID NO: 616444 - RNA, 64 nt, hsa; identical to SEQ ID NO: 492462

SEQ ID NO: 616445 - RNA, 64 nt, hsa; identical to SEQ ID NO: 492463

SEQ ID NO: 616446 - RNA, 64 nt, hsa; identical to SEQ ID NO: 492464

SEQ ID NO: 616447 - RNA, 64 nt, hsa; identical to SEQ ID NO: 492465

SEQ ID NO: 616448 - RNA, 64 nt, hsa; identical to SEQ ID NO: 492466

SEQ ID NO: 616449 - RNA, 64 nt, hsa; identical to SEQ ID NO: 492467

SEQ ID NO: 616450 - RNA, 64 nt, hsa; identical to SEQ ID NO: 492468

SEQ ID NO: 616451 - RNA, 64 nt, hsa; identical to SEQ ID NO: 561089

SEQ ID NO: 616452 - RNA, 64 nt, hsa; identical to SEQ ID NO: 561090

SEQ ID NO: 616453 - RNA, 64 nt, hsa; identical to SEQ ID NO: 561091

SEQ ID NO: 616454 - RNA, 64 nt, hsa; identical to SEQ ID NO: 561092

SEQ ID NO: 616455 - RNA, 64 nt, hsa; identical to SEQ ID NO: 561093

SEQ ID NO: 616456 - RNA, 64 nt, hsa; identical to SEQ ID NO: 561094

SEQ ID NO: 616457 - RNA, 64 nt, hsa; identical to SEQ ID NO: 561095

SEQ ID NO: 616458 - RNA, 64 nt, hsa; identical to SEQ ID NO: 561096

SEQ ID NO: 616459 - RNA, 64 nt, hsa; identical to SEQ ID NO: 561097

SEQ ID NO: 616460 - RNA, 64 nt, hsa; identical to SEQ ID NO: 561098

SEQ ID NO: 616461 - RNA, 64 nt, hsa; identical to SEQ ID NO: 561099

SEQ ID NO: 616462 - RNA, 64 nt, hsa; identical to SEQ ID NO: 561100

SEQ ID NO: 616463 - RNA, 64 nt, hsa; identical to SEQ ID NO: 561101

SEQ ID NO: 616464 - RNA, 64 nt, hsa; identical to SEQ ID NO: 561102

SEQ ID NO: 616465 - RNA, 64 nt, hsa; identical to SEQ ID NO: 561103

SEQ ID NO: 616466 - RNA, 64 nt, hsa; identical to SEQ ID NO: 561104

SEQ ID NO: 616467 - RNA, 64 nt, hsa; identical to SEQ ID NO: 561105

SEQ ID NO: 616468 - RNA, 64 nt, hsa; identical to SEQ ID NO: 561106

SEQ ID NO: 616469 - RNA, 64 nt, hsa; identical to SEQ ID NO: 561107

SEQ ID NO: 616470 - RNA, 64 nt, hsa; identical to SEQ ID NO: 561108

SEQ ID NO: 616471 - RNA, 64 nt, hsa; identical to SEQ ID NO: 561109

SEQ ID NO: 616472 - RNA, 64 nt, hsa; identical to SEQ ID NO: 561110

SEQ ID NO: 616473 - RNA, 64 nt, hsa; identical to SEQ ID NO: 561111

SEQ ID NO: 616474 - RNA, 64 nt, hsa; identical to SEQ ID NO: 561112

SEQ ID NO: 616475 - RNA, 64 nt, hsa; identical to SEQ ID NO: 561113

SEQ ID NO: 616476 - RNA, 64 nt, hsa; identical to SEQ ID NO: 561114

SEQ ID NO: 616477 - RNA, 64 nt, hsa; identical to SEQ ID NO: 561115

SEQ ID NO: 616478 - RNA, 64 nt, hsa; identical to SEQ ID NO: 561116

SEQ ID NO: 616479 - RNA, 64 nt, hsa; identical to SEQ ID NO: 561117

SEQ ID NO: 616480 - RNA, 64 nt, hsa; identical to SEQ ID NO: 561118

SEQ ID NO: 616481 - RNA, 64 nt, hsa; identical to SEQ ID NO: 561119

SEQ ID NO: 616482 - RNA, 64 nt, hsa; identical to SEQ ID NO: 561120

SEQ ID NO: 616483 - RNA, 64 nt, hsa; identical to SEQ ID NO: 561121

SEQ ID NO: 616484 - RNA, 64 nt, hsa; identical to SEQ ID NO: 561122

SEQ ID NO: 616485 - RNA, 64 nt, hsa; identical to SEQ ID NO: 561123

SEQ ID NO: 616486 - RNA, 64 nt, hsa; identical to SEQ ID NO: 561124

SEQ ID NO: 616487 - RNA, 64 nt, hsa; identical to SEQ ID NO: 561125

SEQ ID NO: 616488 - RNA, 64 nt, hsa; identical to SEQ ID NO: 561126

SEQ ID NO: 616489 - RNA, 64 nt, hsa; identical to SEQ ID NO: 561127

SEQ ID NO: 616490 - RNA, 64 nt, hsa; identical to SEQ ID NO: 561128

SEQ ID NO: 616491 - RNA, 64 nt, hsa; identical to SEQ ID NO: 561129

SEQ ID NO: 616492 - RNA, 64 nt, hsa; identical to SEQ ID NO: 561130

SEQ ID NO: 616493 - RNA, 64 nt, hsa; identical to SEQ ID NO: 561131

SEQ ID NO: 616494 - RNA, 64 nt, hsa; identical to SEQ ID NO: 561132

SEQ ID NO: 616495 - RNA, 64 nt, hsa; identical to SEQ ID NO: 561133

SEQ ID NO: 616496 - RNA, 64 nt, hsa; identical to SEQ ID NO: 561134

SEQ ID NO: 616497 - RNA, 64 nt, hsa; identical to SEQ ID NO: 561135

SEQ ID NO: 616498 - RNA, 64 nt, hsa; identical to SEQ ID NO: 561136

SEQ ID NO: 616499 - RNA, 64 nt, hsa; identical to SEQ ID NO: 561137

SEQ ID NO: 616500 - RNA, 64 nt, hsa; identical to SEQ ID NO: 561138

SEQ ID NO: 616501 - RNA, 64 nt, hsa; identical to SEQ ID NO: 561139

SEQ ID NO: 616502 - RNA, 64 nt, hsa; identical to SEQ ID NO: 561140

SEQ ID NO: 616503 - RNA, 64 nt, hsa; identical to SEQ ID NO: 561141

SEQ ID NO: 616504 - RNA, 64 nt, hsa; identical to SEQ ID NO: 561142

SEQ ID NO: 616505 - RNA, 64 nt, hsa; identical to SEQ ID NO: 561143

SEQ ID NO: 616506 - RNA, 64 nt, hsa; identical to SEQ ID NO: 561144

SEQ ID NO: 616507 - RNA, 64 nt, hsa; identical to SEQ ID NO: 561145

SEQ ID NO: 616508 - RNA, 64 nt, hsa; identical to SEQ ID NO: 561146

SEQ ID NO: 616509 - RNA, 64 nt, hsa; identical to SEQ ID NO: 561147

SEQ ID NO: 616510 - RNA, 64 nt, hsa; identical to SEQ ID NO: 561148

SEQ ID NO: 616511 - RNA, 64 nt, hsa; identical to SEQ ID NO: 561149

SEQ ID NO: 616512 - RNA, 64 nt, hsa; identical to SEQ ID NO: 561150

SEQ ID NO: 616513 - RNA, 64 nt, hsa; identical to SEQ ID NO: 561151

SEQ ID NO: 616514 - RNA, 64 nt, hsa; identical to SEQ ID NO: 561152

SEQ ID NO: 616515 - RNA, 64 nt, hsa; identical to SEQ ID NO: 561153

SEQ ID NO: 616516 - RNA, 64 nt, hsa; identical to SEQ ID NO: 561154

SEQ ID NO: 616517 - RNA, 64 nt, hsa; identical to SEQ ID NO: 561155

SEQ ID NO: 616518 - RNA, 64 nt, hsa; identical to SEQ ID NO: 561156

SEQ ID NO: 616519 - RNA, 64 nt, hsa; identical to SEQ ID NO: 561157

SEQ ID NO: 616520 - RNA, 64 nt, hsa; identical to SEQ ID NO: 561158

SEQ ID NO: 616521 - RNA, 64 nt, hsa; identical to SEQ ID NO: 561159

SEQ ID NO: 616522 - RNA, 64 nt, hsa; identical to SEQ ID NO: 561160

SEQ ID NO: 616523 - RNA, 64 nt, hsa; identical to SEQ ID NO: 561161

SEQ ID NO: 616524 - RNA, 64 nt, hsa; identical to SEQ ID NO: 561162

SEQ ID NO: 616525 - RNA, 64 nt, hsa; identical to SEQ ID NO: 561163

SEQ ID NO: 616526 - RNA, 64 nt, hsa; identical to SEQ ID NO: 561164

SEQ ID NO: 616527 - RNA, 64 nt, hsa; identical to SEQ ID NO: 561165

SEQ ID NO: 616528 - RNA, 64 nt, hsa; identical to SEQ ID NO: 561166

SEQ ID NO: 616529 - RNA, 64 nt, hsa; identical to SEQ ID NO: 561167

SEQ ID NO: 616530 - RNA, 64 nt, hsa; identical to SEQ ID NO: 561168

SEQ ID NO: 616531 - RNA, 64 nt, hsa; identical to SEQ ID NO: 561169

SEQ ID NO: 616532 - RNA, 64 nt, hsa; identical to SEQ ID NO: 561170

SEQ ID NO: 616533 - RNA, 64 nt, hsa; identical to SEQ ID NO: 561171

SEQ ID NO: 616534 - RNA, 64 nt, hsa; identical to SEQ ID NO: 561172

SEQ ID NO: 616535 - RNA, 64 nt, hsa; identical to SEQ ID NO: 561173

SEQ ID NO: 616536 - RNA, 64 nt, hsa; identical to SEQ ID NO: 561174

SEQ ID NO: 616537 - RNA, 64 nt, hsa; identical to SEQ ID NO: 561175

SEQ ID NO: 616538 - RNA, 64 nt, hsa; identical to SEQ ID NO: 561176

SEQ ID NO: 616539 - RNA, 64 nt, hsa; identical to SEQ ID NO: 561177

SEQ ID NO: 616540 - RNA, 64 nt, hsa; identical to SEQ ID NO: 561178

SEQ ID NO: 616541 - RNA, 64 nt, hsa; identical to SEQ ID NO: 561179

SEQ ID NO: 616542 - RNA, 64 nt, hsa; identical to SEQ ID NO: 561180

SEQ ID NO: 616543 - RNA, 64 nt, hsa; identical to SEQ ID NO: 561181

SEQ ID NO: 616544 - RNA, 64 nt, hsa; identical to SEQ ID NO: 561182

SEQ ID NO: 616545 - RNA, 64 nt, hsa; identical to SEQ ID NO: 561183

SEQ ID NO: 616546 - RNA, 64 nt, hsa; identical to SEQ ID NO: 561184

SEQ ID NO: 616547 - RNA, 64 nt, hsa; identical to SEQ ID NO: 561185

SEQ ID NO: 616548 - RNA, 64 nt, hsa; identical to SEQ ID NO: 561186

SEQ ID NO: 616549 - RNA, 64 nt, hsa; identical to SEQ ID NO: 561187

SEQ ID NO: 616550 - RNA, 64 nt, hsa; identical to SEQ ID NO: 561188

SEQ ID NO: 616551 - RNA, 64 nt, hsa; identical to SEQ ID NO: 561189

SEQ ID NO: 616552 - RNA, 64 nt, hsa; identical to SEQ ID NO: 561190

SEQ ID NO: 616553 - RNA, 64 nt, hsa; identical to SEQ ID NO: 561191

SEQ ID NO: 616554 - RNA, 64 nt, hsa; identical to SEQ ID NO: 561192

SEQ ID NO: 616555 - RNA, 64 nt, hsa; identical to SEQ ID NO: 561193

SEQ ID NO: 616556 - RNA, 64 nt, hsa; identical to SEQ ID NO: 561194

SEQ ID NO: 616557 - RNA, 64 nt, hsa; identical to SEQ ID NO: 561195

SEQ ID NO: 616558 - RNA, 64 nt, hsa; identical to SEQ ID NO: 561196

SEQ ID NO: 616559 - RNA, 64 nt, hsa; identical to SEQ ID NO: 561197

SEQ ID NO: 616560 - RNA, 64 nt, hsa; identical to SEQ ID NO: 561198

SEQ ID NO: 616561 - RNA, 64 nt, hsa; identical to SEQ ID NO: 561199

SEQ ID NO: 616562 - RNA, 64 nt, hsa
cacucagauuugugcccauucaggggcaauuuggcacucagauucuacucuacuucaccuaacc

SEQ ID NO: 616563 - RNA, 64 nt, hsa
aauuugguuacagugugcuacggugcauuuguaacacucagauuugugcccauucaggggcaau

SEQ ID NO: 616564 - RNA, 64 nt, hsa
cccccgccugugucagguguggaugaggucgucacacucagaaggacaggcuugucugccagcu

SEQ ID NO: 616565 - RNA, 64 nt, hsa
uuaacaacucuaacccaggacagaccacaagccacacucagaggccucacugugcugggggcuu

SEQ ID NO: 616566 - RNA, 64 nt, hsa
agaaagacaugguauuuguucagcagacgccgaccacucagacggaggggccccugggauuccc

SEQ ID NO: 616567 - RNA, 64 nt, hsa
ucacacuucuuuucucccaucccgguugcaaucucacucagacaucacaguaccaccccagggg

SEQ ID NO: 616568 - RNA, 64 nt, hsa
gauuuuguggggugggaguggggagcaggaauugcacucagacaugacauuucaauucaucucu

SEQ ID NO: 616569 - RNA, 64 nt, hsa
aagcagccagauuuccaauguuguuuuuccccuccacucagaaaccccugcccuuucccuucag

SEQ ID NO: 616570 - RNA, 64 nt, hsa
uucucugaccccaaggaguggcagaagaucccuucacucagagaagcaaggcugauauuagcuu

SEQ ID NO: 616571 - RNA, 64 nt, hsa
uuuggaggaaaucagagaagugucaauggaccgucacucagacugagacuugaguuauuacaga

SEQ ID NO: 616572 - RNA, 64 nt, hsa
gccagucagaggauaauauauauauucucaucagcacucagaguagucagugaagagaguagau

SEQ ID NO: 616573 - RNA, 64 nt, hsa
ccaacaggggcuccaugccagccgaccuugaccucacucagaaguccagagucuagcguagugc

SEQ ID NO: 616574 - RNA, 64 nt, hsa
ggcagagcacagcggggugagagggauuccuaaucacucagagcagucugugacuuaguggaca

SEQ ID NO: 616575 - RNA, 64 nt, hsa; identical to SEQ ID NO: 438956

SEQ ID NO: 616576 - RNA, 64 nt, hsa; identical to SEQ ID NO: 438957

SEQ ID NO: 616577 - RNA, 64 nt, hsa; identical to SEQ ID NO: 438958

SEQ ID NO: 616578 - RNA, 64 nt, hsa; identical to SEQ ID NO: 438959

SEQ ID NO: 616579 - RNA, 64 nt, hsa; identical to SEQ ID NO: 438960

SEQ ID NO: 616580 - RNA, 64 nt, hsa; identical to SEQ ID NO: 438961

SEQ ID NO: 616581 - RNA, 64 nt, hsa; identical to SEQ ID NO: 438962

SEQ ID NO: 616582 - RNA, 64 nt, hsa; identical to SEQ ID NO: 438963

SEQ ID NO: 616583 - RNA, 64 nt, hsa; identical to SEQ ID NO: 438964

SEQ ID NO: 616584 - RNA, 64 nt, hsa; identical to SEQ ID NO: 438965

SEQ ID NO: 616585 - RNA, 64 nt, hsa; identical to SEQ ID NO: 438966

SEQ ID NO: 616586 - RNA, 64 nt, hsa; identical to SEQ ID NO: 438967

SEQ ID NO: 616587 - RNA, 64 nt, hsa; identical to SEQ ID NO: 438968

SEQ ID NO: 616588 - RNA, 64 nt, hsa; identical to SEQ ID NO: 438969

SEQ ID NO: 616589 - RNA, 64 nt, hsa; identical to SEQ ID NO: 438970

SEQ ID NO: 616590 - RNA, 64 nt, hsa; identical to SEQ ID NO: 438971

SEQ ID NO: 616591 - RNA, 64 nt, hsa; identical to SEQ ID NO: 262953

SEQ ID NO: 616592 - RNA, 64 nt, hsa; identical to SEQ ID NO: 262954

SEQ ID NO: 616593 - RNA, 64 nt, hsa; identical to SEQ ID NO: 262955

SEQ ID NO: 616594 - RNA, 64 nt, hsa; identical to SEQ ID NO: 262956

SEQ ID NO: 616595 - RNA, 64 nt, hsa; identical to SEQ ID NO: 262957

SEQ ID NO: 616596 - RNA, 64 nt, hsa; identical to SEQ ID NO: 262958

SEQ ID NO: 616597 - RNA, 64 nt, hsa; identical to SEQ ID NO: 262959

SEQ ID NO: 616598 - RNA, 64 nt, hsa; identical to SEQ ID NO: 262960

SEQ ID NO: 616599 - RNA, 64 nt, hsa; identical to SEQ ID NO: 262961

SEQ ID NO: 616600 - RNA, 64 nt, hsa; identical to SEQ ID NO: 262962

SEQ ID NO: 616601 - RNA, 64 nt, hsa; identical to SEQ ID NO: 262963

SEQ ID NO: 616602 - RNA, 64 nt, hsa; identical to SEQ ID NO: 262964

SEQ ID NO: 616603 - RNA, 64 nt, hsa; identical to SEQ ID NO: 262965

SEQ ID NO: 616604 - RNA, 57 nt, hsa; identical to SEQ ID NO: 262966

SEQ ID NO: 616605 - RNA, 64 nt, hsa; identical to SEQ ID NO: 131383

SEQ ID NO: 616606 - RNA, 64 nt, hsa; identical to SEQ ID NO: 131384

SEQ ID NO: 616607 - RNA, 64 nt, hsa; identical to SEQ ID NO: 131385

SEQ ID NO: 616608 - RNA, 64 nt, hsa; identical to SEQ ID NO: 131386

SEQ ID NO: 616609 - RNA, 64 nt, hsa; identical to SEQ ID NO: 131387

SEQ ID NO: 616610 - RNA, 64 nt, hsa; identical to SEQ ID NO: 131388

SEQ ID NO: 616611 - RNA, 64 nt, hsa
auuauuugcaaauaccauggaugauaugcugcuucuguuuaacagugaugcaacauuauguggc

SEQ ID NO: 616612 - RNA, 64 nt, hsa
gcauuuugcauuccauaugaaaaaaaugccacgucuguuuaaauuauuugauguagguuugggu

SEQ ID NO: 616613 - RNA, 64 nt, hsa
auauuucaucuguucuauagggaagccauuuugucuguuuaaaauuucaguuuaauuuugcuuu

SEQ ID NO: 616614 - RNA, 64 nt, hsa
uuugaacaguucuugucaauccgaauuguugauucuguuuaaaugaccaauacuuuuugaaauu

SEQ ID NO: 616615 - RNA, 64 nt, hsa
uggauuuauaaacuuguuuuuuuucuaggugacccuguuuaauaggcuuucacagacuggggaa

SEQ ID NO: 616616 - RNA, 64 nt, hsa
uacugaacuucauccuguuagauggagagcaugccuguuuaagggauuacugguccuacagcca

SEQ ID NO: 616617 - RNA, 64 nt, hsa
aaaaaaugcaguuuuauuauugcuugugccucaacuguuuaagugaauauuaaagggcuuggag

SEQ ID NO: 616618 - RNA, 64 nt, hsa
uccuucccuuucuguguagcagucuugaaauguucuguuuaaaucaguaggcuuaauguguucu

SEQ ID NO: 616619 - RNA, 64 nt, hsa
acacuuguacagccgaguucuucccgcauuacugcuguuuaauagaacgugauuagucaucgcc

SEQ ID NO: 616620 - RNA, 64 nt, hsa
agcccucucuaaauucacugucaucauuuaguaucuguuuaauuuuucaguccaaagagaggaa

SEQ ID NO: 616621 - RNA, 64 nt, hsa
uuuuuuuuuuuauauguauuaaaucaauuuaucacuguuuaaagcuuugaauaucugcaaucuu

SEQ ID NO: 616622 - RNA, 64 nt, hsa
ugauuauuuuucuccuggaaacuccagguccauucuguuuaaaucccuaagaaugucagaauua

SEQ ID NO: 616623 - RNA, 64 nt, hsa
ucucugguuucugaauuuaaaauguugggauuaccuguuuaaaucugucuugggggauguagag

SEQ ID NO: 616624 - RNA, 64 nt, hsa
uaguauuuuaacacuugucuucaacuugauuugucuguuuaauugaaaagaauuauaagaguua

SEQ ID NO: 616625 - RNA, 64 nt, hsa
gugcaauagguuccaauaugcauuuauuagacaucuguuuaaaugguaauguagcauuuauuuu

SEQ ID NO: 616626 - RNA, 64 nt, hsa
guguggaggugaucacgaagauacauguguuugacuguuuaauuugaaaguuuacauuuuuuau

SEQ ID NO: 616627 - RNA, 64 nt, hsa
acaaaaauuguuuauaucuuggaaaaaaaacuuucuguuuaaaaaaaauaaacaagugaauguu

SEQ ID NO: 616628 - RNA, 64 nt, hsa
gucuguuuccauuugaauuucuuauuguaaaaaucuguuuaaauccauuuauauuauuuuacag

SEQ ID NO: 616629 - RNA, 64 nt, hsa
cuuaagggaccacccuuuggucaaucauaacaugcuguuuaaagcagcuguuuacaggaugugu

SEQ ID NO: 616630 - RNA, 64 nt, hsa
acugagauuucaagucguacuauggaacaccuuucuguuuaauucccaaagugacaucuucuca

SEQ ID NO: 616631 - RNA, 64 nt, hsa
aaacgaaauacacacagaaaaaagucuuuccaaacuguuuaaguauuuaaacaucugagccaaa

SEQ ID NO: 616632 - RNA, 64 nt, hsa
uuuuuagcaauagaauuguuucaguauuuugcugcuguuuaaugcgcaucuucagaaaacuucc

SEQ ID NO: 616633 - RNA, 64 nt, hsa
aaccaaaggauauuuccagaaaggauuaagaaagcuguuuaagaaggccaugacucuuuaggug

SEQ ID NO: 616634 - RNA, 64 nt, hsa
uagagacuacacuaauuauuuuaacuguauacaucuguuuaauuugaacacacuacaucguagg

SEQ ID NO: 616635 - RNA, 64 nt, hsa
uguaaaguauaacuucagccacauuuuuagaacacuguuuaacauuuuugcaaaaccuucuugu

SEQ ID NO: 616636 - RNA, 64 nt, hsa
acuaauuguuaacuauucauggaacagcaaacgccuguuuaauaaagaacuuugaccaaggcua

SEQ ID NO: 616637 - RNA, 64 nt, hsa
aaugaaaaguagauauagauauugugaaaauaggcuguuuaacaaacagauuggaauaaagccu

SEQ ID NO: 616638 - RNA, 64 nt, hsa
uuaaagaucugaagugugaguagaauguauucagcuguuuaacauguaguuuagauauucaaaa

SEQ ID NO: 616639 - RNA, 64 nt, hsa
augacaaucaaaccaaaucaucaguuaucaaugucuguuuaauugugugacuaucugacuguug

SEQ ID NO: 616640 - RNA, 64 nt, hsa
ucauucuucugguauuuguaaugaagugaauccacuguuuaaucagauccauaaucuuuaacag

SEQ ID NO: 616641 - RNA, 64 nt, hsa
guaaugacaacauauucuuucauaaaacuauggccuguuuaagauggaacuuugugugugucug

SEQ ID NO: 616642 - RNA, 64 nt, hsa
cuacaauuuaugcaguuucuuugauaauauuuuucuguuuaaaucccugcuucuguuuuugguc

SEQ ID NO: 616643 - RNA, 64 nt, hsa
ggaguccuuuuugucaugcccuuaaguucagcaacuguuuaaccuguuuucagucuuauuuacg

SEQ ID NO: 616644 - RNA, 64 nt, hsa
cuggaccugguucuuagcccuugggcacugcacccuguuuaacauuucaccccacucuguacag

SEQ ID NO: 616645 - RNA, 64 nt, hsa
uacucaaguauuuaaauuuagagagaaugccgcucuguuuaaagcaauguguaaagaugaguuu

SEQ ID NO: 616646 - RNA, 64 nt, hsa
ucacauuaaaguuuauuauguauuuaaugauacacuguuuaauugacaguuuugcauaguuugu

SEQ ID NO: 616647 - RNA, 64 nt, hsa
gccuuuucauuacuuuguuaagaagaaaugccagcuguuuaaucacaccuaccccuggaaaaga

SEQ ID NO: 616648 - RNA, 64 nt, hsa
uagaauucugguuagcuaauugaacuuuugugaccuguuuaaaaacaaaucaaauuuauugaac

SEQ ID NO: 616649 - RNA, 64 nt, hsa
cacucugaugauaccaugguuaccccauugagcucuguuuaaauaaauauuguccuuucaugua

SEQ ID NO: 616650 - RNA, 64 nt, hsa
gauggcccacaacuggguccacauguaaugagcccuguuuaauaacgaaggggugggggagagc

SEQ ID NO: 616651 - RNA, 64 nt, hsa
uuuaacaagccagcuggcuuaugcugguucucagcuguuuaaaaaaaaaaaaaaaaaggaauag

SEQ ID NO: 616652 - RNA, 64 nt, hsa
agacugugaucugggaacuuuuugcuguacaaaucuguuuaaaaaaaaaaaaaaguaacucauu

SEQ ID NO: 616653 - RNA, 64 nt, hsa
aaugugagaaaaauauauccaguaauaguauugacuguuuaaaaaauugagcucaucaaaaaua

SEQ ID NO: 616654 - RNA, 64 nt, hsa
uucccuacaagcauggagaaaaugaagaauaggccuguuuaaugcuaaauuuuguuuucaugua

SEQ ID NO: 616655 - RNA, 64 nt, hsa
acuucuaugucuagucuuccauaggaaauccucacuguuuaaccaugugaggagccuaagucau

SEQ ID NO: 616656 - RNA, 64 nt, hsa
cuuuggucuaagaguucuaaaggaagguaggcaucuguuuaauuaguugguucacccuggcuuu

SEQ ID NO: 616657 - RNA, 64 nt, hsa; identical to SEQ ID NO: 127122

SEQ ID NO: 616658 - RNA, 64 nt, hsa; identical to SEQ ID NO: 127123

SEQ ID NO: 616659 - RNA, 64 nt, hsa; identical to SEQ ID NO: 127124

SEQ ID NO: 616660 - RNA, 64 nt, hsa; identical to SEQ ID NO: 127125

SEQ ID NO: 616661 - RNA, 64 nt, hsa; identical to SEQ ID NO: 127126

SEQ ID NO: 616662 - RNA, 64 nt, hsa; identical to SEQ ID NO: 127127

SEQ ID NO: 616663 - RNA, 64 nt, hsa; identical to SEQ ID NO: 127128

SEQ ID NO: 616664 - RNA, 64 nt, hsa; identical to SEQ ID NO: 127129

SEQ ID NO: 616665 - RNA, 64 nt, hsa; identical to SEQ ID NO: 127130

SEQ ID NO: 616666 - RNA, 64 nt, hsa; identical to SEQ ID NO: 127131

SEQ ID NO: 616667 - RNA, 64 nt, hsa; identical to SEQ ID NO: 127132

SEQ ID NO: 616668 - RNA, 64 nt, hsa; identical to SEQ ID NO: 127133

SEQ ID NO: 616669 - RNA, 64 nt, hsa; identical to SEQ ID NO: 127134

SEQ ID NO: 616670 - RNA, 64 nt, hsa; identical to SEQ ID NO: 127135

SEQ ID NO: 616671 - RNA, 64 nt, hsa; identical to SEQ ID NO: 127136

SEQ ID NO: 616672 - RNA, 64 nt, hsa; identical to SEQ ID NO: 127137

SEQ ID NO: 616673 - RNA, 64 nt, hsa; identical to SEQ ID NO: 127138

SEQ ID NO: 616674 - RNA, 64 nt, hsa; identical to SEQ ID NO: 127139

SEQ ID NO: 616675 - RNA, 64 nt, hsa; identical to SEQ ID NO: 127140

SEQ ID NO: 616676 - RNA, 64 nt, hsa; identical to SEQ ID NO: 127141

SEQ ID NO: 616677 - RNA, 64 nt, hsa; identical to SEQ ID NO: 127142

SEQ ID NO: 616678 - RNA, 64 nt, hsa; identical to SEQ ID NO: 127143

SEQ ID NO: 616679 - RNA, 64 nt, hsa; identical to SEQ ID NO: 127144

SEQ ID NO: 616680 - RNA, 64 nt, hsa; identical to SEQ ID NO: 127145

SEQ ID NO: 616681 - RNA, 64 nt, hsa; identical to SEQ ID NO: 127146

SEQ ID NO: 616682 - RNA, 64 nt, hsa; identical to SEQ ID NO: 127147

SEQ ID NO: 616683 - RNA, 64 nt, hsa; identical to SEQ ID NO: 127148

SEQ ID NO: 616684 - RNA, 64 nt, hsa; identical to SEQ ID NO: 127149

SEQ ID NO: 616685 - RNA, 64 nt, hsa; identical to SEQ ID NO: 127150

SEQ ID NO: 616686 - RNA, 64 nt, hsa; identical to SEQ ID NO: 127151

SEQ ID NO: 616687 - RNA, 64 nt, hsa; identical to SEQ ID NO: 127152

SEQ ID NO: 616688 - RNA, 64 nt, hsa; identical to SEQ ID NO: 127153

SEQ ID NO: 616689 - RNA, 64 nt, hsa; identical to SEQ ID NO: 127154

SEQ ID NO: 616690 - RNA, 64 nt, hsa; identical to SEQ ID NO: 127155

SEQ ID NO: 616691 - RNA, 64 nt, hsa; identical to SEQ ID NO: 127156

SEQ ID NO: 616692 - RNA, 64 nt, hsa; identical to SEQ ID NO: 127157

SEQ ID NO: 616693 - RNA, 64 nt, hsa; identical to SEQ ID NO: 127158

SEQ ID NO: 616694 - RNA, 64 nt, hsa; identical to SEQ ID NO: 127159

SEQ ID NO: 616695 - RNA, 64 nt, hsa; identical to SEQ ID NO: 127160

SEQ ID NO: 616696 - RNA, 64 nt, hsa; identical to SEQ ID NO: 127161

SEQ ID NO: 616697 - RNA, 64 nt, hsa; identical to SEQ ID NO: 127162

SEQ ID NO: 616698 - RNA, 64 nt, hsa; identical to SEQ ID NO: 127163

SEQ ID NO: 616699 - RNA, 64 nt, hsa; identical to SEQ ID NO: 127164

SEQ ID NO: 616700 - RNA, 64 nt, hsa; identical to SEQ ID NO: 127165

SEQ ID NO: 616701 - RNA, 64 nt, hsa; identical to SEQ ID NO: 127166

SEQ ID NO: 616702 - RNA, 64 nt, hsa; identical to SEQ ID NO: 127167

SEQ ID NO: 616703 - RNA, 64 nt, hsa; identical to SEQ ID NO: 127168

SEQ ID NO: 616704 - RNA, 64 nt, hsa; identical to SEQ ID NO: 127169

SEQ ID NO: 616705 - RNA, 64 nt, hsa; identical to SEQ ID NO: 127170

SEQ ID NO: 616706 - RNA, 64 nt, hsa; identical to SEQ ID NO: 127171

SEQ ID NO: 616707 - RNA, 64 nt, hsa; identical to SEQ ID NO: 127172

SEQ ID NO: 616708 - RNA, 64 nt, hsa; identical to SEQ ID NO: 127173

SEQ ID NO: 616709 - RNA, 64 nt, hsa; identical to SEQ ID NO: 127174

SEQ ID NO: 616710 - RNA, 64 nt, hsa; identical to SEQ ID NO: 127175

SEQ ID NO: 616711 - RNA, 64 nt, hsa; identical to SEQ ID NO: 127176

SEQ ID NO: 616712 - RNA, 64 nt, hsa; identical to SEQ ID NO: 127177

SEQ ID NO: 616713 - RNA, 64 nt, hsa; identical to SEQ ID NO: 127178

SEQ ID NO: 616714 - RNA, 64 nt, hsa; identical to SEQ ID NO: 127179

SEQ ID NO: 616715 - RNA, 64 nt, hsa; identical to SEQ ID NO: 127180

SEQ ID NO: 616716 - RNA, 64 nt, hsa; identical to SEQ ID NO: 127181

SEQ ID NO: 616717 - RNA, 64 nt, hsa; identical to SEQ ID NO: 127182

SEQ ID NO: 616718 - RNA, 64 nt, hsa; identical to SEQ ID NO: 127183

SEQ ID NO: 616719 - RNA, 64 nt, hsa; identical to SEQ ID NO: 127184

SEQ ID NO: 616720 - RNA, 64 nt, hsa; identical to SEQ ID NO: 127185

SEQ ID NO: 616721 - RNA, 64 nt, hsa; identical to SEQ ID NO: 127186

SEQ ID NO: 616722 - RNA, 64 nt, hsa; identical to SEQ ID NO: 127187

SEQ ID NO: 616723 - RNA, 64 nt, hsa; identical to SEQ ID NO: 127188

SEQ ID NO: 616724 - RNA, 64 nt, hsa; identical to SEQ ID NO: 127189

SEQ ID NO: 616725 - RNA, 64 nt, hsa; identical to SEQ ID NO: 127190

SEQ ID NO: 616726 - RNA, 64 nt, hsa; identical to SEQ ID NO: 127191

SEQ ID NO: 616727 - RNA, 64 nt, hsa; identical to SEQ ID NO: 127192

SEQ ID NO: 616728 - RNA, 64 nt, hsa; identical to SEQ ID NO: 127193

SEQ ID NO: 616729 - RNA, 64 nt, hsa; identical to SEQ ID NO: 127194

SEQ ID NO: 616730 - RNA, 64 nt, hsa; identical to SEQ ID NO: 127195

SEQ ID NO: 616731 - RNA, 64 nt, hsa; identical to SEQ ID NO: 127196

SEQ ID NO: 616732 - RNA, 64 nt, hsa; identical to SEQ ID NO: 127197

SEQ ID NO: 616733 - RNA, 64 nt, hsa; identical to SEQ ID NO: 127198

SEQ ID NO: 616734 - RNA, 64 nt, hsa; identical to SEQ ID NO: 127199

SEQ ID NO: 616735 - RNA, 64 nt, hsa; identical to SEQ ID NO: 127200

SEQ ID NO: 616736 - RNA, 64 nt, hsa; identical to SEQ ID NO: 127201

SEQ ID NO: 616737 - RNA, 64 nt, hsa; identical to SEQ ID NO: 127202

SEQ ID NO: 616738 - RNA, 64 nt, hsa; identical to SEQ ID NO: 127203

SEQ ID NO: 616739 - RNA, 64 nt, hsa; identical to SEQ ID NO: 127204

SEQ ID NO: 616740 - RNA, 64 nt, hsa; identical to SEQ ID NO: 127205

SEQ ID NO: 616741 - RNA, 64 nt, hsa; identical to SEQ ID NO: 127206

SEQ ID NO: 616742 - RNA, 64 nt, hsa; identical to SEQ ID NO: 127207

SEQ ID NO: 616743 - RNA, 64 nt, hsa; identical to SEQ ID NO: 127208

SEQ ID NO: 616744 - RNA, 64 nt, hsa; identical to SEQ ID NO: 127209

SEQ ID NO: 616745 - RNA, 64 nt, hsa; identical to SEQ ID NO: 127210

SEQ ID NO: 616746 - RNA, 64 nt, hsa; identical to SEQ ID NO: 127211

SEQ ID NO: 616747 - RNA, 64 nt, hsa; identical to SEQ ID NO: 127212

SEQ ID NO: 616748 - RNA, 64 nt, hsa; identical to SEQ ID NO: 127213

SEQ ID NO: 616749 - RNA, 64 nt, hsa; identical to SEQ ID NO: 127214

SEQ ID NO: 616750 - RNA, 64 nt, hsa; identical to SEQ ID NO: 127215

SEQ ID NO: 616751 - RNA, 64 nt, hsa; identical to SEQ ID NO: 127216

SEQ ID NO: 616752 - RNA, 64 nt, hsa; identical to SEQ ID NO: 127217

SEQ ID NO: 616753 - RNA, 64 nt, hsa; identical to SEQ ID NO: 127218

SEQ ID NO: 616754 - RNA, 64 nt, hsa; identical to SEQ ID NO: 127219

SEQ ID NO: 616755 - RNA, 64 nt, hsa; identical to SEQ ID NO: 127220

SEQ ID NO: 616756 - RNA, 64 nt, hsa; identical to SEQ ID NO: 127221

SEQ ID NO: 616757 - RNA, 64 nt, hsa; identical to SEQ ID NO: 127222

SEQ ID NO: 616758 - RNA, 64 nt, hsa; identical to SEQ ID NO: 127223

SEQ ID NO: 616759 - RNA, 64 nt, hsa; identical to SEQ ID NO: 127224

SEQ ID NO: 616760 - RNA, 64 nt, hsa; identical to SEQ ID NO: 127225

SEQ ID NO: 616761 - RNA, 64 nt, hsa; identical to SEQ ID NO: 127226

SEQ ID NO: 616762 - RNA, 64 nt, hsa; identical to SEQ ID NO: 127227

SEQ ID NO: 616763 - RNA, 64 nt, hsa; identical to SEQ ID NO: 127228

SEQ ID NO: 616764 - RNA, 64 nt, hsa; identical to SEQ ID NO: 127229

SEQ ID NO: 616765 - RNA, 64 nt, hsa; identical to SEQ ID NO: 127230

SEQ ID NO: 616766 - RNA, 64 nt, hsa; identical to SEQ ID NO: 127231

SEQ ID NO: 616767 - RNA, 64 nt, hsa; identical to SEQ ID NO: 127232

SEQ ID NO: 616768 - RNA, 64 nt, hsa; identical to SEQ ID NO: 127233

SEQ ID NO: 616769 - RNA, 64 nt, hsa; identical to SEQ ID NO: 127234

SEQ ID NO: 616770 - RNA, 64 nt, hsa; identical to SEQ ID NO: 127235

SEQ ID NO: 616771 - RNA, 64 nt, hsa; identical to SEQ ID NO: 127236

SEQ ID NO: 616772 - RNA, 64 nt, hsa; identical to SEQ ID NO: 127237

SEQ ID NO: 616773 - RNA, 64 nt, hsa; identical to SEQ ID NO: 127238

SEQ ID NO: 616774 - RNA, 64 nt, hsa; identical to SEQ ID NO: 127239

SEQ ID NO: 616775 - RNA, 64 nt, hsa; identical to SEQ ID NO: 127240

SEQ ID NO: 616776 - RNA, 64 nt, hsa; identical to SEQ ID NO: 127241

SEQ ID NO: 616777 - RNA, 64 nt, hsa; identical to SEQ ID NO: 127242

SEQ ID NO: 616778 - RNA, 64 nt, hsa; identical to SEQ ID NO: 127243

SEQ ID NO: 616779 - RNA, 64 nt, hsa; identical to SEQ ID NO: 127244

SEQ ID NO: 616780 - RNA, 64 nt, hsa; identical to SEQ ID NO: 127245

SEQ ID NO: 616781 - RNA, 64 nt, hsa; identical to SEQ ID NO: 127246

SEQ ID NO: 616782 - RNA, 64 nt, hsa; identical to SEQ ID NO: 127247

SEQ ID NO: 616783 - RNA, 64 nt, hsa; identical to SEQ ID NO: 127248

SEQ ID NO: 616784 - RNA, 64 nt, hsa; identical to SEQ ID NO: 127249

SEQ ID NO: 616785 - RNA, 64 nt, hsa; identical to SEQ ID NO: 127250

SEQ ID NO: 616786 - RNA, 64 nt, hsa; identical to SEQ ID NO: 127251

SEQ ID NO: 616787 - RNA, 64 nt, hsa; identical to SEQ ID NO: 127252

SEQ ID NO: 616788 - RNA, 64 nt, hsa; identical to SEQ ID NO: 127253

SEQ ID NO: 616789 - RNA, 64 nt, hsa; identical to SEQ ID NO: 127254

SEQ ID NO: 616790 - RNA, 64 nt, hsa; identical to SEQ ID NO: 127255

SEQ ID NO: 616791 - RNA, 64 nt, hsa; identical to SEQ ID NO: 127256

SEQ ID NO: 616792 - RNA, 64 nt, hsa; identical to SEQ ID NO: 127257

SEQ ID NO: 616793 - RNA, 64 nt, hsa; identical to SEQ ID NO: 127258

SEQ ID NO: 616794 - RNA, 64 nt, hsa; identical to SEQ ID NO: 127259

SEQ ID NO: 616795 - RNA, 64 nt, hsa; identical to SEQ ID NO: 127260

SEQ ID NO: 616796 - RNA, 64 nt, hsa; identical to SEQ ID NO: 127261

SEQ ID NO: 616797 - RNA, 64 nt, hsa; identical to SEQ ID NO: 127262

SEQ ID NO: 616798 - RNA, 64 nt, hsa; identical to SEQ ID NO: 127263

SEQ ID NO: 616799 - RNA, 64 nt, hsa; identical to SEQ ID NO: 127264

SEQ ID NO: 616800 - RNA, 64 nt, hsa; identical to SEQ ID NO: 127265

SEQ ID NO: 616801 - RNA, 64 nt, hsa; identical to SEQ ID NO: 127266

SEQ ID NO: 616802 - RNA, 64 nt, hsa; identical to SEQ ID NO: 127267

SEQ ID NO: 616803 - RNA, 64 nt, hsa; identical to SEQ ID NO: 127268

SEQ ID NO: 616804 - RNA, 64 nt, hsa; identical to SEQ ID NO: 127269

SEQ ID NO: 616805 - RNA, 64 nt, hsa; identical to SEQ ID NO: 127270

SEQ ID NO: 616806 - RNA, 64 nt, hsa; identical to SEQ ID NO: 127271

SEQ ID NO: 616807 - RNA, 64 nt, hsa; identical to SEQ ID NO: 127272

SEQ ID NO: 616808 - RNA, 64 nt, hsa; identical to SEQ ID NO: 127273

SEQ ID NO: 616809 - RNA, 64 nt, hsa; identical to SEQ ID NO: 127274

SEQ ID NO: 616810 - RNA, 64 nt, hsa; identical to SEQ ID NO: 127275

SEQ ID NO: 616811 - RNA, 64 nt, hsa; identical to SEQ ID NO: 127276

SEQ ID NO: 616812 - RNA, 64 nt, hsa; identical to SEQ ID NO: 127277

SEQ ID NO: 616813 - RNA, 64 nt, hsa; identical to SEQ ID NO: 127278

SEQ ID NO: 616814 - RNA, 64 nt, hsa; identical to SEQ ID NO: 127279

SEQ ID NO: 616815 - RNA, 64 nt, hsa; identical to SEQ ID NO: 127280

SEQ ID NO: 616816 - RNA, 64 nt, hsa; identical to SEQ ID NO: 127281

SEQ ID NO: 616817 - RNA, 64 nt, hsa; identical to SEQ ID NO: 127282

SEQ ID NO: 616818 - RNA, 64 nt, hsa; identical to SEQ ID NO: 127283

SEQ ID NO: 616819 - RNA, 64 nt, hsa; identical to SEQ ID NO: 127284

SEQ ID NO: 616820 - RNA, 64 nt, hsa; identical to SEQ ID NO: 127285

SEQ ID NO: 616821 - RNA, 64 nt, hsa; identical to SEQ ID NO: 127286

SEQ ID NO: 616822 - RNA, 64 nt, hsa; identical to SEQ ID NO: 127287

SEQ ID NO: 616823 - RNA, 64 nt, hsa; identical to SEQ ID NO: 127288

SEQ ID NO: 616824 - RNA, 64 nt, hsa; identical to SEQ ID NO: 127289

SEQ ID NO: 616825 - RNA, 64 nt, hsa; identical to SEQ ID NO: 127290

SEQ ID NO: 616826 - RNA, 64 nt, hsa; identical to SEQ ID NO: 127291

SEQ ID NO: 616827 - RNA, 64 nt, hsa; identical to SEQ ID NO: 127292

SEQ ID NO: 616828 - RNA, 64 nt, hsa; identical to SEQ ID NO: 127293

SEQ ID NO: 616829 - RNA, 64 nt, hsa; identical to SEQ ID NO: 127294

SEQ ID NO: 616830 - RNA, 64 nt, hsa; identical to SEQ ID NO: 127295

SEQ ID NO: 616831 - RNA, 64 nt, hsa; identical to SEQ ID NO: 127296

SEQ ID NO: 616832 - RNA, 64 nt, hsa; identical to SEQ ID NO: 127297

SEQ ID NO: 616833 - RNA, 64 nt, hsa; identical to SEQ ID NO: 127298

SEQ ID NO: 616834 - RNA, 64 nt, hsa; identical to SEQ ID NO: 127299

SEQ ID NO: 616835 - RNA, 64 nt, hsa; identical to SEQ ID NO: 127300

SEQ ID NO: 616836 - RNA, 64 nt, hsa; identical to SEQ ID NO: 127301

SEQ ID NO: 616837 - RNA, 64 nt, hsa; identical to SEQ ID NO: 127302

SEQ ID NO: 616838 - RNA, 64 nt, hsa; identical to SEQ ID NO: 127303

SEQ ID NO: 616839 - RNA, 64 nt, hsa; identical to SEQ ID NO: 127304

SEQ ID NO: 616840 - RNA, 64 nt, hsa; identical to SEQ ID NO: 127305

SEQ ID NO: 616841 - RNA, 64 nt, hsa; identical to SEQ ID NO: 127306

SEQ ID NO: 616842 - RNA, 64 nt, hsa; identical to SEQ ID NO: 127307

SEQ ID NO: 616843 - RNA, 64 nt, hsa; identical to SEQ ID NO: 127308

SEQ ID NO: 616844 - RNA, 64 nt, hsa; identical to SEQ ID NO: 127309

SEQ ID NO: 616845 - RNA, 64 nt, hsa; identical to SEQ ID NO: 127310

SEQ ID NO: 616846 - RNA, 64 nt, hsa; identical to SEQ ID NO: 127311

SEQ ID NO: 616847 - RNA, 64 nt, hsa; identical to SEQ ID NO: 127312

SEQ ID NO: 616848 - RNA, 64 nt, hsa; identical to SEQ ID NO: 127313

SEQ ID NO: 616849 - RNA, 64 nt, hsa; identical to SEQ ID NO: 127314

SEQ ID NO: 616850 - RNA, 64 nt, hsa; identical to SEQ ID NO: 127315

SEQ ID NO: 616851 - RNA, 64 nt, hsa; identical to SEQ ID NO: 127316

SEQ ID NO: 616852 - RNA, 64 nt, hsa; identical to SEQ ID NO: 127317

SEQ ID NO: 616853 - RNA, 64 nt, hsa; identical to SEQ ID NO: 127318

SEQ ID NO: 616854 - RNA, 64 nt, hsa; identical to SEQ ID NO: 127319

SEQ ID NO: 616855 - RNA, 64 nt, hsa; identical to SEQ ID NO: 127320

SEQ ID NO: 616856 - RNA, 64 nt, hsa; identical to SEQ ID NO: 127321

SEQ ID NO: 616857 - RNA, 64 nt, hsa; identical to SEQ ID NO: 127322

SEQ ID NO: 616858 - RNA, 64 nt, hsa; identical to SEQ ID NO: 127323

SEQ ID NO: 616859 - RNA, 64 nt, hsa; identical to SEQ ID NO: 127324

SEQ ID NO: 616860 - RNA, 64 nt, hsa; identical to SEQ ID NO: 127325

SEQ ID NO: 616861 - RNA, 64 nt, hsa; identical to SEQ ID NO: 127326

SEQ ID NO: 616862 - RNA, 64 nt, hsa; identical to SEQ ID NO: 127327

SEQ ID NO: 616863 - RNA, 63 nt, hsa; identical to SEQ ID NO: 127328

SEQ ID NO: 616864 - RNA, 64 nt, hsa; identical to SEQ ID NO: 127329

SEQ ID NO: 616865 - RNA, 64 nt, hsa; identical to SEQ ID NO: 127330

SEQ ID NO: 616866 - RNA, 64 nt, hsa; identical to SEQ ID NO: 127331

SEQ ID NO: 616867 - RNA, 64 nt, hsa; identical to SEQ ID NO: 127332

SEQ ID NO: 616868 - RNA, 64 nt, hsa; identical to SEQ ID NO: 127333

SEQ ID NO: 616869 - RNA, 64 nt, hsa; identical to SEQ ID NO: 127334

SEQ ID NO: 616870 - RNA, 64 nt, hsa; identical to SEQ ID NO: 127335

SEQ ID NO: 616871 - RNA, 64 nt, hsa; identical to SEQ ID NO: 127336

SEQ ID NO: 616872 - RNA, 64 nt, hsa; identical to SEQ ID NO: 127337

SEQ ID NO: 616873 - RNA, 64 nt, hsa; identical to SEQ ID NO: 127338

SEQ ID NO: 616874 - RNA, 64 nt, hsa; identical to SEQ ID NO: 127339

SEQ ID NO: 616875 - RNA, 64 nt, hsa; identical to SEQ ID NO: 127340

SEQ ID NO: 616876 - RNA, 64 nt, hsa; identical to SEQ ID NO: 127341

SEQ ID NO: 616877 - RNA, 64 nt, hsa; identical to SEQ ID NO: 127342

SEQ ID NO: 616878 - RNA, 64 nt, hsa; identical to SEQ ID NO: 127343

SEQ ID NO: 616879 - RNA, 64 nt, hsa; identical to SEQ ID NO: 127344

SEQ ID NO: 616880 - RNA, 64 nt, hsa; identical to SEQ ID NO: 127345

SEQ ID NO: 616881 - RNA, 64 nt, hsa; identical to SEQ ID NO: 127346

SEQ ID NO: 616882 - RNA, 64 nt, hsa; identical to SEQ ID NO: 127347

SEQ ID NO: 616883 - RNA, 64 nt, hsa; identical to SEQ ID NO: 127348

SEQ ID NO: 616884 - RNA, 64 nt, hsa; identical to SEQ ID NO: 127349

SEQ ID NO: 616885 - RNA, 64 nt, hsa; identical to SEQ ID NO: 127350

SEQ ID NO: 616886 - RNA, 64 nt, hsa; identical to SEQ ID NO: 127351

SEQ ID NO: 616887 - RNA, 64 nt, hsa; identical to SEQ ID NO: 127352

SEQ ID NO: 616888 - RNA, 64 nt, hsa; identical to SEQ ID NO: 127353

SEQ ID NO: 616889 - RNA, 64 nt, hsa; identical to SEQ ID NO: 127354

SEQ ID NO: 616890 - RNA, 64 nt, hsa; identical to SEQ ID NO: 127355

SEQ ID NO: 616891 - RNA, 64 nt, hsa; identical to SEQ ID NO: 127356

SEQ ID NO: 616892 - RNA, 64 nt, hsa; identical to SEQ ID NO: 127357

SEQ ID NO: 616893 - RNA, 64 nt, hsa; identical to SEQ ID NO: 127358

SEQ ID NO: 616894 - RNA, 64 nt, hsa; identical to SEQ ID NO: 127359

SEQ ID NO: 616895 - RNA, 64 nt, hsa; identical to SEQ ID NO: 127360

SEQ ID NO: 616896 - RNA, 64 nt, hsa; identical to SEQ ID NO: 127361

SEQ ID NO: 616897 - RNA, 64 nt, hsa; identical to SEQ ID NO: 127362

SEQ ID NO: 616898 - RNA, 64 nt, hsa; identical to SEQ ID NO: 127363

SEQ ID NO: 616899 - RNA, 64 nt, hsa; identical to SEQ ID NO: 127364

SEQ ID NO: 616900 - RNA, 64 nt, hsa; identical to SEQ ID NO: 127365

SEQ ID NO: 616901 - RNA, 64 nt, hsa; identical to SEQ ID NO: 127366

SEQ ID NO: 616902 - RNA, 64 nt, hsa; identical to SEQ ID NO: 127367

SEQ ID NO: 616903 - RNA, 64 nt, hsa; identical to SEQ ID NO: 127368

SEQ ID NO: 616904 - RNA, 64 nt, hsa; identical to SEQ ID NO: 127369

SEQ ID NO: 616905 - RNA, 64 nt, hsa; identical to SEQ ID NO: 127370

SEQ ID NO: 616906 - RNA, 64 nt, hsa; identical to SEQ ID NO: 318834

SEQ ID NO: 616907 - RNA, 64 nt, hsa; identical to SEQ ID NO: 318835

SEQ ID NO: 616908 - RNA, 62 nt, hsa; identical to SEQ ID NO: 318836

SEQ ID NO: 616909 - RNA, 64 nt, hsa; identical to SEQ ID NO: 318837

SEQ ID NO: 616910 - RNA, 64 nt, hsa; identical to SEQ ID NO: 318838

SEQ ID NO: 616911 - RNA, 64 nt, hsa; identical to SEQ ID NO: 318839

SEQ ID NO: 616912 - RNA, 64 nt, hsa; identical to SEQ ID NO: 318840

SEQ ID NO: 616913 - RNA, 64 nt, hsa; identical to SEQ ID NO: 318841

SEQ ID NO: 616914 - RNA, 64 nt, hsa; identical to SEQ ID NO: 318842

SEQ ID NO: 616915 - RNA, 64 nt, hsa; identical to SEQ ID NO: 318843

SEQ ID NO: 616916 - RNA, 64 nt, hsa; identical to SEQ ID NO: 318844

SEQ ID NO: 616917 - RNA, 64 nt, hsa; identical to SEQ ID NO: 318845

SEQ ID NO: 616918 - RNA, 64 nt, hsa; identical to SEQ ID NO: 318846

SEQ ID NO: 616919 - RNA, 64 nt, hsa; identical to SEQ ID NO: 318847

SEQ ID NO: 616920 - RNA, 64 nt, hsa; identical to SEQ ID NO: 318848

SEQ ID NO: 616921 - RNA, 64 nt, hsa; identical to SEQ ID NO: 318849

SEQ ID NO: 616922 - RNA, 64 nt, hsa; identical to SEQ ID NO: 318850

SEQ ID NO: 616923 - RNA, 64 nt, hsa; identical to SEQ ID NO: 318851

SEQ ID NO: 616924 - RNA, 64 nt, hsa; identical to SEQ ID NO: 318852

SEQ ID NO: 616925 - RNA, 64 nt, hsa; identical to SEQ ID NO: 318853

SEQ ID NO: 616926 - RNA, 64 nt, hsa; identical to SEQ ID NO: 318854

SEQ ID NO: 616927 - RNA, 64 nt, hsa; identical to SEQ ID NO: 318855

SEQ ID NO: 616928 - RNA, 64 nt, hsa; identical to SEQ ID NO: 318856

SEQ ID NO: 616929 - RNA, 64 nt, hsa; identical to SEQ ID NO: 318857

SEQ ID NO: 616930 - RNA, 64 nt, hsa; identical to SEQ ID NO: 318858

SEQ ID NO: 616931 - RNA, 64 nt, hsa; identical to SEQ ID NO: 318859

SEQ ID NO: 616932 - RNA, 64 nt, hsa; identical to SEQ ID NO: 318860

SEQ ID NO: 616933 - RNA, 64 nt, hsa; identical to SEQ ID NO: 318861

SEQ ID NO: 616934 - RNA, 64 nt, hsa; identical to SEQ ID NO: 318862

SEQ ID NO: 616935 - RNA, 64 nt, hsa; identical to SEQ ID NO: 318863

SEQ ID NO: 616936 - RNA, 64 nt, hsa; identical to SEQ ID NO: 318864

SEQ ID NO: 616937 - RNA, 64 nt, hsa; identical to SEQ ID NO: 318865

SEQ ID NO: 616938 - RNA, 64 nt, hsa; identical to SEQ ID NO: 318866

SEQ ID NO: 616939 - RNA, 64 nt, hsa; identical to SEQ ID NO: 318867

SEQ ID NO: 616940 - RNA, 64 nt, hsa; identical to SEQ ID NO: 318868

SEQ ID NO: 616941 - RNA, 64 nt, hsa; identical to SEQ ID NO: 318869

SEQ ID NO: 616942 - RNA, 64 nt, hsa; identical to SEQ ID NO: 318870

SEQ ID NO: 616943 - RNA, 64 nt, hsa; identical to SEQ ID NO: 318871

SEQ ID NO: 616944 - RNA, 64 nt, hsa; identical to SEQ ID NO: 318872

SEQ ID NO: 616945 - RNA, 64 nt, hsa; identical to SEQ ID NO: 318873

SEQ ID NO: 616946 - RNA, 64 nt, hsa; identical to SEQ ID NO: 318874

SEQ ID NO: 616947 - RNA, 64 nt, hsa; identical to SEQ ID NO: 318875

SEQ ID NO: 616948 - RNA, 64 nt, hsa; identical to SEQ ID NO: 318876

SEQ ID NO: 616949 - RNA, 64 nt, hsa; identical to SEQ ID NO: 318877

SEQ ID NO: 616950 - RNA, 64 nt, hsa; identical to SEQ ID NO: 318878

SEQ ID NO: 616951 - RNA, 64 nt, hsa; identical to SEQ ID NO: 318879

SEQ ID NO: 616952 - RNA, 64 nt, hsa; identical to SEQ ID NO: 318880

SEQ ID NO: 616953 - RNA, 64 nt, hsa; identical to SEQ ID NO: 318881

SEQ ID NO: 616954 - RNA, 64 nt, hsa; identical to SEQ ID NO: 318882

SEQ ID NO: 616955 - RNA, 64 nt, hsa; identical to SEQ ID NO: 318883

SEQ ID NO: 616956 - RNA, 64 nt, hsa; identical to SEQ ID NO: 318884

SEQ ID NO: 616957 - RNA, 64 nt, hsa; identical to SEQ ID NO: 318885

SEQ ID NO: 616958 - RNA, 64 nt, hsa; identical to SEQ ID NO: 318886

SEQ ID NO: 616959 - RNA, 64 nt, hsa; identical to SEQ ID NO: 318887

SEQ ID NO: 616960 - RNA, 64 nt, hsa; identical to SEQ ID NO: 318888

SEQ ID NO: 616961 - RNA, 64 nt, hsa; identical to SEQ ID NO: 318889

SEQ ID NO: 616962 - RNA, 64 nt, hsa; identical to SEQ ID NO: 318890

SEQ ID NO: 616963 - RNA, 64 nt, hsa; identical to SEQ ID NO: 318891

SEQ ID NO: 616964 - RNA, 64 nt, hsa; identical to SEQ ID NO: 318892

SEQ ID NO: 616965 - RNA, 64 nt, hsa; identical to SEQ ID NO: 318893

SEQ ID NO: 616966 - RNA, 64 nt, hsa; identical to SEQ ID NO: 318894

SEQ ID NO: 616967 - RNA, 64 nt, hsa; identical to SEQ ID NO: 318895

SEQ ID NO: 616968 - RNA, 64 nt, hsa; identical to SEQ ID NO: 318896

SEQ ID NO: 616969 - RNA, 64 nt, hsa; identical to SEQ ID NO: 318897

SEQ ID NO: 616970 - RNA, 64 nt, hsa; identical to SEQ ID NO: 318898

SEQ ID NO: 616971 - RNA, 64 nt, hsa; identical to SEQ ID NO: 318899

SEQ ID NO: 616972 - RNA, 64 nt, hsa; identical to SEQ ID NO: 318900

SEQ ID NO: 616973 - RNA, 64 nt, hsa; identical to SEQ ID NO: 318901

SEQ ID NO: 616974 - RNA, 64 nt, hsa; identical to SEQ ID NO: 318902

SEQ ID NO: 616975 - RNA, 64 nt, hsa; identical to SEQ ID NO: 318903

SEQ ID NO: 616976 - RNA, 64 nt, hsa; identical to SEQ ID NO: 318904

SEQ ID NO: 616977 - RNA, 64 nt, hsa; identical to SEQ ID NO: 318905

SEQ ID NO: 616978 - RNA, 64 nt, hsa; identical to SEQ ID NO: 318906

SEQ ID NO: 616979 - RNA, 64 nt, hsa; identical to SEQ ID NO: 318907

SEQ ID NO: 616980 - RNA, 64 nt, hsa; identical to SEQ ID NO: 318908

SEQ ID NO: 616981 - RNA, 64 nt, hsa; identical to SEQ ID NO: 318909

SEQ ID NO: 616982 - RNA, 64 nt, hsa; identical to SEQ ID NO: 318910

SEQ ID NO: 616983 - RNA, 64 nt, hsa; identical to SEQ ID NO: 318911

SEQ ID NO: 616984 - RNA, 64 nt, hsa; identical to SEQ ID NO: 318912

SEQ ID NO: 616985 - RNA, 64 nt, hsa; identical to SEQ ID NO: 318913

SEQ ID NO: 616986 - RNA, 64 nt, hsa; identical to SEQ ID NO: 318914

SEQ ID NO: 616987 - RNA, 64 nt, hsa; identical to SEQ ID NO: 318915

SEQ ID NO: 616988 - RNA, 64 nt, hsa; identical to SEQ ID NO: 318916

SEQ ID NO: 616989 - RNA, 58 nt, hsa; identical to SEQ ID NO: 318917

SEQ ID NO: 616990 - RNA, 64 nt, hsa; identical to SEQ ID NO: 318918

SEQ ID NO: 616991 - RNA, 64 nt, hsa; identical to SEQ ID NO: 318919

SEQ ID NO: 616992 - RNA, 64 nt, hsa; identical to SEQ ID NO: 318920

SEQ ID NO: 616993 - RNA, 64 nt, hsa
uuuucuccccauaucccaaggcgaagcgcugagauucuuccaucuaaaaaacccucgacccgaa

SEQ ID NO: 616994 - RNA, 64 nt, hsa
gucuguaaauaaauaauuuuagaacagccuuuuuuucuuccauaaacuacuauugugaucuauu

SEQ ID NO: 616995 - RNA, 64 nt, hsa
auccaguggggaaaaaaagguuaacaguaaaaauuucuuccacguaauucaauuucucacaaua

SEQ ID NO: 616996 - RNA, 64 nt, hsa
uuuugacauaaugaguaaugcagacauuuacauguucuuccagcuucaaucaguagaccugauu

SEQ ID NO: 616997 - RNA, 64 nt, hsa
cacagcaguggaaggcugcacacaggcacauuccuucuuccacaguggggcaccaaggauucug

SEQ ID NO: 616998 - RNA, 64 nt, hsa
uucaacugcugcugccaaaauugguuuucuaaaauucuuccaguagagacuaaaagaagauuca

SEQ ID NO: 616999 - RNA, 64 nt, hsa
aauuaacuuguuuucuucauccaaaaaaguuuauuucuuccacguacuuaaauuuucugugugg

SEQ ID NO: 617000 - RNA, 64 nt, hsa
uagguaauuaacugcuuguuuuaagugauuauauuucuuccacuguuuuugaaaaauaaucaaa

SEQ ID NO: 617001 - RNA, 64 nt, hsa
ggaacuuuaguaaguucuucucauuucauuauguuucuuccaaggaaacaggagagacugaauu

SEQ ID NO: 617002 - RNA, 64 nt, hsa
ucauggaaccagcugccugcagucaggccccagguucuuccaugggugaacagagcaucugaca

SEQ ID NO: 617003 - RNA, 64 nt, hsa
uagaggcuacagcacuuuacaagcaagguaugcuuucuuccagccccuaggcugugggcacugu

SEQ ID NO: 617004 - RNA, 64 nt, hsa
aaugcccguuaccugguuccuugccuggucugcuuucuuccaaguuugccuggggccuagcccu

SEQ ID NO: 617005 - RNA, 64 nt, hsa
uggcgaaguugcugcuccggcauucaguaccugcuucuuccagagaaauaaaguuaguuucuau

SEQ ID NO: 617006 - RNA, 64 nt, hsa
accggcacccggugggaccuccuaggacugggccuucuuccagggggccccuggcagcagcugg

SEQ ID NO: 617007 - RNA, 64 nt, hsa
auaccuucaagaaguuaacaaaaaaggaauggauuucuuccaugguaauagccaauacuuacuu

SEQ ID NO: 617008 - RNA, 64 nt, hsa
aauuuguccugagucuggagggguuaguucagaguucuuccacuguauguuugaagagaugacc

SEQ ID NO: 617009 - RNA, 64 nt, hsa
cuuaaauguaaguauuacaugacaugcauucuguuucuuccagaguucugucugccacacgaaa

SEQ ID NO: 617010 - RNA, 64 nt, hsa
uuguuggaagagaauguuuauacaaaaaaugaaauucuuccaacagcagagaaacucuaaaaag

SEQ ID NO: 617011 - RNA, 64 nt, hsa
aggaaaauuuaauucugucccuggccagcuauuguucuuccacuucguuuucugcugucccaag

SEQ ID NO: 617012 - RNA, 64 nt, hsa
auauuuguacccucaguggagcccuucuggucuuuucuuccacuucugcagaauuuccucuagc

SEQ ID NO: 617013 - RNA, 64 nt, hsa
cucagaggcaacaaguauuacaguugcuuguauauucuuccagagaucucugucuauacaagca

SEQ ID NO: 617014 - RNA, 64 nt, hsa
uguauuaaggagaaauaaugaacuaucuucuugauucuuccauugagaaaagcauaugaauccu

SEQ ID NO: 617015 - RNA, 64 nt, hsa
guggugguaaaugcuauucauuauuuucuuuucuuucuuccaagugcauguguguccuugucuu

SEQ ID NO: 617016 - RNA, 64 nt, hsa
aaauaaaaagcugcucucacugucagcucucauauucuuccagguuuugcacucuacauaaaau

SEQ ID NO: 617017 - RNA, 64 nt, hsa
ugggaugauguuuaccagcccaaaaccagucauguucuuccaaaagcuucucuuugauagaauu

SEQ ID NO: 617018 - RNA, 64 nt, hsa
cagagacaugguggucugcacaagccuggacaaguucuuccauauugaugguggagcaaccccu

SEQ ID NO: 617019 - RNA, 64 nt, hsa
uugcucauggcauacuuuucauguuuuaauuuuuuucuuccagcaaaauaaacacugaggcccu

SEQ ID NO: 617020 - RNA, 64 nt, hsa
cuguuuuuauguugacugcuuuauguugaauauuuucuuccacaacauguaugugcugcuuauu

SEQ ID NO: 617021 - RNA, 64 nt, hsa
uuuuucaugacugaagggaguuuuauguuauuauuucuuccauaguuuuguuuugguuuauuuu

SEQ ID NO: 617022 - RNA, 64 nt, hsa
ugcaugaugagauacaacuucugaaugcugcacauucuuccaaaaugauccuuagcacaaucua

SEQ ID NO: 617023 - RNA, 64 nt, hsa
cuccuggguuucauguucugugacauccugcuucuucuuccaaaugcaguucauugcagacacc

SEQ ID NO: 617024 - RNA, 64 nt, hsa
gugcugagaggcgagcuccuugaagaaggggcuguucuuccaggaggccuuauuuugaacugcc

SEQ ID NO: 617025 - RNA, 64 nt, hsa
cuaucuuaauauaguguggaauuuuauuguauuauucuuccauucuuaauacuguaccacauuc

SEQ ID NO: 617026 - RNA, 64 nt, hsa
ugcagguuuagaaaaaugguuuucauauucaccauucuuccaccucauugaauugcaugcugua

SEQ ID NO: 617027 - RNA, 64 nt, hsa
acaaaauugauaaucauauagcgaaggcauauuuuucuuccaagcucaagucaggauugugacu

SEQ ID NO: 617028 - RNA, 64 nt, hsa
agcucuuccagugggcaaagaggacgcccauaauuucuuccauugcuagcucaucugugggacc

SEQ ID NO: 617029 - RNA, 64 nt, hsa
auuucuccccaccacggaaccuuccaucuaagauuucuuccagggaaugccagcaaucaggcag

SEQ ID NO: 617030 - RNA, 64 nt, hsa
uggguguguguguauuuggguguguaaauguugguucuuccacuacuggauuuuguaaucuagg

SEQ ID NO: 617031 - RNA, 64 nt, hsa
uuaaaugucuacuuaguuaauuaguuagcugauauucuuccacaauuaauauauucaauuuccc

SEQ ID NO: 617032 - RNA, 64 nt, hsa
gggaaguguuagcuuccuuuccuucuuccaucccuucuuccaucuuuccagcugucaaauccaa

SEQ ID NO: 617033 - RNA, 64 nt, hsa
ccaguuugaugugggaaguguuagcuuccuuuccuucuuccaucccuucuuccaucuuuccagc

SEQ ID NO: 617034 - RNA, 64 nt, hsa
uagggaguugaaacuaucaacuguaaagcuccuuuucuuccacuuuaauuuaaaaguucauguc

SEQ ID NO: 617035 - RNA, 64 nt, hsa
gagagaaaauguucaucugugcagaggaugcauuuucuuccauuaauucuggaaaaaacguuca

SEQ ID NO: 617036 - RNA, 64 nt, hsa
ucuguacucacaaaagagaaucucauuuucuucuuucuuccauucccuuaaauucugaguacug

SEQ ID NO: 617037 - RNA, 64 nt, hsa
ggaaaacugcauuuucucuuccaaaaaggaaagguucuuccaggcgagaaaccuguggucuaga

SEQ ID NO: 617038 - RNA, 64 nt, hsa
caauguuaauauugcuuuaugaauuaacagucuguucuuccagaguccagagacauuguuaaua

SEQ ID NO: 617039 - RNA, 64 nt, hsa
ugaaagccugcaggacuggucguuuuuuuggcaauucuuccacgugggacuuguccacaagaau

SEQ ID NO: 617040 - RNA, 64 nt, hsa
acuaugaaugcaagcaauguggcaaagcuuucacuucuuccaguucuuuucaauaucaugaaag

SEQ ID NO: 617041 - RNA, 64 nt, hsa
ccuaucaauguaagcaaugugcaaaagccuuuauuucuuccacuucuuuucaauaucaugaaag

SEQ ID NO: 617042 - RNA, 64 nt, hsa
guuuucuuuugggggccuuccccuuuuacuccuuuucuuccagagaucaagagcuucucuugca

SEQ ID NO: 617043 - RNA, 64 nt, hsa
uuuucuuccagagaucaagagcuucucuugcaucuucuuccacugggcucuggauuaaucaauu

SEQ ID NO: 617044 - RNA, 64 nt, hsa
ccucuaccucuggccugccccuauuucugaaagcuucuuccagucccugaucuggcucauuccc

SEQ ID NO: 617045 - RNA, 64 nt, hsa
ucccaaguucuccuucagaaccuaguugcuuuuauucuuccagcuaccacuugggcacuucaca

SEQ ID NO: 617046 - RNA, 64 nt, hsa; identical to SEQ ID NO: 492153

SEQ ID NO: 617047 - RNA, 64 nt, hsa; identical to SEQ ID NO: 492154

SEQ ID NO: 617048 - RNA, 64 nt, hsa; identical to SEQ ID NO: 492155

SEQ ID NO: 617049 - RNA, 64 nt, hsa; identical to SEQ ID NO: 492156

SEQ ID NO: 617050 - RNA, 64 nt, hsa; identical to SEQ ID NO: 492157

SEQ ID NO: 617051 - RNA, 64 nt, hsa; identical to SEQ ID NO: 492158

SEQ ID NO: 617052 - RNA, 64 nt, hsa; identical to SEQ ID NO: 492159

SEQ ID NO: 617053 - RNA, 64 nt, hsa; identical to SEQ ID NO: 492160

SEQ ID NO: 617054 - RNA, 64 nt, hsa; identical to SEQ ID NO: 492161

SEQ ID NO: 617055 - RNA, 64 nt, hsa; identical to SEQ ID NO: 492162

SEQ ID NO: 617056 - RNA, 64 nt, hsa; identical to SEQ ID NO: 492163

SEQ ID NO: 617057 - RNA, 64 nt, hsa; identical to SEQ ID NO: 492164

SEQ ID NO: 617058 - RNA, 64 nt, hsa; identical to SEQ ID NO: 492165

SEQ ID NO: 617059 - RNA, 64 nt, hsa; identical to SEQ ID NO: 492166

SEQ ID NO: 617060 - RNA, 64 nt, hsa; identical to SEQ ID NO: 492167

SEQ ID NO: 617061 - RNA, 64 nt, hsa; identical to SEQ ID NO: 492168

SEQ ID NO: 617062 - RNA, 64 nt, hsa; identical to SEQ ID NO: 492169

SEQ ID NO: 617063 - RNA, 64 nt, hsa; identical to SEQ ID NO: 492170

SEQ ID NO: 617064 - RNA, 64 nt, hsa; identical to SEQ ID NO: 492171

SEQ ID NO: 617065 - RNA, 64 nt, hsa; identical to SEQ ID NO: 492172

SEQ ID NO: 617066 - RNA, 64 nt, hsa; identical to SEQ ID NO: 492173

SEQ ID NO: 617067 - RNA, 64 nt, hsa; identical to SEQ ID NO: 492174

SEQ ID NO: 617068 - RNA, 64 nt, hsa; identical to SEQ ID NO: 492175

SEQ ID NO: 617069 - RNA, 64 nt, hsa; identical to SEQ ID NO: 492176

SEQ ID NO: 617070 - RNA, 64 nt, hsa; identical to SEQ ID NO: 492177

SEQ ID NO: 617071 - RNA, 64 nt, hsa; identical to SEQ ID NO: 492178

SEQ ID NO: 617072 - RNA, 64 nt, hsa; identical to SEQ ID NO: 492179

SEQ ID NO: 617073 - RNA, 64 nt, hsa; identical to SEQ ID NO: 492180

SEQ ID NO: 617074 - RNA, 64 nt, hsa; identical to SEQ ID NO: 492181

SEQ ID NO: 617075 - RNA, 64 nt, hsa; identical to SEQ ID NO: 492182

SEQ ID NO: 617076 - RNA, 64 nt, hsa; identical to SEQ ID NO: 492183

SEQ ID NO: 617077 - RNA, 64 nt, hsa; identical to SEQ ID NO: 492184

SEQ ID NO: 617078 - RNA, 64 nt, hsa; identical to SEQ ID NO: 492185

SEQ ID NO: 617079 - RNA, 64 nt, hsa; identical to SEQ ID NO: 492186

SEQ ID NO: 617080 - RNA, 64 nt, hsa; identical to SEQ ID NO: 492187

SEQ ID NO: 617081 - RNA, 64 nt, hsa; identical to SEQ ID NO: 492188

SEQ ID NO: 617082 - RNA, 64 nt, hsa; identical to SEQ ID NO: 492189

SEQ ID NO: 617083 - RNA, 64 nt, hsa; identical to SEQ ID NO: 492190

SEQ ID NO: 617084 - RNA, 64 nt, hsa; identical to SEQ ID NO: 492191

SEQ ID NO: 617085 - RNA, 64 nt, hsa; identical to SEQ ID NO: 492192

SEQ ID NO: 617086 - RNA, 64 nt, hsa; identical to SEQ ID NO: 492193

SEQ ID NO: 617087 - RNA, 64 nt, hsa; identical to SEQ ID NO: 492194

SEQ ID NO: 617088 - RNA, 64 nt, hsa; identical to SEQ ID NO: 492195

SEQ ID NO: 617089 - RNA, 64 nt, hsa; identical to SEQ ID NO: 492196

SEQ ID NO: 617090 - RNA, 64 nt, hsa; identical to SEQ ID NO: 492197

SEQ ID NO: 617091 - RNA, 64 nt, hsa; identical to SEQ ID NO: 492198

SEQ ID NO: 617092 - RNA, 64 nt, hsa; identical to SEQ ID NO: 492199

SEQ ID NO: 617093 - RNA, 64 nt, hsa; identical to SEQ ID NO: 492200

SEQ ID NO: 617094 - RNA, 64 nt, hsa; identical to SEQ ID NO: 492201

SEQ ID NO: 617095 - RNA, 64 nt, hsa; identical to SEQ ID NO: 492202

SEQ ID NO: 617096 - RNA, 64 nt, hsa; identical to SEQ ID NO: 492203

SEQ ID NO: 617097 - RNA, 64 nt, hsa; identical to SEQ ID NO: 492204

SEQ ID NO: 617098 - RNA, 64 nt, hsa; identical to SEQ ID NO: 492205

SEQ ID NO: 617099 - RNA, 64 nt, hsa; identical to SEQ ID NO: 492206

SEQ ID NO: 617100 - RNA, 64 nt, hsa; identical to SEQ ID NO: 492207

SEQ ID NO: 617101 - RNA, 64 nt, hsa; identical to SEQ ID NO: 492208

SEQ ID NO: 617102 - RNA, 64 nt, hsa; identical to SEQ ID NO: 492209

SEQ ID NO: 617103 - RNA, 64 nt, hsa; identical to SEQ ID NO: 492210

SEQ ID NO: 617104 - RNA, 64 nt, hsa; identical to SEQ ID NO: 80933

SEQ ID NO: 617105 - RNA, 64 nt, hsa; identical to SEQ ID NO: 80934

SEQ ID NO: 617106 - RNA, 64 nt, hsa; identical to SEQ ID NO: 80935

SEQ ID NO: 617107 - RNA, 64 nt, hsa; identical to SEQ ID NO: 80936

SEQ ID NO: 617108 - RNA, 64 nt, hsa; identical to SEQ ID NO: 80937

SEQ ID NO: 617109 - RNA, 64 nt, hsa; identical to SEQ ID NO: 80938

SEQ ID NO: 617110 - RNA, 64 nt, hsa; identical to SEQ ID NO: 80939

SEQ ID NO: 617111 - RNA, 64 nt, hsa; identical to SEQ ID NO: 80940

SEQ ID NO: 617112 - RNA, 64 nt, hsa; identical to SEQ ID NO: 80941

SEQ ID NO: 617113 - RNA, 64 nt, hsa; identical to SEQ ID NO: 80942

SEQ ID NO: 617114 - RNA, 64 nt, hsa; identical to SEQ ID NO: 80943

SEQ ID NO: 617115 - RNA, 64 nt, hsa; identical to SEQ ID NO: 80944

SEQ ID NO: 617116 - RNA, 64 nt, hsa; identical to SEQ ID NO: 80945

SEQ ID NO: 617117 - RNA, 64 nt, hsa; identical to SEQ ID NO: 80946

SEQ ID NO: 617118 - RNA, 64 nt, hsa; identical to SEQ ID NO: 80947

SEQ ID NO: 617119 - RNA, 64 nt, hsa; identical to SEQ ID NO: 80948

SEQ ID NO: 617120 - RNA, 64 nt, hsa; identical to SEQ ID NO: 80949

SEQ ID NO: 617121 - RNA, 64 nt, hsa; identical to SEQ ID NO: 80950

SEQ ID NO: 617122 - RNA, 64 nt, hsa; identical to SEQ ID NO: 80951

SEQ ID NO: 617123 - RNA, 64 nt, hsa; identical to SEQ ID NO: 80952

SEQ ID NO: 617124 - RNA, 64 nt, hsa; identical to SEQ ID NO: 80953

SEQ ID NO: 617125 - RNA, 64 nt, hsa; identical to SEQ ID NO: 80954

SEQ ID NO: 617126 - RNA, 63 nt, hsa; identical to SEQ ID NO: 80955

SEQ ID NO: 617127 - RNA, 64 nt, hsa; identical to SEQ ID NO: 80956

SEQ ID NO: 617128 - RNA, 64 nt, hsa; identical to SEQ ID NO: 80957

SEQ ID NO: 617129 - RNA, 64 nt, hsa; identical to SEQ ID NO: 80958

SEQ ID NO: 617130 - RNA, 64 nt, hsa; identical to SEQ ID NO: 80959

SEQ ID NO: 617131 - RNA, 64 nt, hsa; identical to SEQ ID NO: 80960

SEQ ID NO: 617132 - RNA, 64 nt, hsa; identical to SEQ ID NO: 80961

SEQ ID NO: 617133 - RNA, 64 nt, hsa; identical to SEQ ID NO: 80962

SEQ ID NO: 617134 - RNA, 64 nt, hsa; identical to SEQ ID NO: 80963

SEQ ID NO: 617135 - RNA, 64 nt, hsa; identical to SEQ ID NO: 80964

SEQ ID NO: 617136 - RNA, 64 nt, hsa; identical to SEQ ID NO: 80965

SEQ ID NO: 617137 - RNA, 64 nt, hsa; identical to SEQ ID NO: 80966

SEQ ID NO: 617138 - RNA, 64 nt, hsa; identical to SEQ ID NO: 80967

SEQ ID NO: 617139 - RNA, 64 nt, hsa; identical to SEQ ID NO: 80968

SEQ ID NO: 617140 - RNA, 64 nt, hsa; identical to SEQ ID NO: 80969

SEQ ID NO: 617141 - RNA, 64 nt, hsa; identical to SEQ ID NO: 80970

SEQ ID NO: 617142 - RNA, 64 nt, hsa; identical to SEQ ID NO: 80971

SEQ ID NO: 617143 - RNA, 64 nt, hsa; identical to SEQ ID NO: 80972

SEQ ID NO: 617144 - RNA, 64 nt, hsa; identical to SEQ ID NO: 80973

SEQ ID NO: 617145 - RNA, 64 nt, hsa; identical to SEQ ID NO: 80974

SEQ ID NO: 617146 - RNA, 64 nt, hsa; identical to SEQ ID NO: 80975

SEQ ID NO: 617147 - RNA, 64 nt, hsa; identical to SEQ ID NO: 80976

SEQ ID NO: 617148 - RNA, 64 nt, hsa; identical to SEQ ID NO: 80977

SEQ ID NO: 617149 - RNA, 64 nt, hsa; identical to SEQ ID NO: 80978

SEQ ID NO: 617150 - RNA, 64 nt, hsa; identical to SEQ ID NO: 80979

SEQ ID NO: 617151 - RNA, 64 nt, hsa; identical to SEQ ID NO: 80980

SEQ ID NO: 617152 - RNA, 64 nt, hsa; identical to SEQ ID NO: 80981

SEQ ID NO: 617153 - RNA, 64 nt, hsa; identical to SEQ ID NO: 80982

SEQ ID NO: 617154 - RNA, 64 nt, hsa; identical to SEQ ID NO: 80983

SEQ ID NO: 617155 - RNA, 64 nt, hsa; identical to SEQ ID NO: 80984

SEQ ID NO: 617156 - RNA, 64 nt, hsa; identical to SEQ ID NO: 80985

SEQ ID NO: 617157 - RNA, 64 nt, hsa; identical to SEQ ID NO: 80986

SEQ ID NO: 617158 - RNA, 64 nt, hsa; identical to SEQ ID NO: 80987

SEQ ID NO: 617159 - RNA, 64 nt, hsa; identical to SEQ ID NO: 80988

SEQ ID NO: 617160 - RNA, 64 nt, hsa; identical to SEQ ID NO: 80989

SEQ ID NO: 617161 - RNA, 64 nt, hsa; identical to SEQ ID NO: 80990

SEQ ID NO: 617162 - RNA, 64 nt, hsa; identical to SEQ ID NO: 80991

SEQ ID NO: 617163 - RNA, 64 nt, hsa; identical to SEQ ID NO: 80992

SEQ ID NO: 617164 - RNA, 64 nt, hsa; identical to SEQ ID NO: 80993

SEQ ID NO: 617165 - RNA, 64 nt, hsa; identical to SEQ ID NO: 80994

SEQ ID NO: 617166 - RNA, 64 nt, hsa; identical to SEQ ID NO: 80995

SEQ ID NO: 617167 - RNA, 64 nt, hsa; identical to SEQ ID NO: 80996

SEQ ID NO: 617168 - RNA, 64 nt, hsa; identical to SEQ ID NO: 80997

SEQ ID NO: 617169 - RNA, 64 nt, hsa; identical to SEQ ID NO: 80998

SEQ ID NO: 617170 - RNA, 64 nt, hsa; identical to SEQ ID NO: 80999

SEQ ID NO: 617171 - RNA, 64 nt, hsa; identical to SEQ ID NO: 81000

SEQ ID NO: 617172 - RNA, 64 nt, hsa; identical to SEQ ID NO: 81001

SEQ ID NO: 617173 - RNA, 64 nt, hsa; identical to SEQ ID NO: 81002

SEQ ID NO: 617174 - RNA, 64 nt, hsa; identical to SEQ ID NO: 81003

SEQ ID NO: 617175 - RNA, 64 nt, hsa; identical to SEQ ID NO: 81004

SEQ ID NO: 617176 - RNA, 64 nt, hsa; identical to SEQ ID NO: 81005

SEQ ID NO: 617177 - RNA, 64 nt, hsa; identical to SEQ ID NO: 81006

SEQ ID NO: 617178 - RNA, 64 nt, hsa; identical to SEQ ID NO: 81007

SEQ ID NO: 617179 - RNA, 64 nt, hsa; identical to SEQ ID NO: 81008

SEQ ID NO: 617180 - RNA, 64 nt, hsa; identical to SEQ ID NO: 81009

SEQ ID NO: 617181 - RNA, 64 nt, hsa; identical to SEQ ID NO: 81010

SEQ ID NO: 617182 - RNA, 64 nt, hsa; identical to SEQ ID NO: 81011

SEQ ID NO: 617183 - RNA, 64 nt, hsa; identical to SEQ ID NO: 81012

SEQ ID NO: 617184 - RNA, 64 nt, hsa; identical to SEQ ID NO: 81013

SEQ ID NO: 617185 - RNA, 64 nt, hsa; identical to SEQ ID NO: 81014

SEQ ID NO: 617186 - RNA, 64 nt, hsa; identical to SEQ ID NO: 81015

SEQ ID NO: 617187 - RNA, 64 nt, hsa; identical to SEQ ID NO: 81016

SEQ ID NO: 617188 - RNA, 64 nt, hsa; identical to SEQ ID NO: 81017

SEQ ID NO: 617189 - RNA, 64 nt, hsa; identical to SEQ ID NO: 81018

SEQ ID NO: 617190 - RNA, 64 nt, hsa; identical to SEQ ID NO: 81019

SEQ ID NO: 617191 - RNA, 64 nt, hsa; identical to SEQ ID NO: 81020

SEQ ID NO: 617192 - RNA, 64 nt, hsa; identical to SEQ ID NO: 81021

SEQ ID NO: 617193 - RNA, 64 nt, hsa; identical to SEQ ID NO: 81022

SEQ ID NO: 617194 - RNA, 64 nt, hsa; identical to SEQ ID NO: 81023

SEQ ID NO: 617195 - RNA, 64 nt, hsa; identical to SEQ ID NO: 81024

SEQ ID NO: 617196 - RNA, 64 nt, hsa; identical to SEQ ID NO: 81025

SEQ ID NO: 617197 - RNA, 64 nt, hsa; identical to SEQ ID NO: 81026

SEQ ID NO: 617198 - RNA, 64 nt, hsa; identical to SEQ ID NO: 81027

SEQ ID NO: 617199 - RNA, 64 nt, hsa; identical to SEQ ID NO: 81028

SEQ ID NO: 617200 - RNA, 64 nt, hsa; identical to SEQ ID NO: 81029

SEQ ID NO: 617201 - RNA, 64 nt, hsa; identical to SEQ ID NO: 81030

SEQ ID NO: 617202 - RNA, 64 nt, hsa; identical to SEQ ID NO: 81031

SEQ ID NO: 617203 - RNA, 64 nt, hsa; identical to SEQ ID NO: 81032

SEQ ID NO: 617204 - RNA, 64 nt, hsa; identical to SEQ ID NO: 81033

SEQ ID NO: 617205 - RNA, 64 nt, hsa; identical to SEQ ID NO: 81034

SEQ ID NO: 617206 - RNA, 64 nt, hsa; identical to SEQ ID NO: 81035

SEQ ID NO: 617207 - RNA, 64 nt, hsa; identical to SEQ ID NO: 81036

SEQ ID NO: 617208 - RNA, 64 nt, hsa; identical to SEQ ID NO: 81037

SEQ ID NO: 617209 - RNA, 64 nt, hsa; identical to SEQ ID NO: 81038

SEQ ID NO: 617210 - RNA, 64 nt, hsa; identical to SEQ ID NO: 81039

SEQ ID NO: 617211 - RNA, 64 nt, hsa; identical to SEQ ID NO: 81040

SEQ ID NO: 617212 - RNA, 64 nt, hsa; identical to SEQ ID NO: 81041

SEQ ID NO: 617213 - RNA, 64 nt, hsa; identical to SEQ ID NO: 81042

SEQ ID NO: 617214 - RNA, 64 nt, hsa; identical to SEQ ID NO: 358626

SEQ ID NO: 617215 - RNA, 64 nt, hsa; identical to SEQ ID NO: 358627

SEQ ID NO: 617216 - RNA, 64 nt, hsa; identical to SEQ ID NO: 358628

SEQ ID NO: 617217 - RNA, 64 nt, hsa; identical to SEQ ID NO: 358629

SEQ ID NO: 617218 - RNA, 64 nt, hsa; identical to SEQ ID NO: 290755

SEQ ID NO: 617219 - RNA, 64 nt, hsa; identical to SEQ ID NO: 290756

SEQ ID NO: 617220 - RNA, 64 nt, hsa; identical to SEQ ID NO: 21574

SEQ ID NO: 617221 - RNA, 64 nt, hsa; identical to SEQ ID NO: 21575

SEQ ID NO: 617222 - RNA, 64 nt, hsa; identical to SEQ ID NO: 21576

SEQ ID NO: 617223 - RNA, 64 nt, hsa; identical to SEQ ID NO: 21577

SEQ ID NO: 617224 - RNA, 64 nt, hsa; identical to SEQ ID NO: 21578

SEQ ID NO: 617225 - RNA, 64 nt, hsa; identical to SEQ ID NO: 21579

SEQ ID NO: 617226 - RNA, 64 nt, hsa; identical to SEQ ID NO: 21580

SEQ ID NO: 617227 - RNA, 64 nt, hsa; identical to SEQ ID NO: 21581

SEQ ID NO: 617228 - RNA, 64 nt, hsa; identical to SEQ ID NO: 21582

SEQ ID NO: 617229 - RNA, 64 nt, hsa; identical to SEQ ID NO: 21583

SEQ ID NO: 617230 - RNA, 64 nt, hsa; identical to SEQ ID NO: 21584

SEQ ID NO: 617231 - RNA, 64 nt, hsa; identical to SEQ ID NO: 21585

SEQ ID NO: 617232 - RNA, 64 nt, hsa; identical to SEQ ID NO: 21586

SEQ ID NO: 617233 - RNA, 64 nt, hsa; identical to SEQ ID NO: 21587

SEQ ID NO: 617234 - RNA, 64 nt, hsa; identical to SEQ ID NO: 21588

SEQ ID NO: 617235 - RNA, 64 nt, hsa; identical to SEQ ID NO: 21589

SEQ ID NO: 617236 - RNA, 64 nt, hsa; identical to SEQ ID NO: 21590

SEQ ID NO: 617237 - RNA, 64 nt, hsa; identical to SEQ ID NO: 21591

SEQ ID NO: 617238 - RNA, 64 nt, hsa; identical to SEQ ID NO: 21592

SEQ ID NO: 617239 - RNA, 64 nt, hsa; identical to SEQ ID NO: 21593

SEQ ID NO: 617240 - RNA, 64 nt, hsa; identical to SEQ ID NO: 21594

SEQ ID NO: 617241 - RNA, 64 nt, hsa; identical to SEQ ID NO: 21595

SEQ ID NO: 617242 - RNA, 64 nt, hsa; identical to SEQ ID NO: 21596

SEQ ID NO: 617243 - RNA, 64 nt, hsa; identical to SEQ ID NO: 21597

SEQ ID NO: 617244 - RNA, 64 nt, hsa; identical to SEQ ID NO: 21598

SEQ ID NO: 617245 - RNA, 64 nt, hsa; identical to SEQ ID NO: 21599

SEQ ID NO: 617246 - RNA, 64 nt, hsa; identical to SEQ ID NO: 21600

SEQ ID NO: 617247 - RNA, 64 nt, hsa; identical to SEQ ID NO: 21601

SEQ ID NO: 617248 - RNA, 64 nt, hsa; identical to SEQ ID NO: 21602

SEQ ID NO: 617249 - RNA, 64 nt, hsa; identical to SEQ ID NO: 21603

SEQ ID NO: 617250 - RNA, 64 nt, hsa; identical to SEQ ID NO: 21604

SEQ ID NO: 617251 - RNA, 64 nt, hsa; identical to SEQ ID NO: 21605

SEQ ID NO: 617252 - RNA, 64 nt, hsa; identical to SEQ ID NO: 21606

SEQ ID NO: 617253 - RNA, 64 nt, hsa; identical to SEQ ID NO: 21607

SEQ ID NO: 617254 - RNA, 64 nt, hsa; identical to SEQ ID NO: 21608

SEQ ID NO: 617255 - RNA, 64 nt, hsa; identical to SEQ ID NO: 21609

SEQ ID NO: 617256 - RNA, 64 nt, hsa; identical to SEQ ID NO: 21610

SEQ ID NO: 617257 - RNA, 64 nt, hsa; identical to SEQ ID NO: 21611

SEQ ID NO: 617258 - RNA, 64 nt, hsa; identical to SEQ ID NO: 21612

SEQ ID NO: 617259 - RNA, 64 nt, hsa; identical to SEQ ID NO: 21613

SEQ ID NO: 617260 - RNA, 64 nt, hsa; identical to SEQ ID NO: 21614

SEQ ID NO: 617261 - RNA, 64 nt, hsa; identical to SEQ ID NO: 21615

SEQ ID NO: 617262 - RNA, 64 nt, hsa; identical to SEQ ID NO: 21616

SEQ ID NO: 617263 - RNA, 64 nt, hsa; identical to SEQ ID NO: 21617

SEQ ID NO: 617264 - RNA, 64 nt, hsa; identical to SEQ ID NO: 21618

SEQ ID NO: 617265 - RNA, 64 nt, hsa; identical to SEQ ID NO: 21619

SEQ ID NO: 617266 - RNA, 64 nt, hsa; identical to SEQ ID NO: 21620

SEQ ID NO: 617267 - RNA, 64 nt, hsa; identical to SEQ ID NO: 21621

SEQ ID NO: 617268 - RNA, 64 nt, hsa; identical to SEQ ID NO: 21622

SEQ ID NO: 617269 - RNA, 64 nt, hsa; identical to SEQ ID NO: 21623

SEQ ID NO: 617270 - RNA, 64 nt, hsa; identical to SEQ ID NO: 21624

SEQ ID NO: 617271 - RNA, 64 nt, hsa; identical to SEQ ID NO: 21625

SEQ ID NO: 617272 - RNA, 64 nt, hsa; identical to SEQ ID NO: 21626

SEQ ID NO: 617273 - RNA, 64 nt, hsa; identical to SEQ ID NO: 21627

SEQ ID NO: 617274 - RNA, 64 nt, hsa; identical to SEQ ID NO: 21628

SEQ ID NO: 617275 - RNA, 64 nt, hsa; identical to SEQ ID NO: 21629

SEQ ID NO: 617276 - RNA, 64 nt, hsa; identical to SEQ ID NO: 21630

SEQ ID NO: 617277 - RNA, 57 nt, hsa; identical to SEQ ID NO: 21631

SEQ ID NO: 617278 - RNA, 64 nt, hsa; identical to SEQ ID NO: 21632

SEQ ID NO: 617279 - RNA, 64 nt, hsa; identical to SEQ ID NO: 21633

SEQ ID NO: 617280 - RNA, 64 nt, hsa; identical to SEQ ID NO: 21634

SEQ ID NO: 617281 - RNA, 64 nt, hsa; identical to SEQ ID NO: 21635

SEQ ID NO: 617282 - RNA, 64 nt, hsa; identical to SEQ ID NO: 21636

SEQ ID NO: 617283 - RNA, 64 nt, hsa; identical to SEQ ID NO: 21637

SEQ ID NO: 617284 - RNA, 64 nt, hsa; identical to SEQ ID NO: 21638

SEQ ID NO: 617285 - RNA, 64 nt, hsa; identical to SEQ ID NO: 21639

SEQ ID NO: 617286 - RNA, 64 nt, hsa; identical to SEQ ID NO: 21640

SEQ ID NO: 617287 - RNA, 64 nt, hsa; identical to SEQ ID NO: 21641

SEQ ID NO: 617288 - RNA, 64 nt, hsa; identical to SEQ ID NO: 21642

SEQ ID NO: 617289 - RNA, 64 nt, hsa; identical to SEQ ID NO: 21643

SEQ ID NO: 617290 - RNA, 64 nt, hsa; identical to SEQ ID NO: 21644

SEQ ID NO: 617291 - RNA, 64 nt, hsa; identical to SEQ ID NO: 21645

SEQ ID NO: 617292 - RNA, 64 nt, hsa; identical to SEQ ID NO: 21646

SEQ ID NO: 617293 - RNA, 64 nt, hsa; identical to SEQ ID NO: 21647

SEQ ID NO: 617294 - RNA, 64 nt, hsa; identical to SEQ ID NO: 21648

SEQ ID NO: 617295 - RNA, 64 nt, hsa; identical to SEQ ID NO: 21649

SEQ ID NO: 617296 - RNA, 64 nt, hsa; identical to SEQ ID NO: 21650

SEQ ID NO: 617297 - RNA, 64 nt, hsa; identical to SEQ ID NO: 21651

SEQ ID NO: 617298 - RNA, 64 nt, hsa; identical to SEQ ID NO: 21652

SEQ ID NO: 617299 - RNA, 64 nt, hsa; identical to SEQ ID NO: 21653

SEQ ID NO: 617300 - RNA, 64 nt, hsa; identical to SEQ ID NO: 21654

SEQ ID NO: 617301 - RNA, 64 nt, hsa; identical to SEQ ID NO: 21655

SEQ ID NO: 617302 - RNA, 64 nt, hsa; identical to SEQ ID NO: 21656

SEQ ID NO: 617303 - RNA, 64 nt, hsa; identical to SEQ ID NO: 21657

SEQ ID NO: 617304 - RNA, 64 nt, hsa; identical to SEQ ID NO: 21658

SEQ ID NO: 617305 - RNA, 64 nt, hsa; identical to SEQ ID NO: 21659

SEQ ID NO: 617306 - RNA, 64 nt, hsa; identical to SEQ ID NO: 21660

SEQ ID NO: 617307 - RNA, 64 nt, hsa; identical to SEQ ID NO: 21661

SEQ ID NO: 617308 - RNA, 64 nt, hsa; identical to SEQ ID NO: 21662

SEQ ID NO: 617309 - RNA, 64 nt, hsa; identical to SEQ ID NO: 21663

SEQ ID NO: 617310 - RNA, 64 nt, hsa; identical to SEQ ID NO: 21664

SEQ ID NO: 617311 - RNA, 64 nt, hsa; identical to SEQ ID NO: 21665

SEQ ID NO: 617312 - RNA, 64 nt, hsa; identical to SEQ ID NO: 21666

SEQ ID NO: 617313 - RNA, 64 nt, hsa; identical to SEQ ID NO: 21667

SEQ ID NO: 617314 - RNA, 64 nt, hsa; identical to SEQ ID NO: 21668

SEQ ID NO: 617315 - RNA, 64 nt, hsa; identical to SEQ ID NO: 21669

SEQ ID NO: 617316 - RNA, 64 nt, hsa; identical to SEQ ID NO: 21670

SEQ ID NO: 617317 - RNA, 64 nt, hsa; identical to SEQ ID NO: 21671

SEQ ID NO: 617318 - RNA, 64 nt, hsa; identical to SEQ ID NO: 21672

SEQ ID NO: 617319 - RNA, 64 nt, hsa; identical to SEQ ID NO: 21673

SEQ ID NO: 617320 - RNA, 64 nt, hsa; identical to SEQ ID NO: 21674

SEQ ID NO: 617321 - RNA, 64 nt, hsa; identical to SEQ ID NO: 21675

SEQ ID NO: 617322 - RNA, 64 nt, hsa; identical to SEQ ID NO: 21676

SEQ ID NO: 617323 - RNA, 64 nt, hsa; identical to SEQ ID NO: 21677

SEQ ID NO: 617324 - RNA, 64 nt, hsa; identical to SEQ ID NO: 21678

SEQ ID NO: 617325 - RNA, 64 nt, hsa; identical to SEQ ID NO: 21679

SEQ ID NO: 617326 - RNA, 64 nt, hsa; identical to SEQ ID NO: 21680

SEQ ID NO: 617327 - RNA, 64 nt, hsa; identical to SEQ ID NO: 21681

SEQ ID NO: 617328 - RNA, 64 nt, hsa; identical to SEQ ID NO: 21682

SEQ ID NO: 617329 - RNA, 57 nt, hsa
accuuuggaacuugggaguucucauuguaacccuaacaugugagaauaaaaugucuu

SEQ ID NO: 617330 - RNA, 57 nt, hsa
ucgugaggccagcucccggggccccuguaacccuacucuccucucucccuggaccuc

SEQ ID NO: 617331 - RNA, 57 nt, hsa
ccugccuccucccucccagcugcacuuuaacccuagaagguggggaccuggggggag

SEQ ID NO: 617332 - RNA, 57 nt, hsa
cuguauuguuucacuccguauguaacauaacccuaaauaaauuauuucguauuugag

SEQ ID NO: 617333 - RNA, 57 nt, hsa
aaagguugcaccucauuuaaugaagcuuaacccuauguagaaagucucuuucggggg

SEQ ID NO: 617334 - RNA, 57 nt, hsa
guguauaaagcuuuauucuuuagcccuuaacccuaaggcucagggaaauacccuaug

SEQ ID NO: 617335 - RNA, 57 nt, hsa
uaaaaagacauguuugcauugagaaauuaacccuaaaggguuuucaauaggguguag

SEQ ID NO: 617336 - RNA, 57 nt, hsa
ccaugcaccuuacaauuucugaacaguuaacccuauagaagcaugcuuuauaugagu

SEQ ID NO: 617337 - RNA, 57 nt, hsa
ggguaacgaccgcuugucuuuggucucuaacccuaaucucugggcuugcccuuugcc

SEQ ID NO: 617338 - RNA, 57 nt, hsa
gcccaucucaaaucacaaggauuucucuaacccuauccuaauuguccacauacgugg

SEQ ID NO: 617339 - RNA, 57 nt, hsa
uauuauauacuguauuuucuucuaaauuaacccuaauguuuaaaaacucacuuuccc

SEQ ID NO: 617340 - RNA, 57 nt, hsa
cacugaaaaauauuccaagcuucauauuaacccuaccugucaacguaacgauuucau

SEQ ID NO: 617341 - RNA, 57 nt, hsa
auuauuuaaccauuguucuauuuggcauaacccuauuuaauggugcuuagagcugaa

SEQ ID NO: 617342 - RNA, 57 nt, hsa
uuuugcucaacauuaaauugugcuuccuaacccuaaaucuguccagaguaggaacau

SEQ ID NO: 617343 - RNA, 57 nt, hsa
uguuaaauagauuaagacacaguaaguuaacccuacauguuauaaagauggcgacug

SEQ ID NO: 617344 - RNA, 57 nt, hsa
cuaaccaguuaccacacaucuaugauauaacccuaacacacacagaaaagcauacau

SEQ ID NO: 617345 - RNA, 57 nt, hsa
aaguaaguguuuuccggcugauaaggcuaacccuacccaggaaaggauugauaacua

SEQ ID NO: 617346 - RNA, 57 nt, hsa
cuuuguacaguauaugaaacaguauauuaacccuaaaaccuagauguuguccaccug

SEQ ID NO: 617347 - RNA, 57 nt, hsa
ccacucaacucuuggggcaguggcccguaacccuaguuugccugaggcccuuauguc

SEQ ID NO: 617348 - RNA, 57 nt, hsa
cuuuuucacuguagaauaauguggaaauaacccuagauaaaaauucagucugauaac

SEQ ID NO: 617349 - RNA, 57 nt, hsa
aggaugguaccauugcucuuuccuagcuaacccuagauauggcagcucuuuaaugua

SEQ ID NO: 617350 - RNA, 57 nt, hsa
guuucauagucuuugucuaacugcuaguaacccuaccgaguuuuauauaugaguggg

SEQ ID NO: 617351 - RNA, 57 nt, hsa
aucccaucuagauaauuuauagaaauauaacccuaauuggacaugugguacaggauc

SEQ ID NO: 617352 - RNA, 57 nt, hsa
cccugcgugcugguuccuucagaccccuaacccuacuaaccagcaggcucaucucac

SEQ ID NO: 617353 - RNA, 57 nt, hsa
aaacucugggguguaaacaaaugauuguaacccuacacacuauucaauaaguaguag

SEQ ID NO: 617354 - RNA, 57 nt, hsa
ggguuuuuauuguuguuguuugaucccuaacccuacaaagagccuuccuauuccccu

SEQ ID NO: 617355 - RNA, 57 nt, hsa
uugguggaaccaaaccaccuuagugaguaacccuaagaauugacacaaaucucauau

SEQ ID NO: 617356 - RNA, 57 nt, hsa
ggaaauaguuugcagauaauggaggaguaacccuacaacuauauguccuuaguucuu

SEQ ID NO: 617357 - RNA, 57 nt, hsa
gucaggauguuaacagaaaaguccacauaacccuagaauucuuagucaaggaauaau

SEQ ID NO: 617358 - RNA, 57 nt, hsa
gaaaggacaacuggguuccgcuuuccuuaacccuacacccuuuagcuggaugcuguc

SEQ ID NO: 617359 - RNA, 57 nt, hsa
uuagaagagguagagaaaauggaacauuaacccuacacucggaauucccugaagcaa

SEQ ID NO: 617360 - RNA, 57 nt, hsa
auuaaguaggugaguuuaauuaaagcuuaacccuagguaagaguaaaugagaaauau

SEQ ID NO: 617361 - RNA, 57 nt, hsa
cagguauccccccaaagaccccagaaguaacccuaggcucaauggaggggucugggg

SEQ ID NO: 617362 - RNA, 57 nt, hsa
uuccucuucagucugugguacuccuccuaacccuaaacccucuaugcucaggggcug

SEQ ID NO: 617363 - RNA, 57 nt, hsa
uauaacuagaguagaucugaaugaggauaacccuaaaaucaugaggaauggaagaau

SEQ ID NO: 617364 - RNA, 57 nt, hsa
gcuuuggggccacaaaauaauuuaauauaacccuaagcaaaaugcagugacggaguu

SEQ ID NO: 617365 - RNA, 57 nt, hsa
acccccacaacccaucacuucugguguuaacccuaaaauacccacauguauugagcu

SEQ ID NO: 617366 - RNA, 57 nt, hsa
uuuccugagaaucgaaccuugguucccuaacccuaauugaugagaggcucgcugcuu

SEQ ID NO: 617367 - RNA, 57 nt, hsa
gagaugggaaggcacagggagaagggauaacccuacacccagaccccaggcuggaca

SEQ ID NO: 617368 - RNA, 57 nt, hsa
accauggauucgagguauuauacuguauaacccuacaaaauacauagaaguauuauu

SEQ ID NO: 617369 - RNA, 57 nt, hsa
accugaggugggcuggggcugcuccccuaacccuacuuugcuuccgccacucagcca

SEQ ID NO: 617370 - RNA, 50 nt, hsa; identical to SEQ ID NO: 270908

SEQ ID NO: 617371 - RNA, 57 nt, hsa
uggugccuguuggugguguucuugucuuaacccuagauagaaucuaaugaacucaga

SEQ ID NO: 617372 - RNA, 57 nt, hsa
ucuucaacuuuagugcuccccuuuaccuaacccuacggccucccaugcaucuguacu

SEQ ID NO: 617373 - RNA, 57 nt, hsa
aggaauagaaacaaauuuuuaugagcauaacccuauauaaagacaaaaugaauuucu

SEQ ID NO: 617374 - RNA, 57 nt, hsa
agugucucaaaaauauuuuacuaacuguaacccuaaaauugaugucuuuugguuuau

SEQ ID NO: 617375 - RNA, 57 nt, hsa
gguauuugaugcuuucuguggacaauguaacccuaaacacaucauguauuuuaaaug

SEQ ID NO: 617376 - RNA, 57 nt, hsa
uucuaugggccaaacaaaggccauggauaacccuacccgcuuuaugucauuacccau

SEQ ID NO: 617377 - RNA, 57 nt, hsa
cuuuuucauaauuacucuacuucccaguaacccuaaggaaguugcuaacuuaaaaaa

SEQ ID NO: 617378 - RNA, 57 nt, hsa
aguauucuauaauuucaaacuuugugguaacccuacauuuuauaguugccauaucaa

SEQ ID NO: 617379 - RNA, 57 nt, hsa
gaauauaaaaguauaaaacauuaaaaauaacccuagauauacuuuaaaauaauguua

SEQ ID NO: 617380 - RNA, 57 nt, hsa
guaagcacaggcuucuguccuacucuguaacccuagagggcaccucugcugagguca

SEQ ID NO: 617381 - RNA, 57 nt, hsa
cugcgauuuggcaggaaauaaggcgauuaacccuauguguccacaagccucaagccu

SEQ ID NO: 617382 - RNA, 57 nt, hsa
acuauucuaauguuuaauuacauaugguaacccuaaggccuggggagaaaagcuuuu

SEQ ID NO: 617383 - RNA, 57 nt, hsa
guuaagggauuuuaaauugugcauuuuuaacccuacagugaaauaacuuaagauauc

SEQ ID NO: 617384 - RNA, 57 nt, hsa
acuuguugcuuugcugaaaacuaugguuaacccuauauaggugugggaaauuuuugu

SEQ ID NO: 617385 - RNA, 57 nt, hsa
uucuaaaaucacugucaacaauaaaucuaacccuaguuguaucccuccuuucaguau

SEQ ID NO: 617386 - RNA, 57 nt, hsa
uaaaaauuguccaaucuggugaaugucuaacccuaaaguuuaaaaauuucugccucc

SEQ ID NO: 617387 - RNA, 57 nt, hsa
aagcugaucaccgucuaguugggaaaguaacccuacaggguuuguagggacaugauc

SEQ ID NO: 617388 - RNA, 57 nt, hsa
uguguuguauagucucagaguacauucuaacccuacauuucuaaucauuguuauugg

SEQ ID NO: 617389 - RNA, 57 nt, hsa
cucuguacuuuuugcucaauuuuucuguaacccuaaagcugcucuaaaaaaugaagu

SEQ ID NO: 617390 - RNA, 57 nt, hsa
ucaguguuuccuggggggaccaugcucuaacccuaguccaggcggaccucacccuuc

SEQ ID NO: 617391 - RNA, 57 nt, hsa
ccugcacagcuugguuagaccuagauuuaacccuaagguaagaugcugggguauaga

SEQ ID NO: 617392 - RNA, 57 nt, hsa
gggcuaacgaccacagggucugcacucuaacccuaggcaucacaugcucaaugacuc

SEQ ID NO: 617393 - RNA, 57 nt, hsa
gauuauuuaagacuaaaaguugcauuuuaacccuauuuuaccuagcuaauuauuuaa

SEQ ID NO: 617394 - RNA, 57 nt, hsa
aauguuugaaauaguucaaacugcagcuaacccuagucaaaacuauuuuuguaaaag

SEQ ID NO: 617395 - RNA, 57 nt, hsa
uaagagaauuauauauuucuaacuauauaacccuaggaauuuagacaaccugaaauu

SEQ ID NO: 617396 - RNA, 57 nt, hsa
ucaacugauaguagguuuauugggauguaacccuaugauaaguugagaaacaucucu

SEQ ID NO: 617397 - RNA, 57 nt, hsa
guaaugaaugacguuuuaaggaaucccuaacccuacuaucagaaaagguguuuguua

SEQ ID NO: 617398 - RNA, 57 nt, hsa
ucuauuuaucuuauaucguagaucugauaacccuaucuaaaagaaagucacacgcua

SEQ ID NO: 617399 - RNA, 57 nt, hsa
ugacauuuugcguuuuaauauuucucuuaacccuauucucagggaagauggaauuua

SEQ ID NO: 617400 - RNA, 57 nt, hsa
gauucaagaucagauucuaguguucaguaacccuaugugaaucagaugucuccugga

SEQ ID NO: 617401 - RNA, 57 nt, hsa
auucauauucccaccaugauguaauuauaacccuacaauuacuucagguagcuacac

SEQ ID NO: 617402 - RNA, 57 nt, hsa
ucuccaaagugaaugaacucuuacccauaacccuaaugaugcaagucauauggggga

SEQ ID NO: 617403 - RNA, 57 nt, hsa
ggugaaugcugcuuguucucucaccccuaacccuaguaguuccuccacuaacuuucu

SEQ ID NO: 617404 - RNA, 57 nt, hsa
ggaagggauuggaggcggcagaaccauuaacccuacacaagaacacuccagcccaaa

SEQ ID NO: 617405 - RNA, 57 nt, hsa
aucaaagguagggccaauuaaggauucuaacccuaacccagcaccacaaagcccccc

SEQ ID NO: 617406 - RNA, 57 nt, hsa
gagaaaucaaugaagcaaguacaauguuaacccuaaauuaauaaaagaguuaacauc

SEQ ID NO: 617407 - RNA, 57 nt, hsa
gcuggggcuggcaccacgcacagugccuaacccuagaaaagccaugucuucagccgc

SEQ ID NO: 617408 - RNA, 57 nt, hsa
aaccugucugucuccguggaugcauccuaacccuaaggaaaauuccccaggcuguga

SEQ ID NO: 617409 - RNA, 57 nt, hsa
ugggcugggcaugguggcucacgccuguaacccuagcacuuuaggaaaucgaggcga

SEQ ID NO: 617410 - RNA, 57 nt, hsa
guccccuggcccucuguccccucuuaauaacccuagucacagucuccgcagauucuu

SEQ ID NO: 617411 - RNA, 57 nt, hsa
gugcuucaguuugaaaauguaaaauucuaacccuaaaguaggguugguugaaauuuc

SEQ ID NO: 617412 - RNA, 57 nt, hsa
aaaaaagagaaggggguuuguaguacuuaacccuauuuauuuccguauauuuuaguu

SEQ ID NO: 617413 - RNA, 57 nt, hsa
cuucagaucuggaaaccggcucaguauuaacccuaccuuugguuguccugcccuacc

SEQ ID NO: 617414 - RNA, 57 nt, hsa
cuuaagaauaagaccugagauuaacacuaacccuagaauagaaauguaauagggaga

SEQ ID NO: 617415 - RNA, 57 nt, hsa
aaaggaauggagcagagccuguaccccuaacccuaacagcuaaaucaaggaccucag

SEQ ID NO: 617416 - RNA, 57 nt, hsa
cccuccccgcagugggaagugaauccuuaacccuaaaauuuuaaggccacggccuug

SEQ ID NO: 617417 - RNA, 57 nt, hsa
ugguaaugucugggaauccgagacacauaacccuaauucauaaaugggauuuggggu

SEQ ID NO: 617418 - RNA, 57 nt, hsa
gaugaaaaacuguggcccaacagggcuuaacccuauggauggugggauuuuuaucca

SEQ ID NO: 617419 - RNA, 57 nt, hsa
agacuauuaggugcaauuucaagguucuaacccuauacuguaguauucuuuggggug

SEQ ID NO: 617420 - RNA, 57 nt, hsa
uauggaaaaagguuucagccaaaggccuaacccuauucaacaccagaaaguuuacac

SEQ ID NO: 617421 - RNA, 57 nt, hsa
ugaucugaaauaacauuaauuugauuguaacccuauugggguuaguucccacccuuu

SEQ ID NO: 617422 - RNA, 57 nt, hsa
guggcauauuugcuucuaauguuccccuaacccuacaugcauguuuuaugugcacuc

SEQ ID NO: 617423 - RNA, 57 nt, hsa
agaaagaaagaaaaagaaaacugcagauaacccuauacauuaauacugguaucucga

SEQ ID NO: 617424 - RNA, 57 nt, hsa
auucccaauuccugggucaaggugaauuaacccuauguuggagcacuggaaaccguu

SEQ ID NO: 617425 - RNA, 57 nt, hsa
ccuuuaagauauccaucuuuuucuuuuuaacccuaaucuuucacuugaaagauuuua

SEQ ID NO: 617426 - RNA, 57 nt, hsa
uucaguaagaaucaugucuuacugaucuaacccuaaauccaacucauuuauacuuuu

SEQ ID NO: 617427 - RNA, 57 nt, hsa
cuuugugugugggcugagugcuggccuuaacccuaggcguggaagagaaaaugugag

SEQ ID NO: 617428 - RNA, 57 nt, hsa
cacuacuuuuuuaauuuuuuauuuuuuuaacccuacccuuaacccaugaacacuauu

SEQ ID NO: 617429 - RNA, 57 nt, hsa
ccuaaauggcuauguagaacauuucauuaacccuauaagucauucaguauucuuuuc

SEQ ID NO: 617430 - RNA, 57 nt, hsa
uaggcuggucgcaguggcuuacacuuguaacccuagaacuugggaggcugagguggg

SEQ ID NO: 617431 - RNA, 57 nt, hsa
aaacgauuuaauuuauucuaauuagauuaacccuauuaaucuauggauuggguauca

SEQ ID NO: 617432 - RNA, 57 nt, hsa
uuaaaaaauaacacaauuucuugccuguaacccuagcacuuugggaggccgaggcag

SEQ ID NO: 617433 - RNA, 57 nt, hsa
ugauuuguaacaagccuccuuuuaaaguaacccuacaaaaccacuggaaaguuuaug

SEQ ID NO: 617434 - RNA, 57 nt, hsa
gcccacccccuguuaacugccuauuuauaacccuaggauccuccuuauggagaacua

SEQ ID NO: 617435 - RNA, 57 nt, hsa
accucauugauccacugaccaaauccuuaacccuagcgauggcuugggagauggggg

SEQ ID NO: 617436 - RNA, 57 nt, hsa
agggcugggcgcgguggcucaugccuguaacccuagcacuuugggaggcugaggcgg

SEQ ID NO: 617437 - RNA, 64 nt, hsa; identical to SEQ ID NO: 107849

SEQ ID NO: 617438 - RNA, 64 nt, hsa; identical to SEQ ID NO: 107850

SEQ ID NO: 617439 - RNA, 64 nt, hsa; identical to SEQ ID NO: 107851

SEQ ID NO: 617440 - RNA, 64 nt, hsa; identical to SEQ ID NO: 107852

SEQ ID NO: 617441 - RNA, 64 nt, hsa; identical to SEQ ID NO: 107853

SEQ ID NO: 617442 - RNA, 64 nt, hsa; identical to SEQ ID NO: 107854

SEQ ID NO: 617443 - RNA, 64 nt, hsa; identical to SEQ ID NO: 107855

SEQ ID NO: 617444 - RNA, 64 nt, hsa; identical to SEQ ID NO: 107856

SEQ ID NO: 617445 - RNA, 64 nt, hsa; identical to SEQ ID NO: 107857

SEQ ID NO: 617446 - RNA, 64 nt, hsa; identical to SEQ ID NO: 107858

SEQ ID NO: 617447 - RNA, 64 nt, hsa; identical to SEQ ID NO: 107859

SEQ ID NO: 617448 - RNA, 64 nt, hsa; identical to SEQ ID NO: 107860

SEQ ID NO: 617449 - RNA, 64 nt, hsa; identical to SEQ ID NO: 107861

SEQ ID NO: 617450 - RNA, 64 nt, hsa; identical to SEQ ID NO: 107862

SEQ ID NO: 617451 - RNA, 64 nt, hsa; identical to SEQ ID NO: 107863

SEQ ID NO: 617452 - RNA, 63 nt, hsa; identical to SEQ ID NO: 107864

SEQ ID NO: 617453 - RNA, 64 nt, hsa; identical to SEQ ID NO: 107865

SEQ ID NO: 617454 - RNA, 64 nt, hsa; identical to SEQ ID NO: 107866

SEQ ID NO: 617455 - RNA, 64 nt, hsa; identical to SEQ ID NO: 107867

SEQ ID NO: 617456 - RNA, 64 nt, hsa; identical to SEQ ID NO: 107868

SEQ ID NO: 617457 - RNA, 64 nt, hsa; identical to SEQ ID NO: 107869

SEQ ID NO: 617458 - RNA, 64 nt, hsa; identical to SEQ ID NO: 107870

SEQ ID NO: 617459 - RNA, 64 nt, hsa; identical to SEQ ID NO: 107871

SEQ ID NO: 617460 - RNA, 64 nt, hsa; identical to SEQ ID NO: 107872

SEQ ID NO: 617461 - RNA, 64 nt, hsa; identical to SEQ ID NO: 107873

SEQ ID NO: 617462 - RNA, 64 nt, hsa; identical to SEQ ID NO: 107874

SEQ ID NO: 617463 - RNA, 64 nt, hsa; identical to SEQ ID NO: 107875

SEQ ID NO: 617464 - RNA, 64 nt, hsa; identical to SEQ ID NO: 107876

SEQ ID NO: 617465 - RNA, 64 nt, hsa; identical to SEQ ID NO: 107877

SEQ ID NO: 617466 - RNA, 64 nt, hsa; identical to SEQ ID NO: 107878

SEQ ID NO: 617467 - RNA, 64 nt, hsa; identical to SEQ ID NO: 107879

SEQ ID NO: 617468 - RNA, 64 nt, hsa; identical to SEQ ID NO: 107880

SEQ ID NO: 617469 - RNA, 64 nt, hsa; identical to SEQ ID NO: 107881

SEQ ID NO: 617470 - RNA, 64 nt, hsa; identical to SEQ ID NO: 107882

SEQ ID NO: 617471 - RNA, 64 nt, hsa; identical to SEQ ID NO: 107883

SEQ ID NO: 617472 - RNA, 64 nt, hsa; identical to SEQ ID NO: 107884

SEQ ID NO: 617473 - RNA, 64 nt, hsa; identical to SEQ ID NO: 107885

SEQ ID NO: 617474 - RNA, 64 nt, hsa; identical to SEQ ID NO: 107886

SEQ ID NO: 617475 - RNA, 64 nt, hsa; identical to SEQ ID NO: 107887

SEQ ID NO: 617476 - RNA, 64 nt, hsa; identical to SEQ ID NO: 107888

SEQ ID NO: 617477 - RNA, 64 nt, hsa; identical to SEQ ID NO: 107889

SEQ ID NO: 617478 - RNA, 64 nt, hsa; identical to SEQ ID NO: 107890

SEQ ID NO: 617479 - RNA, 64 nt, hsa; identical to SEQ ID NO: 107891

SEQ ID NO: 617480 - RNA, 64 nt, hsa; identical to SEQ ID NO: 107892

SEQ ID NO: 617481 - RNA, 64 nt, hsa; identical to SEQ ID NO: 107893

SEQ ID NO: 617482 - RNA, 64 nt, hsa; identical to SEQ ID NO: 107894

SEQ ID NO: 617483 - RNA, 64 nt, hsa; identical to SEQ ID NO: 107895

SEQ ID NO: 617484 - RNA, 64 nt, hsa; identical to SEQ ID NO: 107896

SEQ ID NO: 617485 - RNA, 64 nt, hsa; identical to SEQ ID NO: 107897

SEQ ID NO: 617486 - RNA, 64 nt, hsa; identical to SEQ ID NO: 107898

SEQ ID NO: 617487 - RNA, 64 nt, hsa; identical to SEQ ID NO: 107899

SEQ ID NO: 617488 - RNA, 64 nt, hsa; identical to SEQ ID NO: 107900

SEQ ID NO: 617489 - RNA, 64 nt, hsa; identical to SEQ ID NO: 107901

SEQ ID NO: 617490 - RNA, 64 nt, hsa; identical to SEQ ID NO: 107902

SEQ ID NO: 617491 - RNA, 64 nt, hsa; identical to SEQ ID NO: 107903

SEQ ID NO: 617492 - RNA, 64 nt, hsa; identical to SEQ ID NO: 107904

SEQ ID NO: 617493 - RNA, 64 nt, hsa; identical to SEQ ID NO: 107905

SEQ ID NO: 617494 - RNA, 64 nt, hsa; identical to SEQ ID NO: 107906

SEQ ID NO: 617495 - RNA, 64 nt, hsa; identical to SEQ ID NO: 107907

SEQ ID NO: 617496 - RNA, 64 nt, hsa; identical to SEQ ID NO: 107908

SEQ ID NO: 617497 - RNA, 64 nt, hsa; identical to SEQ ID NO: 107909

SEQ ID NO: 617498 - RNA, 64 nt, hsa; identical to SEQ ID NO: 107910

SEQ ID NO: 617499 - RNA, 64 nt, hsa; identical to SEQ ID NO: 107911

SEQ ID NO: 617500 - RNA, 64 nt, hsa; identical to SEQ ID NO: 107912

SEQ ID NO: 617501 - RNA, 64 nt, hsa; identical to SEQ ID NO: 107913

SEQ ID NO: 617502 - RNA, 64 nt, hsa; identical to SEQ ID NO: 107914

SEQ ID NO: 617503 - RNA, 64 nt, hsa; identical to SEQ ID NO: 107915

SEQ ID NO: 617504 - RNA, 64 nt, hsa; identical to SEQ ID NO: 107916

SEQ ID NO: 617505 - RNA, 64 nt, hsa; identical to SEQ ID NO: 107917

SEQ ID NO: 617506 - RNA, 64 nt, hsa; identical to SEQ ID NO: 107918

SEQ ID NO: 617507 - RNA, 64 nt, hsa; identical to SEQ ID NO: 107919

SEQ ID NO: 617508 - RNA, 64 nt, hsa; identical to SEQ ID NO: 107920

SEQ ID NO: 617509 - RNA, 64 nt, hsa; identical to SEQ ID NO: 107921

SEQ ID NO: 617510 - RNA, 64 nt, hsa; identical to SEQ ID NO: 107922

SEQ ID NO: 617511 - RNA, 64 nt, hsa; identical to SEQ ID NO: 107923

SEQ ID NO: 617512 - RNA, 64 nt, hsa; identical to SEQ ID NO: 107924

SEQ ID NO: 617513 - RNA, 64 nt, hsa; identical to SEQ ID NO: 107925

SEQ ID NO: 617514 - RNA, 64 nt, hsa; identical to SEQ ID NO: 107926

SEQ ID NO: 617515 - RNA, 64 nt, hsa; identical to SEQ ID NO: 107927

SEQ ID NO: 617516 - RNA, 64 nt, hsa; identical to SEQ ID NO: 107928

SEQ ID NO: 617517 - RNA, 64 nt, hsa; identical to SEQ ID NO: 107929

SEQ ID NO: 617518 - RNA, 64 nt, hsa; identical to SEQ ID NO: 107930

SEQ ID NO: 617519 - RNA, 64 nt, hsa; identical to SEQ ID NO: 107931

SEQ ID NO: 617520 - RNA, 64 nt, hsa; identical to SEQ ID NO: 107932

SEQ ID NO: 617521 - RNA, 64 nt, hsa; identical to SEQ ID NO: 107933

SEQ ID NO: 617522 - RNA, 64 nt, hsa; identical to SEQ ID NO: 48048

SEQ ID NO: 617523 - RNA, 64 nt, hsa; identical to SEQ ID NO: 48049

SEQ ID NO: 617524 - RNA, 64 nt, hsa; identical to SEQ ID NO: 48050

SEQ ID NO: 617525 - RNA, 64 nt, hsa; identical to SEQ ID NO: 48051

SEQ ID NO: 617526 - RNA, 64 nt, hsa; identical to SEQ ID NO: 48052

SEQ ID NO: 617527 - RNA, 64 nt, hsa; identical to SEQ ID NO: 48053

SEQ ID NO: 617528 - RNA, 64 nt, hsa; identical to SEQ ID NO: 48054

SEQ ID NO: 617529 - RNA, 64 nt, hsa; identical to SEQ ID NO: 48055

SEQ ID NO: 617530 - RNA, 64 nt, hsa; identical to SEQ ID NO: 48056

SEQ ID NO: 617531 - RNA, 64 nt, hsa; identical to SEQ ID NO: 48057

SEQ ID NO: 617532 - RNA, 64 nt, hsa; identical to SEQ ID NO: 48058

SEQ ID NO: 617533 - RNA, 64 nt, hsa; identical to SEQ ID NO: 48059

SEQ ID NO: 617534 - RNA, 64 nt, hsa; identical to SEQ ID NO: 48060

SEQ ID NO: 617535 - RNA, 64 nt, hsa; identical to SEQ ID NO: 48061

SEQ ID NO: 617536 - RNA, 64 nt, hsa; identical to SEQ ID NO: 48062

SEQ ID NO: 617537 - RNA, 64 nt, hsa; identical to SEQ ID NO: 48063

SEQ ID NO: 617538 - RNA, 64 nt, hsa; identical to SEQ ID NO: 48064

SEQ ID NO: 617539 - RNA, 64 nt, hsa; identical to SEQ ID NO: 48065

SEQ ID NO: 617540 - RNA, 64 nt, hsa; identical to SEQ ID NO: 48066

SEQ ID NO: 617541 - RNA, 64 nt, hsa; identical to SEQ ID NO: 48067

SEQ ID NO: 617542 - RNA, 64 nt, hsa; identical to SEQ ID NO: 48068

SEQ ID NO: 617543 - RNA, 64 nt, hsa; identical to SEQ ID NO: 48069

SEQ ID NO: 617544 - RNA, 64 nt, hsa; identical to SEQ ID NO: 48070

SEQ ID NO: 617545 - RNA, 64 nt, hsa; identical to SEQ ID NO: 48071

SEQ ID NO: 617546 - RNA, 64 nt, hsa; identical to SEQ ID NO: 48072

SEQ ID NO: 617547 - RNA, 64 nt, hsa; identical to SEQ ID NO: 48073

SEQ ID NO: 617548 - RNA, 64 nt, hsa; identical to SEQ ID NO: 48074

SEQ ID NO: 617549 - RNA, 64 nt, hsa; identical to SEQ ID NO: 48075

SEQ ID NO: 617550 - RNA, 64 nt, hsa; identical to SEQ ID NO: 48076

SEQ ID NO: 617551 - RNA, 64 nt, hsa; identical to SEQ ID NO: 48077

SEQ ID NO: 617552 - RNA, 64 nt, hsa; identical to SEQ ID NO: 48078

SEQ ID NO: 617553 - RNA, 64 nt, hsa; identical to SEQ ID NO: 48079

SEQ ID NO: 617554 - RNA, 64 nt, hsa; identical to SEQ ID NO: 48080

SEQ ID NO: 617555 - RNA, 64 nt, hsa; identical to SEQ ID NO: 48081

SEQ ID NO: 617556 - RNA, 64 nt, hsa; identical to SEQ ID NO: 48082

SEQ ID NO: 617557 - RNA, 64 nt, hsa; identical to SEQ ID NO: 48083

SEQ ID NO: 617558 - RNA, 64 nt, hsa; identical to SEQ ID NO: 48084

SEQ ID NO: 617559 - RNA, 64 nt, hsa; identical to SEQ ID NO: 48085

SEQ ID NO: 617560 - RNA, 64 nt, hsa; identical to SEQ ID NO: 48086

SEQ ID NO: 617561 - RNA, 64 nt, hsa; identical to SEQ ID NO: 48087

SEQ ID NO: 617562 - RNA, 64 nt, hsa; identical to SEQ ID NO: 48088

SEQ ID NO: 617563 - RNA, 64 nt, hsa; identical to SEQ ID NO: 48089

SEQ ID NO: 617564 - RNA, 64 nt, hsa; identical to SEQ ID NO: 48090

SEQ ID NO: 617565 - RNA, 64 nt, hsa; identical to SEQ ID NO: 48091

SEQ ID NO: 617566 - RNA, 64 nt, hsa; identical to SEQ ID NO: 48092

SEQ ID NO: 617567 - RNA, 64 nt, hsa; identical to SEQ ID NO: 48093

SEQ ID NO: 617568 - RNA, 64 nt, hsa; identical to SEQ ID NO: 48094

SEQ ID NO: 617569 - RNA, 64 nt, hsa; identical to SEQ ID NO: 48095

SEQ ID NO: 617570 - RNA, 64 nt, hsa; identical to SEQ ID NO: 48096

SEQ ID NO: 617571 - RNA, 64 nt, hsa; identical to SEQ ID NO: 48097

SEQ ID NO: 617572 - RNA, 64 nt, hsa; identical to SEQ ID NO: 48098

SEQ ID NO: 617573 - RNA, 64 nt, hsa; identical to SEQ ID NO: 48099

SEQ ID NO: 617574 - RNA, 64 nt, hsa; identical to SEQ ID NO: 48100

SEQ ID NO: 617575 - RNA, 64 nt, hsa; identical to SEQ ID NO: 48101

SEQ ID NO: 617576 - RNA, 64 nt, hsa; identical to SEQ ID NO: 48102

SEQ ID NO: 617577 - RNA, 64 nt, hsa; identical to SEQ ID NO: 48103

SEQ ID NO: 617578 - RNA, 64 nt, hsa; identical to SEQ ID NO: 48104

SEQ ID NO: 617579 - RNA, 64 nt, hsa; identical to SEQ ID NO: 48105

SEQ ID NO: 617580 - RNA, 64 nt, hsa; identical to SEQ ID NO: 48106

SEQ ID NO: 617581 - RNA, 64 nt, hsa; identical to SEQ ID NO: 48107

SEQ ID NO: 617582 - RNA, 64 nt, hsa; identical to SEQ ID NO: 48108

SEQ ID NO: 617583 - RNA, 64 nt, hsa; identical to SEQ ID NO: 48109

SEQ ID NO: 617584 - RNA, 64 nt, hsa; identical to SEQ ID NO: 48110

SEQ ID NO: 617585 - RNA, 64 nt, hsa; identical to SEQ ID NO: 48111

SEQ ID NO: 617586 - RNA, 64 nt, hsa; identical to SEQ ID NO: 48112

SEQ ID NO: 617587 - RNA, 64 nt, hsa; identical to SEQ ID NO: 48113

SEQ ID NO: 617588 - RNA, 64 nt, hsa; identical to SEQ ID NO: 48114

SEQ ID NO: 617589 - RNA, 64 nt, hsa; identical to SEQ ID NO: 48115

SEQ ID NO: 617590 - RNA, 64 nt, hsa; identical to SEQ ID NO: 48116

SEQ ID NO: 617591 - RNA, 64 nt, hsa; identical to SEQ ID NO: 48117

SEQ ID NO: 617592 - RNA, 64 nt, hsa; identical to SEQ ID NO: 48118

SEQ ID NO: 617593 - RNA, 64 nt, hsa; identical to SEQ ID NO: 48119

SEQ ID NO: 617594 - RNA, 64 nt, hsa; identical to SEQ ID NO: 48120

SEQ ID NO: 617595 - RNA, 64 nt, hsa; identical to SEQ ID NO: 48121

SEQ ID NO: 617596 - RNA, 64 nt, hsa; identical to SEQ ID NO: 48122

SEQ ID NO: 617597 - RNA, 64 nt, hsa; identical to SEQ ID NO: 48123

SEQ ID NO: 617598 - RNA, 64 nt, hsa; identical to SEQ ID NO: 48124

SEQ ID NO: 617599 - RNA, 64 nt, hsa; identical to SEQ ID NO: 48125

SEQ ID NO: 617600 - RNA, 64 nt, hsa; identical to SEQ ID NO: 48126

SEQ ID NO: 617601 - RNA, 64 nt, hsa; identical to SEQ ID NO: 48127

SEQ ID NO: 617602 - RNA, 64 nt, hsa; identical to SEQ ID NO: 48128

SEQ ID NO: 617603 - RNA, 64 nt, hsa; identical to SEQ ID NO: 48129

SEQ ID NO: 617604 - RNA, 64 nt, hsa; identical to SEQ ID NO: 48130

SEQ ID NO: 617605 - RNA, 64 nt, hsa; identical to SEQ ID NO: 48131

SEQ ID NO: 617606 - RNA, 59 nt, hsa; identical to SEQ ID NO: 48132

SEQ ID NO: 617607 - RNA, 64 nt, hsa; identical to SEQ ID NO: 48133

SEQ ID NO: 617608 - RNA, 64 nt, hsa; identical to SEQ ID NO: 48134

SEQ ID NO: 617609 - RNA, 64 nt, hsa; identical to SEQ ID NO: 48135

SEQ ID NO: 617610 - RNA, 64 nt, hsa; identical to SEQ ID NO: 48136

SEQ ID NO: 617611 - RNA, 64 nt, hsa; identical to SEQ ID NO: 48137

SEQ ID NO: 617612 - RNA, 64 nt, hsa; identical to SEQ ID NO: 48138

SEQ ID NO: 617613 - RNA, 64 nt, hsa; identical to SEQ ID NO: 48139

SEQ ID NO: 617614 - RNA, 64 nt, hsa; identical to SEQ ID NO: 48140

SEQ ID NO: 617615 - RNA, 64 nt, hsa; identical to SEQ ID NO: 48141

SEQ ID NO: 617616 - RNA, 64 nt, hsa; identical to SEQ ID NO: 48142

SEQ ID NO: 617617 - RNA, 64 nt, hsa; identical to SEQ ID NO: 48143

SEQ ID NO: 617618 - RNA, 64 nt, hsa; identical to SEQ ID NO: 48144

SEQ ID NO: 617619 - RNA, 64 nt, hsa; identical to SEQ ID NO: 48145

SEQ ID NO: 617620 - RNA, 64 nt, hsa; identical to SEQ ID NO: 48146

SEQ ID NO: 617621 - RNA, 64 nt, hsa; identical to SEQ ID NO: 48147

SEQ ID NO: 617622 - RNA, 64 nt, hsa; identical to SEQ ID NO: 48148

SEQ ID NO: 617623 - RNA, 64 nt, hsa; identical to SEQ ID NO: 48149

SEQ ID NO: 617624 - RNA, 64 nt, hsa; identical to SEQ ID NO: 48150

SEQ ID NO: 617625 - RNA, 64 nt, hsa; identical to SEQ ID NO: 48151

SEQ ID NO: 617626 - RNA, 64 nt, hsa; identical to SEQ ID NO: 48152

SEQ ID NO: 617627 - RNA, 64 nt, hsa; identical to SEQ ID NO: 48153

SEQ ID NO: 617628 - RNA, 64 nt, hsa; identical to SEQ ID NO: 48154

SEQ ID NO: 617629 - RNA, 64 nt, hsa; identical to SEQ ID NO: 48155

SEQ ID NO: 617630 - RNA, 64 nt, hsa; identical to SEQ ID NO: 48156

SEQ ID NO: 617631 - RNA, 64 nt, hsa; identical to SEQ ID NO: 48157

SEQ ID NO: 617632 - RNA, 64 nt, hsa; identical to SEQ ID NO: 48158

SEQ ID NO: 617633 - RNA, 64 nt, hsa; identical to SEQ ID NO: 48159

SEQ ID NO: 617634 - RNA, 64 nt, hsa; identical to SEQ ID NO: 48160

SEQ ID NO: 617635 - RNA, 64 nt, hsa; identical to SEQ ID NO: 48161

SEQ ID NO: 617636 - RNA, 64 nt, hsa; identical to SEQ ID NO: 48162

SEQ ID NO: 617637 - RNA, 64 nt, hsa; identical to SEQ ID NO: 48163

SEQ ID NO: 617638 - RNA, 64 nt, hsa; identical to SEQ ID NO: 48164

SEQ ID NO: 617639 - RNA, 64 nt, hsa; identical to SEQ ID NO: 48165

SEQ ID NO: 617640 - RNA, 64 nt, hsa; identical to SEQ ID NO: 48166

SEQ ID NO: 617641 - RNA, 64 nt, hsa; identical to SEQ ID NO: 48167

SEQ ID NO: 617642 - RNA, 64 nt, hsa; identical to SEQ ID NO: 48168

SEQ ID NO: 617643 - RNA, 64 nt, hsa; identical to SEQ ID NO: 48169

SEQ ID NO: 617644 - RNA, 64 nt, hsa; identical to SEQ ID NO: 48170

SEQ ID NO: 617645 - RNA, 64 nt, hsa; identical to SEQ ID NO: 48171

SEQ ID NO: 617646 - RNA, 64 nt, hsa; identical to SEQ ID NO: 48172

SEQ ID NO: 617647 - RNA, 64 nt, hsa; identical to SEQ ID NO: 48173

SEQ ID NO: 617648 - RNA, 64 nt, hsa; identical to SEQ ID NO: 48174

SEQ ID NO: 617649 - RNA, 64 nt, hsa; identical to SEQ ID NO: 48175

SEQ ID NO: 617650 - RNA, 64 nt, hsa; identical to SEQ ID NO: 48176

SEQ ID NO: 617651 - RNA, 64 nt, hsa; identical to SEQ ID NO: 48177

SEQ ID NO: 617652 - RNA, 64 nt, hsa; identical to SEQ ID NO: 48178

SEQ ID NO: 617653 - RNA, 64 nt, hsa; identical to SEQ ID NO: 48179

SEQ ID NO: 617654 - RNA, 64 nt, hsa; identical to SEQ ID NO: 48180

SEQ ID NO: 617655 - RNA, 64 nt, hsa; identical to SEQ ID NO: 48181

SEQ ID NO: 617656 - RNA, 64 nt, hsa; identical to SEQ ID NO: 48182

SEQ ID NO: 617657 - RNA, 64 nt, hsa; identical to SEQ ID NO: 48183

SEQ ID NO: 617658 - RNA, 64 nt, hsa; identical to SEQ ID NO: 48184

SEQ ID NO: 617659 - RNA, 64 nt, hsa; identical to SEQ ID NO: 48185

SEQ ID NO: 617660 - RNA, 64 nt, hsa; identical to SEQ ID NO: 48186

SEQ ID NO: 617661 - RNA, 64 nt, hsa; identical to SEQ ID NO: 48187

SEQ ID NO: 617662 - RNA, 64 nt, hsa; identical to SEQ ID NO: 48188

SEQ ID NO: 617663 - RNA, 64 nt, hsa; identical to SEQ ID NO: 48189

SEQ ID NO: 617664 - RNA, 64 nt, hsa; identical to SEQ ID NO: 48190

SEQ ID NO: 617665 - RNA, 64 nt, hsa; identical to SEQ ID NO: 48191

SEQ ID NO: 617666 - RNA, 64 nt, hsa; identical to SEQ ID NO: 48192

SEQ ID NO: 617667 - RNA, 64 nt, hsa; identical to SEQ ID NO: 48193

SEQ ID NO: 617668 - RNA, 64 nt, hsa; identical to SEQ ID NO: 48194

SEQ ID NO: 617669 - RNA, 64 nt, hsa; identical to SEQ ID NO: 48195

SEQ ID NO: 617670 - RNA, 64 nt, hsa; identical to SEQ ID NO: 48196

SEQ ID NO: 617671 - RNA, 64 nt, hsa; identical to SEQ ID NO: 48197

SEQ ID NO: 617672 - RNA, 64 nt, hsa; identical to SEQ ID NO: 48198

SEQ ID NO: 617673 - RNA, 64 nt, hsa; identical to SEQ ID NO: 48199

SEQ ID NO: 617674 - RNA, 64 nt, hsa; identical to SEQ ID NO: 48200

SEQ ID NO: 617675 - RNA, 64 nt, hsa; identical to SEQ ID NO: 48201

SEQ ID NO: 617676 - RNA, 64 nt, hsa; identical to SEQ ID NO: 48202

SEQ ID NO: 617677 - RNA, 64 nt, hsa; identical to SEQ ID NO: 48203

SEQ ID NO: 617678 - RNA, 64 nt, hsa; identical to SEQ ID NO: 48204

SEQ ID NO: 617679 - RNA, 64 nt, hsa; identical to SEQ ID NO: 48205

SEQ ID NO: 617680 - RNA, 64 nt, hsa; identical to SEQ ID NO: 48206

SEQ ID NO: 617681 - RNA, 64 nt, hsa; identical to SEQ ID NO: 48207

SEQ ID NO: 617682 - RNA, 64 nt, hsa; identical to SEQ ID NO: 48208

SEQ ID NO: 617683 - RNA, 64 nt, hsa; identical to SEQ ID NO: 48209

SEQ ID NO: 617684 - RNA, 64 nt, hsa; identical to SEQ ID NO: 48210

SEQ ID NO: 617685 - RNA, 64 nt, hsa; identical to SEQ ID NO: 48211

SEQ ID NO: 617686 - RNA, 64 nt, hsa; identical to SEQ ID NO: 48212

SEQ ID NO: 617687 - RNA, 64 nt, hsa; identical to SEQ ID NO: 48213

SEQ ID NO: 617688 - RNA, 64 nt, hsa; identical to SEQ ID NO: 48214

SEQ ID NO: 617689 - RNA, 64 nt, hsa; identical to SEQ ID NO: 48215

SEQ ID NO: 617690 - RNA, 64 nt, hsa; identical to SEQ ID NO: 48216

SEQ ID NO: 617691 - RNA, 64 nt, hsa; identical to SEQ ID NO: 48217

SEQ ID NO: 617692 - RNA, 64 nt, hsa; identical to SEQ ID NO: 48218

SEQ ID NO: 617693 - RNA, 64 nt, hsa; identical to SEQ ID NO: 48219

SEQ ID NO: 617694 - RNA, 64 nt, hsa; identical to SEQ ID NO: 48220

SEQ ID NO: 617695 - RNA, 64 nt, hsa; identical to SEQ ID NO: 48221

SEQ ID NO: 617696 - RNA, 64 nt, hsa; identical to SEQ ID NO: 48222

SEQ ID NO: 617697 - RNA, 64 nt, hsa; identical to SEQ ID NO: 48223

SEQ ID NO: 617698 - RNA, 64 nt, hsa; identical to SEQ ID NO: 48224

SEQ ID NO: 617699 - RNA, 64 nt, hsa; identical to SEQ ID NO: 48225

SEQ ID NO: 617700 - RNA, 64 nt, hsa; identical to SEQ ID NO: 48226

SEQ ID NO: 617701 - RNA, 64 nt, hsa; identical to SEQ ID NO: 48227

SEQ ID NO: 617702 - RNA, 64 nt, hsa; identical to SEQ ID NO: 48228

SEQ ID NO: 617703 - RNA, 64 nt, hsa; identical to SEQ ID NO: 48229

SEQ ID NO: 617704 - RNA, 64 nt, hsa; identical to SEQ ID NO: 48230

SEQ ID NO: 617705 - RNA, 64 nt, hsa; identical to SEQ ID NO: 48231

SEQ ID NO: 617706 - RNA, 64 nt, hsa; identical to SEQ ID NO: 48232

SEQ ID NO: 617707 - RNA, 64 nt, hsa; identical to SEQ ID NO: 48233

SEQ ID NO: 617708 - RNA, 64 nt, hsa; identical to SEQ ID NO: 48234

SEQ ID NO: 617709 - RNA, 64 nt, hsa; identical to SEQ ID NO: 48235

SEQ ID NO: 617710 - RNA, 64 nt, hsa; identical to SEQ ID NO: 48236

SEQ ID NO: 617711 - RNA, 64 nt, hsa; identical to SEQ ID NO: 48237

SEQ ID NO: 617712 - RNA, 64 nt, hsa; identical to SEQ ID NO: 48238

SEQ ID NO: 617713 - RNA, 64 nt, hsa; identical to SEQ ID NO: 48239

SEQ ID NO: 617714 - RNA, 64 nt, hsa; identical to SEQ ID NO: 48240

SEQ ID NO: 617715 - RNA, 64 nt, hsa; identical to SEQ ID NO: 48241

SEQ ID NO: 617716 - RNA, 64 nt, hsa; identical to SEQ ID NO: 48242

SEQ ID NO: 617717 - RNA, 64 nt, hsa; identical to SEQ ID NO: 48243

SEQ ID NO: 617718 - RNA, 64 nt, hsa; identical to SEQ ID NO: 48244

SEQ ID NO: 617719 - RNA, 64 nt, hsa; identical to SEQ ID NO: 48245

SEQ ID NO: 617720 - RNA, 64 nt, hsa; identical to SEQ ID NO: 48246

SEQ ID NO: 617721 - RNA, 64 nt, hsa; identical to SEQ ID NO: 48247

SEQ ID NO: 617722 - RNA, 64 nt, hsa; identical to SEQ ID NO: 48248

SEQ ID NO: 617723 - RNA, 64 nt, hsa; identical to SEQ ID NO: 48249

SEQ ID NO: 617724 - RNA, 64 nt, hsa; identical to SEQ ID NO: 48250

SEQ ID NO: 617725 - RNA, 64 nt, hsa; identical to SEQ ID NO: 48251

SEQ ID NO: 617726 - RNA, 64 nt, hsa; identical to SEQ ID NO: 48252

SEQ ID NO: 617727 - RNA, 64 nt, hsa; identical to SEQ ID NO: 48253

SEQ ID NO: 617728 - RNA, 64 nt, hsa; identical to SEQ ID NO: 48254

SEQ ID NO: 617729 - RNA, 64 nt, hsa; identical to SEQ ID NO: 48255

SEQ ID NO: 617730 - RNA, 64 nt, hsa; identical to SEQ ID NO: 48256

SEQ ID NO: 617731 - RNA, 64 nt, hsa; identical to SEQ ID NO: 48257

SEQ ID NO: 617732 - RNA, 64 nt, hsa; identical to SEQ ID NO: 48258

SEQ ID NO: 617733 - RNA, 64 nt, hsa; identical to SEQ ID NO: 48259

SEQ ID NO: 617734 - RNA, 64 nt, hsa; identical to SEQ ID NO: 48260

SEQ ID NO: 617735 - RNA, 64 nt, hsa; identical to SEQ ID NO: 48261

SEQ ID NO: 617736 - RNA, 64 nt, hsa; identical to SEQ ID NO: 48262

SEQ ID NO: 617737 - RNA, 64 nt, hsa; identical to SEQ ID NO: 48263

SEQ ID NO: 617738 - RNA, 64 nt, hsa; identical to SEQ ID NO: 48264

SEQ ID NO: 617739 - RNA, 64 nt, hsa; identical to SEQ ID NO: 48265

SEQ ID NO: 617740 - RNA, 64 nt, hsa; identical to SEQ ID NO: 48266

SEQ ID NO: 617741 - RNA, 64 nt, hsa; identical to SEQ ID NO: 48267

SEQ ID NO: 617742 - RNA, 64 nt, hsa; identical to SEQ ID NO: 48268

SEQ ID NO: 617743 - RNA, 64 nt, hsa; identical to SEQ ID NO: 48269

SEQ ID NO: 617744 - RNA, 64 nt, hsa; identical to SEQ ID NO: 48270

SEQ ID NO: 617745 - RNA, 64 nt, hsa; identical to SEQ ID NO: 48271

SEQ ID NO: 617746 - RNA, 64 nt, hsa; identical to SEQ ID NO: 48272

SEQ ID NO: 617747 - RNA, 64 nt, hsa; identical to SEQ ID NO: 48273

SEQ ID NO: 617748 - RNA, 64 nt, hsa; identical to SEQ ID NO: 48274

SEQ ID NO: 617749 - RNA, 64 nt, hsa; identical to SEQ ID NO: 48275

SEQ ID NO: 617750 - RNA, 64 nt, hsa; identical to SEQ ID NO: 48276

SEQ ID NO: 617751 - RNA, 64 nt, hsa; identical to SEQ ID NO: 48277

SEQ ID NO: 617752 - RNA, 64 nt, hsa; identical to SEQ ID NO: 48278

SEQ ID NO: 617753 - RNA, 64 nt, hsa; identical to SEQ ID NO: 48279

SEQ ID NO: 617754 - RNA, 64 nt, hsa; identical to SEQ ID NO: 48280

SEQ ID NO: 617755 - RNA, 64 nt, hsa; identical to SEQ ID NO: 48281

SEQ ID NO: 617756 - RNA, 64 nt, hsa; identical to SEQ ID NO: 48282

SEQ ID NO: 617757 - RNA, 64 nt, hsa; identical to SEQ ID NO: 48283

SEQ ID NO: 617758 - RNA, 64 nt, hsa; identical to SEQ ID NO: 48284

SEQ ID NO: 617759 - RNA, 64 nt, hsa; identical to SEQ ID NO: 48285

SEQ ID NO: 617760 - RNA, 64 nt, hsa; identical to SEQ ID NO: 48286

SEQ ID NO: 617761 - RNA, 64 nt, hsa; identical to SEQ ID NO: 48287

SEQ ID NO: 617762 - RNA, 64 nt, hsa; identical to SEQ ID NO: 48288

SEQ ID NO: 617763 - RNA, 64 nt, hsa; identical to SEQ ID NO: 48289

SEQ ID NO: 617764 - RNA, 64 nt, hsa; identical to SEQ ID NO: 48290

SEQ ID NO: 617765 - RNA, 64 nt, hsa; identical to SEQ ID NO: 48291

SEQ ID NO: 617766 - RNA, 64 nt, hsa; identical to SEQ ID NO: 48292

SEQ ID NO: 617767 - RNA, 64 nt, hsa; identical to SEQ ID NO: 48293

SEQ ID NO: 617768 - RNA, 64 nt, hsa; identical to SEQ ID NO: 48294

SEQ ID NO: 617769 - RNA, 64 nt, hsa; identical to SEQ ID NO: 48295

SEQ ID NO: 617770 - RNA, 64 nt, hsa; identical to SEQ ID NO: 48296

SEQ ID NO: 617771 - RNA, 64 nt, hsa; identical to SEQ ID NO: 48297

SEQ ID NO: 617772 - RNA, 64 nt, hsa; identical to SEQ ID NO: 48298

SEQ ID NO: 617773 - RNA, 64 nt, hsa; identical to SEQ ID NO: 48299

SEQ ID NO: 617774 - RNA, 64 nt, hsa; identical to SEQ ID NO: 48300

SEQ ID NO: 617775 - RNA, 64 nt, hsa; identical to SEQ ID NO: 48301

SEQ ID NO: 617776 - RNA, 64 nt, hsa; identical to SEQ ID NO: 48302

SEQ ID NO: 617777 - RNA, 64 nt, hsa; identical to SEQ ID NO: 411857

SEQ ID NO: 617778 - RNA, 64 nt, hsa; identical to SEQ ID NO: 411858

SEQ ID NO: 617779 - RNA, 64 nt, hsa; identical to SEQ ID NO: 411859

SEQ ID NO: 617780 - RNA, 64 nt, hsa; identical to SEQ ID NO: 411860

SEQ ID NO: 617781 - RNA, 64 nt, hsa; identical to SEQ ID NO: 411861

SEQ ID NO: 617782 - RNA, 64 nt, hsa; identical to SEQ ID NO: 411862

SEQ ID NO: 617783 - RNA, 64 nt, hsa; identical to SEQ ID NO: 411863

SEQ ID NO: 617784 - RNA, 64 nt, hsa; identical to SEQ ID NO: 411864

SEQ ID NO: 617785 - RNA, 64 nt, hsa; identical to SEQ ID NO: 364238

SEQ ID NO: 617786 - RNA, 64 nt, hsa; identical to SEQ ID NO: 364239

SEQ ID NO: 617787 - RNA, 64 nt, hsa; identical to SEQ ID NO: 364240

SEQ ID NO: 617788 - RNA, 64 nt, hsa; identical to SEQ ID NO: 364241

SEQ ID NO: 617789 - RNA, 64 nt, hsa; identical to SEQ ID NO: 364242

SEQ ID NO: 617790 - RNA, 64 nt, hsa; identical to SEQ ID NO: 364243

SEQ ID NO: 617791 - RNA, 64 nt, hsa; identical to SEQ ID NO: 364244

SEQ ID NO: 617792 - RNA, 64 nt, hsa; identical to SEQ ID NO: 364245

SEQ ID NO: 617793 - RNA, 64 nt, hsa; identical to SEQ ID NO: 364246

SEQ ID NO: 617794 - RNA, 64 nt, hsa; identical to SEQ ID NO: 364247

SEQ ID NO: 617795 - RNA, 64 nt, hsa; identical to SEQ ID NO: 364248

SEQ ID NO: 617796 - RNA, 64 nt, hsa; identical to SEQ ID NO: 364249

SEQ ID NO: 617797 - RNA, 64 nt, hsa; identical to SEQ ID NO: 364250

SEQ ID NO: 617798 - RNA, 64 nt, hsa; identical to SEQ ID NO: 364251

SEQ ID NO: 617799 - RNA, 64 nt, hsa; identical to SEQ ID NO: 364252

SEQ ID NO: 617800 - RNA, 64 nt, hsa; identical to SEQ ID NO: 364253

SEQ ID NO: 617801 - RNA, 64 nt, hsa
agucaauauguuggaggcaugcuaagaauaaacaacuaaauaacuguauuagaaaaaaaagaaa

SEQ ID NO: 617802 - RNA, 64 nt, hsa
aacuaaauaacuguauuagaaaaaaaagaaacuuacuaaauaucauaaucugaugauauguggu

SEQ ID NO: 617803 - RNA, 64 nt, hsa
uauuacucuugugacauuuuuuugguuaucaacaacuaaauauaaauuacuuuggaaaaaguaa

SEQ ID NO: 617804 - RNA, 64 nt, hsa
agauccaugcagcuagaacacacuugcuuccacuacuaaauauacaggguauguccuaacaugg

SEQ ID NO: 617805 - RNA, 64 nt, hsa
uuugguuaaacauuucuaaaaauaaacuaccaauacuaaauaguaagaaaccuaacuuuaguag

SEQ ID NO: 617806 - RNA, 64 nt, hsa
ucuauuacuagacauuuauguaacaucuugcuguacuaaauacagcagaaaaucuacucuuuag

SEQ ID NO: 617807 - RNA, 64 nt, hsa
gcacauaagauaauuugcuaaaaugcuaaucuuuacuaaauagugagcuaaauuagaauuucua

SEQ ID NO: 617808 - RNA, 64 nt, hsa
uaguuaaugaugauaacaaugguguaacuuguaaacuaaauauuugguaacugaagcaauaggc

SEQ ID NO: 617809 - RNA, 64 nt, hsa
aaaauuggagacuuauaaucaugguaaauauaaaacuaaauauguuuuaauauuucugaauuuu

SEQ ID NO: 617810 - RNA, 64 nt, hsa
uucaaauaagauuauuuacaaacuuauucuugaaacuaaauauaguaaagaggguuuuuaaaau

SEQ ID NO: 617811 - RNA, 64 nt, hsa
uugaagcacuaauuccaaaauuauggcugaauauacuaaauaacagaaaaguuacagauaagaa

SEQ ID NO: 617812 - RNA, 64 nt, hsa
uuugauuaacuaguguuaaacaaaaaauagguuuacuaaauauguuaaucuauucuuuuaacau

SEQ ID NO: 617813 - RNA, 64 nt, hsa
cuguaguguuaagcaaagucuccucuugcuugauacuaaauaaacuuuugaaagaaauuuugug

SEQ ID NO: 617814 - RNA, 64 nt, hsa
auauguugaaaugcuaccuuuuuuaaaauaagaaacuaaauaaaauuauuuuacuaucagugau

SEQ ID NO: 617815 - RNA, 64 nt, hsa
augcuaagauacugccugcacuggaauguuaaacacuaaauauauaacaagcuguguuuuccua

SEQ ID NO: 617816 - RNA, 64 nt, hsa
cuuuaagucuuuggcaauguuauuguauuauaugacuaaauaacuucgaauuguucaauugugu

SEQ ID NO: 617817 - RNA, 64 nt, hsa
uaauuccaacaaggaauucagaguaauguaaaagacuaaauaucauuccuucuaaggcaaauug

SEQ ID NO: 617818 - RNA, 64 nt, hsa
augagucuucaucacagcaucguuuaugaaaacaacuaaauauucacuaauggugccaguggaa

SEQ ID NO: 617819 - RNA, 64 nt, hsa
guauaguuauuuuaagugccaauuaauuuaucagacuaaauagaaaauauuugagccauuacug

SEQ ID NO: 617820 - RNA, 64 nt, hsa
auugcuuuaguaugcuggcuuguacauaguaggcacuaaauacauguuuguugguugauuguuu

SEQ ID NO: 617821 - RNA, 64 nt, hsa
uuagugcucuuaacuuguuaccauuguaauauuaacuaaauaaacagauguauuaugcuguugc

SEQ ID NO: 617822 - RNA, 64 nt, hsa
guuuuaagaccuaauccccaccucccuucuucuaacuaaauauaaaaagauccaggggacauaa

SEQ ID NO: 617823 - RNA, 64 nt, hsa
agacugcauuguggccccagacuuuuaaaacagcacuaaauaacuugggggaaacggggggagg

SEQ ID NO: 617824 - RNA, 64 nt, hsa
uugugguucuacauuccuggugaaugaugaauguugcugucaaagggcugcccccuaccuuaua

SEQ ID NO: 617825 - RNA, 64 nt, hsa
guuaacauccuaaugugguagguauuagguaaugugcugucaugagaaaaauugagacuuccaa

SEQ ID NO: 617826 - RNA, 64 nt, hsa
uacaagugugguagggacuuaaaaaacuuguaaaugcugucaacuaugauaugguaaaaguuac

SEQ ID NO: 617827 - RNA, 64 nt, hsa
cccuucacaguguuucgacagcugauuacacaguugcugucauaagaaugaauaauaauuaucc

SEQ ID NO: 617828 - RNA, 64 nt, hsa
caucugguugaauggcuuuucuuagugugguauuugcugucacauaguuuuuccugggugaguc

SEQ ID NO: 617829 - RNA, 64 nt, hsa
uguuuacaugucaagaggaaaagcuguaagaaaaugcugucacagacccaucccuguggcaucg

SEQ ID NO: 617830 - RNA, 64 nt, hsa
uaccugcccaaggaugcugucaagcaccugcaugugcugucacgcacaagggcacgugaaguca

SEQ ID NO: 617831 - RNA, 64 nt, hsa
ucaggcgccgcacuuccuuuuaccugcccaaggaugcugucaagcaccugcaugugcugucacg

SEQ ID NO: 617832 - RNA, 64 nt, hsa
uucuggauugagugcugucagaaaguggauugagugcugucagaaagugggagugauuuugcaa

SEQ ID NO: 617833 - RNA, 64 nt, hsa
ggcucaagugagcaaggguuucuucuggauugagugcugucagaaaguggauugagugcuguca

SEQ ID NO: 617834 - RNA, 64 nt, hsa
agcuggcugugggcugagauccuggcuggggcccugcugucaaccucuccuccaggcccugccu

SEQ ID NO: 617835 - RNA, 64 nt, hsa
uguccaugccccaguucuaagcccuguggccaggugcugucacacagcaaaggggacuuugcag

SEQ ID NO: 617836 - RNA, 64 nt, hsa
cucugcugaauauauaagcaggacggccgccuucugcugucagaauuugcaaucaagggugacu

SEQ ID NO: 617837 - RNA, 64 nt, hsa
cuccgaaugacuccuggugcuaggccaugcuggcugcugucacugagcgggacucaggccaaga

SEQ ID NO: 617838 - RNA, 64 nt, hsa
accaggccgugaggcuggagaaacuggcaguuauugcugucaaaagccuguucucucaacugcu

SEQ ID NO: 617839 - RNA, 64 nt, hsa
gcaguuauugcugucaaaagccuguucucucaacugcugucaauaaaauuaaagauacagauuu

SEQ ID NO: 617840 - RNA, 64 nt, hsa
gagggaaacaguguuaccagagcccaguaagaacugcugucaugaaggaggggccaccuuguaa

SEQ ID NO: 617841 - RNA, 64 nt, hsa
cuauaaaucaggguuuuaauuuucucagagaaccugcugucaaauauuuacagcacaucacugu

SEQ ID NO: 617842 - RNA, 64 nt, hsa
ugccugcccugccuccgucccaaccaugggcugcugcugucacucccucuccacuucagugcau

SEQ ID NO: 617843 - RNA, 64 nt, hsa
gcucuuauggagcccuggaguuguugggcaaggaugcugucauuuuuugaaccaaaagacaaac

SEQ ID NO: 617844 - RNA, 64 nt, hsa
ggggaaaacugcuguguguggucuuggaacugguugcugucagguuuaucucauccuaacaccu

SEQ ID NO: 617845 - RNA, 64 nt, hsa
cagcaccauccaagaaacuacuaccuaucaagaaugcugucacaccuuugaagccuggcaagca

SEQ ID NO: 617846 - RNA, 64 nt, hsa
acagcugaacugaauauaaauguucacaaauuaaugcugucaaaggaaugaguaaagcagaaaa

SEQ ID NO: 617847 - RNA, 64 nt, hsa
uuguuuuuguauauaagacugcuuccaccugaaaugcugucauaaguacuggggggguggggga

SEQ ID NO: 617848 - RNA, 64 nt, hsa
cuuuguaugaugaaaagaauguguuaugaaucggugcugucagcccugcugucagaccuucuuc

SEQ ID NO: 617849 - RNA, 64 nt, hsa
aaaagaauguguuaugaaucggugcugucagcccugcugucagaccuucuuccacagcaaauga

SEQ ID NO: 617850 - RNA, 64 nt, hsa
ucuugacagaaaaaaaucaguugacuuaacccuuugcugucaaaagaguuggcguuuccuguuc

SEQ ID NO: 617851 - RNA, 64 nt, hsa
uguagucaauguucgguuccucaaaaggucuugcugcugucagguguuaugcacuccauccauc

SEQ ID NO: 617852 - RNA, 64 nt, hsa
caccugggcuucacggcauccuugcagccaccucugcugucacugcucgaagcagcagucucuc

SEQ ID NO: 617853 - RNA, 64 nt, hsa
gggggccacucagcagcgcuggggcaggugccucugcugucagcuccacccgacaggcagacga

SEQ ID NO: 617854 - RNA, 64 nt, hsa
ccacagaaagaaauguaggugugaaguauuaggcugcugucagggagaggauggcagauggagg

SEQ ID NO: 617855 - RNA, 64 nt, hsa
gugacuaacuuugaaagaacacccaucauguggcugcugucacccuugaccagccgugguggug

SEQ ID NO: 617856 - RNA, 64 nt, hsa
ccccaaacaagcgccaccgugggagaggagaggcugcugucacugguaccggaugcagacccca

SEQ ID NO: 617857 - RNA, 64 nt, hsa
auccaccgccacacuggccggcccacguccugggugcugucaugcccagcuuggagugccacgu

SEQ ID NO: 617858 - RNA, 64 nt, hsa
uucauuucagugaaucuggugaccuccaucugcuugcugucauaacccgacacggacuuauuuu

SEQ ID NO: 617859 - RNA, 64 nt, hsa
ccaaauaaaaaugcacucaucucuguagaacaucugcugucaaaggccagccugucguuagggc

SEQ ID NO: 617860 - RNA, 64 nt, hsa
agaaggcgaacauuucauguuuggcgggcaugugagugcacaagauggaaagagcgauuggagc

SEQ ID NO: 617861 - RNA, 64 nt, hsa
cugacuggaaaaucuugucauucuaacacugaaaagugcacacgcaugacaaaauguagacaag

SEQ ID NO: 617862 - RNA, 64 nt, hsa
auaaugauaaaacaccucacaccucacucuuuauagugcacaaaaugaaugaggucugggcuag

SEQ ID NO: 617863 - RNA, 64 nt, hsa
auuaugggcuggaaagcauuuguuauaaaccuauagugcacauuuuaacugcccccuaaauuac

SEQ ID NO: 617864 - RNA, 64 nt, hsa
ugcacacaggugcacagaccacacagcacacacaagugcacagagcacacugcacacaugcaca

SEQ ID NO: 617865 - RNA, 64 nt, hsa
cacguguagcucacacacaguauacacauacacaagugcacagaccacacacagcacuaacaca

SEQ ID NO: 617866 - RNA, 64 nt, hsa
ccuuauggcaaagagcucccgcaguguuuguuagagugcacaucccuacgugcccacuggcaca

SEQ ID NO: 617867 - RNA, 64 nt, hsa; identical to SEQ ID NO: 504627

SEQ ID NO: 617868 - RNA, 64 nt, hsa; identical to SEQ ID NO: 504628

SEQ ID NO: 617869 - RNA, 64 nt, hsa; identical to SEQ ID NO: 504629

SEQ ID NO: 617870 - RNA, 64 nt, hsa; identical to SEQ ID NO: 504630

SEQ ID NO: 617871 - RNA, 64 nt, hsa; identical to SEQ ID NO: 504631

SEQ ID NO: 617872 - RNA, 64 nt, hsa; identical to SEQ ID NO: 504632

SEQ ID NO: 617873 - RNA, 64 nt, hsa; identical to SEQ ID NO: 504633

SEQ ID NO: 617874 - RNA, 64 nt, hsa; identical to SEQ ID NO: 504634

SEQ ID NO: 617875 - RNA, 64 nt, hsa; identical to SEQ ID NO: 504635

SEQ ID NO: 617876 - RNA, 64 nt, hsa; identical to SEQ ID NO: 504636

SEQ ID NO: 617877 - RNA, 64 nt, hsa; identical to SEQ ID NO: 504637

SEQ ID NO: 617878 - RNA, 64 nt, hsa; identical to SEQ ID NO: 504638

SEQ ID NO: 617879 - RNA, 64 nt, hsa; identical to SEQ ID NO: 504639

SEQ ID NO: 617880 - RNA, 64 nt, hsa; identical to SEQ ID NO: 504640

SEQ ID NO: 617881 - RNA, 64 nt, hsa; identical to SEQ ID NO: 504641

SEQ ID NO: 617882 - RNA, 64 nt, hsa; identical to SEQ ID NO: 504642

SEQ ID NO: 617883 - RNA, 64 nt, hsa; identical to SEQ ID NO: 504643

SEQ ID NO: 617884 - RNA, 64 nt, hsa; identical to SEQ ID NO: 504644

SEQ ID NO: 617885 - RNA, 64 nt, hsa; identical to SEQ ID NO: 504645

SEQ ID NO: 617886 - RNA, 64 nt, hsa; identical to SEQ ID NO: 504646

SEQ ID NO: 617887 - RNA, 64 nt, hsa; identical to SEQ ID NO: 504647

SEQ ID NO: 617888 - RNA, 64 nt, hsa; identical to SEQ ID NO: 504648

SEQ ID NO: 617889 - RNA, 64 nt, hsa; identical to SEQ ID NO: 504649

SEQ ID NO: 617890 - RNA, 64 nt, hsa; identical to SEQ ID NO: 504650

SEQ ID NO: 617891 - RNA, 64 nt, hsa; identical to SEQ ID NO: 504651

SEQ ID NO: 617892 - RNA, 64 nt, hsa; identical to SEQ ID NO: 504652

SEQ ID NO: 617893 - RNA, 64 nt, hsa; identical to SEQ ID NO: 504653

SEQ ID NO: 617894 - RNA, 64 nt, hsa; identical to SEQ ID NO: 504654

SEQ ID NO: 617895 - RNA, 64 nt, hsa; identical to SEQ ID NO: 504655

SEQ ID NO: 617896 - RNA, 64 nt, hsa; identical to SEQ ID NO: 504656

SEQ ID NO: 617897 - RNA, 64 nt, hsa; identical to SEQ ID NO: 504657

SEQ ID NO: 617898 - RNA, 64 nt, hsa; identical to SEQ ID NO: 504658

SEQ ID NO: 617899 - RNA, 64 nt, hsa; identical to SEQ ID NO: 504659

SEQ ID NO: 617900 - RNA, 64 nt, hsa; identical to SEQ ID NO: 504660

SEQ ID NO: 617901 - RNA, 64 nt, hsa; identical to SEQ ID NO: 504661

SEQ ID NO: 617902 - RNA, 64 nt, hsa; identical to SEQ ID NO: 504662

SEQ ID NO: 617903 - RNA, 64 nt, hsa; identical to SEQ ID NO: 504663

SEQ ID NO: 617904 - RNA, 64 nt, hsa; identical to SEQ ID NO: 504664

SEQ ID NO: 617905 - RNA, 64 nt, hsa; identical to SEQ ID NO: 504665

SEQ ID NO: 617906 - RNA, 64 nt, hsa; identical to SEQ ID NO: 504666

SEQ ID NO: 617907 - RNA, 64 nt, hsa; identical to SEQ ID NO: 504667

SEQ ID NO: 617908 - RNA, 64 nt, hsa; identical to SEQ ID NO: 504668

SEQ ID NO: 617909 - RNA, 64 nt, hsa; identical to SEQ ID NO: 504669

SEQ ID NO: 617910 - RNA, 64 nt, hsa; identical to SEQ ID NO: 504670

SEQ ID NO: 617911 - RNA, 64 nt, hsa; identical to SEQ ID NO: 504671

SEQ ID NO: 617912 - RNA, 64 nt, hsa; identical to SEQ ID NO: 504672

SEQ ID NO: 617913 - RNA, 64 nt, hsa; identical to SEQ ID NO: 216073

SEQ ID NO: 617914 - RNA, 64 nt, hsa; identical to SEQ ID NO: 216074

SEQ ID NO: 617915 - RNA, 64 nt, hsa; identical to SEQ ID NO: 216075

SEQ ID NO: 617916 - RNA, 64 nt, hsa; identical to SEQ ID NO: 216076

SEQ ID NO: 617917 - RNA, 64 nt, hsa; identical to SEQ ID NO: 216077

SEQ ID NO: 617918 - RNA, 64 nt, hsa; identical to SEQ ID NO: 216078

SEQ ID NO: 617919 - RNA, 64 nt, hsa; identical to SEQ ID NO: 216079

SEQ ID NO: 617920 - RNA, 64 nt, hsa; identical to SEQ ID NO: 216080

SEQ ID NO: 617921 - RNA, 64 nt, hsa; identical to SEQ ID NO: 216081

SEQ ID NO: 617922 - RNA, 64 nt, hsa; identical to SEQ ID NO: 216082

SEQ ID NO: 617923 - RNA, 64 nt, hsa; identical to SEQ ID NO: 216083

SEQ ID NO: 617924 - RNA, 64 nt, hsa; identical to SEQ ID NO: 216084

SEQ ID NO: 617925 - RNA, 64 nt, hsa; identical to SEQ ID NO: 216085

SEQ ID NO: 617926 - RNA, 64 nt, hsa; identical to SEQ ID NO: 216086

SEQ ID NO: 617927 - RNA, 64 nt, hsa; identical to SEQ ID NO: 216087

SEQ ID NO: 617928 - RNA, 64 nt, hsa; identical to SEQ ID NO: 216088

SEQ ID NO: 617929 - RNA, 64 nt, hsa; identical to SEQ ID NO: 216089

SEQ ID NO: 617930 - RNA, 64 nt, hsa; identical to SEQ ID NO: 216090

SEQ ID NO: 617931 - RNA, 64 nt, hsa; identical to SEQ ID NO: 216091

SEQ ID NO: 617932 - RNA, 64 nt, hsa; identical to SEQ ID NO: 216092

SEQ ID NO: 617933 - RNA, 64 nt, hsa; identical to SEQ ID NO: 216093

SEQ ID NO: 617934 - RNA, 64 nt, hsa; identical to SEQ ID NO: 216094

SEQ ID NO: 617935 - RNA, 64 nt, hsa; identical to SEQ ID NO: 216095

SEQ ID NO: 617936 - RNA, 64 nt, hsa; identical to SEQ ID NO: 216096

SEQ ID NO: 617937 - RNA, 64 nt, hsa; identical to SEQ ID NO: 216097

SEQ ID NO: 617938 - RNA, 64 nt, hsa; identical to SEQ ID NO: 216098

SEQ ID NO: 617939 - RNA, 64 nt, hsa; identical to SEQ ID NO: 216099

SEQ ID NO: 617940 - RNA, 64 nt, hsa; identical to SEQ ID NO: 216100

SEQ ID NO: 617941 - RNA, 64 nt, hsa; identical to SEQ ID NO: 216101

SEQ ID NO: 617942 - RNA, 64 nt, hsa; identical to SEQ ID NO: 216102

SEQ ID NO: 617943 - RNA, 64 nt, hsa; identical to SEQ ID NO: 216103

SEQ ID NO: 617944 - RNA, 64 nt, hsa; identical to SEQ ID NO: 216104

SEQ ID NO: 617945 - RNA, 64 nt, hsa; identical to SEQ ID NO: 216105

SEQ ID NO: 617946 - RNA, 64 nt, hsa; identical to SEQ ID NO: 216106

SEQ ID NO: 617947 - RNA, 64 nt, hsa; identical to SEQ ID NO: 216107

SEQ ID NO: 617948 - RNA, 64 nt, hsa; identical to SEQ ID NO: 216108

SEQ ID NO: 617949 - RNA, 64 nt, hsa; identical to SEQ ID NO: 216109

SEQ ID NO: 617950 - RNA, 64 nt, hsa; identical to SEQ ID NO: 216110

SEQ ID NO: 617951 - RNA, 64 nt, hsa; identical to SEQ ID NO: 216111

SEQ ID NO: 617952 - RNA, 64 nt, hsa; identical to SEQ ID NO: 216112

SEQ ID NO: 617953 - RNA, 64 nt, hsa; identical to SEQ ID NO: 216113

SEQ ID NO: 617954 - RNA, 64 nt, hsa; identical to SEQ ID NO: 216114

SEQ ID NO: 617955 - RNA, 64 nt, hsa; identical to SEQ ID NO: 216115

SEQ ID NO: 617956 - RNA, 64 nt, hsa; identical to SEQ ID NO: 216116

SEQ ID NO: 617957 - RNA, 64 nt, hsa; identical to SEQ ID NO: 216117

SEQ ID NO: 617958 - RNA, 64 nt, hsa; identical to SEQ ID NO: 216118

SEQ ID NO: 617959 - RNA, 64 nt, hsa; identical to SEQ ID NO: 216119

SEQ ID NO: 617960 - RNA, 64 nt, hsa; identical to SEQ ID NO: 216120

SEQ ID NO: 617961 - RNA, 64 nt, hsa; identical to SEQ ID NO: 216121

SEQ ID NO: 617962 - RNA, 64 nt, hsa; identical to SEQ ID NO: 216121

SEQ ID NO: 617963 - RNA, 64 nt, hsa; identical to SEQ ID NO: 216123

SEQ ID NO: 617964 - RNA, 64 nt, hsa; identical to SEQ ID NO: 216124

SEQ ID NO: 617965 - RNA, 64 nt, hsa; identical to SEQ ID NO: 216125

SEQ ID NO: 617966 - RNA, 64 nt, hsa; identical to SEQ ID NO: 216126

SEQ ID NO: 617967 - RNA, 64 nt, hsa; identical to SEQ ID NO: 216127

SEQ ID NO: 617968 - RNA, 64 nt, hsa; identical to SEQ ID NO: 216128

SEQ ID NO: 617969 - RNA, 64 nt, hsa; identical to SEQ ID NO: 216129

SEQ ID NO: 617970 - RNA, 64 nt, hsa; identical to SEQ ID NO: 216130

SEQ ID NO: 617971 - RNA, 64 nt, hsa; identical to SEQ ID NO: 216131

SEQ ID NO: 617972 - RNA, 64 nt, hsa; identical to SEQ ID NO: 216132

SEQ ID NO: 617973 - RNA, 64 nt, hsa; identical to SEQ ID NO: 216133

SEQ ID NO: 617974 - RNA, 64 nt, hsa; identical to SEQ ID NO: 216134

SEQ ID NO: 617975 - RNA, 64 nt, hsa; identical to SEQ ID NO: 216135

SEQ ID NO: 617976 - RNA, 64 nt, hsa; identical to SEQ ID NO: 216136

SEQ ID NO: 617977 - RNA, 64 nt, hsa; identical to SEQ ID NO: 216137

SEQ ID NO: 617978 - RNA, 64 nt, hsa; identical to SEQ ID NO: 216138

SEQ ID NO: 617979 - RNA, 64 nt, hsa; identical to SEQ ID NO: 216139

SEQ ID NO: 617980 - RNA, 64 nt, hsa; identical to SEQ ID NO: 216140

SEQ ID NO: 617981 - RNA, 64 nt, hsa; identical to SEQ ID NO: 216141

SEQ ID NO: 617982 - RNA, 64 nt, hsa; identical to SEQ ID NO: 216142

SEQ ID NO: 617983 - RNA, 64 nt, hsa; identical to SEQ ID NO: 216143

SEQ ID NO: 617984 - RNA, 64 nt, hsa
agaccagccuggccaauaugaugaaaccccgucucuacuaaaaauacaaaauuagucggguaug

SEQ ID NO: 617985 - RNA, 64 nt, hsa
agaccagccuggccaacauggugaaaccccgucucuacuaaaaauacaaaaaguagccaggcgu

SEQ ID NO: 617986 - RNA, 64 nt, hsa
agaacauccuggcuaacacggugaaacuccaucucuacuaaaaauacaaaaaauuggccgggcg

SEQ ID NO: 617987 - RNA, 64 nt, hsa
agaucauccuggccaacauggugacaccccgucucuacuaaaaauacaaaaauuacccaggcau

SEQ ID NO: 617988 - RNA, 64 nt, hsa
aaccacccugggcaacauggugaaacccccgucucuacuaaaauacaaaaaaauuagccaggca

SEQ ID NO: 617989 - RNA, 64 nt, hsa
acugccaggugacgcccucgcugcuccuaccuggcuacuaaacaucgacuucgguucacuucac

SEQ ID NO: 617990 - RNA, 64 nt, hsa
agaccauccuggcuaacauggugaaacccugucucuacuaaaaauacaaaaaaaauuagccagc

SEQ ID NO: 617991 - RNA, 64 nt, hsa
agaccauccuggcgaacacggugaaaccccgucucuacuaaaaaaaauacaaaaaaauuagcca

SEQ ID NO: 617992 - RNA, 64 nt, hsa
agaccagccugaccaacauggcgaaaccccaucucuacuaaaaauacaaaaauuagccuggcau

SEQ ID NO: 617993 - RNA, 64 nt, hsa
agaucagucugggcaacacgaugaaacuccgucucuacuaaaauacaaaaaauuauccaggcau

SEQ ID NO: 617994 - RNA, 64 nt, hsa
agaccagccugaccaacacggagaaaccccgucucuacuaaaaauacagaauuagucaggcgug

SEQ ID NO: 617995 - RNA, 64 nt, hsa
agaucaaccuggccaacauacugaaaccccgucucuacuaaaaauaagaaaaauuagcugggcg

SEQ ID NO: 617996 - RNA, 64 nt, hsa
agaccaaccuggucagcauggcaaaaccccgucucuacuaaaaguacaaaaauuagccaggcgu

SEQ ID NO: 617997 - RNA, 64 nt, hsa
auuaaggaaugcugaugaacaauuuugcuaucgacuacuaaaugagagauuuucagaccccugg

SEQ ID NO: 617998 - RNA, 64 nt, hsa
agaccagccuggccaacauggcaaaaccacaucucuacuaaaaauaaaaaaauuagcugggugu

SEQ ID NO: 617999 - RNA, 64 nt, hsa
cucacuggcugaaggaggaaauuuuagaaggaagcuacuaaaagaucuaauuugaaaaacuaca

SEQ ID NO: 618000 - RNA, 64 nt, hsa
agaccagccuggccaacauggugaaacccugucucuacuaaaaauacaaaaauuagccaggugu

SEQ ID NO: 618001 - RNA, 64 nt, hsa
agaccauccuggcuaacauggugaaaccccgucucuacuaaaaauacaaaaaauuagccaggcg

SEQ ID NO: 618002 - RNA, 64 nt, hsa
agaccagccugacuaacauggugaaaucccgucucuacuaaaaauacaaaaaaaaaaaaaaaaa

SEQ ID NO: 618003 - RNA, 64 nt, hsa
agaccauccuggccaacauggugaaauccugccucuacuaaaaauacaaaaaaaaaaaaaaauu

SEQ ID NO: 618004 - RNA, 64 nt, hsa
agaucagccuggccaacauggugaaaccccaucucuacuaaaaauacaaaaauuagccggacgc

SEQ ID NO: 618005 - RNA, 64 nt, hsa
agaucauccuggccaacauggugaaacccugucucuacuaaaaauacaaaaaugagcugggcau

SEQ ID NO: 618006 - RNA, 64 nt, hsa
agaccagccugaccaacauggagaaaccccgucucuacuaaaaauacaaaaauauuagccgggc

SEQ ID NO: 618007 - RNA, 64 nt, hsa
agaucacccuggcccacauggugagaccccaacucuacuaaaaauacaaaaauuagcugggugu

SEQ ID NO: 618008 - RNA, 64 nt, hsa
gccuuugaauaugcagacaaccuuugaauugugccuacuaaauuauagcaggggacuuuggcac

SEQ ID NO: 618009 - RNA, 64 nt, hsa
uaaaguaaaccucuucccguggaagcacacucuacuacuaaagggaaggcccugggcucugauu

SEQ ID NO: 618010 - RNA, 64 nt, hsa
agaccauccuggcuaacacggugaaaccccgucucuacuaaaaauacaaaaaaaauuagucgga

SEQ ID NO: 618011 - RNA, 64 nt, hsa
aauaugauuuuaugugaagugccauuucuuuauucuacuaaagagagacagcagaaauaaagau

SEQ ID NO: 618012 - RNA, 64 nt, hsa
ugagaccagccuggccaacauggcaaaaccaucucuacuaaaaauagaaaaauuagccaggcac

SEQ ID NO: 618013 - RNA, 64 nt, hsa
aggaguuucagaccaauauggugaaaccccaucucuacuaaaauuacaaaaaaaauuauccagg

SEQ ID NO: 618014 - RNA, 64 nt, hsa
gucuugguaauugcaauuuaacuaggugcgguggcuacuaaaguucgaaggcacgauaugcgug

SEQ ID NO: 618015 - RNA, 64 nt, hsa
uaaaucuucuauuauuauguacuaugauuuauuccuacuaaaacauaaauuagucaauuugggg

SEQ ID NO: 618016 - RNA, 64 nt, hsa
gauguugcuagugcaguguuucacaauucauuuucuacuaaauguguaccauuuuuuaaauugu

SEQ ID NO: 618017 - RNA, 64 nt, hsa
agggcagccugaccaacauagugaaaccccaucucuacuaaaaauacaaaaauuagcugggcgu

SEQ ID NO: 618018 - RNA, 64 nt, hsa
agaccagccuggccaacauggugaaaccuugucucuacuaaaaauacaaaaauuagccaggcgu

SEQ ID NO: 618019 - RNA, 64 nt, hsa
agaccagccugaccaacacggagaaacccuaucucuacuaaaaauacaaaaguagccgggcgug

SEQ ID NO: 618020 - RNA, 64 nt, hsa
agacuagccuggccaacauggugaaaccccgucucuacuaaaaauacaaaaauuagccgggcau

SEQ ID NO: 618021 - RNA, 64 nt, hsa
agaccaggcugggcaucauagcaagaccucaucucuacuaaaauucaaaaacaaaauuagccgg

SEQ ID NO: 618022 - RNA, 64 nt, hsa
gaccagccuguccaacauggugaaacccccaucucuacuaaaaauaccaaaaauuagccgagcg

SEQ ID NO: 618023 - RNA, 64 nt, hsa
agaccauccuggccaacauggugaaaccccgucucuacuaaaaauacaaaaauuagcugggcau

SEQ ID NO: 618024 - RNA, 64 nt, hsa
agaccagccuggccaacauggcaaaaucccaucucuacuaaaaauacaaaaauucacagggugu

SEQ ID NO: 618025 - RNA, 64 nt, hsa
agaccauccugaccaacguggugaaaccccaucucuacuaaaaauagaaaaaucagcugggugu

SEQ ID NO: 618026 - RNA, 64 nt, hsa
agaccagccuggucaagauggugaaaccccaucucuacuaaaauuacaaaaauuagccgggugu

SEQ ID NO: 618027 - RNA, 64 nt, hsa
aaaccagccuggccaacauggugaaaccccaucucuacuaaaaaaacaaaacuagcugggggug

SEQ ID NO: 618028 - RNA, 64 nt, hsa
agaccagccuggccaacauggcaaaaccccgucucuacuaaaaaauacagaaauuagcugggug

SEQ ID NO: 618029 - RNA, 64 nt, hsa
agaccagccugaccaacauggcgaaaccccaucucuacuaaaaauacaaaaauuagcuuggcau

SEQ ID NO: 618030 - RNA, 64 nt, hsa
agaccagccugacuaacauggagaaaccccaucucuacuaaaaauacaaaaugagcugggcgug

SEQ ID NO: 618031 - RNA, 64 nt, hsa
agaccauccuggccaacauggugaaaccccgucucuacuaaaauacaaaaaauuagcugggugu

SEQ ID NO: 618032 - RNA, 64 nt, hsa
agaccagucuggccaacauggggaaaccccgucucuacuaaaaauacaaaaauuagccgggcau

SEQ ID NO: 618033 - RNA, 64 nt, hsa
agaccagccuggccaauguggugaaaccccaucucuacuaaaaauacaaaaauuagcugggcgu

SEQ ID NO: 618034 - RNA, 64 nt, hsa
agaccagccuggccaacacggugaaaccccgccucuacuaaaaauacaaaaaauagccgggugu

SEQ ID NO: 618035 - RNA, 64 nt, hsa
agaccagccuggucaacguggugaaacgccguuucuacuaaaaauaugaaaauuaguugggugu

SEQ ID NO: 618036 - RNA, 64 nt, hsa
ugaagugucuccccaacacuagcaaaucuagguccuacuaaauacaaaucucuggguggaugau

SEQ ID NO: 618037 - RNA, 64 nt, hsa
gaccagccugacaaaacauagugaaaccccgucucuacuaaaaauacaaaaauuagcugggcgu

SEQ ID NO: 618038 - RNA, 64 nt, hsa
agaccagccuggccaacauggugaaaccccaucucuacuaaacaugcaaaaauuaccugggcau

SEQ ID NO: 618039 - RNA, 64 nt, hsa
agaccagccuggccaacguggugaaacgcugucucuacuaaaauacaaaaaaauagggcugggc

SEQ ID NO: 618040 - RNA, 64 nt, hsa
uuuuaagaaaacauguggccuuuuauuaauaacacuacuaaauuuugguuccuccauagaauua

SEQ ID NO: 618041 - RNA, 64 nt, hsa
agaccauccuggccaacauggugaaacccugucucuacuaaaaauacaaaaauagcugggcaug

SEQ ID NO: 618042 - RNA, 64 nt, hsa
agaccagccuggguaauauggcaagagcccaacucuacuaaaaauacaaaaagaaaagaaaaca

SEQ ID NO: 618043 - RNA, 64 nt, hsa
agaccagacuggccaacauggugaaaccccgucucuacuaaaaaaaaaaaauagacaaaaauua

SEQ ID NO: 618044 - RNA, 64 nt, hsa
agacccuccuggcuaacaccgugaaaccccgucucuacuaaaaauacaaaaaauuagccgggcg

SEQ ID NO: 618045 - RNA, 64 nt, hsa
agaccagccuggccaacacggugaaaccccaucucuacuaaaaaaaaauacaaaaauuagccgg

SEQ ID NO: 618046 - RNA, 64 nt, hsa
agaccagccuggccaacauggugaaaccccaucucuacuaaaaaaaaaaaaaaaauuagucggg

SEQ ID NO: 618047 - RNA, 64 nt, hsa
aaaccagccugaccaacauggugaaacccugucucuacuaaauauuagcggggugugguggcgg

SEQ ID NO: 618048 - RNA, 64 nt, hsa
agaucagccugaccaacauggugaaacccuaucucuacuaaaaauauagaauuagccaggcaug

SEQ ID NO: 618049 - RNA, 64 nt, hsa
agaccagccuggccaacauggugaaaccccaucgcuacuaaaaauauaaaaaauuagcugggca

SEQ ID NO: 618050 - RNA, 64 nt, hsa
agaccaucauugcuaacauggugaaaccccgucucuacuaaaaauacaaaaaaaaaaaaaaaac

SEQ ID NO: 618051 - RNA, 64 nt, hsa
agaccagccugaccaacauggagaaacccugucucuacuaaaaauacaaaauuagccaggcgug

SEQ ID NO: 618052 - RNA, 64 nt, hsa
aaacauacuccuaaaaacauuuuccgggauuuuacuacuaaaauuggacauuuaagcgaaguaa

SEQ ID NO: 618053 - RNA, 64 nt, hsa
agaccagccuggccaacauggcgaaaccccaucucuacuaaaaauacaaaaauuagccgggcgu

SEQ ID NO: 618054 - RNA, 64 nt, hsa
agaccagccuggccaauauggugaaaccccaucucuacuaaaaauauaaaaaucagcaaaaaaa

SEQ ID NO: 618055 - RNA, 64 nt, hsa
gcugccaagggguuaaaauugggaaccuaaguugcuacuaaaucauaguucaaaaccuaauaau

SEQ ID NO: 618056 - RNA, 64 nt, hsa
acacagcucuugggaguacaguucucuacguucucuacuaaaucuuaauaaaugcuugacauag

SEQ ID NO: 618057 - RNA, 64 nt, hsa
agacccuccuggccaacauggugaaaccccgucucuacuaaaauacaaaaaauuagcugggcau

SEQ ID NO: 618058 - RNA, 64 nt, hsa
agaccacccugaccaacuuggugaaaucccaucucuacuaaaaauacaaaaauuagcugggugc

SEQ ID NO: 618059 - RNA, 64 nt, hsa
agaccauccugucuaacacggugaaaccccaucucuacuaaaaauacaaaaaaauuagucggac

SEQ ID NO: 618060 - RNA, 64 nt, hsa
agaccagccuggccaacauggugaaaccccaucucuacuaaaaauacaaaaauuagcuaggcgg

SEQ ID NO: 618061 - RNA, 64 nt, hsa
agaccagccuggccaacauggugaaaccccaucucuacuaaaaaauacaaaaauuagccaggca

SEQ ID NO: 618062 - RNA, 64 nt, hsa
gaccagccuggccaacaugaugagaccuccgucucuacuaaaauacauaaauuagccgggugug

SEQ ID NO: 618063 - RNA, 64 nt, hsa
agaccacccuggccaacauggugaaaccccaucucuacuaaaacaaaaauuagccaggcauggu

SEQ ID NO: 618064 - RNA, 64 nt, hsa
agaccagccuggccaacauagugaaaccccaucucuacuaaaaauacagaaauuagccgggcau

SEQ ID NO: 618065 - RNA, 64 nt, hsa
agaccauccuggccaacaugaugaaacccuaucucuacuaaaaauacaaaaauuagccgggcau

SEQ ID NO: 618066 - RNA, 64 nt, hsa
agaccauccuggcuaacacggugaaaccccaucucuacuaaaaauacaaaaaccaaaaaaaauu

SEQ ID NO: 618067 - RNA, 64 nt, hsa
agagcacccuggcuaacauggugaaaccccaucucuacuaaaaauacaaaaguuagccgggggg

SEQ ID NO: 618068 - RNA, 64 nt, hsa
agaccguccuggcuaacacggugaaaccccaucucuacuaaaaauauaaaauauuagccaggcg

SEQ ID NO: 618069 - RNA, 64 nt, hsa
ccugucagguggucugcaaagaugauaaccuugacuacuaaaaacgucuccauggcggggguaa

SEQ ID NO: 618070 - RNA, 64 nt, hsa
agaccagucuggccaacauagcaaaacccugucucuacuaaaaauacaaaaauuaucugggcau

SEQ ID NO: 618071 - RNA, 64 nt, hsa
agaccagccuggccaacauggugaaaccccaucucuacuaaaaauacaaaaauuagcugggcgu

SEQ ID NO: 618072 - RNA, 64 nt, hsa
gaacuggccuggccaacauagcaaaaccucaucucuacuaaaauacaaaaauuagccgggcgug

SEQ ID NO: 618073 - RNA, 64 nt, hsa
agaccauccuggccaacauggugaaaccccgucucuacuaaaaauauaaaaauuagcugggugu

SEQ ID NO: 618074 - RNA, 64 nt, hsa
agaccagccuggccaacaaggcaaaaccccgucucuacuaaaaauaugaaaauuagcugggcuu

SEQ ID NO: 618075 - RNA, 64 nt, hsa
cagccuggccaaccaacauggugaaaccucgugucuacuaaaaauacaagaaacuagccagaug

SEQ ID NO: 618076 - RNA, 64 nt, hsa
agaccagccuggccaacauggcgaaaccccgucucuacuaaaaauacaaaaauuagccaggacu

SEQ ID NO: 618077 - RNA, 64 nt, hsa
ugugccaguaaucccagcuacuugggaggcugaggcgcgagaaucgcuugaacccuggagaugg

SEQ ID NO: 618078 - RNA, 64 nt, hsa
ccgaccacggcgaagcaauagagggggugcuggagcgcgagaggcuggcugauugugaccgaaa

SEQ ID NO: 618079 - RNA, 64 nt, hsa
cuuaaagugaugauuucaaaccuccugaauauuugcgcgagacuuuuuucuuaggaaagaaaaa

SEQ ID NO: 618080 - RNA, 64 nt, hsa
gaaaaaccacaaagaaacaccaggcguaccuggugcgcgagagcguauccccaacugggacuuc

SEQ ID NO: 618081 - RNA, 64 nt, hsa
uucuagagacaauggagagagaaagagagagagagcgcgagagagaucaagacccaaguuuuga

SEQ ID NO: 618082 - RNA, 64 nt, hsa
uagguccucccacaccugcccccuaauaaagugggcgcgagaggaggcugcuguguguuuccug

SEQ ID NO: 618083 - RNA, 64 nt, hsa
ugauucaggcuggacagccuggacauuuugagcagcgcgagaguagaagugaauacccccagga

SEQ ID NO: 618084 - RNA, 64 nt, hsa
cgcuggaggcccggugugguuccgccucggcgaggcgcgagacaggcgcugcugcucacgugga

SEQ ID NO: 618085 - RNA, 64 nt, hsa
uguauguggugugcacauguggccagaggugugugcgcgagaccgacacugugaucccugugcu

SEQ ID NO: 618086 - RNA, 64 nt, hsa
ucucgcguggagggcugucguuugaacucucccagcgcgagagacccugccccgcccccuuccu

SEQ ID NO: 618087 - RNA, 64 nt, hsa
uggguguacagguggguuugggagagaggagcaugcgcgagagagucuccgagugugugcgacg

SEQ ID NO: 618088 - RNA, 64 nt, hsa
cccguuccguaggcaauaacgugcguccgccucagcgcgagauuaggaguucaaacaaugguga

SEQ ID NO: 618089 - RNA, 64 nt, hsa
cccugcagccacgcaccucccggugagaagcagagcgcgagagggagcccuccguaacugccca

SEQ ID NO: 618090 - RNA, 64 nt, hsa
ggcuuccccagccugcggccgcaagcaaaaccaagcgcgagaugcagcuagcacccuucauauc

SEQ ID NO: 618091 - RNA, 59 nt, hsa
cacgugcccacuugggaugcagaaugcagcggagcuaggacccccuccacggccuggac

SEQ ID NO: 618092 - RNA, 59 nt, hsa
guccuuccucacccccuccaauauagucucggagcuacaaccgcagcagccacuauaaa

SEQ ID NO: 618093 - RNA, 59 nt, hsa
gccccaacucggaguccuccagugaucuccggagcuaguucccugcccucacacccugu

SEQ ID NO: 618094 - RNA, 59 nt, hsa
acugucaaggccucauuugcagaggccaccggagcuagggcacuagccugacuuuuaag

SEQ ID NO: 618095 - RNA, 59 nt, hsa
uuauauaaauauagauauaauuuuauuuucggagcuaagaugguguuauuuaagggugg

SEQ ID NO: 618096 - RNA, 59 nt, hsa
gaauugugagucugccccucaggggaauucggagcuagaggacauggaaaauaaagcca

SEQ ID NO: 618097 - RNA, 59 nt, hsa
uaaacaaaaccuuugggugguaaugacuacggagcuaaaguuggggugacaaggauggg

SEQ ID NO: 618098 - RNA, 59 nt, hsa
gcauccucucuccaggucugcucccuuaccggagcuaggauaagguagcaugagugaca

SEQ ID NO: 618099 - RNA, 59 nt, hsa
guguggcugggcuacaucauagcucaucacggagcuacgacuuuggguacugcggacag

SEQ ID NO: 618100 - RNA, 59 nt, hsa
uuuugcaccagacgaacagugaggaaauucggagcuauacauaugugcagaagguuacu

SEQ ID NO: 618101 - RNA, 59 nt, hsa
ggaggaccgagggguugggggccuucuaccggagcuacaccacgcagcugaccaugaac

SEQ ID NO: 618102 - RNA, 59 nt, hsa
gaacaugaaagaaauaaacaggaguucagcggagcuagcagaagacaaggcauguaggg

SEQ ID NO: 618103 - RNA, 59 nt, hsa
aagugcccuugcaagagccuuuaacuuggcggagcuaaggagaucuuauucuaccaugg

SEQ ID NO: 618104 - RNA, 59 nt, hsa
ugcagccggaggguccuaagaauggcucccggagcuaacugagggcccagccuuuuuuc

SEQ ID NO: 618105 - RNA, 59 nt, hsa
ugcucucugaggcagccgcgccucugacucggagcuacuugaaacuucugcucuugcua

SEQ ID NO: 618106 - RNA, 59 nt, hsa
aagcucuggaaauccucaccaaagcccuccggagcuaccaguuagggaucggcagggac

SEQ ID NO: 618107 - RNA, 59 nt, hsa
ucggcccagccccagccugccggagcccacggagcuaccucuaccuccacuccugccac

SEQ ID NO: 618108 - RNA, 59 nt, hsa
gagaggacugggccugauggaaguuaacccggagcuaagucacccagagcacaggagcu

SEQ ID NO: 618109 - RNA, 59 nt, hsa
agaugguguccucggauaaugaucugccccggagcuagggcagcaacaugaggaccaaa

SEQ ID NO: 618110 - RNA, 59 nt, hsa
agggcuggagggaagggcacaggggcgcccggagcuaagauguggugcuuuucuugguu

SEQ ID NO: 618111 - RNA, 59 nt, hsa
gugccugcgaggccaaguugcccacccugcggagcuaggaggcgcgagcagagaacgug

SEQ ID NO: 618112 - RNA, 59 nt, hsa
ugagacagcuccagcuucgcagcccuucccggagcuacagggggauccucuagcauggg

SEQ ID NO: 618113 - RNA, 59 nt, hsa
gacagccugggccucuaacagcuuuuguccggagcuagacuucguguccuuucaguugg

SEQ ID NO: 618114 - RNA, 59 nt, hsa
acggaccuugugauuuguacuguuugcugcggagcuauuuaaagauuuuggaauaaaua

SEQ ID NO: 618115 - RNA, 59 nt, hsa
caugccgcuuggagaagggguggccucgccggagcuagggagcggauguggugggcugg

SEQ ID NO: 618116 - RNA, 59 nt, hsa
acaagagcuucugggaagguaagcggcaucggagcuagaucacguuucacaauuagugg

SEQ ID NO: 618117 - RNA, 59 nt, hsa
uuuuguuuuuaacaaauccccuccuuaaacggagcuauaagguggccaaaucugagaac

SEQ ID NO: 618118 - RNA, 59 nt, hsa
gucugcugcccuccaucccgacauggacccggagcuaacacuggccccuagaaucagcc

SEQ ID NO: 618119 - RNA, 59 nt, hsa
gccuggauccugucgaucuuuacuuguggcggagcuaauggucacauugauaguugauu

SEQ ID NO: 618120 - RNA, 59 nt, hsa; identical to SEQ ID NO: 618116

SEQ ID NO: 618121 - RNA, 59 nt, hsa
ucagccuucaggccugagcaagugcagggcggagcuaccagcccaggcucagauguugg

SEQ ID NO: 618122 - RNA, 59 nt, hsa
acccaccucgcucccagccccaggaccugcggagcuacguuuugcagggcucaguacga

SEQ ID NO: 618123 - RNA, 59 nt, hsa
cugucauucucuagaacacauccaggugucggagcuaagguguucagcucggcugugac

SEQ ID NO: 618124 - RNA, 59 nt, hsa
ccuuugcugaccguuuugggguuccccgccggagcuacaggggcauuuucuucccuaaa

SEQ ID NO: 618125 - RNA, 59 nt, hsa
agcucaucccucccuccaagcccccgaugcggagcuagggcuggagcucugcccaggug

SEQ ID NO: 618126 - RNA, 64 nt, hsa; identical to SEQ ID NO: 310683

SEQ ID NO: 618127 - RNA, 64 nt, hsa; identical to SEQ ID NO: 310684

SEQ ID NO: 618128 - RNA, 64 nt, hsa
cccaggaggcauuccacacaggcacugccccaggacaacacaacaaggacagucacaacaagga

SEQ ID NO: 618129 - RNA, 64 nt, hsa
caacaaggacagucacaacaaggacaacaaggacacaacacaacacacaacaaggacagucaca

SEQ ID NO: 618130 - RNA, 64 nt, hsa
aggacagucacaacaaggacaacaaggacacaacacaacacacaacaaggacagucacaacaag

SEQ ID NO: 618131 - RNA, 64 nt, hsa
caagugcugucuaccaucaacaccaaccagaugaacaacacacacgcugcuguaucucccugug

SEQ ID NO: 618132 - RNA, 64 nt, hsa
aacaauaucagcggauucggaaggagaagccucaacaacacaacuucacccaccgccuccuggc

SEQ ID NO: 618133 - RNA, 64 nt, hsa
aucaaguuaaugaaaauggagaaacugguggacaacaacacagcauugguugacaaauugaagc

SEQ ID NO: 618134 - RNA, 64 nt, hsa
auguguguuuuccgcagcgggaggaagcacugaaacaacacaaaacccuaucucaagaacuugu

SEQ ID NO: 618135 - RNA, 64 nt, hsa
cccaugauucaauuaccucccccgggucccucccacaacacaugggaauucugagagauaccau

SEQ ID NO: 618136 - RNA, 64 nt, hsa
acugccaaguuaguauuguuagagauuucauuuuacaacacaaaaauaagccugugucaaagau

SEQ ID NO: 618137 - RNA, 64 nt, hsa
ccaugccaggagagaacccacgcacaugcacaccacaacacacaacacaccucaccucacacca

SEQ ID NO: 618138 - RNA, 64 nt, hsa
aggagagaacccacgcacaugcacaccacaacacacaacacaccucaccucacaccacagcaca

SEQ ID NO: 618139 - RNA, 64 nt, hsa
ccacaucucaccacaccacagcacaccucaccacacaacacaccacaccccacaccgcacugca

SEQ ID NO: 618140 - RNA, 64 nt, hsa
uuuguuuugucuaaaguguggcaagacauagugcacaacacagggacaaaggcagguuuccugc

SEQ ID NO: 618141 - RNA, 64 nt, hsa
ugguacagauucauguuucugauuuaaaaaaacaacaacacaggauugaauuaaguagaguaau

SEQ ID NO: 618142 - RNA, 64 nt, hsa
gcaagugacuagacucgcgcuaauacagugcuggacaacacauucaccuuuucugugaacaggc

SEQ ID NO: 618143 - RNA, 64 nt, hsa
cacaucucaguauauguagggaccccaaaugaccacaacacaguacaauugcccuuuaccuagg

SEQ ID NO: 618144 - RNA, 64 nt, hsa; identical to SEQ ID NO: 364007

SEQ ID NO: 618145 - RNA, 64 nt, hsa; identical to SEQ ID NO: 364008

SEQ ID NO: 618146 - RNA, 64 nt, hsa; identical to SEQ ID NO: 364009

SEQ ID NO: 618147 - RNA, 64 nt, hsa; identical to SEQ ID NO: 364010

SEQ ID NO: 618148 - RNA, 64 nt, hsa; identical to SEQ ID NO: 364011

SEQ ID NO: 618149 - RNA, 64 nt, hsa; identical to SEQ ID NO: 364012

SEQ ID NO: 618150 - RNA, 64 nt, hsa; identical to SEQ ID NO: 364013

SEQ ID NO: 618151 - RNA, 64 nt, hsa; identical to SEQ ID NO: 364014

SEQ ID NO: 618152 - RNA, 64 nt, hsa; identical to SEQ ID NO: 364015

SEQ ID NO: 618153 - RNA, 64 nt, hsa; identical to SEQ ID NO: 364016

SEQ ID NO: 618154 - RNA, 64 nt, hsa; identical to SEQ ID NO: 364017

SEQ ID NO: 618155 - RNA, 64 nt, hsa; identical to SEQ ID NO: 364018

SEQ ID NO: 618156 - RNA, 64 nt, hsa; identical to SEQ ID NO: 364019

SEQ ID NO: 618157 - RNA, 64 nt, hsa; identical to SEQ ID NO: 364020

SEQ ID NO: 618158 - RNA, 64 nt, hsa; identical to SEQ ID NO: 364021

SEQ ID NO: 618159 - RNA, 64 nt, hsa; identical to SEQ ID NO: 364022

SEQ ID NO: 618160 - RNA, 64 nt, hsa; identical to SEQ ID NO: 364023

SEQ ID NO: 618161 - RNA, 64 nt, hsa; identical to SEQ ID NO: 364024

SEQ ID NO: 618162 - RNA, 64 nt, hsa; identical to SEQ ID NO: 364025

SEQ ID NO: 618163 - RNA, 64 nt, hsa; identical to SEQ ID NO: 364026

SEQ ID NO: 618164 - RNA, 64 nt, hsa; identical to SEQ ID NO: 364027

SEQ ID NO: 618165 - RNA, 64 nt, hsa; identical to SEQ ID NO: 364028

SEQ ID NO: 618166 - RNA, 64 nt, hsa; identical to SEQ ID NO: 364029

SEQ ID NO: 618167 - RNA, 64 nt, hsa; identical to SEQ ID NO: 364030

SEQ ID NO: 618168 - RNA, 64 nt, hsa; identical to SEQ ID NO: 364031

SEQ ID NO: 618169 - RNA, 64 nt, hsa; identical to SEQ ID NO: 364032

SEQ ID NO: 618170 - RNA, 64 nt, hsa; identical to SEQ ID NO: 364033

SEQ ID NO: 618171 - RNA, 64 nt, hsa; identical to SEQ ID NO: 364034

SEQ ID NO: 618172 - RNA, 64 nt, hsa; identical to SEQ ID NO: 364035

SEQ ID NO: 618173 - RNA, 64 nt, hsa; identical to SEQ ID NO: 364036

SEQ ID NO: 618174 - RNA, 64 nt, hsa; identical to SEQ ID NO: 364037

SEQ ID NO: 618175 - RNA, 64 nt, hsa; identical to SEQ ID NO: 364038

SEQ ID NO: 618176 - RNA, 64 nt, hsa; identical to SEQ ID NO: 364039

SEQ ID NO: 618177 - RNA, 64 nt, hsa; identical to SEQ ID NO: 364040

SEQ ID NO: 618178 - RNA, 64 nt, hsa; identical to SEQ ID NO: 364041

SEQ ID NO: 618179 - RNA, 64 nt, hsa; identical to SEQ ID NO: 364042

SEQ ID NO: 618180 - RNA, 64 nt, hsa; identical to SEQ ID NO: 364043

SEQ ID NO: 618181 - RNA, 64 nt, hsa; identical to SEQ ID NO: 364044

SEQ ID NO: 618182 - RNA, 64 nt, hsa; identical to SEQ ID NO: 364045

SEQ ID NO: 618183 - RNA, 64 nt, hsa; identical to SEQ ID NO: 364046

SEQ ID NO: 618184 - RNA, 64 nt, hsa; identical to SEQ ID NO: 364047

SEQ ID NO: 618185 - RNA, 64 nt, hsa; identical to SEQ ID NO: 364048

SEQ ID NO: 618186 - RNA, 64 nt, hsa; identical to SEQ ID NO: 364049

SEQ ID NO: 618187 - RNA, 64 nt, hsa; identical to SEQ ID NO: 364050

SEQ ID NO: 618188 - RNA, 64 nt, hsa; identical to SEQ ID NO: 364051

SEQ ID NO: 618189 - RNA, 64 nt, hsa; identical to SEQ ID NO: 364052

SEQ ID NO: 618190 - RNA, 64 nt, hsa; identical to SEQ ID NO: 364053

SEQ ID NO: 618191 - RNA, 64 nt, hsa; identical to SEQ ID NO: 364054

SEQ ID NO: 618192 - RNA, 64 nt, hsa; identical to SEQ ID NO: 364055

SEQ ID NO: 618193 - RNA, 64 nt, hsa; identical to SEQ ID NO: 364056

SEQ ID NO: 618194 - RNA, 64 nt, hsa; identical to SEQ ID NO: 364057

SEQ ID NO: 618195 - RNA, 64 nt, hsa; identical to SEQ ID NO: 364058

SEQ ID NO: 618196 - RNA, 64 nt, hsa; identical to SEQ ID NO: 364059

SEQ ID NO: 618197 - RNA, 64 nt, hsa; identical to SEQ ID NO: 364060

SEQ ID NO: 618198 - RNA, 64 nt, hsa; identical to SEQ ID NO: 364061

SEQ ID NO: 618199 - RNA, 64 nt, hsa; identical to SEQ ID NO: 364062

SEQ ID NO: 618200 - RNA, 64 nt, hsa; identical to SEQ ID NO: 364063

SEQ ID NO: 618201 - RNA, 64 nt, hsa; identical to SEQ ID NO: 364064

SEQ ID NO: 618202 - RNA, 64 nt, hsa; identical to SEQ ID NO: 364065

SEQ ID NO: 618203 - RNA, 64 nt, hsa; identical to SEQ ID NO: 364066

SEQ ID NO: 618204 - RNA, 64 nt, hsa; identical to SEQ ID NO: 364067

SEQ ID NO: 618205 - RNA, 64 nt, hsa; identical to SEQ ID NO: 364068

SEQ ID NO: 618206 - RNA, 64 nt, hsa; identical to SEQ ID NO: 364069

SEQ ID NO: 618207 - RNA, 64 nt, hsa; identical to SEQ ID NO: 364070

SEQ ID NO: 618208 - RNA, 64 nt, hsa; identical to SEQ ID NO: 364071

SEQ ID NO: 618209 - RNA, 64 nt, hsa; identical to SEQ ID NO: 364072

SEQ ID NO: 618210 - RNA, 64 nt, hsa; identical to SEQ ID NO: 364073

SEQ ID NO: 618211 - RNA, 64 nt, hsa; identical to SEQ ID NO: 364074

SEQ ID NO: 618212 - RNA, 64 nt, hsa; identical to SEQ ID NO: 364075

SEQ ID NO: 618213 - RNA, 64 nt, hsa; identical to SEQ ID NO: 364076

SEQ ID NO: 618214 - RNA, 64 nt, hsa; identical to SEQ ID NO: 364077

SEQ ID NO: 618215 - RNA, 64 nt, hsa; identical to SEQ ID NO: 364078

SEQ ID NO: 618216 - RNA, 64 nt, hsa; identical to SEQ ID NO: 364079

SEQ ID NO: 618217 - RNA, 64 nt, hsa; identical to SEQ ID NO: 364080

SEQ ID NO: 618218 - RNA, 64 nt, hsa; identical to SEQ ID NO: 364081

SEQ ID NO: 618219 - RNA, 64 nt, hsa; identical to SEQ ID NO: 364082

SEQ ID NO: 618220 - RNA, 64 nt, hsa; identical to SEQ ID NO: 364083

SEQ ID NO: 618221 - RNA, 64 nt, hsa; identical to SEQ ID NO: 364084

SEQ ID NO: 618222 - RNA, 64 nt, hsa; identical to SEQ ID NO: 364085

SEQ ID NO: 618223 - RNA, 64 nt, hsa; identical to SEQ ID NO: 364086

SEQ ID NO: 618224 - RNA, 64 nt, hsa; identical to SEQ ID NO: 364087

SEQ ID NO: 618225 - RNA, 64 nt, hsa; identical to SEQ ID NO: 364088

SEQ ID NO: 618226 - RNA, 64 nt, hsa; identical to SEQ ID NO: 364089

SEQ ID NO: 618227 - RNA, 64 nt, hsa; identical to SEQ ID NO: 364090

SEQ ID NO: 618228 - RNA, 64 nt, hsa; identical to SEQ ID NO: 364091

SEQ ID NO: 618229 - RNA, 64 nt, hsa; identical to SEQ ID NO: 364092

SEQ ID NO: 618230 - RNA, 64 nt, hsa; identical to SEQ ID NO: 364093

SEQ ID NO: 618231 - RNA, 64 nt, hsa; identical to SEQ ID NO: 364094

SEQ ID NO: 618232 - RNA, 64 nt, hsa; identical to SEQ ID NO: 364095

SEQ ID NO: 618233 - RNA, 64 nt, hsa; identical to SEQ ID NO: 364096

SEQ ID NO: 618234 - RNA, 64 nt, hsa; identical to SEQ ID NO: 364097

SEQ ID NO: 618235 - RNA, 64 nt, hsa; identical to SEQ ID NO: 364098

SEQ ID NO: 618236 - RNA, 64 nt, hsa; identical to SEQ ID NO: 364099

SEQ ID NO: 618237 - RNA, 64 nt, hsa; identical to SEQ ID NO: 364100

SEQ ID NO: 618238 - RNA, 64 nt, hsa; identical to SEQ ID NO: 364101

SEQ ID NO: 618239 - RNA, 64 nt, hsa; identical to SEQ ID NO: 364102

SEQ ID NO: 618240 - RNA, 64 nt, hsa; identical to SEQ ID NO: 364103

SEQ ID NO: 618241 - RNA, 64 nt, hsa; identical to SEQ ID NO: 364104

SEQ ID NO: 618242 - RNA, 64 nt, hsa; identical to SEQ ID NO: 364105

SEQ ID NO: 618243 - RNA, 64 nt, hsa; identical to SEQ ID NO: 364106

SEQ ID NO: 618244 - RNA, 64 nt, hsa; identical to SEQ ID NO: 364107

SEQ ID NO: 618245 - RNA, 64 nt, hsa; identical to SEQ ID NO: 364108

SEQ ID NO: 618246 - RNA, 64 nt, hsa; identical to SEQ ID NO: 364109

SEQ ID NO: 618247 - RNA, 64 nt, hsa; identical to SEQ ID NO: 364110

SEQ ID NO: 618248 - RNA, 64 nt, hsa; identical to SEQ ID NO: 364111

SEQ ID NO: 618249 - RNA, 64 nt, hsa; identical to SEQ ID NO: 364112

SEQ ID NO: 618250 - RNA, 64 nt, hsa; identical to SEQ ID NO: 616993

SEQ ID NO: 618251 - RNA, 64 nt, hsa; identical to SEQ ID NO: 616994

SEQ ID NO: 618252 - RNA, 64 nt, hsa; identical to SEQ ID NO: 616995

SEQ ID NO: 618253 - RNA, 64 nt, hsa; identical to SEQ ID NO: 616996

SEQ ID NO: 618254 - RNA, 64 nt, hsa; identical to SEQ ID NO: 616997

SEQ ID NO: 618255 - RNA, 64 nt, hsa; identical to SEQ ID NO: 616998

SEQ ID NO: 618256 - RNA, 64 nt, hsa; identical to SEQ ID NO: 616999

SEQ ID NO: 618257 - RNA, 64 nt, hsa; identical to SEQ ID NO: 617000

SEQ ID NO: 618258 - RNA, 64 nt, hsa; identical to SEQ ID NO: 617001

SEQ ID NO: 618259 - RNA, 64 nt, hsa; identical to SEQ ID NO: 617002

SEQ ID NO: 618260 - RNA, 64 nt, hsa; identical to SEQ ID NO: 617003

SEQ ID NO: 618261 - RNA, 64 nt, hsa; identical to SEQ ID NO: 617004

SEQ ID NO: 618262 - RNA, 64 nt, hsa; identical to SEQ ID NO: 617005

SEQ ID NO: 618263 - RNA, 64 nt, hsa; identical to SEQ ID NO: 617006

SEQ ID NO: 618264 - RNA, 64 nt, hsa; identical to SEQ ID NO: 617007

SEQ ID NO: 618265 - RNA, 64 nt, hsa; identical to SEQ ID NO: 617008

SEQ ID NO: 618266 - RNA, 64 nt, hsa; identical to SEQ ID NO: 617009

SEQ ID NO: 618267 - RNA, 64 nt, hsa; identical to SEQ ID NO: 617010

SEQ ID NO: 618268 - RNA, 64 nt, hsa; identical to SEQ ID NO: 617011

SEQ ID NO: 618269 - RNA, 64 nt, hsa; identical to SEQ ID NO: 617012

SEQ ID NO: 618270 - RNA, 64 nt, hsa; identical to SEQ ID NO: 617013

SEQ ID NO: 618271 - RNA, 64 nt, hsa; identical to SEQ ID NO: 617014

SEQ ID NO: 618272 - RNA, 64 nt, hsa; identical to SEQ ID NO: 617015

SEQ ID NO: 618273 - RNA, 64 nt, hsa; identical to SEQ ID NO: 617016

SEQ ID NO: 618274 - RNA, 64 nt, hsa; identical to SEQ ID NO: 617017

SEQ ID NO: 618275 - RNA, 64 nt, hsa; identical to SEQ ID NO: 617018

SEQ ID NO: 618276 - RNA, 64 nt, hsa; identical to SEQ ID NO: 617019

SEQ ID NO: 618277 - RNA, 64 nt, hsa; identical to SEQ ID NO: 617020

SEQ ID NO: 618278 - RNA, 64 nt, hsa; identical to SEQ ID NO: 617021

SEQ ID NO: 618279 - RNA, 64 nt, hsa; identical to SEQ ID NO: 617022

SEQ ID NO: 618280 - RNA, 64 nt, hsa; identical to SEQ ID NO: 617023

SEQ ID NO: 618281 - RNA, 64 nt, hsa; identical to SEQ ID NO: 617024

SEQ ID NO: 618282 - RNA, 64 nt, hsa; identical to SEQ ID NO: 617025

SEQ ID NO: 618283 - RNA, 64 nt, hsa; identical to SEQ ID NO: 617026

SEQ ID NO: 618284 - RNA, 64 nt, hsa; identical to SEQ ID NO: 617027

SEQ ID NO: 618285 - RNA, 64 nt, hsa; identical to SEQ ID NO: 617028

SEQ ID NO: 618286 - RNA, 64 nt, hsa; identical to SEQ ID NO: 617029

SEQ ID NO: 618287 - RNA, 64 nt, hsa; identical to SEQ ID NO: 617030

SEQ ID NO: 618288 - RNA, 64 nt, hsa; identical to SEQ ID NO: 617031

SEQ ID NO: 618289 - RNA, 64 nt, hsa; identical to SEQ ID NO: 617032

SEQ ID NO: 618290 - RNA, 64 nt, hsa; identical to SEQ ID NO: 617033

SEQ ID NO: 618291 - RNA, 64 nt, hsa; identical to SEQ ID NO: 617034

SEQ ID NO: 618292 - RNA, 64 nt, hsa; identical to SEQ ID NO: 617035

SEQ ID NO: 618293 - RNA, 64 nt, hsa; identical to SEQ ID NO: 617036

SEQ ID NO: 618294 - RNA, 64 nt, hsa; identical to SEQ ID NO: 617037

SEQ ID NO: 618295 - RNA, 64 nt, hsa; identical to SEQ ID NO: 617038

SEQ ID NO: 618296 - RNA, 64 nt, hsa; identical to SEQ ID NO: 617039

SEQ ID NO: 618297 - RNA, 64 nt, hsa; identical to SEQ ID NO: 617040

SEQ ID NO: 618298 - RNA, 64 nt, hsa; identical to SEQ ID NO: 617041

SEQ ID NO: 618299 - RNA, 64 nt, hsa; identical to SEQ ID NO: 617042

SEQ ID NO: 618300 - RNA, 64 nt, hsa; identical to SEQ ID NO: 617043

SEQ ID NO: 618301 - RNA, 64 nt, hsa; identical to SEQ ID NO: 617044

SEQ ID NO: 618302 - RNA, 64 nt, hsa; identical to SEQ ID NO: 617045

SEQ ID NO: 618303 - RNA, 64 nt, hsa; identical to SEQ ID NO: 210768

SEQ ID NO: 618304 - RNA, 64 nt, hsa; identical to SEQ ID NO: 210769

SEQ ID NO: 618305 - RNA, 64 nt, hsa; identical to SEQ ID NO: 210770

SEQ ID NO: 618306 - RNA, 64 nt, hsa; identical to SEQ ID NO: 210771

SEQ ID NO: 618307 - RNA, 64 nt, hsa; identical to SEQ ID NO: 210772

SEQ ID NO: 618308 - RNA, 64 nt, hsa; identical to SEQ ID NO: 210773

SEQ ID NO: 618309 - RNA, 64 nt, hsa; identical to SEQ ID NO: 210774

SEQ ID NO: 618310 - RNA, 64 nt, hsa; identical to SEQ ID NO: 210775

SEQ ID NO: 618311 - RNA, 64 nt, hsa; identical to SEQ ID NO: 210776

SEQ ID NO: 618312 - RNA, 64 nt, hsa; identical to SEQ ID NO: 210777

SEQ ID NO: 618313 - RNA, 64 nt, hsa; identical to SEQ ID NO: 210778

SEQ ID NO: 618314 - RNA, 64 nt, hsa; identical to SEQ ID NO: 210779

SEQ ID NO: 618315 - RNA, 64 nt, hsa; identical to SEQ ID NO: 210780

SEQ ID NO: 618316 - RNA, 64 nt, hsa; identical to SEQ ID NO: 210781

SEQ ID NO: 618317 - RNA, 64 nt, hsa; identical to SEQ ID NO: 210782

SEQ ID NO: 618318 - RNA, 64 nt, hsa; identical to SEQ ID NO: 210783

SEQ ID NO: 618319 - RNA, 64 nt, hsa; identical to SEQ ID NO: 210784

SEQ ID NO: 618320 - RNA, 64 nt, hsa; identical to SEQ ID NO: 210785

SEQ ID NO: 618321 - RNA, 64 nt, hsa; identical to SEQ ID NO: 210786

SEQ ID NO: 618322 - RNA, 64 nt, hsa; identical to SEQ ID NO: 210787

SEQ ID NO: 618323 - RNA, 64 nt, hsa; identical to SEQ ID NO: 210788

SEQ ID NO: 618324 - RNA, 64 nt, hsa; identical to SEQ ID NO: 210789

SEQ ID NO: 618325 - RNA, 64 nt, hsa; identical to SEQ ID NO: 210790

SEQ ID NO: 618326 - RNA, 64 nt, hsa; identical to SEQ ID NO: 210791

SEQ ID NO: 618327 - RNA, 64 nt, hsa; identical to SEQ ID NO: 210792

SEQ ID NO: 618328 - RNA, 64 nt, hsa; identical to SEQ ID NO: 210793

SEQ ID NO: 618329 - RNA, 64 nt, hsa; identical to SEQ ID NO: 210794

SEQ ID NO: 618330 - RNA, 64 nt, hsa; identical to SEQ ID NO: 210795

SEQ ID NO: 618331 - RNA, 64 nt, hsa; identical to SEQ ID NO: 210796

SEQ ID NO: 618332 - RNA, 64 nt, hsa; identical to SEQ ID NO: 210797

SEQ ID NO: 618333 - RNA, 64 nt, hsa; identical to SEQ ID NO: 210798

SEQ ID NO: 618334 - RNA, 64 nt, hsa; identical to SEQ ID NO: 210799

SEQ ID NO: 618335 - RNA, 64 nt, hsa; identical to SEQ ID NO: 210800

SEQ ID NO: 618336 - RNA, 64 nt, hsa; identical to SEQ ID NO: 210801

SEQ ID NO: 618337 - RNA, 64 nt, hsa; identical to SEQ ID NO: 210802

SEQ ID NO: 618338 - RNA, 64 nt, hsa; identical to SEQ ID NO: 210803

SEQ ID NO: 618339 - RNA, 64 nt, hsa; identical to SEQ ID NO: 210804

SEQ ID NO: 618340 - RNA, 64 nt, hsa; identical to SEQ ID NO: 210805

SEQ ID NO: 618341 - RNA, 64 nt, hsa; identical to SEQ ID NO: 210806

SEQ ID NO: 618342 - RNA, 64 nt, hsa; identical to SEQ ID NO: 210807

SEQ ID NO: 618343 - RNA, 64 nt, hsa; identical to SEQ ID NO: 210808

SEQ ID NO: 618344 - RNA, 64 nt, hsa; identical to SEQ ID NO: 210809

SEQ ID NO: 618345 - RNA, 63 nt, hsa
gggccuuugguggccacccuggugaggacaccugucccccagggcaggcaccuucucuuuucc

SEQ ID NO: 618346 - RNA, 63 nt, hsa
ccuuucaaugcccagcccugacaccugcccuuugucccccaggccuaggaucagggaccagag

SEQ ID NO: 618347 - RNA, 63 nt, hsa
acugcacaguucacuuuauuuaacaauuuucaugucccccaccucauguuuucaccuuuucug

SEQ ID NO: 618348 - RNA, 63 nt, hsa
ugggaccugaggacuggaugguagaauacuggggucccccagcucuuagcaggaugcaggcua

SEQ ID NO: 618349 - RNA, 63 nt, hsa
ggcagugccucugccagucacugucaucguugugucccccacaacuguccucuugcuagcucg

SEQ ID NO: 618350 - RNA, 63 nt, hsa
ucugccagugggggauguuucuggaggcagcuggucccccacaccgcguccugcugagccugc

SEQ ID NO: 618351 - RNA, 63 nt, hsa
augagagggggcuuggccuucuuaggugacaaugucccccauaucuguaugucaccaggaugg

SEQ ID NO: 618352 - RNA, 63 nt, hsa
ccuccugaagauagccagagagcccaugagaccgucccccagcaucccccacuugccugaagc

SEQ ID NO: 618353 - RNA, 63 nt, hsa
uacuuuuucgccucccagggccugugggaucuggucccccagccucucuugggcuuucuuaca

SEQ ID NO: 618354 - RNA, 63 nt, hsa
gcaggugaggauggugcaccagacaggguagcugucccccaaaaugugcccugugcgggcagu

SEQ ID NO: 618355 - RNA, 63 nt, hsa
cacugcucuccagccugggaggcacagcaaacugucccccaaaaaaaaaaaagaguccuuacc

SEQ ID NO: 618356 - RNA, 63 nt, hsa
acuaaagguggccacaaauucuuugacacucaagucccccaagaccuaaggguuuuaucuccu

SEQ ID NO: 618357 - RNA, 63 nt, hsa
ccagcagcccccuccuccuggcugggaagaauggucccccagcaagcacuugccuguucauuc

SEQ ID NO: 618358 - RNA, 63 nt, hsa
guauuauucccccagcucucagggacaagaccagucccccagcgugguggucagcacggaagc

SEQ ID NO: 618359 - RNA, 63 nt, hsa
cccagggagccgcugauguacaauaaccuugaggucccccauacugaaaacugaccaaggccu

SEQ ID NO: 618360 - RNA, 63 nt, hsa
auauucugugauugauuuugguccuccuccgcugucccccaacacccaggaaugggaaucugg

SEQ ID NO: 618361 - RNA, 63 nt, hsa
cuggcuguguaggggaggaaggggugcaugcaugucccccacccuccacagucuuccuugccu

SEQ ID NO: 618362 - RNA, 63 nt, hsa
guagaaagaaccaggguguccccgggacaggccgucccccaccccauccuguagaaguccauu

SEQ ID NO: 618363 - RNA, 63 nt, hsa
agaaguccauuccccuuuucccuccugugcucugucccccaaggagucauggaacucagggua

SEQ ID NO: 618364 - RNA, 63 nt, hsa
aggcacauggcccaggcagcugucaauucucaugucccccacauggcccaaggugggcaucuu

SEQ ID NO: 618365 - RNA, 63 nt, hsa
agguuagaagacauacagaaacagggcuggugugucccccauagucugcaugcugugccggaa

SEQ ID NO: 618366 - RNA, 63 nt, hsa
uuuuugguagggccaccacucacuggguuuagggucccccaauacacugugaccucaucuuaa

SEQ ID NO: 618367 - RNA, 63 nt, hsa
cccccuuuuuuuuuugagacggggccuugcugugucccccaggcgggaauacagugccaugau

SEQ ID NO: 618368 - RNA, 63 nt, hsa
cucaucauccacccgcugccccuccccgucccugucccccagcaucgggggccugcaaaucua

SEQ ID NO: 618369 - RNA, 63 nt, hsa
agaggcccccaguggggacagggagggggaccugucccccacucucucacccaccagcuccac

SEQ ID NO: 618370 - RNA, 59 nt, hsa
guccccaagauccuccuuagaaucccacagucccccagacccuccuuagaaugccacag

SEQ ID NO: 618371 - RNA, 63 nt, hsa
cacagucccccagacccuccuuagaaugccacagucccccaacccuccacagagcccccagac

SEQ ID NO: 618372 - RNA, 63 nt, hsa
ccugcuguggaggccccagccgugggaauccaggucccccagguggagcugccugccuugccc

SEQ ID NO: 618373 - RNA, 63 nt, hsa
guugggccgcggcugccaggggcggaggugggugucccccaggucucagcccccaaggcugcc

SEQ ID NO: 618374 - RNA, 63 nt, hsa
gcucaggccagaaguccagcugcugccaggcaugucccccagggccacugggcacuaugaguc

SEQ ID NO: 618375 - RNA, 63 nt, hsa
aggcaugucccccagggccacugggcacuaugagucccccaccucucccacuacuggccccuc

SEQ ID NO: 618376 - RNA, 63 nt, hsa
uggacuccagcgguggcuucuugaugcugcgcggucccccacucccuacaucagaaugcaucc

SEQ ID NO: 618377 - RNA, 63 nt, hsa
agaaauuuucagugcaagucuugaugcugcgccgucccccacucccuacaucagaacgcaucc

SEQ ID NO: 618378 - RNA, 63 nt, hsa
aagggugccagaugccugggucucccaagaggggucccccaacucaccguucccgggacaggc

SEQ ID NO: 618379 - RNA, 63 nt, hsa
uguguguucuucucugagcagcuccuccccggagucccccagcacagucccaggagaugacag

SEQ ID NO: 618380 - RNA, 64 nt, hsa; identical to SEQ ID NO: 212912

SEQ ID NO: 618381 - RNA, 64 nt, hsa; identical to SEQ ID NO: 212913

SEQ ID NO: 618382 - RNA, 64 nt, hsa; identical to SEQ ID NO: 212914

SEQ ID NO: 618383 - RNA, 64 nt, hsa; identical to SEQ ID NO: 212915

SEQ ID NO: 618384 - RNA, 64 nt, hsa; identical to SEQ ID NO: 212916

SEQ ID NO: 618385 - RNA, 64 nt, hsa; identical to SEQ ID NO: 212917

SEQ ID NO: 618386 - RNA, 64 nt, hsa; identical to SEQ ID NO: 212918

SEQ ID NO: 618387 - RNA, 60 nt, hsa
gacuagagggugguggagguaaggccuuccagagcccauggcuucaggagagggucucuc

SEQ ID NO: 618388 - RNA, 60 nt, hsa
agcuuuaacaugguucaggcccuuggugugagagcccagggggaggacagcuugucugcu

SEQ ID NO: 618389 - RNA, 60 nt, hsa
caucaguguuuccgucugcucaccugccacagagcccacacccaugcccaccaguguugg

SEQ ID NO: 618390 - RNA, 60 nt, hsa
ggaagacacauucccuucccuguuccccagagagcccaccuccgcccugggcaggagccc

SEQ ID NO: 618391 - RNA, 60 nt, hsa
ucugugcugccugguuugcauccggcucacagagcccagacugcuggaacagccaaggac

SEQ ID NO: 618392 - RNA, 60 nt, hsa
ucccagacaggagccaggguugagcaauggagagcccagcccccacgucuuacagucgcc

SEQ ID NO: 618393 - RNA, 60 nt, hsa
guuuugaacuuccuuucccacuugguagaaagagcccagaagcagcccuggcccuguaag

SEQ ID NO: 618394 - RNA, 60 nt, hsa
gccuuauuucugccggggccuccccaccggagagcccagggggccggccggguuccuggu

SEQ ID NO: 618395 - RNA, 60 nt, hsa
uuuauauaaaaaguguuucugugauucuucagagcccaggagucagugcuggugguugga

SEQ ID NO: 618396 - RNA, 60 nt, hsa
ucccaggcccagcaccgagcagaacagaccagagcccaccacaccacaaagagcagcacc

SEQ ID NO: 618397 - RNA, 60 nt, hsa
cauugaaguggagcccggcacaggggucauagagcccagugaggucggggauuuugaguu

SEQ ID NO: 618398 - RNA, 60 nt, hsa
gccagcucccagccacauggcgcaugaaggagagcccagucucccuccaggaaaggccug

SEQ ID NO: 618399 - RNA, 60 nt, hsa
ugaccagaggggagguggauggcacuuuccagagcccagguucuuauggcauuucccagg

SEQ ID NO: 618400 - RNA, 60 nt, hsa
ugcccacugcccgugcagccuccuucagccagagcccagagcauagacaggaguguagga

SEQ ID NO: 618401 - RNA, 60 nt, hsa
guguuccguacccacugcugaugguuucccagagcccacacugaguugaagaaccuauug

SEQ ID NO: 618402 - RNA, 60 nt, hsa
acucccauuugcucucagugaccccagggcagagcccagagaaguguuccguacccacug

SEQ ID NO: 618403 - RNA, 60 nt, hsa
gauagcaaaugugucugguuagaucucagcagagcccauucugcaagaccuggcugagcc

SEQ ID NO: 618404 - RNA, 60 nt, hsa
uaacaccuucuggagccagcucaucagcucagagcccagggucaggaguucguucaguaa

SEQ ID NO: 618405 - RNA, 60 nt, hsa
uggauguccuucgaaggaaccaggacccucagagcccagcauccaucucugucaucaucu

SEQ ID NO: 618406 - RNA, 60 nt, hsa
ugcuccuacccaugcuacaggccaggaaccagagcccaucaucucagaggccccuggaug

SEQ ID NO: 618407 - RNA, 60 nt, hsa
uguuccuguuaaauguauagcauuguaaugagagcccaucaaauccugagugucaguuug

SEQ ID NO: 618408 - RNA, 60 nt, hsa
uaccuugaccacgcuguacaguaacauccaagagcccauucuacagugggugguuuuggu

SEQ ID NO: 618409 - RNA, 60 nt, hsa
gcugcggcugcaauggaggcaaggggcugcagagcccaggugcacugugugaugauggga

SEQ ID NO: 618410 - RNA, 60 nt, hsa
uaucagugccccccagaguagagagcaauaagagcccagcccagugcagucccggcugug

SEQ ID NO: 618411 - RNA, 60 nt, hsa
guauauacccugcaccagcagugaccgggcagagcccaacccccuccacgggggucccag

SEQ ID NO: 618412 - RNA, 60 nt, hsa
cucccugcacauggcacuacccagacugccagagcccaggcuggccucaucugcaccaug

SEQ ID NO: 618413 - RNA, 60 nt, hsa
uuggagaaaccaaccagauacaucugcuggagagcccaggugggcacagagaagggugga

SEQ ID NO: 618414 - RNA, 60 nt, hsa
uugaagggcaaggagggaaacaguguuaccagagcccaguaagaacugcugucaugaagg

SEQ ID NO: 618415 - RNA, 60 nt, hsa
caaaauguuaacacaaagcuaagauucaucagagcccacccuauucuaaggaaccacaau

SEQ ID NO: 618416 - RNA, 60 nt, hsa
cucugguaaagcauccuguggagggagaggagagcccagucauuugcuuagaugguguuu

SEQ ID NO: 618417 - RNA, 60 nt, hsa
cucacucucaggacuauucuguaagaguccagagcccaccuccucaguuccuguggauag

SEQ ID NO: 618418 - RNA, 60 nt, hsa
ccuaaacagggcacauagaucucucccacuagagcccagagggaugagaggagagagcaa

SEQ ID NO: 618419 - RNA, 60 nt, hsa
ugaggcccuaacaaauuucaggcccagccaagagcccaugaauggaggcugcaggaggcu

SEQ ID NO: 618420 - RNA, 60 nt, hsa
ccuugaaguagcagccuuggcugacuuuccagagcccagucccaagccuggcaccaagcc

SEQ ID NO: 618421 - RNA, 60 nt, hsa
uagugcuaagagggaaggcccagguuugagagagcccagaggggcagagcccagagccuu

SEQ ID NO: 618422 - RNA, 60 nt, hsa
aggcccagguuugagagagcccagaggggcagagcccagagccuuguuuggcccugaucu

SEQ ID NO: 618423 - RNA, 60 nt, hsa
ccccaucggcccuguccccuggagugugucagagcccaggggagaaugcagcccaccagg

SEQ ID NO: 618424 - RNA, 60 nt, hsa
ugaucuacccgugccugggccccuccccucagagcccaugguaacgaaccccuagaaagg

SEQ ID NO: 618425 - RNA, 60 nt, hsa
cccagaagcagucccugacccccagcuuucagagcccagccaccagcuuggggcuggaug

SEQ ID NO: 618426 - RNA, 60 nt, hsa
cacagaagugauaaaggaauccaaaguugaagagcccaggaaacgggaaacuguauccau

SEQ ID NO: 618427 - RNA, 60 nt, hsa
caaccagucuggggccauucagccagggacagagcccacagagcccauacaccugucucc

SEQ ID NO: 618428 - RNA, 60 nt, hsa
uggggccauucagccagggacagagcccacagagcccauacaccugucucccaccagcgg

SEQ ID NO: 618429 - RNA, 64 nt, hsa
uuuaggaaaagaugucuugcaucagucuuacuaggcauaaaagucacacuuaaugacuggaaaa

SEQ ID NO: 618430 - RNA, 64 nt, hsa
uaaaguagaauaauuucaugguauucauuaaaaagcauaaaagucuuccucuugccccagaagu

SEQ ID NO: 618431 - RNA, 64 nt, hsa
cuaugaaugccuucuuaaaaucauguuuuuaaaugcauaaaauauauaggauuacaaaggaauc

SEQ ID NO: 618432 - RNA, 64 nt, hsa
cacauauuuuuauauuauguuaaaguaaagaaaugcauaaaagacaagcacuuuggaagaauua

SEQ ID NO: 618433 - RNA, 64 nt, hsa
acuuuagggagaaaacuuuguauuuuuaaaacuugcauaaaaguuaugcaagugguuuuuauaa

SEQ ID NO: 618434 - RNA, 64 nt, hsa
gaaagugcaguaccgucaucuucaagccuuguaagcauaaaagagaauaggcugcccauauaag

SEQ ID NO: 618435 - RNA, 64 nt, hsa
aaauuggaauaugaaaaacuaauggauaaagcuagcauaaaauugauauuuuaguuuguauuau

SEQ ID NO: 618436 - RNA, 64 nt, hsa
auauggauaagaaugcagguagauaauauucuaggcauaaaacauuuaauguaccuuaccucau

SEQ ID NO: 618437 - RNA, 64 nt, hsa
agguagugccagcagaguagggaaaacugcauuugcauaaaaacuacucuugacaugauuguuc

SEQ ID NO: 618438 - RNA, 64 nt, hsa
cugacugguguucuaccugcaagaugugcagagggcauaaaagcaaaucaacacuuuauaguua

SEQ ID NO: 618439 - RNA, 64 nt, hsa
cuaauuauugccuuuguuguuguauuacaaaucugcauaaaauaccucauuucaaaucaaaucu

SEQ ID NO: 618440 - RNA, 64 nt, hsa
aggccgugugaagagcagcaaagcuuuccagaaggcauaaaaggaaacuugaauaaaggaagau

SEQ ID NO: 618441 - RNA, 64 nt, hsa
acauuaguccuaaacgucccauguauuuuucuaggcauaaaaauaaaaguuggcuaaaaauuuu

SEQ ID NO: 618442 - RNA, 64 nt, hsa
uuaagcauaucuucugaacugaauacaucagcuggcauaaaaggagcaugaagucuguuaaagc

SEQ ID NO: 618443 - RNA, 64 nt, hsa; identical to SEQ ID NO: 204896

SEQ ID NO: 618444 - RNA, 64 nt, hsa; identical to SEQ ID NO: 204897

SEQ ID NO: 618445 - RNA, 64 nt, hsa; identical to SEQ ID NO: 204898

SEQ ID NO: 618446 - RNA, 64 nt, hsa; identical to SEQ ID NO: 204899

SEQ ID NO: 618447 - RNA, 64 nt, hsa; identical to SEQ ID NO: 204900

SEQ ID NO: 618448 - RNA, 64 nt, hsa; identical to SEQ ID NO: 204901

SEQ ID NO: 618449 - RNA, 64 nt, hsa; identical to SEQ ID NO: 204902

SEQ ID NO: 618450 - RNA, 64 nt, hsa; identical to SEQ ID NO: 204903

SEQ ID NO: 618451 - RNA, 64 nt, hsa; identical to SEQ ID NO: 204904

SEQ ID NO: 618452 - RNA, 64 nt, hsa; identical to SEQ ID NO: 204905

SEQ ID NO: 618453 - RNA, 64 nt, hsa; identical to SEQ ID NO: 204906

SEQ ID NO: 618454 - RNA, 64 nt, hsa; identical to SEQ ID NO: 204907

SEQ ID NO: 618455 - RNA, 64 nt, hsa; identical to SEQ ID NO: 204908

SEQ ID NO: 618456 - RNA, 64 nt, hsa; identical to SEQ ID NO: 204909

SEQ ID NO: 618457 - RNA, 64 nt, hsa; identical to SEQ ID NO: 204910

SEQ ID NO: 618458 - RNA, 64 nt, hsa; identical to SEQ ID NO: 204911

SEQ ID NO: 618459 - RNA, 64 nt, hsa; identical to SEQ ID NO: 204912

SEQ ID NO: 618460 - RNA, 64 nt, hsa; identical to SEQ ID NO: 511888

SEQ ID NO: 618461 - RNA, 64 nt, hsa; identical to SEQ ID NO: 511889

SEQ ID NO: 618462 - RNA, 64 nt, hsa; identical to SEQ ID NO: 511890

SEQ ID NO: 618463 - RNA, 64 nt, hsa; identical to SEQ ID NO: 511891

SEQ ID NO: 618464 - RNA, 64 nt, hsa; identical to SEQ ID NO: 511892

SEQ ID NO: 618465 - RNA, 64 nt, hsa; identical to SEQ ID NO: 511893

SEQ ID NO: 618466 - RNA, 64 nt, hsa; identical to SEQ ID NO: 511894

SEQ ID NO: 618467 - RNA, 64 nt, hsa; identical to SEQ ID NO: 511895

SEQ ID NO: 618468 - RNA, 64 nt, hsa; identical to SEQ ID NO: 511896

SEQ ID NO: 618469 - RNA, 64 nt, hsa; identical to SEQ ID NO: 511897

SEQ ID NO: 618470 - RNA, 64 nt, hsa; identical to SEQ ID NO: 511898

SEQ ID NO: 618471 - RNA, 64 nt, hsa; identical to SEQ ID NO: 511899

SEQ ID NO: 618472 - RNA, 64 nt, hsa; identical to SEQ ID NO: 511900

SEQ ID NO: 618473 - RNA, 64 nt, hsa; identical to SEQ ID NO: 511901

SEQ ID NO: 618474 - RNA, 64 nt, hsa; identical to SEQ ID NO: 511902

SEQ ID NO: 618475 - RNA, 64 nt, hsa; identical to SEQ ID NO: 175087

SEQ ID NO: 618476 - RNA, 64 nt, hsa; identical to SEQ ID NO: 175088

SEQ ID NO: 618477 - RNA, 64 nt, hsa; identical to SEQ ID NO: 175089

SEQ ID NO: 618478 - RNA, 64 nt, hsa; identical to SEQ ID NO: 175090

SEQ ID NO: 618479 - RNA, 64 nt, hsa; identical to SEQ ID NO: 175091

SEQ ID NO: 618480 - RNA, 64 nt, hsa; identical to SEQ ID NO: 175092

SEQ ID NO: 618481 - RNA, 64 nt, hsa; identical to SEQ ID NO: 175093

SEQ ID NO: 618482 - RNA, 64 nt, hsa; identical to SEQ ID NO: 175094

SEQ ID NO: 618483 - RNA, 64 nt, hsa; identical to SEQ ID NO: 175095

SEQ ID NO: 618484 - RNA, 64 nt, hsa; identical to SEQ ID NO: 175096

SEQ ID NO: 618485 - RNA, 64 nt, hsa; identical to SEQ ID NO: 175097

SEQ ID NO: 618486 - RNA, 64 nt, hsa; identical to SEQ ID NO: 175098

SEQ ID NO: 618487 - RNA, 64 nt, hsa; identical to SEQ ID NO: 175099

SEQ ID NO: 618488 - RNA, 64 nt, hsa; identical to SEQ ID NO: 175100

SEQ ID NO: 618489 - RNA, 64 nt, hsa; identical to SEQ ID NO: 175101

SEQ ID NO: 618490 - RNA, 64 nt, hsa; identical to SEQ ID NO: 175102

SEQ ID NO: 618491 - RNA, 64 nt, hsa; identical to SEQ ID NO: 175103

SEQ ID NO: 618492 - RNA, 64 nt, hsa; identical to SEQ ID NO: 175104

SEQ ID NO: 618493 - RNA, 64 nt, hsa; identical to SEQ ID NO: 175105

SEQ ID NO: 618494 - RNA, 64 nt, hsa; identical to SEQ ID NO: 175106

SEQ ID NO: 618495 - RNA, 64 nt, hsa; identical to SEQ ID NO: 175107

SEQ ID NO: 618496 - RNA, 64 nt, hsa
uggacgugaccguaucccucugccacaccccaggcccugcgaggggcuaucgagaggagcucac

SEQ ID NO: 618497 - RNA, 64 nt, hsa
cguagccaaggugggcugagcccuggcaggaugacccugcgaaggggcccugguccuuccaggc

SEQ ID NO: 618498 - RNA, 64 nt, hsa
cuuuuguuguaccaaauagggcuccccaccccaccccugcgacaagugcucuucuagaacaggu

SEQ ID NO: 618499 - RNA, 64 nt, hsa
gcagucguggugaaaccggucagcuguggaccugcccugcgaaucggcagaggccuccguggug

SEQ ID NO: 618500 - RNA, 64 nt, hsa
uugccuacagaugguuuccacacuugaaauugugcccugcgaguugcauagcuggaaguucaau

SEQ ID NO: 618501 - RNA, 64 nt, hsa
gagaugaccagggaugcugggcugggcccucuuucccugcgagacgcacacagcugagcacuua

SEQ ID NO: 618502 - RNA, 64 nt, hsa
aggaggacuggucagucacaagagcuucaaccugcccugcgagcccucucugcaccugcucaag

SEQ ID NO: 618503 - RNA, 64 nt, hsa
ucuggugguccuuaggggaguggccccuccugagcccugcgagcagcguccuuuuccucuuccc

SEQ ID NO: 618504 - RNA, 64 nt, hsa
gaaugaggcuggacagauggcggaagcagagguucccugcgaagacuugagauuuagugucugu

SEQ ID NO: 618505 - RNA, 64 nt, hsa
gugaccuuaggaucacucaaguagacccuucacucccugcgagaaauuaggaugaauaacuacc

SEQ ID NO: 618506 - RNA, 64 nt, hsa
gaucacacacguauacacaacauuacugaaagaacccugcgaaucaaaacaacccccacacaga

SEQ ID NO: 618507 - RNA, 64 nt, hsa
gcagacugggagcucccgguccgccucccagcaucccugcgagcguucaugggguguucguguu

SEQ ID NO: 618508 - RNA, 54 nt, hsa
augacagcauauuaaagugagugacccugcgacccacucuuuggaccagcagcg

SEQ ID NO: 618509 - RNA, 64 nt, hsa
caccauguuggccaggauggucucaaucuccugacccugcgaucugcccaccucagccucccaa

SEQ ID NO: 618510 - RNA, 64 nt, hsa
aaugagguuucaguacaaaaggaaccaugggugacccugcgauauccacugucauuuuccaucc

SEQ ID NO: 618511 - RNA, 64 nt, hsa
ggcagacccacauggccugggcucugaaugcccacccugcgacgguggguucugcaucagcaaa

SEQ ID NO: 618512 - RNA, 64 nt, hsa
gucccaaguuggaaauauucaugcuucuuccuuacccugcgauuuugccugugucugaaguggu

SEQ ID NO: 618513 - RNA, 64 nt, hsa
uguacagaaugguaacuaagggugcugugcccaacccugcgacuagcaaggcucgcagcaagag

SEQ ID NO: 618514 - RNA, 64 nt, hsa
gcccuggcacccuggcgugggugcccgccaaacgcccugcgaccgcucagaagcacaaaugcug

SEQ ID NO: 618515 - RNA, 64 nt, hsa
ggaggaggagggagguaucuggugugagcguugccccugcgacauuugggaccacacagguggg

SEQ ID NO: 618516 - RNA, 64 nt, hsa
gacaacccaaacucuccagacaucaccaacuguccccugcgaggagaaaucacuccugggggag

SEQ ID NO: 618517 - RNA, 64 nt, hsa
agguggacagggccuacccagguggaggggaccacccugcgaucagguguuugcgacagggguu

SEQ ID NO: 618518 - RNA, 64 nt, hsa
gagggccuggagggggugcugcgggaccagcuggcccugcgagccuuggaggaggcggugagcg

SEQ ID NO: 618519 - RNA, 64 nt, hsa
acuccucugucaguuucagcaacuacaagggauacccugcgaaaguaccaugagaaauaucaga

SEQ ID NO: 618520 - RNA, 64 nt, hsa
ugauugcuuuccaguuuaaugaaagcuuaaaugucccugcgaacccacaaucucugccagcaga

SEQ ID NO: 618521 - RNA, 64 nt, hsa
ugcugaguggcucguguuucacagugggcggcuucccugcgacggaggcaggaccaggcauuua

SEQ ID NO: 618522 - RNA, 64 nt, hsa
gauccauccaccuauuagcccugggccuggaccucccugcgauuucccacuccuuucuuagucu

SEQ ID NO: 618523 - RNA, 64 nt, hsa
gaaaaggcuuggaguccucgcccagaucucucuccccugcgagcccuuuuuauuugagaaggaa

SEQ ID NO: 618524 - RNA, 64 nt, hsa
gcacagaucuugcagcccagaaccaagucagccucccugcgacugcccaggcacacugcccacc

SEQ ID NO: 618525 - RNA, 64 nt, hsa
cauucccacaaagugaaggaacaguuuccaaaaccccugcgaggcagaguuaagaccugugacg

SEQ ID NO: 618526 - RNA, 57 nt, hsa
gaggguggcagccccuauagugcggggcccugcgacugguaccgugagcgccuggga

SEQ ID NO: 618527 - RNA, 64 nt, hsa
ugccucccgcuggcccaggucuccucuccagucccccugcgacucccuguuuccugggcuaguc

SEQ ID NO: 618528 - RNA, 51 nt, hsa
cacagauccaugcagaaugagcccugcgagcaauagaguugaagcagccuc

SEQ ID NO: 618529 - RNA, 64 nt, hsa
cuugcagccccugcagacgagagucaggccagcacccugcgaccagcuucuccacugaugcaca

SEQ ID NO: 618530 - RNA, 64 nt, hsa
cacauauugugcagcuguugguuuucauguagugcccugcgauggaaauuagauauauuucaug

SEQ ID NO: 618531 - RNA, 64 nt, hsa
agcccacaaacacaagaagcaggacccgcugcagcccugcgacacggaguaccccguguucgug

SEQ ID NO: 618532 - RNA, 64 nt, hsa
gccgagcgugcaacccggagccgccuugggcccucccugcgacagccggacccgccuccgcauc

SEQ ID NO: 618533 - RNA, 64 nt, hsa
cuguccgggccuggguuuccugcccuggcccuggcccugcgaucucucacugugauuccucucc

SEQ ID NO: 618534 - RNA, 64 nt, hsa
aagagggagugaggagaggauugcagggacuuuucccugcgaaacaaaugagacaaugacauaa

SEQ ID NO: 618535 - RNA, 64 nt, hsa
cagugaacacuguccgccgcugugaggccugcuccccugcgaccgcccugccccccgucaccga

SEQ ID NO: 618536 - RNA, 64 nt, hsa
caggccagagccacagcugggagaccugcacugucccugcgaaauacuaagaacaccuagggug

SEQ ID NO: 618537 - RNA, 64 nt, hsa
ggcagcuuugcagaagcccagauggaccuggugccccugcgaggucugucgccuggugcagccu

SEQ ID NO: 618538 - RNA, 64 nt, hsa
gcagggccccuuccugcugucucaccccguguuucccugcgaguggacgugcccagcugucccc

SEQ ID NO: 618539 - RNA, 64 nt, hsa
caaccucauggucauggacagauagacagugcugcccugcgaaguggcucucaggggccaguga

SEQ ID NO: 618540 - RNA, 64 nt, hsa
accucgggucucugccagaggaagacuuaagcaucccugcgaccucacauucuagacagagaug

SEQ ID NO: 618541 - RNA, 64 nt, hsa
cauccagcagcgcuaagguggacaugggauuccucccugcgaugcgugucuuucccacgcagag

SEQ ID NO: 618542 - RNA, 64 nt, hsa
cucccuugaucuuuuugguuuuacuuuaauuaagcccugcgagaaugcuggauaaaugccuuga

SEQ ID NO: 618543 - RNA, 64 nt, hsa
uuugagaugcaacagagaacguaugccacauagccccugcgaagaaaaggcauuauguaucugu

SEQ ID NO: 618544 - RNA, 64 nt, hsa
uuaagaugcagaguggaggggaggugggcacccacccugcgauucuccacccuuuccccuucuu

SEQ ID NO: 618545 - RNA, 64 nt, hsa
agcaggagcagugguggcgccugcccugaggcugcccugcgauggccugggugggagagcuggg

SEQ ID NO: 618546 - RNA, 64 nt, hsa
guugugcgcuuaacgugaggguggguccagugugcccugcgaugggucccgugucacuguuuac

SEQ ID NO: 618547 - RNA, 64 nt, hsa
agcaguaugagcucuugugaggaugcugccgccacccugcgacggagcggcgccccggacugcc

SEQ ID NO: 618548 - RNA, 64 nt, hsa
gggacugaggacuggcagagcugccggcgccggacccugcgacaaccggggucccccaggacag

SEQ ID NO: 618549 - RNA, 64 nt, hsa
agcccgugccgugugacucgaagccuagcgcccucccugcgaagcaucagacgccacccagccc

SEQ ID NO: 618550 - RNA, 64 nt, hsa
ccugggugucagugagaucucagcccugaugacacccugcgagaccuggagcguagggcccagc

SEQ ID NO: 618551 - RNA, 63 nt, hsa
ccaaggucggccgcuacuaggacugcccccggacccugcgaugaugacccgggcgcaaccugg

SEQ ID NO: 618552 - RNA, 64 nt, hsa
cccgggagcuggaggcgcaugcgcauccgcgauucccugcgaccaggccccgagagggcgagac

SEQ ID NO: 618553 - RNA, 64 nt, hsa
gcgucuaagaugagggggccaggcgguggcuucucccugcgaggaggggagaauucuuggggcu

SEQ ID NO: 618554 - RNA, 64 nt, hsa
ugcgggccaccaaguucuggaaaccacguggugucccugcgaauggggcgaucaaguccagagc

SEQ ID NO: 618555 - RNA, 64 nt, hsa
ccguccgcggggcuguggcugcugcugugcaugucccugcgaugggagucuugucucccagccu

SEQ ID NO: 618556 - RNA, 64 nt, hsa
cacaucagugucucguuuacaucucacacagugacccugcgaggcaaggguuugcccaguuugc

SEQ ID NO: 618557 - RNA, 64 nt, hsa
aaggcuucaggaagggccagccacaugccaucuucccugcgaucaggcaaaaaaguggaauuaa

SEQ ID NO: 618558 - RNA, 64 nt, hsa
gcucugcgugugguccguauggaaagccugguagcccugcgaguuaaguacugcuuccauucau

SEQ ID NO: 618559 - RNA, 64 nt, hsa
uccugggcuucugggccaccugcccucggggggccccugcgagggugccuggaguucccacgug

SEQ ID NO: 618560 - RNA, 64 nt, hsa
cggacuucagauacguuaagcaagcaacagcagacccugcgaaugcacaucgacauacccaggg

SEQ ID NO: 618561 - RNA, 64 nt, hsa
gugcuuucucaggaaccuuucaagcggccagaaccccugcgaaucacacaugaccuuugcggga

SEQ ID NO: 618562 - RNA, 64 nt, hsa
augucggcuuccaagugaugcccuccugccacuccccugcgauuuauaagggaauuuuaauuuu

SEQ ID NO: 618563 - RNA, 64 nt, hsa
caugugcccucaaagcugucccacaaucauggagcccugcgaccucccugcccugccgccacau

SEQ ID NO: 618564 - RNA, 64 nt, hsa
caugugcccuugaagcugccccacaaucauggagcccugcgaccuacccgcccugccgccacau

SEQ ID NO: 618565 - RNA, 64 nt, hsa
guacuuucucaggaaccuuucaagcggccagaaccccugcgaaucacacaugaccuuugcggga

SEQ ID NO: 618566 - RNA, 64 nt, hsa
cauauacagugcuuagcacuuaauaaguauuccccccugcgacaccuagcugaacuaugguuug

SEQ ID NO: 618567 - RNA, 64 nt, hsa
cccucaccuguacccacaccuccagaaugcccugcccugcgaguguguccccuguccccaccug

SEQ ID NO: 618568 - RNA, 64 nt, hsa
cccguggugucaccgggacuccaggcacccgcuccccugcgaccaugccaggcacgcugggagg

SEQ ID NO: 618569 - RNA, 64 nt, hsa; identical to SEQ ID NO: 234150

SEQ ID NO: 618570 - RNA, 64 nt, hsa; identical to SEQ ID NO: 234151

SEQ ID NO: 618571 - RNA, 64 nt, hsa; identical to SEQ ID NO: 265005

SEQ ID NO: 618572 - RNA, 64 nt, hsa; identical to SEQ ID NO: 265006

SEQ ID NO: 618573 - RNA, 64 nt, hsa; identical to SEQ ID NO: 265007

SEQ ID NO: 618574 - RNA, 64 nt, hsa; identical to SEQ ID NO: 265008

SEQ ID NO: 618575 - RNA, 64 nt, hsa; identical to SEQ ID NO: 265009

SEQ ID NO: 618576 - RNA, 64 nt, hsa; identical to SEQ ID NO: 265010

SEQ ID NO: 618577 - RNA, 64 nt, hsa; identical to SEQ ID NO: 265011

SEQ ID NO: 618578 - RNA, 64 nt, hsa; identical to SEQ ID NO: 265012

SEQ ID NO: 618579 - RNA, 64 nt, hsa; identical to SEQ ID NO: 265013

SEQ ID NO: 618580 - RNA, 64 nt, hsa; identical to SEQ ID NO: 265014

SEQ ID NO: 618581 - RNA, 64 nt, hsa; identical to SEQ ID NO: 265015

SEQ ID NO: 618582 - RNA, 64 nt, hsa; identical to SEQ ID NO: 265016

SEQ ID NO: 618583 - RNA, 64 nt, hsa; identical to SEQ ID NO: 265017

SEQ ID NO: 618584 - RNA, 64 nt, hsa; identical to SEQ ID NO: 265018

SEQ ID NO: 618585 - RNA, 64 nt, hsa; identical to SEQ ID NO: 265019

SEQ ID NO: 618586 - RNA, 64 nt, hsa; identical to SEQ ID NO: 265020

SEQ ID NO: 618587 - RNA, 64 nt, hsa; identical to SEQ ID NO: 265021

SEQ ID NO: 618588 - RNA, 64 nt, hsa; identical to SEQ ID NO: 265022

SEQ ID NO: 618589 - RNA, 64 nt, hsa; identical to SEQ ID NO: 265023

SEQ ID NO: 618590 - RNA, 64 nt, hsa; identical to SEQ ID NO: 265024

SEQ ID NO: 618591 - RNA, 64 nt, hsa; identical to SEQ ID NO: 265025

SEQ ID NO: 618592 - RNA, 64 nt, hsa; identical to SEQ ID NO: 265026

SEQ ID NO: 618593 - RNA, 64 nt, hsa; identical to SEQ ID NO: 265027

SEQ ID NO: 618594 - RNA, 64 nt, hsa; identical to SEQ ID NO: 265028

SEQ ID NO: 618595 - RNA, 64 nt, hsa; identical to SEQ ID NO: 265029

SEQ ID NO: 618596 - RNA, 64 nt, hsa; identical to SEQ ID NO: 265030

SEQ ID NO: 618597 - RNA, 64 nt, hsa; identical to SEQ ID NO: 265031

SEQ ID NO: 618598 - RNA, 64 nt, hsa; identical to SEQ ID NO: 265032

SEQ ID NO: 618599 - RNA, 64 nt, hsa; identical to SEQ ID NO: 265033

SEQ ID NO: 618600 - RNA, 64 nt, hsa; identical to SEQ ID NO: 265034

SEQ ID NO: 618601 - RNA, 64 nt, hsa; identical to SEQ ID NO: 239110

SEQ ID NO: 618602 - RNA, 64 nt, hsa; identical to SEQ ID NO: 239111

SEQ ID NO: 618603 - RNA, 64 nt, hsa; identical to SEQ ID NO: 239112

SEQ ID NO: 618604 - RNA, 64 nt, hsa; identical to SEQ ID NO: 239113

SEQ ID NO: 618605 - RNA, 64 nt, hsa; identical to SEQ ID NO: 239114

SEQ ID NO: 618606 - RNA, 64 nt, hsa; identical to SEQ ID NO: 239115

SEQ ID NO: 618607 - RNA, 64 nt, hsa; identical to SEQ ID NO: 239116

SEQ ID NO: 618608 - RNA, 64 nt, hsa; identical to SEQ ID NO: 239117

SEQ ID NO: 618609 - RNA, 64 nt, hsa; identical to SEQ ID NO: 239118

SEQ ID NO: 618610 - RNA, 64 nt, hsa; identical to SEQ ID NO: 239119

SEQ ID NO: 618611 - RNA, 54 nt, hsa; identical to SEQ ID NO: 239120

SEQ ID NO: 618612 - RNA, 64 nt, hsa; identical to SEQ ID NO: 239121

SEQ ID NO: 618613 - RNA, 64 nt, hsa; identical to SEQ ID NO: 239122

SEQ ID NO: 618614 - RNA, 64 nt, hsa; identical to SEQ ID NO: 239123

SEQ ID NO: 618615 - RNA, 64 nt, hsa; identical to SEQ ID NO: 239124

SEQ ID NO: 618616 - RNA, 64 nt, hsa; identical to SEQ ID NO: 239125

SEQ ID NO: 618617 - RNA, 64 nt, hsa; identical to SEQ ID NO: 239126

SEQ ID NO: 618618 - RNA, 64 nt, hsa; identical to SEQ ID NO: 239127

SEQ ID NO: 618619 - RNA, 64 nt, hsa; identical to SEQ ID NO: 239128

SEQ ID NO: 618620 - RNA, 64 nt, hsa; identical to SEQ ID NO: 239129

SEQ ID NO: 618621 - RNA, 64 nt, hsa; identical to SEQ ID NO: 239130

SEQ ID NO: 618622 - RNA, 64 nt, hsa; identical to SEQ ID NO: 239131

SEQ ID NO: 618623 - RNA, 64 nt, hsa; identical to SEQ ID NO: 239132

SEQ ID NO: 618624 - RNA, 64 nt, hsa; identical to SEQ ID NO: 239133

SEQ ID NO: 618625 - RNA, 64 nt, hsa; identical to SEQ ID NO: 239134

SEQ ID NO: 618626 - RNA, 64 nt, hsa; identical to SEQ ID NO: 239135

SEQ ID NO: 618627 - RNA, 64 nt, hsa; identical to SEQ ID NO: 239136

SEQ ID NO: 618628 - RNA, 64 nt, hsa; identical to SEQ ID NO: 239137

SEQ ID NO: 618629 - RNA, 64 nt, hsa; identical to SEQ ID NO: 239138

SEQ ID NO: 618630 - RNA, 64 nt, hsa; identical to SEQ ID NO: 239139

SEQ ID NO: 618631 - RNA, 64 nt, hsa; identical to SEQ ID NO: 239140

SEQ ID NO: 618632 - RNA, 64 nt, hsa; identical to SEQ ID NO: 239141

SEQ ID NO: 618633 - RNA, 64 nt, hsa; identical to SEQ ID NO: 239142

SEQ ID NO: 618634 - RNA, 64 nt, hsa; identical to SEQ ID NO: 239143

SEQ ID NO: 618635 - RNA, 64 nt, hsa; identical to SEQ ID NO: 239144

SEQ ID NO: 618636 - RNA, 64 nt, hsa; identical to SEQ ID NO: 239145

SEQ ID NO: 618637 - RNA, 64 nt, hsa; identical to SEQ ID NO: 239146

SEQ ID NO: 618638 - RNA, 64 nt, hsa; identical to SEQ ID NO: 239147

SEQ ID NO: 618639 - RNA, 64 nt, hsa; identical to SEQ ID NO: 239148

SEQ ID NO: 618640 - RNA, 64 nt, hsa; identical to SEQ ID NO: 239149

SEQ ID NO: 618641 - RNA, 64 nt, hsa; identical to SEQ ID NO: 239150

SEQ ID NO: 618642 - RNA, 64 nt, hsa; identical to SEQ ID NO: 239151

SEQ ID NO: 618643 - RNA, 64 nt, hsa
aauuuucuauaaugguaagauguuuauaggaaaguaaugguaguucauguuugagaauuuuuuu

SEQ ID NO: 618644 - RNA, 64 nt, hsa
accuucugauuuugacauaauuggaaauuuucuauaaugguaagauguuuauaggaaaguaaug

SEQ ID NO: 618645 - RNA, 64 nt, hsa
guugugaauuuucuuucuuaaaaauuguaaaacauaaugguacccaaguuuuaaacuuagaugu

SEQ ID NO: 618646 - RNA, 64 nt, hsa
ccucuaguuuauuuauuugcucaucuuuaucaccuaaugguaguuuguuuucuuugguagagua

SEQ ID NO: 618647 - RNA, 64 nt, hsa
ugucauggugcaauuugucuuuggaaaauucagauaaugguaauuuaguguauaugugauuuuc

SEQ ID NO: 618648 - RNA, 64 nt, hsa
aaaaaaguugguauuuuauaagcacagacaauucuaaugguaacuuuuguagucuuaugaauag

SEQ ID NO: 618649 - RNA, 64 nt, hsa
auccuuauagacugaaagaauguagccucugcauuaaugguaaauggucuagaaguuuucguuu

SEQ ID NO: 618650 - RNA, 64 nt, hsa
ccaagcuuacuuuccaucuauaaaacagggcuaauaaugguaaucacaucuaauuuauaggguu

SEQ ID NO: 618651 - RNA, 64 nt, hsa
uuacauaggcuaaaaaacuauguaacuaaauaccuaaugguauuuaauuuuuguuuauugaauu

SEQ ID NO: 618652 - RNA, 64 nt, hsa
uguaaaaaaaauauauauaaacaauugaguuuacuaaugguaaacauuuuuauucugggauucg

SEQ ID NO: 618653 - RNA, 64 nt, hsa
aaaaacagccuucuagcacacuuuuuuaaaugaauaaugguagccuaaacuuaauauuuuuaua

SEQ ID NO: 618654 - RNA, 64 nt, hsa
aaaagaagaaaaucuucuuuacucugcauguuuuuaaugguaaacuggaaucccagauaugguu

SEQ ID NO: 618655 - RNA, 64 nt, hsa
ucacauucacagaaacauuggcagaacccaguuuuaaugguacagaggaguaguuuauaguguu

SEQ ID NO: 618656 - RNA, 64 nt, hsa
ugaaacuuguuggguagaaugaaaauuaaagccauaaugguagaagauggcauacugauuauaa

SEQ ID NO: 618657 - RNA, 62 nt, hsa
ggcagagaaagggacaaugauaguagagugauauggagcaagagauauuuugggcauguggg

SEQ ID NO: 618658 - RNA, 62 nt, hsa
ucuguuuccuguaccaguaggagaucagaaaaauggagcaaagugguagguacuuuuuguga

SEQ ID NO: 618659 - RNA, 62 nt, hsa
cgugcugggcauggggccugcucacagacagcauggagcagggaugggcugucugugcccau

SEQ ID NO: 618660 - RNA, 62 nt, hsa
aguggagggagacccagcauagccaggccaguauggagcaccucacgcacagcucucagaag

SEQ ID NO: 618661 - RNA, 62 nt, hsa
gcagcaggccaggccuuccuguccaggucugcauggagcacucggugacccagagcagggac

SEQ ID NO: 618662 - RNA, 62 nt, hsa
aggcccagugcucuuccugcccaccagggaccauggagcaguggcacccuauggggcuauga

SEQ ID NO: 618663 - RNA, 62 nt, hsa
acuuuuuuaaaaguaggaaccacaaucuuuauauggagcagcuuguuauaucugauuuucau

SEQ ID NO: 618664 - RNA, 62 nt, hsa
cauuuuuuacacuaucauugaggaauaauuacauggagcaugaaauuugggccuccaguaua

SEQ ID NO: 618665 - RNA, 62 nt, hsa
cacguggaauggaacaguggcuagagguauggauggagcaaggucaaauaugagcugaugga

SEQ ID NO: 618666 - RNA, 62 nt, hsa
ccucggccucccaaagugcugggauuacaggcauggagcaccgugccuggccaagauucuuu

SEQ ID NO: 618667 - RNA, 62 nt, hsa
uccgggaugaggcccuggcagaggugaaggacauggagcagcugcuggcccuugggaaggag

SEQ ID NO: 618668 - RNA, 62 nt, hsa
ucuccguccugcccaccuucuuaagaggcgagauggagcaggcccaucugccucugcccuuu

SEQ ID NO: 618669 - RNA, 62 nt, hsa
gaacugugcuguuggaaaaugagagcgaucacauggagcaguaauggagcaaagaccagcca

SEQ ID NO: 618670 - RNA, 62 nt, hsa
uuggaaaaugagagcgaucacauggagcaguaauggagcaaagaccagccaucccaguugag

SEQ ID NO: 618671 - RNA, 64 nt, hsa; identical to SEQ ID NO: 612668

SEQ ID NO: 618672 - RNA, 64 nt, hsa; identical to SEQ ID NO: 612669

SEQ ID NO: 618673 - RNA, 64 nt, hsa; identical to SEQ ID NO: 612670

SEQ ID NO: 618674 - RNA, 64 nt, hsa; identical to SEQ ID NO: 612671

SEQ ID NO: 618675 - RNA, 64 nt, hsa; identical to SEQ ID NO: 612672

SEQ ID NO: 618676 - RNA, 64 nt, hsa; identical to SEQ ID NO: 612673

SEQ ID NO: 618677 - RNA, 64 nt, hsa; identical to SEQ ID NO: 612674

SEQ ID NO: 618678 - RNA, 64 nt, hsa; identical to SEQ ID NO: 612675

SEQ ID NO: 618679 - RNA, 64 nt, hsa; identical to SEQ ID NO: 612676

SEQ ID NO: 618680 - RNA, 64 nt, hsa; identical to SEQ ID NO: 612677

SEQ ID NO: 618681 - RNA, 64 nt, hsa; identical to SEQ ID NO: 612678

SEQ ID NO: 618682 - RNA, 64 nt, hsa; identical to SEQ ID NO: 612679

SEQ ID NO: 618683 - RNA, 64 nt, hsa; identical to SEQ ID NO: 307734

SEQ ID NO: 618684 - RNA, 64 nt, hsa; identical to SEQ ID NO: 307735

SEQ ID NO: 618685 - RNA, 64 nt, hsa; identical to SEQ ID NO: 307736

SEQ ID NO: 618686 - RNA, 64 nt, hsa; identical to SEQ ID NO: 307737

SEQ ID NO: 618687 - RNA, 64 nt, hsa; identical to SEQ ID NO: 307738

SEQ ID NO: 618688 - RNA, 64 nt, hsa; identical to SEQ ID NO: 307739

SEQ ID NO: 618689 - RNA, 64 nt, hsa; identical to SEQ ID NO: 307740

SEQ ID NO: 618690 - RNA, 64 nt, hsa; identical to SEQ ID NO: 307741

SEQ ID NO: 618691 - RNA, 59 nt, hsa; identical to SEQ ID NO: 307742

SEQ ID NO: 618692 - RNA, 64 nt, hsa; identical to SEQ ID NO: 307743

SEQ ID NO: 618693 - RNA, 64 nt, hsa; identical to SEQ ID NO: 307744

SEQ ID NO: 618694 - RNA, 64 nt, hsa; identical to SEQ ID NO: 307745

SEQ ID NO: 618695 - RNA, 64 nt, hsa; identical to SEQ ID NO: 307746

SEQ ID NO: 618696 - RNA, 64 nt, hsa; identical to SEQ ID NO: 307747

SEQ ID NO: 618697 - RNA, 64 nt, hsa; identical to SEQ ID NO: 307748

SEQ ID NO: 618698 - RNA, 64 nt, hsa; identical to SEQ ID NO: 307749

SEQ ID NO: 618699 - RNA, 64 nt, hsa; identical to SEQ ID NO: 307750

SEQ ID NO: 618700 - RNA, 64 nt, hsa; identical to SEQ ID NO: 307751

SEQ ID NO: 618701 - RNA, 64 nt, hsa; identical to SEQ ID NO: 307752

SEQ ID NO: 618702 - RNA, 64 nt, hsa; identical to SEQ ID NO: 307753

SEQ ID NO: 618703 - RNA, 64 nt, hsa; identical to SEQ ID NO: 307754

SEQ ID NO: 618704 - RNA, 64 nt, hsa; identical to SEQ ID NO: 307755

SEQ ID NO: 618705 - RNA, 64 nt, hsa; identical to SEQ ID NO: 307756

SEQ ID NO: 618706 - RNA, 64 nt, hsa; identical to SEQ ID NO: 307757

SEQ ID NO: 618707 - RNA, 64 nt, hsa; identical to SEQ ID NO: 307758

SEQ ID NO: 618708 - RNA, 64 nt, hsa; identical to SEQ ID NO: 307759

SEQ ID NO: 618709 - RNA, 64 nt, hsa; identical to SEQ ID NO: 307760

SEQ ID NO: 618710 - RNA, 64 nt, hsa; identical to SEQ ID NO: 307761

SEQ ID NO: 618711 - RNA, 64 nt, hsa; identical to SEQ ID NO: 307762

SEQ ID NO: 618712 - RNA, 64 nt, hsa; identical to SEQ ID NO: 307763

SEQ ID NO: 618713 - RNA, 64 nt, hsa; identical to SEQ ID NO: 307764

SEQ ID NO: 618714 - RNA, 64 nt, hsa; identical to SEQ ID NO: 307765

SEQ ID NO: 618715 - RNA, 64 nt, hsa; identical to SEQ ID NO: 307766

SEQ ID NO: 618716 - RNA, 64 nt, hsa; identical to SEQ ID NO: 307767

SEQ ID NO: 618717 - RNA, 64 nt, hsa; identical to SEQ ID NO: 307768

SEQ ID NO: 618718 - RNA, 64 nt, hsa; identical to SEQ ID NO: 307769

SEQ ID NO: 618719 - RNA, 64 nt, hsa; identical to SEQ ID NO: 307770

SEQ ID NO: 618720 - RNA, 64 nt, hsa; identical to SEQ ID NO: 307771

SEQ ID NO: 618721 - RNA, 64 nt, hsa; identical to SEQ ID NO: 307772

SEQ ID NO: 618722 - RNA, 64 nt, hsa; identical to SEQ ID NO: 307773

SEQ ID NO: 618723 - RNA, 64 nt, hsa; identical to SEQ ID NO: 307774

SEQ ID NO: 618724 - RNA, 64 nt, hsa; identical to SEQ ID NO: 307775

SEQ ID NO: 618725 - RNA, 64 nt, hsa; identical to SEQ ID NO: 307776

SEQ ID NO: 618726 - RNA, 64 nt, hsa; identical to SEQ ID NO: 307777

SEQ ID NO: 618727 - RNA, 64 nt, hsa; identical to SEQ ID NO: 307778

SEQ ID NO: 618728 - RNA, 64 nt, hsa; identical to SEQ ID NO: 307779

SEQ ID NO: 618729 - RNA, 64 nt, hsa; identical to SEQ ID NO: 307780

SEQ ID NO: 618730 - RNA, 64 nt, hsa; identical to SEQ ID NO: 307781

SEQ ID NO: 618731 - RNA, 64 nt, hsa; identical to SEQ ID NO: 307782

SEQ ID NO: 618732 - RNA, 64 nt, hsa; identical to SEQ ID NO: 307783

SEQ ID NO: 618733 - RNA, 64 nt, hsa; identical to SEQ ID NO: 307784

SEQ ID NO: 618734 - RNA, 64 nt, hsa; identical to SEQ ID NO: 307785

SEQ ID NO: 618735 - RNA, 64 nt, hsa; identical to SEQ ID NO: 307786

SEQ ID NO: 618736 - RNA, 64 nt, hsa; identical to SEQ ID NO: 307787

SEQ ID NO: 618737 - RNA, 64 nt, hsa; identical to SEQ ID NO: 307788

SEQ ID NO: 618738 - RNA, 64 nt, hsa; identical to SEQ ID NO: 307789

SEQ ID NO: 618739 - RNA, 64 nt, hsa; identical to SEQ ID NO: 307790

SEQ ID NO: 618740 - RNA, 64 nt, hsa; identical to SEQ ID NO: 307791

SEQ ID NO: 618741 - RNA, 64 nt, hsa; identical to SEQ ID NO: 307792

SEQ ID NO: 618742 - RNA, 64 nt, hsa; identical to SEQ ID NO: 307793

SEQ ID NO: 618743 - RNA, 64 nt, hsa; identical to SEQ ID NO: 307794

SEQ ID NO: 618744 - RNA, 64 nt, hsa; identical to SEQ ID NO: 307795

SEQ ID NO: 618745 - RNA, 64 nt, hsa; identical to SEQ ID NO: 307796

SEQ ID NO: 618746 - RNA, 62 nt, hsa; identical to SEQ ID NO: 307797

SEQ ID NO: 618747 - RNA, 64 nt, hsa; identical to SEQ ID NO: 307798

SEQ ID NO: 618748 - RNA, 64 nt, hsa; identical to SEQ ID NO: 307799

SEQ ID NO: 618749 - RNA, 64 nt, hsa; identical to SEQ ID NO: 307800

SEQ ID NO: 618750 - RNA, 64 nt, hsa; identical to SEQ ID NO: 307801

SEQ ID NO: 618751 - RNA, 64 nt, hsa; identical to SEQ ID NO: 307802

SEQ ID NO: 618752 - RNA, 64 nt, hsa; identical to SEQ ID NO: 307803

SEQ ID NO: 618753 - RNA, 64 nt, hsa; identical to SEQ ID NO: 307804

SEQ ID NO: 618754 - RNA, 64 nt, hsa; identical to SEQ ID NO: 307805

SEQ ID NO: 618755 - RNA, 64 nt, hsa; identical to SEQ ID NO: 307806

SEQ ID NO: 618756 - RNA, 64 nt, hsa; identical to SEQ ID NO: 307807

SEQ ID NO: 618757 - RNA, 64 nt, hsa; identical to SEQ ID NO: 307808

SEQ ID NO: 618758 - RNA, 64 nt, hsa; identical to SEQ ID NO: 307809

SEQ ID NO: 618759 - RNA, 64 nt, hsa; identical to SEQ ID NO: 357989

SEQ ID NO: 618760 - RNA, 64 nt, hsa; identical to SEQ ID NO: 357990

SEQ ID NO: 618761 - RNA, 64 nt, hsa; identical to SEQ ID NO: 357991

SEQ ID NO: 618762 - RNA, 64 nt, hsa; identical to SEQ ID NO: 357992

SEQ ID NO: 618763 - RNA, 64 nt, hsa; identical to SEQ ID NO: 357993

SEQ ID NO: 618764 - RNA, 64 nt, hsa; identical to SEQ ID NO: 357994

SEQ ID NO: 618765 - RNA, 64 nt, hsa; identical to SEQ ID NO: 357995

SEQ ID NO: 618766 - RNA, 64 nt, hsa; identical to SEQ ID NO: 357996

SEQ ID NO: 618767 - RNA, 64 nt, hsa; identical to SEQ ID NO: 357997

SEQ ID NO: 618768 - RNA, 64 nt, hsa; identical to SEQ ID NO: 357998

SEQ ID NO: 618769 - RNA, 64 nt, hsa; identical to SEQ ID NO: 357999

SEQ ID NO: 618770 - RNA, 64 nt, hsa; identical to SEQ ID NO: 358000

SEQ ID NO: 618771 - RNA, 64 nt, hsa; identical to SEQ ID NO: 358001

SEQ ID NO: 618772 - RNA, 64 nt, hsa; identical to SEQ ID NO: 358002

SEQ ID NO: 618773 - RNA, 64 nt, hsa; identical to SEQ ID NO: 358003

SEQ ID NO: 618774 - RNA, 64 nt, hsa; identical to SEQ ID NO: 358004

SEQ ID NO: 618775 - RNA, 64 nt, hsa; identical to SEQ ID NO: 358005

SEQ ID NO: 618776 - RNA, 64 nt, hsa; identical to SEQ ID NO: 358006

SEQ ID NO: 618777 - RNA, 64 nt, hsa; identical to SEQ ID NO: 358007

SEQ ID NO: 618778 - RNA, 64 nt, hsa; identical to SEQ ID NO: 358008

SEQ ID NO: 618779 - RNA, 64 nt, hsa; identical to SEQ ID NO: 358009

SEQ ID NO: 618780 - RNA, 64 nt, hsa; identical to SEQ ID NO: 358010

SEQ ID NO: 618781 - RNA, 64 nt, hsa; identical to SEQ ID NO: 358011

SEQ ID NO: 618782 - RNA, 64 nt, hsa; identical to SEQ ID NO: 358012

SEQ ID NO: 618783 - RNA, 64 nt, hsa; identical to SEQ ID NO: 358013

SEQ ID NO: 618784 - RNA, 64 nt, hsa; identical to SEQ ID NO: 358014

SEQ ID NO: 618785 - RNA, 64 nt, hsa; identical to SEQ ID NO: 358015

SEQ ID NO: 618786 - RNA, 64 nt, hsa; identical to SEQ ID NO: 358016

SEQ ID NO: 618787 - RNA, 64 nt, hsa; identical to SEQ ID NO: 358017

SEQ ID NO: 618788 - RNA, 64 nt, hsa; identical to SEQ ID NO: 358018

SEQ ID NO: 618789 - RNA, 64 nt, hsa; identical to SEQ ID NO: 358019

SEQ ID NO: 618790 - RNA, 64 nt, hsa; identical to SEQ ID NO: 358020

SEQ ID NO: 618791 - RNA, 64 nt, hsa; identical to SEQ ID NO: 358021

SEQ ID NO: 618792 - RNA, 64 nt, hsa; identical to SEQ ID NO: 358022

SEQ ID NO: 618793 - RNA, 64 nt, hsa; identical to SEQ ID NO: 358023

SEQ ID NO: 618794 - RNA, 64 nt, hsa; identical to SEQ ID NO: 358024

SEQ ID NO: 618795 - RNA, 64 nt, hsa; identical to SEQ ID NO: 358025

SEQ ID NO: 618796 - RNA, 64 nt, hsa; identical to SEQ ID NO: 358026

SEQ ID NO: 618797 - RNA, 64 nt, hsa; identical to SEQ ID NO: 358027

SEQ ID NO: 618798 - RNA, 64 nt, hsa; identical to SEQ ID NO: 358028

SEQ ID NO: 618799 - RNA, 64 nt, hsa; identical to SEQ ID NO: 358029

SEQ ID NO: 618800 - RNA, 64 nt, hsa; identical to SEQ ID NO: 358030

SEQ ID NO: 618801 - RNA, 64 nt, hsa; identical to SEQ ID NO: 358031

SEQ ID NO: 618802 - RNA, 64 nt, hsa; identical to SEQ ID NO: 358032

SEQ ID NO: 618803 - RNA, 64 nt, hsa; identical to SEQ ID NO: 358033

SEQ ID NO: 618804 - RNA, 64 nt, hsa; identical to SEQ ID NO: 358034

SEQ ID NO: 618805 - RNA, 64 nt, hsa; identical to SEQ ID NO: 358035

SEQ ID NO: 618806 - RNA, 64 nt, hsa; identical to SEQ ID NO: 358036

SEQ ID NO: 618807 - RNA, 64 nt, hsa; identical to SEQ ID NO: 358037

SEQ ID NO: 618808 - RNA, 64 nt, hsa; identical to SEQ ID NO: 358038

SEQ ID NO: 618809 - RNA, 64 nt, hsa; identical to SEQ ID NO: 358039

SEQ ID NO: 618810 - RNA, 64 nt, hsa; identical to SEQ ID NO: 358040

SEQ ID NO: 618811 - RNA, 64 nt, hsa; identical to SEQ ID NO: 358041

SEQ ID NO: 618812 - RNA, 64 nt, hsa; identical to SEQ ID NO: 358042

SEQ ID NO: 618813 - RNA, 64 nt, hsa; identical to SEQ ID NO: 358043

SEQ ID NO: 618814 - RNA, 64 nt, hsa; identical to SEQ ID NO: 358044

SEQ ID NO: 618815 - RNA, 64 nt, hsa; identical to SEQ ID NO: 358045

SEQ ID NO: 618816 - RNA, 64 nt, hsa; identical to SEQ ID NO: 358046

SEQ ID NO: 618817 - RNA, 64 nt, hsa; identical to SEQ ID NO: 358047

SEQ ID NO: 618818 - RNA, 64 nt, hsa; identical to SEQ ID NO: 358048

SEQ ID NO: 618819 - RNA, 64 nt, hsa; identical to SEQ ID NO: 358049

SEQ ID NO: 618820 - RNA, 64 nt, hsa; identical to SEQ ID NO: 358050

SEQ ID NO: 618821 - RNA, 64 nt, hsa; identical to SEQ ID NO: 358051

SEQ ID NO: 618822 - RNA, 64 nt, hsa; identical to SEQ ID NO: 358052

SEQ ID NO: 618823 - RNA, 64 nt, hsa; identical to SEQ ID NO: 358053

SEQ ID NO: 618824 - RNA, 64 nt, hsa; identical to SEQ ID NO: 358054

SEQ ID NO: 618825 - RNA, 64 nt, hsa; identical to SEQ ID NO: 358055

SEQ ID NO: 618826 - RNA, 64 nt, hsa; identical to SEQ ID NO: 358056

SEQ ID NO: 618827 - RNA, 64 nt, hsa; identical to SEQ ID NO: 358057

SEQ ID NO: 618828 - RNA, 64 nt, hsa; identical to SEQ ID NO: 358058

SEQ ID NO: 618829 - RNA, 64 nt, hsa; identical to SEQ ID NO: 358059

SEQ ID NO: 618830 - RNA, 64 nt, hsa; identical to SEQ ID NO: 358060

SEQ ID NO: 618831 - RNA, 64 nt, hsa; identical to SEQ ID NO: 358061

SEQ ID NO: 618832 - RNA, 64 nt, hsa; identical to SEQ ID NO: 75323

SEQ ID NO: 618833 - RNA, 64 nt, hsa; identical to SEQ ID NO: 75324

SEQ ID NO: 618834 - RNA, 64 nt, hsa; identical to SEQ ID NO: 75325

SEQ ID NO: 618835 - RNA, 64 nt, hsa; identical to SEQ ID NO: 75326

SEQ ID NO: 618836 - RNA, 64 nt, hsa; identical to SEQ ID NO: 75327

SEQ ID NO: 618837 - RNA, 64 nt, hsa; identical to SEQ ID NO: 75328

SEQ ID NO: 618838 - RNA, 64 nt, hsa; identical to SEQ ID NO: 75329

SEQ ID NO: 618839 - RNA, 64 nt, hsa; identical to SEQ ID NO: 75330

SEQ ID NO: 618840 - RNA, 64 nt, hsa; identical to SEQ ID NO: 75331

SEQ ID NO: 618841 - RNA, 64 nt, hsa; identical to SEQ ID NO: 75332

SEQ ID NO: 618842 - RNA, 64 nt, hsa; identical to SEQ ID NO: 75333

SEQ ID NO: 618843 - RNA, 64 nt, hsa; identical to SEQ ID NO: 75334

SEQ ID NO: 618844 - RNA, 64 nt, hsa; identical to SEQ ID NO: 75335

SEQ ID NO: 618845 - RNA, 64 nt, hsa; identical to SEQ ID NO: 75336

SEQ ID NO: 618846 - RNA, 64 nt, hsa; identical to SEQ ID NO: 75337

SEQ ID NO: 618847 - RNA, 64 nt, hsa; identical to SEQ ID NO: 75338

SEQ ID NO: 618848 - RNA, 64 nt, hsa; identical to SEQ ID NO: 75339

SEQ ID NO: 618849 - RNA, 64 nt, hsa; identical to SEQ ID NO: 75340

SEQ ID NO: 618850 - RNA, 64 nt, hsa; identical to SEQ ID NO: 75341

SEQ ID NO: 618851 - RNA, 64 nt, hsa; identical to SEQ ID NO: 75342

SEQ ID NO: 618852 - RNA, 64 nt, hsa; identical to SEQ ID NO: 75343

SEQ ID NO: 618853 - RNA, 64 nt, hsa; identical to SEQ ID NO: 75344

SEQ ID NO: 618854 - RNA, 64 nt, hsa
auuauacauccuuuaauuaaaaacuauauauguaacuucuuagauauuagcaaaugucucugcu

SEQ ID NO: 618855 - RNA, 64 nt, hsa
aaucuaaaugcuggcucaaauuuauuccccagcuacuucuuauaccacuauucuuuuaauguuu

SEQ ID NO: 618856 - RNA, 64 nt, hsa
agacuacauuugaaauccaaacuuggaguauauaacuucuuauugagcccaacugcuuuuuuuu

SEQ ID NO: 618857 - RNA, 64 nt, hsa
gagacccagccgcgucucacacagguggaauugcacuucuuaacaaaaaggaacuuuauaaaag

SEQ ID NO: 618858 - RNA, 64 nt, hsa
ggaggccucagaaucauggugggaggcaaaagacacuucuuacauuguggcaagaaaaaaugag

SEQ ID NO: 618859 - RNA, 64 nt, hsa
ggaggccucagaaucauggcgggaggugaaaggcacuucuuacauggcagcaagagaaaaugag

SEQ ID NO: 618860 - RNA, 64 nt, hsa
ugcuuuugggucuucuccaaaguaaauugcauggacuucuuaaagaaguuugaaaucaguaaaa

SEQ ID NO: 618861 - RNA, 64 nt, hsa
gagcagucgaagugguaguauggguaaguuaagcacuucuuaacauuguagcagaaaauuccaa

SEQ ID NO: 618862 - RNA, 64 nt, hsa
gggaauaaucugacuucguuggcaguuggccuuaacuucuuaaucauugauccaggaauauuuc

SEQ ID NO: 618863 - RNA, 64 nt, hsa
acuacaauguaaaaccucaauaaaagugcgcuguacuucuuaauguuuauuaaaagauguauuu

SEQ ID NO: 618864 - RNA, 64 nt, hsa
augaguguaugucugaaccuguaauucuuaaaagacuucuuaaucuucuagaagaaaaaucucc

SEQ ID NO: 618865 - RNA, 64 nt, hsa
uuggauaaaauugaaccaacuucaagaaugcagcacuucuuaaucuuuagcucuuucuugggag

SEQ ID NO: 618866 - RNA, 64 nt, hsa
uggucuccaauugcauggucucuguggaucucugacuucuuauuaccuccgauuggaacgcgcc

SEQ ID NO: 618867 - RNA, 64 nt, hsa
gaaugccagaugggaugagaugggauguuaaaccacuucuuauuaccacguuguuggccuccau

SEQ ID NO: 618868 - RNA, 64 nt, hsa
gagccuucacugguucugcaucacccgccccuggacuucuuaguuguuucucuagcgcugagcu

SEQ ID NO: 618869 - RNA, 64 nt, hsa
ugcguaauuuaauggggucuguaaauacuggugcacuucuuacgacuuuuuugagacaugggau

SEQ ID NO: 618870 - RNA, 64 nt, hsa
cucagugcuagcuuauuuguauuuuuccucuuucacuucuuauggaggagaguguuuaacugag

SEQ ID NO: 618871 - RNA, 64 nt, hsa
guccugacacaccuuuugggaaaugcugauuuaaacuucuuaacuggcaacaguuggaacagua

SEQ ID NO: 618872 - RNA, 64 nt, hsa; identical to SEQ ID NO: 52870

SEQ ID NO: 618873 - RNA, 64 nt, hsa; identical to SEQ ID NO: 52871

SEQ ID NO: 618874 - RNA, 64 nt, hsa; identical to SEQ ID NO: 52872

SEQ ID NO: 618875 - RNA, 64 nt, hsa; identical to SEQ ID NO: 52873

SEQ ID NO: 618876 - RNA, 64 nt, hsa; identical to SEQ ID NO: 52874

SEQ ID NO: 618877 - RNA, 64 nt, hsa; identical to SEQ ID NO: 83782

SEQ ID NO: 618878 - RNA, 64 nt, hsa; identical to SEQ ID NO: 83783

SEQ ID NO: 618879 - RNA, 64 nt, hsa; identical to SEQ ID NO: 83784

SEQ ID NO: 618880 - RNA, 64 nt, hsa; identical to SEQ ID NO: 83785

SEQ ID NO: 618881 - RNA, 64 nt, hsa; identical to SEQ ID NO: 83786

SEQ ID NO: 618882 - RNA, 64 nt, hsa; identical to SEQ ID NO: 83787

SEQ ID NO: 618883 - RNA, 64 nt, hsa; identical to SEQ ID NO: 83788

SEQ ID NO: 618884 - RNA, 64 nt, hsa; identical to SEQ ID NO: 83789

SEQ ID NO: 618885 - RNA, 64 nt, hsa; identical to SEQ ID NO: 83790

SEQ ID NO: 618886 - RNA, 64 nt, hsa; identical to SEQ ID NO: 83791

SEQ ID NO: 618887 - RNA, 64 nt, hsa; identical to SEQ ID NO: 83792

SEQ ID NO: 618888 - RNA, 64 nt, hsa; identical to SEQ ID NO: 83793

SEQ ID NO: 618889 - RNA, 64 nt, hsa; identical to SEQ ID NO: 83794

SEQ ID NO: 618890 - RNA, 64 nt, hsa; identical to SEQ ID NO: 83795

SEQ ID NO: 618891 - RNA, 64 nt, hsa; identical to SEQ ID NO: 83796

SEQ ID NO: 618892 - RNA, 64 nt, hsa; identical to SEQ ID NO: 83797

SEQ ID NO: 618893 - RNA, 64 nt, hsa; identical to SEQ ID NO: 83798

SEQ ID NO: 618894 - RNA, 64 nt, hsa; identical to SEQ ID NO: 83799

SEQ ID NO: 618895 - RNA, 64 nt, hsa; identical to SEQ ID NO: 83800

SEQ ID NO: 618896 - RNA, 64 nt, hsa; identical to SEQ ID NO: 83801

SEQ ID NO: 618897 - RNA, 64 nt, hsa; identical to SEQ ID NO: 83802

SEQ ID NO: 618898 - RNA, 64 nt, hsa; identical to SEQ ID NO: 83803

SEQ ID NO: 618899 - RNA, 64 nt, hsa; identical to SEQ ID NO: 83804

SEQ ID NO: 618900 - RNA, 64 nt, hsa; identical to SEQ ID NO: 83805

SEQ ID NO: 618901 - RNA, 64 nt, hsa; identical to SEQ ID NO: 83806

SEQ ID NO: 618902 - RNA, 64 nt, hsa; identical to SEQ ID NO: 83807

SEQ ID NO: 618903 - RNA, 64 nt, hsa; identical to SEQ ID NO: 83808

SEQ ID NO: 618904 - RNA, 64 nt, hsa; identical to SEQ ID NO: 83809

SEQ ID NO: 618905 - RNA, 64 nt, hsa; identical to SEQ ID NO: 83810

SEQ ID NO: 618906 - RNA, 64 nt, hsa; identical to SEQ ID NO: 83811

SEQ ID NO: 618907 - RNA, 64 nt, hsa; identical to SEQ ID NO: 83812

SEQ ID NO: 618908 - RNA, 64 nt, hsa; identical to SEQ ID NO: 83813

SEQ ID NO: 618909 - RNA, 64 nt, hsa; identical to SEQ ID NO: 282954

SEQ ID NO: 618910 - RNA, 64 nt, hsa; identical to SEQ ID NO: 282955

SEQ ID NO: 618911 - RNA, 64 nt, hsa; identical to SEQ ID NO: 282956

SEQ ID NO: 618912 - RNA, 64 nt, hsa; identical to SEQ ID NO: 282957

SEQ ID NO: 618913 - RNA, 64 nt, hsa
uugagcuuugcagguucaauuuagguaaaaaucacauuaugaaacugggaaagucugaaggaau

SEQ ID NO: 618914 - RNA, 64 nt, hsa
gauugacuuuauuuuuuuauagugcuuaauucaccauuaugagaaaugcuuccagucacaaaaa

SEQ ID NO: 618915 - RNA, 64 nt, hsa
auuuccccacaagaucugaaguuugguauuuuugcauuaugacaguuguugagacuaggauuuu

SEQ ID NO: 618916 - RNA, 64 nt, hsa
aauuuugaaaucguauauaugagcuauacuuuaacauuaugagagaaaagcauaaaacaaaaau

SEQ ID NO: 618917 - RNA, 55 nt, hsa
auuuuauucccaucaauugagaaaccauuaugaagaagagaguccauauuucaau

SEQ ID NO: 618918 - RNA, 64 nt, hsa
gaaagcaucacuugggauuaauauggggaugcagcauuaugaugugggucaaggaauuaaguua

SEQ ID NO: 618919 - RNA, 64 nt, hsa
uuuguaaguuguggaaaaagcuaauuguaguuuucauuaugaaguuuucccaauaaaccaggua

SEQ ID NO: 618920 - RNA, 64 nt, hsa
ucugaauagcauauauaugaugcaucggauaggucauuaugauuuuuuaccauuucgacuuaca

SEQ ID NO: 618921 - RNA, 64 nt, hsa
guuuugaauggcauuucauuaaggcaucuaugggcauuaugagcuaaaagcugugguauguuag

SEQ ID NO: 618922 - RNA, 64 nt, hsa
cccccucccuaauugcagugggggcuaaggcauccauuaugaauacagcagaacauuugcuggc

SEQ ID NO: 618923 - RNA, 64 nt, hsa
cuaccauauuuaaaaauaucucaagguuucuguucauuaugaaacaucaauauguuuucuacca

SEQ ID NO: 618924 - RNA, 64 nt, hsa
gaauuuacccucauauucuuuaaaaaacuuaaagcauuaugaauguagagaaauucaccagagc

SEQ ID NO: 618925 - RNA, 64 nt, hsa; identical to SEQ ID NO: 23238

SEQ ID NO: 618926 - RNA, 64 nt, hsa; identical to SEQ ID NO: 23239

SEQ ID NO: 618927 - RNA, 64 nt, hsa; identical to SEQ ID NO: 23240

SEQ ID NO: 618928 - RNA, 64 nt, hsa; identical to SEQ ID NO: 23241

SEQ ID NO: 618929 - RNA, 64 nt, hsa; identical to SEQ ID NO: 123292

SEQ ID NO: 618930 - RNA, 64 nt, hsa; identical to SEQ ID NO: 123293

SEQ ID NO: 618931 - RNA, 64 nt, hsa; identical to SEQ ID NO: 123294

SEQ ID NO: 618932 - RNA, 64 nt, hsa; identical to SEQ ID NO: 123295

SEQ ID NO: 618933 - RNA, 64 nt, hsa; identical to SEQ ID NO: 123296

SEQ ID NO: 618934 - RNA, 64 nt, hsa; identical to SEQ ID NO: 123297

SEQ ID NO: 618935 - RNA, 64 nt, hsa; identical to SEQ ID NO: 123298

SEQ ID NO: 618936 - RNA, 64 nt, hsa; identical to SEQ ID NO: 123299

SEQ ID NO: 618937 - RNA, 64 nt, hsa; identical to SEQ ID NO: 123300

SEQ ID NO: 618938 - RNA, 64 nt, hsa; identical to SEQ ID NO: 123301

SEQ ID NO: 618939 - RNA, 64 nt, hsa; identical to SEQ ID NO: 123302

SEQ ID NO: 618940 - RNA, 64 nt, hsa; identical to SEQ ID NO: 123303

SEQ ID NO: 618941 - RNA, 64 nt, hsa; identical to SEQ ID NO: 123304

SEQ ID NO: 618942 - RNA, 64 nt, hsa; identical to SEQ ID NO: 123305

SEQ ID NO: 618943 - RNA, 64 nt, hsa; identical to SEQ ID NO: 123306

SEQ ID NO: 618944 - RNA, 64 nt, hsa; identical to SEQ ID NO: 123307

SEQ ID NO: 618945 - RNA, 64 nt, hsa
acaacuugcauacuuugauggagcuuaauugugugaguagaauauguagcaaagcuuuuuagga

SEQ ID NO: 618946 - RNA, 64 nt, hsa
caggaaugauggggucugguuuaugugaacaagugaguagaaaccccuuuggaucauuuuauua

SEQ ID NO: 618947 - RNA, 64 nt, hsa
aggaguacacagaauagaauuuagacugucccuugaguagaauccacugauuuucuguggcucc

SEQ ID NO: 618948 - RNA, 64 nt, hsa
aacuguacuaaucccuuuccccagauuguaucaugaguagaaucagguucacguggugcuucaa

SEQ ID NO: 618949 - RNA, 64 nt, hsa
uguggccagggguugggagaacuuuacaaacauuaggaccuaacacugucucaucgcugaaaua

SEQ ID NO: 618950 - RNA, 64 nt, hsa
aagguccugugugacccucucugcaucuguccccaggaccuaugcucccugcucacccccuucu

SEQ ID NO: 618951 - RNA, 64 nt, hsa
uucccugugggccagggaugcucggucccagaggaggaccuagugacaucaugggacaggucaa

SEQ ID NO: 618952 - RNA, 64 nt, hsa
agcugcccuccuggugcagggccgaggggacacaaggaccuaccuggaagcagcugacaugcug

SEQ ID NO: 618953 - RNA, 64 nt, hsa
uuauguuacaaggugaucaagugaaggaaaaaccugagccuaucuggcugggaugguggaauua

SEQ ID NO: 618954 - RNA, 64 nt, hsa
agcaagaucaggagcuccugauagcaggcgucuuugagccuagcugggguagaggcacugccca

SEQ ID NO: 618955 - RNA, 64 nt, hsa; identical to SEQ ID NO: 270360

SEQ ID NO: 618956 - RNA, 64 nt, hsa; identical to SEQ ID NO: 270361

SEQ ID NO: 618957 - RNA, 64 nt, hsa; identical to SEQ ID NO: 270362

SEQ ID NO: 618958 - RNA, 64 nt, hsa; identical to SEQ ID NO: 270363

SEQ ID NO: 618959 - RNA, 64 nt, hsa; identical to SEQ ID NO: 270364

SEQ ID NO: 618960 - RNA, 64 nt, hsa; identical to SEQ ID NO: 270365

SEQ ID NO: 618961 - RNA, 64 nt, hsa; identical to SEQ ID NO: 175633

SEQ ID NO: 618962 - RNA, 64 nt, hsa; identical to SEQ ID NO: 175634

SEQ ID NO: 618963 - RNA, 64 nt, hsa; identical to SEQ ID NO: 175635

SEQ ID NO: 618964 - RNA, 64 nt, hsa; identical to SEQ ID NO: 175636

SEQ ID NO: 618965 - RNA, 64 nt, hsa; identical to SEQ ID NO: 175637

SEQ ID NO: 618966 - RNA, 64 nt, hsa; identical to SEQ ID NO: 175638

SEQ ID NO: 618967 - RNA, 64 nt, hsa; identical to SEQ ID NO: 175639

SEQ ID NO: 618968 - RNA, 64 nt, hsa; identical to SEQ ID NO: 175640

SEQ ID NO: 618969 - RNA, 64 nt, hsa; identical to SEQ ID NO: 175641

SEQ ID NO: 618970 - RNA, 64 nt, hsa; identical to SEQ ID NO: 175642

SEQ ID NO: 618971 - RNA, 64 nt, hsa; identical to SEQ ID NO: 175643

SEQ ID NO: 618972 - RNA, 64 nt, hsa; identical to SEQ ID NO: 175644

SEQ ID NO: 618973 - RNA, 64 nt, hsa; identical to SEQ ID NO: 175645

SEQ ID NO: 618974 - RNA, 64 nt, hsa; identical to SEQ ID NO: 175646

SEQ ID NO: 618975 - RNA, 64 nt, hsa; identical to SEQ ID NO: 175647

SEQ ID NO: 618976 - RNA, 64 nt, hsa; identical to SEQ ID NO: 175648

SEQ ID NO: 618977 - RNA, 64 nt, hsa; identical to SEQ ID NO: 175649

SEQ ID NO: 618978 - RNA, 64 nt, hsa; identical to SEQ ID NO: 175650

SEQ ID NO: 618979 - RNA, 64 nt, hsa; identical to SEQ ID NO: 175651

SEQ ID NO: 618980 - RNA, 64 nt, hsa; identical to SEQ ID NO: 175652

SEQ ID NO: 618981 - RNA, 64 nt, hsa; identical to SEQ ID NO: 175653

SEQ ID NO: 618982 - RNA, 64 nt, hsa; identical to SEQ ID NO: 175654

SEQ ID NO: 618983 - RNA, 64 nt, hsa; identical to SEQ ID NO: 175655

SEQ ID NO: 618984 - RNA, 64 nt, hsa; identical to SEQ ID NO: 175656

SEQ ID NO: 618985 - RNA, 64 nt, hsa; identical to SEQ ID NO: 175657

SEQ ID NO: 618986 - RNA, 64 nt, hsa; identical to SEQ ID NO: 175658

SEQ ID NO: 618987 - RNA, 64 nt, hsa; identical to SEQ ID NO: 175659

SEQ ID NO: 618988 - RNA, 64 nt, hsa; identical to SEQ ID NO: 175660

SEQ ID NO: 618989 - RNA, 64 nt, hsa; identical to SEQ ID NO: 175661

SEQ ID NO: 618990 - RNA, 64 nt, hsa; identical to SEQ ID NO: 175662

SEQ ID NO: 618991 - RNA, 64 nt, hsa; identical to SEQ ID NO: 175663

SEQ ID NO: 618992 - RNA, 64 nt, hsa; identical to SEQ ID NO: 175664

SEQ ID NO: 618993 - RNA, 64 nt, hsa; identical to SEQ ID NO: 175665

SEQ ID NO: 618994 - RNA, 64 nt, hsa; identical to SEQ ID NO: 175666

SEQ ID NO: 618995 - RNA, 64 nt, hsa; identical to SEQ ID NO: 175667

SEQ ID NO: 618996 - RNA, 64 nt, hsa; identical to SEQ ID NO: 175668

SEQ ID NO: 618997 - RNA, 64 nt, hsa; identical to SEQ ID NO: 175669

SEQ ID NO: 618998 - RNA, 64 nt, hsa; identical to SEQ ID NO: 175670

SEQ ID NO: 618999 - RNA, 64 nt, hsa; identical to SEQ ID NO: 175671

SEQ ID NO: 619000 - RNA, 64 nt, hsa; identical to SEQ ID NO: 175672

SEQ ID NO: 619001 - RNA, 64 nt, hsa; identical to SEQ ID NO: 175673

SEQ ID NO: 619002 - RNA, 64 nt, hsa; identical to SEQ ID NO: 175674

SEQ ID NO: 619003 - RNA, 64 nt, hsa; identical to SEQ ID NO: 175675

SEQ ID NO: 619004 - RNA, 64 nt, hsa; identical to SEQ ID NO: 175676

SEQ ID NO: 619005 - RNA, 64 nt, hsa; identical to SEQ ID NO: 175677

SEQ ID NO: 619006 - RNA, 64 nt, hsa; identical to SEQ ID NO: 175678

SEQ ID NO: 619007 - RNA, 64 nt, hsa; identical to SEQ ID NO: 175679

SEQ ID NO: 619008 - RNA, 64 nt, hsa; identical to SEQ ID NO: 175680

SEQ ID NO: 619009 - RNA, 64 nt, hsa; identical to SEQ ID NO: 175681

SEQ ID NO: 619010 - RNA, 64 nt, hsa; identical to SEQ ID NO: 175682

SEQ ID NO: 619011 - RNA, 64 nt, hsa; identical to SEQ ID NO: 175683

SEQ ID NO: 619012 - RNA, 64 nt, hsa; identical to SEQ ID NO: 175684

SEQ ID NO: 619013 - RNA, 64 nt, hsa; identical to SEQ ID NO: 175685

SEQ ID NO: 619014 - RNA, 64 nt, hsa; identical to SEQ ID NO: 175686

SEQ ID NO: 619015 - RNA, 64 nt, hsa; identical to SEQ ID NO: 175687

SEQ ID NO: 619016 - RNA, 64 nt, hsa; identical to SEQ ID NO: 175688

SEQ ID NO: 619017 - RNA, 64 nt, hsa; identical to SEQ ID NO: 175689

SEQ ID NO: 619018 - RNA, 64 nt, hsa; identical to SEQ ID NO: 175690

SEQ ID NO: 619019 - RNA, 64 nt, hsa; identical to SEQ ID NO: 175691

SEQ ID NO: 619020 - RNA, 64 nt, hsa; identical to SEQ ID NO: 175692

SEQ ID NO: 619021 - RNA, 64 nt, hsa; identical to SEQ ID NO: 175693

SEQ ID NO: 619022 - RNA, 64 nt, hsa; identical to SEQ ID NO: 175694

SEQ ID NO: 619023 - RNA, 64 nt, hsa; identical to SEQ ID NO: 175695

SEQ ID NO: 619024 - RNA, 64 nt, hsa; identical to SEQ ID NO: 175696

SEQ ID NO: 619025 - RNA, 64 nt, hsa; identical to SEQ ID NO: 175697

SEQ ID NO: 619026 - RNA, 64 nt, hsa; identical to SEQ ID NO: 175698

SEQ ID NO: 619027 - RNA, 64 nt, hsa; identical to SEQ ID NO: 175699

SEQ ID NO: 619028 - RNA, 64 nt, hsa; identical to SEQ ID NO: 175700

SEQ ID NO: 619029 - RNA, 64 nt, hsa; identical to SEQ ID NO: 175701

SEQ ID NO: 619030 - RNA, 64 nt, hsa; identical to SEQ ID NO: 175702

SEQ ID NO: 619031 - RNA, 64 nt, hsa; identical to SEQ ID NO: 175703

SEQ ID NO: 619032 - RNA, 64 nt, hsa; identical to SEQ ID NO: 175704

SEQ ID NO: 619033 - RNA, 64 nt, hsa; identical to SEQ ID NO: 175705

SEQ ID NO: 619034 - RNA, 64 nt, hsa; identical to SEQ ID NO: 175706

SEQ ID NO: 619035 - RNA, 64 nt, hsa; identical to SEQ ID NO: 175707

SEQ ID NO: 619036 - RNA, 64 nt, hsa; identical to SEQ ID NO: 175708

SEQ ID NO: 619037 - RNA, 64 nt, hsa; identical to SEQ ID NO: 175709

SEQ ID NO: 619038 - RNA, 64 nt, hsa; identical to SEQ ID NO: 175710

SEQ ID NO: 619039 - RNA, 64 nt, hsa; identical to SEQ ID NO: 175711

SEQ ID NO: 619040 - RNA, 64 nt, hsa; identical to SEQ ID NO: 175712

SEQ ID NO: 619041 - RNA, 64 nt, hsa; identical to SEQ ID NO: 175713

SEQ ID NO: 619042 - RNA, 64 nt, hsa; identical to SEQ ID NO: 175714

SEQ ID NO: 619043 - RNA, 64 nt, hsa; identical to SEQ ID NO: 175715

SEQ ID NO: 619044 - RNA, 64 nt, hsa; identical to SEQ ID NO: 175716

SEQ ID NO: 619045 - RNA, 64 nt, hsa; identical to SEQ ID NO: 175717

SEQ ID NO: 619046 - RNA, 64 nt, hsa; identical to SEQ ID NO: 175718

SEQ ID NO: 619047 - RNA, 64 nt, hsa; identical to SEQ ID NO: 175719

SEQ ID NO: 619048 - RNA, 64 nt, hsa; identical to SEQ ID NO: 175720

SEQ ID NO: 619049 - RNA, 64 nt, hsa; identical to SEQ ID NO: 175721

SEQ ID NO: 619050 - RNA, 64 nt, hsa; identical to SEQ ID NO: 175722

SEQ ID NO: 619051 - RNA, 64 nt, hsa; identical to SEQ ID NO: 175723

SEQ ID NO: 619052 - RNA, 64 nt, hsa; identical to SEQ ID NO: 175724

SEQ ID NO: 619053 - RNA, 64 nt, hsa; identical to SEQ ID NO: 175725

SEQ ID NO: 619054 - RNA, 64 nt, hsa; identical to SEQ ID NO: 175726

SEQ ID NO: 619055 - RNA, 64 nt, hsa; identical to SEQ ID NO: 175727

SEQ ID NO: 619056 - RNA, 64 nt, hsa; identical to SEQ ID NO: 143712

SEQ ID NO: 619057 - RNA, 64 nt, hsa; identical to SEQ ID NO: 143713

SEQ ID NO: 619058 - RNA, 64 nt, hsa; identical to SEQ ID NO: 143714

SEQ ID NO: 619059 - RNA, 64 nt, hsa; identical to SEQ ID NO: 143715

SEQ ID NO: 619060 - RNA, 64 nt, hsa; identical to SEQ ID NO: 143716

SEQ ID NO: 619061 - RNA, 64 nt, hsa; identical to SEQ ID NO: 143717

SEQ ID NO: 619062 - RNA, 64 nt, hsa; identical to SEQ ID NO: 143718

SEQ ID NO: 619063 - RNA, 64 nt, hsa; identical to SEQ ID NO: 143719

SEQ ID NO: 619064 - RNA, 64 nt, hsa; identical to SEQ ID NO: 143720

SEQ ID NO: 619065 - RNA, 64 nt, hsa; identical to SEQ ID NO: 143721

SEQ ID NO: 619066 - RNA, 64 nt, hsa; identical to SEQ ID NO: 143722

SEQ ID NO: 619067 - RNA, 64 nt, hsa; identical to SEQ ID NO: 143723

SEQ ID NO: 619068 - RNA, 64 nt, hsa; identical to SEQ ID NO: 143724

SEQ ID NO: 619069 - RNA, 64 nt, hsa; identical to SEQ ID NO: 143725

SEQ ID NO: 619070 - RNA, 64 nt, hsa; identical to SEQ ID NO: 143726

SEQ ID NO: 619071 - RNA, 64 nt, hsa; identical to SEQ ID NO: 143727

SEQ ID NO: 619072 - RNA, 64 nt, hsa; identical to SEQ ID NO: 143728

SEQ ID NO: 619073 - RNA, 64 nt, hsa; identical to SEQ ID NO: 143729

SEQ ID NO: 619074 - RNA, 64 nt, hsa; identical to SEQ ID NO: 143730

SEQ ID NO: 619075 - RNA, 64 nt, hsa; identical to SEQ ID NO: 143731

SEQ ID NO: 619076 - RNA, 64 nt, hsa; identical to SEQ ID NO: 143732

SEQ ID NO: 619077 - RNA, 64 nt, hsa; identical to SEQ ID NO: 143733

SEQ ID NO: 619078 - RNA, 64 nt, hsa; identical to SEQ ID NO: 143734

SEQ ID NO: 619079 - RNA, 64 nt, hsa; identical to SEQ ID NO: 143735

SEQ ID NO: 619080 - RNA, 64 nt, hsa; identical to SEQ ID NO: 143736

SEQ ID NO: 619081 - RNA, 64 nt, hsa; identical to SEQ ID NO: 143737

SEQ ID NO: 619082 - RNA, 64 nt, hsa; identical to SEQ ID NO: 143738

SEQ ID NO: 619083 - RNA, 64 nt, hsa; identical to SEQ ID NO: 143739

SEQ ID NO: 619084 - RNA, 64 nt, hsa; identical to SEQ ID NO: 143740

SEQ ID NO: 619085 - RNA, 64 nt, hsa; identical to SEQ ID NO: 143741

SEQ ID NO: 619086 - RNA, 64 nt, hsa; identical to SEQ ID NO: 143742

SEQ ID NO: 619087 - RNA, 64 nt, hsa; identical to SEQ ID NO: 143743

SEQ ID NO: 619088 - RNA, 64 nt, hsa; identical to SEQ ID NO: 143744

SEQ ID NO: 619089 - RNA, 64 nt, hsa; identical to SEQ ID NO: 143745

SEQ ID NO: 619090 - RNA, 64 nt, hsa; identical to SEQ ID NO: 143746

SEQ ID NO: 619091 - RNA, 64 nt, hsa; identical to SEQ ID NO: 143747

SEQ ID NO: 619092 - RNA, 64 nt, hsa; identical to SEQ ID NO: 143748

SEQ ID NO: 619093 - RNA, 64 nt, hsa; identical to SEQ ID NO: 143749

SEQ ID NO: 619094 - RNA, 64 nt, hsa; identical to SEQ ID NO: 143750

SEQ ID NO: 619095 - RNA, 64 nt, hsa; identical to SEQ ID NO: 143751

SEQ ID NO: 619096 - RNA, 64 nt, hsa; identical to SEQ ID NO: 143752

SEQ ID NO: 619097 - RNA, 64 nt, hsa; identical to SEQ ID NO: 143753

SEQ ID NO: 619098 - RNA, 64 nt, hsa; identical to SEQ ID NO: 143754

SEQ ID NO: 619099 - RNA, 64 nt, hsa; identical to SEQ ID NO: 143755

SEQ ID NO: 619100 - RNA, 64 nt, hsa; identical to SEQ ID NO: 143756

SEQ ID NO: 619101 - RNA, 64 nt, hsa; identical to SEQ ID NO: 143757

SEQ ID NO: 619102 - RNA, 64 nt, hsa; identical to SEQ ID NO: 143758

SEQ ID NO: 619103 - RNA, 64 nt, hsa; identical to SEQ ID NO: 143759

SEQ ID NO: 619104 - RNA, 64 nt, hsa; identical to SEQ ID NO: 143760

SEQ ID NO: 619105 - RNA, 64 nt, hsa; identical to SEQ ID NO: 143761

SEQ ID NO: 619106 - RNA, 64 nt, hsa; identical to SEQ ID NO: 143762

SEQ ID NO: 619107 - RNA, 64 nt, hsa; identical to SEQ ID NO: 143763

SEQ ID NO: 619108 - RNA, 64 nt, hsa; identical to SEQ ID NO: 143764

SEQ ID NO: 619109 - RNA, 64 nt, hsa; identical to SEQ ID NO: 143765

SEQ ID NO: 619110 - RNA, 64 nt, hsa; identical to SEQ ID NO: 143766

SEQ ID NO: 619111 - RNA, 64 nt, hsa; identical to SEQ ID NO: 143767

SEQ ID NO: 619112 - RNA, 64 nt, hsa; identical to SEQ ID NO: 143768

SEQ ID NO: 619113 - RNA, 64 nt, hsa; identical to SEQ ID NO: 143769

SEQ ID NO: 619114 - RNA, 64 nt, hsa; identical to SEQ ID NO: 143770

SEQ ID NO: 619115 - RNA, 64 nt, hsa; identical to SEQ ID NO: 143771

SEQ ID NO: 619116 - RNA, 64 nt, hsa; identical to SEQ ID NO: 143772

SEQ ID NO: 619117 - RNA, 64 nt, hsa; identical to SEQ ID NO: 143773

SEQ ID NO: 619118 - RNA, 64 nt, hsa; identical to SEQ ID NO: 143774

SEQ ID NO: 619119 - RNA, 64 nt, hsa; identical to SEQ ID NO: 143775

SEQ ID NO: 619120 - RNA, 64 nt, hsa; identical to SEQ ID NO: 143776

SEQ ID NO: 619121 - RNA, 64 nt, hsa; identical to SEQ ID NO: 143777

SEQ ID NO: 619122 - RNA, 64 nt, hsa; identical to SEQ ID NO: 143778

SEQ ID NO: 619123 - RNA, 64 nt, hsa; identical to SEQ ID NO: 143779

SEQ ID NO: 619124 - RNA, 64 nt, hsa; identical to SEQ ID NO: 143780

SEQ ID NO: 619125 - RNA, 64 nt, hsa; identical to SEQ ID NO: 143781

SEQ ID NO: 619126 - RNA, 64 nt, hsa; identical to SEQ ID NO: 143782

SEQ ID NO: 619127 - RNA, 64 nt, hsa; identical to SEQ ID NO: 143783

SEQ ID NO: 619128 - RNA, 64 nt, hsa; identical to SEQ ID NO: 143784

SEQ ID NO: 619129 - RNA, 64 nt, hsa; identical to SEQ ID NO: 143785

SEQ ID NO: 619130 - RNA, 64 nt, hsa; identical to SEQ ID NO: 143786

SEQ ID NO: 619131 - RNA, 64 nt, hsa; identical to SEQ ID NO: 143787

SEQ ID NO: 619132 - RNA, 64 nt, hsa; identical to SEQ ID NO: 143788

SEQ ID NO: 619133 - RNA, 64 nt, hsa; identical to SEQ ID NO: 143789

SEQ ID NO: 619134 - RNA, 57 nt, hsa; identical to SEQ ID NO: 143790

SEQ ID NO: 619135 - RNA, 64 nt, hsa; identical to SEQ ID NO: 143791

SEQ ID NO: 619136 - RNA, 64 nt, hsa; identical to SEQ ID NO: 143792

SEQ ID NO: 619137 - RNA, 64 nt, hsa; identical to SEQ ID NO: 143793

SEQ ID NO: 619138 - RNA, 64 nt, hsa; identical to SEQ ID NO: 143794

SEQ ID NO: 619139 - RNA, 64 nt, hsa; identical to SEQ ID NO: 143795

SEQ ID NO: 619140 - RNA, 64 nt, hsa; identical to SEQ ID NO: 143796

SEQ ID NO: 619141 - RNA, 64 nt, hsa; identical to SEQ ID NO: 143797

SEQ ID NO: 619142 - RNA, 64 nt, hsa; identical to SEQ ID NO: 143798

SEQ ID NO: 619143 - RNA, 64 nt, hsa; identical to SEQ ID NO: 143799

SEQ ID NO: 619144 - RNA, 64 nt, hsa; identical to SEQ ID NO: 143800

SEQ ID NO: 619145 - RNA, 64 nt, hsa; identical to SEQ ID NO: 143801

SEQ ID NO: 619146 - RNA, 64 nt, hsa; identical to SEQ ID NO: 143802

SEQ ID NO: 619147 - RNA, 64 nt, hsa; identical to SEQ ID NO: 143803

SEQ ID NO: 619148 - RNA, 64 nt, hsa; identical to SEQ ID NO: 143804

SEQ ID NO: 619149 - RNA, 64 nt, hsa; identical to SEQ ID NO: 143805

SEQ ID NO: 619150 - RNA, 64 nt, hsa; identical to SEQ ID NO: 143806

SEQ ID NO: 619151 - RNA, 64 nt, hsa; identical to SEQ ID NO: 143807

SEQ ID NO: 619152 - RNA, 64 nt, hsa; identical to SEQ ID NO: 143808

SEQ ID NO: 619153 - RNA, 64 nt, hsa; identical to SEQ ID NO: 143809

SEQ ID NO: 619154 - RNA, 64 nt, hsa; identical to SEQ ID NO: 143810

SEQ ID NO: 619155 - RNA, 64 nt, hsa; identical to SEQ ID NO: 143811

SEQ ID NO: 619156 - RNA, 64 nt, hsa; identical to SEQ ID NO: 143812

SEQ ID NO: 619157 - RNA, 64 nt, hsa; identical to SEQ ID NO: 125404

SEQ ID NO: 619158 - RNA, 64 nt, hsa; identical to SEQ ID NO: 125405

SEQ ID NO: 619159 - RNA, 64 nt, hsa; identical to SEQ ID NO: 125406

SEQ ID NO: 619160 - RNA, 64 nt, hsa; identical to SEQ ID NO: 125407

SEQ ID NO: 619161 - RNA, 64 nt, hsa; identical to SEQ ID NO: 125408

SEQ ID NO: 619162 - RNA, 57 nt, hsa; identical to SEQ ID NO: 125409

SEQ ID NO: 619163 - RNA, 64 nt, hsa; identical to SEQ ID NO: 125410

SEQ ID NO: 619164 - RNA, 64 nt, hsa; identical to SEQ ID NO: 125411

SEQ ID NO: 619165 - RNA, 64 nt, hsa; identical to SEQ ID NO: 125412

SEQ ID NO: 619166 - RNA, 64 nt, hsa; identical to SEQ ID NO: 125413

SEQ ID NO: 619167 - RNA, 64 nt, hsa; identical to SEQ ID NO: 125414

SEQ ID NO: 619168 - RNA, 64 nt, hsa; identical to SEQ ID NO: 125415

SEQ ID NO: 619169 - RNA, 64 nt, hsa; identical to SEQ ID NO: 125416

SEQ ID NO: 619170 - RNA, 63 nt, hsa; identical to SEQ ID NO: 125417

SEQ ID NO: 619171 - RNA, 64 nt, hsa; identical to SEQ ID NO: 125418

SEQ ID NO: 619172 - RNA, 64 nt, hsa; identical to SEQ ID NO: 125419

SEQ ID NO: 619173 - RNA, 64 nt, hsa; identical to SEQ ID NO: 125420

SEQ ID NO: 619174 - RNA, 64 nt, hsa; identical to SEQ ID NO: 125421

SEQ ID NO: 619175 - RNA, 53 nt, hsa; identical to SEQ ID NO: 125422

SEQ ID NO: 619176 - RNA, 64 nt, hsa; identical to SEQ ID NO: 125423

SEQ ID NO: 619177 - RNA, 64 nt, hsa; identical to SEQ ID NO: 125424

SEQ ID NO: 619178 - RNA, 64 nt, hsa; identical to SEQ ID NO: 125425

SEQ ID NO: 619179 - RNA, 64 nt, hsa; identical to SEQ ID NO: 125426

SEQ ID NO: 619180 - RNA, 64 nt, hsa; identical to SEQ ID NO: 125427

SEQ ID NO: 619181 - RNA, 64 nt, hsa; identical to SEQ ID NO: 125428

SEQ ID NO: 619182 - RNA, 64 nt, hsa; identical to SEQ ID NO: 125429

SEQ ID NO: 619183 - RNA, 56 nt, hsa; identical to SEQ ID NO: 125430

SEQ ID NO: 619184 - RNA, 64 nt, hsa; identical to SEQ ID NO: 125431

SEQ ID NO: 619185 - RNA, 60 nt, hsa; identical to SEQ ID NO: 125432

SEQ ID NO: 619186 - RNA, 64 nt, hsa; identical to SEQ ID NO: 125433

SEQ ID NO: 619187 - RNA, 64 nt, hsa; identical to SEQ ID NO: 125434

SEQ ID NO: 619188 - RNA, 64 nt, hsa; identical to SEQ ID NO: 125435

SEQ ID NO: 619189 - RNA, 64 nt, hsa; identical to SEQ ID NO: 125436

SEQ ID NO: 619190 - RNA, 60 nt, hsa; identical to SEQ ID NO: 125437

SEQ ID NO: 619191 - RNA, 64 nt, hsa; identical to SEQ ID NO: 125438

SEQ ID NO: 619192 - RNA, 64 nt, hsa; identical to SEQ ID NO: 125439

SEQ ID NO: 619193 - RNA, 64 nt, hsa; identical to SEQ ID NO: 125440

SEQ ID NO: 619194 - RNA, 64 nt, hsa; identical to SEQ ID NO: 125441

SEQ ID NO: 619195 - RNA, 64 nt, hsa; identical to SEQ ID NO: 125442

SEQ ID NO: 619196 - RNA, 64 nt, hsa; identical to SEQ ID NO: 125443

SEQ ID NO: 619197 - RNA, 64 nt, hsa; identical to SEQ ID NO: 125444

SEQ ID NO: 619198 - RNA, 64 nt, hsa; identical to SEQ ID NO: 125445

SEQ ID NO: 619199 - RNA, 64 nt, hsa; identical to SEQ ID NO: 125446

SEQ ID NO: 619200 - RNA, 64 nt, hsa; identical to SEQ ID NO: 125447

SEQ ID NO: 619201 - RNA, 64 nt, hsa; identical to SEQ ID NO: 125448

SEQ ID NO: 619202 - RNA, 64 nt, hsa; identical to SEQ ID NO: 125449

SEQ ID NO: 619203 - RNA, 64 nt, hsa; identical to SEQ ID NO: 125450

SEQ ID NO: 619204 - RNA, 64 nt, hsa; identical to SEQ ID NO: 125451

SEQ ID NO: 619205 - RNA, 64 nt, hsa; identical to SEQ ID NO: 125452

SEQ ID NO: 619206 - RNA, 64 nt, hsa; identical to SEQ ID NO: 125453

SEQ ID NO: 619207 - RNA, 64 nt, hsa; identical to SEQ ID NO: 125454

SEQ ID NO: 619208 - RNA, 64 nt, hsa; identical to SEQ ID NO: 125455

SEQ ID NO: 619209 - RNA, 64 nt, hsa; identical to SEQ ID NO: 125456

SEQ ID NO: 619210 - RNA, 64 nt, hsa; identical to SEQ ID NO: 125457

SEQ ID NO: 619211 - RNA, 64 nt, hsa; identical to SEQ ID NO: 125458

SEQ ID NO: 619212 - RNA, 64 nt, hsa; identical to SEQ ID NO: 125459

SEQ ID NO: 619213 - RNA, 64 nt, hsa; identical to SEQ ID NO: 125460

SEQ ID NO: 619214 - RNA, 59 nt, hsa; identical to SEQ ID NO: 125461

SEQ ID NO: 619215 - RNA, 64 nt, hsa; identical to SEQ ID NO: 125462

SEQ ID NO: 619216 - RNA, 64 nt, hsa; identical to SEQ ID NO: 125463

SEQ ID NO: 619217 - RNA, 64 nt, hsa; identical to SEQ ID NO: 125464

SEQ ID NO: 619218 - RNA, 64 nt, hsa; identical to SEQ ID NO: 125465

SEQ ID NO: 619219 - RNA, 64 nt, hsa; identical to SEQ ID NO: 125466

SEQ ID NO: 619220 - RNA, 64 nt, hsa; identical to SEQ ID NO: 125467

SEQ ID NO: 619221 - RNA, 64 nt, hsa; identical to SEQ ID NO: 125468

SEQ ID NO: 619222 - RNA, 64 nt, hsa; identical to SEQ ID NO: 125469

SEQ ID NO: 619223 - RNA, 64 nt, hsa; identical to SEQ ID NO: 125470

SEQ ID NO: 619224 - RNA, 64 nt, hsa; identical to SEQ ID NO: 125471

SEQ ID NO: 619225 - RNA, 64 nt, hsa; identical to SEQ ID NO: 125472

SEQ ID NO: 619226 - RNA, 64 nt, hsa; identical to SEQ ID NO: 125473

SEQ ID NO: 619227 - RNA, 64 nt, hsa; identical to SEQ ID NO: 125474

SEQ ID NO: 619228 - RNA, 55 nt, hsa; identical to SEQ ID NO: 125475

SEQ ID NO: 619229 - RNA, 64 nt, hsa; identical to SEQ ID NO: 125476

SEQ ID NO: 619230 - RNA, 64 nt, hsa; identical to SEQ ID NO: 125477

SEQ ID NO: 619231 - RNA, 64 nt, hsa; identical to SEQ ID NO: 125478

SEQ ID NO: 619232 - RNA, 64 nt, hsa; identical to SEQ ID NO: 125479

SEQ ID NO: 619233 - RNA, 64 nt, hsa; identical to SEQ ID NO: 125480

SEQ ID NO: 619234 - RNA, 64 nt, hsa; identical to SEQ ID NO: 125481

SEQ ID NO: 619235 - RNA, 64 nt, hsa; identical to SEQ ID NO: 125482

SEQ ID NO: 619236 - RNA, 64 nt, hsa; identical to SEQ ID NO: 125483

SEQ ID NO: 619237 - RNA, 64 nt, hsa; identical to SEQ ID NO: 125484

SEQ ID NO: 619238 - RNA, 64 nt, hsa; identical to SEQ ID NO: 125485

SEQ ID NO: 619239 - RNA, 64 nt, hsa; identical to SEQ ID NO: 125486

SEQ ID NO: 619240 - RNA, 64 nt, hsa; identical to SEQ ID NO: 125487

SEQ ID NO: 619241 - RNA, 64 nt, hsa; identical to SEQ ID NO: 125488

SEQ ID NO: 619242 - RNA, 64 nt, hsa; identical to SEQ ID NO: 125489

SEQ ID NO: 619243 - RNA, 64 nt, hsa; identical to SEQ ID NO: 125490

SEQ ID NO: 619244 - RNA, 64 nt, hsa; identical to SEQ ID NO: 125491

SEQ ID NO: 619245 - RNA, 64 nt, hsa; identical to SEQ ID NO: 125492

SEQ ID NO: 619246 - RNA, 64 nt, hsa; identical to SEQ ID NO: 125493

SEQ ID NO: 619247 - RNA, 64 nt, hsa; identical to SEQ ID NO: 125494

SEQ ID NO: 619248 - RNA, 64 nt, hsa; identical to SEQ ID NO: 125495

SEQ ID NO: 619249 - RNA, 64 nt, hsa; identical to SEQ ID NO: 125496

SEQ ID NO: 619250 - RNA, 64 nt, hsa; identical to SEQ ID NO: 143712

SEQ ID NO: 619251 - RNA, 64 nt, hsa; identical to SEQ ID NO: 143713

SEQ ID NO: 619252 - RNA, 64 nt, hsa; identical to SEQ ID NO: 143714

SEQ ID NO: 619253 - RNA, 64 nt, hsa; identical to SEQ ID NO: 143715

SEQ ID NO: 619254 - RNA, 64 nt, hsa; identical to SEQ ID NO: 143716

SEQ ID NO: 619255 - RNA, 64 nt, hsa; identical to SEQ ID NO: 143717

SEQ ID NO: 619256 - RNA, 64 nt, hsa; identical to SEQ ID NO: 143718

SEQ ID NO: 619257 - RNA, 64 nt, hsa; identical to SEQ ID NO: 143719

SEQ ID NO: 619258 - RNA, 64 nt, hsa; identical to SEQ ID NO: 143720

SEQ ID NO: 619259 - RNA, 64 nt, hsa; identical to SEQ ID NO: 143721

SEQ ID NO: 619260 - RNA, 64 nt, hsa; identical to SEQ ID NO: 143722

SEQ ID NO: 619261 - RNA, 64 nt, hsa; identical to SEQ ID NO: 143723

SEQ ID NO: 619262 - RNA, 64 nt, hsa; identical to SEQ ID NO: 143724

SEQ ID NO: 619263 - RNA, 64 nt, hsa; identical to SEQ ID NO: 143725

SEQ ID NO: 619264 - RNA, 64 nt, hsa; identical to SEQ ID NO: 143726

SEQ ID NO: 619265 - RNA, 64 nt, hsa; identical to SEQ ID NO: 143727

SEQ ID NO: 619266 - RNA, 64 nt, hsa; identical to SEQ ID NO: 143728

SEQ ID NO: 619267 - RNA, 64 nt, hsa; identical to SEQ ID NO: 143729

SEQ ID NO: 619268 - RNA, 64 nt, hsa; identical to SEQ ID NO: 143730

SEQ ID NO: 619269 - RNA, 64 nt, hsa; identical to SEQ ID NO: 143731

SEQ ID NO: 619270 - RNA, 64 nt, hsa; identical to SEQ ID NO: 143732

SEQ ID NO: 619271 - RNA, 64 nt, hsa; identical to SEQ ID NO: 143733

SEQ ID NO: 619272 - RNA, 64 nt, hsa; identical to SEQ ID NO: 143734

SEQ ID NO: 619273 - RNA, 64 nt, hsa; identical to SEQ ID NO: 143735

SEQ ID NO: 619274 - RNA, 64 nt, hsa; identical to SEQ ID NO: 143736

SEQ ID NO: 619275 - RNA, 64 nt, hsa; identical to SEQ ID NO: 143737

SEQ ID NO: 619276 - RNA, 64 nt, hsa; identical to SEQ ID NO: 143738

SEQ ID NO: 619277 - RNA, 64 nt, hsa; identical to SEQ ID NO: 143739

SEQ ID NO: 619278 - RNA, 64 nt, hsa; identical to SEQ ID NO: 143740

SEQ ID NO: 619279 - RNA, 64 nt, hsa; identical to SEQ ID NO: 143741

SEQ ID NO: 619280 - RNA, 64 nt, hsa; identical to SEQ ID NO: 143742

SEQ ID NO: 619281 - RNA, 64 nt, hsa; identical to SEQ ID NO: 143743

SEQ ID NO: 619282 - RNA, 64 nt, hsa; identical to SEQ ID NO: 143744

SEQ ID NO: 619283 - RNA, 64 nt, hsa; identical to SEQ ID NO: 143745

SEQ ID NO: 619284 - RNA, 64 nt, hsa; identical to SEQ ID NO: 143746

SEQ ID NO: 619285 - RNA, 64 nt, hsa; identical to SEQ ID NO: 143747

SEQ ID NO: 619286 - RNA, 64 nt, hsa; identical to SEQ ID NO: 143748

SEQ ID NO: 619287 - RNA, 64 nt, hsa; identical to SEQ ID NO: 143749

SEQ ID NO: 619288 - RNA, 64 nt, hsa; identical to SEQ ID NO: 143750

SEQ ID NO: 619289 - RNA, 64 nt, hsa; identical to SEQ ID NO: 143751

SEQ ID NO: 619290 - RNA, 64 nt, hsa; identical to SEQ ID NO: 143752

SEQ ID NO: 619291 - RNA, 64 nt, hsa; identical to SEQ ID NO: 143753

SEQ ID NO: 619292 - RNA, 64 nt, hsa; identical to SEQ ID NO: 143754

SEQ ID NO: 619293 - RNA, 64 nt, hsa; identical to SEQ ID NO: 143755

SEQ ID NO: 619294 - RNA, 64 nt, hsa; identical to SEQ ID NO: 143756

SEQ ID NO: 619295 - RNA, 64 nt, hsa; identical to SEQ ID NO: 143757

SEQ ID NO: 619296 - RNA, 64 nt, hsa; identical to SEQ ID NO: 143758

SEQ ID NO: 619297 - RNA, 64 nt, hsa; identical to SEQ ID NO: 143759

SEQ ID NO: 619298 - RNA, 64 nt, hsa; identical to SEQ ID NO: 143760

SEQ ID NO: 619299 - RNA, 64 nt, hsa; identical to SEQ ID NO: 143761

SEQ ID NO: 619300 - RNA, 64 nt, hsa; identical to SEQ ID NO: 143762

SEQ ID NO: 619301 - RNA, 64 nt, hsa; identical to SEQ ID NO: 143763

SEQ ID NO: 619302 - RNA, 64 nt, hsa; identical to SEQ ID NO: 143764

SEQ ID NO: 619303 - RNA, 64 nt, hsa; identical to SEQ ID NO: 143765

SEQ ID NO: 619304 - RNA, 64 nt, hsa; identical to SEQ ID NO: 143766

SEQ ID NO: 619305 - RNA, 64 nt, hsa; identical to SEQ ID NO: 143767

SEQ ID NO: 619306 - RNA, 64 nt, hsa; identical to SEQ ID NO: 143768

SEQ ID NO: 619307 - RNA, 64 nt, hsa; identical to SEQ ID NO: 143769

SEQ ID NO: 619308 - RNA, 64 nt, hsa; identical to SEQ ID NO: 143770

SEQ ID NO: 619309 - RNA, 64 nt, hsa; identical to SEQ ID NO: 143771

SEQ ID NO: 619310 - RNA, 64 nt, hsa; identical to SEQ ID NO: 143772

SEQ ID NO: 619311 - RNA, 64 nt, hsa; identical to SEQ ID NO: 143773

SEQ ID NO: 619312 - RNA, 64 nt, hsa; identical to SEQ ID NO: 143774

SEQ ID NO: 619313 - RNA, 64 nt, hsa; identical to SEQ ID NO: 143775

SEQ ID NO: 619314 - RNA, 64 nt, hsa; identical to SEQ ID NO: 143776

SEQ ID NO: 619315 - RNA, 64 nt, hsa; identical to SEQ ID NO: 143777

SEQ ID NO: 619316 - RNA, 64 nt, hsa; identical to SEQ ID NO: 143778

SEQ ID NO: 619317 - RNA, 64 nt, hsa; identical to SEQ ID NO: 143779

SEQ ID NO: 619318 - RNA, 64 nt, hsa; identical to SEQ ID NO: 143780

SEQ ID NO: 619319 - RNA, 64 nt, hsa; identical to SEQ ID NO: 143781

SEQ ID NO: 619320 - RNA, 64 nt, hsa; identical to SEQ ID NO: 143782

SEQ ID NO: 619321 - RNA, 64 nt, hsa; identical to SEQ ID NO: 143783

SEQ ID NO: 619322 - RNA, 64 nt, hsa; identical to SEQ ID NO: 143784

SEQ ID NO: 619323 - RNA, 64 nt, hsa; identical to SEQ ID NO: 143785

SEQ ID NO: 619324 - RNA, 64 nt, hsa; identical to SEQ ID NO: 143786

SEQ ID NO: 619325 - RNA, 64 nt, hsa; identical to SEQ ID NO: 143787

SEQ ID NO: 619326 - RNA, 64 nt, hsa; identical to SEQ ID NO: 143788

SEQ ID NO: 619327 - RNA, 64 nt, hsa; identical to SEQ ID NO: 143789

SEQ ID NO: 619328 - RNA, 57 nt, hsa; identical to SEQ ID NO: 143790

SEQ ID NO: 619329 - RNA, 64 nt, hsa; identical to SEQ ID NO: 143791

SEQ ID NO: 619330 - RNA, 64 nt, hsa; identical to SEQ ID NO: 143792

SEQ ID NO: 619331 - RNA, 64 nt, hsa; identical to SEQ ID NO: 143793

SEQ ID NO: 619332 - RNA, 64 nt, hsa; identical to SEQ ID NO: 143794

SEQ ID NO: 619333 - RNA, 64 nt, hsa; identical to SEQ ID NO: 143795

SEQ ID NO: 619334 - RNA, 64 nt, hsa; identical to SEQ ID NO: 143796

SEQ ID NO: 619335 - RNA, 64 nt, hsa; identical to SEQ ID NO: 143797

SEQ ID NO: 619336 - RNA, 64 nt, hsa; identical to SEQ ID NO: 143798

SEQ ID NO: 619337 - RNA, 64 nt, hsa; identical to SEQ ID NO: 143799

SEQ ID NO: 619338 - RNA, 64 nt, hsa; identical to SEQ ID NO: 143800

SEQ ID NO: 619339 - RNA, 64 nt, hsa; identical to SEQ ID NO: 143801

SEQ ID NO: 619340 - RNA, 64 nt, hsa; identical to SEQ ID NO: 143802

SEQ ID NO: 619341 - RNA, 64 nt, hsa; identical to SEQ ID NO: 143803

SEQ ID NO: 619342 - RNA, 64 nt, hsa; identical to SEQ ID NO: 143804

SEQ ID NO: 619343 - RNA, 64 nt, hsa; identical to SEQ ID NO: 143805

SEQ ID NO: 619344 - RNA, 64 nt, hsa; identical to SEQ ID NO: 143806

SEQ ID NO: 619345 - RNA, 64 nt, hsa; identical to SEQ ID NO: 143807

SEQ ID NO: 619346 - RNA, 64 nt, hsa; identical to SEQ ID NO: 143808

SEQ ID NO: 619347 - RNA, 64 nt, hsa; identical to SEQ ID NO: 143809

SEQ ID NO: 619348 - RNA, 64 nt, hsa; identical to SEQ ID NO: 143810

SEQ ID NO: 619349 - RNA, 64 nt, hsa; identical to SEQ ID NO: 143811

SEQ ID NO: 619350 - RNA, 64 nt, hsa; identical to SEQ ID NO: 143812

SEQ ID NO: 619351 - RNA, 64 nt, hsa; identical to SEQ ID NO: 125404

SEQ ID NO: 619352 - RNA, 64 nt, hsa; identical to SEQ ID NO: 125405

SEQ ID NO: 619353 - RNA, 64 nt, hsa; identical to SEQ ID NO: 125406

SEQ ID NO: 619354 - RNA, 64 nt, hsa; identical to SEQ ID NO: 125407

SEQ ID NO: 619355 - RNA, 64 nt, hsa; identical to SEQ ID NO: 125408

SEQ ID NO: 619356 - RNA, 57 nt, hsa; identical to SEQ ID NO: 125409

SEQ ID NO: 619357 - RNA, 64 nt, hsa; identical to SEQ ID NO: 125410

SEQ ID NO: 619358 - RNA, 64 nt, hsa; identical to SEQ ID NO: 125411

SEQ ID NO: 619359 - RNA, 64 nt, hsa; identical to SEQ ID NO: 125412

SEQ ID NO: 619360 - RNA, 64 nt, hsa; identical to SEQ ID NO: 125413

SEQ ID NO: 619361 - RNA, 64 nt, hsa; identical to SEQ ID NO: 125414

SEQ ID NO: 619362 - RNA, 64 nt, hsa; identical to SEQ ID NO: 125415

SEQ ID NO: 619363 - RNA, 64 nt, hsa; identical to SEQ ID NO: 125416

SEQ ID NO: 619364 - RNA, 63 nt, hsa; identical to SEQ ID NO: 125417

SEQ ID NO: 619365 - RNA, 64 nt, hsa; identical to SEQ ID NO: 125418

SEQ ID NO: 619366 - RNA, 64 nt, hsa; identical to SEQ ID NO: 125419

SEQ ID NO: 619367 - RNA, 64 nt, hsa; identical to SEQ ID NO: 125420

SEQ ID NO: 619368 - RNA, 64 nt, hsa; identical to SEQ ID NO: 125421

SEQ ID NO: 619369 - RNA, 53 nt, hsa; identical to SEQ ID NO: 125422

SEQ ID NO: 619370 - RNA, 64 nt, hsa; identical to SEQ ID NO: 125423

SEQ ID NO: 619371 - RNA, 64 nt, hsa; identical to SEQ ID NO: 125424

SEQ ID NO: 619372 - RNA, 64 nt, hsa; identical to SEQ ID NO: 125425

SEQ ID NO: 619373 - RNA, 64 nt, hsa; identical to SEQ ID NO: 125426

SEQ ID NO: 619374 - RNA, 64 nt, hsa; identical to SEQ ID NO: 125427

SEQ ID NO: 619375 - RNA, 64 nt, hsa; identical to SEQ ID NO: 125428

SEQ ID NO: 619376 - RNA, 64 nt, hsa; identical to SEQ ID NO: 125429

SEQ ID NO: 619377 - RNA, 56 nt, hsa; identical to SEQ ID NO: 125430

SEQ ID NO: 619378 - RNA, 64 nt, hsa; identical to SEQ ID NO: 125431

SEQ ID NO: 619379 - RNA, 60 nt, hsa; identical to SEQ ID NO: 125432

SEQ ID NO: 619380 - RNA, 64 nt, hsa; identical to SEQ ID NO: 125433

SEQ ID NO: 619381 - RNA, 64 nt, hsa; identical to SEQ ID NO: 125434

SEQ ID NO: 619382 - RNA, 64 nt, hsa; identical to SEQ ID NO: 125435

SEQ ID NO: 619383 - RNA, 64 nt, hsa; identical to SEQ ID NO: 125436

SEQ ID NO: 619384 - RNA, 60 nt, hsa; identical to SEQ ID NO: 125437

SEQ ID NO: 619385 - RNA, 64 nt, hsa; identical to SEQ ID NO: 125438

SEQ ID NO: 619386 - RNA, 64 nt, hsa; identical to SEQ ID NO: 125439

SEQ ID NO: 619387 - RNA, 64 nt, hsa; identical to SEQ ID NO: 125440

SEQ ID NO: 619388 - RNA, 64 nt, hsa; identical to SEQ ID NO: 125441

SEQ ID NO: 619389 - RNA, 64 nt, hsa; identical to SEQ ID NO: 125442

SEQ ID NO: 619390 - RNA, 64 nt, hsa; identical to SEQ ID NO: 125443

SEQ ID NO: 619391 - RNA, 64 nt, hsa; identical to SEQ ID NO: 125444

SEQ ID NO: 619392 - RNA, 64 nt, hsa; identical to SEQ ID NO: 125445

SEQ ID NO: 619393 - RNA, 64 nt, hsa; identical to SEQ ID NO: 125446

SEQ ID NO: 619394 - RNA, 64 nt, hsa; identical to SEQ ID NO: 125447

SEQ ID NO: 619395 - RNA, 64 nt, hsa; identical to SEQ ID NO: 125448

SEQ ID NO: 619396 - RNA, 64 nt, hsa; identical to SEQ ID NO: 125449

SEQ ID NO: 619397 - RNA, 64 nt, hsa; identical to SEQ ID NO: 125450

SEQ ID NO: 619398 - RNA, 64 nt, hsa; identical to SEQ ID NO: 125451

SEQ ID NO: 619399 - RNA, 64 nt, hsa; identical to SEQ ID NO: 125452

SEQ ID NO: 619400 - RNA, 64 nt, hsa; identical to SEQ ID NO: 125453

SEQ ID NO: 619401 - RNA, 64 nt, hsa; identical to SEQ ID NO: 125454

SEQ ID NO: 619402 - RNA, 64 nt, hsa; identical to SEQ ID NO: 125455

SEQ ID NO: 619403 - RNA, 64 nt, hsa; identical to SEQ ID NO: 125456

SEQ ID NO: 619404 - RNA, 64 nt, hsa; identical to SEQ ID NO: 125457

SEQ ID NO: 619405 - RNA, 64 nt, hsa; identical to SEQ ID NO: 125458

SEQ ID NO: 619406 - RNA, 64 nt, hsa; identical to SEQ ID NO: 125459

SEQ ID NO: 619407 - RNA, 64 nt, hsa; identical to SEQ ID NO: 125460

SEQ ID NO: 619408 - RNA, 59 nt, hsa; identical to SEQ ID NO: 125461

SEQ ID NO: 619409 - RNA, 64 nt, hsa; identical to SEQ ID NO: 125462

SEQ ID NO: 619410 - RNA, 64 nt, hsa; identical to SEQ ID NO: 125463

SEQ ID NO: 619411 - RNA, 64 nt, hsa; identical to SEQ ID NO: 125464

SEQ ID NO: 619412 - RNA, 64 nt, hsa; identical to SEQ ID NO: 125465

SEQ ID NO: 619413 - RNA, 64 nt, hsa; identical to SEQ ID NO: 125466

SEQ ID NO: 619414 - RNA, 64 nt, hsa; identical to SEQ ID NO: 125467

SEQ ID NO: 619415 - RNA, 64 nt, hsa; identical to SEQ ID NO: 125468

SEQ ID NO: 619416 - RNA, 64 nt, hsa; identical to SEQ ID NO: 125469

SEQ ID NO: 619417 - RNA, 64 nt, hsa; identical to SEQ ID NO: 125470

SEQ ID NO: 619418 - RNA, 64 nt, hsa; identical to SEQ ID NO: 125471

SEQ ID NO: 619419 - RNA, 64 nt, hsa; identical to SEQ ID NO: 125472

SEQ ID NO: 619420 - RNA, 64 nt, hsa; identical to SEQ ID NO: 125473

SEQ ID NO: 619421 - RNA, 64 nt, hsa; identical to SEQ ID NO: 125474

SEQ ID NO: 619422 - RNA, 55 nt, hsa; identical to SEQ ID NO: 125475

SEQ ID NO: 619423 - RNA, 64 nt, hsa; identical to SEQ ID NO: 125476

SEQ ID NO: 619424 - RNA, 64 nt, hsa; identical to SEQ ID NO: 125477

SEQ ID NO: 619425 - RNA, 64 nt, hsa; identical to SEQ ID NO: 125478

SEQ ID NO: 619426 - RNA, 64 nt, hsa; identical to SEQ ID NO: 125479

SEQ ID NO: 619427 - RNA, 64 nt, hsa; identical to SEQ ID NO: 125480

SEQ ID NO: 619428 - RNA, 64 nt, hsa; identical to SEQ ID NO: 125481

SEQ ID NO: 619429 - RNA, 64 nt, hsa; identical to SEQ ID NO: 125482

SEQ ID NO: 619430 - RNA, 64 nt, hsa; identical to SEQ ID NO: 125483

SEQ ID NO: 619431 - RNA, 64 nt, hsa; identical to SEQ ID NO: 125484

SEQ ID NO: 619432 - RNA, 64 nt, hsa; identical to SEQ ID NO: 125485

SEQ ID NO: 619433 - RNA, 64 nt, hsa; identical to SEQ ID NO: 125486

SEQ ID NO: 619434 - RNA, 64 nt, hsa; identical to SEQ ID NO: 125487

SEQ ID NO: 619435 - RNA, 64 nt, hsa; identical to SEQ ID NO: 125488

SEQ ID NO: 619436 - RNA, 64 nt, hsa; identical to SEQ ID NO: 125489

SEQ ID NO: 619437 - RNA, 64 nt, hsa; identical to SEQ ID NO: 125490

SEQ ID NO: 619438 - RNA, 64 nt, hsa; identical to SEQ ID NO: 125491

SEQ ID NO: 619439 - RNA, 64 nt, hsa; identical to SEQ ID NO: 125492

SEQ ID NO: 619440 - RNA, 64 nt, hsa; identical to SEQ ID NO: 125493

SEQ ID NO: 619441 - RNA, 64 nt, hsa; identical to SEQ ID NO: 125494

SEQ ID NO: 619442 - RNA, 64 nt, hsa; identical to SEQ ID NO: 125495

SEQ ID NO: 619443 - RNA, 64 nt, hsa; identical to SEQ ID NO: 125496

SEQ ID NO: 619444 - RNA, 64 nt, hsa; identical to SEQ ID NO: 117710

SEQ ID NO: 619445 - RNA, 64 nt, hsa; identical to SEQ ID NO: 117711

SEQ ID NO: 619446 - RNA, 64 nt, hsa; identical to SEQ ID NO: 117712

SEQ ID NO: 619447 - RNA, 64 nt, hsa; identical to SEQ ID NO: 117713

SEQ ID NO: 619448 - RNA, 64 nt, hsa; identical to SEQ ID NO: 117714

SEQ ID NO: 619449 - RNA, 64 nt, hsa; identical to SEQ ID NO: 117715

SEQ ID NO: 619450 - RNA, 64 nt, hsa; identical to SEQ ID NO: 117716

SEQ ID NO: 619451 - RNA, 64 nt, hsa; identical to SEQ ID NO: 117717

SEQ ID NO: 619452 - RNA, 64 nt, hsa; identical to SEQ ID NO: 117718

SEQ ID NO: 619453 - RNA, 64 nt, hsa; identical to SEQ ID NO: 117719

SEQ ID NO: 619454 - RNA, 64 nt, hsa; identical to SEQ ID NO: 117720

SEQ ID NO: 619455 - RNA, 64 nt, hsa; identical to SEQ ID NO: 117721

SEQ ID NO: 619456 - RNA, 64 nt, hsa; identical to SEQ ID NO: 117722

SEQ ID NO: 619457 - RNA, 64 nt, hsa; identical to SEQ ID NO: 117723

SEQ ID NO: 619458 - RNA, 64 nt, hsa; identical to SEQ ID NO: 117724

SEQ ID NO: 619459 - RNA, 64 nt, hsa; identical to SEQ ID NO: 117725

SEQ ID NO: 619460 - RNA, 64 nt, hsa; identical to SEQ ID NO: 117726

SEQ ID NO: 619461 - RNA, 64 nt, hsa; identical to SEQ ID NO: 117727

SEQ ID NO: 619462 - RNA, 64 nt, hsa; identical to SEQ ID NO: 117728

SEQ ID NO: 619463 - RNA, 64 nt, hsa; identical to SEQ ID NO: 117729

SEQ ID NO: 619464 - RNA, 64 nt, hsa; identical to SEQ ID NO: 117730

SEQ ID NO: 619465 - RNA, 64 nt, hsa; identical to SEQ ID NO: 117731

SEQ ID NO: 619466 - RNA, 64 nt, hsa; identical to SEQ ID NO: 117732

SEQ ID NO: 619467 - RNA, 64 nt, hsa; identical to SEQ ID NO: 117733

SEQ ID NO: 619468 - RNA, 64 nt, hsa; identical to SEQ ID NO: 117734

SEQ ID NO: 619469 - RNA, 64 nt, hsa; identical to SEQ ID NO: 117735

SEQ ID NO: 619470 - RNA, 64 nt, hsa; identical to SEQ ID NO: 117736

SEQ ID NO: 619471 - RNA, 64 nt, hsa; identical to SEQ ID NO: 117737

SEQ ID NO: 619472 - RNA, 64 nt, hsa; identical to SEQ ID NO: 117738

SEQ ID NO: 619473 - RNA, 64 nt, hsa; identical to SEQ ID NO: 117739

SEQ ID NO: 619474 - RNA, 64 nt, hsa; identical to SEQ ID NO: 117740

SEQ ID NO: 619475 - RNA, 64 nt, hsa; identical to SEQ ID NO: 117741

SEQ ID NO: 619476 - RNA, 64 nt, hsa; identical to SEQ ID NO: 117742

SEQ ID NO: 619477 - RNA, 64 nt, hsa; identical to SEQ ID NO: 117743

SEQ ID NO: 619478 - RNA, 64 nt, hsa; identical to SEQ ID NO: 117744

SEQ ID NO: 619479 - RNA, 64 nt, hsa; identical to SEQ ID NO: 117745

SEQ ID NO: 619480 - RNA, 64 nt, hsa; identical to SEQ ID NO: 117746

SEQ ID NO: 619481 - RNA, 64 nt, hsa; identical to SEQ ID NO: 117747

SEQ ID NO: 619482 - RNA, 64 nt, hsa; identical to SEQ ID NO: 117748

SEQ ID NO: 619483 - RNA, 64 nt, hsa; identical to SEQ ID NO: 117749

SEQ ID NO: 619484 - RNA, 64 nt, hsa; identical to SEQ ID NO: 117750

SEQ ID NO: 619485 - RNA, 64 nt, hsa; identical to SEQ ID NO: 117751

SEQ ID NO: 619486 - RNA, 64 nt, hsa; identical to SEQ ID NO: 117752

SEQ ID NO: 619487 - RNA, 64 nt, hsa; identical to SEQ ID NO: 117753

SEQ ID NO: 619488 - RNA, 64 nt, hsa; identical to SEQ ID NO: 117754

SEQ ID NO: 619489 - RNA, 64 nt, hsa; identical to SEQ ID NO: 117755

SEQ ID NO: 619490 - RNA, 64 nt, hsa; identical to SEQ ID NO: 117756

SEQ ID NO: 619491 - RNA, 64 nt, hsa; identical to SEQ ID NO: 117757

SEQ ID NO: 619492 - RNA, 64 nt, hsa; identical to SEQ ID NO: 117758

SEQ ID NO: 619493 - RNA, 64 nt, hsa; identical to SEQ ID NO: 117759

SEQ ID NO: 619494 - RNA, 64 nt, hsa; identical to SEQ ID NO: 117760

SEQ ID NO: 619495 - RNA, 64 nt, hsa; identical to SEQ ID NO: 117761

SEQ ID NO: 619496 - RNA, 64 nt, hsa; identical to SEQ ID NO: 117762

SEQ ID NO: 619497 - RNA, 64 nt, hsa; identical to SEQ ID NO: 117763

SEQ ID NO: 619498 - RNA, 64 nt, hsa; identical to SEQ ID NO: 117764

SEQ ID NO: 619499 - RNA, 64 nt, hsa; identical to SEQ ID NO: 117765

SEQ ID NO: 619500 - RNA, 64 nt, hsa; identical to SEQ ID NO: 117766

SEQ ID NO: 619501 - RNA, 64 nt, hsa; identical to SEQ ID NO: 117767

SEQ ID NO: 619502 - RNA, 64 nt, hsa; identical to SEQ ID NO: 117768

SEQ ID NO: 619503 - RNA, 64 nt, hsa; identical to SEQ ID NO: 117769

SEQ ID NO: 619504 - RNA, 64 nt, hsa; identical to SEQ ID NO: 117770

SEQ ID NO: 619505 - RNA, 64 nt, hsa; identical to SEQ ID NO: 117771

SEQ ID NO: 619506 - RNA, 64 nt, hsa; identical to SEQ ID NO: 117772

SEQ ID NO: 619507 - RNA, 64 nt, hsa; identical to SEQ ID NO: 117773

SEQ ID NO: 619508 - RNA, 64 nt, hsa; identical to SEQ ID NO: 117774

SEQ ID NO: 619509 - RNA, 64 nt, hsa; identical to SEQ ID NO: 117775

SEQ ID NO: 619510 - RNA, 64 nt, hsa; identical to SEQ ID NO: 117776

SEQ ID NO: 619511 - RNA, 64 nt, hsa; identical to SEQ ID NO: 117777

SEQ ID NO: 619512 - RNA, 64 nt, hsa; identical to SEQ ID NO: 117778

SEQ ID NO: 619513 - RNA, 64 nt, hsa; identical to SEQ ID NO: 117779

SEQ ID NO: 619514 - RNA, 64 nt, hsa; identical to SEQ ID NO: 117780

SEQ ID NO: 619515 - RNA, 64 nt, hsa; identical to SEQ ID NO: 117781

SEQ ID NO: 619516 - RNA, 64 nt, hsa; identical to SEQ ID NO: 117782

SEQ ID NO: 619517 - RNA, 64 nt, hsa; identical to SEQ ID NO: 117783

SEQ ID NO: 619518 - RNA, 64 nt, hsa; identical to SEQ ID NO: 117784

SEQ ID NO: 619519 - RNA, 64 nt, hsa; identical to SEQ ID NO: 117785

SEQ ID NO: 619520 - RNA, 64 nt, hsa; identical to SEQ ID NO: 117786

SEQ ID NO: 619521 - RNA, 59 nt, hsa; identical to SEQ ID NO: 58889

SEQ ID NO: 619522 - RNA, 64 nt, hsa; identical to SEQ ID NO: 117788

SEQ ID NO: 619523 - RNA, 64 nt, hsa; identical to SEQ ID NO: 117789

SEQ ID NO: 619524 - RNA, 64 nt, hsa; identical to SEQ ID NO: 117790

SEQ ID NO: 619525 - RNA, 64 nt, hsa; identical to SEQ ID NO: 117791

SEQ ID NO: 619526 - RNA, 64 nt, hsa; identical to SEQ ID NO: 117792

SEQ ID NO: 619527 - RNA, 64 nt, hsa; identical to SEQ ID NO: 117793

SEQ ID NO: 619528 - RNA, 64 nt, hsa; identical to SEQ ID NO: 117794

SEQ ID NO: 619529 - RNA, 64 nt, hsa; identical to SEQ ID NO: 117795

SEQ ID NO: 619530 - RNA, 64 nt, hsa; identical to SEQ ID NO: 117796

SEQ ID NO: 619531 - RNA, 64 nt, hsa; identical to SEQ ID NO: 117797

SEQ ID NO: 619532 - RNA, 64 nt, hsa; identical to SEQ ID NO: 117798

SEQ ID NO: 619533 - RNA, 64 nt, hsa; identical to SEQ ID NO: 117799

SEQ ID NO: 619534 - RNA, 64 nt, hsa; identical to SEQ ID NO: 117800

SEQ ID NO: 619535 - RNA, 64 nt, hsa; identical to SEQ ID NO: 117801

SEQ ID NO: 619536 - RNA, 64 nt, hsa; identical to SEQ ID NO: 117802

SEQ ID NO: 619537 - RNA, 64 nt, hsa; identical to SEQ ID NO: 117803

SEQ ID NO: 619538 - RNA, 64 nt, hsa; identical to SEQ ID NO: 117804

SEQ ID NO: 619539 - RNA, 64 nt, hsa; identical to SEQ ID NO: 117805

SEQ ID NO: 619540 - RNA, 64 nt, hsa; identical to SEQ ID NO: 117806

SEQ ID NO: 619541 - RNA, 64 nt, hsa; identical to SEQ ID NO: 117807

SEQ ID NO: 619542 - RNA, 64 nt, hsa; identical to SEQ ID NO: 117808

SEQ ID NO: 619543 - RNA, 64 nt, hsa; identical to SEQ ID NO: 117809

SEQ ID NO: 619544 - RNA, 64 nt, hsa; identical to SEQ ID NO: 117810

SEQ ID NO: 619545 - RNA, 64 nt, hsa; identical to SEQ ID NO: 117811

SEQ ID NO: 619546 - RNA, 64 nt, hsa; identical to SEQ ID NO: 117812

SEQ ID NO: 619547 - RNA, 64 nt, hsa; identical to SEQ ID NO: 117813

SEQ ID NO: 619548 - RNA, 64 nt, hsa; identical to SEQ ID NO: 117814

SEQ ID NO: 619549 - RNA, 64 nt, hsa; identical to SEQ ID NO: 117815

SEQ ID NO: 619550 - RNA, 64 nt, hsa; identical to SEQ ID NO: 117816

SEQ ID NO: 619551 - RNA, 64 nt, hsa; identical to SEQ ID NO: 117817

SEQ ID NO: 619552 - RNA, 64 nt, hsa; identical to SEQ ID NO: 117818

SEQ ID NO: 619553 - RNA, 64 nt, hsa; identical to SEQ ID NO: 117819

SEQ ID NO: 619554 - RNA, 64 nt, hsa; identical to SEQ ID NO: 117820

SEQ ID NO: 619555 - RNA, 64 nt, hsa; identical to SEQ ID NO: 117821

SEQ ID NO: 619556 - RNA, 64 nt, hsa; identical to SEQ ID NO: 117822

SEQ ID NO: 619557 - RNA, 64 nt, hsa; identical to SEQ ID NO: 117823

SEQ ID NO: 619558 - RNA, 64 nt, hsa; identical to SEQ ID NO: 145091

SEQ ID NO: 619559 - RNA, 64 nt, hsa; identical to SEQ ID NO: 145092

SEQ ID NO: 619560 - RNA, 64 nt, hsa; identical to SEQ ID NO: 145093

SEQ ID NO: 619561 - RNA, 64 nt, hsa; identical to SEQ ID NO: 145094

SEQ ID NO: 619562 - RNA, 64 nt, hsa; identical to SEQ ID NO: 145095

SEQ ID NO: 619563 - RNA, 64 nt, hsa; identical to SEQ ID NO: 145096

SEQ ID NO: 619564 - RNA, 64 nt, hsa; identical to SEQ ID NO: 145097

SEQ ID NO: 619565 - RNA, 64 nt, hsa; identical to SEQ ID NO: 145098

SEQ ID NO: 619566 - RNA, 64 nt, hsa; identical to SEQ ID NO: 145099

SEQ ID NO: 619567 - RNA, 64 nt, hsa; identical to SEQ ID NO: 145100

SEQ ID NO: 619568 - RNA, 64 nt, hsa; identical to SEQ ID NO: 145101

SEQ ID NO: 619569 - RNA, 64 nt, hsa; identical to SEQ ID NO: 145102

SEQ ID NO: 619570 - RNA, 64 nt, hsa; identical to SEQ ID NO: 145103

SEQ ID NO: 619571 - RNA, 64 nt, hsa; identical to SEQ ID NO: 145104

SEQ ID NO: 619572 - RNA, 64 nt, hsa; identical to SEQ ID NO: 145105

SEQ ID NO: 619573 - RNA, 64 nt, hsa; identical to SEQ ID NO: 145106

SEQ ID NO: 619574 - RNA, 64 nt, hsa; identical to SEQ ID NO: 145107

SEQ ID NO: 619575 - RNA, 64 nt, hsa; identical to SEQ ID NO: 145108

SEQ ID NO: 619576 - RNA, 64 nt, hsa; identical to SEQ ID NO: 145109

SEQ ID NO: 619577 - RNA, 64 nt, hsa; identical to SEQ ID NO: 145110

SEQ ID NO: 619578 - RNA, 64 nt, hsa; identical to SEQ ID NO: 145111

SEQ ID NO: 619579 - RNA, 64 nt, hsa; identical to SEQ ID NO: 145112

SEQ ID NO: 619580 - RNA, 64 nt, hsa; identical to SEQ ID NO: 145113

SEQ ID NO: 619581 - RNA, 64 nt, hsa; identical to SEQ ID NO: 145114

SEQ ID NO: 619582 - RNA, 64 nt, hsa; identical to SEQ ID NO: 145115

SEQ ID NO: 619583 - RNA, 64 nt, hsa; identical to SEQ ID NO: 145116

SEQ ID NO: 619584 - RNA, 64 nt, hsa; identical to SEQ ID NO: 145117

SEQ ID NO: 619585 - RNA, 64 nt, hsa; identical to SEQ ID NO: 145118

SEQ ID NO: 619586 - RNA, 64 nt, hsa; identical to SEQ ID NO: 145119

SEQ ID NO: 619587 - RNA, 64 nt, hsa; identical to SEQ ID NO: 145120

SEQ ID NO: 619588 - RNA, 64 nt, hsa; identical to SEQ ID NO: 145121

SEQ ID NO: 619589 - RNA, 64 nt, hsa; identical to SEQ ID NO: 145122

SEQ ID NO: 619590 - RNA, 64 nt, hsa; identical to SEQ ID NO: 145123

SEQ ID NO: 619591 - RNA, 64 nt, hsa; identical to SEQ ID NO: 145124

SEQ ID NO: 619592 - RNA, 64 nt, hsa; identical to SEQ ID NO: 145125

SEQ ID NO: 619593 - RNA, 64 nt, hsa; identical to SEQ ID NO: 145126

SEQ ID NO: 619594 - RNA, 64 nt, hsa; identical to SEQ ID NO: 44417

SEQ ID NO: 619595 - RNA, 64 nt, hsa; identical to SEQ ID NO: 44418

SEQ ID NO: 619596 - RNA, 64 nt, hsa; identical to SEQ ID NO: 44419

SEQ ID NO: 619597 - RNA, 64 nt, hsa; identical to SEQ ID NO: 44420

SEQ ID NO: 619598 - RNA, 62 nt, hsa; identical to SEQ ID NO: 44421

SEQ ID NO: 619599 - RNA, 64 nt, hsa; identical to SEQ ID NO: 44422

SEQ ID NO: 619600 - RNA, 64 nt, hsa; identical to SEQ ID NO: 44423

SEQ ID NO: 619601 - RNA, 64 nt, hsa; identical to SEQ ID NO: 44424

SEQ ID NO: 619602 - RNA, 64 nt, hsa; identical to SEQ ID NO: 145359

SEQ ID NO: 619603 - RNA, 64 nt, hsa; identical to SEQ ID NO: 145360

SEQ ID NO: 619604 - RNA, 64 nt, hsa; identical to SEQ ID NO: 145361

SEQ ID NO: 619605 - RNA, 64 nt, hsa; identical to SEQ ID NO: 145362

SEQ ID NO: 619606 - RNA, 64 nt, hsa; identical to SEQ ID NO: 145363

SEQ ID NO: 619607 - RNA, 64 nt, hsa; identical to SEQ ID NO: 145364

SEQ ID NO: 619608 - RNA, 64 nt, hsa; identical to SEQ ID NO: 145365

SEQ ID NO: 619609 - RNA, 64 nt, hsa; identical to SEQ ID NO: 145366

SEQ ID NO: 619610 - RNA, 64 nt, hsa; identical to SEQ ID NO: 145367

SEQ ID NO: 619611 - RNA, 64 nt, hsa; identical to SEQ ID NO: 145368

SEQ ID NO: 619612 - RNA, 64 nt, hsa; identical to SEQ ID NO: 145369

SEQ ID NO: 619613 - RNA, 64 nt, hsa; identical to SEQ ID NO: 145370

SEQ ID NO: 619614 - RNA, 64 nt, hsa; identical to SEQ ID NO: 145371

SEQ ID NO: 619615 - RNA, 64 nt, hsa; identical to SEQ ID NO: 145372

SEQ ID NO: 619616 - RNA, 64 nt, hsa; identical to SEQ ID NO: 145373

SEQ ID NO: 619617 - RNA, 64 nt, hsa; identical to SEQ ID NO: 145374

SEQ ID NO: 619618 - RNA, 64 nt, hsa; identical to SEQ ID NO: 145375

SEQ ID NO: 619619 - RNA, 64 nt, hsa; identical to SEQ ID NO: 145376

SEQ ID NO: 619620 - RNA, 64 nt, hsa; identical to SEQ ID NO: 145377

SEQ ID NO: 619621 - RNA, 64 nt, hsa; identical to SEQ ID NO: 145378

SEQ ID NO: 619622 - RNA, 64 nt, hsa; identical to SEQ ID NO: 145379

SEQ ID NO: 619623 - RNA, 64 nt, hsa; identical to SEQ ID NO: 145380

SEQ ID NO: 619624 - RNA, 64 nt, hsa; identical to SEQ ID NO: 145381

SEQ ID NO: 619625 - RNA, 64 nt, hsa; identical to SEQ ID NO: 145382

SEQ ID NO: 619626 - RNA, 64 nt, hsa; identical to SEQ ID NO: 145383

SEQ ID NO: 619627 - RNA, 64 nt, hsa; identical to SEQ ID NO: 145384

SEQ ID NO: 619628 - RNA, 64 nt, hsa; identical to SEQ ID NO: 145385

SEQ ID NO: 619629 - RNA, 64 nt, hsa; identical to SEQ ID NO: 145386

SEQ ID NO: 619630 - RNA, 64 nt, hsa; identical to SEQ ID NO: 145387

SEQ ID NO: 619631 - RNA, 64 nt, hsa; identical to SEQ ID NO: 145388

SEQ ID NO: 619632 - RNA, 64 nt, hsa; identical to SEQ ID NO: 145389

SEQ ID NO: 619633 - RNA, 64 nt, hsa; identical to SEQ ID NO: 145390

SEQ ID NO: 619634 - RNA, 64 nt, hsa; identical to SEQ ID NO: 145391

SEQ ID NO: 619635 - RNA, 64 nt, hsa; identical to SEQ ID NO: 145392

SEQ ID NO: 619636 - RNA, 64 nt, hsa; identical to SEQ ID NO: 145393

SEQ ID NO: 619637 - RNA, 64 nt, hsa; identical to SEQ ID NO: 145394

SEQ ID NO: 619638 - RNA, 64 nt, hsa; identical to SEQ ID NO: 145395

SEQ ID NO: 619639 - RNA, 64 nt, hsa; identical to SEQ ID NO: 145396

SEQ ID NO: 619640 - RNA, 64 nt, hsa; identical to SEQ ID NO: 145397

SEQ ID NO: 619641 - RNA, 64 nt, hsa; identical to SEQ ID NO: 145398

SEQ ID NO: 619642 - RNA, 64 nt, hsa; identical to SEQ ID NO: 145399

SEQ ID NO: 619643 - RNA, 64 nt, hsa
guuauucugcacaaaacuuuugggaauuccucuuugcacccagagacucagaggggaagagggu

SEQ ID NO: 619644 - RNA, 64 nt, hsa
uccccagcugccucaacucugucucuggcagcucugcacccagggaccaugugcucuccacacc

SEQ ID NO: 619645 - RNA, 64 nt, hsa
augagcagcuccugcccuguggcgacagccagcgugcacccagacgcuggugccauggcgaagc

SEQ ID NO: 619646 - RNA, 64 nt, hsa
cuggagcuugagcucuugccuggaacgcugcagcugcacccacccugcuugaucccaccuggga

SEQ ID NO: 619647 - RNA, 64 nt, hsa
gagaacuuuucugucuuacaagaggauuguaaaaugcacccaucagugcucuguaaaacacacc

SEQ ID NO: 619648 - RNA, 64 nt, hsa
ucagcgcucuguagcuagcaauagguuuguaaaaugcacccaucagcacucuguaaaacgcacc

SEQ ID NO: 619649 - RNA, 64 nt, hsa
caggcagcggagcccuacuagacugccagucucaugcacccagaccuguggccagauuguggcc

SEQ ID NO: 619650 - RNA, 64 nt, hsa
cugaaaguuccuuugguugcucacaacucagguaugcacccauguggcagccaggcagcggagc

SEQ ID NO: 619651 - RNA, 64 nt, hsa
cucccaaguagcuggaauuacaggcacauaccacugcacccagcuaauuuuuguauuuuuagua

SEQ ID NO: 619652 - RNA, 64 nt, hsa
caaaugguguuuucuuaugcaggacugaucgauuugcacccaccuuucugcacauaaguuaugg

SEQ ID NO: 619653 - RNA, 64 nt, hsa
ccccgcaagcaaaccugcccccucugccucccagugcacccaaugacccccucccuuggggcga

SEQ ID NO: 619654 - RNA, 64 nt, hsa
gcugcuccucuccgcagccagaaaugcugccggcugcacccagagggagcagugaggcaggaca

SEQ ID NO: 619655 - RNA, 64 nt, hsa; identical to SEQ ID NO: 257739

SEQ ID NO: 619656 - RNA, 64 nt, hsa; identical to SEQ ID NO: 257740

SEQ ID NO: 619657 - RNA, 64 nt, hsa; identical to SEQ ID NO: 257741

SEQ ID NO: 619658 - RNA, 64 nt, hsa; identical to SEQ ID NO: 257742

SEQ ID NO: 619659 - RNA, 64 nt, hsa; identical to SEQ ID NO: 257743

SEQ ID NO: 619660 - RNA, 64 nt, hsa
gcugggccgagggaggagcugguuuggcauaggaccuaaccagugaagcuagaggcuacagcca

SEQ ID NO: 619661 - RNA, 64 nt, hsa
guuuuuagccagggaaaacugagccccaggaaaaccuaaccacugggcaggcagaauuuguuug

SEQ ID NO: 619662 - RNA, 64 nt, hsa
ggaguucccugggcuucuggcaccuguuucuaggccuaaccauuaguacuuacugugcagggaa

SEQ ID NO: 619663 - RNA, 64 nt, hsa
aaacuccuuuuaaccaagcuuagcuucucaaaggccuaaccaagccuuggcaccgccagauccu

SEQ ID NO: 619664 - RNA, 64 nt, hsa
ugagccgagaucaugccacugcacuccagccugggcgacggagugagacuccaucucaaaaaaa

SEQ ID NO: 619665 - RNA, 64 nt, hsa
uaugcucugcucaguguuguuugucugcuuguuugcgacggagcgagacuccgucucgaaaaaa

SEQ ID NO: 619666 - RNA, 64 nt, hsa
acacagagagacagacuugagaacuugacaaguugcgacggagagaaaaaagaaguguccgaga

SEQ ID NO: 619667 - RNA, 64 nt, hsa
gaaaggaaaauuaguuguguauuucacgacgaaagcgacggaccaaaagaaauuuccugcccca

SEQ ID NO: 619668 - RNA, 64 nt, hsa
ugauccgggacugcaauaacaauguccagaguaugcgacggacagaggaacuaaucuaccugag

SEQ ID NO: 619669 - RNA, 64 nt, hsa
gaguggcucguguuucacagugggcggcuucccugcgacggaggcaggaccaggcauuuagcua

SEQ ID NO: 619670 - RNA, 64 nt, hsa
ugagcugagauugcgccacugcacuccagccugggcgacggagcgagacucugucucaaaacaa

SEQ ID NO: 619671 - RNA, 64 nt, hsa
cuguaaucagagaguauuuaaggagggcaguucugcgacggacuguguguguguugaaaguaaa

SEQ ID NO: 619672 - RNA, 64 nt, hsa
acagcuugucucuugccugccacugugugaaucggcgacggagcacugcaccugccuccagccg

SEQ ID NO: 619673 - RNA, 64 nt, hsa
aaugugaaucccggcggacacgccaaauugcgaggcgacggaaacggaaagacucuuuucuccu

SEQ ID NO: 619674 - RNA, 64 nt, hsa
guaugagcucuugugaggaugcugccgccacccugcgacggagcggcgccccggacugccugac

SEQ ID NO: 619675 - RNA, 64 nt, hsa
uggacggucccggcucagaccgucuguacucagagcgacggaugcccccugggacccucacugc

SEQ ID NO: 619676 - RNA, 64 nt, hsa
ggugucgcggggagccuggugcccuucuagaugggcgacggaggcaaggacaagacgaguccga

SEQ ID NO: 619677 - RNA, 64 nt, hsa
ugagccgagaucucaccacuguacuccagccugggcgacggagugagacucccucucaaaaaaa

SEQ ID NO: 619678 - RNA, 64 nt, hsa
gagccugugagggagguggcggguccccacuguggcgacggagagcugacaguagcccagggcu

SEQ ID NO: 619679 - RNA, 64 nt, hsa
gcagggggcucggaggacucaggccgcagcccccgcgacggagggcagggcccacccugcggug

SEQ ID NO: 619680 - RNA, 64 nt, hsa; identical to SEQ ID NO: 169421

SEQ ID NO: 619681 - RNA, 64 nt, hsa; identical to SEQ ID NO: 169422

SEQ ID NO: 619682 - RNA, 64 nt, hsa; identical to SEQ ID NO: 169423

SEQ ID NO: 619683 - RNA, 64 nt, hsa; identical to SEQ ID NO: 169424

SEQ ID NO: 619684 - RNA, 64 nt, hsa; identical to SEQ ID NO: 169425

SEQ ID NO: 619685 - RNA, 64 nt, hsa; identical to SEQ ID NO: 169426

SEQ ID NO: 619686 - RNA, 64 nt, hsa; identical to SEQ ID NO: 169427

SEQ ID NO: 619687 - RNA, 64 nt, hsa; identical to SEQ ID NO: 169428

SEQ ID NO: 619688 - RNA, 64 nt, hsa; identical to SEQ ID NO: 169429

SEQ ID NO: 619689 - RNA, 64 nt, hsa; identical to SEQ ID NO: 169430

SEQ ID NO: 619690 - RNA, 64 nt, hsa; identical to SEQ ID NO: 169431

SEQ ID NO: 619691 - RNA, 64 nt, hsa; identical to SEQ ID NO: 169432

SEQ ID NO: 619692 - RNA, 64 nt, hsa; identical to SEQ ID NO: 169433

SEQ ID NO: 619693 - RNA, 64 nt, hsa; identical to SEQ ID NO: 169434

SEQ ID NO: 619694 - RNA, 64 nt, hsa; identical to SEQ ID NO: 169435

SEQ ID NO: 619695 - RNA, 64 nt, hsa; identical to SEQ ID NO: 169436

SEQ ID NO: 619696 - RNA, 64 nt, hsa; identical to SEQ ID NO: 169437

SEQ ID NO: 619697 - RNA, 64 nt, hsa; identical to SEQ ID NO: 169438

SEQ ID NO: 619698 - RNA, 64 nt, hsa; identical to SEQ ID NO: 169439

SEQ ID NO: 619699 - RNA, 64 nt, hsa; identical to SEQ ID NO: 169440

SEQ ID NO: 619700 - RNA, 64 nt, hsa; identical to SEQ ID NO: 169441

SEQ ID NO: 619701 - RNA, 64 nt, hsa; identical to SEQ ID NO: 169442

SEQ ID NO: 619702 - RNA, 64 nt, hsa; identical to SEQ ID NO: 169443

SEQ ID NO: 619703 - RNA, 64 nt, hsa; identical to SEQ ID NO: 169442

SEQ ID NO: 619704 - RNA, 64 nt, hsa; identical to SEQ ID NO: 169443

SEQ ID NO: 619705 - RNA, 64 nt, hsa; identical to SEQ ID NO: 522710

SEQ ID NO: 619706 - RNA, 64 nt, hsa; identical to SEQ ID NO: 522711

SEQ ID NO: 619707 - RNA, 64 nt, hsa; identical to SEQ ID NO: 522712

SEQ ID NO: 619708 - RNA, 64 nt, hsa; identical to SEQ ID NO: 522713

SEQ ID NO: 619709 - RNA, 64 nt, hsa; identical to SEQ ID NO: 522714

SEQ ID NO: 619710 - RNA, 64 nt, hsa; identical to SEQ ID NO: 522715

SEQ ID NO: 619711 - RNA, 64 nt, hsa; identical to SEQ ID NO: 522716

SEQ ID NO: 619712 - RNA, 64 nt, hsa; identical to SEQ ID NO: 522717

SEQ ID NO: 619713 - RNA, 64 nt, hsa; identical to SEQ ID NO: 522718

SEQ ID NO: 619714 - RNA, 64 nt, hsa; identical to SEQ ID NO: 522719

SEQ ID NO: 619715 - RNA, 64 nt, hsa; identical to SEQ ID NO: 522720

SEQ ID NO: 619716 - RNA, 64 nt, hsa; identical to SEQ ID NO: 522721

SEQ ID NO: 619717 - RNA, 64 nt, hsa; identical to SEQ ID NO: 522722

SEQ ID NO: 619718 - RNA, 64 nt, hsa; identical to SEQ ID NO: 522723

SEQ ID NO: 619719 - RNA, 64 nt, hsa; identical to SEQ ID NO: 522724

SEQ ID NO: 619720 - RNA, 64 nt, hsa; identical to SEQ ID NO: 522725

SEQ ID NO: 619721 - RNA, 64 nt, hsa
cuugcugagucaucaucaucaucaucaucauugucgucgucaucaucuugcugagugucucuug

SEQ ID NO: 619722 - RNA, 64 nt, hsa
acacacacaucaucauuaucaucaucaucauugucgucgucaucaucuugcugagucaucauca

SEQ ID NO: 619723 - RNA, 64 nt, hsa; identical to SEQ ID NO: 167088

SEQ ID NO: 619724 - RNA, 64 nt, hsa; identical to SEQ ID NO: 167089

SEQ ID NO: 619725 - RNA, 64 nt, hsa; identical to SEQ ID NO: 167090

SEQ ID NO: 619726 - RNA, 64 nt, hsa; identical to SEQ ID NO: 167091

SEQ ID NO: 619727 - RNA, 64 nt, hsa; identical to SEQ ID NO: 167092

SEQ ID NO: 619728 - RNA, 64 nt, hsa; identical to SEQ ID NO: 167093

SEQ ID NO: 619729 - RNA, 64 nt, hsa; identical to SEQ ID NO: 167094

SEQ ID NO: 619730 - RNA, 64 nt, hsa; identical to SEQ ID NO: 167095

SEQ ID NO: 619731 - RNA, 64 nt, hsa; identical to SEQ ID NO: 167096

SEQ ID NO: 619732 - RNA, 64 nt, hsa; identical to SEQ ID NO: 167097

SEQ ID NO: 619733 - RNA, 64 nt, hsa; identical to SEQ ID NO: 167098

SEQ ID NO: 619734 - RNA, 64 nt, hsa; identical to SEQ ID NO: 167099

SEQ ID NO: 619735 - RNA, 64 nt, hsa; identical to SEQ ID NO: 167100

SEQ ID NO: 619736 - RNA, 64 nt, hsa; identical to SEQ ID NO: 167101

SEQ ID NO: 619737 - RNA, 64 nt, hsa; identical to SEQ ID NO: 167102

SEQ ID NO: 619738 - RNA, 64 nt, hsa; identical to SEQ ID NO: 167103

SEQ ID NO: 619739 - RNA, 64 nt, hsa; identical to SEQ ID NO: 167104

SEQ ID NO: 619740 - RNA, 64 nt, hsa; identical to SEQ ID NO: 167105

SEQ ID NO: 619741 - RNA, 64 nt, hsa; identical to SEQ ID NO: 167106

SEQ ID NO: 619742 - RNA, 64 nt, hsa; identical to SEQ ID NO: 167107

SEQ ID NO: 619743 - RNA, 64 nt, hsa; identical to SEQ ID NO: 167108

SEQ ID NO: 619744 - RNA, 64 nt, hsa; identical to SEQ ID NO: 167109

SEQ ID NO: 619745 - RNA, 64 nt, hsa; identical to SEQ ID NO: 167110

SEQ ID NO: 619746 - RNA, 64 nt, hsa; identical to SEQ ID NO: 167111

SEQ ID NO: 619747 - RNA, 64 nt, hsa; identical to SEQ ID NO: 167112

SEQ ID NO: 619748 - RNA, 64 nt, hsa; identical to SEQ ID NO: 167113

SEQ ID NO: 619749 - RNA, 64 nt, hsa; identical to SEQ ID NO: 167114

SEQ ID NO: 619750 - RNA, 64 nt, hsa; identical to SEQ ID NO: 167115

SEQ ID NO: 619751 - RNA, 64 nt, hsa; identical to SEQ ID NO: 167116

SEQ ID NO: 619752 - RNA, 64 nt, hsa; identical to SEQ ID NO: 167117

SEQ ID NO: 619753 - RNA, 64 nt, hsa; identical to SEQ ID NO: 167118

SEQ ID NO: 619754 - RNA, 64 nt, hsa; identical to SEQ ID NO: 167119

SEQ ID NO: 619755 - RNA, 64 nt, hsa; identical to SEQ ID NO: 167120

SEQ ID NO: 619756 - RNA, 64 nt, hsa; identical to SEQ ID NO: 167121

SEQ ID NO: 619757 - RNA, 64 nt, hsa; identical to SEQ ID NO: 167122

SEQ ID NO: 619758 - RNA, 64 nt, hsa; identical to SEQ ID NO: 167123

SEQ ID NO: 619759 - RNA, 64 nt, hsa; identical to SEQ ID NO: 167124

SEQ ID NO: 619760 - RNA, 64 nt, hsa; identical to SEQ ID NO: 167125

SEQ ID NO: 619761 - RNA, 64 nt, hsa; identical to SEQ ID NO: 167126

SEQ ID NO: 619762 - RNA, 64 nt, hsa; identical to SEQ ID NO: 167127

SEQ ID NO: 619763 - RNA, 64 nt, hsa; identical to SEQ ID NO: 167128

SEQ ID NO: 619764 - RNA, 64 nt, hsa; identical to SEQ ID NO: 167129

SEQ ID NO: 619765 - RNA, 64 nt, hsa; identical to SEQ ID NO: 167130

SEQ ID NO: 619766 - RNA, 64 nt, hsa; identical to SEQ ID NO: 167131

SEQ ID NO: 619767 - RNA, 64 nt, hsa; identical to SEQ ID NO: 167132

SEQ ID NO: 619768 - RNA, 64 nt, hsa; identical to SEQ ID NO: 167133

SEQ ID NO: 619769 - RNA, 64 nt, hsa; identical to SEQ ID NO: 167134

SEQ ID NO: 619770 - RNA, 64 nt, hsa; identical to SEQ ID NO: 167135

SEQ ID NO: 619771 - RNA, 64 nt, hsa; identical to SEQ ID NO: 167136

SEQ ID NO: 619772 - RNA, 64 nt, hsa; identical to SEQ ID NO: 167137

SEQ ID NO: 619773 - RNA, 64 nt, hsa; identical to SEQ ID NO: 167138

SEQ ID NO: 619774 - RNA, 64 nt, hsa; identical to SEQ ID NO: 167139

SEQ ID NO: 619775 - RNA, 64 nt, hsa; identical to SEQ ID NO: 167140

SEQ ID NO: 619776 - RNA, 64 nt, hsa; identical to SEQ ID NO: 167141

SEQ ID NO: 619777 - RNA, 64 nt, hsa; identical to SEQ ID NO: 167142

SEQ ID NO: 619778 - RNA, 64 nt, hsa; identical to SEQ ID NO: 167143

SEQ ID NO: 619779 - RNA, 64 nt, hsa; identical to SEQ ID NO: 167144

SEQ ID NO: 619780 - RNA, 64 nt, hsa; identical to SEQ ID NO: 167145

SEQ ID NO: 619781 - RNA, 64 nt, hsa; identical to SEQ ID NO: 167146

SEQ ID NO: 619782 - RNA, 64 nt, hsa; identical to SEQ ID NO: 167147

SEQ ID NO: 619783 - RNA, 64 nt, hsa; identical to SEQ ID NO: 167148

SEQ ID NO: 619784 - RNA, 64 nt, hsa; identical to SEQ ID NO: 167149

SEQ ID NO: 619785 - RNA, 64 nt, hsa; identical to SEQ ID NO: 167150

SEQ ID NO: 619786 - RNA, 64 nt, hsa; identical to SEQ ID NO: 167151

SEQ ID NO: 619787 - RNA, 64 nt, hsa; identical to SEQ ID NO: 167152

SEQ ID NO: 619788 - RNA, 64 nt, hsa; identical to SEQ ID NO: 167153

SEQ ID NO: 619789 - RNA, 64 nt, hsa; identical to SEQ ID NO: 167154

SEQ ID NO: 619790 - RNA, 64 nt, hsa; identical to SEQ ID NO: 167155

SEQ ID NO: 619791 - RNA, 64 nt, hsa; identical to SEQ ID NO: 167156

SEQ ID NO: 619792 - RNA, 64 nt, hsa; identical to SEQ ID NO: 167157

SEQ ID NO: 619793 - RNA, 64 nt, hsa; identical to SEQ ID NO: 167158

SEQ ID NO: 619794 - RNA, 64 nt, hsa; identical to SEQ ID NO: 167159

SEQ ID NO: 619795 - RNA, 64 nt, hsa; identical to SEQ ID NO: 167160

SEQ ID NO: 619796 - RNA, 64 nt, hsa; identical to SEQ ID NO: 167161

SEQ ID NO: 619797 - RNA, 64 nt, hsa; identical to SEQ ID NO: 167162

SEQ ID NO: 619798 - RNA, 64 nt, hsa; identical to SEQ ID NO: 167163

SEQ ID NO: 619799 - RNA, 64 nt, hsa; identical to SEQ ID NO: 167164

SEQ ID NO: 619800 - RNA, 64 nt, hsa; identical to SEQ ID NO: 167165

SEQ ID NO: 619801 - RNA, 64 nt, hsa; identical to SEQ ID NO: 167166

SEQ ID NO: 619802 - RNA, 64 nt, hsa; identical to SEQ ID NO: 167167

SEQ ID NO: 619803 - RNA, 64 nt, hsa; identical to SEQ ID NO: 167168

SEQ ID NO: 619804 - RNA, 64 nt, hsa
ggggauccugucuuccuccccaccccaccccacucuuacccaauuucugggcucuggauccuca

SEQ ID NO: 619805 - RNA, 64 nt, hsa
cugccucucuguggucuccauccugacucuugaacuuacccacaauaagaauaaauucugccuc

SEQ ID NO: 619806 - RNA, 64 nt, hsa
accuucaagaacaugccaaccucugucagauucacuuacccacaaacaaggaggcacguuuggc

SEQ ID NO: 619807 - RNA, 64 nt, hsa
aacaugucacuccacagcagaggaccgguugcagcuuacccagaaccacuccuccaggagagcu

SEQ ID NO: 619808 - RNA, 64 nt, hsa
cugacugucuuuauugcagaagacaguguguugccuuacccagaaugagauugaauuguuuugc

SEQ ID NO: 619809 - RNA, 64 nt, hsa
cacacacacacuauuucagaagacaguguguugccuuacccagaaugagugcuaggauuacagg

SEQ ID NO: 619810 - RNA, 64 nt, hsa; identical to SEQ ID NO: 209724

SEQ ID NO: 619811 - RNA, 64 nt, hsa; identical to SEQ ID NO: 209725

SEQ ID NO: 619812 - RNA, 64 nt, hsa; identical to SEQ ID NO: 209726

SEQ ID NO: 619813 - RNA, 64 nt, hsa; identical to SEQ ID NO: 209727

SEQ ID NO: 619814 - RNA, 64 nt, hsa; identical to SEQ ID NO: 209728

SEQ ID NO: 619815 - RNA, 64 nt, hsa; identical to SEQ ID NO: 209729

SEQ ID NO: 619816 - RNA, 64 nt, hsa; identical to SEQ ID NO: 209730

SEQ ID NO: 619817 - RNA, 64 nt, hsa; identical to SEQ ID NO: 209731

SEQ ID NO: 619818 - RNA, 64 nt, hsa; identical to SEQ ID NO: 209732

SEQ ID NO: 619819 - RNA, 64 nt, hsa; identical to SEQ ID NO: 209733

SEQ ID NO: 619820 - RNA, 63 nt, hsa; identical to SEQ ID NO: 209734

SEQ ID NO: 619821 - RNA, 64 nt, hsa; identical to SEQ ID NO: 209735

SEQ ID NO: 619822 - RNA, 64 nt, hsa; identical to SEQ ID NO: 209736

SEQ ID NO: 619823 - RNA, 64 nt, hsa; identical to SEQ ID NO: 209737

SEQ ID NO: 619824 - RNA, 64 nt, hsa; identical to SEQ ID NO: 209738

SEQ ID NO: 619825 - RNA, 64 nt, hsa; identical to SEQ ID NO: 209739

SEQ ID NO: 619826 - RNA, 64 nt, hsa; identical to SEQ ID NO: 209740

SEQ ID NO: 619827 - RNA, 64 nt, hsa; identical to SEQ ID NO: 209741

SEQ ID NO: 619828 - RNA, 64 nt, hsa; identical to SEQ ID NO: 209742

SEQ ID NO: 619829 - RNA, 64 nt, hsa; identical to SEQ ID NO: 209743

SEQ ID NO: 619830 - RNA, 64 nt, hsa; identical to SEQ ID NO: 209744

SEQ ID NO: 619831 - RNA, 64 nt, hsa; identical to SEQ ID NO: 209745

SEQ ID NO: 619832 - RNA, 64 nt, hsa; identical to SEQ ID NO: 209746

SEQ ID NO: 619833 - RNA, 64 nt, hsa; identical to SEQ ID NO: 209747

SEQ ID NO: 619834 - RNA, 64 nt, hsa; identical to SEQ ID NO: 209748

SEQ ID NO: 619835 - RNA, 64 nt, hsa; identical to SEQ ID NO: 209749

SEQ ID NO: 619836 - RNA, 64 nt, hsa; identical to SEQ ID NO: 209750

SEQ ID NO: 619837 - RNA, 64 nt, hsa; identical to SEQ ID NO: 209751

SEQ ID NO: 619838 - RNA, 64 nt, hsa; identical to SEQ ID NO: 209752

SEQ ID NO: 619839 - RNA, 64 nt, hsa; identical to SEQ ID NO: 209753

SEQ ID NO: 619840 - RNA, 64 nt, hsa; identical to SEQ ID NO: 209754

SEQ ID NO: 619841 - RNA, 64 nt, hsa; identical to SEQ ID NO: 209755

SEQ ID NO: 619842 - RNA, 64 nt, hsa; identical to SEQ ID NO: 209756

SEQ ID NO: 619843 - RNA, 64 nt, hsa; identical to SEQ ID NO: 209757

SEQ ID NO: 619844 - RNA, 64 nt, hsa; identical to SEQ ID NO: 209758

SEQ ID NO: 619845 - RNA, 64 nt, hsa; identical to SEQ ID NO: 209759

SEQ ID NO: 619846 - RNA, 64 nt, hsa; identical to SEQ ID NO: 209760

SEQ ID NO: 619847 - RNA, 64 nt, hsa; identical to SEQ ID NO: 209761

SEQ ID NO: 619848 - RNA, 64 nt, hsa; identical to SEQ ID NO: 209762

SEQ ID NO: 619849 - RNA, 64 nt, hsa; identical to SEQ ID NO: 209763

SEQ ID NO: 619850 - RNA, 64 nt, hsa; identical to SEQ ID NO: 209764

SEQ ID NO: 619851 - RNA, 64 nt, hsa; identical to SEQ ID NO: 209765

SEQ ID NO: 619852 - RNA, 64 nt, hsa; identical to SEQ ID NO: 209766

SEQ ID NO: 619853 - RNA, 64 nt, hsa; identical to SEQ ID NO: 209767

SEQ ID NO: 619854 - RNA, 64 nt, hsa; identical to SEQ ID NO: 209768

SEQ ID NO: 619855 - RNA, 64 nt, hsa; identical to SEQ ID NO: 209769

SEQ ID NO: 619856 - RNA, 64 nt, hsa; identical to SEQ ID NO: 209770

SEQ ID NO: 619857 - RNA, 64 nt, hsa; identical to SEQ ID NO: 209771

SEQ ID NO: 619858 - RNA, 64 nt, hsa; identical to SEQ ID NO: 209772

SEQ ID NO: 619859 - RNA, 64 nt, hsa; identical to SEQ ID NO: 209773

SEQ ID NO: 619860 - RNA, 64 nt, hsa; identical to SEQ ID NO: 209774

SEQ ID NO: 619861 - RNA, 64 nt, hsa; identical to SEQ ID NO: 209775

SEQ ID NO: 619862 - RNA, 64 nt, hsa; identical to SEQ ID NO: 209776

SEQ ID NO: 619863 - RNA, 64 nt, hsa; identical to SEQ ID NO: 209777

SEQ ID NO: 619864 - RNA, 64 nt, hsa; identical to SEQ ID NO: 209778

SEQ ID NO: 619865 - RNA, 64 nt, hsa; identical to SEQ ID NO: 209779

SEQ ID NO: 619866 - RNA, 64 nt, hsa; identical to SEQ ID NO: 209780

SEQ ID NO: 619867 - RNA, 64 nt, hsa; identical to SEQ ID NO: 209781

SEQ ID NO: 619868 - RNA, 64 nt, hsa; identical to SEQ ID NO: 209782

SEQ ID NO: 619869 - RNA, 64 nt, hsa; identical to SEQ ID NO: 209783

SEQ ID NO: 619870 - RNA, 64 nt, hsa; identical to SEQ ID NO: 209784

SEQ ID NO: 619871 - RNA, 64 nt, hsa; identical to SEQ ID NO: 209785

SEQ ID NO: 619872 - RNA, 64 nt, hsa; identical to SEQ ID NO: 209786

SEQ ID NO: 619873 - RNA, 64 nt, hsa; identical to SEQ ID NO: 209787

SEQ ID NO: 619874 - RNA, 64 nt, hsa; identical to SEQ ID NO: 209788

SEQ ID NO: 619875 - RNA, 64 nt, hsa; identical to SEQ ID NO: 209789

SEQ ID NO: 619876 - RNA, 64 nt, hsa; identical to SEQ ID NO: 209790

SEQ ID NO: 619877 - RNA, 64 nt, hsa; identical to SEQ ID NO: 209791

SEQ ID NO: 619878 - RNA, 64 nt, hsa; identical to SEQ ID NO: 209792

SEQ ID NO: 619879 - RNA, 64 nt, hsa; identical to SEQ ID NO: 209793

SEQ ID NO: 619880 - RNA, 64 nt, hsa; identical to SEQ ID NO: 209794

SEQ ID NO: 619881 - RNA, 64 nt, hsa; identical to SEQ ID NO: 209795

SEQ ID NO: 619882 - RNA, 64 nt, hsa; identical to SEQ ID NO: 209796

SEQ ID NO: 619883 - RNA, 64 nt, hsa; identical to SEQ ID NO: 209797

SEQ ID NO: 619884 - RNA, 64 nt, hsa; identical to SEQ ID NO: 209798

SEQ ID NO: 619885 - RNA, 64 nt, hsa; identical to SEQ ID NO: 209799

SEQ ID NO: 619886 - RNA, 64 nt, hsa; identical to SEQ ID NO: 209800

SEQ ID NO: 619887 - RNA, 64 nt, hsa; identical to SEQ ID NO: 209801

SEQ ID NO: 619888 - RNA, 64 nt, hsa; identical to SEQ ID NO: 209802

SEQ ID NO: 619889 - RNA, 64 nt, hsa; identical to SEQ ID NO: 209803

SEQ ID NO: 619890 - RNA, 64 nt, hsa; identical to SEQ ID NO: 209804

SEQ ID NO: 619891 - RNA, 64 nt, hsa; identical to SEQ ID NO: 209805

SEQ ID NO: 619892 - RNA, 64 nt, hsa; identical to SEQ ID NO: 209806

SEQ ID NO: 619893 - RNA, 64 nt, hsa; identical to SEQ ID NO: 209807

SEQ ID NO: 619894 - RNA, 64 nt, hsa; identical to SEQ ID NO: 209808

SEQ ID NO: 619895 - RNA, 64 nt, hsa; identical to SEQ ID NO: 209809

SEQ ID NO: 619896 - RNA, 64 nt, hsa; identical to SEQ ID NO: 209810

SEQ ID NO: 619897 - RNA, 64 nt, hsa; identical to SEQ ID NO: 209811

SEQ ID NO: 619898 - RNA, 64 nt, hsa; identical to SEQ ID NO: 209812

SEQ ID NO: 619899 - RNA, 64 nt, hsa; identical to SEQ ID NO: 209813

SEQ ID NO: 619900 - RNA, 64 nt, hsa; identical to SEQ ID NO: 209814

SEQ ID NO: 619901 - RNA, 64 nt, hsa; identical to SEQ ID NO: 508730

SEQ ID NO: 619902 - RNA, 64 nt, hsa; identical to SEQ ID NO: 508731

SEQ ID NO: 619903 - RNA, 64 nt, hsa; identical to SEQ ID NO: 508732

SEQ ID NO: 619904 - RNA, 64 nt, hsa; identical to SEQ ID NO: 508733

SEQ ID NO: 619905 - RNA, 64 nt, hsa; identical to SEQ ID NO: 508734

SEQ ID NO: 619906 - RNA, 64 nt, hsa; identical to SEQ ID NO: 508735

SEQ ID NO: 619907 - RNA, 64 nt, hsa
gugaaaucccugagggcaggggcugucucauucaucuguggauauggagcgggaccacuaugug

SEQ ID NO: 619908 - RNA, 64 nt, hsa
cugggugccagagcuucuaggucugugcacucucucuguggaaggcugcugucacuagccccuc

SEQ ID NO: 619909 - RNA, 64 nt, hsa
aagggcccucuuggcuugauuuugcuucuuucuuucuguggaggauauacuaagugcgacuuug

SEQ ID NO: 619910 - RNA, 64 nt, hsa
ccuccugaauacaagcugacugacauugacugugucuguggaaaaugggagcucuuguugugga

SEQ ID NO: 619911 - RNA, 64 nt, hsa
aucagguauaugacugguaaaaauguucuccccuucuguggauuguuuucaguuucuuguuggu

SEQ ID NO: 619912 - RNA, 64 nt, hsa
ccugaaugggaugucauagcuucuaaauggagcuucuguggaaugaagugcuagacugaaggac

SEQ ID NO: 619913 - RNA, 64 nt, hsa
aaaaugauccccaagugugaacaaaagaugcucuucuguggaccacugcaugagcuuuuauacu

SEQ ID NO: 619914 - RNA, 64 nt, hsa
cuccucuuuuagcugaugaacuuauucuguagauucuguggaacaagccuaucagcuucagaau

SEQ ID NO: 619915 - RNA, 64 nt, hsa
aaugaacucugaggcagaaauauuugccuuggauucuguggauucuuuaaaccugugugcuaau

SEQ ID NO: 619916 - RNA, 64 nt, hsa
gcucacuugaggacuuuguuuugaaaaaguaccuucuguggacaagguauugugcuaccagcua

SEQ ID NO: 619917 - RNA, 64 nt, hsa
cccacccggguagcaggcugcugggcaguucugcucuguggaggggcgggcaccagcgccacuu

SEQ ID NO: 619918 - RNA, 64 nt, hsa
ggggugggggagggucuuauuuuaucuuaucuuuucuguggaucagaaaaaacagaagccaaac

SEQ ID NO: 619919 - RNA, 64 nt, hsa
uagccacccugagcagaacuuugugaugcuucauucuguggaauuuugugcuugcuacuguaua

SEQ ID NO: 619920 - RNA, 64 nt, hsa
uauuguaaaugguggaugacaaaagaaaaucugcucuguggaaagaaagaacugucucuaccag

SEQ ID NO: 619921 - RNA, 64 nt, hsa
caaccaggcuguuauuccccuggacuccgugacaucuguggaauuuuuuagcucuuuaaaaucu

SEQ ID NO: 619922 - RNA, 64 nt, hsa
gaacuuguggcugggccauggaagcugugacuccucuguggacaugguggcagcagggaacccc

SEQ ID NO: 619923 - RNA, 64 nt, hsa
auguaugaccagagccuugcaacucaaaguguggucuguggaccagcagcggcagugacaccug

SEQ ID NO: 619924 - RNA, 64 nt, hsa
gguccucagguaucuaccucccaccuucuccucaucuguggagcaagccaacucagugccccag

SEQ ID NO: 619925 - RNA, 64 nt, hsa
aaggaaaguaguccaggcugucccugaaacugagucuguggacacuguggaaagcuuugaacaa

SEQ ID NO: 619926 - RNA, 64 nt, hsa
agauuaaacuucaccuacaaacuccuuaauaugaucuguggagaauguacacaguuuaaacaca

SEQ ID NO: 619927 - RNA, 64 nt, hsa
acucaccaaagggacuugggagccaccuucucacucuguggaaguacuuuagugagagcugacu

SEQ ID NO: 619928 - RNA, 64 nt, hsa
cagccgucucauucucucgucuugcugcguccugucuguggaguccucagucacucugcuguug

SEQ ID NO: 619929 - RNA, 64 nt, hsa
auauccaacagugaggguuaagcaacauggugcaucuguggauagaacgccacccagccgcccg

SEQ ID NO: 619930 - RNA, 64 nt, hsa
agcgacugggagaugggucggucacccagacagcucuguggaggcagggucugagccuugccug

SEQ ID NO: 619931 - RNA, 64 nt, hsa
agucgccacguggccuggggcaggucacuuuaccucuguggaccuguuuucucuuugugaagcu

SEQ ID NO: 619932 - RNA, 64 nt, hsa
agcaccccuugccggugaaggaugcggcaggugcucuguggaugagaggaaccaucgcaggaug

SEQ ID NO: 619933 - RNA, 64 nt, hsa
uccaaagacuuguuucagaaagaugagagagaacucuguggauacucauggguacagagaaaug

SEQ ID NO: 619934 - RNA, 64 nt, hsa
aguggggcucacugaaccucucuccuuucuaaaaucuguggaaauuacuuuugguaacuaaggc

SEQ ID NO: 619935 - RNA, 64 nt, hsa; identical to SEQ ID NO: 55166

SEQ ID NO: 619936 - RNA, 64 nt, hsa; identical to SEQ ID NO: 55167

SEQ ID NO: 619937 - RNA, 64 nt, hsa; identical to SEQ ID NO: 55168

SEQ ID NO: 619938 - RNA, 64 nt, hsa; identical to SEQ ID NO: 55169

SEQ ID NO: 619939 - RNA, 64 nt, hsa; identical to SEQ ID NO: 55170

SEQ ID NO: 619940 - RNA, 64 nt, hsa; identical to SEQ ID NO: 55171

SEQ ID NO: 619941 - RNA, 64 nt, hsa; identical to SEQ ID NO: 55172

SEQ ID NO: 619942 - RNA, 64 nt, hsa; identical to SEQ ID NO: 55173

SEQ ID NO: 619943 - RNA, 64 nt, hsa; identical to SEQ ID NO: 55174

SEQ ID NO: 619944 - RNA, 64 nt, hsa; identical to SEQ ID NO: 55175

SEQ ID NO: 619945 - RNA, 64 nt, hsa; identical to SEQ ID NO: 55176

SEQ ID NO: 619946 - RNA, 64 nt, hsa; identical to SEQ ID NO: 55177

SEQ ID NO: 619947 - RNA, 64 nt, hsa; identical to SEQ ID NO: 220048

SEQ ID NO: 619948 - RNA, 64 nt, hsa; identical to SEQ ID NO: 220049

SEQ ID NO: 619949 - RNA, 64 nt, hsa; identical to SEQ ID NO: 220050

SEQ ID NO: 619950 - RNA, 64 nt, hsa; identical to SEQ ID NO: 220051

SEQ ID NO: 619951 - RNA, 64 nt, hsa; identical to SEQ ID NO: 220052

SEQ ID NO: 619952 - RNA, 64 nt, hsa; identical to SEQ ID NO: 220053

SEQ ID NO: 619953 - RNA, 64 nt, hsa; identical to SEQ ID NO: 220054

SEQ ID NO: 619954 - RNA, 64 nt, hsa; identical to SEQ ID NO: 220055

SEQ ID NO: 619955 - RNA, 64 nt, hsa
ggucagaguuacucaucccuuuucaaagaauuguggguggaaguuuguaaaggccauucauuug

SEQ ID NO: 619956 - RNA, 64 nt, hsa
agggaaacuugggaauagcuauaaaguaaaacuuggguggaaccuggggcccuggcaucacaca

SEQ ID NO: 619957 - RNA, 64 nt, hsa
guuucacuagauuuggaaagaagaaagaggauaaggguggaaaggcugagcagaaagguacucu

SEQ ID NO: 619958 - RNA, 64 nt, hsa
auccacugguuccagcugacaguggccguccuacggguggaagcacugaccguauccagaaguu

SEQ ID NO: 619959 - RNA, 64 nt, hsa
ugaauaugaauauuguggagucuguccagauaccggguggaagacugguuuugaucaguuuaag

SEQ ID NO: 619960 - RNA, 64 nt, hsa
uuuuggacaauaaagaaucuaaaauggguggggaggguggaagaaaugguggacuguaucucuc

SEQ ID NO: 619961 - RNA, 64 nt, hsa
ggggugcuugggugaucucugcuucauuagucauggguggaagaaaaaccacaccccccgcacc

SEQ ID NO: 619962 - RNA, 64 nt, hsa
uaaauuggggguuuaaacauuaaguaggagcuugggguggaagagggacagccggcugggccac

SEQ ID NO: 619963 - RNA, 64 nt, hsa
gaacccagagccacccgcuaugagcacaggccggggguggaaggcccaguagagcugcccuucc

SEQ ID NO: 619964 - RNA, 64 nt, hsa
ugggaauucauaugaucugccagagccucuccagggguggaauacauguccuggacuaagccaa

SEQ ID NO: 619965 - RNA, 64 nt, hsa
cuguccccauucucauggcccuuuggucacugccggguggaauagcacuggcuucagcaggcgu

SEQ ID NO: 619966 - RNA, 64 nt, hsa
cagaaggugggcuagggccuccugcaggguugugggguggaacagggucuccucuccccagcca

SEQ ID NO: 619967 - RNA, 64 nt, hsa
ucugcaugucgggcuuaaggucaccagccgggcaggguggaaggagcuugccucuuugagaaac

SEQ ID NO: 619968 - RNA, 64 nt, hsa
agggcaauugucagucuuuuuagagaaggggccaggguggaacaaucccagugaguaaauuauu

SEQ ID NO: 619969 - RNA, 64 nt, hsa
ccugggaccgcgguggguggaaucccaaggcuggggguggaaggagcagggcucuggagggauu

SEQ ID NO: 619970 - RNA, 64 nt, hsa
ccaggaggucuucagaguuuccugggaccgcgguggguggaaucccaaggcuggggguggaagg

SEQ ID NO: 619971 - RNA, 59 nt, hsa; identical to SEQ ID NO: 76155

SEQ ID NO: 619972 - RNA, 64 nt, hsa; identical to SEQ ID NO: 76156

SEQ ID NO: 619973 - RNA, 64 nt, hsa; identical to SEQ ID NO: 76157

SEQ ID NO: 619974 - RNA, 64 nt, hsa; identical to SEQ ID NO: 76158

SEQ ID NO: 619975 - RNA, 64 nt, hsa; identical to SEQ ID NO: 76159

SEQ ID NO: 619976 - RNA, 64 nt, hsa; identical to SEQ ID NO: 76160

SEQ ID NO: 619977 - RNA, 64 nt, hsa; identical to SEQ ID NO: 76161

SEQ ID NO: 619978 - RNA, 64 nt, hsa; identical to SEQ ID NO: 76162

SEQ ID NO: 619979 - RNA, 64 nt, hsa; identical to SEQ ID NO: 76163

SEQ ID NO: 619980 - RNA, 64 nt, hsa; identical to SEQ ID NO: 76164

SEQ ID NO: 619981 - RNA, 64 nt, hsa; identical to SEQ ID NO: 76165

SEQ ID NO: 619982 - RNA, 64 nt, hsa; identical to SEQ ID NO: 76166

SEQ ID NO: 619983 - RNA, 64 nt, hsa; identical to SEQ ID NO: 76167

SEQ ID NO: 619984 - RNA, 64 nt, hsa; identical to SEQ ID NO: 76168

SEQ ID NO: 619985 - RNA, 64 nt, hsa; identical to SEQ ID NO: 76169

SEQ ID NO: 619986 - RNA, 58 nt, hsa; identical to SEQ ID NO: 76170

SEQ ID NO: 619987 - RNA, 64 nt, hsa; identical to SEQ ID NO: 76171

SEQ ID NO: 619988 - RNA, 64 nt, hsa; identical to SEQ ID NO: 76172

SEQ ID NO: 619989 - RNA, 64 nt, hsa; identical to SEQ ID NO: 76173

SEQ ID NO: 619990 - RNA, 64 nt, hsa; identical to SEQ ID NO: 76174

SEQ ID NO: 619991 - RNA, 64 nt, hsa; identical to SEQ ID NO: 76175

SEQ ID NO: 619992 - RNA, 52 nt, hsa; identical to SEQ ID NO: 76176

SEQ ID NO: 619993 - RNA, 64 nt, hsa; identical to SEQ ID NO: 76177

SEQ ID NO: 619994 - RNA, 64 nt, hsa; identical to SEQ ID NO: 76178

SEQ ID NO: 619995 - RNA, 64 nt, hsa; identical to SEQ ID NO: 76179

SEQ ID NO: 619996 - RNA, 64 nt, hsa; identical to SEQ ID NO: 76180

SEQ ID NO: 619997 - RNA, 64 nt, hsa; identical to SEQ ID NO: 76181

SEQ ID NO: 619998 - RNA, 64 nt, hsa; identical to SEQ ID NO: 76182

SEQ ID NO: 619999 - RNA, 64 nt, hsa; identical to SEQ ID NO: 76183

SEQ ID NO: 620000 - RNA, 64 nt, hsa; identical to SEQ ID NO: 76184

SEQ ID NO: 620001 - RNA, 64 nt, hsa; identical to SEQ ID NO: 76185

SEQ ID NO: 620002 - RNA, 64 nt, hsa; identical to SEQ ID NO: 76186

SEQ ID NO: 620003 - RNA, 64 nt, hsa; identical to SEQ ID NO: 76187

SEQ ID NO: 620004 - RNA, 64 nt, hsa; identical to SEQ ID NO: 76188

SEQ ID NO: 620005 - RNA, 64 nt, hsa; identical to SEQ ID NO: 76189

SEQ ID NO: 620006 - RNA, 64 nt, hsa; identical to SEQ ID NO: 76190

SEQ ID NO: 620007 - RNA, 64 nt, hsa; identical to SEQ ID NO: 76191

SEQ ID NO: 620008 - RNA, 64 nt, hsa; identical to SEQ ID NO: 76192

SEQ ID NO: 620009 - RNA, 64 nt, hsa; identical to SEQ ID NO: 76193

SEQ ID NO: 620010 - RNA, 64 nt, hsa; identical to SEQ ID NO: 76194

SEQ ID NO: 620011 - RNA, 64 nt, hsa; identical to SEQ ID NO: 76195

SEQ ID NO: 620012 - RNA, 64 nt, hsa; identical to SEQ ID NO: 76196

SEQ ID NO: 620013 - RNA, 64 nt, hsa; identical to SEQ ID NO: 76197

SEQ ID NO: 620014 - RNA, 64 nt, hsa; identical to SEQ ID NO: 76198

SEQ ID NO: 620015 - RNA, 64 nt, hsa; identical to SEQ ID NO: 76199

SEQ ID NO: 620016 - RNA, 64 nt, hsa; identical to SEQ ID NO: 76200

SEQ ID NO: 620017 - RNA, 64 nt, hsa; identical to SEQ ID NO: 76201

SEQ ID NO: 620018 - RNA, 64 nt, hsa; identical to SEQ ID NO: 76202

SEQ ID NO: 620019 - RNA, 64 nt, hsa; identical to SEQ ID NO: 76203

SEQ ID NO: 620020 - RNA, 64 nt, hsa; identical to SEQ ID NO: 76204

SEQ ID NO: 620021 - RNA, 64 nt, hsa; identical to SEQ ID NO: 76205

SEQ ID NO: 620022 - RNA, 64 nt, hsa; identical to SEQ ID NO: 76206

SEQ ID NO: 620023 - RNA, 64 nt, hsa; identical to SEQ ID NO: 76207

SEQ ID NO: 620024 - RNA, 64 nt, hsa; identical to SEQ ID NO: 76208

SEQ ID NO: 620025 - RNA, 64 nt, hsa; identical to SEQ ID NO: 76209

SEQ ID NO: 620026 - RNA, 64 nt, hsa; identical to SEQ ID NO: 76210

SEQ ID NO: 620027 - RNA, 64 nt, hsa; identical to SEQ ID NO: 76211

SEQ ID NO: 620028 - RNA, 64 nt, hsa; identical to SEQ ID NO: 76212

SEQ ID NO: 620029 - RNA, 64 nt, hsa; identical to SEQ ID NO: 76213

SEQ ID NO: 620030 - RNA, 64 nt, hsa; identical to SEQ ID NO: 76214

SEQ ID NO: 620031 - RNA, 64 nt, hsa; identical to SEQ ID NO: 76215

SEQ ID NO: 620032 - RNA, 64 nt, hsa; identical to SEQ ID NO: 76216

SEQ ID NO: 620033 - RNA, 64 nt, hsa; identical to SEQ ID NO: 76217

SEQ ID NO: 620034 - RNA, 64 nt, hsa; identical to SEQ ID NO: 76218

SEQ ID NO: 620035 - RNA, 64 nt, hsa; identical to SEQ ID NO: 76219

SEQ ID NO: 620036 - RNA, 64 nt, hsa; identical to SEQ ID NO: 440860

SEQ ID NO: 620037 - RNA, 64 nt, hsa; identical to SEQ ID NO: 440861

SEQ ID NO: 620038 - RNA, 64 nt, hsa; identical to SEQ ID NO: 440862

SEQ ID NO: 620039 - RNA, 64 nt, hsa; identical to SEQ ID NO: 440863

SEQ ID NO: 620040 - RNA, 64 nt, hsa; identical to SEQ ID NO: 440864

SEQ ID NO: 620041 - RNA, 64 nt, hsa; identical to SEQ ID NO: 440865

SEQ ID NO: 620042 - RNA, 64 nt, hsa; identical to SEQ ID NO: 440866

SEQ ID NO: 620043 - RNA, 64 nt, hsa; identical to SEQ ID NO: 440867

SEQ ID NO: 620044 - RNA, 64 nt, hsa; identical to SEQ ID NO: 440868

SEQ ID NO: 620045 - RNA, 64 nt, hsa; identical to SEQ ID NO: 440869

SEQ ID NO: 620046 - RNA, 64 nt, hsa; identical to SEQ ID NO: 440870

SEQ ID NO: 620047 - RNA, 64 nt, hsa; identical to SEQ ID NO: 440871

SEQ ID NO: 620048 - RNA, 64 nt, hsa; identical to SEQ ID NO: 440872

SEQ ID NO: 620049 - RNA, 64 nt, hsa; identical to SEQ ID NO: 440873

SEQ ID NO: 620050 - RNA, 64 nt, hsa; identical to SEQ ID NO: 440874

SEQ ID NO: 620051 - RNA, 64 nt, hsa; identical to SEQ ID NO: 440875

SEQ ID NO: 620052 - RNA, 64 nt, hsa; identical to SEQ ID NO: 440876

SEQ ID NO: 620053 - RNA, 64 nt, hsa; identical to SEQ ID NO: 440877

SEQ ID NO: 620054 - RNA, 64 nt, hsa; identical to SEQ ID NO: 440878

SEQ ID NO: 620055 - RNA, 64 nt, hsa; identical to SEQ ID NO: 440879

SEQ ID NO: 620056 - RNA, 64 nt, hsa; identical to SEQ ID NO: 440880

SEQ ID NO: 620057 - RNA, 64 nt, hsa; identical to SEQ ID NO: 440881

SEQ ID NO: 620058 - RNA, 64 nt, hsa; identical to SEQ ID NO: 440882

SEQ ID NO: 620059 - RNA, 64 nt, hsa; identical to SEQ ID NO: 440883

SEQ ID NO: 620060 - RNA, 64 nt, hsa; identical to SEQ ID NO: 440884

SEQ ID NO: 620061 - RNA, 64 nt, hsa; identical to SEQ ID NO: 440885

SEQ ID NO: 620062 - RNA, 64 nt, hsa; identical to SEQ ID NO: 440886

SEQ ID NO: 620063 - RNA, 64 nt, hsa; identical to SEQ ID NO: 440887

SEQ ID NO: 620064 - RNA, 64 nt, hsa; identical to SEQ ID NO: 440888

SEQ ID NO: 620065 - RNA, 64 nt, hsa; identical to SEQ ID NO: 440889

SEQ ID NO: 620066 - RNA, 64 nt, hsa; identical to SEQ ID NO: 440890

SEQ ID NO: 620067 - RNA, 64 nt, hsa; identical to SEQ ID NO: 440891

SEQ ID NO: 620068 - RNA, 64 nt, hsa; identical to SEQ ID NO: 440892

SEQ ID NO: 620069 - RNA, 64 nt, hsa; identical to SEQ ID NO: 440893

SEQ ID NO: 620070 - RNA, 64 nt, hsa; identical to SEQ ID NO: 440894

SEQ ID NO: 620071 - RNA, 64 nt, hsa; identical to SEQ ID NO: 440895

SEQ ID NO: 620072 - RNA, 64 nt, hsa; identical to SEQ ID NO: 440896

SEQ ID NO: 620073 - RNA, 64 nt, hsa; identical to SEQ ID NO: 440897

SEQ ID NO: 620074 - RNA, 64 nt, hsa; identical to SEQ ID NO: 440898

SEQ ID NO: 620075 - RNA, 64 nt, hsa; identical to SEQ ID NO: 440899

SEQ ID NO: 620076 - RNA, 64 nt, hsa; identical to SEQ ID NO: 440900

SEQ ID NO: 620077 - RNA, 64 nt, hsa; identical to SEQ ID NO: 440901

SEQ ID NO: 620078 - RNA, 64 nt, hsa; identical to SEQ ID NO: 440902

SEQ ID NO: 620079 - RNA, 62 nt, hsa; identical to SEQ ID NO: 440903

SEQ ID NO: 620080 - RNA, 64 nt, hsa; identical to SEQ ID NO: 440904

SEQ ID NO: 620081 - RNA, 64 nt, hsa; identical to SEQ ID NO: 440905

SEQ ID NO: 620082 - RNA, 64 nt, hsa; identical to SEQ ID NO: 440906

SEQ ID NO: 620083 - RNA, 64 nt, hsa; identical to SEQ ID NO: 101343

SEQ ID NO: 620084 - RNA, 64 nt, hsa; identical to SEQ ID NO: 101344

SEQ ID NO: 620085 - RNA, 64 nt, hsa; identical to SEQ ID NO: 101382

SEQ ID NO: 620086 - RNA, 64 nt, hsa; identical to SEQ ID NO: 101383

SEQ ID NO: 620087 - RNA, 64 nt, hsa; identical to SEQ ID NO: 101390

SEQ ID NO: 620088 - RNA, 64 nt, hsa; identical to SEQ ID NO: 101391

SEQ ID NO: 620089 - RNA, 64 nt, hsa; identical to SEQ ID NO: 101422

SEQ ID NO: 620090 - RNA, 64 nt, hsa; identical to SEQ ID NO: 101423

SEQ ID NO: 620091 - RNA, 64 nt, hsa; identical to SEQ ID NO: 101457

SEQ ID NO: 620092 - RNA, 64 nt, hsa; identical to SEQ ID NO: 101458

SEQ ID NO: 620093 - RNA, 64 nt, hsa; identical to SEQ ID NO: 101473

SEQ ID NO: 620094 - RNA, 64 nt, hsa; identical to SEQ ID NO: 101474

SEQ ID NO: 620095 - RNA, 64 nt, hsa; identical to SEQ ID NO: 101503

SEQ ID NO: 620096 - RNA, 64 nt, hsa; identical to SEQ ID NO: 101504

SEQ ID NO: 620097 - RNA, 64 nt, hsa; identical to SEQ ID NO: 101509

SEQ ID NO: 620098 - RNA, 64 nt, hsa; identical to SEQ ID NO: 101510

SEQ ID NO: 620099 - RNA, 64 nt, hsa; identical to SEQ ID NO: 101540

SEQ ID NO: 620100 - RNA, 64 nt, hsa; identical to SEQ ID NO: 101541

SEQ ID NO: 620101 - RNA, 64 nt, hsa; identical to SEQ ID NO: 101569

SEQ ID NO: 620102 - RNA, 64 nt, hsa; identical to SEQ ID NO: 101570

SEQ ID NO: 620103 - RNA, 64 nt, hsa; identical to SEQ ID NO: 101580

SEQ ID NO: 620104 - RNA, 64 nt, hsa; identical to SEQ ID NO: 101581

SEQ ID NO: 620105 - RNA, 64 nt, hsa; identical to SEQ ID NO: 101592

SEQ ID NO: 620106 - RNA, 64 nt, hsa; identical to SEQ ID NO: 101593

SEQ ID NO: 620107 - RNA, 64 nt, hsa; identical to SEQ ID NO: 101595

SEQ ID NO: 620108 - RNA, 64 nt, hsa; identical to SEQ ID NO: 101596

SEQ ID NO: 620109 - RNA, 64 nt, hsa; identical to SEQ ID NO: 101648

SEQ ID NO: 620110 - RNA, 64 nt, hsa; identical to SEQ ID NO: 101649

SEQ ID NO: 620111 - RNA, 64 nt, hsa; identical to SEQ ID NO: 101668

SEQ ID NO: 620112 - RNA, 64 nt, hsa; identical to SEQ ID NO: 101669

SEQ ID NO: 620113 - RNA, 64 nt, hsa; identical to SEQ ID NO: 101691

SEQ ID NO: 620114 - RNA, 64 nt, hsa; identical to SEQ ID NO: 101692

SEQ ID NO: 620115 - RNA, 64 nt, hsa; identical to SEQ ID NO: 101693

SEQ ID NO: 620116 - RNA, 64 nt, hsa; identical to SEQ ID NO: 101724

SEQ ID NO: 620117 - RNA, 64 nt, hsa; identical to SEQ ID NO: 101725

SEQ ID NO: 620118 - RNA, 64 nt, hsa; identical to SEQ ID NO: 101749

SEQ ID NO: 620119 - RNA, 64 nt, hsa; identical to SEQ ID NO: 101750

SEQ ID NO: 620120 - RNA, 64 nt, hsa; identical to SEQ ID NO: 101751

SEQ ID NO: 620121 - RNA, 64 nt, hsa; identical to SEQ ID NO: 101752

SEQ ID NO: 620122 - RNA, 64 nt, hsa; identical to SEQ ID NO: 101753

SEQ ID NO: 620123 - RNA, 64 nt, hsa; identical to SEQ ID NO: 101795

SEQ ID NO: 620124 - RNA, 64 nt, hsa; identical to SEQ ID NO: 101796

SEQ ID NO: 620125 - RNA, 64 nt, hsa; identical to SEQ ID NO: 101797

SEQ ID NO: 620126 - RNA, 64 nt, hsa; identical to SEQ ID NO: 101808

SEQ ID NO: 620127 - RNA, 64 nt, hsa; identical to SEQ ID NO: 101809

SEQ ID NO: 620128 - RNA, 64 nt, hsa; identical to SEQ ID NO: 101829

SEQ ID NO: 620129 - RNA, 64 nt, hsa; identical to SEQ ID NO: 101830

SEQ ID NO: 620130 - RNA, 63 nt, hsa; identical to SEQ ID NO: 98265

SEQ ID NO: 620131 - RNA, 64 nt, hsa; identical to SEQ ID NO: 98266

SEQ ID NO: 620132 - RNA, 64 nt, hsa; identical to SEQ ID NO: 98267

SEQ ID NO: 620133 - RNA, 64 nt, hsa; identical to SEQ ID NO: 98268

SEQ ID NO: 620134 - RNA, 64 nt, hsa; identical to SEQ ID NO: 98269

SEQ ID NO: 620135 - RNA, 64 nt, hsa; identical to SEQ ID NO: 98270

SEQ ID NO: 620136 - RNA, 64 nt, hsa; identical to SEQ ID NO: 98271

SEQ ID NO: 620137 - RNA, 64 nt, hsa; identical to SEQ ID NO: 98272

SEQ ID NO: 620138 - RNA, 64 nt, hsa; identical to SEQ ID NO: 98273

SEQ ID NO: 620139 - RNA, 64 nt, hsa; identical to SEQ ID NO: 98274

SEQ ID NO: 620140 - RNA, 64 nt, hsa; identical to SEQ ID NO: 98275

SEQ ID NO: 620141 - RNA, 64 nt, hsa; identical to SEQ ID NO: 98276

SEQ ID NO: 620142 - RNA, 64 nt, hsa; identical to SEQ ID NO: 98277

SEQ ID NO: 620143 - RNA, 64 nt, hsa; identical to SEQ ID NO: 98278

SEQ ID NO: 620144 - RNA, 64 nt, hsa; identical to SEQ ID NO: 98279

SEQ ID NO: 620145 - RNA, 64 nt, hsa; identical to SEQ ID NO: 98280

SEQ ID NO: 620146 - RNA, 64 nt, hsa; identical to SEQ ID NO: 98281

SEQ ID NO: 620147 - RNA, 64 nt, hsa; identical to SEQ ID NO: 98282

SEQ ID NO: 620148 - RNA, 64 nt, hsa; identical to SEQ ID NO: 98283

SEQ ID NO: 620149 - RNA, 64 nt, hsa; identical to SEQ ID NO: 98284

SEQ ID NO: 620150 - RNA, 64 nt, hsa; identical to SEQ ID NO: 98285

SEQ ID NO: 620151 - RNA, 64 nt, hsa; identical to SEQ ID NO: 98286

SEQ ID NO: 620152 - RNA, 64 nt, hsa; identical to SEQ ID NO: 98287

SEQ ID NO: 620153 - RNA, 64 nt, hsa; identical to SEQ ID NO: 98288

SEQ ID NO: 620154 - RNA, 64 nt, hsa; identical to SEQ ID NO: 98289

SEQ ID NO: 620155 - RNA, 64 nt, hsa; identical to SEQ ID NO: 98290

SEQ ID NO: 620156 - RNA, 64 nt, hsa; identical to SEQ ID NO: 98291

SEQ ID NO: 620157 - RNA, 64 nt, hsa; identical to SEQ ID NO: 98292

SEQ ID NO: 620158 - RNA, 64 nt, hsa; identical to SEQ ID NO: 98293

SEQ ID NO: 620159 - RNA, 64 nt, hsa; identical to SEQ ID NO: 98294

SEQ ID NO: 620160 - RNA, 64 nt, hsa; identical to SEQ ID NO: 98295

SEQ ID NO: 620161 - RNA, 64 nt, hsa; identical to SEQ ID NO: 98296

SEQ ID NO: 620162 - RNA, 64 nt, hsa; identical to SEQ ID NO: 98297

SEQ ID NO: 620163 - RNA, 64 nt, hsa; identical to SEQ ID NO: 98298

SEQ ID NO: 620164 - RNA, 64 nt, hsa; identical to SEQ ID NO: 98299

SEQ ID NO: 620165 - RNA, 64 nt, hsa; identical to SEQ ID NO: 98300

SEQ ID NO: 620166 - RNA, 64 nt, hsa; identical to SEQ ID NO: 98301

SEQ ID NO: 620167 - RNA, 64 nt, hsa; identical to SEQ ID NO: 98302

SEQ ID NO: 620168 - RNA, 63 nt, hsa
ggaggaggaugccacgcacuuccucucucggagcccucagacaucuccagugugccagacaaa

SEQ ID NO: 620169 - RNA, 63 nt, hsa
ugugggcaaaggcagggccacuuuugaagucuucccucagauuuccauuguguggccuggugg

SEQ ID NO: 620170 - RNA, 63 nt, hsa
cagaccuucaucugggaacgugcugagccagcacccucagaugauuucccuccaaacugcuga

SEQ ID NO: 620171 - RNA, 63 nt, hsa
uucuuuccuugugaucugaaugucuccuuuucccccucagagggcaaagaggugaacauaaag

SEQ ID NO: 620172 - RNA, 63 nt, hsa
uguaagccacugcuuauaauaaaaccaacaauacccucagacugaaagggcggaaguuauuau

SEQ ID NO: 620173 - RNA, 63 nt, hsa
ucagccuagaaauucugaccagcaccucaguuucccucagagggaaacagcaggaggagggau

SEQ ID NO: 620174 - RNA, 63 nt, hsa
cacaugacaucugccugggcccugaccaauaaacccucagacccaggacccaggacccugcug

SEQ ID NO: 620175 - RNA, 63 nt, hsa
ucccucauuacccaaggcaaggggcaggacaggcccucagaagcagcucuuggaggagaugag

SEQ ID NO: 620176 - RNA, 63 nt, hsa
gcugggaauguggaggcucugugagcccugcagcccucagaaucagggccagggaugcagaag

SEQ ID NO: 620177 - RNA, 63 nt, hsa
cccagccuacagaacaauggccauucugagugacccucagagugggugugugggugcgucuag

SEQ ID NO: 620178 - RNA, 63 nt, hsa
agacccaauuuuuuaagcccccagacuccuuagcccucagagccggcagcccccuacccucag

SEQ ID NO: 620179 - RNA, 63 nt, hsa
gacuccuuagcccucagagccggcagcccccuacccucagacaaggaacucucuccucucuuu

SEQ ID NO: 620180 - RNA, 63 nt, hsa
agccuggggcucccugagucagggcugugucuccccucagacuggggcucccugaggacgggg

SEQ ID NO: 620181 - RNA, 63 nt, hsa
aaguggggcucccucaggacagcguugugucuccccucagacugcggcucccugaggacgggg

SEQ ID NO: 620182 - RNA, 63 nt, hsa
agacugcggcucccugaggacggggcugugucucccucagacuggggcucccugaagaaaggg

SEQ ID NO: 620183 - RNA, 63 nt, hsa
agacuggggcucccugaagaaagggcugcuucucccucagacuggagcucccugaagaugggg

SEQ ID NO: 620184 - RNA, 63 nt, hsa
agacuggagcucccugaagauggggcugugucccccucagacuggggcugccugaggaugagg

SEQ ID NO: 620185 - RNA, 63 nt, hsa
aauguuucaucuccaacccucugccaguuuggccccucagagcuugguggcucaagacuguua

SEQ ID NO: 620186 - RNA, 63 nt, hsa
ugagugagugguggcggggcugcuccuucccaccccucagaacagcucugauccucguuaaua

SEQ ID NO: 620187 - RNA, 63 nt, hsa
aaaaaaaaggaaacagccucacuuuuuugugcucccucagaauugcuugcuaugucuguuaau

SEQ ID NO: 620188 - RNA, 63 nt, hsa
guuguuguuguuguuguuguuuuaauugggcaacccucagaacugaagagguucagagaacuu

SEQ ID NO: 620189 - RNA, 63 nt, hsa
caacaagaaacuucucccucacccccuccuuuacccucagauuuggagaugguaaccaaagga

SEQ ID NO: 620190 - RNA, 63 nt, hsa
ugcccaucuggagacugcaggcucccuuccuuacccucagagagugcuuaugguggguguuuu

SEQ ID NO: 620191 - RNA, 63 nt, hsa
aacuucgcucaggagggccuccccuuccccucucccucagaguuuucacugccgucucgucuu

SEQ ID NO: 620192 - RNA, 63 nt, hsa
aucccuuucuuggugacgacuuaaaucuggguucccucagacauuggguugcaccccaacaaa

SEQ ID NO: 620193 - RNA, 63 nt, hsa
ggaggcagagauuggagugauacauugugggaacccucagaagauaggaaaaaagcauggaau

SEQ ID NO: 620194 - RNA, 63 nt, hsa
cagaagauaggaaaaaagcauggaauagauucucccucagaguuccaguaguugccaacccug

SEQ ID NO: 620195 - RNA, 63 nt, hsa
ucagugccagccccugcuggcuggugccugagccccucagacagcccccugccccgcaggccu

SEQ ID NO: 620196 - RNA, 63 nt, hsa
aaaaagggcagcccuccuuaccacuguggaagucccucagaggccuuggggcaugacccagug

SEQ ID NO: 620197 - RNA, 63 nt, hsa
uguaacuaauuugugguaaaguaguugauucagcccucagaagaaaacuuuuguuuagagccc

SEQ ID NO: 620198 - RNA, 63 nt, hsa
gaaaucuccuaacaaaagaacuaagaggcccagcccucagaaacccuucagugcuacauuuug

SEQ ID NO: 620199 - RNA, 63 nt, hsa
ccuguuccugaggccucauuuagaaagaaaauccccucagaaggcugucuggcacccaguguc

SEQ ID NO: 620200 - RNA, 63 nt, hsa
gcuuucugccucugguaacaggagugagugagccccucagaccugcacucugggugucuccug

SEQ ID NO: 620201 - RNA, 63 nt, hsa
caguucuuggugacugucccaccgggagccucccccucagaugaucucuccacgguagcacuu

SEQ ID NO: 620202 - RNA, 63 nt, hsa
uucauccaguuuguucuccggguguggccucagcccucagaacaauccgauucacguagggaa

SEQ ID NO: 620203 - RNA, 63 nt, hsa
caaggguaggggacaagauguaggcuccagcuccccucagaccuccucaucucaugagcuucu

SEQ ID NO: 620204 - RNA, 63 nt, hsa
uauucagagaacuauacuacccucacagugaggcccucagaccugccacagggcagagcaggu

SEQ ID NO: 620205 - RNA, 63 nt, hsa
cuuucagaugcauugacucuucccgccuccccucccucagaaagguagugcccacacuauuuu

SEQ ID NO: 620206 - RNA, 63 nt, hsa
ccgugucacagcuguguccccuugucaggaagacccucagauguggccagagcaccggccucc

SEQ ID NO: 620207 - RNA, 63 nt, hsa
acauucauacacaagccuuuucacacagcacuccccucagacacccucagagaguucacacug

SEQ ID NO: 620208 - RNA, 63 nt, hsa
acaagccuuuucacacagcacuccccucagacacccucagagaguucacacugaugggaaaug

SEQ ID NO: 620209 - RNA, 63 nt, hsa
ccagacccagagguccaggucccagccccuccucccucagacccagcgguccaaugccaccua

SEQ ID NO: 620210 - RNA, 63 nt, hsa
cagacccagggguccaggcccccaaccccuccucccucagacucagagguccaggcccccaac

SEQ ID NO: 620211 - RNA, 63 nt, hsa
agacccaggaguccagaccccccagccccuccucccucagacccaggaguccagccccuccuc

SEQ ID NO: 620212 - RNA, 63 nt, hsa
uccucccucagacccaggaguccagccccuccucccucagacccaggaguccagaccccccag

SEQ ID NO: 620213 - RNA, 63 nt, hsa; identical to SEQ ID NO: 620211

SEQ ID NO: 620214 - RNA, 63 nt, hsa
ucaaaccaaggguacagauccccagccccuccucccucagacccaggaguccagaccccccag

SEQ ID NO: 620215 - RNA, 63 nt, hsa
cagacccgggaguccaggcccccagccccuccucccucagacccaggaguccaggccccagcc

SEQ ID NO: 620216 - RNA, 63 nt, hsa
cagacccaggaguccaggcccccagccccuccucccucagacccgggaguccaggcccccagc

SEQ ID NO: 620217 - RNA, 63 nt, hsa
caggacccaggaguccaggccccagccccuccucccucagacccaggaguccaggcccccagc

SEQ ID NO: 620218 - RNA, 63 nt, hsa
cagacccaggauucccgggccccaguaccuccucccucagacccaggacuccaggcccccagc

SEQ ID NO: 620219 - RNA, 63 nt, hsa
cagauccaggagucuaguccuccagcuccuccucccucagacccaggauucccgggccccagu

SEQ ID NO: 620220 - RNA, 63 nt, hsa
caguuugguuucuagcaugaagacagagccccacccucagaugcacaugagcuggcgggauug

SEQ ID NO: 620221 - RNA, 63 nt, hsa
augcugucuucguacugggaaagggauuuucagcccucagaaucgcuccaccuugcagcucuc

SEQ ID NO: 620222 - RNA, 63 nt, hsa
ucugagcccaggccugcagggguggagggcagucccucagaaucccagaggcagucccagccu

SEQ ID NO: 620223 - RNA, 63 nt, hsa
gcccuccccuuccucccauccuuguccuucucucccucagaagccucaggacccaacaggugg

SEQ ID NO: 620224 - RNA, 64 nt, hsa; identical to SEQ ID NO: 111894

SEQ ID NO: 620225 - RNA, 64 nt, hsa; identical to SEQ ID NO: 111895

SEQ ID NO: 620226 - RNA, 64 nt, hsa; identical to SEQ ID NO: 111896

SEQ ID NO: 620227 - RNA, 64 nt, hsa; identical to SEQ ID NO: 111897

SEQ ID NO: 620228 - RNA, 64 nt, hsa; identical to SEQ ID NO: 111898

SEQ ID NO: 620229 - RNA, 64 nt, hsa; identical to SEQ ID NO: 111899

SEQ ID NO: 620230 - RNA, 64 nt, hsa; identical to SEQ ID NO: 111900

SEQ ID NO: 620231 - RNA, 64 nt, hsa; identical to SEQ ID NO: 111901

SEQ ID NO: 620232 - RNA, 64 nt, hsa; identical to SEQ ID NO: 111902

SEQ ID NO: 620233 - RNA, 64 nt, hsa; identical to SEQ ID NO: 111903

SEQ ID NO: 620234 - RNA, 64 nt, hsa; identical to SEQ ID NO: 111904

SEQ ID NO: 620235 - RNA, 64 nt, hsa; identical to SEQ ID NO: 111905

SEQ ID NO: 620236 - RNA, 64 nt, hsa; identical to SEQ ID NO: 111906

SEQ ID NO: 620237 - RNA, 64 nt, hsa; identical to SEQ ID NO: 111907

SEQ ID NO: 620238 - RNA, 64 nt, hsa; identical to SEQ ID NO: 111908

SEQ ID NO: 620239 - RNA, 64 nt, hsa; identical to SEQ ID NO: 111909

SEQ ID NO: 620240 - RNA, 64 nt, hsa; identical to SEQ ID NO: 111910

SEQ ID NO: 620241 - RNA, 64 nt, hsa; identical to SEQ ID NO: 111911

SEQ ID NO: 620242 - RNA, 64 nt, hsa; identical to SEQ ID NO: 111912

SEQ ID NO: 620243 - RNA, 64 nt, hsa; identical to SEQ ID NO: 111913

SEQ ID NO: 620244 - RNA, 64 nt, hsa; identical to SEQ ID NO: 111914

SEQ ID NO: 620245 - RNA, 64 nt, hsa; identical to SEQ ID NO: 111915

SEQ ID NO: 620246 - RNA, 64 nt, hsa; identical to SEQ ID NO: 111916

SEQ ID NO: 620247 - RNA, 64 nt, hsa; identical to SEQ ID NO: 111917

SEQ ID NO: 620248 - RNA, 64 nt, hsa; identical to SEQ ID NO: 111918

SEQ ID NO: 620249 - RNA, 64 nt, hsa; identical to SEQ ID NO: 111919

SEQ ID NO: 620250 - RNA, 64 nt, hsa; identical to SEQ ID NO: 111920

SEQ ID NO: 620251 - RNA, 64 nt, hsa; identical to SEQ ID NO: 111921

SEQ ID NO: 620252 - RNA, 64 nt, hsa; identical to SEQ ID NO: 111922

SEQ ID NO: 620253 - RNA, 64 nt, hsa; identical to SEQ ID NO: 111923

SEQ ID NO: 620254 - RNA, 64 nt, hsa; identical to SEQ ID NO: 111924

SEQ ID NO: 620255 - RNA, 64 nt, hsa; identical to SEQ ID NO: 111925

SEQ ID NO: 620256 - RNA, 64 nt, hsa; identical to SEQ ID NO: 111926

SEQ ID NO: 620257 - RNA, 64 nt, hsa; identical to SEQ ID NO: 111927

SEQ ID NO: 620258 - RNA, 63 nt, hsa; identical to SEQ ID NO: 620168

SEQ ID NO: 620259 - RNA, 63 nt, hsa; identical to SEQ ID NO: 620169

SEQ ID NO: 620260 - RNA, 63 nt, hsa; identical to SEQ ID NO: 620170

SEQ ID NO: 620261 - RNA, 63 nt, hsa; identical to SEQ ID NO: 620171

SEQ ID NO: 620262 - RNA, 63 nt, hsa; identical to SEQ ID NO: 620172

SEQ ID NO: 620263 - RNA, 63 nt, hsa; identical to SEQ ID NO: 620173

SEQ ID NO: 620264 - RNA, 63 nt, hsa; identical to SEQ ID NO: 620174

SEQ ID NO: 620265 - RNA, 63 nt, hsa; identical to SEQ ID NO: 620175

SEQ ID NO: 620266 - RNA, 63 nt, hsa; identical to SEQ ID NO: 620176

SEQ ID NO: 620267 - RNA, 63 nt, hsa; identical to SEQ ID NO: 620177

SEQ ID NO: 620268 - RNA, 63 nt, hsa; identical to SEQ ID NO: 620178

SEQ ID NO: 620269 - RNA, 63 nt, hsa; identical to SEQ ID NO: 620179

SEQ ID NO: 620270 - RNA, 63 nt, hsa; identical to SEQ ID NO: 620180

SEQ ID NO: 620271 - RNA, 63 nt, hsa; identical to SEQ ID NO: 620181

SEQ ID NO: 620272 - RNA, 63 nt, hsa; identical to SEQ ID NO: 620182

SEQ ID NO: 620273 - RNA, 63 nt, hsa; identical to SEQ ID NO: 620183

SEQ ID NO: 620274 - RNA, 63 nt, hsa; identical to SEQ ID NO: 620184

SEQ ID NO: 620275 - RNA, 63 nt, hsa; identical to SEQ ID NO: 620185

SEQ ID NO: 620276 - RNA, 63 nt, hsa; identical to SEQ ID NO: 620186

SEQ ID NO: 620277 - RNA, 63 nt, hsa; identical to SEQ ID NO: 620187

SEQ ID NO: 620278 - RNA, 63 nt, hsa; identical to SEQ ID NO: 620188

SEQ ID NO: 620279 - RNA, 63 nt, hsa; identical to SEQ ID NO: 620189

SEQ ID NO: 620280 - RNA, 63 nt, hsa; identical to SEQ ID NO: 620190

SEQ ID NO: 620281 - RNA, 63 nt, hsa; identical to SEQ ID NO: 620191

SEQ ID NO: 620282 - RNA, 63 nt, hsa; identical to SEQ ID NO: 620192

SEQ ID NO: 620283 - RNA, 63 nt, hsa; identical to SEQ ID NO: 620193

SEQ ID NO: 620284 - RNA, 63 nt, hsa; identical to SEQ ID NO: 620194

SEQ ID NO: 620285 - RNA, 63 nt, hsa; identical to SEQ ID NO: 620195

SEQ ID NO: 620286 - RNA, 63 nt, hsa; identical to SEQ ID NO: 620196

SEQ ID NO: 620287 - RNA, 63 nt, hsa; identical to SEQ ID NO: 620197

SEQ ID NO: 620288 - RNA, 63 nt, hsa; identical to SEQ ID NO: 620198

SEQ ID NO: 620289 - RNA, 63 nt, hsa; identical to SEQ ID NO: 620199

SEQ ID NO: 620290 - RNA, 63 nt, hsa; identical to SEQ ID NO: 620200

SEQ ID NO: 620291 - RNA, 63 nt, hsa; identical to SEQ ID NO: 620201

SEQ ID NO: 620292 - RNA, 63 nt, hsa; identical to SEQ ID NO: 620202

SEQ ID NO: 620293 - RNA, 63 nt, hsa; identical to SEQ ID NO: 620203

SEQ ID NO: 620294 - RNA, 63 nt, hsa; identical to SEQ ID NO: 620204

SEQ ID NO: 620295 - RNA, 63 nt, hsa; identical to SEQ ID NO: 620205

SEQ ID NO: 620296 - RNA, 63 nt, hsa; identical to SEQ ID NO: 620206

SEQ ID NO: 620297 - RNA, 63 nt, hsa; identical to SEQ ID NO: 620207

SEQ ID NO: 620298 - RNA, 63 nt, hsa; identical to SEQ ID NO: 620208

SEQ ID NO: 620299 - RNA, 63 nt, hsa; identical to SEQ ID NO: 620209

SEQ ID NO: 620300 - RNA, 63 nt, hsa; identical to SEQ ID NO: 620210

SEQ ID NO: 620301 - RNA, 63 nt, hsa; identical to SEQ ID NO: 620211

SEQ ID NO: 620302 - RNA, 63 nt, hsa; identical to SEQ ID NO: 620212

SEQ ID NO: 620303 - RNA, 63 nt, hsa; identical to SEQ ID NO: 620211

SEQ ID NO: 620304 - RNA, 63 nt, hsa; identical to SEQ ID NO: 620214

SEQ ID NO: 620305 - RNA, 63 nt, hsa; identical to SEQ ID NO: 620215

SEQ ID NO: 620306 - RNA, 63 nt, hsa; identical to SEQ ID NO: 620216

SEQ ID NO: 620307 - RNA, 63 nt, hsa; identical to SEQ ID NO: 620217

SEQ ID NO: 620308 - RNA, 63 nt, hsa; identical to SEQ ID NO: 620218

SEQ ID NO: 620309 - RNA, 63 nt, hsa; identical to SEQ ID NO: 620219

SEQ ID NO: 620310 - RNA, 63 nt, hsa; identical to SEQ ID NO: 620220

SEQ ID NO: 620311 - RNA, 63 nt, hsa; identical to SEQ ID NO: 620221

SEQ ID NO: 620312 - RNA, 63 nt, hsa; identical to SEQ ID NO: 620222

SEQ ID NO: 620313 - RNA, 63 nt, hsa; identical to SEQ ID NO: 620223

SEQ ID NO: 620314 - RNA, 64 nt, hsa; identical to SEQ ID NO: 87480

SEQ ID NO: 620315 - RNA, 64 nt, hsa; identical to SEQ ID NO: 87481

SEQ ID NO: 620316 - RNA, 64 nt, hsa; identical to SEQ ID NO: 87482

SEQ ID NO: 620317 - RNA, 64 nt, hsa; identical to SEQ ID NO: 87483

SEQ ID NO: 620318 - RNA, 64 nt, hsa; identical to SEQ ID NO: 87484

SEQ ID NO: 620319 - RNA, 64 nt, hsa; identical to SEQ ID NO: 87485

SEQ ID NO: 620320 - RNA, 64 nt, hsa; identical to SEQ ID NO: 87486

SEQ ID NO: 620321 - RNA, 64 nt, hsa; identical to SEQ ID NO: 87487

SEQ ID NO: 620322 - RNA, 64 nt, hsa; identical to SEQ ID NO: 87488

SEQ ID NO: 620323 - RNA, 64 nt, hsa; identical to SEQ ID NO: 87489

SEQ ID NO: 620324 - RNA, 64 nt, hsa; identical to SEQ ID NO: 87490

SEQ ID NO: 620325 - RNA, 64 nt, hsa; identical to SEQ ID NO: 87491

SEQ ID NO: 620326 - RNA, 64 nt, hsa; identical to SEQ ID NO: 87492

SEQ ID NO: 620327 - RNA, 64 nt, hsa; identical to SEQ ID NO: 87493

SEQ ID NO: 620328 - RNA, 64 nt, hsa; identical to SEQ ID NO: 87494

SEQ ID NO: 620329 - RNA, 64 nt, hsa; identical to SEQ ID NO: 87495

SEQ ID NO: 620330 - RNA, 64 nt, hsa; identical to SEQ ID NO: 87496

SEQ ID NO: 620331 - RNA, 64 nt, hsa; identical to SEQ ID NO: 87497

SEQ ID NO: 620332 - RNA, 64 nt, hsa; identical to SEQ ID NO: 87498

SEQ ID NO: 620333 - RNA, 64 nt, hsa; identical to SEQ ID NO: 87499

SEQ ID NO: 620334 - RNA, 64 nt, hsa; identical to SEQ ID NO: 87500

SEQ ID NO: 620335 - RNA, 64 nt, hsa; identical to SEQ ID NO: 87501

SEQ ID NO: 620336 - RNA, 64 nt, hsa; identical to SEQ ID NO: 87502

SEQ ID NO: 620337 - RNA, 64 nt, hsa; identical to SEQ ID NO: 87503

SEQ ID NO: 620338 - RNA, 64 nt, hsa; identical to SEQ ID NO: 87504

SEQ ID NO: 620339 - RNA, 64 nt, hsa; identical to SEQ ID NO: 87505

SEQ ID NO: 620340 - RNA, 64 nt, hsa; identical to SEQ ID NO: 87506

SEQ ID NO: 620341 - RNA, 64 nt, hsa; identical to SEQ ID NO: 87507

SEQ ID NO: 620342 - RNA, 64 nt, hsa; identical to SEQ ID NO: 87508

SEQ ID NO: 620343 - RNA, 64 nt, hsa; identical to SEQ ID NO: 87509

SEQ ID NO: 620344 - RNA, 64 nt, hsa; identical to SEQ ID NO: 87510

SEQ ID NO: 620345 - RNA, 64 nt, hsa; identical to SEQ ID NO: 87511

SEQ ID NO: 620346 - RNA, 64 nt, hsa; identical to SEQ ID NO: 87512

SEQ ID NO: 620347 - RNA, 64 nt, hsa; identical to SEQ ID NO: 87513

SEQ ID NO: 620348 - RNA, 64 nt, hsa; identical to SEQ ID NO: 87514

SEQ ID NO: 620349 - RNA, 64 nt, hsa; identical to SEQ ID NO: 87515

SEQ ID NO: 620350 - RNA, 64 nt, hsa; identical to SEQ ID NO: 87516

SEQ ID NO: 620351 - RNA, 64 nt, hsa; identical to SEQ ID NO: 87517

SEQ ID NO: 620352 - RNA, 64 nt, hsa; identical to SEQ ID NO: 87518

SEQ ID NO: 620353 - RNA, 64 nt, hsa; identical to SEQ ID NO: 87519

SEQ ID NO: 620354 - RNA, 64 nt, hsa; identical to SEQ ID NO: 87520

SEQ ID NO: 620355 - RNA, 64 nt, hsa; identical to SEQ ID NO: 87521

SEQ ID NO: 620356 - RNA, 64 nt, hsa; identical to SEQ ID NO: 87522

SEQ ID NO: 620357 - RNA, 64 nt, hsa; identical to SEQ ID NO: 87523

SEQ ID NO: 620358 - RNA, 64 nt, hsa; identical to SEQ ID NO: 87524

SEQ ID NO: 620359 - RNA, 64 nt, hsa; identical to SEQ ID NO: 87525

SEQ ID NO: 620360 - RNA, 64 nt, hsa; identical to SEQ ID NO: 87526

SEQ ID NO: 620361 - RNA, 64 nt, hsa; identical to SEQ ID NO: 87527

SEQ ID NO: 620362 - RNA, 64 nt, hsa; identical to SEQ ID NO: 87528

SEQ ID NO: 620363 - RNA, 64 nt, hsa; identical to SEQ ID NO: 87529

SEQ ID NO: 620364 - RNA, 64 nt, hsa; identical to SEQ ID NO: 87530

SEQ ID NO: 620365 - RNA, 64 nt, hsa; identical to SEQ ID NO: 87531

SEQ ID NO: 620366 - RNA, 64 nt, hsa; identical to SEQ ID NO: 87532

SEQ ID NO: 620367 - RNA, 64 nt, hsa; identical to SEQ ID NO: 87533

SEQ ID NO: 620368 - RNA, 64 nt, hsa; identical to SEQ ID NO: 87534

SEQ ID NO: 620369 - RNA, 64 nt, hsa; identical to SEQ ID NO: 87535

SEQ ID NO: 620370 - RNA, 64 nt, hsa; identical to SEQ ID NO: 87536

SEQ ID NO: 620371 - RNA, 64 nt, hsa; identical to SEQ ID NO: 381884

SEQ ID NO: 620372 - RNA, 64 nt, hsa; identical to SEQ ID NO: 381885

SEQ ID NO: 620373 - RNA, 64 nt, hsa; identical to SEQ ID NO: 381886

SEQ ID NO: 620374 - RNA, 64 nt, hsa; identical to SEQ ID NO: 381887

SEQ ID NO: 620375 - RNA, 64 nt, hsa; identical to SEQ ID NO: 381888

SEQ ID NO: 620376 - RNA, 64 nt, hsa; identical to SEQ ID NO: 381889

SEQ ID NO: 620377 - RNA, 64 nt, hsa; identical to SEQ ID NO: 381890

SEQ ID NO: 620378 - RNA, 64 nt, hsa; identical to SEQ ID NO: 381891

SEQ ID NO: 620379 - RNA, 59 nt, hsa; identical to SEQ ID NO: 381892

SEQ ID NO: 620380 - RNA, 64 nt, hsa; identical to SEQ ID NO: 381893

SEQ ID NO: 620381 - RNA, 64 nt, hsa; identical to SEQ ID NO: 381894

SEQ ID NO: 620382 - RNA, 64 nt, hsa; identical to SEQ ID NO: 381895

SEQ ID NO: 620383 - RNA, 64 nt, hsa; identical to SEQ ID NO: 381896

SEQ ID NO: 620384 - RNA, 64 nt, hsa; identical to SEQ ID NO: 381897

SEQ ID NO: 620385 - RNA, 64 nt, hsa; identical to SEQ ID NO: 381898

SEQ ID NO: 620386 - RNA, 64 nt, hsa; identical to SEQ ID NO: 381899

SEQ ID NO: 620387 - RNA, 64 nt, hsa; identical to SEQ ID NO: 381900

SEQ ID NO: 620388 - RNA, 64 nt, hsa; identical to SEQ ID NO: 381901

SEQ ID NO: 620389 - RNA, 64 nt, hsa; identical to SEQ ID NO: 381902

SEQ ID NO: 620390 - RNA, 64 nt, hsa; identical to SEQ ID NO: 381903

SEQ ID NO: 620391 - RNA, 64 nt, hsa; identical to SEQ ID NO: 381904

SEQ ID NO: 620392 - RNA, 64 nt, hsa; identical to SEQ ID NO: 381905

SEQ ID NO: 620393 - RNA, 64 nt, hsa; identical to SEQ ID NO: 381906

SEQ ID NO: 620394 - RNA, 64 nt, hsa; identical to SEQ ID NO: 381907

SEQ ID NO: 620395 - RNA, 64 nt, hsa; identical to SEQ ID NO: 381908

SEQ ID NO: 620396 - RNA, 64 nt, hsa; identical to SEQ ID NO: 381909

SEQ ID NO: 620397 - RNA, 64 nt, hsa; identical to SEQ ID NO: 381910

SEQ ID NO: 620398 - RNA, 64 nt, hsa; identical to SEQ ID NO: 381911

SEQ ID NO: 620399 - RNA, 64 nt, hsa; identical to SEQ ID NO: 381912

SEQ ID NO: 620400 - RNA, 64 nt, hsa; identical to SEQ ID NO: 381913

SEQ ID NO: 620401 - RNA, 64 nt, hsa; identical to SEQ ID NO: 381914

SEQ ID NO: 620402 - RNA, 64 nt, hsa; identical to SEQ ID NO: 381915

SEQ ID NO: 620403 - RNA, 64 nt, hsa; identical to SEQ ID NO: 381916

SEQ ID NO: 620404 - RNA, 64 nt, hsa; identical to SEQ ID NO: 381917

SEQ ID NO: 620405 - RNA, 64 nt, hsa; identical to SEQ ID NO: 381918

SEQ ID NO: 620406 - RNA, 64 nt, hsa; identical to SEQ ID NO: 381919

SEQ ID NO: 620407 - RNA, 64 nt, hsa; identical to SEQ ID NO: 381920

SEQ ID NO: 620408 - RNA, 64 nt, hsa; identical to SEQ ID NO: 381921

SEQ ID NO: 620409 - RNA, 64 nt, hsa; identical to SEQ ID NO: 381922

SEQ ID NO: 620410 - RNA, 64 nt, hsa; identical to SEQ ID NO: 381923

SEQ ID NO: 620411 - RNA, 64 nt, hsa; identical to SEQ ID NO: 381924

SEQ ID NO: 620412 - RNA, 64 nt, hsa; identical to SEQ ID NO: 381925

SEQ ID NO: 620413 - RNA, 64 nt, hsa; identical to SEQ ID NO: 381926

SEQ ID NO: 620414 - RNA, 64 nt, hsa; identical to SEQ ID NO: 381927

SEQ ID NO: 620415 - RNA, 64 nt, hsa; identical to SEQ ID NO: 381928

SEQ ID NO: 620416 - RNA, 64 nt, hsa; identical to SEQ ID NO: 60878

SEQ ID NO: 620417 - RNA, 64 nt, hsa; identical to SEQ ID NO: 60879

SEQ ID NO: 620418 - RNA, 64 nt, hsa; identical to SEQ ID NO: 60880

SEQ ID NO: 620419 - RNA, 64 nt, hsa; identical to SEQ ID NO: 60881

SEQ ID NO: 620420 - RNA, 64 nt, hsa; identical to SEQ ID NO: 60882

SEQ ID NO: 620421 - RNA, 64 nt, hsa; identical to SEQ ID NO: 60883

SEQ ID NO: 620422 - RNA, 64 nt, hsa; identical to SEQ ID NO: 60884

SEQ ID NO: 620423 - RNA, 64 nt, hsa; identical to SEQ ID NO: 60885

SEQ ID NO: 620424 - RNA, 64 nt, hsa; identical to SEQ ID NO: 60886

SEQ ID NO: 620425 - RNA, 64 nt, hsa; identical to SEQ ID NO: 60887

SEQ ID NO: 620426 - RNA, 64 nt, hsa; identical to SEQ ID NO: 60888

SEQ ID NO: 620427 - RNA, 64 nt, hsa; identical to SEQ ID NO: 60889

SEQ ID NO: 620428 - RNA, 64 nt, hsa; identical to SEQ ID NO: 60890

SEQ ID NO: 620429 - RNA, 64 nt, hsa; identical to SEQ ID NO: 60891

SEQ ID NO: 620430 - RNA, 64 nt, hsa; identical to SEQ ID NO: 60892

SEQ ID NO: 620431 - RNA, 64 nt, hsa; identical to SEQ ID NO: 60893

SEQ ID NO: 620432 - RNA, 64 nt, hsa; identical to SEQ ID NO: 60894

SEQ ID NO: 620433 - RNA, 64 nt, hsa; identical to SEQ ID NO: 60895

SEQ ID NO: 620434 - RNA, 64 nt, hsa; identical to SEQ ID NO: 60896

SEQ ID NO: 620435 - RNA, 64 nt, hsa; identical to SEQ ID NO: 60897

SEQ ID NO: 620436 - RNA, 64 nt, hsa; identical to SEQ ID NO: 60898

SEQ ID NO: 620437 - RNA, 64 nt, hsa; identical to SEQ ID NO: 60899

SEQ ID NO: 620438 - RNA, 64 nt, hsa; identical to SEQ ID NO: 60900

SEQ ID NO: 620439 - RNA, 64 nt, hsa; identical to SEQ ID NO: 60901

SEQ ID NO: 620440 - RNA, 64 nt, hsa; identical to SEQ ID NO: 60902

SEQ ID NO: 620441 - RNA, 64 nt, hsa; identical to SEQ ID NO: 60903

SEQ ID NO: 620442 - RNA, 64 nt, hsa; identical to SEQ ID NO: 60904

SEQ ID NO: 620443 - RNA, 64 nt, hsa; identical to SEQ ID NO: 60905

SEQ ID NO: 620444 - RNA, 64 nt, hsa; identical to SEQ ID NO: 60906

SEQ ID NO: 620445 - RNA, 64 nt, hsa; identical to SEQ ID NO: 60907

SEQ ID NO: 620446 - RNA, 64 nt, hsa; identical to SEQ ID NO: 60908

SEQ ID NO: 620447 - RNA, 64 nt, hsa; identical to SEQ ID NO: 60909

SEQ ID NO: 620448 - RNA, 64 nt, hsa; identical to SEQ ID NO: 60910

SEQ ID NO: 620449 - RNA, 64 nt, hsa; identical to SEQ ID NO: 60911

SEQ ID NO: 620450 - RNA, 64 nt, hsa; identical to SEQ ID NO: 60912

SEQ ID NO: 620451 - RNA, 64 nt, hsa; identical to SEQ ID NO: 60913

SEQ ID NO: 620452 - RNA, 64 nt, hsa; identical to SEQ ID NO: 60914

SEQ ID NO: 620453 - RNA, 64 nt, hsa; identical to SEQ ID NO: 60915

SEQ ID NO: 620454 - RNA, 64 nt, hsa; identical to SEQ ID NO: 60916

SEQ ID NO: 620455 - RNA, 64 nt, hsa; identical to SEQ ID NO: 60917

SEQ ID NO: 620456 - RNA, 64 nt, hsa; identical to SEQ ID NO: 60918

SEQ ID NO: 620457 - RNA, 64 nt, hsa; identical to SEQ ID NO: 60919

SEQ ID NO: 620458 - RNA, 64 nt, hsa; identical to SEQ ID NO: 60920

SEQ ID NO: 620459 - RNA, 64 nt, hsa; identical to SEQ ID NO: 60921

SEQ ID NO: 620460 - RNA, 64 nt, hsa; identical to SEQ ID NO: 60922

SEQ ID NO: 620461 - RNA, 64 nt, hsa; identical to SEQ ID NO: 60923

SEQ ID NO: 620462 - RNA, 64 nt, hsa; identical to SEQ ID NO: 60924

SEQ ID NO: 620463 - RNA, 64 nt, hsa; identical to SEQ ID NO: 60925

SEQ ID NO: 620464 - RNA, 64 nt, hsa; identical to SEQ ID NO: 60926

SEQ ID NO: 620465 - RNA, 64 nt, hsa; identical to SEQ ID NO: 60927

SEQ ID NO: 620466 - RNA, 64 nt, hsa; identical to SEQ ID NO: 60928

SEQ ID NO: 620467 - RNA, 64 nt, hsa; identical to SEQ ID NO: 60929

SEQ ID NO: 620468 - RNA, 64 nt, hsa; identical to SEQ ID NO: 60930

SEQ ID NO: 620469 - RNA, 64 nt, hsa; identical to SEQ ID NO: 60931

SEQ ID NO: 620470 - RNA, 64 nt, hsa; identical to SEQ ID NO: 60932

SEQ ID NO: 620471 - RNA, 64 nt, hsa; identical to SEQ ID NO: 60933

SEQ ID NO: 620472 - RNA, 64 nt, hsa; identical to SEQ ID NO: 550527

SEQ ID NO: 620473 - RNA, 64 nt, hsa; identical to SEQ ID NO: 550528

SEQ ID NO: 620474 - RNA, 64 nt, hsa; identical to SEQ ID NO: 550529

SEQ ID NO: 620475 - RNA, 64 nt, hsa; identical to SEQ ID NO: 550530

SEQ ID NO: 620476 - RNA, 64 nt, hsa; identical to SEQ ID NO: 550531

SEQ ID NO: 620477 - RNA, 64 nt, hsa; identical to SEQ ID NO: 550532

SEQ ID NO: 620478 - RNA, 64 nt, hsa; identical to SEQ ID NO: 550533

SEQ ID NO: 620479 - RNA, 64 nt, hsa; identical to SEQ ID NO: 550534

SEQ ID NO: 620480 - RNA, 64 nt, hsa; identical to SEQ ID NO: 550535

SEQ ID NO: 620481 - RNA, 64 nt, hsa; identical to SEQ ID NO: 550536

SEQ ID NO: 620482 - RNA, 64 nt, hsa; identical to SEQ ID NO: 550537

SEQ ID NO: 620483 - RNA, 64 nt, hsa; identical to SEQ ID NO: 550538

SEQ ID NO: 620484 - RNA, 64 nt, hsa; identical to SEQ ID NO: 550539

SEQ ID NO: 620485 - RNA, 64 nt, hsa; identical to SEQ ID NO: 550540

SEQ ID NO: 620486 - RNA, 64 nt, hsa; identical to SEQ ID NO: 550541

SEQ ID NO: 620487 - RNA, 64 nt, hsa; identical to SEQ ID NO: 550542

SEQ ID NO: 620488 - RNA, 64 nt, hsa; identical to SEQ ID NO: 550543

SEQ ID NO: 620489 - RNA, 64 nt, hsa; identical to SEQ ID NO: 550544

SEQ ID NO: 620490 - RNA, 64 nt, hsa; identical to SEQ ID NO: 550545

SEQ ID NO: 620491 - RNA, 64 nt, hsa; identical to SEQ ID NO: 550546

SEQ ID NO: 620492 - RNA, 64 nt, hsa; identical to SEQ ID NO: 550547

SEQ ID NO: 620493 - RNA, 64 nt, hsa; identical to SEQ ID NO: 550548

SEQ ID NO: 620494 - RNA, 64 nt, hsa; identical to SEQ ID NO: 550549

SEQ ID NO: 620495 - RNA, 64 nt, hsa; identical to SEQ ID NO: 550550

SEQ ID NO: 620496 - RNA, 64 nt, hsa; identical to SEQ ID NO: 550551

SEQ ID NO: 620497 - RNA, 64 nt, hsa; identical to SEQ ID NO: 550552

SEQ ID NO: 620498 - RNA, 64 nt, hsa; identical to SEQ ID NO: 550553

SEQ ID NO: 620499 - RNA, 64 nt, hsa; identical to SEQ ID NO: 550554

SEQ ID NO: 620500 - RNA, 64 nt, hsa; identical to SEQ ID NO: 550555

SEQ ID NO: 620501 - RNA, 64 nt, hsa; identical to SEQ ID NO: 550556

SEQ ID NO: 620502 - RNA, 64 nt, hsa; identical to SEQ ID NO: 550557

SEQ ID NO: 620503 - RNA, 64 nt, hsa; identical to SEQ ID NO: 550558

SEQ ID NO: 620504 - RNA, 64 nt, hsa; identical to SEQ ID NO: 550559

SEQ ID NO: 620505 - RNA, 64 nt, hsa; identical to SEQ ID NO: 550560

SEQ ID NO: 620506 - RNA, 64 nt, hsa; identical to SEQ ID NO: 550561

SEQ ID NO: 620507 - RNA, 64 nt, hsa; identical to SEQ ID NO: 550562

SEQ ID NO: 620508 - RNA, 64 nt, hsa; identical to SEQ ID NO: 550563

SEQ ID NO: 620509 - RNA, 64 nt, hsa; identical to SEQ ID NO: 550564

SEQ ID NO: 620510 - RNA, 64 nt, hsa; identical to SEQ ID NO: 550565

SEQ ID NO: 620511 - RNA, 64 nt, hsa; identical to SEQ ID NO: 550566

SEQ ID NO: 620512 - RNA, 64 nt, hsa; identical to SEQ ID NO: 550567

SEQ ID NO: 620513 - RNA, 64 nt, hsa; identical to SEQ ID NO: 550568

SEQ ID NO: 620514 - RNA, 64 nt, hsa; identical to SEQ ID NO: 550569

SEQ ID NO: 620515 - RNA, 64 nt, hsa; identical to SEQ ID NO: 550570

SEQ ID NO: 620516 - RNA, 64 nt, hsa; identical to SEQ ID NO: 550571

SEQ ID NO: 620517 - RNA, 64 nt, hsa; identical to SEQ ID NO: 550572

SEQ ID NO: 620518 - RNA, 64 nt, hsa
cuagagugacucagacacaccacaguaacaacucucgcugcaauuuuauuuuaauuugagaaau

SEQ ID NO: 620519 - RNA, 64 nt, hsa
gcuccccacaguccaaauaagcugaaagugcagcucgcugcaggccccagagcgagcuuccccu

SEQ ID NO: 620520 - RNA, 64 nt, hsa
cagccaggcuggagugcaguggcaugaucucagcucgcugcaacccccaccucccagguucaag

SEQ ID NO: 620521 - RNA, 64 nt, hsa
ccuacugagcauccuccagcuucccuggugcuguucgcugcaguuguuccccaucaguacucaa

SEQ ID NO: 620522 - RNA, 64 nt, hsa
ucgucggucgguuugccgucagagauggcgcaucucgcugcaucccccgagaguacaccgguug

SEQ ID NO: 620523 - RNA, 64 nt, hsa
ucgccaggcuggagugcaguggcgcagucucggcucgcugcaaccucugacucccugguucaaa

SEQ ID NO: 620524 - RNA, 64 nt, hsa
agauguguucugagcuggaugccggguuccagaaucgcugcacaguuccaacaggacagcgccu

SEQ ID NO: 620525 - RNA, 64 nt, hsa
aggaugugugaaaaucuuuuccagggaaauggguucgcugcagagguaaggauguguuccugua

SEQ ID NO: 620526 - RNA, 64 nt, hsa
gccaggccuuggguuuccccagcacagccuccugucgcugcaugcgacguguugggauuuuugg

SEQ ID NO: 620527 - RNA, 64 nt, hsa
uguuucuagggaaaugaaagaaaggccagcaaauucgcugcaaccuguugauagcaagugaauu

SEQ ID NO: 620528 - RNA, 64 nt, hsa
ucuucuagguugggugggugacguagacgacuacucgcugcacgggggcugccuggucacgcgc

SEQ ID NO: 620529 - RNA, 64 nt, hsa
agacaccaguuaaguggcguucaugggggcucuuucgcugcagccuccaccgugcugaggucag

SEQ ID NO: 620530 - RNA, 64 nt, hsa
uuauauuaugcagagaugugcgugcaaagaauaaucgcugcaguuuuguuuuuaugugugaaac

SEQ ID NO: 620531 - RNA, 64 nt, hsa
ugauguagugaccaagugcaauaugggcgggcagucgcugcagggagcaccacggccagaagua

SEQ ID NO: 620532 - RNA, 64 nt, hsa
gaagagccauggaugcuuuccacaaaaugucaccucgcugcacuaaaggaugaugaauccuaau

SEQ ID NO: 620533 - RNA, 64 nt, hsa
gaaucguggugguuuuauuuuauuuuucuuuuugucgcugcacuuccuguuuaguuccaaggga

SEQ ID NO: 620534 - RNA, 55 nt, hsa
aguauaccagcuccaagugagccucucgcugcaguaacaguuccgccgugaccca

SEQ ID NO: 620535 - RNA, 64 nt, hsa
auuccccaauggacuccagaagaaacuugauucaucgcugcaaaggaaagaacaaccuuaaaac

SEQ ID NO: 620536 - RNA, 64 nt, hsa
uuaggaagguuuuuuuaaacggcuuuuuguaacuucgcugcaggaagcagguuuguuucuuuuu

SEQ ID NO: 620537 - RNA, 64 nt, hsa
acacucuuguguauauuuccaaauuuuuguacagucgcugcacauauuugaaaucauauauuaa

SEQ ID NO: 620538 - RNA, 64 nt, hsa
uuuuguuuugaaaaaauaaacagauuaaccugccucgcugcagugagagcaugggacaaguccg

SEQ ID NO: 620539 - RNA, 64 nt, hsa
cauuugcucgcaguauccuagaaucuuugugcucucgcugcaguucccuuuggguuccauguuu

SEQ ID NO: 620540 - RNA, 64 nt, hsa
gccugaugcaggccggcucccaguggggcaggccucgcugcagaaugcccaguaguacugcggc

SEQ ID NO: 620541 - RNA, 64 nt, hsa
gaugcaaguuucagcaaagggcagucuugucgaaucgcugcagcagcuuucuuucaucuuuaua

SEQ ID NO: 620542 - RNA, 64 nt, hsa
aacaaguaccugacgcgcgcccgcaggguggagaucgcugcaucccugcagcucaacgagaccc

SEQ ID NO: 620543 - RNA, 64 nt, hsa
uggcagagcauucagugccacgguuuaggugaagucgcugcauaugugacugucaugagauccu

SEQ ID NO: 620544 - RNA, 64 nt, hsa
augaugcuugagaugguuuuugcaaaagcagaaaucgcugcaagguaaucacaauagauaaaag

SEQ ID NO: 620545 - RNA, 60 nt, hsa
agugccagaagagacaguagucugcauacaucgcugcaggccacagagcagcuuggguug

SEQ ID NO: 620546 - RNA, 64 nt, hsa
ugaaucccgcuggagagcaaacacgaacuucuguucgcugcaaaaugguuagaaagaaacagcu

SEQ ID NO: 620547 - RNA, 64 nt, hsa
cucccuuucagagccugcuccccgcccucucugcucgcugcauugugguguucucuucucaagg

SEQ ID NO: 620548 - RNA, 64 nt, hsa
ccaccuuugaccccaaggccuggagggcccaaugucgcugcaaacacagccacgaagaacaugc

SEQ ID NO: 620549 - RNA, 64 nt, hsa
acguugcucagguucccccuguggguuccgguccucgcugcacccguggccgcagaggcugcag

SEQ ID NO: 620550 - RNA, 64 nt, hsa
ccccuggcaaacaaauugaagugccaaacagcacucgcugcaggguauuuuuagagucauagcu

SEQ ID NO: 620551 - RNA, 64 nt, hsa
uggcauuucuaggaaaacugugaccugugacaaaucgcugcauuuuuaaugucaagauguguuu

SEQ ID NO: 620552 - RNA, 64 nt, hsa
ccaggcaucucccuaccagccgcccacauuggcuucgcugcagcgcuugcuguggguccgucag

SEQ ID NO: 620553 - RNA, 64 nt, hsa
aaggggucccaaaggccaaggcaguggguggcucucgcugcagcuucaaggcugguggcuggga

SEQ ID NO: 620554 - RNA, 64 nt, hsa
augcucuccgccguguucguguccccaggcgcccucgcugcagccccgcccccgugggucucug

SEQ ID NO: 620555 - RNA, 64 nt, hsa
agaagcaccuggacuucuagggauuccuccuuagucgcugcaugcagaauucuaugacacucua

SEQ ID NO: 620556 - RNA, 64 nt, hsa
uagcacugggcccaaauauucuuuguaaagaaaaucgcugcagcaaaaacuguuacuguguuua

SEQ ID NO: 620557 - RNA, 64 nt, hsa
cgacaugcauuuacucucugccgugggucugcagucgcugcaaccuacccucucucugccucag

SEQ ID NO: 620558 - RNA, 64 nt, hsa
augugccaccccugugggcagcaagaagcugggaucgcugcagccauguuuucccggccaugcc

SEQ ID NO: 620559 - RNA, 64 nt, hsa
gcugaagagggcuggguuuuuuuuucucuuagggucgcugcauaaacuguuguaugccuggugc

SEQ ID NO: 620560 - RNA, 64 nt, hsa
acugaaggaaagaacaucagcugaccaaaugucaucgcugcauuuuauuucacaagaggagugu

SEQ ID NO: 620561 - RNA, 64 nt, hsa
agucccaggugaaccacaccauccugcaguacuaucgcugcauggccagcgagcuuguccgugu

SEQ ID NO: 620562 - RNA, 64 nt, hsa
cgcccaggcuggagugcaauggcacuaucucagcucgcugcaaccuucaccuccuggguucaag

SEQ ID NO: 620563 - RNA, 64 nt, hsa
ugcaggagaaugagcggguggagaaacuggaaugucgcugcauucagcugucuggacaaacaga

SEQ ID NO: 620564 - RNA, 64 nt, hsa
uccaggccauguggcuguucccacggcccaguccucgcugcaguaaccccugggggcucugacc

SEQ ID NO: 620565 - RNA, 64 nt, hsa
aaucccagcacuuugggaggcccaggcagaaggaucgcugcagcccaggaguucgagacuagcc

SEQ ID NO: 620566 - RNA, 64 nt, hsa
agauugagccugcagugagcuaugacgaugccacucgcugcauucaagucuagaugacagagca

SEQ ID NO: 620567 - RNA, 64 nt, hsa
ggagcccgguguucagugguuucccugcccgaggucgcugcagccccaucuaccacaucuucau

SEQ ID NO: 620568 - RNA, 64 nt, hsa
ccagaggccacaccccaggccgggcccccgcccaucgcugcagcugccaugugagucccaggag

SEQ ID NO: 620569 - RNA, 64 nt, hsa
cacaccuguauuugauucucagccaggggagcacucgcugcacuggugggaggcgguugggaaa

SEQ ID NO: 620570 - RNA, 64 nt, hsa
auccugaggugccgccauuggcgguucugcugcuucgcugcagggauaagguggagcuaccgaa

SEQ ID NO: 620571 - RNA, 64 nt, hsa
ucucggagggcugguguucaccaaguuucccuccucgcugcaacccaaugacaccuguauuguu

SEQ ID NO: 620572 - RNA, 64 nt, hsa
caggagcugggccugaggcuuaggagagcugccuucgcugcaggaaaucagggauuaucccuua

SEQ ID NO: 620573 - RNA, 64 nt, hsa
gaaugugacacauuuucaagggcaucucuaucuuucgcugcagaguuguaguucugggcccucg

SEQ ID NO: 620574 - RNA, 64 nt, hsa
cuguccgcccacugcccuugcuguucugggaucuucgcugcaguucacgggaaacaagccugag

SEQ ID NO: 620575 - RNA, 64 nt, hsa
caugggcuugguuuauacgaauugccauuaaacaucgcugcaccagccagccuccggccucugu

SEQ ID NO: 620576 - RNA, 64 nt, hsa
uagucugucgcgggcgcagggacccaacccggugucgcugcacccgcccgagccccgcuccucg

SEQ ID NO: 620577 - RNA, 64 nt, hsa
gcccauaggcaucacucuucagcaccuggucuguucgcugcagggcaugguggacaguaaugcu

SEQ ID NO: 620578 - RNA, 64 nt, hsa
gcugaacacccugcggagcgggugagaucggcuuucgcugcacccagcacugauuccgaccagg

SEQ ID NO: 620579 - RNA, 64 nt, hsa
ugccucccaguucuuccaagugucuaacuagucuucgcugcagcgucagccaaagcuggccccu

SEQ ID NO: 620580 - RNA, 64 nt, hsa
accgccugggccacagcuaggcccucccaccggcucgcugcagagccgggcccagcgcgcccug

SEQ ID NO: 620581 - RNA, 64 nt, hsa
cugugcaagaaaagaacaaggaaaaauggauguuucgcugcaggauuaaguuacaauuaucuuc

SEQ ID NO: 620582 - RNA, 64 nt, hsa
ggggagugagacaggcuggguccugccagcuggaucgcugcacauggccugagcauccagaccu

SEQ ID NO: 620583 - RNA, 64 nt, hsa
ugcauccacaaguuaguagcaaacuggggaauacucgcugcagcugggguucccugcuuuuugg

SEQ ID NO: 620584 - RNA, 64 nt, hsa
aacaucugagaaccuccucggcccucccagucccucgcugcacaaauacuccgcaagagaggcc

SEQ ID NO: 620585 - RNA, 64 nt, hsa
cucagggacugagccccaagacgccucuguaaccucgcugcagcuucaguaguaaacugggucc

SEQ ID NO: 620586 - RNA, 64 nt, hsa
cacccaggcuggagugcaguggcaugaucucaggucgcugcaaccucugccuccaggguucaag

SEQ ID NO: 620587 - RNA, 64 nt, hsa
cguccaggcuggagugcaguggcacaaucucagcucgcugcaaccucugccuccuggguucaag

SEQ ID NO: 620588 - RNA, 64 nt, hsa
cguguaaccagcgggguaaguuaagccaggaccuucgcugcaaaccugguuuuauugcuccuuc

SEQ ID NO: 620589 - RNA, 64 nt, hsa
gcugucccuugcccagggcacuugcauuccagccucgcugcauuugcucucucgauuccccuuu

SEQ ID NO: 620590 - RNA, 64 nt, hsa
caccaagaacagggcccaggggagucaggccuauucgcugcacuuccugccaaacuuugccccc

SEQ ID NO: 620591 - RNA, 64 nt, hsa
gcucuuugaguaucaccgauccacccugcagcccucgcugcaguccuccaugaccuaccucuau

SEQ ID NO: 620592 - RNA, 64 nt, hsa
ugccaggccucugcucugaagagcaaaacugcugucgcugcaguaucugauaccagacauccac

SEQ ID NO: 620593 - RNA, 64 nt, hsa
ggcugcuuccugccuaaagcaggcccuucggggcucgcugcacacacaucucuggcucuccagg

SEQ ID NO: 620594 - RNA, 64 nt, hsa
uuuccuuuaaagaggauuucugucucugggacccucgcugcaccuaccccucccauugcaaagc

SEQ ID NO: 620595 - RNA, 64 nt, hsa
uguuuguuuuguuuuguuuuuuugagacggugucucgcugcaucacccaggcuggagugcagug

SEQ ID NO: 620596 - RNA, 64 nt, hsa; identical to SEQ ID NO: 620523

SEQ ID NO: 620597 - RNA, 64 nt, hsa
gaaccugggagguggagguugcaguaagcugagaucgcugcacuccagccugggcgacaagagc

SEQ ID NO: 620598 - RNA, 64 nt, hsa
cucauguauuauuauuauuuuugagauggaguuuugcucuuaaugauauuauuauuauuugaga

SEQ ID NO: 620599 - RNA, 64 nt, hsa
cuuaaugauauuauuauuauuugagacagaguuuugcucuuauugcccaggcuggagugcagug

SEQ ID NO: 620600 - RNA, 64 nt, hsa
aaauugucugucugcucuuauuuuuguaccauauugcucuuaaaaaucuugguuugguacaguu

SEQ ID NO: 620601 - RNA, 64 nt, hsa
uguugaaugccugucccaguccaaauugucugucugcucuuauuuuuguaccauauugcucuua

SEQ ID NO: 620602 - RNA, 64 nt, hsa
cucuuugccucucaauugucauugauacaugcauugcucuuauucugucuggcauuacaauugc

SEQ ID NO: 620603 - RNA, 64 nt, hsa
ucaugaaaaccugaagaguucacuuuuguuauuaugcucuuaaugauuuacagacugaugccag

SEQ ID NO: 620604 - RNA, 64 nt, hsa
cgaguggauggauagucugcuuguuuuuaguuuuugcucuuaacaaacacugcugcagucagca

SEQ ID NO: 620605 - RNA, 64 nt, hsa
cauaacaaauacucagcaaaugugaaacuuuauuugcucuuacuucaaaauuaguccaaaaugu

SEQ ID NO: 620606 - RNA, 64 nt, hsa
uucuguugaacaccccucuuagggauguuucuuuugcucuuauuuccugcaucuuuccuuaagg

SEQ ID NO: 620607 - RNA, 64 nt, hsa
uggguuucuaugauugaccuugagguuuacuccuugcucuuacaacauuucuaaggauuuuuaa

SEQ ID NO: 620608 - RNA, 64 nt, hsa
gcaaucggcuuaaaauucccuuucuuaaauguugugcucuuauguucucggcuuuuuaaugacu

SEQ ID NO: 620609 - RNA, 64 nt, hsa
ccagaaacugugcauuccagaucuacauacuaaaugcucuuaucauuuugaaaugggcucuuga

SEQ ID NO: 620610 - RNA, 64 nt, hsa
uguuuuuguuauuaaauggaaaaggccugaauuaugcucuuaugugaaguaaauugauauaacc

SEQ ID NO: 620611 - RNA, 64 nt, hsa
ugauuggguuugaaagauuuugaauuauagacagugcucuuaauaguuuuuaauaaguugauau

SEQ ID NO: 620612 - RNA, 64 nt, hsa
uuacaggugugagccaccaugccuggccgugguuugcucuuaauguuuuuaaggaugguuguga

SEQ ID NO: 620613 - RNA, 64 nt, hsa
aaaagaaaucuuaaguagaauucucuaaaagguuugcucuuaauguuuucuuuguuuuguuuug

SEQ ID NO: 620614 - RNA, 64 nt, hsa
uuugggugaggggacccuacucuguuaucccaagugcucuuauucuggugagaagaaccuuacu

SEQ ID NO: 620615 - RNA, 64 nt, hsa
accuccuacuaccaccacacaaacuuaguucauaugcucuuacuugggcaagggugcuuuccuu

SEQ ID NO: 620616 - RNA, 64 nt, hsa; identical to SEQ ID NO: 164072

SEQ ID NO: 620617 - RNA, 64 nt, hsa; identical to SEQ ID NO: 164073

SEQ ID NO: 620618 - RNA, 64 nt, hsa; identical to SEQ ID NO: 164074

SEQ ID NO: 620619 - RNA, 64 nt, hsa; identical to SEQ ID NO: 164075

SEQ ID NO: 620620 - RNA, 64 nt, hsa; identical to SEQ ID NO: 164076

SEQ ID NO: 620621 - RNA, 64 nt, hsa; identical to SEQ ID NO: 164077

SEQ ID NO: 620622 - RNA, 64 nt, hsa; identical to SEQ ID NO: 164078

SEQ ID NO: 620623 - RNA, 64 nt, hsa; identical to SEQ ID NO: 164079

SEQ ID NO: 620624 - RNA, 64 nt, hsa; identical to SEQ ID NO: 164080

SEQ ID NO: 620625 - RNA, 64 nt, hsa; identical to SEQ ID NO: 164081

SEQ ID NO: 620626 - RNA, 64 nt, hsa; identical to SEQ ID NO: 164082

SEQ ID NO: 620627 - RNA, 64 nt, hsa; identical to SEQ ID NO: 164083

SEQ ID NO: 620628 - RNA, 64 nt, hsa; identical to SEQ ID NO: 164084

SEQ ID NO: 620629 - RNA, 64 nt, hsa; identical to SEQ ID NO: 164085

SEQ ID NO: 620630 - RNA, 64 nt, hsa; identical to SEQ ID NO: 164080

SEQ ID NO: 620631 - RNA, 64 nt, hsa; identical to SEQ ID NO: 164081

SEQ ID NO: 620632 - RNA, 64 nt, hsa; identical to SEQ ID NO: 164088

SEQ ID NO: 620633 - RNA, 64 nt, hsa; identical to SEQ ID NO: 164089

SEQ ID NO: 620634 - RNA, 64 nt, hsa; identical to SEQ ID NO: 164090

SEQ ID NO: 620635 - RNA, 64 nt, hsa; identical to SEQ ID NO: 164091

SEQ ID NO: 620636 - RNA, 64 nt, hsa; identical to SEQ ID NO: 164092

SEQ ID NO: 620637 - RNA, 64 nt, hsa; identical to SEQ ID NO: 164093

SEQ ID NO: 620638 - RNA, 64 nt, hsa; identical to SEQ ID NO: 164094

SEQ ID NO: 620639 - RNA, 64 nt, hsa; identical to SEQ ID NO: 164095

SEQ ID NO: 620640 - RNA, 64 nt, hsa; identical to SEQ ID NO: 164096

SEQ ID NO: 620641 - RNA, 64 nt, hsa; identical to SEQ ID NO: 164097

SEQ ID NO: 620642 - RNA, 64 nt, hsa; identical to SEQ ID NO: 164098

SEQ ID NO: 620643 - RNA, 64 nt, hsa; identical to SEQ ID NO: 164099

SEQ ID NO: 620644 - RNA, 64 nt, hsa; identical to SEQ ID NO: 164100

SEQ ID NO: 620645 - RNA, 64 nt, hsa; identical to SEQ ID NO: 164101

SEQ ID NO: 620646 - RNA, 64 nt, hsa; identical to SEQ ID NO: 247936

SEQ ID NO: 620647 - RNA, 64 nt, hsa; identical to SEQ ID NO: 247937

SEQ ID NO: 620648 - RNA, 64 nt, hsa; identical to SEQ ID NO: 247938

SEQ ID NO: 620649 - RNA, 64 nt, hsa; identical to SEQ ID NO: 247939

SEQ ID NO: 620650 - RNA, 64 nt, hsa; identical to SEQ ID NO: 247940

SEQ ID NO: 620651 - RNA, 64 nt, hsa; identical to SEQ ID NO: 247941

SEQ ID NO: 620652 - RNA, 64 nt, hsa; identical to SEQ ID NO: 247942

SEQ ID NO: 620653 - RNA, 64 nt, hsa; identical to SEQ ID NO: 247943

SEQ ID NO: 620654 - RNA, 64 nt, hsa; identical to SEQ ID NO: 247944

SEQ ID NO: 620655 - RNA, 64 nt, hsa; identical to SEQ ID NO: 247945

SEQ ID NO: 620656 - RNA, 64 nt, hsa; identical to SEQ ID NO: 247946

SEQ ID NO: 620657 - RNA, 64 nt, hsa; identical to SEQ ID NO: 247947

SEQ ID NO: 620658 - RNA, 64 nt, hsa; identical to SEQ ID NO: 247948

SEQ ID NO: 620659 - RNA, 64 nt, hsa; identical to SEQ ID NO: 247949

SEQ ID NO: 620660 - RNA, 64 nt, hsa; identical to SEQ ID NO: 247950

SEQ ID NO: 620661 - RNA, 64 nt, hsa; identical to SEQ ID NO: 247951

SEQ ID NO: 620662 - RNA, 64 nt, hsa; identical to SEQ ID NO: 247952

SEQ ID NO: 620663 - RNA, 64 nt, hsa; identical to SEQ ID NO: 247953

SEQ ID NO: 620664 - RNA, 64 nt, hsa; identical to SEQ ID NO: 247954

SEQ ID NO: 620665 - RNA, 64 nt, hsa; identical to SEQ ID NO: 247955

SEQ ID NO: 620666 - RNA, 64 nt, hsa; identical to SEQ ID NO: 247956

SEQ ID NO: 620667 - RNA, 64 nt, hsa; identical to SEQ ID NO: 247957

SEQ ID NO: 620668 - RNA, 64 nt, hsa; identical to SEQ ID NO: 247958

SEQ ID NO: 620669 - RNA, 64 nt, hsa; identical to SEQ ID NO: 247959

SEQ ID NO: 620670 - RNA, 64 nt, hsa; identical to SEQ ID NO: 247960

SEQ ID NO: 620671 - RNA, 64 nt, hsa; identical to SEQ ID NO: 247961

SEQ ID NO: 620672 - RNA, 64 nt, hsa; identical to SEQ ID NO: 247962

SEQ ID NO: 620673 - RNA, 64 nt, hsa; identical to SEQ ID NO: 247963

SEQ ID NO: 620674 - RNA, 64 nt, hsa; identical to SEQ ID NO: 247964

SEQ ID NO: 620675 - RNA, 64 nt, hsa; identical to SEQ ID NO: 247965

SEQ ID NO: 620676 - RNA, 64 nt, hsa; identical to SEQ ID NO: 247966

SEQ ID NO: 620677 - RNA, 64 nt, hsa; identical to SEQ ID NO: 247967

SEQ ID NO: 620678 - RNA, 64 nt, hsa; identical to SEQ ID NO: 247968

SEQ ID NO: 620679 - RNA, 64 nt, hsa; identical to SEQ ID NO: 247969

SEQ ID NO: 620680 - RNA, 64 nt, hsa; identical to SEQ ID NO: 247970

SEQ ID NO: 620681 - RNA, 64 nt, hsa; identical to SEQ ID NO: 247971

SEQ ID NO: 620682 - RNA, 64 nt, hsa; identical to SEQ ID NO: 247972

SEQ ID NO: 620683 - RNA, 64 nt, hsa; identical to SEQ ID NO: 247973

SEQ ID NO: 620684 - RNA, 64 nt, hsa; identical to SEQ ID NO: 247974

SEQ ID NO: 620685 - RNA, 64 nt, hsa; identical to SEQ ID NO: 247975

SEQ ID NO: 620686 - RNA, 64 nt, hsa; identical to SEQ ID NO: 247976

SEQ ID NO: 620687 - RNA, 64 nt, hsa; identical to SEQ ID NO: 247977

SEQ ID NO: 620688 - RNA, 64 nt, hsa; identical to SEQ ID NO: 247978

SEQ ID NO: 620689 - RNA, 64 nt, hsa; identical to SEQ ID NO: 365331

SEQ ID NO: 620690 - RNA, 64 nt, hsa; identical to SEQ ID NO: 365332

SEQ ID NO: 620691 - RNA, 64 nt, hsa; identical to SEQ ID NO: 365333

SEQ ID NO: 620692 - RNA, 64 nt, hsa; identical to SEQ ID NO: 365334

SEQ ID NO: 620693 - RNA, 64 nt, hsa; identical to SEQ ID NO: 365335

SEQ ID NO: 620694 - RNA, 64 nt, hsa; identical to SEQ ID NO: 365336

SEQ ID NO: 620695 - RNA, 64 nt, hsa; identical to SEQ ID NO: 365337

SEQ ID NO: 620696 - RNA, 64 nt, hsa; identical to SEQ ID NO: 365338

SEQ ID NO: 620697 - RNA, 64 nt, hsa; identical to SEQ ID NO: 365339

SEQ ID NO: 620698 - RNA, 64 nt, hsa; identical to SEQ ID NO: 365340

SEQ ID NO: 620699 - RNA, 64 nt, hsa; identical to SEQ ID NO: 365341

SEQ ID NO: 620700 - RNA, 64 nt, hsa; identical to SEQ ID NO: 365342

SEQ ID NO: 620701 - RNA, 64 nt, hsa; identical to SEQ ID NO: 365343

SEQ ID NO: 620702 - RNA, 64 nt, hsa; identical to SEQ ID NO: 365344

SEQ ID NO: 620703 - RNA, 64 nt, hsa; identical to SEQ ID NO: 365345

SEQ ID NO: 620704 - RNA, 64 nt, hsa; identical to SEQ ID NO: 365346

SEQ ID NO: 620705 - RNA, 64 nt, hsa; identical to SEQ ID NO: 365347

SEQ ID NO: 620706 - RNA, 64 nt, hsa; identical to SEQ ID NO: 365348

SEQ ID NO: 620707 - RNA, 64 nt, hsa; identical to SEQ ID NO: 365349

SEQ ID NO: 620708 - RNA, 64 nt, hsa; identical to SEQ ID NO: 365350

SEQ ID NO: 620709 - RNA, 64 nt, hsa; identical to SEQ ID NO: 365351

SEQ ID NO: 620710 - RNA, 64 nt, hsa; identical to SEQ ID NO: 365352

SEQ ID NO: 620711 - RNA, 64 nt, hsa; identical to SEQ ID NO: 365353

SEQ ID NO: 620712 - RNA, 64 nt, hsa; identical to SEQ ID NO: 365354

SEQ ID NO: 620713 - RNA, 64 nt, hsa; identical to SEQ ID NO: 365355

SEQ ID NO: 620714 - RNA, 64 nt, hsa; identical to SEQ ID NO: 365356

SEQ ID NO: 620715 - RNA, 64 nt, hsa; identical to SEQ ID NO: 365357

SEQ ID NO: 620716 - RNA, 64 nt, hsa; identical to SEQ ID NO: 365358

SEQ ID NO: 620717 - RNA, 64 nt, hsa; identical to SEQ ID NO: 365359

SEQ ID NO: 620718 - RNA, 64 nt, hsa; identical to SEQ ID NO: 365360

SEQ ID NO: 620719 - RNA, 64 nt, hsa; identical to SEQ ID NO: 365361

SEQ ID NO: 620720 - RNA, 63 nt, hsa; identical to SEQ ID NO: 365362

SEQ ID NO: 620721 - RNA, 64 nt, hsa; identical to SEQ ID NO: 365363

SEQ ID NO: 620722 - RNA, 64 nt, hsa; identical to SEQ ID NO: 365364

SEQ ID NO: 620723 - RNA, 64 nt, hsa; identical to SEQ ID NO: 365365

SEQ ID NO: 620724 - RNA, 64 nt, hsa; identical to SEQ ID NO: 365366

SEQ ID NO: 620725 - RNA, 64 nt, hsa; identical to SEQ ID NO: 365367

SEQ ID NO: 620726 - RNA, 64 nt, hsa; identical to SEQ ID NO: 365368

SEQ ID NO: 620727 - RNA, 64 nt, hsa; identical to SEQ ID NO: 365369

SEQ ID NO: 620728 - RNA, 64 nt, hsa; identical to SEQ ID NO: 365370

SEQ ID NO: 620729 - RNA, 64 nt, hsa; identical to SEQ ID NO: 365371

SEQ ID NO: 620730 - RNA, 64 nt, hsa; identical to SEQ ID NO: 365372

SEQ ID NO: 620731 - RNA, 64 nt, hsa; identical to SEQ ID NO: 365373

SEQ ID NO: 620732 - RNA, 64 nt, hsa; identical to SEQ ID NO: 365374

SEQ ID NO: 620733 - RNA, 64 nt, hsa; identical to SEQ ID NO: 365375

SEQ ID NO: 620734 - RNA, 64 nt, hsa; identical to SEQ ID NO: 365376

SEQ ID NO: 620735 - RNA, 64 nt, hsa; identical to SEQ ID NO: 365377

SEQ ID NO: 620736 - RNA, 64 nt, hsa; identical to SEQ ID NO: 365378

SEQ ID NO: 620737 - RNA, 64 nt, hsa; identical to SEQ ID NO: 365379

SEQ ID NO: 620738 - RNA, 64 nt, hsa; identical to SEQ ID NO: 365380

SEQ ID NO: 620739 - RNA, 64 nt, hsa; identical to SEQ ID NO: 365381

SEQ ID NO: 620740 - RNA, 64 nt, hsa; identical to SEQ ID NO: 365382

SEQ ID NO: 620741 - RNA, 64 nt, hsa; identical to SEQ ID NO: 365383

SEQ ID NO: 620742 - RNA, 64 nt, hsa; identical to SEQ ID NO: 365384

SEQ ID NO: 620743 - RNA, 64 nt, hsa; identical to SEQ ID NO: 365385

SEQ ID NO: 620744 - RNA, 64 nt, hsa; identical to SEQ ID NO: 365386

SEQ ID NO: 620745 - RNA, 64 nt, hsa; identical to SEQ ID NO: 365387

SEQ ID NO: 620746 - RNA, 64 nt, hsa; identical to SEQ ID NO: 365388

SEQ ID NO: 620747 - RNA, 64 nt, hsa; identical to SEQ ID NO: 365389

SEQ ID NO: 620748 - RNA, 64 nt, hsa; identical to SEQ ID NO: 365390

SEQ ID NO: 620749 - RNA, 64 nt, hsa; identical to SEQ ID NO: 365391

SEQ ID NO: 620750 - RNA, 64 nt, hsa; identical to SEQ ID NO: 365392

SEQ ID NO: 620751 - RNA, 64 nt, hsa; identical to SEQ ID NO: 365393

SEQ ID NO: 620752 - RNA, 64 nt, hsa; identical to SEQ ID NO: 365394

SEQ ID NO: 620753 - RNA, 64 nt, hsa; identical to SEQ ID NO: 365395

SEQ ID NO: 620754 - RNA, 64 nt, hsa; identical to SEQ ID NO: 365396

SEQ ID NO: 620755 - RNA, 64 nt, hsa; identical to SEQ ID NO: 365397

SEQ ID NO: 620756 - RNA, 64 nt, hsa; identical to SEQ ID NO: 365398

SEQ ID NO: 620757 - RNA, 64 nt, hsa; identical to SEQ ID NO: 365399

SEQ ID NO: 620758 - RNA, 64 nt, hsa; identical to SEQ ID NO: 365400

SEQ ID NO: 620759 - RNA, 64 nt, hsa; identical to SEQ ID NO: 365401

SEQ ID NO: 620760 - RNA, 64 nt, hsa; identical to SEQ ID NO: 365402

SEQ ID NO: 620761 - RNA, 64 nt, hsa; identical to SEQ ID NO: 365403

SEQ ID NO: 620762 - RNA, 64 nt, hsa; identical to SEQ ID NO: 365404

SEQ ID NO: 620763 - RNA, 64 nt, hsa; identical to SEQ ID NO: 365405

SEQ ID NO: 620764 - RNA, 64 nt, hsa; identical to SEQ ID NO: 365406

SEQ ID NO: 620765 - RNA, 64 nt, hsa; identical to SEQ ID NO: 365407

SEQ ID NO: 620766 - RNA, 64 nt, hsa; identical to SEQ ID NO: 365408

SEQ ID NO: 620767 - RNA, 64 nt, hsa; identical to SEQ ID NO: 365409

SEQ ID NO: 620768 - RNA, 64 nt, hsa; identical to SEQ ID NO: 365410

SEQ ID NO: 620769 - RNA, 64 nt, hsa; identical to SEQ ID NO: 365411

SEQ ID NO: 620770 - RNA, 64 nt, hsa; identical to SEQ ID NO: 365412

SEQ ID NO: 620771 - RNA, 64 nt, hsa; identical to SEQ ID NO: 365413

SEQ ID NO: 620772 - RNA, 64 nt, hsa; identical to SEQ ID NO: 365414

SEQ ID NO: 620773 - RNA, 64 nt, hsa; identical to SEQ ID NO: 365415

SEQ ID NO: 620774 - RNA, 64 nt, hsa; identical to SEQ ID NO: 365416

SEQ ID NO: 620775 - RNA, 64 nt, hsa; identical to SEQ ID NO: 365417

SEQ ID NO: 620776 - RNA, 64 nt, hsa; identical to SEQ ID NO: 365418

SEQ ID NO: 620777 - RNA, 63 nt, hsa
cccagaugcgcuuuaauuuuuuuuaauauguuuugaucacagaacuucuagaauaacccagau

SEQ ID NO: 620778 - RNA, 63 nt, hsa
ccagaugcucuuucauauucuuuuaauacaucuugaucacagcugggggaaaaaaagcuuuuu

SEQ ID NO: 620779 - RNA, 63 nt, hsa
ggccccucagagccaggugcuggccagaugccuugaucacagccuccauggccaggggccugu

SEQ ID NO: 620780 - RNA, 63 nt, hsa
guggcucuggggccaaccgaccacaggugucacugaucacaggugucaccguaguggcuacca

SEQ ID NO: 620781 - RNA, 63 nt, hsa
auaccugaaggcuggucgacuuuuuaaaaaacaugaucacacuguauaagcuacuuagaacuu

SEQ ID NO: 620782 - RNA, 63 nt, hsa
cccccaucaaaaugccacugguaccugagguauugaucacagcagccgaagcaccagugccca

SEQ ID NO: 620783 - RNA, 63 nt, hsa
augcuggaaagagcaaaagaauaucauuggcccugaucacauagaugcugcgccgccuagcaa

SEQ ID NO: 620784 - RNA, 63 nt, hsa
aucaaaaugcagaaaauguguggugcacuaagaugaucacacagcauuaaaacuaaaaaaaaa

SEQ ID NO: 620785 - RNA, 63 nt, hsa
ucauuuacauaacagugauaaaagcuuuaaguuugaucacauccaauuaaucacauuuuuuaa

SEQ ID NO: 620786 - RNA, 63 nt, hsa
uugaguccaggaguucaaggcugcagugaguugugaucacaccauugcaguccagccagguug

SEQ ID NO: 620787 - RNA, 63 nt, hsa; identical to SEQ ID NO: 450730

SEQ ID NO: 620788 - RNA, 63 nt, hsa; identical to SEQ ID NO: 450731

SEQ ID NO: 620789 - RNA, 63 nt, hsa; identical to SEQ ID NO: 450732

SEQ ID NO: 620790 - RNA, 63 nt, hsa; identical to SEQ ID NO: 450733

SEQ ID NO: 620791 - RNA, 63 nt, hsa; identical to SEQ ID NO: 450734

SEQ ID NO: 620792 - RNA, 63 nt, hsa; identical to SEQ ID NO: 450735

SEQ ID NO: 620793 - RNA, 63 nt, hsa; identical to SEQ ID NO: 450736

SEQ ID NO: 620794 - RNA, 63 nt, hsa; identical to SEQ ID NO: 450737

SEQ ID NO: 620795 - RNA, 63 nt, hsa; identical to SEQ ID NO: 450738

SEQ ID NO: 620796 - RNA, 63 nt, hsa; identical to SEQ ID NO: 450739

SEQ ID NO: 620797 - RNA, 63 nt, hsa; identical to SEQ ID NO: 450740

SEQ ID NO: 620798 - RNA, 63 nt, hsa; identical to SEQ ID NO: 450741

SEQ ID NO: 620799 - RNA, 63 nt, hsa; identical to SEQ ID NO: 450742

SEQ ID NO: 620800 - RNA, 63 nt, hsa; identical to SEQ ID NO: 450743

SEQ ID NO: 620801 - RNA, 63 nt, hsa; identical to SEQ ID NO: 450744

SEQ ID NO: 620802 - RNA, 63 nt, hsa; identical to SEQ ID NO: 450745

SEQ ID NO: 620803 - RNA, 63 nt, hsa; identical to SEQ ID NO: 450746

SEQ ID NO: 620804 - RNA, 63 nt, hsa; identical to SEQ ID NO: 450747

SEQ ID NO: 620805 - RNA, 63 nt, hsa; identical to SEQ ID NO: 450748

SEQ ID NO: 620806 - RNA, 63 nt, hsa; identical to SEQ ID NO: 450749

SEQ ID NO: 620807 - RNA, 63 nt, hsa; identical to SEQ ID NO: 450750

SEQ ID NO: 620808 - RNA, 63 nt, hsa; identical to SEQ ID NO: 450751

SEQ ID NO: 620809 - RNA, 63 nt, hsa; identical to SEQ ID NO: 450752

SEQ ID NO: 620810 - RNA, 63 nt, hsa; identical to SEQ ID NO: 450753

SEQ ID NO: 620811 - RNA, 63 nt, hsa; identical to SEQ ID NO: 450754

SEQ ID NO: 620812 - RNA, 63 nt, hsa; identical to SEQ ID NO: 450755

SEQ ID NO: 620813 - RNA, 63 nt, hsa; identical to SEQ ID NO: 450756

SEQ ID NO: 620814 - RNA, 63 nt, hsa; identical to SEQ ID NO: 450757

SEQ ID NO: 620815 - RNA, 63 nt, hsa; identical to SEQ ID NO: 450758

SEQ ID NO: 620816 - RNA, 63 nt, hsa; identical to SEQ ID NO: 450759

SEQ ID NO: 620817 - RNA, 63 nt, hsa; identical to SEQ ID NO: 450760

SEQ ID NO: 620818 - RNA, 63 nt, hsa; identical to SEQ ID NO: 450761

SEQ ID NO: 620819 - RNA, 63 nt, hsa; identical to SEQ ID NO: 450762

SEQ ID NO: 620820 - RNA, 63 nt, hsa; identical to SEQ ID NO: 450763

SEQ ID NO: 620821 - RNA, 63 nt, hsa; identical to SEQ ID NO: 450764

SEQ ID NO: 620822 - RNA, 63 nt, hsa; identical to SEQ ID NO: 450765

SEQ ID NO: 620823 - RNA, 63 nt, hsa; identical to SEQ ID NO: 450766

SEQ ID NO: 620824 - RNA, 63 nt, hsa; identical to SEQ ID NO: 450765

SEQ ID NO: 620825 - RNA, 63 nt, hsa; identical to SEQ ID NO: 450766

SEQ ID NO: 620826 - RNA, 63 nt, hsa; identical to SEQ ID NO: 450769

SEQ ID NO: 620827 - RNA, 63 nt, hsa; identical to SEQ ID NO: 450770

SEQ ID NO: 620828 - RNA, 63 nt, hsa; identical to SEQ ID NO: 450771

SEQ ID NO: 620829 - RNA, 63 nt, hsa; identical to SEQ ID NO: 450772

SEQ ID NO: 620830 - RNA, 63 nt, hsa; identical to SEQ ID NO: 450773

SEQ ID NO: 620831 - RNA, 63 nt, hsa; identical to SEQ ID NO: 450774

SEQ ID NO: 620832 - RNA, 63 nt, hsa; identical to SEQ ID NO: 450775

SEQ ID NO: 620833 - RNA, 63 nt, hsa; identical to SEQ ID NO: 450776

SEQ ID NO: 620834 - RNA, 63 nt, hsa; identical to SEQ ID NO: 450777

SEQ ID NO: 620835 - RNA, 63 nt, hsa; identical to SEQ ID NO: 450778

SEQ ID NO: 620836 - RNA, 63 nt, hsa; identical to SEQ ID NO: 450779

SEQ ID NO: 620837 - RNA, 63 nt, hsa; identical to SEQ ID NO: 450780

SEQ ID NO: 620838 - RNA, 63 nt, hsa; identical to SEQ ID NO: 450781

SEQ ID NO: 620839 - RNA, 63 nt, hsa; identical to SEQ ID NO: 450782

SEQ ID NO: 620840 - RNA, 63 nt, hsa; identical to SEQ ID NO: 450783

SEQ ID NO: 620841 - RNA, 63 nt, hsa; identical to SEQ ID NO: 450784

SEQ ID NO: 620842 - RNA, 63 nt, hsa; identical to SEQ ID NO: 450785

SEQ ID NO: 620843 - RNA, 63 nt, hsa; identical to SEQ ID NO: 450786

SEQ ID NO: 620844 - RNA, 63 nt, hsa; identical to SEQ ID NO: 450787

SEQ ID NO: 620845 - RNA, 63 nt, hsa; identical to SEQ ID NO: 450788

SEQ ID NO: 620846 - RNA, 63 nt, hsa; identical to SEQ ID NO: 450789

SEQ ID NO: 620847 - RNA, 63 nt, hsa; identical to SEQ ID NO: 450790

SEQ ID NO: 620848 - RNA, 63 nt, hsa; identical to SEQ ID NO: 450791

SEQ ID NO: 620849 - RNA, 63 nt, hsa; identical to SEQ ID NO: 450792

SEQ ID NO: 620850 - RNA, 63 nt, hsa; identical to SEQ ID NO: 450793

SEQ ID NO: 620851 - RNA, 63 nt, hsa; identical to SEQ ID NO: 450794

SEQ ID NO: 620852 - RNA, 63 nt, hsa; identical to SEQ ID NO: 450795

SEQ ID NO: 620853 - RNA, 63 nt, hsa; identical to SEQ ID NO: 450796

SEQ ID NO: 620854 - RNA, 63 nt, hsa; identical to SEQ ID NO: 450797

SEQ ID NO: 620855 - RNA, 63 nt, hsa; identical to SEQ ID NO: 450798

SEQ ID NO: 620856 - RNA, 63 nt, hsa; identical to SEQ ID NO: 450799

SEQ ID NO: 620857 - RNA, 63 nt, hsa; identical to SEQ ID NO: 450800

SEQ ID NO: 620858 - RNA, 63 nt, hsa; identical to SEQ ID NO: 450801

SEQ ID NO: 620859 - RNA, 63 nt, hsa; identical to SEQ ID NO: 450802

SEQ ID NO: 620860 - RNA, 63 nt, hsa; identical to SEQ ID NO: 450803

SEQ ID NO: 620861 - RNA, 63 nt, hsa; identical to SEQ ID NO: 450804

SEQ ID NO: 620862 - RNA, 63 nt, hsa; identical to SEQ ID NO: 450805

SEQ ID NO: 620863 - RNA, 63 nt, hsa; identical to SEQ ID NO: 450806

SEQ ID NO: 620864 - RNA, 63 nt, hsa; identical to SEQ ID NO: 450807

SEQ ID NO: 620865 - RNA, 63 nt, hsa; identical to SEQ ID NO: 450808

SEQ ID NO: 620866 - RNA, 63 nt, hsa; identical to SEQ ID NO: 450809

SEQ ID NO: 620867 - RNA, 63 nt, hsa; identical to SEQ ID NO: 450810

SEQ ID NO: 620868 - RNA, 63 nt, hsa; identical to SEQ ID NO: 450811

SEQ ID NO: 620869 - RNA, 63 nt, hsa; identical to SEQ ID NO: 450812

SEQ ID NO: 620870 - RNA, 63 nt, hsa; identical to SEQ ID NO: 450813

SEQ ID NO: 620871 - RNA, 63 nt, hsa; identical to SEQ ID NO: 450814

SEQ ID NO: 620872 - RNA, 63 nt, hsa; identical to SEQ ID NO: 450815

SEQ ID NO: 620873 - RNA, 63 nt, hsa; identical to SEQ ID NO: 450816

SEQ ID NO: 620874 - RNA, 63 nt, hsa; identical to SEQ ID NO: 450817

SEQ ID NO: 620875 - RNA, 63 nt, hsa; identical to SEQ ID NO: 450818

SEQ ID NO: 620876 - RNA, 63 nt, hsa; identical to SEQ ID NO: 450819

SEQ ID NO: 620877 - RNA, 63 nt, hsa; identical to SEQ ID NO: 450820

SEQ ID NO: 620878 - RNA, 63 nt, hsa; identical to SEQ ID NO: 450821

SEQ ID NO: 620879 - RNA, 63 nt, hsa; identical to SEQ ID NO: 450822

SEQ ID NO: 620880 - RNA, 63 nt, hsa; identical to SEQ ID NO: 450823

SEQ ID NO: 620881 - RNA, 63 nt, hsa; identical to SEQ ID NO: 450824

SEQ ID NO: 620882 - RNA, 63 nt, hsa; identical to SEQ ID NO: 450825

SEQ ID NO: 620883 - RNA, 63 nt, hsa; identical to SEQ ID NO: 450826

SEQ ID NO: 620884 - RNA, 63 nt, hsa; identical to SEQ ID NO: 450827

SEQ ID NO: 620885 - RNA, 63 nt, hsa; identical to SEQ ID NO: 450828

SEQ ID NO: 620886 - RNA, 63 nt, hsa; identical to SEQ ID NO: 450829

SEQ ID NO: 620887 - RNA, 63 nt, hsa; identical to SEQ ID NO: 450830

SEQ ID NO: 620888 - RNA, 63 nt, hsa; identical to SEQ ID NO: 450831

SEQ ID NO: 620889 - RNA, 63 nt, hsa; identical to SEQ ID NO: 450832

SEQ ID NO: 620890 - RNA, 63 nt, hsa; identical to SEQ ID NO: 450833

SEQ ID NO: 620891 - RNA, 63 nt, hsa; identical to SEQ ID NO: 450834

SEQ ID NO: 620892 - RNA, 63 nt, hsa; identical to SEQ ID NO: 450835

SEQ ID NO: 620893 - RNA, 63 nt, hsa; identical to SEQ ID NO: 450836

SEQ ID NO: 620894 - RNA, 63 nt, hsa; identical to SEQ ID NO: 450837

SEQ ID NO: 620895 - RNA, 63 nt, hsa; identical to SEQ ID NO: 450838

SEQ ID NO: 620896 - RNA, 63 nt, hsa; identical to SEQ ID NO: 450839

SEQ ID NO: 620897 - RNA, 63 nt, hsa; identical to SEQ ID NO: 450840

SEQ ID NO: 620898 - RNA, 63 nt, hsa; identical to SEQ ID NO: 450841

SEQ ID NO: 620899 - RNA, 63 nt, hsa; identical to SEQ ID NO: 450842

SEQ ID NO: 620900 - RNA, 63 nt, hsa; identical to SEQ ID NO: 450843

SEQ ID NO: 620901 - RNA, 63 nt, hsa; identical to SEQ ID NO: 450844

SEQ ID NO: 620902 - RNA, 63 nt, hsa; identical to SEQ ID NO: 450845

SEQ ID NO: 620903 - RNA, 63 nt, hsa; identical to SEQ ID NO: 450846

SEQ ID NO: 620904 - RNA, 63 nt, hsa; identical to SEQ ID NO: 450847

SEQ ID NO: 620905 - RNA, 63 nt, hsa; identical to SEQ ID NO: 450848

SEQ ID NO: 620906 - RNA, 63 nt, hsa; identical to SEQ ID NO: 450849

SEQ ID NO: 620907 - RNA, 63 nt, hsa; identical to SEQ ID NO: 450850

SEQ ID NO: 620908 - RNA, 63 nt, hsa; identical to SEQ ID NO: 450851

SEQ ID NO: 620909 - RNA, 63 nt, hsa; identical to SEQ ID NO: 450852

SEQ ID NO: 620910 - RNA, 51 nt, hsa; identical to SEQ ID NO: 250138

SEQ ID NO: 620911 - RNA, 63 nt, hsa; identical to SEQ ID NO: 450854

SEQ ID NO: 620912 - RNA, 63 nt, hsa; identical to SEQ ID NO: 450855

SEQ ID NO: 620913 - RNA, 63 nt, hsa; identical to SEQ ID NO: 450856

SEQ ID NO: 620914 - RNA, 63 nt, hsa; identical to SEQ ID NO: 450857

SEQ ID NO: 620915 - RNA, 63 nt, hsa; identical to SEQ ID NO: 450858

SEQ ID NO: 620916 - RNA, 63 nt, hsa; identical to SEQ ID NO: 450859

SEQ ID NO: 620917 - RNA, 63 nt, hsa; identical to SEQ ID NO: 450860

SEQ ID NO: 620918 - RNA, 63 nt, hsa; identical to SEQ ID NO: 450861

SEQ ID NO: 620919 - RNA, 63 nt, hsa; identical to SEQ ID NO: 450862

SEQ ID NO: 620920 - RNA, 63 nt, hsa; identical to SEQ ID NO: 450863

SEQ ID NO: 620921 - RNA, 63 nt, hsa; identical to SEQ ID NO: 450864

SEQ ID NO: 620922 - RNA, 63 nt, hsa; identical to SEQ ID NO: 450865

SEQ ID NO: 620923 - RNA, 63 nt, hsa; identical to SEQ ID NO: 450866

SEQ ID NO: 620924 - RNA, 64 nt, hsa; identical to SEQ ID NO: 126265

SEQ ID NO: 620925 - RNA, 64 nt, hsa; identical to SEQ ID NO: 126266

SEQ ID NO: 620926 - RNA, 64 nt, hsa; identical to SEQ ID NO: 126267

SEQ ID NO: 620927 - RNA, 64 nt, hsa; identical to SEQ ID NO: 126268

SEQ ID NO: 620928 - RNA, 64 nt, hsa; identical to SEQ ID NO: 126269

SEQ ID NO: 620929 - RNA, 64 nt, hsa; identical to SEQ ID NO: 126270

SEQ ID NO: 620930 - RNA, 64 nt, hsa; identical to SEQ ID NO: 126271

SEQ ID NO: 620931 - RNA, 64 nt, hsa; identical to SEQ ID NO: 126272

SEQ ID NO: 620932 - RNA, 64 nt, hsa; identical to SEQ ID NO: 126273

SEQ ID NO: 620933 - RNA, 64 nt, hsa; identical to SEQ ID NO: 126274

SEQ ID NO: 620934 - RNA, 64 nt, hsa; identical to SEQ ID NO: 126275

SEQ ID NO: 620935 - RNA, 64 nt, hsa; identical to SEQ ID NO: 126276

SEQ ID NO: 620936 - RNA, 64 nt, hsa; identical to SEQ ID NO: 126277

SEQ ID NO: 620937 - RNA, 64 nt, hsa; identical to SEQ ID NO: 126278

SEQ ID NO: 620938 - RNA, 64 nt, hsa; identical to SEQ ID NO: 126279

SEQ ID NO: 620939 - RNA, 64 nt, hsa; identical to SEQ ID NO: 126280

SEQ ID NO: 620940 - RNA, 63 nt, hsa
cgugugcuagaagguucgaugccucuggaaugcaugugauacucaucuccauuuuguuuccuu

SEQ ID NO: 620941 - RNA, 63 nt, hsa
aggacggugggaagccugagagagagugaaauuaugugauacacugaaaugacuuuuguuuuu

SEQ ID NO: 620942 - RNA, 63 nt, hsa
ugugagaguugagcucauuuucuaguuggaagaaugugauauuuguuguguugguaguuuacc

SEQ ID NO: 620943 - RNA, 63 nt, hsa
uauuuuuguuacguacuguuucuuugauaauugaugugauaaggaaaaaaguccuauuuuuau

SEQ ID NO: 620944 - RNA, 63 nt, hsa
uuaagaaagugaacaguugcaacuauuuugcuuaugugauagauguuuugaaaaauguaguug

SEQ ID NO: 620945 - RNA, 63 nt, hsa
cuugaguccagaaguuugagaucagccugggcaaugugauaaaaccccaucucuacaaaaagc

SEQ ID NO: 620946 - RNA, 51 nt, hsa
aaaguacacaaguggaauaaaaugugauacaacauauacucacuauggaau

SEQ ID NO: 620947 - RNA, 63 nt, hsa
auucucaaauaugaaaugggaccuaauaccaguaugugauaaauguugauguuuucuguguac

SEQ ID NO: 620948 - RNA, 63 nt, hsa
acuuagcacaugugugcuugaggguggcugggaaugugauauacagcacccugauccuaacag

SEQ ID NO: 620949 - RNA, 63 nt, hsa
ugucuugucuccacucugugaaacccacaggggaugugauaaacagggcuauuagggguauca

SEQ ID NO: 620950 - RNA, 63 nt, hsa
ccaagaaagagcuuuaguuucuuggcaagaauaaugugauauuaguaaguaaaggucuuaaaa

SEQ ID NO: 620951 - RNA, 63 nt, hsa
aaauaugaaggagagguuggggacacgcacccuaugugauaccaaguuuuauugucaagacag

SEQ ID NO: 620952 - RNA, 63 nt, hsa
guuaucuuuuuuauuguguuguguuaugccuacaugugauauaaauuaauauuuauauucauu

SEQ ID NO: 620953 - RNA, 63 nt, hsa
gagagcuuagccccuggaggcagcacaaggaggaugugauaugugggggagugagcacugggu

SEQ ID NO: 620954 - RNA, 50 nt, hsa
acaaaaaaccccgauuuuagaugugauauuuaggcuuucauuccaguuug

SEQ ID NO: 620955 - RNA, 63 nt, hsa
ggcccuagggccugcuucuauguauuuaucaacaugugauacauucaauugguuaaaugguuu

SEQ ID NO: 620956 - RNA, 63 nt, hsa
uccagugcaguauaaauuguaacauaaaacuuuaugugauauaggaauagugucaaugacaca

SEQ ID NO: 620957 - RNA, 63 nt, hsa
uuuaugaacuauaaaugauugucuuuaauaaauaugugauaaaauccaauuuuuauuauuuua

SEQ ID NO: 620958 - RNA, 63 nt, hsa
gagcgcaccagaauaagagcgcaccagcuaacaaugugauacggccauaugucacuuaaggau

SEQ ID NO: 620959 - RNA, 63 nt, hsa
uuaauugcauuuuaauuaauugccaguuuuuacaugugauagucaguuguacaaagaaaaugc

SEQ ID NO: 620960 - RNA, 63 nt, hsa
uucuagaucaauuuuuauaaaguacuaaugcucaugugauaauuuaaaauuauuuucaacuac

SEQ ID NO: 620961 - RNA, 51 nt, hsa
agauauucaccgauguuuaauaugugauacaagugacaugcugugcucagu

SEQ ID NO: 620962 - RNA, 63 nt, hsa
gauaagcauaaugaaaauagaugcaaaaaacuaaugugauaugaaaauaucuggguuuuucuu

SEQ ID NO: 620963 - RNA, 63 nt, hsa
ccaacuggucuaagcagcauuuaauugaagaauaugugauacagccucuucaaucagauugua

SEQ ID NO: 620964 - RNA, 63 nt, hsa
cuggcaacaacaaagccaacagucaaaacagagaugugauaaggaucagaacagcagagguuc

SEQ ID NO: 620965 - RNA, 63 nt, hsa
uuuuccuguuugcacucugagggcuuaagucauaugugauauuuacaaagcaauuggcccauu

SEQ ID NO: 620966 - RNA, 63 nt, hsa
aagccagacaccuaauucuucaguucacugcccaugugauacugauugccacauuaagguuga

SEQ ID NO: 620967 - RNA, 63 nt, hsa
aauccagacaccuaauucuucaguucacuacucaugugauacugauucccacauuaagguuga

SEQ ID NO: 620968 - RNA, 63 nt, hsa
aauucuuguuuuguggguauuaggagugugggaaugugauaaccuaaacaaccuuugcucuga

SEQ ID NO: 620969 - RNA, 62 nt, hsa
aaccugaaucaucuuugugagucuugaaaaagaugugauauuugacuuuugcuuuaaacugc

SEQ ID NO: 620970 - RNA, 63 nt, hsa
ccauaugauuucuagcugccauggugguuaggaaugugauacugccuguuugcaaagucacag

SEQ ID NO: 620971 - RNA, 63 nt, hsa
gcauauauaaaacaaaacaaacaaccugccacaaugugauauguguaauaucauuucauaaaa

SEQ ID NO: 620972 - RNA, 63 nt, hsa
gauaaugugcuugagucccuauaaucuauagacaugugauagcaaaagaaacaaacaaaagcc

SEQ ID NO: 620973 - RNA, 63 nt, hsa
uuuuaaaguugaaaagcaucccaguuaaacuagaugugauaguuaaaccagaugaaagcauga

SEQ ID NO: 620974 - RNA, 63 nt, hsa
ggucugcaguagacacaauuggcugagcaggauaugugauacugugugguugguguggaguuu

SEQ ID NO: 620975 - RNA, 63 nt, hsa
gucacagccuccucaaaggguugugaaaaucaaaugugauaauuuguggaaagcccuuagcag

SEQ ID NO: 620976 - RNA, 63 nt, hsa
auugucuucauguacauuuggaacuaacacgugaugugauauauuccuaaacuaugaaaccuu

SEQ ID NO: 620977 - RNA, 63 nt, hsa
guucaucaaugaaugaaugaauggcuaagcaaaaugugauauguaccuaacgaaguauccuuc

SEQ ID NO: 620978 - RNA, 63 nt, hsa
uuggauggcuuaagcaccucagcauuccuuacuaugugauaaaauacauauagaauauaagau

SEQ ID NO: 620979 - RNA, 63 nt, hsa
cucauggcuuggaguuaccuuauauucagguauaugugauauuuugccugguuuguuaaaauu

SEQ ID NO: 620980 - RNA, 63 nt, hsa
ggaaucucuuaaaacauaaugagagguuugguaaugugauauuuuaagcuuauucuuuuucuu

SEQ ID NO: 620981 - RNA, 63 nt, hsa
uccugccuuuguaguucugguauucacuuuacuaugugauagaaguagcauguugcugccaga

SEQ ID NO: 620982 - RNA, 63 nt, hsa
auaguacaguuguauuuguccuucauauucaggaugugauauuuacaaaaugcagaacaguuu

SEQ ID NO: 620983 - RNA, 63 nt, hsa
uuuaagguaaauuggucaggaacuauuaauuccaugugauacauuaggaagcugaauuauuag

SEQ ID NO: 620984 - RNA, 63 nt, hsa
aacaaaaacuuguuacuaaagaaaauaucugaaaugugauaaguucuuaugccauguuaauuu

SEQ ID NO: 620985 - RNA, 63 nt, hsa
ugaggcuggcagguacagagaugaacuguacacaugugauacauuuaagccacuggaaaaacc

SEQ ID NO: 620986 - RNA, 63 nt, hsa
gcauauauggcagaggugauggcugguggguaaaugugauaguaaauuguagaaaccucuucu

SEQ ID NO: 620987 - RNA, 63 nt, hsa
aaccuacucuggacauuucauauaucuggaaucaugugauaucucuuuugugacuggcuucuu

SEQ ID NO: 620988 - RNA, 63 nt, hsa
gcacaucauauucuauuguuuacuauaaaaaucaugugauaacugauuauuacuucuguuucu

SEQ ID NO: 620989 - RNA, 63 nt, hsa
gcaucuaaguaauaauuuuuuaagauucacuauaugugauaguaugauaugcauuuauuuaaa

SEQ ID NO: 620990 - RNA, 63 nt, hsa
aauuaccuaacaaacaguguauuuauuuuuaauaugugauaaugaucuugugguauauaugca

SEQ ID NO: 620991 - RNA, 63 nt, hsa
cuggguagucauggauuucugcuggacauuugaaugugauaaacaauccagcauuacuuagga

SEQ ID NO: 620992 - RNA, 63 nt, hsa
aaguuauuuguuucagaaaauuauucuuuuuuuaugugauaaaucauaugauuuaagugcaug

SEQ ID NO: 620993 - RNA, 63 nt, hsa
ugaacucuugugauuucacaagauucucuacuuaugugauaggaggguauggccaguuauuca

SEQ ID NO: 620994 - RNA, 63 nt, hsa
gguucguauuuuaaaaaucuugcacaaauuguaaugugauacugugaaacaaauugaaaacau

SEQ ID NO: 620995 - RNA, 63 nt, hsa
ugcugugcuaaauaucaaucaagccauguauaaaugugauaugauuggcaauauguguuuacu

SEQ ID NO: 620996 - RNA, 63 nt, hsa
cacacugauaaauuauuaagauuaagauuauuuaugugauaaaugaaaucuccuaccaaucca

SEQ ID NO: 620997 - RNA, 63 nt, hsa
uggcagggagagggaacgguccaugaaaucuuuaugugauauaaggauuuuaaguuugggcca

SEQ ID NO: 620998 - RNA, 63 nt, hsa
auauuuauaucuugcauccuauaucaugucaauaugugauauagaaaagagauacgugaauuu

SEQ ID NO: 620999 - RNA, 63 nt, hsa
aauuuucaacucagaagcacucaaaaaugcaaaaugugauaaugggcacuuguuuaaaagaau

SEQ ID NO: 621000 - RNA, 63 nt, hsa
ucuauggcacuguuuuuuaucacaaauauguauaugugauauugauauauaacuauauauauu

SEQ ID NO: 621001 - RNA, 63 nt, hsa
gccaagcuucguggaggaauguaggugacaucaaugugauaaagucuguguucugaguuguca

SEQ ID NO: 621002 - RNA, 63 nt, hsa
uuccucaaggccaccuggccaggagcuucucugaugugauauccacuuuuuuuuuuuuugaga

SEQ ID NO: 621003 - RNA, 63 nt, hsa
augugggagaaccuuacaaggcucuaaaaugagaugugauauggcuugaaaugggaggagaca

SEQ ID NO: 621004 - RNA, 63 nt, hsa
augcuuuauuaauguuuucaaaagguauuauacaugugauacauuuuuuaagcuucaguugcu

SEQ ID NO: 621005 - RNA, 63 nt, hsa
uacaaaugcuguaauauaaagcauaucaaguuuaugugauacguaucauugcaagagaauuug

SEQ ID NO: 621006 - RNA, 54 nt, hsa
aaguaauacuuugcuuguaaacagaugugauagagauaaaguuaucuaacaaau

SEQ ID NO: 621007 - RNA, 63 nt, hsa
aacauuccugagugaauucgcaagcgcacuagcaugugauauuagggaguuugcaauaaauua

SEQ ID NO: 621008 - RNA, 63 nt, hsa
cccacugcuaaccuuauauaucucuauagacaaaugugauaaugacaugauuucccaccugcc

SEQ ID NO: 621009 - RNA, 63 nt, hsa
accaacaguauucaagaagcaaccagcaccaucaugugauaaugguacuauggcauauaugca

SEQ ID NO: 621010 - RNA, 63 nt, hsa
uuaaaucauguuuuccuaaaauguagcaacuacaugugauaaaagcaaauuagaacauucugu

SEQ ID NO: 621011 - RNA, 63 nt, hsa
uuuauuaaauauucagguaacaguucugaauucaugugauaaugguggcauuauauaugauua

SEQ ID NO: 621012 - RNA, 63 nt, hsa
uacuuuaaaaauggcuuuaaggauaaagaauaaaugugauagcugugcaugcauuauauauuu

SEQ ID NO: 621013 - RNA, 63 nt, hsa
uugguugggagcaucuuguaugaucuccguaugaugugauauugauggagauagugguccuca

SEQ ID NO: 621014 - RNA, 63 nt, hsa
ggaaugcugaagaauuaacacuuugacuccuaaaugugauacugguuuguagauucccuuaga

SEQ ID NO: 621015 - RNA, 63 nt, hsa
aagauugccuaguacaccuuuguaucucauuugaugugauacccagaagagaucauuguuuuu

SEQ ID NO: 621016 - RNA, 50 nt, hsa
acauugacaaugaguuuuaaaugugauacccauagcuuccaugagaacag

SEQ ID NO: 621017 - RNA, 63 nt, hsa
ccuguugcuuccagccacugugauguuugaaauaugugauaguaccugguugugaaaaaagac

SEQ ID NO: 621018 - RNA, 63 nt, hsa
cugagcauuccuaaauaucugcuuagaaauaucaugugauaaagagggaccuucuuaauacac

SEQ ID NO: 621019 - RNA, 63 nt, hsa
ugucuuaaauaauuuaaccauaaauuuucugucaugugauacuggaauaugggauacuuuuca

SEQ ID NO: 621020 - RNA, 63 nt, hsa
cuuuaauuucaggaauugaauggguuugcuagaaugugauauuugaagcaucacauaaaaaug

SEQ ID NO: 621021 - RNA, 63 nt, hsa
ucaagugggcuauuaaaaucuaacguugaguaaaugugauagugaugagaaaggaauuuugug

SEQ ID NO: 621022 - RNA, 63 nt, hsa
cagaaguaaaaucugaugguucuaaaucaaucaaugugauaguucauuuuuaacucuuagaag

SEQ ID NO: 621023 - RNA, 63 nt, hsa
aggacuaaaacuuuaaacuagaguugaugcuuaaugugauagagacaucucuaaaguauuuug

SEQ ID NO: 621024 - RNA, 63 nt, hsa
uagacaagcauguucucucgucuugccaccaucaugugauaugaaaagaagcaugaauaauuu

SEQ ID NO: 621025 - RNA, 63 nt, hsa
aauauuuuucagaaguuauaguugucuuuuaguaugugauacuaauuaagauuacuuuuguau

SEQ ID NO: 621026 - RNA, 63 nt, hsa
ucuucuggaaugaauacccucauaucuguccugaugugauaugucugagacugaaugcgggag

SEQ ID NO: 621027 - RNA, 63 nt, hsa
acugacaauauaaaggguuuuguugaaucaacaaugugauacguaaauuauagaaaaagaaaa

SEQ ID NO: 621028 - RNA, 63 nt, hsa
ugacaauuuuuccuuuuucuacacuaaaacaauaugugauauauuuccccucuugaagaggca

SEQ ID NO: 621029 - RNA, 63 nt, hsa
ucaaaagagaaaaauaauguccauccugucgugaugugauaggagcagcuuaacaggcaggga

SEQ ID NO: 621030 - RNA, 63 nt, hsa
auacuaauguuuguuucuauaaaucaaauacacaugugauaauaugcauguaaauacauaacu

SEQ ID NO: 621031 - RNA, 63 nt, hsa
ccugcuugucuaguuuguauucgcugacuuucuaugugauauagaugcauuuguaauacucuu

SEQ ID NO: 621032 - RNA, 63 nt, hsa
gggugcagaauugauaccagacagaaggugucuaugugauaaugaguuucagaggcugaucuc

SEQ ID NO: 621033 - RNA, 63 nt, hsa
gaaaguaaaaagaacaacacuuguuaugagggcaugugauauuuucacaucuuaauuaagcuc

SEQ ID NO: 621034 - RNA, 63 nt, hsa
cugaucauguuuaugagaaacuggcaaagcagaaugugauauccuaggagguaaugaccauga

SEQ ID NO: 621035 - RNA, 63 nt, hsa
aaaacuuaaauaugguguuaaaaauggaaauauaugugauauuugcauuauuaaaccccuuug

SEQ ID NO: 621036 - RNA, 63 nt, hsa
gacacauuuaucauauucauucacacauauuauaugugauagcuguccaacauccugucuggg

SEQ ID NO: 621037 - RNA, 63 nt, hsa
uaaacuagguuuguauuguacaugagguacuucaugugauauguuuuggauuuagucauauug

SEQ ID NO: 621038 - RNA, 63 nt, hsa
uaauuuuuaaaaauuacauucuucugauguaacaugugauacauacaaaagaauauaguuuaa

SEQ ID NO: 621039 - RNA, 63 nt, hsa
cagugccccaacuuguacugcgccugaauagucaugugauaauuuacugaagaaaucuagugu

SEQ ID NO: 621040 - RNA, 63 nt, hsa
acgacugaaaaaguucaucugaugccucugagcaugugauaaaguccuggguagacacggaaa

SEQ ID NO: 621041 - RNA, 63 nt, hsa
aucugcugucuaaaugauauauauaugauauauaugugauauauauauaucauauauaugaua

SEQ ID NO: 621042 - RNA, 63 nt, hsa
cagugugguaaaauugggguaaaaugugguaaaaugugauacgcacaaacccuuugaaaauag

SEQ ID NO: 621043 - RNA, 63 nt, hsa
ugcaguauguauaaacuuauaagaauuaaauugaugugauaauuuuauguuuuuauaauuaaa

SEQ ID NO: 621044 - RNA, 63 nt, hsa
acucgaguugaagguuugugaauagaaggggaaaugugauagaagauuauucagaacaaaaua

SEQ ID NO: 621045 - RNA, 63 nt, hsa
uaucuuagaaaaccuguugguuaaggcagcugcaugugauaaaagugguacuugaacuuggua

SEQ ID NO: 621046 - RNA, 63 nt, hsa
ccaauauucugauaauuggcacuggaucacaaaaugugauaaaacuuuaaauguauaaaacuu

SEQ ID NO: 621047 - RNA, 63 nt, hsa
uuacuuuuggguucaccuagaucauaugaguugaugugauacuucuagaacaaaauuauucau

SEQ ID NO: 621048 - RNA, 63 nt, hsa
auagaaggaauggccaguucaaaagaauaguagaugugauagugccgugaauguauucuacug

SEQ ID NO: 621049 - RNA, 63 nt, hsa
acacccuucacacuguuaucaccuauccugaagaugugauacacugaauggaaauaaauagau

SEQ ID NO: 621050 - RNA, 63 nt, hsa
aagacaagacugucauauuguagagacuuugguaugugauaccauagaauacugauuggauag

SEQ ID NO: 621051 - RNA, 63 nt, hsa
uaccuuaggguuuugccauuguaaaugggucugaugugauaugacaagaccagagaaauugga

SEQ ID NO: 621052 - RNA, 63 nt, hsa
uuuuaagcucauggaucaauggauuuguuuacaaugugauauuuucuauuaaauccaguauuu

SEQ ID NO: 621053 - RNA, 63 nt, hsa
auuuccuacaaacuuuaaaugcuguuuuuauagaugugauaugaggcaacacaagcacagaca

SEQ ID NO: 621054 - RNA, 63 nt, hsa
aaucauggggaacagauguguuccacccaacaaaugugauaagugaucaugcagccagagcca

SEQ ID NO: 621055 - RNA, 63 nt, hsa
aucauggggcacagauauguucccacccaacaaaugugauaagugauugugcagccagagcca

SEQ ID NO: 621056 - RNA, 63 nt, hsa
aaauacuuccucugcuuguauuuugcgaugaagaugugauacaucuuuaaaugaaaauauacc

SEQ ID NO: 621057 - RNA, 63 nt, hsa
ugaggcuaguguuugcauuccugguuauauguaaugugauaaauuagcuaugaaugguaaaag

SEQ ID NO: 621058 - RNA, 63 nt, hsa
gggaaaagggaguaaaagguguauuuuugucguaugugauagaauauuuugcugcacaugcau

SEQ ID NO: 621059 - RNA, 63 nt, hsa
gaaauaucuguggugagauugcugagucaggugaugugauaucauaagcuuucuuggaacggg

SEQ ID NO: 621060 - RNA, 63 nt, hsa
uugugcuuggaauaugacuuaaguaucuccuaaaugugauacagaagaacaucucaucccaua

SEQ ID NO: 621061 - RNA, 63 nt, hsa
cacaggaaaucauugcuauggucuccccuaggaaugugauagauagcuucuauaauuaugcag

SEQ ID NO: 621062 - RNA, 63 nt, hsa
gagaagaagaaggugauaaguguugaaaauuaaaugugauaaccuuugaaccuugaauuuugg

SEQ ID NO: 621063 - RNA, 63 nt, hsa
uaggggcaugagaaaagcacauaauggauguggaugugauagguggucuuuuccuguuaacaa

SEQ ID NO: 621064 - RNA, 63 nt, hsa
ugcaguauugcaacaggggugcaauuuaaggcuaugugauagaggguuauuuacucagugugu

SEQ ID NO: 621065 - RNA, 63 nt, hsa
uagacagaagccaguauacauuuugcacuauugaugugauacuguagccagccaggaccuuac

SEQ ID NO: 621066 - RNA, 63 nt, hsa
augaagcaaaauuucuuuucuccaccaugcuuuaugugauaguauuuaaaauugaugugaguu

SEQ ID NO: 621067 - RNA, 63 nt, hsa
uaauuugauuucuuuaauuccuuauugaaucuuaugugauaugauuuucuggauuuacagaac

SEQ ID NO: 621068 - RNA, 63 nt, hsa
aaaccucuucuguaaugccagguucuugacaagaugugauaauuccacacuuacauccucaga

SEQ ID NO: 621069 - RNA, 63 nt, hsa
uauauugauaagcaaacuauuuccaaacuaaaaaugugauagauaaaagugugauuaaucaaa

SEQ ID NO: 621070 - RNA, 63 nt, hsa
augucuuuuuguguaauggacugggccaaucaaaugugauaaaauuaauuugagaaugaaacu

SEQ ID NO: 621071 - RNA, 63 nt, hsa
gcucuuugcucauucuagggccaguggaggaaaaugugauaaggccagagcuugugugcuggg

SEQ ID NO: 621072 - RNA, 63 nt, hsa
augggagacauccauuuaagaucaacuguuuacaugugauacaucgaaaacuguuuacuucaa

SEQ ID NO: 621073 - RNA, 63 nt, hsa
uuuuaacuagguaucuuauggugagauggugggaugugauaaccaagauguaaguauuacauu

SEQ ID NO: 621074 - RNA, 63 nt, hsa
gaaacuaauucagcaggcugaaggaaaugguucaugugauaaugugggcugguauccucuaga

SEQ ID NO: 621075 - RNA, 63 nt, hsa
ccugcuccgcuucauguccccuccugaguagucaugugauaauaaacucucauguuauuguuc

SEQ ID NO: 621076 - RNA, 63 nt, hsa
gaaaaaacauaugaaucagauggaacaaucugaaugugauaugcuccaugaugcuguguguuu

SEQ ID NO: 621077 - RNA, 63 nt, hsa
auuauuaaguuguacugaauucuuugcagcuuaaugugauauaugacuaucuugaacaagaga

SEQ ID NO: 621078 - RNA, 63 nt, hsa
gaaaacagaguauuucuggcagcugugguacaaaugugauaauauauugcuaaaauauuuuag

SEQ ID NO: 621079 - RNA, 63 nt, hsa
uuguguuuuugucuuuaugcuauguacagagaaaugugauaauuuuuuauaauaaauauuuuu

SEQ ID NO: 621080 - RNA, 63 nt, hsa
uuugaaguaaauaauacgagugaauauuuucaaaugugauaaaauagcacaaguggcugguga

SEQ ID NO: 621081 - RNA, 63 nt, hsa
aucucagccuccagaguagcugggacuacaggcaugugauaugaugcucggcugauuuuuguu

SEQ ID NO: 621082 - RNA, 63 nt, hsa
uuuacuguaacgaaaccaagaaacuuguuuagaaugugauaggcagcuaaaacuguuaugccc

SEQ ID NO: 621083 - RNA, 63 nt, hsa
agaggcuauagcugggaacccgacugugaaaguaugugauaucugaacacauacuagaaagcu

SEQ ID NO: 621084 - RNA, 63 nt, hsa
uauagauaacagauuaguaguuacaugguaauuaugugauauaaaauauucauauauuaucaa

SEQ ID NO: 621085 - RNA, 63 nt, hsa
cuuaguuaucauuaauguaguuccucauugaacaugugauaaucuaauaccugugaaaacuga

SEQ ID NO: 621086 - RNA, 63 nt, hsa
uaauuuaaaucuguaaauaauugcuuuauugugaugugauacagaacaaaguguucguuuuug

SEQ ID NO: 621087 - RNA, 63 nt, hsa
cuguuaaucaaaauugcauuuuacaauuuaauaaugugauauuuccuaugucuacagcauacc

SEQ ID NO: 621088 - RNA, 63 nt, hsa
cuauuacuauauuuacuugcauaugucagaaugaugugauagacuaucucugucacuaugcug

SEQ ID NO: 621089 - RNA, 63 nt, hsa
auuuuaaggcugugaaugguagacauuuaucacaugugauauuguguaaagccucuucuguuu

SEQ ID NO: 621090 - RNA, 63 nt, hsa
uucacugcacuuggcauuauuuuuauaagcugaaugugauaauaaggacacuauggaaauguc

SEQ ID NO: 621091 - RNA, 63 nt, hsa
aggaaacauucagugaaaaacuuguagaaugggaugugauaacgagguuccaguaaucugagc

SEQ ID NO: 621092 - RNA, 63 nt, hsa
aauacacauuaucacugaaaaaauguagcuuuuaugugauauguuuuaaaguuaaaacuggau

SEQ ID NO: 621093 - RNA, 63 nt, hsa
gaccugcaaacgcuucaguuguuagcauuuucaaugugauauaaacagcuucuccaauacagc

SEQ ID NO: 621094 - RNA, 63 nt, hsa
aaggcuaagcaauaaauguuugauuaucuuuagaugugauauagcuaguucccaaagugauug

SEQ ID NO: 621095 - RNA, 63 nt, hsa
uuccuauuuauuuuuauuauuuuuuaaucccaaaugugauaguagcuucaguauguuuccuca

SEQ ID NO: 621096 - RNA, 63 nt, hsa
acaccugcugagaaaacaugccucugccaaaggaugugauauauaaguguacauaugugcugu

SEQ ID NO: 621097 - RNA, 63 nt, hsa
aaauggaguauuaauuuuuaauauuuucaccauaugugauaacaaaggaucuuucaugaaugu

SEQ ID NO: 621098 - RNA, 63 nt, hsa
ugagcacacuacggaucuggaaaauacuggaaaaugugauacuuagaauacuuuggcugcuaa

SEQ ID NO: 621099 - RNA, 63 nt, hsa
aaugagugggaaauacauugugccuuucucuagaugugauacguuauaccaaaaucuuuguag

SEQ ID NO: 621100 - RNA, 63 nt, hsa
agcuugugaagucauucuaaagcuagaggaaguaugugauauacacauggacuaaggcucagg

SEQ ID NO: 621101 - RNA, 63 nt, hsa
auuuauuuauuuuuaaaauuuaaauuauuuuuuaugugauaucaugaguaccuuuacauugug

SEQ ID NO: 621102 - RNA, 63 nt, hsa
cuguauguaauguauuuauguauguauuuguaaaugugauagaagucugggggggaguugggg

SEQ ID NO: 621103 - RNA, 63 nt, hsa
uuuaaaaaugucuauuaauauuccaucguauagaugugauauaauuugcuugaugguugucuc

SEQ ID NO: 621104 - RNA, 63 nt, hsa
gagauauaaggugauauugcuauugaccugaaaaugugauagaacuucugguugccuauugau

SEQ ID NO: 621105 - RNA, 63 nt, hsa
uaccacauauauaugcauuuagauauacaucacaugugauauaucuagauccauauauagguu

SEQ ID NO: 621106 - RNA, 63 nt, hsa
cugauacuuguuuuauacauaaauuuuuuuuagaugugauaaagcuaaacuuggccaaagugu

SEQ ID NO: 621107 - RNA, 63 nt, hsa
ugacauuaaauuuggcuauaaaagauggacuacaugugauacuccuauggacguuaauugaaa

SEQ ID NO: 621108 - RNA, 63 nt, hsa
gaaguucaaaagacuuauauauguauaagugguaugugauauaaaucguguguuucauaugca

SEQ ID NO: 621109 - RNA, 63 nt, hsa
guuguucccauucuucuuugugagacagagagaaugugauauagagaaaucuggcuggcuaca

SEQ ID NO: 621110 - RNA, 63 nt, hsa
agcaauauucuuuugaaaaaagugccaguccuuaugugauaaacuaagaagcccauugaauau

SEQ ID NO: 621111 - RNA, 63 nt, hsa
agaucaguuuaguuguauaguugucaaaguuauaugugauaucaaugaagaaauauuuguagc

SEQ ID NO: 621112 - RNA, 63 nt, hsa
uuuuguuucuauuuaauguuuucgagauaugacaugugauaagauggaaagccaauaaaccug

SEQ ID NO: 621113 - RNA, 63 nt, hsa
gaaguucauaggacuuacauauguacaagugguaugugauauaaaucguguguuucauaugca

SEQ ID NO: 621114 - RNA, 63 nt, hsa
ucaguguuuucucaugcaaaauuuucuucuagcaugugauaaugaguaaacuaaaacuauuuu

SEQ ID NO: 621115 - RNA, 63 nt, hsa
cccuauauuggagaggauaacucgcguuuacauaugugauaguuaugcuuaauacuaauucac

SEQ ID NO: 621116 - RNA, 63 nt, hsa
uaugccgcuagauacaugcuuuuuaaugagauaaugugauauuauacauaacacauaucgauu

SEQ ID NO: 621117 - RNA, 63 nt, hsa
uacuauuucccuuuaguuuuuagcagcggcuggaugugauaugucuaguuuaaccaguccccu

SEQ ID NO: 621118 - RNA, 63 nt, hsa
ucccaugccuggagaagcuaaugccaacucaucaugugauaauucaauuuguacaauaaauua

SEQ ID NO: 621119 - RNA, 63 nt, hsa
caagaaaagguggguauggaaacacaugagagaaugugauagugaagucauauuuacaaaacu

SEQ ID NO: 621120 - RNA, 63 nt, hsa
aacacuugcaaccuaccuguugagcaucacagaaugugauaaggaaaucaacuugcuuaucaa

SEQ ID NO: 621121 - RNA, 63 nt, hsa
gacucagacuaacauacaggacaguccagcuggaugugauaaagauuuuaucaccucauaugg

SEQ ID NO: 621122 - RNA, 63 nt, hsa
caaaaaugucaaucaaauauuaaaaaauaguuaaugugauagaaaaaccuuacauauuuuuuu

SEQ ID NO: 621123 - RNA, 63 nt, hsa
auucucugauggccugacaggccuauuaaguagaugugauauuuucucccaagaugaccucca

SEQ ID NO: 621124 - RNA, 63 nt, hsa
acucuagaggugacucagucaggacugacaguaaugugauaauugccuucauuuucaacccag

SEQ ID NO: 621125 - RNA, 63 nt, hsa
ugauacauaagagauguauauguuuugggguauaugugauaauuugauacauucagauagugu

SEQ ID NO: 621126 - RNA, 63 nt, hsa
acuaugugaaaaauuauauuugugcauaauaaaaugugauaacuuuuuacaacagaaugugau

SEQ ID NO: 621127 - RNA, 63 nt, hsa
gaaaguugagaagaacacgaagcacagacccugaugugauaaaacauuuugugguuucucuga

SEQ ID NO: 621128 - RNA, 63 nt, hsa
aaauuauccguuguuuuugcauaugcccaguugaugugauaaaauuuucauugucuugccaua

SEQ ID NO: 621129 - RNA, 63 nt, hsa
ucucaaagccuacauucaggaucucccucuaggaugugauagaucuggucccucuccuugaac

SEQ ID NO: 621130 - RNA, 63 nt, hsa
aaugacuauuuugcuuacuauugugucuaugauaugugauacaaagcaaauauuuucuaaaua

SEQ ID NO: 621131 - RNA, 63 nt, hsa
uccucaccaguaauaugucuccuugcuucuuugaugugauaguuuugagaugggugagaaucu

SEQ ID NO: 621132 - RNA, 63 nt, hsa
gucucuuugagaaguaugugcccuaucucauggaugugauaguggaaggaauuguggauggaa

SEQ ID NO: 621133 - RNA, 63 nt, hsa
ccaguggaaacuuuuacuccuccucauccgcagaugugauagaacugaaguaucuaggaauuc

SEQ ID NO: 621134 - RNA, 63 nt, hsa
aguauuuaaacaauauuuagagcaaguguccucaugugauaaacagagcacaguccaaagaua

SEQ ID NO: 621135 - RNA, 63 nt, hsa
aaaacguaucuucagaacuuaacauauuacuggaugugauacagauuuugcuuucuguggaau

SEQ ID NO: 621136 - RNA, 63 nt, hsa
caugauaguguuaaaaaacaaaauuugcuaacaaugugauauaaagacuuuaaaaguuacaca

SEQ ID NO: 621137 - RNA, 63 nt, hsa
ugaagaugaguuacuccuugucaucuuacaaauaugugauaugguaauuuucauaacagaugu

SEQ ID NO: 621138 - RNA, 63 nt, hsa
gucauuauauuuaccuguuuuuuaacacaauguaugugauagucaaaaaaucacaguuuuuca

SEQ ID NO: 621139 - RNA, 63 nt, hsa
cugcagacuuaacguguuuucugucauaguuagaugugauaauucuaagagugucuaugacuu

SEQ ID NO: 621140 - RNA, 63 nt, hsa
accauauaggcauugauuaacuucuuuaaguacaugugauaacuauggaaaucaagauuaugu

SEQ ID NO: 621141 - RNA, 63 nt, hsa
uaaucccguagcauagcaccuuuuguauaaacaaugugauauugcuucugcacauccaaaaau

SEQ ID NO: 621142 - RNA, 63 nt, hsa
uauaaaaccuuuaagaggauucauggugaauauaugugauaacaucuuuauacuuugaaaaau

SEQ ID NO: 621143 - RNA, 63 nt, hsa
auguguuuaaacagaaagaagggaaaagguacuaugugauaugguacugaaauuuugauccca

SEQ ID NO: 621144 - RNA, 63 nt, hsa
uuagauguuuucuugcuguuccuugucucuuuuaugugauauuuuaacaacuuuugagagugu

SEQ ID NO: 621145 - RNA, 63 nt, hsa
guguaauccuguaaacacugucugccuagugugaugugauauagucuuugucuuucaugcugc

SEQ ID NO: 621146 - RNA, 63 nt, hsa
agauucuccucuaauucuguaggacuuugaauaaugugauauuuuucuuauaauuggacccuu

SEQ ID NO: 621147 - RNA, 63 nt, hsa
aggcaucuuacaaauuuugccccuuuuaugaggaugugauaguugcugcaaaugagggguuac

SEQ ID NO: 621148 - RNA, 63 nt, hsa
uuguucuuuuaugacuacaaugaacauaugucuaugugauagcuaaagauauuuuugaauugu

SEQ ID NO: 621149 - RNA, 63 nt, hsa
uuccuuauucacuuacauuacaaaucuaagaccaugugauaagcaugacuggagagguuuaau

SEQ ID NO: 621150 - RNA, 63 nt, hsa
uacuaaauucuacuacuggguuauaauuaaaucaugugauauuccacguuuggauaugcucau

SEQ ID NO: 621151 - RNA, 63 nt, hsa
caccaaguuacuugcuuugcuuuccucucuaugaugugauaauacaguaaaagcuuucuuacc

SEQ ID NO: 621152 - RNA, 63 nt, hsa
uaagaaguaauuauaauuaggaauaggcuauggaugugauacuugguauuuuuuaagauaaac

SEQ ID NO: 621153 - RNA, 63 nt, hsa
acuaagugaaaaucugagaaagaguuaauugcaaugugauaguggguagaaaggagagaaaaa

SEQ ID NO: 621154 - RNA, 63 nt, hsa
gcauguauccuugauagcaucacaucauacagaaugugauaagaauggcacuuuaccucugug

SEQ ID NO: 621155 - RNA, 63 nt, hsa
agcaauauauauauggauuucuauaaucacucgaugugauacaguauaaauaugcuaugguuu

SEQ ID NO: 621156 - RNA, 63 nt, hsa
cuuaaaaaucacucuucaugcuucccugguccuaugugauaacagaguuagagacuugagucu

SEQ ID NO: 621157 - RNA, 63 nt, hsa
gggagacuugcugguggguuagugguccucaggaugugauagaaacauccaguguaaaaagga

SEQ ID NO: 621158 - RNA, 63 nt, hsa
aaagaaaaaaacuaaucuuggcauccuaucacuaugugauauuuuguacaucuuacuguauuu

SEQ ID NO: 621159 - RNA, 63 nt, hsa
gccagcaucccucuucugcuucucagugaagauaugugauauggauguuugaagcuaaucugc

SEQ ID NO: 621160 - RNA, 63 nt, hsa
gacaaaaauaaacuaaguaccuguaguguauuuaugugauaugugucaaguuacucaaaguua

SEQ ID NO: 621161 - RNA, 63 nt, hsa
uuuuucuuagcuggcaugccauaaaggccagcuaugugauauuagaggaagaaaggauuuuuc

SEQ ID NO: 621162 - RNA, 63 nt, hsa
ugguugguggggcaggucauuuggaaauaaagaaugugauagagauggcugaagaggggaagc

SEQ ID NO: 621163 - RNA, 63 nt, hsa
uuuuuuaguuguuaucaaauuguaaaaucaguaaugugauauuuuauauucugaaacauuucu

SEQ ID NO: 621164 - RNA, 63 nt, hsa
gaaugauucacugaagaugaaaagauaggacggaugugauaugaaaaaaacccaaacauuuug

SEQ ID NO: 621165 - RNA, 63 nt, hsa
cucuccaucuuauauguauucuaaccaggaaaaaugugauagcacauggguagccuaggcagu

SEQ ID NO: 621166 - RNA, 63 nt, hsa
gacacuugagugaguuugauggauaaugagcuaaugugauaucuauaggucacaauuuuuuaa

SEQ ID NO: 621167 - RNA, 63 nt, hsa
uacuuaagaaauuaauucaguuggauuaucauuaugugauacuggcagauugcagugcaaccu

SEQ ID NO: 621168 - RNA, 63 nt, hsa
uccauauguacguguguauauaauauauauuguaugugauaauaugaucguauucuauaaaua

SEQ ID NO: 621169 - RNA, 63 nt, hsa
gcuauaaauggaauuuuguguaaauucacaaaaaugugauauaaacaggaucuaagacuggau

SEQ ID NO: 621170 - RNA, 63 nt, hsa
agccauuucauguuccaguuguaagauaaggaaaugugauaauagcuguuucaucauugucuu

SEQ ID NO: 621171 - RNA, 63 nt, hsa
aggaucccaugagaacauuauacuggaaguuacaugugauacccagcuaaagaauacauauca

SEQ ID NO: 621172 - RNA, 63 nt, hsa
uuaauaugaagaacuagauagugguguaaacaaaugugauaauguuuauuuacuuucgguucu

SEQ ID NO: 621173 - RNA, 63 nt, hsa
uuuacuuucuucaccaagugcaauagauuacugaugugauauucuguugcuuuacaguuacag

SEQ ID NO: 621174 - RNA, 63 nt, hsa
ucuugauauaucaucucagaaacuuuccugaauaugugauaauauauggaaaaugauuuauag

SEQ ID NO: 621175 - RNA, 63 nt, hsa
accaggcgagagggcacccucccuuccucccccaugugauaaauggguccagggcugaucaaa

SEQ ID NO: 621176 - RNA, 63 nt, hsa
aucacuuaugcugagcaaccaaauauuacaguuaugugauaaaggaaaaauucuuuccugccc

SEQ ID NO: 621177 - RNA, 63 nt, hsa
gaagcaggcuuggaggguuaauuuacccacagaaugugauaguaauaggggagggaggcugcu

SEQ ID NO: 621178 - RNA, 63 nt, hsa
ugcuuuaaauuggaagacgcuggaggcacugggaugugauaugccccucucucucccaaucag

SEQ ID NO: 621179 - RNA, 63 nt, hsa
aaacaguuccauuuucucucuuguaaguguuaaaugugauaaaaguacauauuuuaaauuguu

SEQ ID NO: 621180 - RNA, 63 nt, hsa
aauugcuuucucaaaaguuuggguuaguuucaaaugugauauuuuggagggaagguaaaguag

SEQ ID NO: 621181 - RNA, 63 nt, hsa
acauuaccaugauuuauuguaauggaguagaguaugugauaguaucugcuucaagaccuauag

SEQ ID NO: 621182 - RNA, 63 nt, hsa
cuugauagaaugacuuugagguccuuggauaaaaugugauauaugcaaguacaguauguugcu

SEQ ID NO: 621183 - RNA, 63 nt, hsa
gcuuuuauuuccguuuaaacauauuuuguauauaugugauauaaauuaaugugugcaaauugu

SEQ ID NO: 621184 - RNA, 63 nt, hsa
uaaaauuuguuugcucguaugcuguucccuucaaugugauaucagagauuacuaugaauguua

SEQ ID NO: 621185 - RNA, 63 nt, hsa
aaagauggaguuucuaagguccgguguucuaagaugugauauucuaagacuuacucuaagauc

SEQ ID NO: 621186 - RNA, 63 nt, hsa
cuuuuuuauauuuuuaagacuagauuuugagccaugugauaguuuuaccucauauuaaauaua

SEQ ID NO: 621187 - RNA, 63 nt, hsa
gacagucacagcacugcacuguggugcggcuucaugugauaugacaguggaugcuaaggugag

SEQ ID NO: 621188 - RNA, 63 nt, hsa
cagcaugaauugagucucauccauaucugagugaugugauauugagaugacacuuuggaguuu

SEQ ID NO: 621189 - RNA, 63 nt, hsa
uuauauacuaccguagcacuguagcuauuuuuuaugugauaaucuuguuugauaaaaaaguaa

SEQ ID NO: 621190 - RNA, 63 nt, hsa
caagauaauucauacuggagagaaauccuacaaaugugauaaauguggcaaagccuuuaacug

SEQ ID NO: 621191 - RNA, 63 nt, hsa
ucauaguguugagaaauccuagaaaugugaagaaugugauaaaguuuuaaaugguugucacac

SEQ ID NO: 621192 - RNA, 63 nt, hsa
uuauacuggugagaaauucuagaaauguaaagaaugugauaaaggcuuuacaugguugucaca

SEQ ID NO: 621193 - RNA, 63 nt, hsa
ucauacuggagagaaacccuacaaaugcgaagaaugugauaaagacuucaacuguuccucaca

SEQ ID NO: 621194 - RNA, 63 nt, hsa
caaaugcugucucuugugaaauagaugaauaaaaugugauaguaacauaguagaguacucucu

SEQ ID NO: 621195 - RNA, 63 nt, hsa
uuucaagugacaagcaaaguaaauguauauauuaugugauaaaucauguuuucaagaacguca

SEQ ID NO: 621196 - RNA, 63 nt, hsa
gaagaagccaccuuggacauguagccccagcagaugugauauagagaagaaacaggaaacuug

SEQ ID NO: 621197 - RNA, 63 nt, hsa
gcaucauguccaauguccagauggccagaaugaaugugauaguucagaccaaugccuuccacu

SEQ ID NO: 621198 - RNA, 63 nt, hsa
gaauccauacuaaagagcauuuauaauaauuauaugugauagagauuuuccgcaggccaaagu

SEQ ID NO: 621199 - RNA, 63 nt, hsa
uuuuauuucguaaagagguaccaacugucgcugaugugauaugucagaacugaagaguaaauc

SEQ ID NO: 621200 - RNA, 63 nt, hsa
auuccuccauuucgccagcacaagucuugcuaaaugugauacuguugacauccuccagaaugg

SEQ ID NO: 621201 - RNA, 63 nt, hsa
gcugugacuagaaccauaaaucuuaaaggggguaugugauaauagagggcuggaauuuaaacc

SEQ ID NO: 621202 - RNA, 63 nt, hsa
auguuguauggaaauuauaguucaauuauuuuaaugugauagagugcaacaagucauuguaga

SEQ ID NO: 621203 - RNA, 63 nt, hsa
gcgauggacaauuaugauagcuuauguagcugaaugugauacaugccgaaugccacacguaaa

SEQ ID NO: 621204 - RNA, 63 nt, hsa
caccacuugguuuuauuuuucuaagugcaugugaugugauagaguguguggggcucugugucc

SEQ ID NO: 621205 - RNA, 63 nt, hsa
ucagcugaggaggauguaugucaccucaggaccaugugauaauugcguuaacugcacaaauug

SEQ ID NO: 621206 - RNA, 63 nt, hsa
uaacauuuugaagaauuccuuuuguguuuuaaaaugugauauauauauauauaaaauuccuag

SEQ ID NO: 621207 - RNA, 63 nt, hsa
cuacaaacuuuuauaaauguuuuaaagaaguccaugugauaauuguaaaggugaugaauuuac

SEQ ID NO: 621208 - RNA, 63 nt, hsa
acccagugucugucucccacgacaggccaagggaugugauaguguuguugggaggggguagaa

SEQ ID NO: 621209 - RNA, 63 nt, hsa
uaaaauuuaacucaaaauguauaacggacuuaaaugugauacauaaaacuagauaacuuugaa

SEQ ID NO: 621210 - RNA, 63 nt, hsa
gaauuaccaucucagaagucaagcugauggaguaugugauaaagugaauguacauguauauac

SEQ ID NO: 621211 - RNA, 63 nt, hsa
uuaaaauuaaaauauucugcaguugggagugaaaugugauagcacauacguugacauuaugca

SEQ ID NO: 621212 - RNA, 63 nt, hsa
aaaauauaacuucuugauuuauuguuuuuuaagaugugauaugguacugugguuauguuguuu

SEQ ID NO: 621213 - RNA, 63 nt, hsa
aaaucuuugaauuuuaauuuuacucuuuuauacaugugauaauuucauaaagugagggauccc

SEQ ID NO: 621214 - RNA, 63 nt, hsa
uaauuuugcaaauaaacuauuaauaaauauuauaugugauaaauucuaaauuaugaacauuag

SEQ ID NO: 621215 - RNA, 63 nt, hsa
ugaguaaaaacaaaaaaaaacaaaugacaaagaaugugauagcucauauuuuagaaauggcuu

SEQ ID NO: 621216 - RNA, 63 nt, hsa
caauccuacacuacagauuucaguuuuuagaaaaugugauaauaauauugauauuuaguuucu

SEQ ID NO: 621217 - RNA, 62 nt, hsa
uauuuaaaauuuuuuugccaauggugccaaguaaugugaaugcuaauacugcuuaagaaaau

SEQ ID NO: 621218 - RNA, 62 nt, hsa
guucucuucuguuacugauauguaaguguggcaaugugaacugaagcugaugggcugagaac

SEQ ID NO: 621219 - RNA, 62 nt, hsa
ggccagagccaagaaacacuuucagaaaaacaaaugugaaggggagagacaggggccgcccu

SEQ ID NO: 621220 - RNA, 62 nt, hsa
uaauaugcuaaccugaugcacugcugaaagaaaaugugaauuuuucguaauaauugcauuuu

SEQ ID NO: 621221 - RNA, 62 nt, hsa
auuccugcaaagcuugcuuuggggaguuggauaaugugaaaauuuuaaguaccuaggggaga

SEQ ID NO: 621222 - RNA, 62 nt, hsa
aaguuuauguaguacuuaauguacaugauaugaaugugaagcauaaaauuaaauaaaauuuu

SEQ ID NO: 621223 - RNA, 62 nt, hsa
acuccugauguuuuuucuacaaaaguccauaaaaugugaaaacuggagaagaucuuagaggu

SEQ ID NO: 621224 - RNA, 62 nt, hsa
cggcuugugaaaaguuguuaaacaacaugcuaaaugugaaaugucaacccucacucuaaacu

SEQ ID NO: 621225 - RNA, 62 nt, hsa
aagggaacauaauuuguuuaggcucccacauaaaugugaaucuggccaacaacuuugguuca

SEQ ID NO: 621226 - RNA, 62 nt, hsa
cuguuauuauacuuaaucuucuaaacuaaacuaaugugaacaguagggaagcaagggcccaa

SEQ ID NO: 621227 - RNA, 62 nt, hsa
uuucauuaccuccuacuugccauucacccaucaaugugaaagucagggucacagcuggucug

SEQ ID NO: 621228 - RNA, 62 nt, hsa
uacuuucuuccuugccuaugcagggcaaacaaaaugugaaauucugcccucagcugagcuga

SEQ ID NO: 621229 - RNA, 62 nt, hsa
gcuguauuccuaaacaaauuguuuccuaaacaaaugugaaaaugugaacagugcugaaaggu

SEQ ID NO: 621230 - RNA, 62 nt, hsa
ccuaaacaaauuguuuccuaaacaaaugugaaaaugugaacagugcugaaagguuuugugaa

SEQ ID NO: 621231 - RNA, 62 nt, hsa
aaaguucauuauuuauuuuaccuuuuacugacaaugugaaacucgaagaaaauguucucuuu

SEQ ID NO: 621232 - RNA, 62 nt, hsa
guuaacauauguucggacugcuucccuucaccaaugugaacaacuuuuuuucccaaacagug

SEQ ID NO: 621233 - RNA, 62 nt, hsa
guguaaaguuuaacacgguuugacaguaaauaaaugugaauuuuuucaaguaguuaacaugu

SEQ ID NO: 621234 - RNA, 62 nt, hsa
auuagaguaccaacuuaauguuuuucucgaagaaugugaaaauaauuagaccuguuaaauua

SEQ ID NO: 621235 - RNA, 62 nt, hsa
guuuuguuuuguuuuucucuuucacucagccaaaugugaaaguugugaauuuaggaaaauca

SEQ ID NO: 621236 - RNA, 62 nt, hsa
gcaauuugaaauauauucugguuguuuuucuaaaugugaagacuuaccaaaugaauuuuaga

SEQ ID NO: 621237 - RNA, 62 nt, hsa
acuuuccaggaagaaaagagggcaaagggaacaaugugaaaagaagcagaaaaucauaaaag

SEQ ID NO: 621238 - RNA, 62 nt, hsa
auuauaauuaguuccucauuagcauuuugcuaaaugugaaugaugauccuaggcauuugcug

SEQ ID NO: 621239 - RNA, 62 nt, hsa
ggguaacuagggaagauaauauuaaggaagacaaugugaaaagaaaaaugagccuggcaaga

SEQ ID NO: 621240 - RNA, 62 nt, hsa
aagcugaggauccucacaggagcagacagagaaaugugaagggugggguuuuauguguggga

SEQ ID NO: 621241 - RNA, 62 nt, hsa
gagacuugccuuuuaaggaucgaaaguacgccaaugugaauuuccauuauuuucaauggaag

SEQ ID NO: 621242 - RNA, 62 nt, hsa
gcuuuggaaauuuaauguuaguugaaauguaaaaugugaaaacuuuagaucauuuguaguaa

SEQ ID NO: 621243 - RNA, 62 nt, hsa
gguuucuauauuuugagauguuuuuuccuuacaaugugaacucaucgugaucuuggaaauca

SEQ ID NO: 621244 - RNA, 62 nt, hsa
uaguuuaaaaaauuauaaaugaaucuaaucaaaaugugaauaguagucaaaaggauaauuua

SEQ ID NO: 621245 - RNA, 62 nt, hsa
uugaauugaaugucuauaaggucuaaagguagaaugugaauauugccacagaguucauugcu

SEQ ID NO: 621246 - RNA, 62 nt, hsa
ggauacaguuuguuuuuagauguccuuuguccaaugugaacauuuauucauauuguuuugau

SEQ ID NO: 621247 - RNA, 62 nt, hsa
uuuggugccuuacuuuuaucuuaauuuuugccaaugugaaaauuaaggauaaaucagaguua

SEQ ID NO: 621248 - RNA, 62 nt, hsa
aauuuuggguuaaagguuuuggcugcuguaagaaugugaauuugaauguauuuugaauugua

SEQ ID NO: 621249 - RNA, 62 nt, hsa
uuugcugguuaaccuuuaucauuuaucuuuguaaugugaacaugcuucagaguguaccuuuu

SEQ ID NO: 621250 - RNA, 62 nt, hsa
aauucccuuuuucuaaggcacagagcugguaaaaugugaaguaauagugaaccuaacaguca

SEQ ID NO: 621251 - RNA, 62 nt, hsa
ccggauguugaaacaaccacaggucaagaaggaaugugaaucuguuguuuuauaagaguuua

SEQ ID NO: 621252 - RNA, 62 nt, hsa
uaggaggaucuagggacagaaggaaagugaaaaaugugaaaauacaaaauacccaagauuua

SEQ ID NO: 621253 - RNA, 62 nt, hsa
cagcuucagcaguguugaacuguguguuuaaaaaugugaauuacuguuauuguauacuguaa

SEQ ID NO: 621254 - RNA, 62 nt, hsa
augcaguguugcgguggcacugaagaagugugaaugugaaggcggcgucggcgcggggccag

SEQ ID NO: 621255 - RNA, 62 nt, hsa
cucuggugcuuuaguuaggucauuuuuuuagaaaugugaagaggucugauuggcugcuuaaa

SEQ ID NO: 621256 - RNA, 62 nt, hsa
gugccauuuagagggaacucuugguaccuggaaaugugaaucuggaauauuaccugugucau

SEQ ID NO: 621257 - RNA, 62 nt, hsa
aguauuaggcuuugggguggggggaggucuguaaugugaaacaacuucuugucuuuuuuucu

SEQ ID NO: 621258 - RNA, 61 nt, hsa
cgugaugcucaggcuugaaaugcauuauuuugaaugugaaguaaauacuguaccuuuauug

SEQ ID NO: 621259 - RNA, 62 nt, hsa
caccuucccugacucagaacccacauccacucaaugugaacucuacuaccacgaccucccca

SEQ ID NO: 621260 - RNA, 62 nt, hsa
acugcuuguuuugcacaagaagugauuuugugaaugugaaguggagaggccgagcagcagcc

SEQ ID NO: 621261 - RNA, 62 nt, hsa
uuugggguuacuucuuuguuucuaaguauaagaaugugaagaauauuugaaaacucaaugaa

SEQ ID NO: 621262 - RNA, 62 nt, hsa
uccaccagccccucacaggcuuggggguuuucaaugugaaacacaugccaguuuuuaaaaug

SEQ ID NO: 621263 - RNA, 62 nt, hsa
agaaacauagacucccaaguuuuaaacaccuaaaugugaauaacccauauauacaacaaagu

SEQ ID NO: 621264 - RNA, 62 nt, hsa
gagauauaaaaguaggaaacagguauaauuuuaaugugaaaauuaagucuucacuuucugug

SEQ ID NO: 621265 - RNA, 62 nt, hsa
aauaaccaggugugagcuacaggucucuguguaaugugaagcucucccguauuucauuucug

SEQ ID NO: 621266 - RNA, 62 nt, hsa
uuaauuuggauccuuuggguuuggagaaagggaaugugaaagcugucauuacagacaacagg

SEQ ID NO: 621267 - RNA, 62 nt, hsa
ucuaaaugggauuuugaguucuccagcuauagaaugugaaugagauaaaaagugaacuaucu

SEQ ID NO: 621268 - RNA, 62 nt, hsa
gccauuuccuguccuggaauuaguuuuucuaaaaugugaauaaacuuguuuuauaaaaagca

SEQ ID NO: 621269 - RNA, 62 nt, hsa
aauugauuugcugaauuuuucugcuaguucaaaaugugaauuaggaccuggucaguuugaaa

SEQ ID NO: 621270 - RNA, 62 nt, hsa
auuagauaauagauggggucaaauucugugugaaugugaacuugccuaguaagcacuuuguc

SEQ ID NO: 621271 - RNA, 62 nt, hsa
ugugugaggcaaacuaugcaugggaauagcuuaaugugaagauaaucauuuggacaacucaa

SEQ ID NO: 621272 - RNA, 62 nt, hsa
uuugcauuaaaauauagaagucuuuuaaaguaaaugugaaccuugucuaaguacuguaaucc

SEQ ID NO: 621273 - RNA, 62 nt, hsa
uuccccuccacuugcugccaagaucauauucuaaugugaaaugucauagguguucaaaagcg

SEQ ID NO: 621274 - RNA, 62 nt, hsa
ugggggaaaauuauuuugacaugacgugguaaaaugugaaaaacuaaugugucucaggcuca

SEQ ID NO: 621275 - RNA, 62 nt, hsa
aauaauucuacagaaauaaaacuguaaagugcaaugugaaaucaaagauuauagucauugua

SEQ ID NO: 621276 - RNA, 62 nt, hsa
uuuuaggaaaagugaaucuugcuguuuucaauaaugugaaugcuauguucugggaaaaucca

SEQ ID NO: 621277 - RNA, 62 nt, hsa
ucuucucaaguuucaagcaagaccauuuacuuaaugugaaguuuuggaaaguuauaaaggug

SEQ ID NO: 621278 - RNA, 62 nt, hsa
uuuucaguauuuuaaauaaaauuuuguaaaguaaugugaauuaaaaauuuuggaacaauuag

SEQ ID NO: 621279 - RNA, 62 nt, hsa
uucccugugaguaaugcuuauggaaucugacaaaugugaaugagcugccauuggugggaauc

SEQ ID NO: 621280 - RNA, 62 nt, hsa
cacacugguccugcagcuuauugaaucagagaaaugugaagauaagaugaacuaaacaaaca

SEQ ID NO: 621281 - RNA, 62 nt, hsa
gcagcuacugacugaauaaccacuuuuaaaggaaugugaaauuuaaauaauagacauacaga

SEQ ID NO: 621282 - RNA, 62 nt, hsa
gggcccccaucggagcccugcaaauuccgagaaaugugaaacuugguggggucagggaggaa

SEQ ID NO: 621283 - RNA, 62 nt, hsa
auaggaauccuuuuuuuuuuuuuuaaagacuaaaugugaaaaaauaaucacuacuuaagcua

SEQ ID NO: 621284 - RNA, 62 nt, hsa
cugacucuuugcucuaauuuuggaaaaaaagaaaugugaagggucaacuccaacguaugugg

SEQ ID NO: 621285 - RNA, 62 nt, hsa
auuacguuguuucuuauagauuuuuuaaaaaaaaugugaaauuuuuccacacuauguguguu

SEQ ID NO: 621286 - RNA, 62 nt, hsa
uuucaaaaauuaaagaccuacaucacaggguuaaugugaagaaagcuuuauuuuucaaauga

SEQ ID NO: 621287 - RNA, 62 nt, hsa
caugaauuuguaaugucuugagcucuauuaugaaugugaagccuuccccuuauccucccugu

SEQ ID NO: 621288 - RNA, 62 nt, hsa
ugcuugccaguacugccaaagcacugcugugaaaugugaaguacuuuguuuuuuuauuuuua

SEQ ID NO: 621289 - RNA, 62 nt, hsa
aagaugcagguuuaagaaguuaauauuuauaaaaugugaaagacacaguuacuaggauaacu

SEQ ID NO: 621290 - RNA, 62 nt, hsa
aaguugaaaugcaaaaauacuaauuagagaauaaugugaauaaaaugggaaucuucuuggua

SEQ ID NO: 621291 - RNA, 62 nt, hsa
guguucuaaguggaaggagaguuacugaagggaaugugaauuuuuaccguuuguacuuaaga

SEQ ID NO: 621292 - RNA, 62 nt, hsa
uucuggcagugugggauggaugaaugaaguggaaugugaacuuugggcaaguuaagugggac

SEQ ID NO: 621293 - RNA, 62 nt, hsa
uagugaacuuauuuucaguagacauagaaaacaaugugaauauuuaaggucugugacuauag

SEQ ID NO: 621294 - RNA, 62 nt, hsa
guuauuauuaacauuuauuuauuauuuuucuaaaugugaaagcaauacauaauuuagggaaa

SEQ ID NO: 621295 - RNA, 62 nt, hsa
aacuugcguucuguuaauggugccgaaauaacaaugugaaccugagacuggccugcaugaau

SEQ ID NO: 621296 - RNA, 62 nt, hsa
uggagccuuuacagaagcaucacauuuaaaccaaugugaauucaaaaaagagaaggaaacuu

SEQ ID NO: 621297 - RNA, 62 nt, hsa
acccuccccugcaaguuuguagcucaaguuguaaugugaaagucauauuuuauuuguggcau

SEQ ID NO: 621298 - RNA, 62 nt, hsa
ugaaaaguccaucuugcugauuugaugauugaaaugugaaagugaaguggaaggaaugaaug

SEQ ID NO: 621299 - RNA, 62 nt, hsa
guaggucaaaucaaauuaaagaugauuuuuuuaaugugaauaaaguuauguucugauaguuu

SEQ ID NO: 621300 - RNA, 62 nt, hsa
acauguugcuuuguauaaaaaucuuauuuauaaaugugaagcuuuuugaugccaucaaaacu

SEQ ID NO: 621301 - RNA, 62 nt, hsa
cagacuucguggguuuuguuuuuaagcaaaacaaugugaaaacauuuaaguuugaaauguug

SEQ ID NO: 621302 - RNA, 62 nt, hsa
aggaguccugggucccuggccuccaaagcuggaaugugaacgcaugccacgguggucugacc

SEQ ID NO: 621303 - RNA, 62 nt, hsa
auuuuuuagacuuaaguuuuaucuucugucagaaugugaaaaguucugcccaguuucugagc

SEQ ID NO: 621304 - RNA, 55 nt, hsa; identical to SEQ ID NO: 450960

SEQ ID NO: 621305 - RNA, 62 nt, hsa
ggaaaaaaaaguauggaggccuuauuuucaaaaaugugaaauauaaggcacguuuucacaca

SEQ ID NO: 621306 - RNA, 62 nt, hsa
aggggcaggccuuuuugagccaaucccaccauaaugugaauaugccagugacugcugcgcug

SEQ ID NO: 621307 - RNA, 62 nt, hsa
uccuugcugucaucccacauagcccuggggugaaugugaauccagagucuauuuuucuaaau

SEQ ID NO: 621308 - RNA, 62 nt, hsa
ugaauuucuuucagcuuuuuguucacauaaagaaugugaaauuuuuacagaaucagacagau

SEQ ID NO: 621309 - RNA, 62 nt, hsa
caagauuaagaggccaggaagagguuagacgcaaugugaaacuguccuccuaggauaagguu

SEQ ID NO: 621310 - RNA, 62 nt, hsa
caaguuguacauuuguguaugaacugacauaaaaugugaaagccuguaaguguacauguagu

SEQ ID NO: 621311 - RNA, 62 nt, hsa
accuuuucucagaaugguuuccugauugugucaaugugaaaguuaaauaaaauuuaugugcc

SEQ ID NO: 621312 - RNA, 62 nt, hsa
caacuugccuugaugucugagcuuuccagugcaaugugaauuugagcagccagaaaucuauu

SEQ ID NO: 621313 - RNA, 62 nt, hsa
uuuccuucuaaacaaggacaaaugagaccagcaaugugaacuguauuuacauaaacgugcaa

SEQ ID NO: 621314 - RNA, 62 nt, hsa
caaauuucuugugguuuguacagauuuguuaaaaugugaacguuuucuaacugccucguagg

SEQ ID NO: 621315 - RNA, 62 nt, hsa
cccccccccccccaugaaaugcagguucacuaaaugugaacagcuuugcuuuucacgugauu

SEQ ID NO: 621316 - RNA, 62 nt, hsa
accucucugagccucaguugucucuucuguaaaaugugaaaagaugugcucccaccacaugc

SEQ ID NO: 621317 - RNA, 62 nt, hsa
gagugguuaguaaacugcacuguuucugugauaaugugaaaugagaaguauuuacauuggag

SEQ ID NO: 621318 - RNA, 62 nt, hsa
aguuugucaauccuuguuuuagaagauggaaaaaugugaagaucuuuggagauucucuugag

SEQ ID NO: 621319 - RNA, 62 nt, hsa
aaaaacaaauuguguuuuauugcgguaucaacaaugugaauaaggauuaacauauuguaaau

SEQ ID NO: 621320 - RNA, 62 nt, hsa
ugagagaaaaggaauguugcacaaggguugugaaugugaaagggggaauggaggaauggaaa

SEQ ID NO: 621321 - RNA, 62 nt, hsa
ccugccuuuuacuagcuacuuuagaaauagaaaaugugaagagugacuauuuacauguauac

SEQ ID NO: 621322 - RNA, 62 nt, hsa
gggauagguccuugggucaaaaguuguaaauaaaugugaaacaucuucucaugcaauuauuu

SEQ ID NO: 621323 - RNA, 62 nt, hsa
cuguagagaucaucuuuacaguuccucgggaaaaugugaaugugcugcguuuuguuuucuuu

SEQ ID NO: 621324 - RNA, 62 nt, hsa
caaccugauggcauuaauucugugguuggggaaaugugaaagugaaaucgauaauaccacag

SEQ ID NO: 621325 - RNA, 62 nt, hsa
acucuauuuuuaaagaucacaaaguaauuuuaaaugugaacagguucccauaccaugaaugc

SEQ ID NO: 621326 - RNA, 62 nt, hsa
agcacugacaaaggauaugguacuaaaaauaaaaugugaaaugucaaagacaugucagugcu

SEQ ID NO: 621327 - RNA, 62 nt, hsa
uccacuaauuuugcaugcguauuuauaagaaaaaugugaauuuggugguuuuauucuaucgg

SEQ ID NO: 621328 - RNA, 62 nt, hsa
aaagaaauaauugaccaaguaaguuugcauaaaaugugaauacuaaauguguccccaguugc

SEQ ID NO: 621329 - RNA, 62 nt, hsa
auuuaaacacauuugaaacauacaaaaauagaaaugugaaagcauuuggugaaagccaaagc

SEQ ID NO: 621330 - RNA, 62 nt, hsa
caggaagacuuccagcuuucucuuuguucuucaaugugaaacugagaccaagucucucuaag

SEQ ID NO: 621331 - RNA, 62 nt, hsa
ucucuuuuuaauggagauugaaaagggagaauaaugugaauaucacggcuuauauuauuaaa

SEQ ID NO: 621332 - RNA, 62 nt, hsa
ucaucaucccaggggagaacuacauugggauaaaugugaagaaggcuuuuaagguaggucau

SEQ ID NO: 621333 - RNA, 62 nt, hsa
uuuuuacagacaacaucgaguaauggcuuguaaaugugaauuuugccagaggugguuuuuga

SEQ ID NO: 621334 - RNA, 62 nt, hsa
caauuugugggaacaggaggggagaggaaacaaaugugaaguuguggacucuacccaggcag

SEQ ID NO: 621335 - RNA, 62 nt, hsa
cuuugagaaucucauacaucugugaaaaagauaaugugaaauaaacaguaaaaaaaaaaagu

SEQ ID NO: 621336 - RNA, 62 nt, hsa
uacaggauuugaacucagaucugucugauaggaaugugaaagcacggacucuuacugcuaac

SEQ ID NO: 621337 - RNA, 62 nt, hsa
augaaaccucuguggcucuuucgaaacgugaaaaugugaagaaagcuacuaacuuagcugua

SEQ ID NO: 621338 - RNA, 62 nt, hsa
ggagcugauggcucacugggcucuuggaggggaaugugaagaaaccaaggagucacuuuuuc

SEQ ID NO: 621339 - RNA, 62 nt, hsa
uauugugguagcauguucaaaauccaacaaguaaugugaauuuuagauguaaauaucugcca

SEQ ID NO: 621340 - RNA, 62 nt, hsa
uuugguaccuuaauuugacuguccucgcagagaaugugaacauguguguguguuguguuaau

SEQ ID NO: 621341 - RNA, 62 nt, hsa
aagguaacuuauuucucuucugcacagagcauaaugugaaguuuuauaccuacuuuuaaaau

SEQ ID NO: 621342 - RNA, 62 nt, hsa
caggaggguuuuuaaaaaguguuuaaaugucaaaugugaauuggugaugggugauggagggu

SEQ ID NO: 621343 - RNA, 62 nt, hsa
cucuacuccucaugacaugaagaaaaagacugaaugugaagggaguuucuguacuguaagcu

SEQ ID NO: 621344 - RNA, 62 nt, hsa
guuugagugcuucagauacauuuuucagauacaaugugaagacauugaagauaugugguccu

SEQ ID NO: 621345 - RNA, 62 nt, hsa
auuguacuccuuccuuggagcugaaugcaaggaaugugaauucugaggaauuaagguagaau

SEQ ID NO: 621346 - RNA, 62 nt, hsa
uguuuugauuuuuuuugcuacugugcaaguuuaaugugaauaaaaucuuuguggaaugauga

SEQ ID NO: 621347 - RNA, 62 nt, hsa
ccucuuccuccccaccccacugcccccaccuuaaugugaauuugacugaugaaugaagagcg

SEQ ID NO: 621348 - RNA, 62 nt, hsa
auggcaagaauguucuaguaaauguguaccaaaaugugaauuacuuuguacgauuacagucu

SEQ ID NO: 621349 - RNA, 62 nt, hsa
uuucccauagggcauuaguucucagauuuuggaaugugaaauaaucaccuaggaaguugguu

SEQ ID NO: 621350 - RNA, 62 nt, hsa
aauaccuuuuuuugcaucuuuuuucaaaguuuaaugugaacuuuuagaaaagugauuaaugu

SEQ ID NO: 621351 - RNA, 62 nt, hsa
uucaaccuacuuucauacugaagaugcagcaaaaugugaaugggaaaagagauggccugaga

SEQ ID NO: 621352 - RNA, 62 nt, hsa
aguucucuuaucuuugaucguauauuucucauaaugugaaauaugaugagauucacuuaggg

SEQ ID NO: 621353 - RNA, 62 nt, hsa
cagccauuuuuuuaguuaguaaaaauccuauuaaugugaaccagccaggaauaacaguguua

SEQ ID NO: 621354 - RNA, 62 nt, hsa
uggcaauuugucuuuuaagucuuaaccuugcuaaugugaauacugggaaagugauuuuuucu

SEQ ID NO: 621355 - RNA, 62 nt, hsa
agaaaaguaugugauuuuuaccuuuuuuaacaaaugugaaaaagucaguuuuagaaauuucg

SEQ ID NO: 621356 - RNA, 62 nt, hsa
uguuaaaaaaaaaaaaaaucuuaaauuccuacaaugugaaacugaaacuaauaauuugaucc

SEQ ID NO: 621357 - RNA, 62 nt, hsa
uauuugcuuaaaugcuggaaaguaacuguuaaaaugugaaauuguaauuuuuaaaaaggcua

SEQ ID NO: 621358 - RNA, 62 nt, hsa
cuccaggaagaugucuuuguggacccacuaugaaugugaauaacccuuccuacggggaaucu

SEQ ID NO: 621359 - RNA, 62 nt, hsa
acuaauagaucaccuuagaaaauuaugcaauuaaugugaaaauaauugauguuugcaaugug

SEQ ID NO: 621360 - RNA, 62 nt, hsa
uguuacaugauuuuuuaaaaaaaggaaaagaaaaugugaaacacaauuuaguccucauuauu

SEQ ID NO: 621361 - RNA, 62 nt, hsa
cagucuuucuaaaguguguguauguuugugugaaugugaaugauacugaucuuauaucuguu

SEQ ID NO: 621362 - RNA, 62 nt, hsa
uggaauuggagauuguagacgugguuuuacaaaaugugaaaugucuaaauaucuguucauaa

SEQ ID NO: 621363 - RNA, 62 nt, hsa
ggacagaucaaggcacuucaacucauuuggaaaaugugaacacugaugacaugguauaggag

SEQ ID NO: 621364 - RNA, 62 nt, hsa
ugacauuguauguaucuauuuauuaaguucucaaugugaaaaaugugucuguaagauugucc

SEQ ID NO: 621365 - RNA, 62 nt, hsa
ucuauuugaugauaaacuauaaauucauugaaaaugugaauucuauuauggguagccuuuuu

SEQ ID NO: 621366 - RNA, 62 nt, hsa
guaagaauccugaggaccuggagugcaaugagaaugugaaacacaaaaccaaggaguacauu

SEQ ID NO: 621367 - RNA, 62 nt, hsa
cucaguuggcuuugugaagugugaaacccuacaaugugaaaggaaagugcuugcugugaugu

SEQ ID NO: 621368 - RNA, 62 nt, hsa
aaggagggaaaaaccauaaaaggaauacuuauaaugugaagguuuguaaauaguccaugaug

SEQ ID NO: 621369 - RNA, 62 nt, hsa
agcacauuuuauaauuuggaagacacaaaucaaaugugaaggauuugauuuucuacauuuaa

SEQ ID NO: 621370 - RNA, 62 nt, hsa
caaaauaugugaauuugcugcuucugagaggcaaugugaaagagggaguauuacuuuuaugu

SEQ ID NO: 621371 - RNA, 62 nt, hsa
uagucagaaaccauggauuuauuuuacugcacaaugugaaguuuacauuuuauuaacacuug

SEQ ID NO: 621372 - RNA, 62 nt, hsa
uaaagggaacaaauaauguuucauccuauggaaaugugaaggaugaauugagcuccuggccc

SEQ ID NO: 621373 - RNA, 62 nt, hsa
gcccaaaaguaaucgcucuggaguagaaaccaaaugugaauagccacaucuuaccuguaaag

SEQ ID NO: 621374 - RNA, 62 nt, hsa
agcugaagacaaccaagaggcuuaugagaucuaaugugaaaaucaucacucaagaugccucc

SEQ ID NO: 621375 - RNA, 62 nt, hsa
aauugcuuuagcuucuggucagcacugauuaaaaugugaauagugaaguggcuauccuaaac

SEQ ID NO: 621376 - RNA, 62 nt, hsa
uaagccugccgccaaaauaaaucacuuaucaaaaugugaacuguuuuccucauguucaguua

SEQ ID NO: 621377 - RNA, 62 nt, hsa
guuuguuaauguugggauucucugcacuuuugaaugugaaagcuuauaucccugaauucuga

SEQ ID NO: 621378 - RNA, 62 nt, hsa
acggcuuuggagacaaucaaguaacaacugaaaaugugaaaguaaccauaucugacaaaauu

SEQ ID NO: 621379 - RNA, 62 nt, hsa
uaugauucuaaucaagcuguauguagagacugaaugugaagucaagucugagcacaaaaaga

SEQ ID NO: 621380 - RNA, 62 nt, hsa
gcacacuuuauaaccuuaaguuuuuauuugagaaugugaaaguacaaagugcaguagacuuc

SEQ ID NO: 621381 - RNA, 62 nt, hsa
auaaauaugucuaucaaauaccucuguaguaaaaugugaaaaagcuuugaguguuccuucgu

SEQ ID NO: 621382 - RNA, 62 nt, hsa
gaaaaaaaauaagaaagaaagaguuggaugaaaaugugaaagcccaaguuuagaugugcauu

SEQ ID NO: 621383 - RNA, 62 nt, hsa
aaccuccugcuucucccaccuugggaaggagaaaugugaaacccggcagcggccgaccuagg

SEQ ID NO: 621384 - RNA, 62 nt, hsa
acccagggcuuaaccugcuagaaaaugcauggaaugugaacacaaguuaauuauuucaaaau

SEQ ID NO: 621385 - RNA, 62 nt, hsa
cuaauuuaugagaaaauguaauaauugcaaugaaugugaauuauacagacaggcaaacauuu

SEQ ID NO: 621386 - RNA, 62 nt, hsa
acuuguacccgaucauaauaaaaauggauaauaaugugaaggaagaaaagagccgcuugaau

SEQ ID NO: 621387 - RNA, 62 nt, hsa
aguccuaaucuuuacuauccacuucuaaauuuaaugugaauuucauacauguuauuaguugu

SEQ ID NO: 621388 - RNA, 62 nt, hsa
gggaucugcugcugcauuaaaucgggaaagaaaaugugaagauuucauuuggaaucacagaa

SEQ ID NO: 621389 - RNA, 62 nt, hsa
aaauauaagguuuuaauuauacugcugaagcaaaugugaaugccaaagacuacguuuugcag

SEQ ID NO: 621390 - RNA, 62 nt, hsa
ucagcugugucccccaguccgugucuuuuuagaaugugaaugaugauaaaguugugaaauaa

SEQ ID NO: 621391 - RNA, 62 nt, hsa
ugcugaacaccuuguggaagcaaaaaucugaaaaugugaauaaaauuauuuuggauuuugua

SEQ ID NO: 621392 - RNA, 62 nt, hsa
ccauaggugccacaucuaugagauguuugauaaaugugaauaugcuuuuacauuugggcuua

SEQ ID NO: 621393 - RNA, 62 nt, hsa
aaagggagugcuuugugaucuaguaaagcuggaaugugaagcucuuuccuaucauggaaucu

SEQ ID NO: 621394 - RNA, 62 nt, hsa
ugagaaaauuuauacuguagagaaacccuggaaaugugaagaacguggcaaaguucuuuacc

SEQ ID NO: 621395 - RNA, 62 nt, hsa
uaagagaauucauaccggagagaaacuguacaaaugugaagaauauggcaaagccugugaau

SEQ ID NO: 621396 - RNA, 62 nt, hsa
agauaauucauucuggggaaaaaaaugcuacaaaugugaaaaacguggcagagccuucagac

SEQ ID NO: 621397 - RNA, 62 nt, hsa
aaugagaacucauacuggaggaaagucuuacaaaugugaagaauguggcagucuuuaaaucu

SEQ ID NO: 621398 - RNA, 62 nt, hsa
uucugccagcgcauguguccuuucaaggggaaaaugugaagcugaacccccuccagacaccc

SEQ ID NO: 621399 - RNA, 62 nt, hsa
gcacaauauggccuaaacugccauaguuuuagaaugugaaaaaaaugcauguuuacuuaccu

SEQ ID NO: 621400 - RNA, 62 nt, hsa
cucccucuccuuaccacgggucagaccuaaagaaugugaacacuuuuuuuuuuuuuucuggg

SEQ ID NO: 621401 - RNA, 62 nt, hsa
uuagauuuuugaggauuaugugacuaguaauaaaugugaaauaaauuuucaaaaaaguugac

SEQ ID NO: 621402 - RNA, 55 nt, hsa; identical to SEQ ID NO: 451058

SEQ ID NO: 621403 - RNA, 62 nt, hsa
cuuauuuucauuuccaaacaacuacuaugauaaaugugaagaagauucuguuuuuuugugac

SEQ ID NO: 621404 - RNA, 62 nt, hsa
uagagccagaaguaacuuugucccaguccuacaaugugaaaagagugaauaguugccucuuu

SEQ ID NO: 621405 - RNA, 62 nt, hsa
uaugcacacacacacagauaaugcuuccagugaaugugaacuucuuuucccuguggcacuga

SEQ ID NO: 621406 - RNA, 62 nt, hsa
cauucguuagucuacauguuucuaaacauauaaaugugaauuuaaucaauuccuuucauagu

SEQ ID NO: 621407 - RNA, 62 nt, hsa
auuguaagacuuuugagaauauacuugauuaaaaugugaaagaagggauuguuaacuuauug

SEQ ID NO: 621408 - RNA, 62 nt, hsa
auauaauguuaauuuauugacuaguuugaaauaaugugaaguguuuuuuauaucagauuaau

SEQ ID NO: 621409 - RNA, 62 nt, hsa
uacgggguugauucugaccauaggaaguaugcaaugugaaucacuauuuacagagaaaccua

SEQ ID NO: 621410 - RNA, 62 nt, hsa
uucacuuuuggcgacuagaaacaauuccaguaaaugugaaucucgacaaaucgaggacugaa

SEQ ID NO: 621411 - RNA, 62 nt, hsa
aacgagcgaacaacugagcccaagccggugagaaugugaaacaguuucucaaaggaaagaau

SEQ ID NO: 621412 - RNA, 62 nt, hsa
ucuugcacaaaagugaucguuuucuuccaaacaaugugaauuuaaaaggucacacaaaagaa

SEQ ID NO: 621413 - RNA, 62 nt, hsa
gggaaugugugaaaauaauuggauuuuuaaacaaugugaauaaagaggcuuguguuuugauu

SEQ ID NO: 621414 - RNA, 62 nt, hsa
ggauacaguguaaaccagauccauauaaggugaaugugaaaugggagucuucugagggugau

SEQ ID NO: 621415 - RNA, 62 nt, hsa
uagaaaaauugcauuggaauagauuuuauuuaaaugugaaccaucaacaaccuacaacaaga

SEQ ID NO: 621416 - RNA, 62 nt, hsa
uguacaauuaacugaagaauugauaauaacugaaugugaaacaucaauaaagaccacuuaau

SEQ ID NO: 621417 - RNA, 62 nt, hsa
uuuguauucaaaugacgauuauuuuucuacucaaugugaauaucccuggccagccuuuccac

SEQ ID NO: 621418 - RNA, 62 nt, hsa
acuugucaaauagauccugaauccaacagacaaaugugaacuauucuaccacccuuaaaguu

SEQ ID NO: 621419 - RNA, 62 nt, hsa
aaauuuguaccuaugugacagacauuuucaauaaugugaacugcugauuugauggagcuacu

SEQ ID NO: 621420 - RNA, 62 nt, hsa
aguucucucacaccaagggccccauaguuauaaaugugaaauuauauuccaggucaaaauuu

SEQ ID NO: 621421 - RNA, 62 nt, hsa
uaaauuuaaaaugcagagagaccaaugguuaaaaugugaauaguauuguaacuauuuuaagg

SEQ ID NO: 621422 - RNA, 62 nt, hsa
guacaaaaaagcuuaucauaaauuauuucaugaaugugaauagauuucuggccuugaggacg

SEQ ID NO: 621423 - RNA, 62 nt, hsa
ucuuauuuuucuguaaaauauuucacaucccaaaugugaagaagugaaaaagacuucgcagc

SEQ ID NO: 621424 - RNA, 62 nt, hsa
cauccacugaugaacaugcaaacuuugggcauaaugugaacuaaaauugaaauggaaaaugu

SEQ ID NO: 621425 - RNA, 62 nt, hsa
gugauaugucugagacugaaugcgggagguucaaugugaagcuguguguggugucaaaguuu

SEQ ID NO: 621426 - RNA, 62 nt, hsa
ugcaaugggauacuuauuaaauaauuaauaagaaugugaauaagugucauacuuuugugauu

SEQ ID NO: 621427 - RNA, 62 nt, hsa
ggaugaaaauaaugggaguauaauacccauuuaaugugaaaaacauaagagucuuaaaagaa

SEQ ID NO: 621428 - RNA, 62 nt, hsa
guacgcucuaugcauaguaugacuucuauuuuaaugugaagaauuuuuugucucucuccuga

SEQ ID NO: 621429 - RNA, 62 nt, hsa
aucuuauacuuaguaugaguccuaaaauuaaaaaugugaaacuguuguacuauacguauaac

SEQ ID NO: 621430 - RNA, 62 nt, hsa
aauacaacucuuuuuuuuaaaccaggaaggaaaaugugaacauggaaacaacuucuaguauu

SEQ ID NO: 621431 - RNA, 62 nt, hsa
gaauuuucuaagacaguccucuggauccucuaaaugugaauuuugauguaauaacugcuaau

SEQ ID NO: 621432 - RNA, 62 nt, hsa
cuuaaaaaggcucagguuuuugaccaaaauacaaugugaauuuauucugacauuccuaaaau

SEQ ID NO: 621433 - RNA, 62 nt, hsa
cagaauugaaaaagauaaacacucaaccaaacaaugugaaaacggguucuguaguauuugua

SEQ ID NO: 621434 - RNA, 62 nt, hsa
aauuugaguuguucaggcuacugaaacauuaaaaugugaauucccaaacuuuucuuuuuggc

SEQ ID NO: 621435 - RNA, 62 nt, hsa
augugaagacucugcuaauauagguauuuuagaaugugaauugaagaauggaucccaaaaac

SEQ ID NO: 621436 - RNA, 62 nt, hsa
caaaugaaguaguguuaaccucaaauaggcuaaaugugaacaaauaaaauacagcaaauacu

SEQ ID NO: 621437 - RNA, 62 nt, hsa
acgcuuuacuaagccucggcuucuucaucuauaaugugaaggguuuaauaacaugagucccc

SEQ ID NO: 621438 - RNA, 62 nt, hsa
acuguagcuuauauucuuuauuugugcauaccaaugugaaaauccacucuuuuauuauguug

SEQ ID NO: 621439 - RNA, 62 nt, hsa
aaguaauagcguaaaguaaaguaugauauggaaaugugaaguuugcaagagaaugauuucca

SEQ ID NO: 621440 - RNA, 62 nt, hsa
uugccugggaguagagauaaagacacaaaccgaaugugaaauaccagguaauaauuauuuug

SEQ ID NO: 621441 - RNA, 62 nt, hsa
ugugugugugcucaggcaauuauuuugcuaagaaugugaauucaagugcagcucaauacuag

SEQ ID NO: 621442 - RNA, 62 nt, hsa
agguggaguggaugccucagaacggacgagauaaugugaacuagcuggaauuuuuuauucuu

SEQ ID NO: 621443 - RNA, 62 nt, hsa
aaaaaccccaaacuguugauuauuagccagguaaugugaauaaauucuauaggaacauauga

SEQ ID NO: 621444 - RNA, 62 nt, hsa
gaaggguugucacauuauaaaaucuuuaggaaaaugugaacuggaaaacgcuucggucaguu

SEQ ID NO: 621445 - RNA, 62 nt, hsa
auaguuaagcaauuucaaaaaugcuccaaagaaaugugaaaggaccuuuugucacagcacuu

SEQ ID NO: 621446 - RNA, 62 nt, hsa
uaaugcggcccccuuccccagagcuuaccucgaaugugaaaucccuacuucuuauaaugcag

SEQ ID NO: 621447 - RNA, 62 nt, hsa
auggaugauuuaagugucucacuaaagcaugaaaugugaauuuuuauuguuguacauacgau

SEQ ID NO: 621448 - RNA, 62 nt, hsa
caaauaaagggcuguuucuacagguaacauuaaaugugaacucaacacuuccagagucuuua

SEQ ID NO: 621449 - RNA, 62 nt, hsa
acaccacuaaagaaacgaucagacagaucuggaaugugaagcguuauagaagauaacuggcc

SEQ ID NO: 621450 - RNA, 62 nt, hsa
ucuugauuaaaaguuauguaauaaccaaaugcaaugugaaauauuuuacuggacucuauuuu

SEQ ID NO: 621451 - RNA, 62 nt, hsa; identical to SEQ ID NO: 621449

SEQ ID NO: 621452 - RNA, 62 nt, hsa; identical to SEQ ID NO: 621450

SEQ ID NO: 621453 - RNA, 62 nt, hsa
cagaugugagcuucuauuuguuuagaagcauaaaugugaauuauauacaguuugaauuuugc

SEQ ID NO: 621454 - RNA, 62 nt, hsa
cugaaaagcgaauagcaguguuuucagaaacaaaugugaaagcagucaaauuaaguagauac

SEQ ID NO: 621455 - RNA, 62 nt, hsa
caccaggagacggccacagacacacacugcuaaaugugaagauggaacuaaacuggaaauua

SEQ ID NO: 621456 - RNA, 62 nt, hsa
guuauaaagaaauacacuaaggagagguaguaaaugugaaccuuguugcaguguauaaggug

SEQ ID NO: 621457 - RNA, 62 nt, hsa
uacuguuacuaaaagcuuuauaugaaauuauuaaugugaaguuuuucauuuauaauucaagg

SEQ ID NO: 621458 - RNA, 62 nt, hsa
agaggguuuugaaauguuuuucaaauaugugaaaugugaaacugcugucuuuuauauuaaag

SEQ ID NO: 621459 - RNA, 62 nt, hsa
uaauccaguauuuggaaaguaauccaguuugaaaugugaagauguauuccggcagaauagug

SEQ ID NO: 621460 - RNA, 62 nt, hsa
auauaguggcucuacguaauguagccuguauuaaugugaaauauuuaccagaauauucaaua

SEQ ID NO: 621461 - RNA, 62 nt, hsa
uuggggucugcuccuaccccaccccauuuaacaaugugaagugacugaggcuggggugccuc

SEQ ID NO: 621462 - RNA, 62 nt, hsa
ugugaagcauucaaaucaaagcuaaaagccuaaaugugaaaugcuaaugacaagccugagaa

SEQ ID NO: 621463 - RNA, 62 nt, hsa
cugccucacaggugaagauuaaagagacaacgaaugugaaucaugcuugcagguuugagggc

SEQ ID NO: 621464 - RNA, 62 nt, hsa
uuuuauggaacucaguauuaaaagaaaaauauaaugugaauuagccacuuugcagaauaugu

SEQ ID NO: 621465 - RNA, 62 nt, hsa
uaggaaagauuuacacaauagauaaucaucuuaaugugaaagauauuugaaguauuaauuuu

SEQ ID NO: 621466 - RNA, 62 nt, hsa
acauacucauucccaaagcaauccaaaaacaaaaugugaaccauuuggguuucaaauguuaa

SEQ ID NO: 621467 - RNA, 62 nt, hsa
cuuuggucauucugcuguguucauuaggugccaaugugaagucuggauuuuaauuggcaugu

SEQ ID NO: 621468 - RNA, 62 nt, hsa
uuauuuuuuauggauacucugaauggcaauuaaaugugaaacccaguuucuugggcaaguca

SEQ ID NO: 621469 - RNA, 62 nt, hsa
uuuuguaaaacuguuauuuuuuuuuuuuucacaaugugaaacugaaggucaauaaauuauua

SEQ ID NO: 621470 - RNA, 62 nt, hsa
ccaggcccaguuaaugcuagucuuucaugugaaaugugaagcugccauguugccuuuucucu

SEQ ID NO: 621471 - RNA, 62 nt, hsa
guauuucauuagauucucugauucuauauaagaaugugaaaagauugauauauuguuguuag

SEQ ID NO: 621472 - RNA, 62 nt, hsa
auaucaaacguuuaacuuuauuuaaaaaguauaaugugaaaacauaaaauauauuaaaacuu

SEQ ID NO: 621473 - RNA, 62 nt, hsa
uuucagucuaggaaagauuuuccuucucuuggaaugugaagaucugucgauucaucuccaau

SEQ ID NO: 621474 - RNA, 62 nt, hsa
ggugaauaaguuauaaauucccacagaagaaaaaugugaaagacugggugcuagacaagaag

SEQ ID NO: 621475 - RNA, 62 nt, hsa
aacauagaacugugauauuuugcuauuacuucaaugugaauaaauaagguaaaguauaucau

SEQ ID NO: 621476 - RNA, 62 nt, hsa
uauuauuaacaugaauauauuauuuugcuauuaaugugaaaguugucucuaaauauuuuuua

SEQ ID NO: 621477 - RNA, 62 nt, hsa
cugugccuggcuagaaaacaagcguuuauuugaaugugaauaguguuucaaagguauguagu

SEQ ID NO: 621478 - RNA, 62 nt, hsa
uuguacaagcacauaugauguagacauuuuuaaaugugaagcuuuaacaggaauaggauagc

SEQ ID NO: 621479 - RNA, 62 nt, hsa
gaaaaaaaaaggcauucuaguaaaucgaauguaaugugaauggaauuucaaaacaggaucua

SEQ ID NO: 621480 - RNA, 62 nt, hsa
ugcugcuacuuuaaaguguggucauuaugaugaaugugaaaagaguuuuggcuuguucuaaa

SEQ ID NO: 621481 - RNA, 62 nt, hsa
cugagcccuggggacuguuccaaagccagugaaaugugaaggaaagugggguccuucggggc

SEQ ID NO: 621482 - RNA, 62 nt, hsa
gcgaucaugucaguuggcccuuuaauauuuccaaugugaaagauuauuuaaaugcuuuuaaa

SEQ ID NO: 621483 - RNA, 62 nt, hsa
augauuuuguugacaugacuacagacugaaauaaugugaaugaauuaacugaauuugcucug

SEQ ID NO: 621484 - RNA, 62 nt, hsa
uuuuaacccucgcauuccucugcuuuuccaagaaugugaaucuugccaagcuguccgugaga

SEQ ID NO: 621485 - RNA, 62 nt, hsa
uucugaaugcuuuuccacguagacuuaucuggaaugugaacacaacucuuugguuaauagua

SEQ ID NO: 621486 - RNA, 62 nt, hsa
aaugauuuugcuacauuuggaauucaauaaaaaaugugaacaauaauaucuuuaauauaacu

SEQ ID NO: 621487 - RNA, 62 nt, hsa
ccccagagccugggcucugcuggacuuaguauaaugugaaaaaaauguguucuccuauuccu

SEQ ID NO: 621488 - RNA, 62 nt, hsa
uuuauguaacauuugcuagcuuguaaaaggcgaaugugaaauauugcaucugcauuuuccaa

SEQ ID NO: 621489 - RNA, 62 nt, hsa
cugugcguuuguaugugucugggauccagggcaaugugaauuuucuuuuuauuugggagauu

SEQ ID NO: 621490 - RNA, 62 nt, hsa
cugauccaucaggaucagucccuauuaugcaaaaugugaauuuaauuuuauuuguacugaca

SEQ ID NO: 621491 - RNA, 62 nt, hsa
uccggcggggccugucccugggcccaggagccaaugugaacuuuuuuuuuuaccgggauuau

SEQ ID NO: 621492 - RNA, 62 nt, hsa
acuugagagaaaaacuuagaucugagugauggaaugugaagcaaaucuucaaaaucaguaga

SEQ ID NO: 621493 - RNA, 62 nt, hsa
auacugagaaaaaguccugucaguucagaaaaaaugugaagucuacuuuaguauuccuguaa

SEQ ID NO: 621494 - RNA, 62 nt, hsa
gagagccacuaggaggccugcaguuauuuuugaaugugaaaaugcauuugcguucaucuugu

SEQ ID NO: 621495 - RNA, 62 nt, hsa
caucuugugguuauucuggguuguggaaggaaaaugugaaugaaaguagugcuggaugcaau

SEQ ID NO: 621496 - RNA, 62 nt, hsa
caaaaaagaugcaguuuuccuuuguauugggaaaugugaaaauaaaauugucaacucuuuca

SEQ ID NO: 621497 - RNA, 62 nt, hsa
cucuccuccaccccaggcuuagaggacagaaaaaugugaagagacgccccacccacccucag

SEQ ID NO: 621498 - RNA, 62 nt, hsa
uagacucacacaguugccugaagcaguuggggaaugugaaagucucacugaguuaguucuua

SEQ ID NO: 621499 - RNA, 62 nt, hsa
ugacccuuuauauuuguucuaaaauaagucaaaaugugaaaauaauauuaaaucuaagauau

SEQ ID NO: 621500 - RNA, 62 nt, hsa
gaagaaucuaauaggaugcugguuguguauuaaaugugaaauugcauagauaaagguagaug

SEQ ID NO: 621501 - RNA, 62 nt, hsa
aaacagcugucaaaucucaaggugaagaucuaaaugugaacaguuuacuaaugcacuacuga

SEQ ID NO: 621502 - RNA, 62 nt, hsa
acaugacuuuugcauccauuguauuaucagaaaaugugaagaagaaaaaaaugccauguuuu

SEQ ID NO: 621503 - RNA, 62 nt, hsa
gggccugugauuuccugucaguguccucagcuaaugugaacaguguuggucugcugguuaga

SEQ ID NO: 621504 - RNA, 62 nt, hsa
cuuuucuuuagucccaaccacuaguuuuaacaaaugugaauuauugaaaugugaagggacaa

SEQ ID NO: 621505 - RNA, 62 nt, hsa
aaccacuaguuuuaacaaaugugaauuauugaaaugugaagggacaaaaagaaucauacauu

SEQ ID NO: 621506 - RNA, 62 nt, hsa
auuuucugugagcacacuaaaagcgaaaaauaaaugugaauaaaauguacaaauuuguugug

SEQ ID NO: 621507 - RNA, 62 nt, hsa
ccugaaauuccguaaguacauagucaaaacacaaugugaagaauuuguuuaaaaacauccug

SEQ ID NO: 621508 - RNA, 62 nt, hsa
ugaguuccucauuuguugguaaaaagaaaaagaaugugaaaaugucucuuuuuuucuuggcu

SEQ ID NO: 621509 - RNA, 62 nt, hsa
ugacuucaccugaggcaucacagagacaaaagaaugugaagcuacuuaacaaaguaaggcaa

SEQ ID NO: 621510 - RNA, 62 nt, hsa
aauauuuuguguugaucauuauuuccauucuuaaugugaaaaaaaguaauuauuuauacuua

SEQ ID NO: 621511 - RNA, 62 nt, hsa
augucuuuaagaaaaagaaaucaaucugcagaaaugugaagauuugcaagcaguguaaacug

SEQ ID NO: 621512 - RNA, 62 nt, hsa
caguuaaacucauugucuguuuggaagaccagaaugugaagacaaguaguagaagaaaauga

SEQ ID NO: 621513 - RNA, 62 nt, hsa
cuucccuuucugcuuguguuaaguauguguaaaaugugaagugaaugaaacacucaguuguu

SEQ ID NO: 621514 - RNA, 62 nt, hsa
cgugguagccgacugugaggaaaagcagagggaaugugaaagaaaauaagagaauccacggg

SEQ ID NO: 621515 - RNA, 62 nt, hsa
cucugcucaccuugguuuccgcacaccuucgcaaugugaacaggucaggagucccucccguc

SEQ ID NO: 621516 - RNA, 62 nt, hsa
gguagucuuagcagggggagcccucgacccugaaugugaacuugaacuggagugccucugcu

SEQ ID NO: 621517 - RNA, 62 nt, hsa
cccugucagccuuucaauaaaaguuaugcacaaaugugaacaccugagauggagcugaacau

SEQ ID NO: 621518 - RNA, 62 nt, hsa
auagcagugugcaugcaggcaggaggcagggaaaugugaaauggcaaugaucucuuauugag

SEQ ID NO: 621519 - RNA, 62 nt, hsa
uauugaaaguuucaaugugguuuaaagggaugaaugugaauuaugaacuaguaugugacaau

SEQ ID NO: 621520 - RNA, 62 nt, hsa
ugggcaggucuagugagcuguagaauugaaucaaugugaacucagggaacuggggaaggcug

SEQ ID NO: 621521 - RNA, 62 nt, hsa
uuccuauuuucgaugaaguucugagauacugaaaugugaaaagagcaaucagaauugugcuu

SEQ ID NO: 621522 - RNA, 62 nt, hsa
ugguugggcucugccaaagacuaauggacuaaaaugugaaacagccucuugcccuguaccuu

SEQ ID NO: 621523 - RNA, 62 nt, hsa
acguuuuguguagaucuuuauaagcuuuugagaaugugaaauagcaccaucaaaauauaaug

SEQ ID NO: 621524 - RNA, 62 nt, hsa
uugaaugacugacccaaaaugugaaugaagcuaaugugaaugugagugaagcucccuucagg

SEQ ID NO: 621525 - RNA, 62 nt, hsa
uuugacacacaguuguugaaugacugacccaaaaugugaaugaagcuaaugugaaugugagu

SEQ ID NO: 621526 - RNA, 62 nt, hsa
cuguauuaucaauuucucauagacacugugcuaaugugaauuuuaaaugaccugcaucaagu

SEQ ID NO: 621527 - RNA, 62 nt, hsa
ucauuuucuguauuauauaugaaaaguaaauuaaugugaaaccuggcccagcuugcuggaaa

SEQ ID NO: 621528 - RNA, 62 nt, hsa
aaacaaaagguucuaagaugauuucaggaaauaaugugaacauguaauaaaauggaaaugaa

SEQ ID NO: 621529 - RNA, 62 nt, hsa
aauaaugccuuuguaaccacaacuuucacuauaaugugaaauguaacuguccguaguaucag

SEQ ID NO: 621530 - RNA, 62 nt, hsa
uggaaaacuggugacagugagaauauaaacucaaugugaaucacgugauacuucgcaggcgu

SEQ ID NO: 621531 - RNA, 62 nt, hsa
uuuauuaaaguauguguguguaucagugucucaaugugaagauuguaaccucaagauuagga

SEQ ID NO: 621532 - RNA, 62 nt, hsa
cggcaucuuguuacugcaauaguuggaaauaaaaugugaaaauuagcaaaaccaugaauggu

SEQ ID NO: 621533 - RNA, 62 nt, hsa
aaucuacaauuucuucuuuaaaaauauuuauuaaugugaauggaauauaacaauucagcuua

SEQ ID NO: 621534 - RNA, 62 nt, hsa
uguuuaugaucccagcaauacacuuuuuaaaaaaugugaaagucaaagaauuaaguucuagu

SEQ ID NO: 621535 - RNA, 62 nt, hsa
gauuucaaagaccacugucuucauugcacaacaaugugaauauaaucaacacuauugaacug

SEQ ID NO: 621536 - RNA, 62 nt, hsa
aaugaagaaaacacuguaauugcuacucagcaaaugugaauaaaagguguuugcguuauuag

SEQ ID NO: 621537 - RNA, 62 nt, hsa
agaguucuauucuucagguagauaauuuuucaaaugugaauuaucuuuugugucuauauuga

SEQ ID NO: 621538 - RNA, 62 nt, hsa
uccuuuugcaaaagcagacuaaaauguuuuaaaaugugaaaaaacauuauuuuuucaaagca

SEQ ID NO: 621539 - RNA, 62 nt, hsa
uaagaaagagauuguguuuggagucagauuucaaugugaaacccaugccuuacauuuacaca

SEQ ID NO: 621540 - RNA, 62 nt, hsa
agagccuguuugucuugcuuccccagagauagaaugugaagacacgcgcuagaaaucgcagu

SEQ ID NO: 621541 - RNA, 62 nt, hsa
uugauaucuccaugaugauaguugaauguugcaaugugaaaaaucugcuguuaacugcaacc

SEQ ID NO: 621542 - RNA, 62 nt, hsa
gaaaacuugaaaaaguauaagcauuuguuaaaaaugugaauuucuugaaugaauuucacauu

SEQ ID NO: 621543 - RNA, 62 nt, hsa
auauaauuuacuucuuauaaauugaagucuuaaaugugaaaccaagaaauguaaucaagcag

SEQ ID NO: 621544 - RNA, 62 nt, hsa
auguuccuaagacccuugucccagauacucuaaaugugaauguaugagcugggggagucaac

SEQ ID NO: 621545 - RNA, 62 nt, hsa
cacuuuuagaacuaugaguacuacuuuuguuaaaugugaaaaacccucacagaaagucaucg

SEQ ID NO: 621546 - RNA, 62 nt, hsa
acucucagagaccuuaaaaagaaguuuacugcaaugugaauaauuuaaucucugguugccaa

SEQ ID NO: 621547 - RNA, 62 nt, hsa
cauaggaaaauucauacuggagagaaacuacaaaugugaagaauguguuaaagccuuuaaca

SEQ ID NO: 621548 - RNA, 62 nt, hsa
uugagaaaauucguacuggagagaauccuacaaaugugaaaaauguggcaaauccuuuaacu

SEQ ID NO: 621549 - RNA, 62 nt, hsa
uaagaaaauucauacuggaaagaaacccuacaaaugugaagucuguggcaaagcuuuuaacu

SEQ ID NO: 621550 - RNA, 62 nt, hsa
aagacaguuuauacuuugagagaaacccugcaaaugugaauaauguggcaauacuuuaaacc

SEQ ID NO: 621551 - RNA, 62 nt, hsa
uaacauaaaucauacuggugaaaaauccuagaaaugugaaaaauaucacaaagccuuuaaau

SEQ ID NO: 621552 - RNA, 62 nt, hsa
uaagaaaauuuacacuagagagaaagccuacaaaugugaagaauguggcaaagccuuuaacc

SEQ ID NO: 621553 - RNA, 62 nt, hsa
uaagauaauucauagcggagagaaaccccacaaaugugaagaauguggcagagcuuuuaacc

SEQ ID NO: 621554 - RNA, 62 nt, hsa
uaagauaauucacaguggagaaaaacccuacaaaugugaagaauguggcaaagcuuuuaacc

SEQ ID NO: 621555 - RNA, 62 nt, hsa
uaagaaaauucauaguaaagagaaacccuacaaaugugaacaguguggcaaggucuuuaaga

SEQ ID NO: 621556 - RNA, 62 nt, hsa
caagaagauucauacuagagagaaacccuacaaaugugaagaauguggcauaucuuuuaacc

SEQ ID NO: 621557 - RNA, 62 nt, hsa
uaagaugauucacacuugaaugaaacccuacaaaugugaacgauguggcaguuguuuuaacu

SEQ ID NO: 621558 - RNA, 62 nt, hsa
uaagaaaauucaaacuggagagaaacucuacaaaugugaagaauguggcaaagcuuuuaacc

SEQ ID NO: 621559 - RNA, 62 nt, hsa
accuaaaauucaugcaggagagaaacaccacaaaugugaaaaauuugguaaauucuuuaaca

SEQ ID NO: 621560 - RNA, 51 nt, hsa; identical to SEQ ID NO: 451216

SEQ ID NO: 621561 - RNA, 62 nt, hsa
uuuguauuuuauuuuucaaaauaaaagcuuucaaugugaagcauucugguaguuacauguuu

SEQ ID NO: 621562 - RNA, 62 nt, hsa
cugcuaguuuuuaugagaaguauauuauauuaaaugugaauuuuuuaaauuuugcuucuuau

SEQ ID NO: 621563 - RNA, 62 nt, hsa
uggcugugacuguggccgccacggccacccggaaugugaagggcgcuccgggcucugagccc

SEQ ID NO: 621564 - RNA, 62 nt, hsa
guggaggagacugcccuguccugagccuggaaaaugugaaacugucuccugcaaccugcugg

SEQ ID NO: 621565 - RNA, 62 nt, hsa
ccauacuagagagaagcccuacaaauguaaagaaugugaaaagucuuucagucagagcucaa

SEQ ID NO: 621566 - RNA, 62 nt, hsa
uaaaagaauacacacuagagaaaaaccuuacaaaugugaagcaucugauaaauccugugaag

SEQ ID NO: 621567 - RNA, 62 nt, hsa
ucacaugggaauaaaauuccauugcugcaaugaaugugaaaaagccaucagucaaagaaacu

SEQ ID NO: 621568 - RNA, 62 nt, hsa
uaaaaggaaaacagaaaaaggaaaaguaggcaaaugugaaaauaguuucaauauaucuuaug

SEQ ID NO: 621569 - RNA, 62 nt, hsa
aguaaauaauuguaucuuuccauagcuuuucaaaugugaaaucauuuuuggaagcuuggauc

SEQ ID NO: 621570 - RNA, 62 nt, hsa
cuguuugagaaugaugcuacucugaucuaaugaaugugaacauguagauguuuuguguguau

SEQ ID NO: 621571 - RNA, 62 nt, hsa
cacacuuguauauacauucuugagaacacugcaaugugaaaaucacguuugcuauuuauaaa

SEQ ID NO: 621572 - RNA, 62 nt, hsa
auaauuccacagccucuucuaacaaugccuacaaugugaauuccucccaaccucugggaucc

SEQ ID NO: 621573 - RNA, 62 nt, hsa
gauucauuuuaucgagaugccaagaugaacacaaugugaauaucauuuccauuucuaagcag

SEQ ID NO: 621574 - RNA, 62 nt, hsa
uacccccucaauaucaugaucauccaaucucaaaugugaaaaaaaaaaagaaauuugauuuu

SEQ ID NO: 621575 - RNA, 62 nt, hsa
gguauaugaacaaauuuucuagucgaguuuucaaugugaauuuguucuuacauuauggcucc

SEQ ID NO: 621576 - RNA, 62 nt, hsa
aggugcccagaaugaggcugcuuuccaaagccaaugugaacagcggcuggacuuggagguag

SEQ ID NO: 621577 - RNA, 62 nt, hsa
uaagacaauucauauuugagagaaacccugcaaaugugaagaauguggcaaugcuuguaacu

SEQ ID NO: 621578 - RNA, 62 nt, hsa
uaagagaauucauacuggagagaaacccuacaaaugugaagaauguggcaaagcuuuuaacc

SEQ ID NO: 621579 - RNA, 62 nt, hsa
auuauuuucuccaaauaaaaauuagauggaaaaaugugaaaaaaauuauucaugcucucaua

SEQ ID NO: 621580 - RNA, 62 nt, hsa
uauaaagucuuaaaugugugcauaaaaaacuaaaugugaauauaaaaucuaaauaaaggaau

SEQ ID NO: 621581 - RNA, 62 nt, hsa
auagguagcacauuuaucauuugugacagaauaaugugaaguuaaguaauuacugaacuuua

SEQ ID NO: 621582 - RNA, 62 nt, hsa
agcugucaaagcuuagguggucuuuaugcuguaaugugaaagcaaauauuucuucguguugg

SEQ ID NO: 621583 - RNA, 62 nt, hsa
augugugaaugccauaucuguagaugacgaugaaugugaaggguuaauguagaaauguuugu

SEQ ID NO: 621584 - RNA, 62 nt, hsa
acuucuuuaaaaacuccuucuaagcauauuaaaaugugaaauuuugcguacucucucucucu

SEQ ID NO: 621585 - RNA, 62 nt, hsa
gaaaacacugacuuuguuuuuauaaguuauuaaaugugaaauugaucugcaucagcuuauuu

SEQ ID NO: 621586 - RNA, 62 nt, hsa
aaaacauuuguaaggcugcaacauaauauuaaaaugugaauaaauaaauguucugauaaaau

SEQ ID NO: 621587 - RNA, 62 nt, hsa
uacccaaucaagaauagacccuucacacaggaaaugugaacaauuguuauauaugaacacuc

SEQ ID NO: 621588 - RNA, 62 nt, hsa
uuccuccucaccagaaaucccugggcuuccacaaugugaacucacucauugucagguguccg

SEQ ID NO: 621589 - RNA, 62 nt, hsa
cuucagugauauacuuguucguucauuucuaaaaugugaagcuuuaggaccaaauuguuaga

SEQ ID NO: 621590 - RNA, 62 nt, hsa
uuuaaugaaagguggaaaauaauuuaacuuacaaugugaaaauacaaugugaaauguacaau

SEQ ID NO: 621591 - RNA, 62 nt, hsa
ggaaaauaauuuaacuuacaaugugaaaauacaaugugaaauguacaauaaaucauauuuau

SEQ ID NO: 621592 - RNA, 62 nt, hsa
ugagauuaaaguuagucuuaaaauguaaauaaaaugugaaacguguccucagagacugugcc

SEQ ID NO: 621593 - RNA, 62 nt, hsa
cccgaggcgcagcaauaauaaggcagcuguugaaugugaagggucccuuuggaaaauuaacc

SEQ ID NO: 621594 - RNA, 62 nt, hsa
auaugccacuaauaaaaugaaucuaaacauugaaugugaauggcccucagaaaaucaucuag

SEQ ID NO: 621595 - RNA, 62 nt, hsa
ucauauacuauugauccuuuggcacuuaaauaaaugugaaauccuccaggaauuuuccugug

SEQ ID NO: 621596 - RNA, 62 nt, hsa
aaaauguguuuacuucagaacggcacuacauaaaugugaaaaguuguugaucuugaaauauc

SEQ ID NO: 621597 - RNA, 62 nt, hsa
ugacuuuaaugaaucuuugguguggaaugaaaaaugugaacuucuuacucauagugugguuu

SEQ ID NO: 621598 - RNA, 62 nt, hsa
cuuuauuauagagacauuugaaaauauccauuaaugugaauaucaccugaauucagucuguu

SEQ ID NO: 621599 - RNA, 62 nt, hsa
cuucaucucuuacuugauagacuuacuaauaaaaugugaagacuagaccaauugucaugcuu

SEQ ID NO: 621600 - RNA, 62 nt, hsa
aguaucugagauauacaaaucucccuguaggaaaugugaaagaaaagcacaacaaaacuagg

SEQ ID NO: 621601 - RNA, 62 nt, hsa
aguaacacuuuguacauaacaaauacucagcaaaugugaaacuuuauuugcucuuacuucaa

SEQ ID NO: 621602 - RNA, 62 nt, hsa
uuuaugaauaauaugcagagaugcauauuaggaaugugaagccagaaugggucaguuguagc

SEQ ID NO: 621603 - RNA, 62 nt, hsa
ucugaauaaccugcgugucuaaaaccacgugaaaugugaaugauuauuggcaauauuaccuu

SEQ ID NO: 621604 - RNA, 62 nt, hsa
gagaaguucccauuauuauuucuguucuuacaaaugugaaacggaagcucauagaggugaga

SEQ ID NO: 621605 - RNA, 62 nt, hsa
gaaaacacuugaauugacgcaauauaaaacaaaaugugaaaaccaaaguggauuuauccugc

SEQ ID NO: 621606 - RNA, 62 nt, hsa
uuuauuggcgguauacaaaguaaaauguuauaaaugugaaguuauaaaauaaauauaugcua

SEQ ID NO: 621607 - RNA, 62 nt, hsa
ggccaggcucucccgagucguggcaccuccacaaugugaauuuucugaaucccuauuccagg

SEQ ID NO: 621608 - RNA, 62 nt, hsa
guauuauuuuuacuguuaaaaaauuuuuuaaaaaugugaaauguaauguuuuuacagcaaca

SEQ ID NO: 621609 - RNA, 62 nt, hsa
acuggugaauuacagaccugaugaauuuauagaaugugaagacccaguggaucauguuggaa

SEQ ID NO: 621610 - RNA, 62 nt, hsa
acagcuucagaaagagcucaaaauaaauuggaaaugugaaucgcagcuguggguuuuaccac

SEQ ID NO: 621611 - RNA, 62 nt, hsa
ggaaaguguaaauguuuuucaugguuucuaucaaugugaaauaaaauuuaauucugacuuuu

SEQ ID NO: 621612 - RNA, 62 nt, hsa
acaguccuacuccgauguuaucuuucugauucaaugugaauccaucuuuccuugcaauauuu

SEQ ID NO: 621613 - RNA, 62 nt, hsa
uagcaucuauguuacacucuccuagaguauaaaaugugaauguuuuuguagcuaaauuguaa

SEQ ID NO: 621614 - RNA, 62 nt, hsa
uuugcaaaauuggauuaaauuccaccuaucuuaaugugaauuaaaaaccaccauuuauaaua

SEQ ID NO: 621615 - RNA, 62 nt, hsa
caaugguguuuuucuuguaaauguguuggacaaaugugaagaugcauuguaguuuaaccaua

SEQ ID NO: 621616 - RNA, 62 nt, hsa
uaagccuauuguuuaaugcaaaauauggaacaaaugugaacugguaaaggucgaucuugaua

SEQ ID NO: 621617 - RNA, 62 nt, hsa
aaaucuuuuucauagguaaugacagaugccuuaaugugaagcuuauuuauaauagcaauaaa

SEQ ID NO: 621618 - RNA, 62 nt, hsa
cggaaaauuuacaagcaaccuagagguccagcaaugugaaaagaaucaaguaauucugcuua

SEQ ID NO: 621619 - RNA, 62 nt, hsa
aauuuacugguauacuaagugauuuaaauuugaaugugaaauacugauaggcuuuuaagcuu

SEQ ID NO: 621620 - RNA, 62 nt, hsa
uaaaaaauuuauacuuaaaaaauccugcccaaaaugugaagcuugguugacugauguucaug

SEQ ID NO: 621621 - RNA, 62 nt, hsa
gggugaagcuuugaaauaaauacugcaccaaaaaugugaaaaagaaucacguaguaaaugua

SEQ ID NO: 621622 - RNA, 62 nt, hsa
ggagaaaugcaguugcugacugggaauuuaagaaugugaacuucucacuagaauugguaugg

SEQ ID NO: 621623 - RNA, 62 nt, hsa
aaauacauccaaaaggguaaggcaguuuuaaaaaugugaaaacauuuaaaaaugauaauagc

SEQ ID NO: 621624 - RNA, 62 nt, hsa
auuugccagacagagaucagaauugaaccgucaaugugaaauaaagaguucuccuuguacuu

SEQ ID NO: 621625 - RNA, 62 nt, hsa
auguaaacaucauaaauaguaaauaaugauucaaugugaauuuuaaaaugcaaauauugcua

SEQ ID NO: 621626 - RNA, 62 nt, hsa
uauguaccuuuugauagauccacauaaaaagaaaugugaaguuuucuuuuacuaucuuuuca

SEQ ID NO: 621627 - RNA, 62 nt, hsa
uugucuuuuucugcccaucugucuacuaauaaaaugugaaauaaaauaccuguauugcuacu

SEQ ID NO: 621628 - RNA, 62 nt, hsa
cugccuucaaggacuguuucagugugagucagaaugugaaaaaggaauaaaaaauacuguug

SEQ ID NO: 621629 - RNA, 62 nt, hsa
cucaaaaaaaauaaaauaaaaagucaauuuagaaugugaaauucugaccaccuuuuggcuuu

SEQ ID NO: 621630 - RNA, 62 nt, hsa
gacauuuuuccguuugcuuuuguuccaaugucaaugugaacguccacaugaaaccuacacac

SEQ ID NO: 621631 - RNA, 62 nt, hsa
gguuguaguugaaaauuuuauaaaauaccguuaaugugaaguuuuucuuuagucacagaagu

SEQ ID NO: 621632 - RNA, 62 nt, hsa
agagcaagcaaaucuuuuuaaaaaauaguaugaaugugaauacuagaaaagauuuaaaaaau

SEQ ID NO: 621633 - RNA, 62 nt, hsa
aagacugccaaggagcagauuuucucccuggaaaugugaaaacugaaccuauaacucugaua

SEQ ID NO: 621634 - RNA, 62 nt, hsa
cgagccacggcagcccccuguaucuggauuguaaugugaaucuuuaggguaauuccuccagu

SEQ ID NO: 621635 - RNA, 62 nt, hsa
caaacaggauuaacugugaagacuaauuuauaaaugugaaccuaagaaaacuccaccucuga

SEQ ID NO: 621636 - RNA, 62 nt, hsa
cugugggagggaaggacaaggguucccuuggaaaugugaagggucuuggccucaucccucag

SEQ ID NO: 621637 - RNA, 62 nt, hsa
aaacugugcaagcuuucuuuuuaucauuaggaaaugugaaacguuggacaaauuuugaguuu

SEQ ID NO: 621638 - RNA, 62 nt, hsa
caccaaauuuacacaacaaaaugacauguucgaaugugaaaggucauaauagcuuucccauc

SEQ ID NO: 621639 - RNA, 62 nt, hsa
ucuguccuuaauuuuuugagcaaaaucuggaaaaugugaaagcauauuuagauuuuauauac

SEQ ID NO: 621640 - RNA, 62 nt, hsa
acuaacuguaacuuaagugcugggggaaaaaaaaugugaacuaacuuauuuaauuuauggca

SEQ ID NO: 621641 - RNA, 62 nt, hsa
uuuaugaaguaaaguuaaaaacaaacauaggaaaugugaaaauauuuguguuuguuuugucu

SEQ ID NO: 621642 - RNA, 62 nt, hsa
augacucacaaaacugauuuuaaaaucaaguuaaugugaauuuugaaaauuacuacuuaauc

SEQ ID NO: 621643 - RNA, 62 nt, hsa
gcauuaagaaaauaaaauuucuauauaccaaaaaugugaaguuauaccaaauaaaguuucua

SEQ ID NO: 621644 - RNA, 62 nt, hsa
uuacugcauaugaggcuuucuguuaauuuuuuaaugugaauaauuuauauauugcacauucu

SEQ ID NO: 621645 - RNA, 62 nt, hsa
aaaauaauaaaugucagcugguuuugauacugaaugugaacaaggcucaccuaaggaaacug

SEQ ID NO: 621646 - RNA, 62 nt, hsa
gcuguuagaaaaacagaauuaacaaagacaguaaugugaagagugcauuacacuauucuuau

SEQ ID NO: 621647 - RNA, 62 nt, hsa
cuuucccugcagugucuuugaaacuugaacauaaugugaaggcugaaugauagagauauuuu

SEQ ID NO: 621648 - RNA, 62 nt, hsa
ggggaugaggguuagccauaguauucuuugcaaaugugaaagcgagacauuauaucuucucu

SEQ ID NO: 621649 - RNA, 62 nt, hsa
cagguuuggaagccacaggcgauucuauggucaaugugaaggacuagaaauaaaaacccaca

SEQ ID NO: 621650 - RNA, 62 nt, hsa
ugacugcgggcugggggggcauucccaguaggaaugugaagccagagguuucggauucguga

SEQ ID NO: 621651 - RNA, 62 nt, hsa
ugacagcaauuuucuaauauuugguuuaauaaaaugugaauaaugucccuuuuaaccauggu

SEQ ID NO: 621652 - RNA, 62 nt, hsa
uauauucccaugaaggauucuuuuuuuaaaaaaaugugaaaugucaucuuguacuuacaccu

SEQ ID NO: 621653 - RNA, 62 nt, hsa
augagauuaagcuucaaucacugcuccucagcaaugugaagaaucaaagucagggcaagaaa

SEQ ID NO: 621654 - RNA, 62 nt, hsa
ggcccacuuccagggcccaggugcugcaacuaaaugugaaagcucaguggccgcuccuucuu

SEQ ID NO: 621655 - RNA, 62 nt, hsa
gugccagacaccgggcaguacacuuuggaaagaaugugaaauccuuuuaauuuuuaauccau

SEQ ID NO: 621656 - RNA, 62 nt, hsa
augcagccaaugcauuuucuuacaguuuacagaaugugaagauguuuaauguuacaguguug

SEQ ID NO: 621657 - RNA, 62 nt, hsa
gccagcagaacugaagugugcugugacaagccaaugugaauuucuaccaaauaguagagcau

SEQ ID NO: 621658 - RNA, 62 nt, hsa
cacaguaauguuauuaucuauguauuguagacaaugugaaaauacauuugacauagaaugaa

SEQ ID NO: 621659 - RNA, 62 nt, hsa
aaagccugucuuccgcuagaacaacgucuacaaaugugaagaugaugacuucuggcacgcgg

SEQ ID NO: 621660 - RNA, 62 nt, hsa
ugaacaguagggcauuacauuugugugaauuaaaugugaacuucuguauuacguugcggcgu

SEQ ID NO: 621661 - RNA, 62 nt, hsa
ugaccucaucuagcuaugaauucugggaagucaaugugaaaaacauugcugcauucaugcaa

SEQ ID NO: 621662 - RNA, 62 nt, hsa
cuguaaauuugcauaacuggauguacuuagauaaugugaaauaaacauuaaagacaaggucu

SEQ ID NO: 621663 - RNA, 62 nt, hsa
ugauuuuguuauacuugacuuaacuuuauugcaaugugaauuaauugcacugcuaaguagga

SEQ ID NO: 621664 - RNA, 62 nt, hsa
aggaacuacugaggaucagaguaauccaagcaaaugugaaucauuuuaccuuugacaaaggu

SEQ ID NO: 621665 - RNA, 62 nt, hsa
agucaauagucuucccauccaaacuauaagagaaugugaauuucuucaacaucauacuuaaa

SEQ ID NO: 621666 - RNA, 62 nt, hsa
auugaucuuuuccacaaguauuaaacugccaaaaugugaauaugcaaagccuuucugaaucu

SEQ ID NO: 621667 - RNA, 62 nt, hsa
cugcagaacuuuguucuguuuucugccacaaaaaugugaauaguucagagugaaaaccuuuu

SEQ ID NO: 621668 - RNA, 62 nt, hsa
gggaacaaaccucacuugagcugugccuagacaaugugaauuccuguguugcuaacagaagu

SEQ ID NO: 621669 - RNA, 62 nt, hsa
cauuucuggaacauggauuuguguucaccuuaaaugugaaaauaaauccuauuuucuaugga

SEQ ID NO: 621670 - RNA, 62 nt, hsa
ucauguuugagugauuuuaaaauguuuuggugaaugugaaaacuaaaguuugugucaugaga

SEQ ID NO: 621671 - RNA, 62 nt, hsa
cuacguuuaaauaucuuugaaaguuuguauuaaaugugaauuuuaagaaauaauauuuauau

SEQ ID NO: 621672 - RNA, 62 nt, hsa
ccagucuaucaucaaccuugaguauucuacacaaugugaauucaagugccugauuaauugag

SEQ ID NO: 621673 - RNA, 62 nt, hsa
uuucaaagugacuucuaugaagcuuuuuuuuuaaugugaaauuuucagaauguuguuuuuuu

SEQ ID NO: 621674 - RNA, 62 nt, hsa
gggguaugugagauguuuugacacaggcaugcaaugugaaauacguguaucauggagaauga

SEQ ID NO: 621675 - RNA, 62 nt, hsa
ucuugcccacaggccuguggcaaaaggauaaaaaugugaacgaaguuuaacauucugacuug

SEQ ID NO: 621676 - RNA, 62 nt, hsa
caaauauuugcacuguauuaaauuuaaauguuaaugugaaaugguuuaaauuuuacaugcug

SEQ ID NO: 621677 - RNA, 62 nt, hsa
uguaauuauaaaauauauuggcuuuuguuuucaaugugaaagauacauuaaauggacacaua

SEQ ID NO: 621678 - RNA, 62 nt, hsa
ccuccuuucaguauuuuucacuuguugccccaaaugugaaagcauuucauuccuuuaagagg

SEQ ID NO: 621679 - RNA, 62 nt, hsa
gccugaaaucaaacuugauuuaacucaguaagaaugugaauuauuuguucuacuuggguggu

SEQ ID NO: 621680 - RNA, 62 nt, hsa
guguggucuguuacuuuaauguuucuguuuuuaaugugaaggccaagcaggcccugggaugg

SEQ ID NO: 621681 - RNA, 62 nt, hsa
ggaaaaggcaauaauuuucuaagacccgugugaaugugaagaaaagcaguauguuacugguu

SEQ ID NO: 621682 - RNA, 62 nt, hsa
auuuuuuuuuaaauaaaaaaguuuacagaucaaaugugaaauaaauaugaauggaguggucc

SEQ ID NO: 621683 - RNA, 62 nt, hsa
aagaacaagaaauggauguaagccuggcccauaaugugaacauaaguaaucacuaaugcuca

SEQ ID NO: 621684 - RNA, 62 nt, hsa
cugggguaagagaaaaaaagcacaucacaacaaaugugaaagccuucauuauuacacguucc

SEQ ID NO: 621685 - RNA, 62 nt, hsa
uaugauuuuuaagagauuuauguucuacuuaaaaugugaauuguacuucugagcugccuuaa

SEQ ID NO: 621686 - RNA, 62 nt, hsa
cugugcacuugccuuguugcugaaguuccaauaaugugaaaaccaaaguagagguuuuuuuc

SEQ ID NO: 621687 - RNA, 62 nt, hsa
caugccguucuucuguguaauauuaagaacugaaugugaaguuuauagcuagccugggugua

SEQ ID NO: 621688 - RNA, 62 nt, hsa
gaaaggacaagacacuguuaugcccuguccuaaaugugaagacagagguugaauuuuuuaaa

SEQ ID NO: 621689 - RNA, 62 nt, hsa
auuuuguauuguuucaauugcaucucccagauaaugugaaaaugguccaggagaaggccaau

SEQ ID NO: 621690 - RNA, 62 nt, hsa
cuucuaacagaauucaaccagaaauaauugauaaugugaauuuuuguuaauuguucacuugu

SEQ ID NO: 621691 - RNA, 62 nt, hsa
aaaaauguuuucuuacccuugacuuacaaugaaaugugaaauuacuugucugaaccccgugg

SEQ ID NO: 621692 - RNA, 62 nt, hsa
aaugcccauauuguaucuaucuguagucguuuaaugugaauuauaugugaauuuuuuucaaa

SEQ ID NO: 621693 - RNA, 62 nt, hsa
uaugagacgagagagagaagccuccgcuccuuaaugugaaacuucaugaaguuuuaaacuuc

SEQ ID NO: 621694 - RNA, 62 nt, hsa
aaguaauuuagaagauauuauuugucuuaaaaaaugugaaaugcuuuuauauucuaauaguu

SEQ ID NO: 621695 - RNA, 62 nt, hsa
caucuuccugaaaggauguuaguuucugccacaaugugaagaaggccuucaccuugacucuu

SEQ ID NO: 621696 - RNA, 62 nt, hsa
ccaaaccuaguuucccaugaguugcgacugaaaaugugaaacgacacuguauugcuguauac

SEQ ID NO: 621697 - RNA, 62 nt, hsa
ggauguagcuuguuaguaguuaaaucuauagaaaugugaaauacacuuuguguggaaaaacc

SEQ ID NO: 621698 - RNA, 62 nt, hsa
aguauuauugagucuuuucauacacuucuuaaaaugugaaaaucuauguuuucaguauuaug

SEQ ID NO: 621699 - RNA, 62 nt, hsa
cuccugcaaugaauguuuaugugauugaagcaaaugugaaucguauuauuuuaaaaaguggc

SEQ ID NO: 621700 - RNA, 62 nt, hsa
gaacaaaacugugcuguuacaacucaguguucaaugugaaauugcugccaaauguuauguag

SEQ ID NO: 621701 - RNA, 62 nt, hsa
uacuuagauucacaaugguuguguaucucuauaaugugaaauauuuuuuuguggugauaaaa

SEQ ID NO: 621702 - RNA, 62 nt, hsa
uguuuuucuauuaaaaagcaaucaagaaagauaaugugaaaaagaaaggaauuuagagguag

SEQ ID NO: 621703 - RNA, 62 nt, hsa
gggauguaauccggauggccgcuucuguacuuaaugugaaauauuuagauaccuuuuugaac

SEQ ID NO: 621704 - RNA, 62 nt, hsa
auucaagagcaaucuuugcuaaggaguaagugaaugugaagaguaccaacuacaacaauucu

SEQ ID NO: 621705 - RNA, 62 nt, hsa
ccuaauacugucaccuugggggugagaauuccaaugugaauuugcagggggagugggggaca

SEQ ID NO: 621706 - RNA, 62 nt, hsa
cacauuauuuauagaaaauguacaguugugugaaugugaaauaaauguccucaacucccuuc

SEQ ID NO: 621707 - RNA, 62 nt, hsa
uugcucugaggguuaaaugaaaauaaaaagaaaaugugaaacagcaccacagguacuugaca

SEQ ID NO: 621708 - RNA, 62 nt, hsa
gcugugagcuccuugggggcaggcccucaauaaaugugaacugcugcugccgccucugccgu

SEQ ID NO: 621709 - RNA, 62 nt, hsa
auaaauauaauugggauuuuaaaaacaugagaaaugugaacugugauggggugggcagggcu

SEQ ID NO: 621710 - RNA, 62 nt, hsa
uuucuacugagcaaaauaccaucuaaaaggagaaugugaauaguuguauuuugaaaugaugu

SEQ ID NO: 621711 - RNA, 62 nt, hsa
ugagccaauagugauuuguuugcauaucaccuaaugugaaaagugcucaucugugaacucua

SEQ ID NO: 621712 - RNA, 62 nt, hsa
aaugaaacccuauggagaauuuaucccuuuacaaugugaauagucaucuccuaauuuguuuc

SEQ ID NO: 621713 - RNA, 62 nt, hsa
caaguucuaaggaagaaaagagucuccuuucgaaugugaagaaguaaauuuagaggaaauca

SEQ ID NO: 621714 - RNA, 62 nt, hsa
uaaauuguuauuuucgcacaaugggaaucucuaaugugaaaauguauucuaugaaaauaauu

SEQ ID NO: 621715 - RNA, 62 nt, hsa
aagugagaagacauaaccaagacauggaaauaaaugugaaagcuggagccgaagagucaaag

SEQ ID NO: 621716 - RNA, 62 nt, hsa
cuccgugugugcaugugacugugcuggguuggaaugugaacaauaaagaggaauguccaagu

SEQ ID NO: 621717 - RNA, 62 nt, hsa
guuacucuaaauagaaauauaggguuuuuuuuaaugugaauuuuugccuaucuuuaaacauu

SEQ ID NO: 621718 - RNA, 62 nt, hsa
gaaaauacuguaaauacguuggggauuuguucaaugugaaaucagauaguuguuuucauaca

SEQ ID NO: 621719 - RNA, 62 nt, hsa
aaucuaaaagaauuuuaccauucaguuaauucaaugugaacacuggcacacugcucuuaaga

SEQ ID NO: 621720 - RNA, 62 nt, hsa
uacaguuugucuuugcuuuuccaaguuuuucuaaugugaagaaauuguauuacucuacuucu

SEQ ID NO: 621721 - RNA, 62 nt, hsa
auguguuuuccagguggauauaguuuguaaacaaugugaauaaaguauuuaacauguucaac

SEQ ID NO: 621722 - RNA, 62 nt, hsa
ucuggagcccgggagagccacacugugggcuuaaugugaauagaggaacaaguggguaucuc

SEQ ID NO: 621723 - RNA, 62 nt, hsa
uauaugugaaaacauucuguaagcuucguacaaaugugaaguauuaauauuaucgcaguauu

SEQ ID NO: 621724 - RNA, 62 nt, hsa
auucgauccucuuaaggcauuaucagugagcaaaugugaaggaaauggugucuggaagaaag

SEQ ID NO: 621725 - RNA, 62 nt, hsa
caauuuuguauaguuuauuucaaucuaaauaaaaugugaauuuuguuuaaagcuuaggcaca

SEQ ID NO: 621726 - RNA, 62 nt, hsa
uauguuuuuguugcauuuauguuuuugcagucaaugugaauucuuacgaauguacaacacaa

SEQ ID NO: 621727 - RNA, 62 nt, hsa
ccaucugauacuccauugccuaugaaauguaaaaugugaacucccugugcugcuuguagaca

SEQ ID NO: 621728 - RNA, 62 nt, hsa
uguaauucaaacaugcuauauuuuuuaaaaucaaugugaaaacauagacuuauuuuuaaauu

SEQ ID NO: 621729 - RNA, 62 nt, hsa
auucuugagaguuguaucugucguuauuucugaaugugaagcucagagaagugacacagagu

SEQ ID NO: 621730 - RNA, 62 nt, hsa
ucuguguucccuuagauacuccuguaauucuuaaugugaauaguuuguuaauauugcuguaa

SEQ ID NO: 621731 - RNA, 62 nt, hsa
aacauaccauuauagucucuucuuucugagaaaaugugaaaccagaauugcaagacugggug

SEQ ID NO: 621732 - RNA, 62 nt, hsa
gguugaaaauguugacccuauccuguuauuuaaaugugaacauuuauuguacauucagugag

SEQ ID NO: 621733 - RNA, 62 nt, hsa
acguuacaaucauuuuuaggguuauuguaaucaaugugaauaucauguuuuuucaaaucugu

SEQ ID NO: 621734 - RNA, 62 nt, hsa
aaacucucaagggaaggugaugcaggggagaaaaugugaauuaaauuacauagauggguguu

SEQ ID NO: 621735 - RNA, 62 nt, hsa
ugaugauaaauuuguuacuuuggaguugaauaaaugugaaggcugugaagaguggacagucu

SEQ ID NO: 621736 - RNA, 62 nt, hsa
aguuuuucuugguuuauggaaauaucuauauuaaugugaaaauaauuaauuuagaauuguga

SEQ ID NO: 621737 - RNA, 62 nt, hsa
cuuucucuuucucucuucccucagaaacuagaaaugugaaugaggauuauuauaaaaggggg

SEQ ID NO: 621738 - RNA, 62 nt, hsa
uaaaccaucuuggcuugugcuuuauucaaacuaaugugaaacaauaaauuuaaauauuauuu

SEQ ID NO: 621739 - RNA, 62 nt, hsa
ucacuuuuuggauugcaucuccccaaaaacuaaaugugaaaucccuaccauuucuagccucu

SEQ ID NO: 621740 - RNA, 62 nt, hsa
guuuacaaucuacucaccaggcucauaccuacaaugugaacauacaguaugcccuuauuagc

SEQ ID NO: 621741 - RNA, 62 nt, hsa
ucauccucagcagcaucgaggaagggccgaggaaugugaagccagaucucgggacucagauu

SEQ ID NO: 621742 - RNA, 62 nt, hsa
aagcuggguagccuauugggguugagagggaaaaugugaaaucucagaauuuaucucccuua

SEQ ID NO: 621743 - RNA, 62 nt, hsa
acaaguauugaaauaauuacuaauuaaucacaaaugugaaguuaugcaugauguaaaaaaua

SEQ ID NO: 621744 - RNA, 62 nt, hsa
ucuagauguguaauuacauggaaaauacuagcaaugugaaugcuuuuguaguaaccaucuug

SEQ ID NO: 621745 - RNA, 62 nt, hsa
aaauauuucaguagaaauuacuugcaaaaugaaaugugaauuguaaaacuuggccuaaacaa

SEQ ID NO: 621746 - RNA, 62 nt, hsa
cauuaacaguuuguccuuaggaugcaaaugaaaaugugaauacauaccuuguuguacuguug

SEQ ID NO: 621747 - RNA, 62 nt, hsa
uaaucauaagccuuaauaagauuuuucuaagaaaugugaaauagaacaauuuucaucuaauu

SEQ ID NO: 621748 - RNA, 62 nt, hsa
agcuaguuuacaggcuuacugugauuuaagcaaaugugaaaagugaaaccuuaauuuuauca

SEQ ID NO: 621749 - RNA, 62 nt, hsa
acucucaccauuuggauccuguguggagagggaaugugaaauuuacaucauuucuuuuuggg

SEQ ID NO: 621750 - RNA, 62 nt, hsa
uuuguuacaaaucuucugaaaaaaaacaaaacaaugugaaacauuaaaauuaaaaggcauua

SEQ ID NO: 621751 - RNA, 62 nt, hsa
gguuuccugaaacuggguuaauucuuuauagaaaugugaacacugaauuuauuuuaaaaaau

SEQ ID NO: 621752 - RNA, 62 nt, hsa
cuggugucuccugcccacccuggucccagguaaaugugaauggagacagguaugagaggcug

SEQ ID NO: 621753 - RNA, 62 nt, hsa
auugcacagacugaauggcuuuacauguuucuaaugugaauuaggcaugugaagcagugggu

SEQ ID NO: 621754 - RNA, 62 nt, hsa
auugcggccccucaccuuguccacguaucaggaaugugaaugugggaccuuuccuccauccc

SEQ ID NO: 621755 - RNA, 62 nt, hsa
aacccaccaccacaaagcaaauuagacaacuuaaugugaaaucauaccauugguugacguuu

SEQ ID NO: 621756 - RNA, 62 nt, hsa
gcuucucccaccucugagauuaggacaggaaaaaugugaaauuucccaauuacaggauuaua

SEQ ID NO: 621757 - RNA, 62 nt, hsa
accagaauaggagauuauggccuauugaacaaaaugugaaacugggaguccacaaagacaua

SEQ ID NO: 621758 - RNA, 62 nt, hsa
uauuugucauuuacaguauugggguuuuuaugaaugugaagcaaacaaaaaaaauuuguaug

SEQ ID NO: 621759 - RNA, 62 nt, hsa
agggcuuaugguacauggcuuccuggaaucaaaaugugaauucauguggaagggacauuaau

SEQ ID NO: 621760 - RNA, 62 nt, hsa
ucuuuaauaguguugaguggcacaaccuuguaaaugugaaaguacaacgcauauuuaucucu

SEQ ID NO: 621761 - RNA, 62 nt, hsa
gacuuugcacacagccucaggcuccacacagaaaugugaacuuggccucagacaggcuggcc

SEQ ID NO: 621762 - RNA, 62 nt, hsa
gaaggagaaggaaggagacucaccucugccucaaugugaaucagacccuaccccaccacgau

SEQ ID NO: 621763 - RNA, 62 nt, hsa
ucuuuaauaguguugaguggcacaaccuuguaaaugugaaaguacaacucguauuuaucucu

SEQ ID NO: 621764 - RNA, 62 nt, hsa
uuucucacauacuguacacagguaguauuuucaaugugaauccaaagcuugucugguucucu

SEQ ID NO: 621765 - RNA, 62 nt, hsa
gugggcccagucauuggguuuuaucagugcuuaaugugaacuaaguuuuuuacuuccacaga

SEQ ID NO: 621766 - RNA, 55 nt, hsa; identical to SEQ ID NO: 451422

SEQ ID NO: 621767 - RNA, 62 nt, hsa
auccaaggaauaguucaguaauuauugccuaaaaugugaaagcauauuuuguauccuaaaau

SEQ ID NO: 621768 - RNA, 62 nt, hsa
uccuuucugagaaguuaguguuaaggucuuggaaugugaacacauuguuuguagugcuaucc

SEQ ID NO: 621769 - RNA, 62 nt, hsa
uagaagagccacgugaaacccaugacaaaaugaaugugaauauucuuucuaaaaauuuagaa

SEQ ID NO: 621770 - RNA, 62 nt, hsa
uuguauuauugauuguauuguauacuauauuaaaugugaauuuguaccccuucauuuuaaaa

SEQ ID NO: 621771 - RNA, 62 nt, hsa
gaauagcugcauaagacauuuugaaauaauguaaugugaaguguuucuuaaagcucugaaca

SEQ ID NO: 621772 - RNA, 62 nt, hsa
ggcauaccuaaggacuaauuuaaacacauaucaaugugaaggacuaauuuaaauuacuauca

SEQ ID NO: 621773 - RNA, 62 nt, hsa
guaaauacauuauugaaaagcaaaucuguauaaaugugaaauuuuuauuuguauuaguaaua

SEQ ID NO: 621774 - RNA, 62 nt, hsa
gaguuuugcccaggccugcugucuugaguacaaaugugaaugaucgacugacugcuuguugc

SEQ ID NO: 621775 - RNA, 62 nt, hsa
agguaacuaugcaaagcauccaggcgguucugaaugugaagcacuacacccagcagaguccc

SEQ ID NO: 621776 - RNA, 62 nt, hsa
guuagaagagagacaggggagugagcuagucaaaugugaaaaaugcucucccagcaaagcug

SEQ ID NO: 621777 - RNA, 62 nt, hsa
uuuuaguuacucaaaagccccuucuuguucugaaugugaaagcucuucccguuccugcuuac

SEQ ID NO: 621778 - RNA, 62 nt, hsa
acauuauauuaaaaaaaaaguuguguggugggaaugugaaagcagagaaauaacuuguaaau

SEQ ID NO: 621779 - RNA, 62 nt, hsa
gaaaccuuuuuuaaacuauuucuagguuugugaaugugaagccccaggccgcagggggcaag

SEQ ID NO: 621780 - RNA, 62 nt, hsa
aauaguguaauuaaaaauaauugaaaguguuaaaugugaacuugagcuguuugaccagucac

SEQ ID NO: 621781 - RNA, 62 nt, hsa
acaagagaaugcugucaauauugguguacuguaaugugaaucuaugcuggugaaaacaauuu

SEQ ID NO: 621782 - RNA, 62 nt, hsa
aggguacucuaguuuuauguagaugauuucagaaugugaaggcugguuugccugucagucau

SEQ ID NO: 621783 - RNA, 62 nt, hsa
cagggaauaggaaaugagggcacuuacacauuaaugugaauuaguaauugugguauagaaau

SEQ ID NO: 621784 - RNA, 62 nt, hsa
auauuucagugagguauauuuuaauacugaucaaugugaacuuuucuaaauacucuauuguc

SEQ ID NO: 621785 - RNA, 62 nt, hsa
gugauaacugccucguuuaaauggucacaagaaaugugaagagagagcuagggcagacaugc

SEQ ID NO: 621786 - RNA, 62 nt, hsa
uauuauuuggcuagaaauugcuguuuuuaauaaaugugaauuuuuuaaaaauaaagauuuuu

SEQ ID NO: 621787 - RNA, 62 nt, hsa
aaaauuuucuacagagaguuaauuaucaccaaaaugugaaugguacauacaaaaccuggcau

SEQ ID NO: 621788 - RNA, 62 nt, hsa
uaauuguaaaagauuaguugaaaaacuguaugaaugugaagaucacaugcuuagucauuuuu

SEQ ID NO: 621789 - RNA, 62 nt, hsa
acuucaaguaacaugcuuagcuuucccuccuuaaugugaaaaaucaagggcuuacugacaua

SEQ ID NO: 621790 - RNA, 62 nt, hsa
acugcaucaacccgacauuccuuucuuauaccaaugugaaauuuccagaucaucuguaaacc

SEQ ID NO: 621791 - RNA, 62 nt, hsa
aaaauuauugaagcgauuucuauguggaaauaaaugugaaaaauaacuaugauauuuuggua

SEQ ID NO: 621792 - RNA, 62 nt, hsa
auaagcauaggagguucuguuauuaaagaaacaaugugaaauaauguggaaauuaauacuga

SEQ ID NO: 621793 - RNA, 62 nt, hsa
cagucgggaagcuuuccagcuuccagcccuugaaugugaagugucauuggcaugucuggcag

SEQ ID NO: 621794 - RNA, 62 nt, hsa
ucuggcaaacguuucucaaaucugcuucauccaaugugaaguucaucuugcagcauuuacua

SEQ ID NO: 621795 - RNA, 62 nt, hsa
uuucuguuagcugauugugguaaacaauguuuaaugugaaaagaaauuaaaacuuucuucau

SEQ ID NO: 621796 - RNA, 62 nt, hsa
uuaaauauuuauaugcuuuguugacuagcugaaaugugaauucuguuaguguugacuaaaga

SEQ ID NO: 621797 - RNA, 62 nt, hsa
guggugcauauuaaaauaagcagagaaaaaaaaaugugaauaaacuacugaaaacacuuggu

SEQ ID NO: 621798 - RNA, 62 nt, hsa
cauuuuuugaagcuuucuacauauagugucugaaugugaagucuuacucaacuugcuuuuuu

SEQ ID NO: 621799 - RNA, 62 nt, hsa
aaagaauaaguauucuugcaucuggccuuagaaaugugaaguuauauucucaaguuuauuuu

SEQ ID NO: 621800 - RNA, 62 nt, hsa
auugccugagaacugcaaugaacaaucugacaaaugugaagcuggccaaaagucggaaaaug

SEQ ID NO: 621801 - RNA, 62 nt, hsa
uaucuucugauuucaaagguaauacaacauuuaaugugaaacauuuagugaauacaguaaag

SEQ ID NO: 621802 - RNA, 62 nt, hsa
aucacuguucuauaggcuuaugaucugagcaaaaugugaacuucaguauguuuacuauugcu

SEQ ID NO: 621803 - RNA, 62 nt, hsa
gugaccuuuucuucauuuugguuuauuuuuguaaugugaaaaguaucacucuaaaaaacauu

SEQ ID NO: 621804 - RNA, 62 nt, hsa
cuggcucugggugagucaguaagugguuagugaaugugaaggccaugauauuacugugcacu

SEQ ID NO: 621805 - RNA, 62 nt, hsa
aauuagacacuuuagaggauauacuuggugauaaugugaaugauguaaucagacuaacaguu

SEQ ID NO: 621806 - RNA, 62 nt, hsa
aauauuauacuaauauguuguacauucggaagaaugugaaucaaucaguauguuuuuagauu

SEQ ID NO: 621807 - RNA, 62 nt, hsa
uuuaacauagguuuuuaaagacuaggauauugaaugugaaacauccguuuucauuguucacu

SEQ ID NO: 621808 - RNA, 62 nt, hsa
gauuguacacauuuuuuucaaugaaguacaauaaugugaacugcauguguaaacagcaucac

SEQ ID NO: 621809 - RNA, 62 nt, hsa
gccaagaacuguauuuacugugguuguggacaaaugugaaaguaacuuuaugcuuaaauaaa

SEQ ID NO: 621810 - RNA, 62 nt, hsa
uaggauagugugauguguaacaaacaaccucaaaugugaaugccuugauuuuauuuuuaugg

SEQ ID NO: 621811 - RNA, 62 nt, hsa
ugugagaucuguaauuuuuuuuuuuuguagaaaaugugaauuuuuugguccucuaauuuguu

SEQ ID NO: 621812 - RNA, 62 nt, hsa
ggaguguuauguuuugccacuauuauuuucagaaugugaagauuuuacucuuggcuuaauuu

SEQ ID NO: 621813 - RNA, 62 nt, hsa
augaauucuuuaggguagaaauuuauuuagcaaaugugaauucuuuugagaaaguaugaagu

SEQ ID NO: 621814 - RNA, 62 nt, hsa
aaauagcaaaacaacaaaaaagcaaaccuuaaaaugugaagaaagugugaauuuuaguuuug

SEQ ID NO: 621815 - RNA, 62 nt, hsa
ugaaugcauauguaugugugguuacuuuuuauaaugugaaauaaugaauaaugaauuuacuc

SEQ ID NO: 621816 - RNA, 62 nt, hsa
uugccaagaggucucccaggagauauuugggaaaugugaaguucguaucuuuaaggagcauu

SEQ ID NO: 621817 - RNA, 62 nt, hsa
agagugguuuuuguuuuuucuuuucagauguuaaugugaaagaaaggguguugcauuuuuac

SEQ ID NO: 621818 - RNA, 62 nt, hsa
uugcagcaagcacuacaauguaugugaucgucaaugugaauagcuuagaauacugcaaagga

SEQ ID NO: 621819 - RNA, 62 nt, hsa
cggcgaccgcccuccgcgaaaauaguuuguuuaaugugaacuuguagcuguaaaacgcuguc

SEQ ID NO: 621820 - RNA, 62 nt, hsa
uuuuuuggguaacaaucccgcagcugacaaaaaaugugaaauuuccacaaaauauccaacuu

SEQ ID NO: 621821 - RNA, 62 nt, hsa
agccagaaagcaaaaaaacaauaguaaugauaaaugugaacauuuuugcuuauucauugaau

SEQ ID NO: 621822 - RNA, 62 nt, hsa
aauguaaucaaaaugaaauauagauuaguuuaaaugugaauucagugacucuagggccaaag

SEQ ID NO: 621823 - RNA, 52 nt, hsa; identical to SEQ ID NO: 451479

SEQ ID NO: 621824 - RNA, 62 nt, hsa
cuuacuaaauccagauuuuuuaaacuguuuuaaaugugaauucuucccagaaauuucaaugc

SEQ ID NO: 621825 - RNA, 62 nt, hsa
uggcuugugaaaaguuguuaaacaacaugcuaaaugugaaauguuaacccucuaaacuuucc

SEQ ID NO: 621826 - RNA, 62 nt, hsa
uaucacuagcagagaguaugauacaauuuucaaaugugaacaaucuuaaauuuagcuugucu

SEQ ID NO: 621827 - RNA, 62 nt, hsa
aaggcauguaggaaaauauugguacguuggaaaaugugaaaagagcuuuacuuucaaaaugu

SEQ ID NO: 621828 - RNA, 62 nt, hsa
gggaggagggaggaaagaugaaaaaccacuuaaaugugaaggaacaacagcaacaagaccag

SEQ ID NO: 621829 - RNA, 62 nt, hsa
cccauuccccuacuccugagcuaggaggaaaaaaugugaaucuuaccagcaguuccagccaa

SEQ ID NO: 621830 - RNA, 62 nt, hsa
cgcgaaccuaugacacuucuuauuccacacugaaugugaaauugcauguucagauguuuacu

SEQ ID NO: 621831 - RNA, 62 nt, hsa
agagauuuagguuuaauuaauuuuacacaucuaaugugaacugcugccuaaccacucaagag

SEQ ID NO: 621832 - RNA, 62 nt, hsa
caccacacccagccuccaucuuuaaacuuuuaaaugugaaauuucuaucauguaccguuagc

SEQ ID NO: 621833 - RNA, 62 nt, hsa
accccuccugccccacuuuggcccagaaaccaaaugugaacuuccugucucccaccucagca

SEQ ID NO: 621834 - RNA, 62 nt, hsa
uauuaaaucuuuuuuaaugcuguacuaagauaaaugugaagucugaguaagguugcucucag

SEQ ID NO: 621835 - RNA, 62 nt, hsa
uaauggugcucacuuuagcagacagcguccacaaugugaauccuacaguuuccaggugaggc

SEQ ID NO: 621836 - RNA, 62 nt, hsa
aauaagagcuuuuuuguuucuuggguuuuuaaaaugugaaucugcaaugaucauaaaaauua

SEQ ID NO: 621837 - RNA, 62 nt, hsa
aaaugugaaucugcaaugaucauaaaaauuaaaaugugaaugucaacaauaaaaagcaagac

SEQ ID NO: 621838 - RNA, 62 nt, hsa
aucuggaggagaggauaauuuccacuguguggaaugugaauaguuaaaugaaaaguuauggu

SEQ ID NO: 621839 - RNA, 62 nt, hsa
cuccuccucucaguauucucuccaaagauugaaaugugaagccccagccccacccucugccc

SEQ ID NO: 621840 - RNA, 62 nt, hsa
ccuuaaacucuuguucaguucacauuaauugaaaugugaacuugccugucguuugcaacuuc

SEQ ID NO: 621841 - RNA, 62 nt, hsa
cgguucaugaaaagcuaugaaacagcaugcuaaaugugaaaugucaacccucacuaaacuuu

SEQ ID NO: 621842 - RNA, 62 nt, hsa
gaauuguauuucaguuuugaagauuuaaaaaaaaugugaaaauaaauauauauuaguauccu

SEQ ID NO: 621843 - RNA, 62 nt, hsa
guagacugccauuauguguggucuucccauuaaaugugaacauuuuaauauguaugcauuca

SEQ ID NO: 621844 - RNA, 62 nt, hsa
cacuccugcuuuccuaaggaugaaacagugauaaugugaacucaaaugagguuuccugggua

SEQ ID NO: 621845 - RNA, 62 nt, hsa
auguugcagaagaccagaucauuuuuauacagaaugugaaauacugauacaguuauucuuuu

SEQ ID NO: 621846 - RNA, 62 nt, hsa
uccauccagacauuugcaaacgucaggagaaaaaugugaauuauuuauccagaugcauguca

SEQ ID NO: 621847 - RNA, 62 nt, hsa
uuauugcuuucauuccuuaccccccucaagcaaaugugaaaaguauacugaccuaagauucu

SEQ ID NO: 621848 - RNA, 62 nt, hsa
gcuuugugcugauaucagaacagcagaaauuaaaugugaaauguuucugaugacuuauguuc

SEQ ID NO: 621849 - RNA, 62 nt, hsa
gccccaggccagagccacccaaugaacagugcaaugugaaggaaggcaggagccugcagggg

SEQ ID NO: 621850 - RNA, 62 nt, hsa
aaugcugauguccucaccacaugcggagaacaaaugugaagggaguaggauauugggucagu

SEQ ID NO: 621851 - RNA, 62 nt, hsa
aaacugagcccuuuguuuaaaaaacaauuccaaaugugaaacuagaaugagagggaagagau

SEQ ID NO: 621852 - RNA, 62 nt, hsa
auuuauaucauagcagaagaaauaggauuaucaaugugaacugcuuagcauggugccuggua

SEQ ID NO: 621853 - RNA, 62 nt, hsa
gcuugucgguucaaagaggaaagaugaauuucaaugugaaaacacguuuuguugagggcugu

SEQ ID NO: 621854 - RNA, 62 nt, hsa
aguauggacucaugagcuauuguugguugcuaaaugugaaucacgcgggagugagugugccc

SEQ ID NO: 621855 - RNA, 62 nt, hsa
acuuuuaacucuugaaauauaggaacuuaaauaaugugaaacuggauuaaacuuaaucuaaa

SEQ ID NO: 621856 - RNA, 62 nt, hsa
aagcaacagaggaccaaugcaacaagaacacaaaugugaaaucaugggcugacugagacaau

SEQ ID NO: 621857 - RNA, 62 nt, hsa
gucucugcagguuagaagucugcuaaagaucaaaugugaaaguacuuggagaaacugaggcc

SEQ ID NO: 621858 - RNA, 62 nt, hsa
cauuuuggaaauguccucauuauguagaauggaaugugaaaauuauuuuuguuaaaacagga

SEQ ID NO: 621859 - RNA, 62 nt, hsa
aauagguacaguaaugaaaacuauacuaucaaaaugugaauaaaauuauagucagccauaaa

SEQ ID NO: 621860 - RNA, 62 nt, hsa
aaccaacuaguuaccuuuggacugcaacaaaaaaugugaaaaugaagauuuauuucuuuuaa

SEQ ID NO: 621861 - RNA, 62 nt, hsa
agaacuuuauaaaaaucuugaguuuguucacuaaugugaaauaagcuauguguccaggguau

SEQ ID NO: 621862 - RNA, 62 nt, hsa
auuuauaggaaaguuauauuaaugagauuaauaaugugaaauacaguuuuccugcaaaauua

SEQ ID NO: 621863 - RNA, 62 nt, hsa
cugccuguuccccuucucccggccuccuucacaaugugaagcugugggugcagugggcccaa

SEQ ID NO: 621864 - RNA, 62 nt, hsa
cccuugucaaaaauuaguugaaauuguucauuaaugugaauacagacugcauuuuaaaauug

SEQ ID NO: 621865 - RNA, 62 nt, hsa
agacacuuugaggcaagcaggaggcucugccuaaugugaauuuauuuauuugugaauaaacu

SEQ ID NO: 621866 - RNA, 62 nt, hsa
uuacagggcauuccaagugauucuuaucaggaaaugugaaaaacacuccuguacauaaucgg

SEQ ID NO: 621867 - RNA, 62 nt, hsa
gaggcguucguaugugacccacagauggcgucaaugugaacaccucucuuugugcugaauuu

SEQ ID NO: 621868 - RNA, 62 nt, hsa
uccaggaaagagagauucccuggaaaauugaaaaugugaauccuagggggaaauuggggauu

SEQ ID NO: 621869 - RNA, 62 nt, hsa
acagguguacaguuaucguuguacuuuuguacaaugugaauuuuguuaauaaauuauaaggu

SEQ ID NO: 621870 - RNA, 62 nt, hsa
caccauuaauuaguugggguggaguuuacuguaaugugaaauuuucacauuugaauuuuuua

SEQ ID NO: 621871 - RNA, 62 nt, hsa
uugaauacuugaaucaugcaggccaauauuauaaugugaaaagguaucuacucuauuuacac

SEQ ID NO: 621872 - RNA, 62 nt, hsa
guuugucaaugauuugucagagaaccuguugaaaugugaauuaagaagcuaagaaaauauuu

SEQ ID NO: 621873 - RNA, 62 nt, hsa
caagcacagugccugcauguauuuauccaauaaaugugaaauucuguccaguuuuguggugg

SEQ ID NO: 621874 - RNA, 62 nt, hsa
aauccauacuagagaaacacuauagauguaaaaaugugaaaaguuuuauucaaaauaucaaa

SEQ ID NO: 621875 - RNA, 62 nt, hsa
uuuugcuguauauuugugauagcacuuucuacaaugugaacuuuauuaaauacaaaacuucc

SEQ ID NO: 621876 - RNA, 62 nt, hsa
gaccguuugcuauauuccuuuuucuaugaaauaaugugaaugauaauaaaacagcuuugacu

SEQ ID NO: 621877 - RNA, 62 nt, hsa
cucaaggucacuagaaaugggccagcugggucaaugugaagccccaaauuugcccagauuca

SEQ ID NO: 621878 - RNA, 62 nt, hsa
aauuuaaaccuuggaucuucaaaaaauaaaauaaugugaagcaaaaccaacuaaaaagugau

SEQ ID NO: 621879 - RNA, 62 nt, hsa
ugaggaucuugauuuggaucucuuuuuauuuaaaugugaauuucaacuuuugacaaucaaag

SEQ ID NO: 621880 - RNA, 62 nt, hsa
uuuucuagaagcacuauuuacacaaauaugcaaaugugaaauaaccgaucuauaacgugaag

SEQ ID NO: 621881 - RNA, 62 nt, hsa
ggcgagggguucggaguguauuuucagguuggaaugugaagguuccuggcuuccaugugacu

SEQ ID NO: 621882 - RNA, 62 nt, hsa
uuuggaaauccuagccaaggggauuucguguaaaugugaacacugacgaacugaaaagcuaa

SEQ ID NO: 621883 - RNA, 62 nt, hsa
cgaguccaacagagaaaggacgucgcuguugaaaugugaaucccggcggacacgccaaauug

SEQ ID NO: 621884 - RNA, 62 nt, hsa
agcucacaccuguaccugaugggaaugaacauaaugugaagaaacuuauuucccaguguaaa

SEQ ID NO: 621885 - RNA, 62 nt, hsa
aaugacagagccuucaaaaauauuuuuggaauaaugugaaucaaccgaaaacugggggcaag

SEQ ID NO: 621886 - RNA, 62 nt, hsa
guugacuucuucccgacccagaaagcauggggaaugugaaggguaugcagaauguuguuggu

SEQ ID NO: 621887 - RNA, 62 nt, hsa
ccgccagaggccugaagcugagcguguacguuaaugugaauguauauagucuuugcagaggu

SEQ ID NO: 621888 - RNA, 62 nt, hsa
augcuccaaccucccggggggacgacgaugacaaugugaaaccaucacagcugggaagacau

SEQ ID NO: 621889 - RNA, 62 nt, hsa
gcuggguagaagcuguuuuaauuccccuguugaaugugaaaaagguaguaguauuccugggu

SEQ ID NO: 621890 - RNA, 60 nt, hsa; identical to SEQ ID NO: 451546

SEQ ID NO: 621891 - RNA, 62 nt, hsa
ggcugcauauccaugggcgggcagcauaagagaaugugaagcccuucagugagacgagacga

SEQ ID NO: 621892 - RNA, 62 nt, hsa
ggcccaucacucggcuguggagaacaaagaccaaugugaagacacuacagaggauucugucu

SEQ ID NO: 621893 - RNA, 62 nt, hsa
ucuaauucuaaggaauaugagcuuuauguaauaaugugaaucaugguuuuucuuaguagauu

SEQ ID NO: 621894 - RNA, 62 nt, hsa
ugcagaagagcuugaaugggacgugcagcgagaaugugaaggauggagcagguagcucaucu

SEQ ID NO: 621895 - RNA, 62 nt, hsa
uuauaucaucuugucaaauugcuucaguuguaaaugugaaaaaugggcuggggaaaggaggu

SEQ ID NO: 621896 - RNA, 62 nt, hsa
auuuaaucccaggaaagaggcaucaaagcuagaaugugaauauaacuuuuguggaccaauac

SEQ ID NO: 621897 - RNA, 62 nt, hsa
agauuucaagagagcucaagcuuucagaagucaaugugaaaauuccuuccuaggcuguccca

SEQ ID NO: 621898 - RNA, 62 nt, hsa
gaaucccacgcuucucuuuggaaacaauaugcaaugugaagcggucguguugugaguuuagu

SEQ ID NO: 621899 - RNA, 62 nt, hsa
ucuuguuuuccuuuuuagaaguuuuuuuccuuaaugugaaaguaauuugaccaaguuauaau

SEQ ID NO: 621900 - RNA, 62 nt, hsa
cacuuccugagcaccugcuacaugccaggcaaaaugugaaauuugcaugcuaugaggcuaaa

SEQ ID NO: 621901 - RNA, 62 nt, hsa
uuuaaaagauuuuuuuauuguuaucaauaauaaaugugaacuauuuaaagaaaagaaugucu

SEQ ID NO: 621902 - RNA, 62 nt, hsa
gcccuugacaggugggggcuggcuggggccuuaaugugaaaagacaguggcaggcagcugga

SEQ ID NO: 621903 - RNA, 62 nt, hsa
uugagacggacuuugacaaaacacgaaaugguaaugugaagcuaagagcagagagugaccaa

SEQ ID NO: 621904 - RNA, 62 nt, hsa
augaaagaaaaugugaccaaagaaaugcacgaaaugugaaguucuuugucacuguccuguau

SEQ ID NO: 621905 - RNA, 62 nt, hsa
aacugcugaaaggugaccaaagaaaugcacaaaaugugaaaaucuuugucacuccauuuugu

SEQ ID NO: 621906 - RNA, 62 nt, hsa
aguagugguauggauauaaccuauuuagauuuaaugugaaauuuaagaaggaaacuugacuu

SEQ ID NO: 621907 - RNA, 62 nt, hsa
uuacuagagcaagauggguuuuuaaggaaaauaaugugaaauucuggaaauuuucuuugggg

SEQ ID NO: 621908 - RNA, 62 nt, hsa
ugucuucuaugccacccuacagauuuuauuuuaaugugaauuauuuuuuucauuucauuuuu

SEQ ID NO: 621909 - RNA, 62 nt, hsa
cgugacauugacaucaaacaaggauuacagugaaugugaaaaaaaaaaaaaaagauaccuga

SEQ ID NO: 621910 - RNA, 62 nt, hsa
uuccuagaccugguugucagccaaaguccuacaaugugaaaagaguuagauacuauuuuacu

SEQ ID NO: 621911 - RNA, 62 nt, hsa
augaaucgcuucucuuuugaaacaauacucauaaugugaaguguuaauacuaguugugaccu

SEQ ID NO: 621912 - RNA, 62 nt, hsa
cuuaaagaaacaaaguccaaaagucacuuuugaaugugaacaaaaggaagaaaaucaaggaa

SEQ ID NO: 621913 - RNA, 62 nt, hsa
ggagaacccuccuaaauccauagaguuuucaaaaugugaaucuuuggaagccuugaguucag

SEQ ID NO: 621914 - RNA, 62 nt, hsa
cugauugguuuucuuucuuuuuccuuggauuaaaugugaaagcaaaggcuucuggcucugcu

SEQ ID NO: 621915 - RNA, 62 nt, hsa
acagcagaagccucucuccuagacugaaaaugaaugugaaacuaggaaauaaaaugugcccc

SEQ ID NO: 621916 - RNA, 62 nt, hsa
caggaaaaaaaaaaaaagaaauucgcauguuuaaugugaacucuccccuccccaucuguguu

SEQ ID NO: 621917 - RNA, 62 nt, hsa
auaucacagaaucagaccaugugucccauggcaaugugaauccaauagucaauuacauaaug

SEQ ID NO: 621918 - RNA, 62 nt, hsa
uauauauauauauauauaacuugaacuucauaaaugugaagauuaccacuucuuuuuauggc

SEQ ID NO: 621919 - RNA, 62 nt, hsa
uagcaacagcucacaugacugaguagguagaaaaugugaaauaaaucucauauauauaguuu

SEQ ID NO: 621920 - RNA, 62 nt, hsa
cauaacuaaugcauagaaaagauacauaaagcaaugugaaaguuucuugcuucuccuuuuua

SEQ ID NO: 621921 - RNA, 62 nt, hsa
aacccuguuugcaccucgauuuguuugcugaaaaugugaaauaguaaaaaugaaauaacugg

SEQ ID NO: 621922 - RNA, 62 nt, hsa
auuuauuugacaaaaaauccaguuaauauauuaaugugaaauaaacccuguuugcaccucga

SEQ ID NO: 621923 - RNA, 62 nt, hsa
agugaaagugacucucagguggugggguggggaaugugaauaaacaugauuucuugccgggc

SEQ ID NO: 621924 - RNA, 62 nt, hsa
ccagagguuuacaaguuuucuaagcuuuugauaaugugaagcuccaggccgagaggaugcug

SEQ ID NO: 621925 - RNA, 62 nt, hsa
guauugaaaaagaucgcgaauaaaaaucaacaaaugugaaagcccagaaaaauauauucgua

SEQ ID NO: 621926 - RNA, 62 nt, hsa
ggaaauuaaaccauucaugaauaaacuuuaaaaaugugaaguguccuuuuccuuuucacaau

SEQ ID NO: 621927 - RNA, 62 nt, hsa
ucuuaaguuguuuaugcuuuaucagacuggcuaaugugaaagcauaauauuaugaaguuuau

SEQ ID NO: 621928 - RNA, 62 nt, hsa
uauaaggcagggaagguucauuuguaaguaguaaugugaacugaauugcauuaagagugugu

SEQ ID NO: 621929 - RNA, 62 nt, hsa
auuugaagaaagacugcauuguaauugagaggaaugugaaggugcauucaugggugcccuug

SEQ ID NO: 621930 - RNA, 62 nt, hsa
uuuuauaacaguuuaccacuaugcuugauuauaaugugaaaggcggaauucugaguguguua

SEQ ID NO: 621931 - RNA, 62 nt, hsa
uuuuaaaucaguguauaaucuagaugguaaaaaaugugaaauugggauuagggaccaaccaa

SEQ ID NO: 621932 - RNA, 62 nt, hsa
aauuauguuucaucaaugugcagaauaaucacaaugugaauuaucaaauucuccucaaugcc

SEQ ID NO: 621933 - RNA, 62 nt, hsa
guugauuuaugcugggcaguggaacgauuuccaaugugaagacgucaauaacuucauuugcg

SEQ ID NO: 621934 - RNA, 62 nt, hsa
ggcauauauguucaaauucaaaccauuuuuaaaaugugaagauggacuucaugcaaguuggc

SEQ ID NO: 621935 - RNA, 62 nt, hsa
uacaguucuguaaugcaaggaugcaguuuaaaaaugugaaguagugaugguuuuugaaauaa

SEQ ID NO: 621936 - RNA, 62 nt, hsa
aaaguauacuaaguaaguuaguuuuuauuauuaaugugaaagcaaaaacuuguauguuaacu

SEQ ID NO: 621937 - RNA, 62 nt, hsa
aaauguacuguuuuagaauguauuacaauaucaaugugaauaucuugaauccuguuacaaau

SEQ ID NO: 621938 - RNA, 62 nt, hsa
aucgagcuguuaauuuuuagacuauagaucaaaaugugaaacauuuuauguucaauccauau

SEQ ID NO: 621939 - RNA, 62 nt, hsa
gcucagaaaagaugcugacucuuucauuauggaaugugaaauaucaguguugucuauaaaua

SEQ ID NO: 621940 - RNA, 62 nt, hsa
gcacaaaauaugcauauaaaagugauggaauuaaugugaaauaaaacaaaaauauaauggcu

SEQ ID NO: 621941 - RNA, 62 nt, hsa
aauugaacuuauccuaaaacaaauaguuuauaaaugugaacuuaaacucuaauuaauuccaa

SEQ ID NO: 621942 - RNA, 62 nt, hsa
accccccacccaggggaccugcuccgugagauaaugugaaauacgacuguggaccaaacgca

SEQ ID NO: 621943 - RNA, 62 nt, hsa
uuuuaaucugcugccauauuguagcucaauacaaugugaauuuguuuuucguuuugggguuu

SEQ ID NO: 621944 - RNA, 62 nt, hsa
uguaagaauguacccuggaucaaaacacuauaaaugugaaaacuacaaggaagguuuuccau

SEQ ID NO: 621945 - RNA, 62 nt, hsa
uaacuacuguaaggagaggagcggcguuggcaaaugugaaccaugagaauaucagugauacu

SEQ ID NO: 621946 - RNA, 62 nt, hsa
uaaaaguaaucauacuggugagaaauucuaaaaaugugaagacuauggcaaagucuuuaaau

SEQ ID NO: 621947 - RNA, 62 nt, hsa
uaagauaauuaaugcuggagagaaacccuacaaaugugaagaauguggcaaagauuucuauu

SEQ ID NO: 621948 - RNA, 62 nt, hsa
uaaaauaauucauaaaggagauaaauuauacaaaugugaagaauguggcaaagcuuuuaaca

SEQ ID NO: 621949 - RNA, 62 nt, hsa
uaagauaauuuauacuggagagaagcccuacaaaugugaaaaauguggcaaaccuuuuaacc

SEQ ID NO: 621950 - RNA, 62 nt, hsa
uuagauaauucaugcuggagagaaacccuacaaaugugaaaaauguggcaaagcuuuuaacc

SEQ ID NO: 621951 - RNA, 62 nt, hsa
uaagauaacucauacuggagaaaaaucuuacaaaugugaagaauguggcaaagccuuuaucc

SEQ ID NO: 621952 - RNA, 62 nt, hsa
caaaauaauucauacaggagagaaacccuacaaaugugaagaaugugacaaagccuuuaacc

SEQ ID NO: 621953 - RNA, 62 nt, hsa
aaacauaauucauaauggagaaaaacccuacaaaugugaagaaugugucaaagcuuuuaacu

SEQ ID NO: 621954 - RNA, 62 nt, hsa
cauaagggaauucauaauagagaaacccuacaaaugugaagaacguggccuggcuuuuaaca

SEQ ID NO: 621955 - RNA, 62 nt, hsa
uaaagaaaaucauucugcugaaaaauccuagaaaugugaagaaugugaaaaagccuuuaaau

SEQ ID NO: 621956 - RNA, 62 nt, hsa
ucauucugcugaaaaauccuagaaaugugaagaaugugaaaaagccuuuaaaugauugucac

SEQ ID NO: 621957 - RNA, 62 nt, hsa
aucggggaauuuaugcugguaggaaacuuucaaaugugaagaauauuggcaggucuauucuc

SEQ ID NO: 621958 - RNA, 62 nt, hsa
gaaacucaaucaauguuauugugaaaacugggaaugugaauguaauauauguagaaaaacau

SEQ ID NO: 621959 - RNA, 62 nt, hsa
ucucugguuguuagcagcaaagaauucucacaaaugugaauaugggcgcacauuugccucau

SEQ ID NO: 621960 - RNA, 62 nt, hsa
gacacagacugcgaccagaacagaaauaugaaaaugugaaugacagcgucccccgugugugg

SEQ ID NO: 621961 - RNA, 62 nt, hsa
uacccccaaguccucucacuccuccagccuggaaugugaagugacuccccaaccccuuuggc

SEQ ID NO: 621962 - RNA, 62 nt, hsa
auaaucucauccccccacccgacuucuuuugaaaugugaacguccuuccuugacugucuagc

SEQ ID NO: 621963 - RNA, 62 nt, hsa
cucagagggcuuuucugaggauuaaauaaauaaaugugaagcacuuagaacugauggccagc

SEQ ID NO: 621964 - RNA, 62 nt, hsa
ucauagacuucauacuggagagaaaccuuacaaaugugaagcaugugacaaaguuuucaguc

SEQ ID NO: 621965 - RNA, 62 nt, hsa
cagaggcggccccucccacggcucccaauaaaaaugugaaaaccaacccccgaacgugagca

SEQ ID NO: 621966 - RNA, 62 nt, hsa
acagauuauuuuuauagugauuuuugcagcuaaaugugaaggcaacugucuuaagucccuuc

SEQ ID NO: 621967 - RNA, 62 nt, hsa
aaguaacauugacuguaagaccucuguagggcaaugugaaaaucaugauugcuacagaagca

SEQ ID NO: 621968 - RNA, 62 nt, hsa
acaugcacaggccugcuugugaaucaggacugaaugugaaagggaaguauugagugaggaca

SEQ ID NO: 621969 - RNA, 62 nt, hsa
ccaacagggaaggcucuguccagaaaggauugaaugugaacgggggcacccccuuuucuugc

SEQ ID NO: 621970 - RNA, 62 nt, hsa
guaaauccugccaccauguuguagcucaauacaaugugaacucacuuuuuuuuuuuuuuuaa

SEQ ID NO: 621971 - RNA, 58 nt, hsa; identical to SEQ ID NO: 451627

SEQ ID NO: 621972 - RNA, 62 nt, hsa
aggggaaauguauuuaugcagcgacaccccacaaugugaacaaacagacaaaaaaucugugc

SEQ ID NO: 621973 - RNA, 62 nt, hsa
auauugcaggcuccacuccagaucaccacaauaaugugaauauugcaauaaagcaagucaua

SEQ ID NO: 621974 - RNA, 62 nt, hsa
aaacauaaaucauaguguugagaaauccuagaaaugugaagaaugugauaaaguuuuaaaug

SEQ ID NO: 621975 - RNA, 62 nt, hsa
uaaaagaaaucauaugaaugagaaauccuagaaaugugaagaaugugacaaagccuuuaaau

SEQ ID NO: 621976 - RNA, 62 nt, hsa
uaagggaauuuauacaggagggaaacccuacaaaugugaagaauguggcaagccuuuuagcu

SEQ ID NO: 621977 - RNA, 62 nt, hsa
aaaagaauucauacuggaggaaaagcccuacaaaugugaaaaacguggcaaagcuuuucauu

SEQ ID NO: 621978 - RNA, 51 nt, hsa; identical to SEQ ID NO: 250138

SEQ ID NO: 621979 - RNA, 62 nt, hsa
auguaagaauugaugauguauuugcaaacauuaaugugaaauaaauugaauuuaauguugaa

SEQ ID NO: 621980 - RNA, 62 nt, hsa
ucuggccucugugccccagcagugccuugugcaaugugaaugugcgcgucucugcuaaacca

SEQ ID NO: 621981 - RNA, 62 nt, hsa
gcacacauuauaaaaauucaaaaauuaccaaaaaugugaaaauuaauucuccccuaacaucc

SEQ ID NO: 621982 - RNA, 62 nt, hsa
cgucuuuuccgacuucaguuuuugugauaaagaaugugaacaguuguuagauguucucagug

SEQ ID NO: 621983 - RNA, 62 nt, hsa
guauccuguuagcuccauucucagggcguuugaaugugaauuaggaccagcgcaaugaaugc

SEQ ID NO: 621984 - RNA, 62 nt, hsa
guauucucaguaguuccgauauguacccucgaaaugugaauguuaucuuaugagacucuguu

SEQ ID NO: 621985 - RNA, 62 nt, hsa
gauggggccuggaaaggcaacuuuuccugauuaaugugaaaaauaauuccuauggacacucc

SEQ ID NO: 621986 - RNA, 62 nt, hsa
uuuuuuuuguuuguuuugagcagacaggcuaaaaugugaacguggggugagggaucacugcc

SEQ ID NO: 621987 - RNA, 62 nt, hsa
uuuagguucugugaacuugcgagucauguagaaaugugaagaguccagugguagaauuugag

SEQ ID NO: 621988 - RNA, 62 nt, hsa
gccucccggagggccccaguuucccucccgugaaugugaaguuccccaucuugguggccugc

SEQ ID NO: 621989 - RNA, 51 nt, hsa; identical to SEQ ID NO: 451645

SEQ ID NO: 621990 - RNA, 62 nt, hsa
ucauagucuucauacugcagagaaaucuuacaaaugugaagacugugacaaaguugucaguc

SEQ ID NO: 621991 - RNA, 62 nt, hsa
gagguuuuuuggaaagccuacuauugcguuucaaugugaacuuugaaaucuuauugugcauc

SEQ ID NO: 621992 - RNA, 62 nt, hsa
cagaagugauuuggaagagaaauccuaaaaugaaugugaacaacagagugaucagaagagug

SEQ ID NO: 621993 - RNA, 62 nt, hsa
augucgacacuguagccacaguuuuggccguaaaugugaauuuggcaaguaaccacuguucc

SEQ ID NO: 621994 - RNA, 62 nt, hsa
gaagccucccucauuccucccaggaauuaauaaaugugaagagaggcucuguuuaaaauguc

SEQ ID NO: 621995 - RNA, 62 nt, hsa
aucucgcuguggacgccuguaaauuacugagaaaugugaaacgugcaaucuugaaacugagg

SEQ ID NO: 621996 - RNA, 62 nt, hsa
cgguuggcgaucucccgacagcuggauccggcaaugugaagcuuuuguuuggguuuccccgc

SEQ ID NO: 621997 - RNA, 62 nt, hsa
uugucuuuaauuucugucagaaugcuauugaaaaugugaauugcaugacuuguagcauauuc

SEQ ID NO: 621998 - RNA, 62 nt, hsa
agaaauguaaagacugaauugaauuuuaagcuaaugugaaaucagagaauguuguaauaagu

SEQ ID NO: 621999 - RNA, 62 nt, hsa
cccuccuugagcucaucagaaagguuuuaugaaaugugaaccauuuugggaaaagcugauca

SEQ ID NO: 622000 - RNA, 62 nt, hsa
aaaauauuuccugacuugaguguuccuuuuuaaaugugaauuuuuauuucuuuuuaauuauu

SEQ ID NO: 622001 - RNA, 62 nt, hsa
aaaauggaaaaaaacauaaaaagcagaauuuuaaugugaagacauuuuuugcuauaaucauu

SEQ ID NO: 622002 - RNA, 62 nt, hsa
gggcauucacagaguagcugugaguucuugguaaugugaaaaaggccuuguuuuucagaaau

SEQ ID NO: 622003 - RNA, 62 nt, hsa
agguccagcccagaucugagaggaacccuggaaaugugaagucucuguugguuugggagaga

SEQ ID NO: 622004 - RNA, 62 nt, hsa
ggugcugggagccccuagaaguuccaaaagagaaugugaagcagaucaaggaaacuucuguu

SEQ ID NO: 622005 - RNA, 62 nt, hsa
uuuuuugucuguuuauuuacgcuuuuauuggaaaugugaauaaguaaagaauuacuuguguu

SEQ ID NO: 622006 - RNA, 62 nt, hsa
uugggacaagcuuuacauggguggggagggaaaaugugaaacacauuagcaauaaguuaaac

SEQ ID NO: 622007 - RNA, 62 nt, hsa
gaaauuccucuuuuagccucuccuuagaggugaaugugaaugaagccucccaggcacccgcu

SEQ ID NO: 622008 - RNA, 62 nt, hsa
cugauaugccuucacucagaagaaaagaaaugaaugugaaagaaagccaagcaucacuugca

SEQ ID NO: 622009 - RNA, 62 nt, hsa
ccagugaauaaagagaaucuaaggauuuguacaaugugaaauaacguguuaaauaaauguca

SEQ ID NO: 622010 - RNA, 62 nt, hsa
cgcugcccucuggagaaccuucuucaaccggaaaugugaagacccucgacaucuugaauugc

SEQ ID NO: 622011 - RNA, 62 nt, hsa
cgccuuuuuggccugugauguuuuauccuuacaaugugaauaauggcacugaccggugcuuu

SEQ ID NO: 622012 - RNA, 62 nt, hsa
caguggccucgugguuauuagcaaggcuggguaaugugaaggcccaagagcagagucugggc

SEQ ID NO: 622013 - RNA, 62 nt, hsa
cuucucagaaacagacugaauuugaucugauuaaugugaaggacuggccagucugggaaacc

SEQ ID NO: 622014 - RNA, 62 nt, hsa
ggcaaagggauccauaugugcaauggcaaagaaaugugaaaaggcauugggagaagcagucu

SEQ ID NO: 622015 - RNA, 62 nt, hsa
uucagaaccuucucugacagacacgguaacuaaaugugaaaaaccaauaagcuggugacuca

SEQ ID NO: 622016 - RNA, 62 nt, hsa
uugaaaauaucacaaguucagaaucccuauacaaugugaauauguggaaauaauuucccagc

SEQ ID NO: 622017 - RNA, 62 nt, hsa
uuuuuuugucagcuuaucaaucagacugaucuaaugugaaauguaaguauccuuaaaaacaa

SEQ ID NO: 622018 - RNA, 62 nt, hsa
cccgccccaccccaccccaccccacccucugaaaugugaaaagccugcacucuuccuguggg

SEQ ID NO: 622019 - RNA, 62 nt, hsa
cugcugcaacuuggagaaccucccugcccugaaaugugaaccaagcacacuuugguuccuuc

SEQ ID NO: 622020 - RNA, 62 nt, hsa
aaaucaagugcaccuacaccaacugcucucaaaaugugaacugacuuuuuuuuuuuuuuuuu

SEQ ID NO: 622021 - RNA, 62 nt, hsa
acagugagaaaagaaaggcuaaacacuauguaaaugugaauggaaacuuggaaauacucguu

SEQ ID NO: 622022 - RNA, 62 nt, hsa
guacuagugaacaccguccucgaucuguacgaaaugugaaauguuuagggacaucuccaugc

SEQ ID NO: 622023 - RNA, 62 nt, hsa
cauggagguaucucccgaaucauacaaaauuaaaugugaagaccguuuaugcauaccuucau

SEQ ID NO: 622024 - RNA, 62 nt, hsa
uauauucggucuuugaaacugacaaucuuugaaaugugaauacuguaacaauauguuuucuu

SEQ ID NO: 622025 - RNA, 62 nt, hsa
ugggggaauuuuuguuuuuuucuguuuucuauaaugugaaacuuuuguaguauguauuuuuc

SEQ ID NO: 622026 - RNA, 62 nt, hsa
aacagcaguauuacuauaagcaguugcuucaaaaugugaauuaacuuguugaaacuguggcu

SEQ ID NO: 622027 - RNA, 62 nt, hsa
uggaucaugcuaugucuguugcaagugaccacaaugugaaagaauuuaagucuuugaucgaa

SEQ ID NO: 622028 - RNA, 62 nt, hsa
uucuuuacauuuucaugaaggcacggagugugaaugugaagacacaagcucuuucuggauac

SEQ ID NO: 622029 - RNA, 62 nt, hsa
uacuucugggcaauuuuuguauccaaggaaauaaugugaaugcgaggaaaugucuuuagagc

SEQ ID NO: 622030 - RNA, 62 nt, hsa
cguguccuccuuauuuaaaaagguauacuuacaaugugaaguaacuuaugaauaaaaggaaa

SEQ ID NO: 622031 - RNA, 62 nt, hsa
uucuugagaaaaagauaaaggguuauaauuugaaugugaacugauccagaaauaagugcugu

SEQ ID NO: 622032 - RNA, 62 nt, hsa
auagagauugauauuaauguaccauguauguuaaugugaaucugugggcaggauacuuuucc

SEQ ID NO: 622033 - RNA, 62 nt, hsa
gaaguauguuuagucagcaugcucaggaaauaaaugugaauugcccuugagaccugcuucua

SEQ ID NO: 622034 - RNA, 62 nt, hsa
guugcuccagaugagucagugaguggugaaugaaugugaaggccuagggcauuacuguauac

SEQ ID NO: 622035 - RNA, 62 nt, hsa
gcugggacgugaccugugcugagggcugugagaaugugaaacaacagugugaaaauuggcug

SEQ ID NO: 622036 - RNA, 62 nt, hsa
agaauggaguuguuggggcaggacaugcacacaaugugaaacagacaaaaugcauuacaccu

SEQ ID NO: 622037 - RNA, 62 nt, hsa
gaaccucuuaagaaguccucagaaccagaagcaaugugaacucucagcgcugguccuggugg

SEQ ID NO: 622038 - RNA, 62 nt, hsa
gccacccuccucgcugccauucucugggcuggaaugugaagccucagucacucuaaaugaag

SEQ ID NO: 622039 - RNA, 62 nt, hsa
uuguaaagaaacuguugaaaauaaagagaagcaaugugaagcaccuggugucuuguaguaua

SEQ ID NO: 622040 - RNA, 62 nt, hsa
ggcugguuggauuuugggguggcaguuggacuaaugugaaaaaaacauugcugaaaaccuaa

SEQ ID NO: 622041 - RNA, 62 nt, hsa
uacacacagaggggaaccgauuuuuuuuauccaaugugaauuauaaaugagauaauccacag

SEQ ID NO: 622042 - RNA, 62 nt, hsa
cuuuuguauggcguuuuuauugugagauauuuaaugugaaugguuggggggacucuggcuga

SEQ ID NO: 622043 - RNA, 62 nt, hsa
gucucucccgagggauggcuuuagucuugaugaaugugaaccaugucggaauuguuagguag

SEQ ID NO: 622044 - RNA, 62 nt, hsa
guauuguggucauuuugaugauauguguguaaaaugugaauaauccaauuggugucuguacu

SEQ ID NO: 622045 - RNA, 62 nt, hsa
aaauguggcauuagaguagaaauaucuuuggaaaugugaaagaccccauagugaaauauuug

SEQ ID NO: 622046 - RNA, 62 nt, hsa
aauaagaugguguguauguaagaaauuuguaaaaugugaagagcuaucuacacuaaguucgu

SEQ ID NO: 622047 - RNA, 62 nt, hsa
gggggacuaugagaucaaaauauuuuuauuauaaugugaagacauugucuuuucacucuauc

SEQ ID NO: 622048 - RNA, 62 nt, hsa
auuuuaagucuuucuuuggucaacuuuuuuuuaaugugaaaaguuagguaagacacuuuuuu

SEQ ID NO: 622049 - RNA, 62 nt, hsa
uucacaccagcaggugucuggacgaaaacaucaaugugaauaagggccaagugcaguccugu

SEQ ID NO: 622050 - RNA, 62 nt, hsa
uuuaaauaagagagaaaugaugccguuuuuuaaaugugaagcagacuauaauucucagcucu

SEQ ID NO: 622051 - RNA, 62 nt, hsa
ggcuuuguagcaagaugagcaaugcuguuggaaaugugaagucaccaguggccuuaccccug

SEQ ID NO: 622052 - RNA, 62 nt, hsa
cccagcaccccauucuuguauacacauggcaaaaugugaagaaacuccuuucaucucagcag

SEQ ID NO: 622053 - RNA, 62 nt, hsa
auuauuaugcaaaaaugaauguuuuuucaaaaaaugugaaauguauuuuauuuucuuuauuu

SEQ ID NO: 622054 - RNA, 62 nt, hsa
cuugauuaaggacuacagaauugggcccuuagaaugugaaaaaaaaaaguaauuaaaaagac

SEQ ID NO: 622055 - RNA, 62 nt, hsa
uuuuucacauuuaagcaggaaugcaauauaaaaaugugaaucucuuaauucucagccaugug

SEQ ID NO: 622056 - RNA, 62 nt, hsa
aagaaggcagggcaguuaaccuuuuuggugccaaugugaaauguaaaugauuuuauguuuuu

SEQ ID NO: 622057 - RNA, 62 nt, hsa
cagaaaugacuuggccucauuuuggauuucauaaugugaaguauucaugauuuugaacuggu

SEQ ID NO: 622058 - RNA, 62 nt, hsa
ccauggcaguaauggggcaaacaauaaaaugcaaugugaaaugauuugaugauuugggaaau

SEQ ID NO: 622059 - RNA, 62 nt, hsa
aggcuguauucagcaaggcgcuaacuugcuuaaaugugaauuacuaacuucuaaaacuguac

SEQ ID NO: 622060 - RNA, 62 nt, hsa
cuacaagagcagaggauuaagguuuuuuuagaaaugugaaacaacauagcaguaaaauacau

SEQ ID NO: 622061 - RNA, 62 nt, hsa
acaguugcuuuggauucucuaagaugaauccaaaugugaaagaugcauguuacugccaaaac

SEQ ID NO: 622062 - RNA, 62 nt, hsa
uccagagcaucuugaacaggaauauuaagauaaaugugaaucugcaauggcugaaaagaguu

SEQ ID NO: 622063 - RNA, 62 nt, hsa
uuagcgugcgguuucccaucaguuuuaccgugaaugugaaaaggugaaacuggugcugacuu

SEQ ID NO: 622064 - RNA, 62 nt, hsa
guguggcauccauguugguuucgucugucuguaaugugaauuccaguauuuguuuaguauuu

SEQ ID NO: 622065 - RNA, 62 nt, hsa
acuguauuugacaaaggaaacucuuaaauuauaaugugaaaccugguuuuaugaaaccaaag

SEQ ID NO: 622066 - RNA, 62 nt, hsa
ugcuuuuuuucuuccuauucagaaaagagcaaaaugugaaaagacacaagacucucagguau

SEQ ID NO: 622067 - RNA, 62 nt, hsa
cgaccugcccuauuuucuauccucacugcaguaaugugaaagugaaguggaaauauugucac

SEQ ID NO: 622068 - RNA, 62 nt, hsa
ccuaaaccuauugauuccucgugauuauuuccaaugugaaaacaguuguguaugauugcauu

SEQ ID NO: 622069 - RNA, 62 nt, hsa
uuugacugcuugaaaaagauuagcauacaucuaaugugaaaagaccacauuugauucaacug

SEQ ID NO: 622070 - RNA, 62 nt, hsa
aucuuuuuaugacuaauaguuuuuugauuaaaaaugugaacaagaaaauacuaaaauaaaaa

SEQ ID NO: 622071 - RNA, 62 nt, hsa
cauauuacagccaguuuggggccccugacugcaaugugaaaccucucgcugcugcuagguuu

SEQ ID NO: 622072 - RNA, 62 nt, hsa
auuuuuuuaaaaauugaguggcacaucaaagaaaugugaaauuaaaaagaauucuuccaaaa

SEQ ID NO: 622073 - RNA, 62 nt, hsa
ggaaacaacucuauuaucuggugacuuuggguaaugugaaucagugccugaggaccuuugcu

SEQ ID NO: 622074 - RNA, 62 nt, hsa
acacaacugauaccuguucuuucuuuccaagaaaugugaauuauuugacugugagacguccu

SEQ ID NO: 622075 - RNA, 62 nt, hsa
aguuauucuugaucagauagaauuuaaccuaaaaugugaacucuuacuuacuuuuuguacau

SEQ ID NO: 622076 - RNA, 62 nt, hsa
gauaaccuaaaauaauuuagaaaugaauuaaaaaugugaaaucggguuaaagugaugaugau

SEQ ID NO: 622077 - RNA, 62 nt, hsa
gcccuugcaaagcagcuggccaaggcuuauuaaaugugaacccaacuuuuccccagggcuuu

SEQ ID NO: 622078 - RNA, 62 nt, hsa
uuuuuacaucuacguuguugcuuucuaaaaugaaugugaaugccaucuuuuaugacugcaac

SEQ ID NO: 622079 - RNA, 62 nt, hsa
uuuagccuucuaauuaguucacuugaaacauaaaugugaaaugucuucauucaauguuaaac

SEQ ID NO: 622080 - RNA, 62 nt, hsa
aguuacagcaguggaauaaguauucauuuagaaaugugaaugagcaguaaaacugaugacau

SEQ ID NO: 622081 - RNA, 62 nt, hsa
ggauaauaacagcaguggaauaaguacuuagaaaugugaaaaaugagcaguaaaauagauga

SEQ ID NO: 622082 - RNA, 62 nt, hsa
acuuuuccucacuuuguugugcacuguaaugaaaugugaaaaaugcuuuauuuagcuguaug

SEQ ID NO: 622083 - RNA, 62 nt, hsa
uuagcgugcgguuucccaucaguuuuacugugaaugugaaaaggugaaacuguugcugacuu

SEQ ID NO: 622084 - RNA, 62 nt, hsa
caguauugugagaucaauuucugaccauaugaaaugugaaaaguauauguuucuguuacaau

SEQ ID NO: 622085 - RNA, 62 nt, hsa
cuuaauuugagacuuuuuuauaaugguuucguaaugugaaaucaaauacuaauuuaaacucu

SEQ ID NO: 622086 - RNA, 62 nt, hsa
aacaauccuucgcuuuuccucacucacguggaaaugugaacugucccggcucugucuucauu

SEQ ID NO: 622087 - RNA, 64 nt, hsa
aaagcugaggcagguggaucaccugaggucaggaauucaagaccagccuggccaacauggugaa

SEQ ID NO: 622088 - RNA, 64 nt, hsa
ccccaucuucccccacccccuuuuugaauuauuaauucaagaucaacaaagcauuccucaagau

SEQ ID NO: 622089 - RNA, 64 nt, hsa
gaaaguaacaaucuauggcuuauuucuaugacaaauucaagagcuagaaaaauaaaauguuuca

SEQ ID NO: 622090 - RNA, 64 nt, hsa
uuugaacaaagcucaaaguaugcaaugcuucauuauucaagaaugaaaaauauaauguugauaa

SEQ ID NO: 622091 - RNA, 64 nt, hsa
aauguaucugcauauguuuuccacauaaauuuuaauucaagaaaugacagucaaaagauccuuc

SEQ ID NO: 622092 - RNA, 64 nt, hsa
gacaaguuuuaguuaaaacucaucacauaaagaaauucaagaaguauuuuuuuaauuucugaag

SEQ ID NO: 622093 - RNA, 64 nt, hsa
aacuuauaguauaaaaauguacuaacaaagacuaauucaagaaguugcaggauacacaauuuuu

SEQ ID NO: 622094 - RNA, 64 nt, hsa
ccucccacaacacgugggaauuauaggagcuacaauucaagaugagauuugagugggaacacag

SEQ ID NO: 622095 - RNA, 64 nt, hsa
aguacagcagaaagaaaagaaguggaacauaagcauucaagauuaauauuugauucucuaucuc

SEQ ID NO: 622096 - RNA, 64 nt, hsa
uaaaacugacauaaaauuuuaugauaauaacaugauucaagaaaugugauguagauuuuugaga

SEQ ID NO: 622097 - RNA, 64 nt, hsa
ugauuuuuuuucauuaaaguauuuccuuuuuuuaauucaagaaaaguuuaccuuucuuaugcuu

SEQ ID NO: 622098 - RNA, 64 nt, hsa
aaaccagcagauaguaaaccugguucaaaguacaauucaagaaacugaguauuuaugggcauug

SEQ ID NO: 622099 - RNA, 64 nt, hsa
auagucuugucaccuuagagcuuguuuauggaagauucaagaaaacuauaaaauacuuaaagau

SEQ ID NO: 622100 - RNA, 64 nt, hsa
cuuuaaagcccaaauaaucauuuuucacauugauauucaagaauugagauagauagaagccaaa

SEQ ID NO: 622101 - RNA, 64 nt, hsa
gaaauauucauuaaaaccauugaaauaaaaauaaauucaagaaaguaagaaguacugauuaugu

SEQ ID NO: 622102 - RNA, 64 nt, hsa
uauaucaaagucagggaugaggagcaggaggacuauucaagauaaacuucuguaaccuaugcau

SEQ ID NO: 622103 - RNA, 64 nt, hsa
aagaguaguuucuuacacaguuuaacacggccugauucaagacucugauaggauucaaacagau

SEQ ID NO: 622104 - RNA, 64 nt, hsa
gaggcugaggcagguggcucacuugaggucaggaauucaagaccagccuggccaacauggugaa

SEQ ID NO: 622105 - RNA, 64 nt, hsa
ucggagguuaagauuaugaaauuuuagaaucucuauucaagaugauguucacuccaaauacacu

SEQ ID NO: 622106 - RNA, 64 nt, hsa
accuuuucugcucuuucaaauaacucuaaugaauauucaagauauuuuagccuuuuaaaaaguu

SEQ ID NO: 622107 - RNA, 64 nt, hsa
aaauccuucccaaaucauaagggcaccuauugagauucaagacaagcagacucguaaaaucuug

SEQ ID NO: 622108 - RNA, 64 nt, hsa
caauggcaaaauacaguaugucacagucaugcacauucaagagagaaaauauaacaaguucuuu

SEQ ID NO: 622109 - RNA, 64 nt, hsa
caguccuuaaugcugaaaacacagagaauggguaauucaagaggccuuucuuuuaaaauagacu

SEQ ID NO: 622110 - RNA, 64 nt, hsa
aaucuguguacugaacauaguagauugacaucuaauucaagauuacaacaucuguuacauucua

SEQ ID NO: 622111 - RNA, 64 nt, hsa
ccaaaaacccaaaaaugcuuuaaccacaguauaaauaauagauuauacacaucaucuuaauaac

SEQ ID NO: 622112 - RNA, 64 nt, hsa
aaagaauauguuuuguugcagcugauuccaguuuauaauagaucccuaguaaaaagcuuugauu

SEQ ID NO: 622113 - RNA, 64 nt, hsa
ucgucugcgauuuuaucuguuaaccaaauaaaacauaauagaauuuccuaaugagauauaucuu

SEQ ID NO: 622114 - RNA, 64 nt, hsa
gguuuuacuacccaaaucuaaauagauacuuuugauaauagauaacugcucuuuuacuaagaca

SEQ ID NO: 622115 - RNA, 64 nt, hsa
uagcugacccuaaauucauuuuucaugcuuaaaaauaauagaacaaauaauaauacuauuuuug

SEQ ID NO: 622116 - RNA, 64 nt, hsa
ucccugguaguaguggucucauucacaaaaaagaauaauagauguaacuggagucacuuugcag

SEQ ID NO: 622117 - RNA, 64 nt, hsa
cagaaauuguaaauaucuuguagcauauucugaaauaauagaguaaguucuucucagagauguu

SEQ ID NO: 622118 - RNA, 64 nt, hsa
uccuccaugcuggcaaugcguuacagguuuuaugauaauagaacuaugacagucuucaagucaa

SEQ ID NO: 622119 - RNA, 64 nt, hsa
uguuaguauuguauuaaacaaauguugcauagagauaauagaacauugcuuguaaauaauucag

SEQ ID NO: 622120 - RNA, 64 nt, hsa
cuuccagaaagucuuugagggaggaccuauacccauaauagaauuauggcacucauuucugaca

SEQ ID NO: 622121 - RNA, 64 nt, hsa
aacucuucuuauucauucuaggcaugacuccuauauaauagauuacucauaaauauacccuccu

SEQ ID NO: 622122 - RNA, 64 nt, hsa
guacaacuuaauuguuuuaaaaaucaguagagauauaauagauaacuuuuucuugucuuuaaga

SEQ ID NO: 622123 - RNA, 64 nt, hsa
agcucguuaccaagugugaaugaagcaauaugucauaauagaguagccacugguugcauaauaa

SEQ ID NO: 622124 - RNA, 64 nt, hsa
aauaugucauaauagaguagccacugguugcauaauaauagagaccuaaauucucaaauaggga

SEQ ID NO: 622125 - RNA, 64 nt, hsa
uuuauauuuuuuuuucuuugagacaacaguacauauaauagagguacaauucguuggauuuuug

SEQ ID NO: 622126 - RNA, 64 nt, hsa
ugacuagaaccauaaaucuuaaaggggguaugugauaauagagggcuggaauuuaaaccuguau

SEQ ID NO: 622127 - RNA, 64 nt, hsa
gaaguaacuggugauauaucucaaauuguaauuaauaauagauugugaauaaugauuuggggau

SEQ ID NO: 622128 - RNA, 64 nt, hsa
uaagagagaugagcacuucuaaguugaguauauuauaauagauuaguacuggauuauucaggcu

SEQ ID NO: 622129 - RNA, 64 nt, hsa; identical to SEQ ID NO: 615355

SEQ ID NO: 622130 - RNA, 64 nt, hsa; identical to SEQ ID NO: 615356

SEQ ID NO: 622131 - RNA, 64 nt, hsa; identical to SEQ ID NO: 615357

SEQ ID NO: 622132 - RNA, 64 nt, hsa; identical to SEQ ID NO: 615358

SEQ ID NO: 622133 - RNA, 64 nt, hsa; identical to SEQ ID NO: 615359

SEQ ID NO: 622134 - RNA, 64 nt, hsa; identical to SEQ ID NO: 615360

SEQ ID NO: 622135 - RNA, 64 nt, hsa; identical to SEQ ID NO: 615361

SEQ ID NO: 622136 - RNA, 64 nt, hsa; identical to SEQ ID NO: 615362

SEQ ID NO: 622137 - RNA, 64 nt, hsa; identical to SEQ ID NO: 615363

SEQ ID NO: 622138 - RNA, 64 nt, hsa; identical to SEQ ID NO: 615364

SEQ ID NO: 622139 - RNA, 64 nt, hsa; identical to SEQ ID NO: 615365

SEQ ID NO: 622140 - RNA, 64 nt, hsa; identical to SEQ ID NO: 615366

SEQ ID NO: 622141 - RNA, 64 nt, hsa; identical to SEQ ID NO: 615367

SEQ ID NO: 622142 - RNA, 64 nt, hsa; identical to SEQ ID NO: 615368

SEQ ID NO: 622143 - RNA, 64 nt, hsa; identical to SEQ ID NO: 615369

SEQ ID NO: 622144 - RNA, 64 nt, hsa; identical to SEQ ID NO: 615370

SEQ ID NO: 622145 - RNA, 64 nt, hsa; identical to SEQ ID NO: 615371

SEQ ID NO: 622146 - RNA, 64 nt, hsa; identical to SEQ ID NO: 615372

SEQ ID NO: 622147 - RNA, 64 nt, hsa; identical to SEQ ID NO: 615373

SEQ ID NO: 622148 - RNA, 64 nt, hsa; identical to SEQ ID NO: 615374

SEQ ID NO: 622149 - RNA, 64 nt, hsa; identical to SEQ ID NO: 615375

SEQ ID NO: 622150 - RNA, 64 nt, hsa; identical to SEQ ID NO: 615376

SEQ ID NO: 622151 - RNA, 64 nt, hsa; identical to SEQ ID NO: 615377

SEQ ID NO: 622152 - RNA, 64 nt, hsa; identical to SEQ ID NO: 615378

SEQ ID NO: 622153 - RNA, 64 nt, hsa; identical to SEQ ID NO: 615379

SEQ ID NO: 622154 - RNA, 64 nt, hsa; identical to SEQ ID NO: 615380

SEQ ID NO: 622155 - RNA, 64 nt, hsa; identical to SEQ ID NO: 615381

SEQ ID NO: 622156 - RNA, 64 nt, hsa; identical to SEQ ID NO: 615382

SEQ ID NO: 622157 - RNA, 64 nt, hsa; identical to SEQ ID NO: 615383

SEQ ID NO: 622158 - RNA, 64 nt, hsa; identical to SEQ ID NO: 615384

SEQ ID NO: 622159 - RNA, 64 nt, hsa; identical to SEQ ID NO: 615385

SEQ ID NO: 622160 - RNA, 64 nt, hsa; identical to SEQ ID NO: 615386

SEQ ID NO: 622161 - RNA, 64 nt, hsa; identical to SEQ ID NO: 615387

SEQ ID NO: 622162 - RNA, 51 nt, hsa
ggguggagacggacguguagcccuggcgaggccagccggcggcagcacagc

SEQ ID NO: 622163 - RNA, 64 nt, hsa
agcguuucugguuuuggguguacagucuugugugccuggcgagaagaauauuuucuauuuuuuu

SEQ ID NO: 622164 - RNA, 64 nt, hsa
ugcagugagccaagauugcaccauugcacuccagccuggcgacagagcaagacucugucucaaa

SEQ ID NO: 622165 - RNA, 64 nt, hsa
ugcagugagccaagaucgugccacugcacuccagccuggcgacacagugagacucugucucaaa

SEQ ID NO: 622166 - RNA, 64 nt, hsa
gccgcccucccuuggccgcccuacuccccaguuuccuggcgaugagccauuuauugugucucac

SEQ ID NO: 622167 - RNA, 64 nt, hsa
cccagagccccaggaaaaugggagugagaagaugccuggcgagguuuuggccaggaggacguga

SEQ ID NO: 622168 - RNA, 64 nt, hsa
cauagcucugugugagccagcaauaccgcugcccccuggcgacagggcagaccaaugaugccag

SEQ ID NO: 622169 - RNA, 64 nt, hsa
aggccaaccggcaccacggacuccuggguggcgcccuggcgaacuuguuugugauaguuggguu

SEQ ID NO: 622170 - RNA, 64 nt, hsa
ugggcggaucacaaggucaggagaucgagaccauccuggcgaacacggugaaaccccgucucua

SEQ ID NO: 622171 - RNA, 64 nt, hsa
uaguaggccuuccuuccuccgcugggcugggucaccuggcgaggguuucacucaucauggaugc

SEQ ID NO: 622172 - RNA, 64 nt, hsa
caaauucagccuccaucacuuaccagucaggaacccuggcgauaucacuuuaacuuucugaacc

SEQ ID NO: 622173 - RNA, 64 nt, hsa
gaauguaacuccuggugugaagaugaauguaaacccuggcgacaguugagaccuuuuucuuuua

SEQ ID NO: 622174 - RNA, 64 nt, hsa
uugggaacaaguguaauuuccuucccuccuuuaaccuggcgaugagcguccuuuaaaccacugu

SEQ ID NO: 622175 - RNA, 64 nt, hsa
guccugccaaggggcgccaggagcagagccagggccuggcgagcuggcguggagcccacaggau

SEQ ID NO: 622176 - RNA, 64 nt, hsa
cccgcagucccugcaugaccauuggcccugcuggccuggcgaugugggcauccugggguucuua

SEQ ID NO: 622177 - RNA, 64 nt, hsa
cuccccuucaugcccuagccuguguucuagcuguccuggcgagacuucugugagugaagaggaa

SEQ ID NO: 622178 - RNA, 64 nt, hsa
gagccaggagucgcggccccugccucccuuccucccuggcgauccucaccugcccagccauggc

SEQ ID NO: 622179 - RNA, 64 nt, hsa
ugcaguguggugagaucaugccacuacacuccagccuggcgacagagcgagacuugguuucaaa

SEQ ID NO: 622180 - RNA, 64 nt, hsa
cacuggugugugccgggcgccgaggccaggggccccuggcgagaaccgcacacaccccucccac

SEQ ID NO: 622181 - RNA, 64 nt, hsa
ugcagugagccgagaucacgccacugcacuccagccuggcgacagagcgagacucccucucaaa

SEQ ID NO: 622182 - RNA, 64 nt, hsa
ccuugacccucagccaagauugguaaagcugcguccuggcgauuccaggagacccagcuggaaa

SEQ ID NO: 622183 - RNA, 64 nt, hsa
uauuuauuagagcugugagagcuugggggacacaccuggcgagcaagcucgcuuuuuaaaaaug

SEQ ID NO: 622184 - RNA, 64 nt, hsa
acugccucauucagagauagaugccugcauggguccuggcgauuauuuuaaugcuggcuacacc

SEQ ID NO: 622185 - RNA, 64 nt, hsa
uacccuuaaugcuugagaaccuaaagcugguuauccuggcgaacaccccuacccuucuauugcg

SEQ ID NO: 622186 - RNA, 64 nt, hsa
ugcagugagacgagaucgcgccacugcacuccagccuggcgacagagcgagacgccgucucaaa

SEQ ID NO: 622187 - RNA, 64 nt, hsa
ugcagugagcugagaucacgccauugcacucaagccuggcgacagagcgagacuccgucucaaa

SEQ ID NO: 622188 - RNA, 64 nt, hsa
auccaucuccugguguucugcagucaucuccccuccuggcgaguucucuuuggaaauagcauga

SEQ ID NO: 622189 - RNA, 64 nt, hsa
cugacuccuaaaccaaaagugcuuuaaaaaccagccuggcgaggacagcccuggacccacucca

SEQ ID NO: 622190 - RNA, 64 nt, hsa
ugggacuuaaaaggcccaagcacugaaaauggaaccuggcgaaagcagaggaggagaaugaaga

SEQ ID NO: 622191 - RNA, 64 nt, hsa
gaucacaccacuguacuccagcccggcacuccagccuggcgacaagagugagacuccaccucaa

SEQ ID NO: 622192 - RNA, 64 nt, hsa
ccagcugccagggccuggggccacugggccagcgccuggcgauacugguugggggcaggaucau

SEQ ID NO: 622193 - RNA, 64 nt, hsa
aucagguaagaggggaacagcugcuguacaucguccuggcgagugacaaugugacagaagccug

SEQ ID NO: 622194 - RNA, 64 nt, hsa
ccucccugaggaguacuucacaccagcuccuuccccuggcgaucagagcucaggugaggaccgg

SEQ ID NO: 622195 - RNA, 64 nt, hsa
uugcccucaagguuuuuugcuuuucuccugugcaccuggcgaggcugaaggcgagggguggagg

SEQ ID NO: 622196 - RNA, 64 nt, hsa
uacagugagccgagaucauaccacugcacuccagccuggcgacagagcaagacuccaucucaaa

SEQ ID NO: 622197 - RNA, 64 nt, hsa
gcccaggacguggguucagcgugggcgaggaaagccuggcgagcguggcccuguaaaagcuuuc

SEQ ID NO: 622198 - RNA, 64 nt, hsa
agguucaucuccagguuucgggauucccauccguccuggcgauccugccagcagugggugggca

SEQ ID NO: 622199 - RNA, 64 nt, hsa
gcacuagcugggccugguggccaccgccagagcuccuggcgacaucuuggcguggcagccucuu

SEQ ID NO: 622200 - RNA, 64 nt, hsa
ccucuguacauuucccugugguucuccguccuucccuggcgagggagcugggacugaagcuuuc

SEQ ID NO: 622201 - RNA, 64 nt, hsa
ggugagauaggggcagauaggagcugcaggggugccuggcgagccucugguuuuccucugcucc

SEQ ID NO: 622202 - RNA, 64 nt, hsa
cguacccucgccagaggccccccuacaucaaccuccuggcgaugcccugguggagcagaugggu

SEQ ID NO: 622203 - RNA, 64 nt, hsa
cugcuguuguaacacccuugauccuggaccaggcccuggcgagaugcauucacaagcacaucug

SEQ ID NO: 622204 - RNA, 64 nt, hsa
gggcaggcucuuguccaguuucagggcugaaaugccuggcgaacuccauucagccaucacauau

SEQ ID NO: 622205 - RNA, 64 nt, hsa
uggugcccccuccuccccggccaaggcgccuggaccuggcgaggacgcugcccgccgagcggac

SEQ ID NO: 622206 - RNA, 64 nt, hsa
cucugugcuccuccuacccuuccagugcccuaggccuggcgacugccccugccuuuuagacccg

SEQ ID NO: 622207 - RNA, 64 nt, hsa
ugacgcgugucccccacucaccuuccccggagacccuggcgaccgccgggcgcugacaccagac

SEQ ID NO: 622208 - RNA, 64 nt, hsa
aggagaaggugugagcaugagccuauuggacacaccuggcgacguauaccaggugucccacccc

SEQ ID NO: 622209 - RNA, 64 nt, hsa
ugcagugagcugagaucacaccacugcacuccagccuggcgacagagagagacuccaucucaaa

SEQ ID NO: 622210 - RNA, 64 nt, hsa
gcagugagccaagaucgcaccacugcacuccagcccuggcgacagagugagacuccaucucaaa

SEQ ID NO: 622211 - RNA, 64 nt, hsa
auuucugacucaucugccagcucuguccugcaugccuggcgagcuggggcccagggcagcauga

SEQ ID NO: 622212 - RNA, 64 nt, hsa
ggcugacgccaagaaugaaguggcccacugcagcccuggcgagcaggcuucuuggauggacagu

SEQ ID NO: 622213 - RNA, 64 nt, hsa
ugcagugagccaagguuccaccacugcacuccagccuggcgacagagcaaggcuccacucaaaa

SEQ ID NO: 622214 - RNA, 64 nt, hsa
gguggaucaccugaggucaggaguuagaggccagccuggcgaaaccccaucucuacuaaaaaua

SEQ ID NO: 622215 - RNA, 64 nt, hsa
ugggcagaucacgaggucaagagaucgagaccauccuggcgaacauggugaaaccccaucucua

SEQ ID NO: 622216 - RNA, 64 nt, hsa
cacugaagcuggacaagagccucaauaaggacacccuggcgaggaagcuggcagugcucacccc

SEQ ID NO: 622217 - RNA, 64 nt, hsa
agaaagcccuuucccagcccuccaccacuuccacccuggcgaguggagcaggggcaggcgaacc

SEQ ID NO: 622218 - RNA, 64 nt, hsa
ugggacgcaaaggagggagggaagcaaggccuugccuggcgaguugucaugugguuggugguga

SEQ ID NO: 622219 - RNA, 64 nt, hsa
caaugugcuaggauuacaggcaugagccacuguaccuggcgaaaaacaguuuguuaacacaggc

SEQ ID NO: 622220 - RNA, 64 nt, hsa
ccccuucaggccuccuuacuccaucuuccagaccccuggcgaccaccgccccucucaguggcuc

SEQ ID NO: 622221 - RNA, 64 nt, hsa
cgguggacuuuuccucuggacaaaaugacagcauccuggcgacuccacaguggagcugagcgcc

SEQ ID NO: 622222 - RNA, 64 nt, hsa
ccuggaaccaccugggucggccgcccaaaucuuuccuggcgaaggggagggaagggguguucug

SEQ ID NO: 622223 - RNA, 64 nt, hsa
gugccaaaccgccccucagcagggcagggccaguccuggcgaccccgguuccucuguguccucu

SEQ ID NO: 622224 - RNA, 64 nt, hsa
cggguggaucacgaggucaggagaucgagaccauccuggcgaacauggugagaccccaucucua

SEQ ID NO: 622225 - RNA, 64 nt, hsa
gggcgaccucaauggugcgugcauccccgagcacccuggcgaccucgugcagaccgaggccuuc

SEQ ID NO: 622226 - RNA, 64 nt, hsa
aggaaagggaugcauugacacucuccugcaugcaccuggcgagaagccaccugaaagucacugu

SEQ ID NO: 622227 - RNA, 64 nt, hsa
ccaucuaggggcacaggcccccacggccgggcccccuggcgacaacuuccaucauuccagagaa

SEQ ID NO: 622228 - RNA, 64 nt, hsa
cuuccgcuugauuuugcacaaucccggcgauacuccuggcgauacugacuagaaagucagggag

SEQ ID NO: 622229 - RNA, 64 nt, hsa
gauuagucgagacugguccucaccugcuccggcuccuggcgaccacuaccccugcgucccggcc

SEQ ID NO: 622230 - RNA, 64 nt, hsa
uucagugagccaagaucgcaccacugcucuccagccuggcgacagagggagacuccaucucaaa

SEQ ID NO: 622231 - RNA, 64 nt, hsa
uuaaaaaaacaacucauucccacauucuucagucccuggcgaccaccauauuuuuaagucauua

SEQ ID NO: 622232 - RNA, 64 nt, hsa
uuuuuuuuuugaugagucucacucugcacuccagccuggcgacagagcaagacuccaucuaaaa

SEQ ID NO: 622233 - RNA, 64 nt, hsa
aucuccacccuaaaauaguucuguugaauuucacccuggcgauguaaacugagagcuuaucuuc

SEQ ID NO: 622234 - RNA, 64 nt, hsa
ugcagugagccgagauugcaccacugcauuccagccuggcgacagagugagacuccaucucaaa

SEQ ID NO: 622235 - RNA, 64 nt, hsa
cuugaguccuggaguuggagaacagccuggaaagccuggcgauaccccaucucuauuuagaaac

SEQ ID NO: 622236 - RNA, 64 nt, hsa
ucgccucugaaugaugcuucuuucuguguuggagccuggcgaaguuguguuuucaagcccucua

SEQ ID NO: 622237 - RNA, 64 nt, hsa
ccucaccaggucucugagcugggugggaggccauccuggcgaccacugcccauuccauucaccc

SEQ ID NO: 622238 - RNA, 64 nt, hsa
ucugccccugcaguggguguuacgggcggugugcccuggcgagcaagcuuugauucuugguucu

SEQ ID NO: 622239 - RNA, 64 nt, hsa
ucagggugccaggaagaucucgucggagccuguuccuggcgagaguaagagccaccgggcuggg

SEQ ID NO: 622240 - RNA, 64 nt, hsa
aggaccuuggagggaggaacaacgagcagaaggcccuggcgacugggcugagcccccaagugaa

SEQ ID NO: 622241 - RNA, 64 nt, hsa
uuuaugagucccuguccucuucugcagguccagcccuggcgagggcaggucagaggaagugaag

SEQ ID NO: 622242 - RNA, 64 nt, hsa; identical to SEQ ID NO: 552517

SEQ ID NO: 622243 - RNA, 64 nt, hsa; identical to SEQ ID NO: 552518

SEQ ID NO: 622244 - RNA, 64 nt, hsa; identical to SEQ ID NO: 552519

SEQ ID NO: 622245 - RNA, 64 nt, hsa; identical to SEQ ID NO: 552520

SEQ ID NO: 622246 - RNA, 64 nt, hsa; identical to SEQ ID NO: 552521

SEQ ID NO: 622247 - RNA, 64 nt, hsa; identical to SEQ ID NO: 552522

SEQ ID NO: 622248 - RNA, 64 nt, hsa; identical to SEQ ID NO: 552523

SEQ ID NO: 622249 - RNA, 64 nt, hsa; identical to SEQ ID NO: 552524

SEQ ID NO: 622250 - RNA, 64 nt, hsa; identical to SEQ ID NO: 552525

SEQ ID NO: 622251 - RNA, 64 nt, hsa; identical to SEQ ID NO: 552526

SEQ ID NO: 622252 - RNA, 64 nt, hsa; identical to SEQ ID NO: 552527

SEQ ID NO: 622253 - RNA, 64 nt, hsa; identical to SEQ ID NO: 552528

SEQ ID NO: 622254 - RNA, 64 nt, hsa; identical to SEQ ID NO: 552529

SEQ ID NO: 622255 - RNA, 64 nt, hsa; identical to SEQ ID NO: 552530

SEQ ID NO: 622256 - RNA, 64 nt, hsa; identical to SEQ ID NO: 552531

SEQ ID NO: 622257 - RNA, 64 nt, hsa; identical to SEQ ID NO: 552532

SEQ ID NO: 622258 - RNA, 64 nt, hsa; identical to SEQ ID NO: 552533

SEQ ID NO: 622259 - RNA, 64 nt, hsa; identical to SEQ ID NO: 552534

SEQ ID NO: 622260 - RNA, 64 nt, hsa; identical to SEQ ID NO: 552535

SEQ ID NO: 622261 - RNA, 64 nt, hsa; identical to SEQ ID NO: 552536

SEQ ID NO: 622262 - RNA, 64 nt, hsa; identical to SEQ ID NO: 552537

SEQ ID NO: 622263 - RNA, 64 nt, hsa; identical to SEQ ID NO: 552538

SEQ ID NO: 622264 - RNA, 64 nt, hsa; identical to SEQ ID NO: 552539

SEQ ID NO: 622265 - RNA, 64 nt, hsa; identical to SEQ ID NO: 552540

SEQ ID NO: 622266 - RNA, 64 nt, hsa; identical to SEQ ID NO: 552541

SEQ ID NO: 622267 - RNA, 64 nt, hsa
ccucuucuggaaaaugaagaaauucaacuaguagauuccugaggucccccuagcuuaaaaaaaa

SEQ ID NO: 622268 - RNA, 64 nt, hsa
auccucucuugcccucccucaauuccccuguaacauuccugaagcuguucccacucccagaugg

SEQ ID NO: 622269 - RNA, 64 nt, hsa
aggggagaauauucccuaagcaacuggcaauaguauuccugaaauaccuagaaauuucuaucug

SEQ ID NO: 622270 - RNA, 64 nt, hsa
cacuugcuauauaguaguaugcaguauuuauauuauuccugaaaauaaaaugaggggagaauau

SEQ ID NO: 622271 - RNA, 64 nt, hsa
uuaguucuucaaguaacaguuuacugguuguuccauuccugaauaugcaggcuaauuuguacag

SEQ ID NO: 622272 - RNA, 64 nt, hsa
cccauacaaaggugcuauccuagggauuuuaugaauuccugaaaggaaaauagaauaugaucaa

SEQ ID NO: 622273 - RNA, 64 nt, hsa
uccuaucaagccaguacgugcuaacaggcucaauauuccugaaugaaauaucagacuagugaca

SEQ ID NO: 622274 - RNA, 64 nt, hsa
aagccuuuccauaaggaauguagcugguuuccucauuccugaaagaaacaguuaacuuucagaa

SEQ ID NO: 622275 - RNA, 64 nt, hsa
gagguucacaguuguauuccaguauucaagauagauuccugauuuuucaauuaggaaaaguaaa

SEQ ID NO: 622276 - RNA, 64 nt, hsa
uuuagaggcauuacuuuuuuaaaaauauuggucaauuccugacauaagaugugagguucacagu

SEQ ID NO: 622277 - RNA, 64 nt, hsa
ugaguuacuguuuuguuccuccccacugcuucccauuccugaguuuuguaauuccuaauccuuc

SEQ ID NO: 622278 - RNA, 64 nt, hsa
uauaguuucuuaaagaaucauuaauccuuauaggauuccugaguuacuguuuuguuccucccca

SEQ ID NO: 622279 - RNA, 64 nt, hsa
uacaacaaauauucauguauuccaaauuuugcucauuccugauuauuuccuuagauuuccaggu

SEQ ID NO: 622280 - RNA, 64 nt, hsa
aauaaauauaaauacacagguaauuuuaacacauauuccugaugaaaucauuauuaucugcaau

SEQ ID NO: 622281 - RNA, 64 nt, hsa
uagcuaguuagagacucgccugggaaauugcuccauuccugaguaaacagauauuuucgcccac

SEQ ID NO: 622282 - RNA, 64 nt, hsa
acuuagggagugugccuugggcgggccauuucacauuccugacccucacuuuucucaucuguaa

SEQ ID NO: 622283 - RNA, 64 nt, hsa
aaggagauuuaauuguaaauaugaaagccaaaguauuccugaauggucaaauacagcaauaaag

SEQ ID NO: 622284 - RNA, 64 nt, hsa
gcaaauauuuuuuuaagggaacuauaaccuuaggauuccugaaaagaauuucaaaaaaaaaaua

SEQ ID NO: 622285 - RNA, 64 nt, hsa
cuuacucuucuacaauguggccggaucauuugucauuccugaauaggucuuucucucaaccugc

SEQ ID NO: 622286 - RNA, 64 nt, hsa
uuucuaagccuacagcaucuugauucauaguauaauuccugaaguaugcugaauggacuuuuua

SEQ ID NO: 622287 - RNA, 64 nt, hsa
ucucagugaggcuaucuuccuuuuccccaguaacauuccugaauuuacuguuaucuuauuguag

SEQ ID NO: 622288 - RNA, 64 nt, hsa
acuguuaucuuauuguaguacuugcaugacauggauuccugauaucugaugagagguucauucu

SEQ ID NO: 622289 - RNA, 64 nt, hsa
cguaggccagugugucucugaaacggauccagcaauuccugagccaagaggaacuugaccccca

SEQ ID NO: 622290 - RNA, 64 nt, hsa
ggauggccagagaugcuggacuugccuaaaauauauuccugagauuuccuccuggccuuuccug

SEQ ID NO: 622291 - RNA, 64 nt, hsa
uauuuucuguugaggaaagauaaaaauguaugcaauuccugaguguagaaacuucuugcacuua

SEQ ID NO: 622292 - RNA, 64 nt, hsa
ucuuuuuaagguuguaaguaccagaguugguggaauuccugaggugcuuccagaaaaccuuauu

SEQ ID NO: 622293 - RNA, 64 nt, hsa
gccacauuaaauacccgugcaggcgcggagaagcaaccggcacccccuuccggccugaaagccc

SEQ ID NO: 622294 - RNA, 64 nt, hsa
ugaguuuggauaguccggccagugcacagaugauaaccggcacauucauucuucuuaaauuauc

SEQ ID NO: 622295 - RNA, 64 nt, hsa
ggccgucccaaaccucgcagggcuccagcaggccaaccggcaccacggacuccuggguggcgcc

SEQ ID NO: 622296 - RNA, 64 nt, hsa
ucgccauuuacucagaaaaaaugucccuuacaggaaccggcagcagcuaggcagucaccggccc

SEQ ID NO: 622297 - RNA, 64 nt, hsa
gauagaauuucucugccagugcaguaagaguugaaaccggcaguuacacuaaguaaguggaggg

SEQ ID NO: 622298 - RNA, 64 nt, hsa
aacccggugguuaacgauuuaauacauauaaccaaaccggcagcguuuagaguugggauauaca

SEQ ID NO: 622299 - RNA, 64 nt, hsa
gggcccagugcaugguggccagaggugucacccaaaccggcaggugcgauuuuguuaacccagc

SEQ ID NO: 622300 - RNA, 64 nt, hsa
ccuuuuccauaaaguguaauuuuaauggcugcaaaaccggcaaccuguaacugcccuuuuaaau

SEQ ID NO: 622301 - RNA, 64 nt, hsa
caguagcugaaccagcagaccuaccugcagugggaaccggcagcaucccagccaggguuugcug

SEQ ID NO: 622302 - RNA, 64 nt, hsa
ccggucacuggcacuccagaagacagcgugccggaaccggcagcucucaccuuucugugacuug

SEQ ID NO: 622303 - RNA, 64 nt, hsa
auuuaauuuuuuuggacucaagaucuaugcuuuaaaccggcaagguuauagauacagccucuag

SEQ ID NO: 622304 - RNA, 64 nt, hsa
auugacacagcugcgaagugcccaggaagaggagaaccggcagcugcuggcugaaguucaggcc

SEQ ID NO: 622305 - RNA, 64 nt, hsa
gguugcaccgcggcgcuucccagcaccaacauguaaccggcauguuuccagcagaagacaaaaa

SEQ ID NO: 622306 - RNA, 64 nt, hsa
acagcuggaguuggccacggccaagaacgacaugaaccggcaccugcacgaguacauggagaug

SEQ ID NO: 622307 - RNA, 64 nt, hsa
uugaugauuuugcauaaaauuaugcauugaugucaaccggcaggcuacaggaacccuggcuggu

SEQ ID NO: 622308 - RNA, 64 nt, hsa
uguacauaagacaaagcuacugccuucuagagacaaccggcagugaccucacugaagacaaaaa

SEQ ID NO: 622309 - RNA, 64 nt, hsa
ucuguuuugaauuuuuuuaauuaauagaaagaccaaccggcaaacuuucagaugaaugcuuacu

SEQ ID NO: 622310 - RNA, 64 nt, hsa
cccucugggcagacugucaucacaugcaugcauaaaccggcaugugugccaaugcacacgagug

SEQ ID NO: 622311 - RNA, 64 nt, hsa
uaugacauauguaauacacaucuguguacacagaaaccggcaccugccagacagagcugguucu

SEQ ID NO: 622312 - RNA, 64 nt, hsa
uguccucgcccaggagggcuucccugucagcaauaaccggcauccguuuuggaaccugcgucug

SEQ ID NO: 622313 - RNA, 64 nt, hsa
aggucgggagcacagccgcuccccaaacccagcaaaccggcagagagccgguuucccagcagcc

SEQ ID NO: 622314 - RNA, 64 nt, hsa
cucccuuuuaggugaagccccuuuuucuugcuaaaaccggcaauucuccgguuagaaauguuac

SEQ ID NO: 622315 - RNA, 64 nt, hsa
cggaggcacagagggcaggagcacagaccccuuaaaccggcauuguauuccaaagacgacaauu

SEQ ID NO: 622316 - RNA, 64 nt, hsa
auuuuacccuugagcuuagccgcgggucccugugaaccggcacauuccuuuccuuuaggccguc

SEQ ID NO: 622317 - RNA, 64 nt, hsa
uaaccuuagagcuuggacagucugagcuguagguaaccggcauauuauuccauaucuuuguuuu

SEQ ID NO: 622318 - RNA, 59 nt, hsa
ccucccuauucuguuauuucuuaguguagguagacaauucuuucaggagcagagcagcg

SEQ ID NO: 622319 - RNA, 59 nt, hsa
augaaaggaacauuugaaagaaaauguggguagacaauuucuugcaacuugggggaaag

SEQ ID NO: 622320 - RNA, 59 nt, hsa
uauugugguggugauuuucucaugagaagguagacaacacuucaguuuuucuugagggg

SEQ ID NO: 622321 - RNA, 59 nt, hsa
gugcuuuagguagguguuauuacauaucuguagacaauugguauaugaaauauacacau

SEQ ID NO: 622322 - RNA, 64 nt, hsa
agcucacaucaaaauagaccagccauuugcacauaguuaccagucacucuguuucugaaaccaa

SEQ ID NO: 622323 - RNA, 64 nt, hsa
aaaagugucagugaaauguaggucuauauggaaaaguuaccauuaggaaaauauggccauacug

SEQ ID NO: 622324 - RNA, 64 nt, hsa
uuaagguuuuuggccugaauagcaggaaagauggaguuaccaguuacugaaauagggaaggaug

SEQ ID NO: 622325 - RNA, 64 nt, hsa
caguacuuugcuuugauugaaggcuguagagcugaguuaccaaaauuucuauuucaaaggaaac

SEQ ID NO: 622326 - RNA, 64 nt, hsa
uugaggcugaacauaauuucauuaucccucaaaaaguuaccaccacaucagaaaaaauaaaaaa

SEQ ID NO: 622327 - RNA, 64 nt, hsa
cauguucuucagauuacaugggauuguaguugggaguuaccauguaacucaaacauaauuaaca

SEQ ID NO: 622328 - RNA, 64 nt, hsa
caagagccccuaagucccagccucugcaauacacaguuaccagaugggaaugcagcacaguggc

SEQ ID NO: 622329 - RNA, 64 nt, hsa
agggaagagacugguuacuagcguaaagcugacaaguuaccaguucaccugaucagaauguauu

SEQ ID NO: 622330 - RNA, 64 nt, hsa; identical to SEQ ID NO: 86375

SEQ ID NO: 622331 - RNA, 64 nt, hsa; identical to SEQ ID NO: 86376

SEQ ID NO: 622332 - RNA, 64 nt, hsa; identical to SEQ ID NO: 86377

SEQ ID NO: 622333 - RNA, 64 nt, hsa; identical to SEQ ID NO: 86378

SEQ ID NO: 622334 - RNA, 64 nt, hsa; identical to SEQ ID NO: 86379

SEQ ID NO: 622335 - RNA, 64 nt, hsa; identical to SEQ ID NO: 86380

SEQ ID NO: 622336 - RNA, 64 nt, hsa; identical to SEQ ID NO: 86381

SEQ ID NO: 622337 - RNA, 64 nt, hsa; identical to SEQ ID NO: 86382

SEQ ID NO: 622338 - RNA, 64 nt, hsa; identical to SEQ ID NO: 410642

SEQ ID NO: 622339 - RNA, 64 nt, hsa; identical to SEQ ID NO: 410643

SEQ ID NO: 622340 - RNA, 64 nt, hsa; identical to SEQ ID NO: 410644

SEQ ID NO: 622341 - RNA, 64 nt, hsa; identical to SEQ ID NO: 410645

SEQ ID NO: 622342 - RNA, 64 nt, hsa; identical to SEQ ID NO: 410646

SEQ ID NO: 622343 - RNA, 64 nt, hsa; identical to SEQ ID NO: 410647

SEQ ID NO: 622344 - RNA, 64 nt, hsa; identical to SEQ ID NO: 410648

SEQ ID NO: 622345 - RNA, 64 nt, hsa; identical to SEQ ID NO: 410649

SEQ ID NO: 622346 - RNA, 64 nt, hsa; identical to SEQ ID NO: 410650

SEQ ID NO: 622347 - RNA, 64 nt, hsa; identical to SEQ ID NO: 410651

SEQ ID NO: 622348 - RNA, 64 nt, hsa; identical to SEQ ID NO: 410652

SEQ ID NO: 622349 - RNA, 64 nt, hsa; identical to SEQ ID NO: 410653

SEQ ID NO: 622350 - RNA, 64 nt, hsa; identical to SEQ ID NO: 410654

SEQ ID NO: 622351 - RNA, 64 nt, hsa; identical to SEQ ID NO: 410655

SEQ ID NO: 622352 - RNA, 64 nt, hsa; identical to SEQ ID NO: 410656

SEQ ID NO: 622353 - RNA, 64 nt, hsa; identical to SEQ ID NO: 410657

SEQ ID NO: 622354 - RNA, 64 nt, hsa; identical to SEQ ID NO: 410658

SEQ ID NO: 622355 - RNA, 64 nt, hsa; identical to SEQ ID NO: 410659

SEQ ID NO: 622356 - RNA, 64 nt, hsa; identical to SEQ ID NO: 410660

SEQ ID NO: 622357 - RNA, 64 nt, hsa; identical to SEQ ID NO: 410661

SEQ ID NO: 622358 - RNA, 64 nt, hsa; identical to SEQ ID NO: 410662

SEQ ID NO: 622359 - RNA, 64 nt, hsa; identical to SEQ ID NO: 410663

SEQ ID NO: 622360 - RNA, 64 nt, hsa; identical to SEQ ID NO: 410664

SEQ ID NO: 622361 - RNA, 64 nt, hsa; identical to SEQ ID NO: 410665

SEQ ID NO: 622362 - RNA, 64 nt, hsa; identical to SEQ ID NO: 410666

SEQ ID NO: 622363 - RNA, 64 nt, hsa; identical to SEQ ID NO: 410667

SEQ ID NO: 622364 - RNA, 64 nt, hsa; identical to SEQ ID NO: 410668

SEQ ID NO: 622365 - RNA, 64 nt, hsa; identical to SEQ ID NO: 410669

SEQ ID NO: 622366 - RNA, 64 nt, hsa; identical to SEQ ID NO: 410670

SEQ ID NO: 622367 - RNA, 64 nt, hsa; identical to SEQ ID NO: 410671

SEQ ID NO: 622368 - RNA, 64 nt, hsa; identical to SEQ ID NO: 410672

SEQ ID NO: 622369 - RNA, 64 nt, hsa; identical to SEQ ID NO: 410673

SEQ ID NO: 622370 - RNA, 64 nt, hsa; identical to SEQ ID NO: 410674

SEQ ID NO: 622371 - RNA, 64 nt, hsa; identical to SEQ ID NO: 410675

SEQ ID NO: 622372 - RNA, 64 nt, hsa; identical to SEQ ID NO: 410676

SEQ ID NO: 622373 - RNA, 64 nt, hsa; identical to SEQ ID NO: 410677

SEQ ID NO: 622374 - RNA, 64 nt, hsa; identical to SEQ ID NO: 375724

SEQ ID NO: 622375 - RNA, 64 nt, hsa; identical to SEQ ID NO: 375725

SEQ ID NO: 622376 - RNA, 59 nt, hsa; identical to SEQ ID NO: 375726

SEQ ID NO: 622377 - RNA, 64 nt, hsa; identical to SEQ ID NO: 375727

SEQ ID NO: 622378 - RNA, 64 nt, hsa; identical to SEQ ID NO: 375728

SEQ ID NO: 622379 - RNA, 64 nt, hsa; identical to SEQ ID NO: 375729

SEQ ID NO: 622380 - RNA, 64 nt, hsa; identical to SEQ ID NO: 375730

SEQ ID NO: 622381 - RNA, 64 nt, hsa; identical to SEQ ID NO: 375731

SEQ ID NO: 622382 - RNA, 64 nt, hsa; identical to SEQ ID NO: 375732

SEQ ID NO: 622383 - RNA, 64 nt, hsa; identical to SEQ ID NO: 375733

SEQ ID NO: 622384 - RNA, 64 nt, hsa; identical to SEQ ID NO: 375734

SEQ ID NO: 622385 - RNA, 64 nt, hsa; identical to SEQ ID NO: 375735

SEQ ID NO: 622386 - RNA, 64 nt, hsa; identical to SEQ ID NO: 375736

SEQ ID NO: 622387 - RNA, 64 nt, hsa; identical to SEQ ID NO: 375737

SEQ ID NO: 622388 - RNA, 64 nt, hsa; identical to SEQ ID NO: 375738

SEQ ID NO: 622389 - RNA, 64 nt, hsa; identical to SEQ ID NO: 375739

SEQ ID NO: 622390 - RNA, 64 nt, hsa; identical to SEQ ID NO: 562765

SEQ ID NO: 622391 - RNA, 64 nt, hsa; identical to SEQ ID NO: 562766

SEQ ID NO: 622392 - RNA, 64 nt, hsa; identical to SEQ ID NO: 562767

SEQ ID NO: 622393 - RNA, 64 nt, hsa; identical to SEQ ID NO: 562768

SEQ ID NO: 622394 - RNA, 64 nt, hsa; identical to SEQ ID NO: 562769

SEQ ID NO: 622395 - RNA, 64 nt, hsa; identical to SEQ ID NO: 562770

SEQ ID NO: 622396 - RNA, 64 nt, hsa; identical to SEQ ID NO: 562771

SEQ ID NO: 622397 - RNA, 64 nt, hsa; identical to SEQ ID NO: 562772

SEQ ID NO: 622398 - RNA, 64 nt, hsa; identical to SEQ ID NO: 562773

SEQ ID NO: 622399 - RNA, 64 nt, hsa; identical to SEQ ID NO: 562774

SEQ ID NO: 622400 - RNA, 64 nt, hsa; identical to SEQ ID NO: 562775

SEQ ID NO: 622401 - RNA, 64 nt, hsa; identical to SEQ ID NO: 562776

SEQ ID NO: 622402 - RNA, 64 nt, hsa; identical to SEQ ID NO: 562777

SEQ ID NO: 622403 - RNA, 64 nt, hsa; identical to SEQ ID NO: 562778

SEQ ID NO: 622404 - RNA, 64 nt, hsa; identical to SEQ ID NO: 562779

SEQ ID NO: 622405 - RNA, 64 nt, hsa; identical to SEQ ID NO: 562780

SEQ ID NO: 622406 - RNA, 64 nt, hsa; identical to SEQ ID NO: 562781

SEQ ID NO: 622407 - RNA, 64 nt, hsa; identical to SEQ ID NO: 562782

SEQ ID NO: 622408 - RNA, 64 nt, hsa; identical to SEQ ID NO: 562783

SEQ ID NO: 622409 - RNA, 64 nt, hsa; identical to SEQ ID NO: 562784

SEQ ID NO: 622410 - RNA, 64 nt, hsa; identical to SEQ ID NO: 562785

SEQ ID NO: 622411 - RNA, 64 nt, hsa; identical to SEQ ID NO: 562786

SEQ ID NO: 622412 - RNA, 64 nt, hsa; identical to SEQ ID NO: 562787

SEQ ID NO: 622413 - RNA, 64 nt, hsa; identical to SEQ ID NO: 562788

SEQ ID NO: 622414 - RNA, 64 nt, hsa; identical to SEQ ID NO: 562789

SEQ ID NO: 622415 - RNA, 64 nt, hsa; identical to SEQ ID NO: 562790

SEQ ID NO: 622416 - RNA, 64 nt, hsa; identical to SEQ ID NO: 562791

SEQ ID NO: 622417 - RNA, 64 nt, hsa; identical to SEQ ID NO: 562792

SEQ ID NO: 622418 - RNA, 64 nt, hsa; identical to SEQ ID NO: 562793

SEQ ID NO: 622419 - RNA, 64 nt, hsa; identical to SEQ ID NO: 562794

SEQ ID NO: 622420 - RNA, 64 nt, hsa; identical to SEQ ID NO: 562795

SEQ ID NO: 622421 - RNA, 64 nt, hsa; identical to SEQ ID NO: 562796

SEQ ID NO: 622422 - RNA, 64 nt, hsa; identical to SEQ ID NO: 562797

SEQ ID NO: 622423 - RNA, 64 nt, hsa; identical to SEQ ID NO: 562798

SEQ ID NO: 622424 - RNA, 64 nt, hsa; identical to SEQ ID NO: 562799

SEQ ID NO: 622425 - RNA, 64 nt, hsa; identical to SEQ ID NO: 562800

SEQ ID NO: 622426 - RNA, 64 nt, hsa; identical to SEQ ID NO: 562801

SEQ ID NO: 622427 - RNA, 64 nt, hsa; identical to SEQ ID NO: 562802

SEQ ID NO: 622428 - RNA, 64 nt, hsa; identical to SEQ ID NO: 562803

SEQ ID NO: 622429 - RNA, 64 nt, hsa; identical to SEQ ID NO: 562804

SEQ ID NO: 622430 - RNA, 64 nt, hsa; identical to SEQ ID NO: 562805

SEQ ID NO: 622431 - RNA, 64 nt, hsa; identical to SEQ ID NO: 562806

SEQ ID NO: 622432 - RNA, 64 nt, hsa; identical to SEQ ID NO: 562807

SEQ ID NO: 622433 - RNA, 64 nt, hsa; identical to SEQ ID NO: 562808

SEQ ID NO: 622434 - RNA, 64 nt, hsa; identical to SEQ ID NO: 562809

SEQ ID NO: 622435 - RNA, 64 nt, hsa; identical to SEQ ID NO: 562810

SEQ ID NO: 622436 - RNA, 64 nt, hsa; identical to SEQ ID NO: 562811

SEQ ID NO: 622437 - RNA, 64 nt, hsa; identical to SEQ ID NO: 562812

SEQ ID NO: 622438 - RNA, 64 nt, hsa; identical to SEQ ID NO: 562813

SEQ ID NO: 622439 - RNA, 64 nt, hsa; identical to SEQ ID NO: 562814

SEQ ID NO: 622440 - RNA, 64 nt, hsa; identical to SEQ ID NO: 562815

SEQ ID NO: 622441 - RNA, 64 nt, hsa; identical to SEQ ID NO: 562816

SEQ ID NO: 622442 - RNA, 64 nt, hsa; identical to SEQ ID NO: 562817

SEQ ID NO: 622443 - RNA, 64 nt, hsa; identical to SEQ ID NO: 562818

SEQ ID NO: 622444 - RNA, 64 nt, hsa; identical to SEQ ID NO: 562819

SEQ ID NO: 622445 - RNA, 64 nt, hsa; identical to SEQ ID NO: 562820

SEQ ID NO: 622446 - RNA, 64 nt, hsa; identical to SEQ ID NO: 562821

SEQ ID NO: 622447 - RNA, 64 nt, hsa; identical to SEQ ID NO: 562822

SEQ ID NO: 622448 - RNA, 64 nt, hsa; identical to SEQ ID NO: 562823

SEQ ID NO: 622449 - RNA, 64 nt, hsa; identical to SEQ ID NO: 562824

SEQ ID NO: 622450 - RNA, 64 nt, hsa; identical to SEQ ID NO: 562825

SEQ ID NO: 622451 - RNA, 64 nt, hsa; identical to SEQ ID NO: 562826

SEQ ID NO: 622452 - RNA, 64 nt, hsa; identical to SEQ ID NO: 562827

SEQ ID NO: 622453 - RNA, 64 nt, hsa; identical to SEQ ID NO: 562828

SEQ ID NO: 622454 - RNA, 64 nt, hsa; identical to SEQ ID NO: 562829

SEQ ID NO: 622455 - RNA, 64 nt, hsa; identical to SEQ ID NO: 562830

SEQ ID NO: 622456 - RNA, 64 nt, hsa; identical to SEQ ID NO: 562831

SEQ ID NO: 622457 - RNA, 64 nt, hsa; identical to SEQ ID NO: 562832

SEQ ID NO: 622458 - RNA, 64 nt, hsa; identical to SEQ ID NO: 562833

SEQ ID NO: 622459 - RNA, 64 nt, hsa; identical to SEQ ID NO: 562834

SEQ ID NO: 622460 - RNA, 64 nt, hsa; identical to SEQ ID NO: 562835

SEQ ID NO: 622461 - RNA, 64 nt, hsa; identical to SEQ ID NO: 562836

SEQ ID NO: 622462 - RNA, 64 nt, hsa; identical to SEQ ID NO: 562837

SEQ ID NO: 622463 - RNA, 64 nt, hsa; identical to SEQ ID NO: 562838

SEQ ID NO: 622464 - RNA, 64 nt, hsa
cagcauuggaaaaagccacuuggacuucacagagcugucagaagacuuaggaagcuuugccagu

SEQ ID NO: 622465 - RNA, 64 nt, hsa
acucucuggagauagcuaccuggacuuuacagagcugucagaagacuugggaagguuugccagc

SEQ ID NO: 622466 - RNA, 64 nt, hsa
cuggauugagugcugucagaaaguggauugagugcugucagaaagugggagugauuuugcaacu

SEQ ID NO: 622467 - RNA, 64 nt, hsa
cucaagugagcaaggguuucuucuggauugagugcugucagaaaguggauugagugcugucaga

SEQ ID NO: 622468 - RNA, 64 nt, hsa
guuguaaagugaaguaagauuggaggguggauggcugucagagcucuugcagauacuguguuca

SEQ ID NO: 622469 - RNA, 64 nt, hsa
gcacgggggcagcgugcagcccugcccugucaggcugucagacaagccccggggggcagcaggu

SEQ ID NO: 622470 - RNA, 64 nt, hsa
auacugcccuucucucugccugccucaccuccagcugucagagggugagcagggcccuggaggc

SEQ ID NO: 622471 - RNA, 64 nt, hsa
cccccagcccagccugcucugcggcccccugcggcugucagagagcggugagaccuggagcgag

SEQ ID NO: 622472 - RNA, 64 nt, hsa
agaugggacguuuuauuugugugcucucccuugacugucagauugaaguaagagcaguucucuc

SEQ ID NO: 622473 - RNA, 64 nt, hsa
agcagagcuuccauuaguguagaccuguagccaccugucagaagguggguggcauauuggggac

SEQ ID NO: 622474 - RNA, 64 nt, hsa
aagaggauuccuucaccacaguuucaccuuuacgcugucagacaacuuccugccacagaagaag

SEQ ID NO: 622475 - RNA, 64 nt, hsa
cgucuuccguguucucagagguucuuuucagugucugucagaacuuggcauacuuucuccauag

SEQ ID NO: 622476 - RNA, 64 nt, hsa
cguggcccgaggggcuguggaacgggucccggaacugucagacauguuugauuuuagcguuucc

SEQ ID NO: 622477 - RNA, 64 nt, hsa
cacaaaggucuugguucucccaggagcucagggccugucagaccuggugacaagugccaaaggc

SEQ ID NO: 622478 - RNA, 64 nt, hsa; identical to SEQ ID NO: 165852

SEQ ID NO: 622479 - RNA, 64 nt, hsa; identical to SEQ ID NO: 165853

SEQ ID NO: 622480 - RNA, 64 nt, hsa; identical to SEQ ID NO: 165854

SEQ ID NO: 622481 - RNA, 64 nt, hsa; identical to SEQ ID NO: 165855

SEQ ID NO: 622482 - RNA, 64 nt, hsa; identical to SEQ ID NO: 165856

SEQ ID NO: 622483 - RNA, 64 nt, hsa; identical to SEQ ID NO: 165857

SEQ ID NO: 622484 - RNA, 64 nt, hsa; identical to SEQ ID NO: 458986

SEQ ID NO: 622485 - RNA, 64 nt, hsa; identical to SEQ ID NO: 458987

SEQ ID NO: 622486 - RNA, 64 nt, hsa; identical to SEQ ID NO: 458988

SEQ ID NO: 622487 - RNA, 64 nt, hsa; identical to SEQ ID NO: 458989

SEQ ID NO: 622488 - RNA, 64 nt, hsa; identical to SEQ ID NO: 458990

SEQ ID NO: 622489 - RNA, 64 nt, hsa; identical to SEQ ID NO: 458991

SEQ ID NO: 622490 - RNA, 64 nt, hsa; identical to SEQ ID NO: 458992

SEQ ID NO: 622491 - RNA, 64 nt, hsa; identical to SEQ ID NO: 458993

SEQ ID NO: 622492 - RNA, 64 nt, hsa; identical to SEQ ID NO: 458994

SEQ ID NO: 622493 - RNA, 64 nt, hsa; identical to SEQ ID NO: 458995

SEQ ID NO: 622494 - RNA, 64 nt, hsa; identical to SEQ ID NO: 458996

SEQ ID NO: 622495 - RNA, 64 nt, hsa; identical to SEQ ID NO: 458997

SEQ ID NO: 622496 - RNA, 64 nt, hsa; identical to SEQ ID NO: 458998

SEQ ID NO: 622497 - RNA, 64 nt, hsa; identical to SEQ ID NO: 458999

SEQ ID NO: 622498 - RNA, 64 nt, hsa; identical to SEQ ID NO: 459000

SEQ ID NO: 622499 - RNA, 64 nt, hsa; identical to SEQ ID NO: 459001

SEQ ID NO: 622500 - RNA, 64 nt, hsa; identical to SEQ ID NO: 459002

SEQ ID NO: 622501 - RNA, 64 nt, hsa; identical to SEQ ID NO: 459003

SEQ ID NO: 622502 - RNA, 64 nt, hsa; identical to SEQ ID NO: 459004

SEQ ID NO: 622503 - RNA, 64 nt, hsa; identical to SEQ ID NO: 459005

SEQ ID NO: 622504 - RNA, 64 nt, hsa; identical to SEQ ID NO: 459006

SEQ ID NO: 622505 - RNA, 64 nt, hsa; identical to SEQ ID NO: 459007

SEQ ID NO: 622506 - RNA, 64 nt, hsa; identical to SEQ ID NO: 459008

SEQ ID NO: 622507 - RNA, 64 nt, hsa; identical to SEQ ID NO: 459009

SEQ ID NO: 622508 - RNA, 64 nt, hsa; identical to SEQ ID NO: 459010

SEQ ID NO: 622509 - RNA, 64 nt, hsa; identical to SEQ ID NO: 459011

SEQ ID NO: 622510 - RNA, 64 nt, hsa; identical to SEQ ID NO: 459012

SEQ ID NO: 622511 - RNA, 64 nt, hsa; identical to SEQ ID NO: 459013

SEQ ID NO: 622512 - RNA, 64 nt, hsa; identical to SEQ ID NO: 459014

SEQ ID NO: 622513 - RNA, 64 nt, hsa; identical to SEQ ID NO: 459015

SEQ ID NO: 622514 - RNA, 64 nt, hsa; identical to SEQ ID NO: 459016

SEQ ID NO: 622515 - RNA, 64 nt, hsa; identical to SEQ ID NO: 459017

SEQ ID NO: 622516 - RNA, 64 nt, hsa; identical to SEQ ID NO: 459018

SEQ ID NO: 622517 - RNA, 64 nt, hsa; identical to SEQ ID NO: 459019

SEQ ID NO: 622518 - RNA, 64 nt, hsa; identical to SEQ ID NO: 459020

SEQ ID NO: 622519 - RNA, 64 nt, hsa; identical to SEQ ID NO: 459021

SEQ ID NO: 622520 - RNA, 64 nt, hsa; identical to SEQ ID NO: 459022

SEQ ID NO: 622521 - RNA, 64 nt, hsa; identical to SEQ ID NO: 459023

SEQ ID NO: 622522 - RNA, 64 nt, hsa; identical to SEQ ID NO: 459024

SEQ ID NO: 622523 - RNA, 64 nt, hsa; identical to SEQ ID NO: 459025

SEQ ID NO: 622524 - RNA, 64 nt, hsa; identical to SEQ ID NO: 459026

SEQ ID NO: 622525 - RNA, 64 nt, hsa; identical to SEQ ID NO: 459027

SEQ ID NO: 622526 - RNA, 64 nt, hsa; identical to SEQ ID NO: 459028

SEQ ID NO: 622527 - RNA, 64 nt, hsa; identical to SEQ ID NO: 459029

SEQ ID NO: 622528 - RNA, 64 nt, hsa; identical to SEQ ID NO: 459030

SEQ ID NO: 622529 - RNA, 64 nt, hsa; identical to SEQ ID NO: 459031

SEQ ID NO: 622530 - RNA, 64 nt, hsa; identical to SEQ ID NO: 459032

SEQ ID NO: 622531 - RNA, 64 nt, hsa; identical to SEQ ID NO: 459033

SEQ ID NO: 622532 - RNA, 64 nt, hsa; identical to SEQ ID NO: 459034

SEQ ID NO: 622533 - RNA, 64 nt, hsa; identical to SEQ ID NO: 459035

SEQ ID NO: 622534 - RNA, 63 nt, hsa
cccaucacgcagacaggaaggguguuugcgcacucugaucaacuggaaccucuguaucaugcg

SEQ ID NO: 622535 - RNA, 63 nt, hsa
aggaugguagcuggaauaccuuccuucuuaaaaucugaucauggcagggauaugcagggcacu

SEQ ID NO: 622536 - RNA, 63 nt, hsa
acugaugcagucccuagggaauagaauggugcuucugaucaccugugacaugaacaguuucuu

SEQ ID NO: 622537 - RNA, 63 nt, hsa
uggagagggcugaagcuguugcugggggccgauucugaucaagacacauggcuugaaaaugga

SEQ ID NO: 622538 - RNA, 63 nt, hsa
cuacagagucugagaagauaucaucaugcugaaucugaucauacuguuuuuuaaaaguuuaag

SEQ ID NO: 622539 - RNA, 63 nt, hsa
caacccucaucaccaugcuuccccuagaaggguucugaucaccggagggcagccccaaaggcc

SEQ ID NO: 622540 - RNA, 63 nt, hsa
gugcacucaguuccuguauacuguguguuuuguucugaucaagggguagggaaccuuuccaga

SEQ ID NO: 622541 - RNA, 63 nt, hsa
cugccagucgguucccacggagccauuuuuagcucugaucagcaugggaaugugccucggccu

SEQ ID NO: 622542 - RNA, 63 nt, hsa
cccccacucuauacuagggacuggaucucagccucugaucaguuucacaaaguuuguucccua

SEQ ID NO: 622543 - RNA, 63 nt, hsa
cagacugcugcaaagcuuuugccugcaagagaaucugaucaauuugaagucccuguuugggaa

SEQ ID NO: 622544 - RNA, 63 nt, hsa
aggucggggaggaguggagcuauccuuccaugaucugaucauguacaguucccuuuuuaaaaa

SEQ ID NO: 622545 - RNA, 63 nt, hsa
uuuacucccuuauagaaagaauugugugaauguucugaucacuaccacccagcugguuccagc

SEQ ID NO: 622546 - RNA, 63 nt, hsa
cucacacugcagccaagguuuuuaucauguuacucugaucauguuuuucacccccugacauuc

SEQ ID NO: 622547 - RNA, 63 nt, hsa
ucuaaggaaagaguugauccuuaugagggagauucugaucauauuaaaaaucuggguaaacua

SEQ ID NO: 622548 - RNA, 63 nt, hsa
gucuuuaauuucaggaaucagaaaucauaggguucugaucacauugcacgccuccccccucac

SEQ ID NO: 622549 - RNA, 63 nt, hsa
agaacuaggaguaaguccaucucaagguggacuucugaucauugaggauggugagauaaauag

SEQ ID NO: 622550 - RNA, 63 nt, hsa
acuuuaaagauagacuuuaggggcuggcacaaaucugaucagagacacauauccauacacagg

SEQ ID NO: 622551 - RNA, 63 nt, hsa
uaggcaaugcuggaaggaaaugaaauuauaccuucugaucaaauaaccauggcuucccucagc

SEQ ID NO: 622552 - RNA, 63 nt, hsa
caaagaaaaauuugguaggcgguaguuuagaacucugaucagguacuacaucaaccaaaagag

SEQ ID NO: 622553 - RNA, 63 nt, hsa
cauauaacuuuuaacucuuuggcuauccugggcucugaucaugauauguuugagcauaguagc

SEQ ID NO: 622554 - RNA, 63 nt, hsa
ucaauggccuggucaacaucaacaaccccucccucugaucauuuccaguugauugucauaucc

SEQ ID NO: 622555 - RNA, 63 nt, hsa
acuguuggacucuauucagugucauguccuauaucugaucaaguuaucaaggagauaauucua

SEQ ID NO: 622556 - RNA, 63 nt, hsa
aauuaaugcaguuuugcacaaauauuuuuacauucugaucauucaguucugucauuguaaucu

SEQ ID NO: 622557 - RNA, 63 nt, hsa
ucccucuccacuaguggugaaugcaugugucugucugaucagcaucacugcacacggaggucu

SEQ ID NO: 622558 - RNA, 63 nt, hsa
cuguugagguaaaguuugcacagucaucugacuucugaucaagcauuagauuuuaacuuguuu

SEQ ID NO: 622559 - RNA, 63 nt, hsa
aaauguuugcuuauuucccuacuaaaauuuguaucugaucaaagcacauaagaauauaaauaa

SEQ ID NO: 622560 - RNA, 63 nt, hsa
uuuagaaauacauagacauugucuuuuaugaauucugaucauauuuagucauuuugaccaaau

SEQ ID NO: 622561 - RNA, 63 nt, hsa
cguacacugacuuuggggccuggguguugggguucugaucagaauuuggcgggaugauauguu

SEQ ID NO: 622562 - RNA, 63 nt, hsa
aaagaaugauuuugugaauucugugauuuuucuucugaucaguuucaaucuguaauaaaugcc

SEQ ID NO: 622563 - RNA, 63 nt, hsa
caucucagcaaaaugggcacugccagagccauuucugaucacaccaccauccuggaccaugug

SEQ ID NO: 622564 - RNA, 63 nt, hsa
ucuacauggaccuauguauauauaucuaagaccucugaucauuaaaaccuauaaaggguugag

SEQ ID NO: 622565 - RNA, 63 nt, hsa
aauucuggcuucacuacugcucacugcucacuuucugaucacucugauacuuuuuuuuuuuuu

SEQ ID NO: 622566 - RNA, 63 nt, hsa
aacuugaaaaacacuucugugcuaccacucaguucugaucaaauccuuacauuuugcaacacu

SEQ ID NO: 622567 - RNA, 63 nt, hsa
gaagggugugaaggcugaacaaucauggauuuuucugaucaauugugcuuuaggaaauuauug

SEQ ID NO: 622568 - RNA, 63 nt, hsa
uggauuauaaauuucuuucauacgguuguauuuucugaucauugguuucuuaauaugguugua

SEQ ID NO: 622569 - RNA, 63 nt, hsa
ugguggggguguauuagcagccaaauaagcacaucugaucaaaaagaaccaggcuuagauuuu

SEQ ID NO: 622570 - RNA, 63 nt, hsa
aaggcaggcgcacgagguccagggaggcccuuuucugaucaugccccuucucucccaccccau

SEQ ID NO: 622571 - RNA, 63 nt, hsa
ggucucccucagaagccccuuccuccacagacuucugaucaucucccucuucuccccuccuuu

SEQ ID NO: 622572 - RNA, 63 nt, hsa
aaucaugcaacguguugggggaaguucugccuuucugaucaaucuuuuggguucacguggaaa

SEQ ID NO: 622573 - RNA, 63 nt, hsa
uuaccuagguugccaaagguaauuuaggaagggucugaucauuuagaugagaguucuuugggg

SEQ ID NO: 622574 - RNA, 63 nt, hsa
cauucaaaaaaaagaacuuugaaagagaaucuuucugaucaccuuagaaauggcaguaagccc

SEQ ID NO: 622575 - RNA, 63 nt, hsa
acccaccaggccuuaccuaguguuucccaucccucugaucacauagcacuuguaugugauuua

SEQ ID NO: 622576 - RNA, 63 nt, hsa
uaacauuaaauuuaugaguauuuuacucugaauucugaucaccagauaauucauuuuucugau

SEQ ID NO: 622577 - RNA, 63 nt, hsa
agaaaauuucugacugauagaguagaugccuguucugaucaagauaacguguauaaaaaauca

SEQ ID NO: 622578 - RNA, 63 nt, hsa
ggaagaaaugcaucacuagggguugauucccaaucugaucaacugauaaugggugagagagca

SEQ ID NO: 622579 - RNA, 63 nt, hsa
gugccccaugccccauuacaggcucacacccagucugaucaggcugaguuuuguauguaucua

SEQ ID NO: 622580 - RNA, 63 nt, hsa
ggaauaugugaagauguuuuuaugaagucucuuucugaucacgaacaauagcuugcgcucuac

SEQ ID NO: 622581 - RNA, 63 nt, hsa
agaaggaugggacuauuacauccacaugauaccucugaucaaguauuuuugacauuuacugug

SEQ ID NO: 622582 - RNA, 63 nt, hsa
uuaacacauuguuauuucuguaggagcaacuucucugaucaaaauuacuuuucuggguaugug

SEQ ID NO: 622583 - RNA, 63 nt, hsa
uauauacuguauucuagccagaauaauuuuagaucugaucagguaguagcuaaaauuagaaaa

SEQ ID NO: 622584 - RNA, 63 nt, hsa
gucgcucuccuucgauuccauuuuaccuccucuucugaucacuuccagagaugagcuguuucu

SEQ ID NO: 622585 - RNA, 63 nt, hsa
gcaggugcccacauucugcuaaugagagcuuugucugaucaguccuggguccaucaguuuguc

SEQ ID NO: 622586 - RNA, 63 nt, hsa
ggguuuugauacuuauguugaaauacuaauguuucugaucaauaaaaucaaacucuuaauaua

SEQ ID NO: 622587 - RNA, 63 nt, hsa
ccuuuugauuugauaaguuauaaauucugugguucugaucauugguccagaggggagauaggu

SEQ ID NO: 622588 - RNA, 63 nt, hsa
uggcauuuuauguccuucuguguccuucauguaucugaucaaugaagaccuguaacacuaagu

SEQ ID NO: 622589 - RNA, 63 nt, hsa
aaacagccuauuuacaaguggaaacacauugguucugaucacuccuaacuugcugggugauca

SEQ ID NO: 622590 - RNA, 63 nt, hsa
ccagcucaaccuuugugcugacaucauaccauuucugaucaugaaauauuggcuacuggugua

SEQ ID NO: 622591 - RNA, 63 nt, hsa
auaaauuuacguucucagcaacuguuauuucucucugaucauuaauuauauguaaaauaauau

SEQ ID NO: 622592 - RNA, 63 nt, hsa
guuaauauuaagcaaggugccgguuguacaaucucugaucagugucuuuucagcacuuugagc

SEQ ID NO: 622593 - RNA, 63 nt, hsa
uauauauauauauaccauaaaagcaauauguucucugaucauauacucugcuguggucaugcc

SEQ ID NO: 622594 - RNA, 63 nt, hsa
uuuuccauaggcauuaaagugcugaaugcucagucugaucaacaagugggcaccugcacuacc

SEQ ID NO: 622595 - RNA, 63 nt, hsa
uguuuuauaaaagcucuagauaaaacuuucuuuucugaucaugaaucaaguaucugugguuuc

SEQ ID NO: 622596 - RNA, 63 nt, hsa
uucaacagaauuuauauguuguaauaggaauuaucugaucaauuacacucuuauauauaauuu

SEQ ID NO: 622597 - RNA, 63 nt, hsa
aaaccggggaaccccaacugggaaaggaggcccucugaucacacgcaggacccaaacacucag

SEQ ID NO: 622598 - RNA, 63 nt, hsa
uagagugcuuccuccuaaccauucuuuaccguuucugaucacacagaauugagaaagaucucu

SEQ ID NO: 622599 - RNA, 63 nt, hsa
aaaauccacucuuuuauuauguugagauuaucuucugaucaggaaguuugagugcuaugcaaa

SEQ ID NO: 622600 - RNA, 63 nt, hsa
guauauauuuaaguuuuaagugacacuuggauuucugaucaguguugcaaaaaauugcuacuu

SEQ ID NO: 622601 - RNA, 63 nt, hsa
gacucucaaccaacuucagaucuaugacauuauucugaucacuggcuccaucauacauauuca

SEQ ID NO: 622602 - RNA, 63 nt, hsa
acucagcaugacgacugaguagacuuguuuacaucugaucaaagcacugggcuuguccaggcu

SEQ ID NO: 622603 - RNA, 63 nt, hsa
uacugaagaagcuuuugaaguuugugguaaucgucugaucauauaaaccacccauuucagagu

SEQ ID NO: 622604 - RNA, 63 nt, hsa
aacucaaguaaaugcuucagucaggacucugagucugaucaugaauuuuauguuuuaauuuau

SEQ ID NO: 622605 - RNA, 63 nt, hsa
caaaggacacagaaaaaaaauggccccaggagaucugaucacacuuccuccugaggcaccucu

SEQ ID NO: 622606 - RNA, 63 nt, hsa
cuuggcacuuuuucguguggaucuugccacauuucugaucagagguguacacuaacauuuccc

SEQ ID NO: 622607 - RNA, 63 nt, hsa
ccuaauuuuuuaugcuaaaacuggcucaauccuucugaucauugcaguuuucucucaaauaug

SEQ ID NO: 622608 - RNA, 63 nt, hsa
ccacaucccuccacuucuccaacuucuguuuaaucugaucacggcucuuuuuaagcccuggca

SEQ ID NO: 622609 - RNA, 63 nt, hsa
aaacagucuacacagucucacguagaccaaaauucugaucauuuuccaggcuguugcaugaag

SEQ ID NO: 622610 - RNA, 63 nt, hsa
ggggacccagacugccuucaucucugauggcagucugaucacuguggccacugugcgagccgu

SEQ ID NO: 622611 - RNA, 63 nt, hsa
uccucaagcaacacuccuagggccuggcuucugucugaucaaggcaccacacaacccagaaag

SEQ ID NO: 622612 - RNA, 63 nt, hsa
uuuuuaaguggcacggucuuuuucugcuugaaaucugaucacaccccccagccauugcccucc

SEQ ID NO: 622613 - RNA, 63 nt, hsa
uucaccguaguaacacauaaaguaaaugcuaccucugaucaaagcaccuugaauggaaggucc

SEQ ID NO: 622614 - RNA, 63 nt, hsa
ucugaguuacucgggagggaaaagugcagcuccucugaucaucugccccaugagugggauaga

SEQ ID NO: 622615 - RNA, 63 nt, hsa
ucaguucccacuugcuuggguuccuggggguuuucugaucacuggugcgcauugauguacaua

SEQ ID NO: 622616 - RNA, 63 nt, hsa
cuguaauggguaaaagccacauuuaggagguggucugaucauagaacaccuuaggaagaaagu

SEQ ID NO: 622617 - RNA, 63 nt, hsa
cauguugacuauuugcaacgagcucaaaugcuaucugaucaaagucuauuuugcauaaaaugu

SEQ ID NO: 622618 - RNA, 63 nt, hsa
ucaagucucuuccagagugcgagacucagcuuaucugaucaaggugaacuugcccuucaauag

SEQ ID NO: 622619 - RNA, 63 nt, hsa
uuauaacuguccagaagugugggcuauguauuaucugaucagucuauggucccaguaaaagua

SEQ ID NO: 622620 - RNA, 63 nt, hsa
ucaauauuuucugugauaauuuauuacuuuguaucugaucagcuguuuguggauuuaauuaaa

SEQ ID NO: 622621 - RNA, 63 nt, hsa
uaagguaaaaaugagguuuccaagauuuaauaaucugaucaaguucuuguuauuuccaaauag

SEQ ID NO: 622622 - RNA, 63 nt, hsa
caggaguuucuauagcgagacauagaauaguauucugaucaguugccaaagaaucuaggaaau

SEQ ID NO: 622623 - RNA, 63 nt, hsa
aguugacaccagcuaaggcugcuuaaaauaaguucugaucauuauauaagaagggaaaugccu

SEQ ID NO: 622624 - RNA, 63 nt, hsa
guugagaucagugacugcuggauagucucccagucugaucaaugaagcauucgauuaguuuuu

SEQ ID NO: 622625 - RNA, 63 nt, hsa
uuuaauuuuggccacuuguagguaucagugugaucugaucaacacucugguuaccuuggucag

SEQ ID NO: 622626 - RNA, 63 nt, hsa
guuucccuuaccugaucgacauauuuuccuuuaucugaucaacccaucaaucauguggauuuc

SEQ ID NO: 622627 - RNA, 63 nt, hsa
ugacauaauaguccaccucccauuacuuugauaucugaucaaauguauagacuuggcuuuguu

SEQ ID NO: 622628 - RNA, 63 nt, hsa
cuugaauaaggaaaugacaauuuuuuccacuuaucugaucagaacaaauguuuauuaagcauc

SEQ ID NO: 622629 - RNA, 63 nt, hsa
caccuggccaggauuugguuguuuaaauauaaaucugaucaccccccugcuuagaacccuucu

SEQ ID NO: 622630 - RNA, 63 nt, hsa
uuuuaauccccuuuaaugaugcagugguuuuuaucugaucaggaacuugucaugauuuccuuu

SEQ ID NO: 622631 - RNA, 63 nt, hsa
uugucaggaugggagaggccgcagguguuguguucugaucacuggucugugcccucacagcac

SEQ ID NO: 622632 - RNA, 63 nt, hsa
uaacuuuaacuuuugaaaagaccaagacuuuugucugaucaagugguuuuacagcuaccaccc

SEQ ID NO: 622633 - RNA, 63 nt, hsa
gaccugcuuaaacaaguacugcugagauaagugucugaucaagcuacaguguacuuuaaguag

SEQ ID NO: 622634 - RNA, 63 nt, hsa
agggcacucugagauagcacugcucuggggccaucugaucaccaucgggagcaaaucucugac

SEQ ID NO: 622635 - RNA, 63 nt, hsa
gaauugcaauuuuaagaccagaaaaauuugaagucugaucagagauuuacaacuguucauuau

SEQ ID NO: 622636 - RNA, 63 nt, hsa
ucguauguuaguuucacuugucuacuuuauaugucugaucaauuuggauaccauuuuguccag

SEQ ID NO: 622637 - RNA, 63 nt, hsa
cgagggagagaccuuuccacugcagagagucucucugaucaagacaccgcagugauggagaag

SEQ ID NO: 622638 - RNA, 63 nt, hsa
gcucaguuuguagugaugggaaguguauuuuacucugaucaaauaaauaaugcuggaauacuc

SEQ ID NO: 622639 - RNA, 63 nt, hsa
auuaucaucacagcagaaaaaagucauugcauaucugaucaauaacuucagauucuaagagug

SEQ ID NO: 622640 - RNA, 63 nt, hsa
uuaguauauugcgguuaugugucauuguaccccucugaucauuuccuguguuugaguuggaau

SEQ ID NO: 622641 - RNA, 63 nt, hsa
ccacaucaugaccaaaggaaccccucccuggugucugaucagggcuguggcaucacgaaacau

SEQ ID NO: 622642 - RNA, 63 nt, hsa
cagguuaagacaaaggguugacuggccuauuuaucugaucaagaacaugucagcaaugucucu

SEQ ID NO: 622643 - RNA, 63 nt, hsa
ggugcagguuuuggguuuggcauuauucauguuucugaucaauucuaugcaacucucauaguu

SEQ ID NO: 622644 - RNA, 63 nt, hsa
uagaggcugaaugacaaugccaaacacuccaccucugaucagaaccaugcaguguuaacacuu

SEQ ID NO: 622645 - RNA, 63 nt, hsa
cuggggaggagguugauguaauggugacucuuuucugaucagcaccuuggccgugauucccaa

SEQ ID NO: 622646 - RNA, 63 nt, hsa
uuguauguaaagauaccucugagguccaacagcucugaucauuuugggcuucaagucucucuc

SEQ ID NO: 622647 - RNA, 63 nt, hsa
uaaagaaaacaauauugaaauuuugcucuauuuucugaucaugaaacugauuguaaagcuuuu

SEQ ID NO: 622648 - RNA, 63 nt, hsa
cuguagaugaucggccugcuggugugguaguaaucugaucacagauauucuuaaaucagcagu

SEQ ID NO: 622649 - RNA, 63 nt, hsa
gcuuuuccaccaaaagccugaaucugucaauccucugaucaaauaucugagugccaccacugg

SEQ ID NO: 622650 - RNA, 63 nt, hsa
acuucucuccaagggcaggcuguuaggccccuuucugaucaggaggcuucuuuaugaauuaaa

SEQ ID NO: 622651 - RNA, 63 nt, hsa
ucacagggagaaacuugccucugaaagcuauuuucugaucaagaaaaggcccacuuuuuaaaa

SEQ ID NO: 622652 - RNA, 63 nt, hsa
cagacacagacaagcuucauuuaaauuauuucaucugaucauuaucauuuauaacuuuauugu

SEQ ID NO: 622653 - RNA, 63 nt, hsa
caauucaagugacacauuaaugauaaacucagaucugaucaagaguccggauuucuaacaguc

SEQ ID NO: 622654 - RNA, 63 nt, hsa
cuacucaagcuccucuggccgcggaacaauuccucugaucauguuugguuuucuucuuccuua

SEQ ID NO: 622655 - RNA, 63 nt, hsa
gaagucaacuggguggccuuuucuggguuaucuucugaucauggccuuucaacccaacaaggg

SEQ ID NO: 622656 - RNA, 63 nt, hsa
aauauuucugcuucaagccuuuaggaauuaagaucugaucagaauuuaacuaaaggguaguug

SEQ ID NO: 622657 - RNA, 63 nt, hsa
uuuuaucuguaaugguuugucugucuuuuuuccucugaucaguauuuuuuuauaccaguuuug

SEQ ID NO: 622658 - RNA, 63 nt, hsa
uccugauguuuaagaccugaaccccagccccaaucugaucagacaucauggacucgcccagcu

SEQ ID NO: 622659 - RNA, 63 nt, hsa
gggcucugaagcucaagucagaggagugggaggucugaucauuguugguggaaaaacguaagg

SEQ ID NO: 622660 - RNA, 63 nt, hsa
uauaauaaaguagagcaacacacauugaaagcuucugaucaacgguccugaaauuuucaucuu

SEQ ID NO: 622661 - RNA, 63 nt, hsa
cuugaugggauucuggacaggauguguuugcuuucugaucaaggccuuauuggaaagcagucc

SEQ ID NO: 622662 - RNA, 63 nt, hsa
uuaauauugguguucaagacuauaucuaauuccucugaucacuuugagaaacaaacuuuuauu

SEQ ID NO: 622663 - RNA, 63 nt, hsa
auaaaauuuggccaauuuuuacagaagaaauucucugaucauuuaguucugucuauuuagaaa

SEQ ID NO: 622664 - RNA, 63 nt, hsa
ggaggggcuuugugauaacuacucccagcuucuucugaucauuucaaaauuaagucgauuuuu

SEQ ID NO: 622665 - RNA, 63 nt, hsa
gugagaagaggaggucuacccaggagccucgggucugaucaagggagaggccaggcgcagcuc

SEQ ID NO: 622666 - RNA, 63 nt, hsa
ccuuuucccccgucuuuucugaaaaauuguaaaucugaucauaucaacauguaugaacuuaaa

SEQ ID NO: 622667 - RNA, 63 nt, hsa
aaacuaugggaaagcugaucuauaaagaggcauucugaucaauucauuuguaggaaacuggga

SEQ ID NO: 622668 - RNA, 63 nt, hsa
ucuguuggucagucagguguuugcucagcccugucugaucaccugugcugcucugucccuaac

SEQ ID NO: 622669 - RNA, 63 nt, hsa
acuuguuuauaaaaaacaaaacaauaaaaagagucugaucagagcccagggcccugucugucu

SEQ ID NO: 622670 - RNA, 63 nt, hsa
aauccauuuuccccacucuuuuauuuuugcuauucugaucauuugucccccuuuuaaaaauaa

SEQ ID NO: 622671 - RNA, 63 nt, hsa
uguacguguaguuucuaguggagaaaucaaggcucugaucauuuuguuuuuaguaugaaaaug

SEQ ID NO: 622672 - RNA, 63 nt, hsa
auuggcagugccaguuucuagccaauagacuugucugaucauaacauuguaagccuguagcuu

SEQ ID NO: 622673 - RNA, 63 nt, hsa
uauuauauuucuggaauuucacacuuuaccuacucugaucacucuguucucuuuguuuuaaag

SEQ ID NO: 622674 - RNA, 63 nt, hsa
uucuuuuuugguuuuuugguuuuuuuuuuuuccucugaucacauucuucaaagacggaguauu

SEQ ID NO: 622675 - RNA, 63 nt, hsa
auuuuauauuuacauugagaauuucaacuagcuucugaucaauuuuuaauaaaaaauuuucaa

SEQ ID NO: 622676 - RNA, 63 nt, hsa
ugaaagaauuuccuguugagauauaaaggcccaucugaucacuggauugggcugagcagagaa

SEQ ID NO: 622677 - RNA, 63 nt, hsa
aggcaucugcaugggucuucuuuuacuggacugucugaucaggguggagggaaggugagaggu

SEQ ID NO: 622678 - RNA, 63 nt, hsa
cuaacucaacuguugccgucucaucuucucucaucugaucacuucauguuuuguuuuuguuac

SEQ ID NO: 622679 - RNA, 63 nt, hsa
ggacccccggggcugcagccuccucuuucugucucugaucagagccgacaccagacgugauua

SEQ ID NO: 622680 - RNA, 63 nt, hsa
gcccucaguuuuccuacagaguaguggcuuaucucugaucagcuguuacaaacuaaauuccau

SEQ ID NO: 622681 - RNA, 63 nt, hsa
gcuuauucuguuuuaaacauugaaaaguuguggucugaucaguuaauuuguauguagcagugu

SEQ ID NO: 622682 - RNA, 63 nt, hsa
auucuagcucaugguugcuaggaaagcuaggccucugaucauagaagcagauagcuucagucc

SEQ ID NO: 622683 - RNA, 63 nt, hsa
agaaaaccauggucucucugcuugcuuggcccuucugaucauguaugcaucccccaaggauga

SEQ ID NO: 622684 - RNA, 63 nt, hsa
uguuuuaacauuuuugcuaucuuuuuuuauuauucugaucaugauaugaccauuuaaccucag

SEQ ID NO: 622685 - RNA, 63 nt, hsa
gaugaaugugcuagaugaaugauuuggguuguaucugaucaugguucacaaaaauuauguuag

SEQ ID NO: 622686 - RNA, 63 nt, hsa
cuguaaccuuucauguguguuaagaaacacugaucugaucauuugggauuugcugaggcauuu

SEQ ID NO: 622687 - RNA, 63 nt, hsa
ucauauuaccaccgcucucauuucauggagucuucugaucaaaaaagcucacgucguauuucu

SEQ ID NO: 622688 - RNA, 63 nt, hsa
uuacuuauuuucauauuguauuuuaacuguuucucugaucaaauuuuuuuacuuccuccuccu

SEQ ID NO: 622689 - RNA, 63 nt, hsa
gcaccgggaaacucugcuuccccauuguuuccaucugaucagcuguggugugaggacuucuca

SEQ ID NO: 622690 - RNA, 63 nt, hsa
aguugauugaagugaguuggcugcauuuucuuaucugaucacaauggcaggggacagaaugug

SEQ ID NO: 622691 - RNA, 63 nt, hsa
ugaugcaugcuggaaaaagacacgcuuuucauuucugaucaguuguacuucauccuauaucag

SEQ ID NO: 622692 - RNA, 63 nt, hsa
uaggaagguaugcagugugagaacugaaguauuucugaucacucucagacuguccuccgugau

SEQ ID NO: 622693 - RNA, 63 nt, hsa
ucagagugagugggaaguuucacaacggauugaucugaucaaucccuucaaggagcugaaggc

SEQ ID NO: 622694 - RNA, 63 nt, hsa
cauuuuguucaacuuauacaaaacaagccagcaucugaucaaaaguauuacauaaaauauuuu

SEQ ID NO: 622695 - RNA, 63 nt, hsa
gcaaauuucagccaauuuuguagcuaagauuguucugaucagcucaaaaagauuuggcuuagu

SEQ ID NO: 622696 - RNA, 63 nt, hsa
ccucuuggaugcguuauuuucucaucagcuggcucugaucaugaauuuguuguaauuuuaugu

SEQ ID NO: 622697 - RNA, 63 nt, hsa
uuguauucaaaauuaaugaaacugaagguuuauucugaucauaauuuguuuagugcuacauuu

SEQ ID NO: 622698 - RNA, 63 nt, hsa
cuguaggacuaagcuaagucugcuuugcagauaucugaucagauagucccuucauucuguaga

SEQ ID NO: 622699 - RNA, 63 nt, hsa
aaacccagaguuuauguagaaagcauugaauguucugaucagaugugacuaaggucaaggaaa

SEQ ID NO: 622700 - RNA, 63 nt, hsa
ugugguccuccuccccagaacucagaacccaagucugaucaggagaaaaacaucacacaaauu

SEQ ID NO: 622701 - RNA, 63 nt, hsa
auggauguaggagagcuucuuuucuaacuaccaucugaucagacaaggaaugaagcaaugacu

SEQ ID NO: 622702 - RNA, 63 nt, hsa
uaaaguauuuuuucuagucuuccgagaaacuuuucugaucaguuugcgaguuuugaugaguuu

SEQ ID NO: 622703 - RNA, 63 nt, hsa
uuuuuauguaggugaguuauauuuucuuucuuuucugaucagguuauuggugacuuacuggac

SEQ ID NO: 622704 - RNA, 63 nt, hsa
cagcaagauccuguccaagaguagccuguggaaucugaucaguuacuuuaaaaaaugacuccu

SEQ ID NO: 622705 - RNA, 63 nt, hsa
uaaaagaguuagaugggaugaugcucagacucaucugaucaaaguuccgagaggcauagaagg

SEQ ID NO: 622706 - RNA, 63 nt, hsa
ugcaaaauagaagaagaggaaguuagagauaauucugaucaaucauuuuggaggcuuuguuau

SEQ ID NO: 622707 - RNA, 63 nt, hsa
ccgugugcuccaguguuuucuuguguuguuuucucugaucacaacuuuucugcuaccugguuu

SEQ ID NO: 622708 - RNA, 63 nt, hsa
uccuuugugccuccacagccacagccuggcagcucugaucaggaaagugaggaacagcaacaa

SEQ ID NO: 622709 - RNA, 63 nt, hsa
acaauacauuucugguaagauggaaucacuaccucugaucacauaucaggcuaacgauagaga

SEQ ID NO: 622710 - RNA, 63 nt, hsa
acagaaucaugaucuuccagguuccccccaguuucugaucauguugauuuguagcuguggauc

SEQ ID NO: 622711 - RNA, 63 nt, hsa
guucugugcccuucaguggauggaacgugagugucugaucaucucucuuggaaguuuucugaa

SEQ ID NO: 622712 - RNA, 63 nt, hsa
cgagggaggagaagggaccugccuugugacaucucugaucagguuggggugccccagcaccca

SEQ ID NO: 622713 - RNA, 63 nt, hsa
ugugcgccuacaggagugagcacuaaggugugcucugaucauccacugugccaugugccaggu

SEQ ID NO: 622714 - RNA, 63 nt, hsa
uagauaguggugcagugcuuuaacauacauucaucugaucagcauuaauuuggggaauuuuuu

SEQ ID NO: 622715 - RNA, 63 nt, hsa
uuccuggcaagcucuuucacaacccuacauauuucugaucaugugcugccuuuuacugcugaa

SEQ ID NO: 622716 - RNA, 63 nt, hsa
uguucucagcacauaugggaacuaugaggagccucugaucaaauuggcuacaaucuuggagcu

SEQ ID NO: 622717 - RNA, 63 nt, hsa
ggccaagggugucccacauucccaacaccgcccucugaucaccaugggaaucuuuggacucag

SEQ ID NO: 622718 - RNA, 63 nt, hsa
caggcuuuuuaggaagcucugcaacagaugugaucugaucauaggcaauuagaacuggaagaa

SEQ ID NO: 622719 - RNA, 63 nt, hsa
uaaaauuauucacuugguaaguguucaagucuuucugaucaccccaaguagcaugacugaucu

SEQ ID NO: 622720 - RNA, 63 nt, hsa
cugaugcaaaagggucuuuuccuagcuuccuggucugaucagugcuaugagauggacagauaa

SEQ ID NO: 622721 - RNA, 63 nt, hsa
aacggaguacauuuuuaaaauuuuuuguuccauucugaucaacuaaagaaaauuaaggugucc

SEQ ID NO: 622722 - RNA, 63 nt, hsa
aggagagaggugagggggggaugacuugcggguucugaucaggccccuggguggggaaggggc

SEQ ID NO: 622723 - RNA, 63 nt, hsa
guugguguugccucacuccucugagcucuucuuucugaucaagcccugcuuaaaguuaaauaa

SEQ ID NO: 622724 - RNA, 63 nt, hsa
ccauggagcuuguguucucagaaucugaugcuuucugaucaacaaaacugagcaaggaagauc

SEQ ID NO: 622725 - RNA, 63 nt, hsa
gaagaugccacaccuggccuccacacuugcucuucugaucagucugucuggauugaguccuac

SEQ ID NO: 622726 - RNA, 58 nt, hsa
auauacuccccuggaaauaauguguggcucugaucaguuuccuccaacuccugguuca

SEQ ID NO: 622727 - RNA, 63 nt, hsa
uuuuuaaguucuucugaacuguagaaauagcuaucugaucacuucagcguaaagcaguguguu

SEQ ID NO: 622728 - RNA, 63 nt, hsa
uggcguaaggccucacucccggcugggaaggucucugaucacacagaagcagcccugcccagc

SEQ ID NO: 622729 - RNA, 63 nt, hsa
ccugugcuggcacugugccagucaugaggcagcucugaucacuuccccacuguggaaacagga

SEQ ID NO: 622730 - RNA, 63 nt, hsa
cuucuccuuuagaugcuagaaacacauuuugauucugaucauggggugggggagagaggaaag

SEQ ID NO: 622731 - RNA, 63 nt, hsa
cgugccucaucccagaaacacggaggcuguggaucugaucaccaggcugcccaagggugcugu

SEQ ID NO: 622732 - RNA, 63 nt, hsa
agccagugggaaagggaaccugagauggagcucucugaucacccuuucagccccagggcccgg

SEQ ID NO: 622733 - RNA, 63 nt, hsa
ggaggggagggggcgccuuguucucccuccaggucugaucauaaacaauuaccaggaacuagc

SEQ ID NO: 622734 - RNA, 63 nt, hsa
gauaacugguccucauaccaugcaggucccauuucugaucaccccacuggcaggacaauucac

SEQ ID NO: 622735 - RNA, 63 nt, hsa
cuuuuuuucccucuucccccuaaaaaugguaaaucugaucauaucuacauguaugaacuuaac

SEQ ID NO: 622736 - RNA, 63 nt, hsa
aggggguccccaaaguggcccacuuucuguggcucugaucagcgcaggggccagccagggaca

SEQ ID NO: 622737 - RNA, 63 nt, hsa
uaucuuuccaagugccaggcacgggcuuccuuuucugaucaaacauaccauuuuuuauauuuc

SEQ ID NO: 622738 - RNA, 63 nt, hsa
gauuuugcauuuuguccaaaaucaugugcuucuucugaucaauuuugguuguuccagaauuuc

SEQ ID NO: 622739 - RNA, 63 nt, hsa
aagaaccuccuggcugggacugcccaacucuguucugaucagugggugggugagguaggguuu

SEQ ID NO: 622740 - RNA, 63 nt, hsa
auauaaaaagucuggauugucaguaguauuagaucugaucaagguaggaauuacaauugcaug

SEQ ID NO: 622741 - RNA, 63 nt, hsa
uuuccaggguccuccggaccccaccuuccacacucugaucacagccccccuaccuuuugcccu

SEQ ID NO: 622742 - RNA, 63 nt, hsa
uggcaaagguggggaggggggaagaugaugcauucugaucauuauaaagaauacuuuucaggg

SEQ ID NO: 622743 - RNA, 63 nt, hsa
ucucacgcauauccaugagcuuuaauuucacuuucugaucacgguacguccauaaagccagua

SEQ ID NO: 622744 - RNA, 63 nt, hsa
ccuuaugauaaagccgccuuuagucuuccauguucugaucacuguguggggugguucaagagc

SEQ ID NO: 622745 - RNA, 63 nt, hsa
agggugaaagaagaaaccuuaaacauagucagcucugaucacauccccugucuacucauccag

SEQ ID NO: 622746 - RNA, 63 nt, hsa
cuuuagaucucuuucaagcacauuccauuuucuucugaucauacuuccucagaaaaccuuuuu

SEQ ID NO: 622747 - RNA, 63 nt, hsa
aaagggcuguuugguuagcaucucaucuugcauucugaucaauuggcaagaaagggagauuuc

SEQ ID NO: 622748 - RNA, 63 nt, hsa
acagccacucaccuuuuccuccugagccugcucucugaucagcuggauccccacgugagcaac

SEQ ID NO: 622749 - RNA, 63 nt, hsa
uuuguaaccagaugaaucaugauuucuaagacuucugaucaaaaauacugugaaauaaagaau

SEQ ID NO: 622750 - RNA, 63 nt, hsa
aaaggaugcauuucggcuuuuaaccaguuugguucugaucauugcaaccucugugcuuuuaua

SEQ ID NO: 622751 - RNA, 63 nt, hsa
aauuugugaagcuuaugauacagcugaaaccagucugaucaauuuuaugcuaccugucaccaa

SEQ ID NO: 622752 - RNA, 63 nt, hsa
ggcuucuccagggggcacccuuugagcugugggucugaucaccccaagucccgcccggaggag

SEQ ID NO: 622753 - RNA, 63 nt, hsa
ccugaaggcauaaaccacauccagccaccuccuucugaucagcagcaaagcugacguuuugau

SEQ ID NO: 622754 - RNA, 63 nt, hsa
ggugcgguguggaugcaccuacaaggccaacucucugaucagggugagggagagauggaagaa

SEQ ID NO: 622755 - RNA, 63 nt, hsa
ucccguagauggcgagcaccuugcaggcagccuucugaucaguacugcucuccuagggccugg

SEQ ID NO: 622756 - RNA, 63 nt, hsa
ccacggcccuugccacugucuccuggcccucucucugaucaugccagguuugcaccagccucg

SEQ ID NO: 622757 - RNA, 63 nt, hsa
aagauuauuuuacguugaguccauuuuuaauguucugaucaccugacagggcaccccaaaccc

SEQ ID NO: 622758 - RNA, 63 nt, hsa
gcaagcccagguugaccuugugaugugaauugaucugaucagacuguauuaaaaauguuagua

SEQ ID NO: 622759 - RNA, 63 nt, hsa
aggaaggagagacauuaggagccgauaaaugcaucugaucagaaaucagcagacagaauuacc

SEQ ID NO: 622760 - RNA, 63 nt, hsa
accuaacccccccauaucuguucaaccucaguaucugaucaggcuccucagccuccaccaucc

SEQ ID NO: 622761 - RNA, 63 nt, hsa
gcauuuccgaagaucagauauuuugcuuaaaggucugaucauauaggaaauauaugcagaaca

SEQ ID NO: 622762 - RNA, 63 nt, hsa
guucuaguauuauuuuguaacaaauagcagacaucugaucauuuuauccauaaauauucuuua

SEQ ID NO: 622763 - RNA, 63 nt, hsa
uuggggagucuuaugaaucauuccagccaacucucugaucacaaagaauacugugccccuuuc

SEQ ID NO: 622764 - RNA, 63 nt, hsa
caguaugauugguaaaugggaaauauaauugauucugaucacucuuggucagcuucucuuucu

SEQ ID NO: 622765 - RNA, 63 nt, hsa
cuuccucagcgucaccuccuucauugagccuucucugaucacuccaucccucuccuaccccuc

SEQ ID NO: 622766 - RNA, 63 nt, hsa
aaaaaauaaagcugauugucaugugauuaaauaucugaucaacagguaugaauauaacuuaaa

SEQ ID NO: 622767 - RNA, 63 nt, hsa
cuccauucacaacuucauggccacgcccgaguuucugaucaaugacuacacccacaacauccc

SEQ ID NO: 622768 - RNA, 63 nt, hsa
gcuacagauugagaugaauuugcaaaccauauaucugaucaauuuggaauauauaaaguguac

SEQ ID NO: 622769 - RNA, 63 nt, hsa
cucuucuugcccuuggcccagcugggaccaaacucugaucaguauuagggguagagugaggua

SEQ ID NO: 622770 - RNA, 63 nt, hsa
guuaguuaguguagauuccauuuacugcauucuucugaucacugaaauaaaagcuauauaaga

SEQ ID NO: 622771 - RNA, 63 nt, hsa
ugcagaggaguaagucuugugucaaagcaggaaucugaucagagguucagaauuggaaguaca

SEQ ID NO: 622772 - RNA, 63 nt, hsa
gcuugucugaaaauaucaccuuuuguggauuuaucugaucaccaaauaauaaauauuaagaag

SEQ ID NO: 622773 - RNA, 61 nt, hsa
gggaagcuggcccaggucagguccgcaaaggcuucugaagaagaggaagggcgaguagggg

SEQ ID NO: 622774 - RNA, 61 nt, hsa
ucaugacuucuccuuuccagaguuuuggguccuucugaauuaaugguccuuuucgaacacc

SEQ ID NO: 622775 - RNA, 61 nt, hsa
ccccacaccuggaggcuggagccaggggccacuucugaacugcaccagcaccaggcccacc

SEQ ID NO: 622776 - RNA, 61 nt, hsa
gacggacagcguguggcaguguuuaaaugcucuucugaaggcugauacgacagcucucugu

SEQ ID NO: 622777 - RNA, 61 nt, hsa
agagaguuugagccuuugcuggucacauugccuucugaagaggagggaguauuagauuaua

SEQ ID NO: 622778 - RNA, 61 nt, hsa
aaaaagaccaaacauuugagauugucacagccuucugaaguuacucauuauaagucaagca

SEQ ID NO: 622779 - RNA, 61 nt, hsa
ucaucacuccuuccuaguucuacuguucaagcuucugaaauaaacaggacuugaucacaag

SEQ ID NO: 622780 - RNA, 61 nt, hsa
ggugcugaaccucgggaacgagcuauccuagcuucugaauccagguuaggauuauacuuga

SEQ ID NO: 622781 - RNA, 61 nt, hsa
cuaacauguaauugcagauaacuuugacuuucuucugaauauuuuaucuuuccuuggcuuu

SEQ ID NO: 622782 - RNA, 61 nt, hsa
aguuaauguaagaauacuuuaaaucucuaagcuucugaaguguuagagguagagauggucu

SEQ ID NO: 622783 - RNA, 61 nt, hsa
aaacccaagucaguuauuagauuuaaaucaccuucugaaaugcugcuauagggcugguauc

SEQ ID NO: 622784 - RNA, 61 nt, hsa
ugcauuugugcaacuucaaacauauugggugcuucugaauuccugaugauuggauuuaagc

SEQ ID NO: 622785 - RNA, 61 nt, hsa
ccuagauguuaguguuguggauguccuuggucuucugaagauucagguccuccucuccggg

SEQ ID NO: 622786 - RNA, 61 nt, hsa
cuugcucugccuuugaguuguuccgugaucacuucugaauaagcaguuugccuuuauaaaa

SEQ ID NO: 622787 - RNA, 61 nt, hsa
auuaugauaguuuuuaagguuucaauucaaucuucugaacggcauaaguccuauuuuagcc

SEQ ID NO: 622788 - RNA, 61 nt, hsa
uucugggacccagaugaguucuucacuagcccuucugaaccccuugcuccauaauuggucu

SEQ ID NO: 622789 - RNA, 61 nt, hsa
agaggaaaaagaaaaacauuuccucuuauaacuucugaaguaauuuguaaaaaagauuugu

SEQ ID NO: 622790 - RNA, 61 nt, hsa
ugauucguguuuguacuuuauuuuuuugugccuucugaaaggaucuaaaacaaaaauauuu

SEQ ID NO: 622791 - RNA, 61 nt, hsa
gcgagggaggggagguggccgucgaguugaccuucugaacaugagugucaacuccaggacu

SEQ ID NO: 622792 - RNA, 61 nt, hsa
uuuuuccuuaacguuugaagucaguuuaaaacuucugaagugcugucuuuuuacauuuuac

SEQ ID NO: 622793 - RNA, 61 nt, hsa
ccuuugucuaaucauuggauuuauugugucacuucugaaguuucacagaaaugaaugaauu

SEQ ID NO: 622794 - RNA, 61 nt, hsa
agacuaauuuuuaagaauuacaaagcucauucuucugaaucuaauaucacuaacuccuaga

SEQ ID NO: 622795 - RNA, 61 nt, hsa
cuucuuaaacucugaguuuauaaaauaacuacuucugaacuccugagaucuaguggauacc

SEQ ID NO: 622796 - RNA, 61 nt, hsa
acuuugaaagacucuggugccuuguggugcccuucugaaauucaaacaguaaugcaaaagu

SEQ ID NO: 622797 - RNA, 61 nt, hsa
uuguaacaaugaugaccccggccugucucaucuucugaagaggaaaagucaaaguguugcu

SEQ ID NO: 622798 - RNA, 61 nt, hsa
uuaaccaaagaagcuguacuccggggggucucuucugaauaaagcaauuagcaaaucaugu

SEQ ID NO: 622799 - RNA, 61 nt, hsa
cccccggaacccucuaccaaugccuucugaccuucugaagcuuuccgaauccucccaguug

SEQ ID NO: 622800 - RNA, 61 nt, hsa
agaauuguucuuuuuccuguuguuuucuuaacuucugaaagagcugugggugguggggggc

SEQ ID NO: 622801 - RNA, 61 nt, hsa
aucccucuggggcuguucacgugguccuaaucuucugaacuuggcgcugccccuggcagcc

SEQ ID NO: 622802 - RNA, 61 nt, hsa
caauucuuugaucucaugcaaugcacacuuucuucugaauuagcaaacugaauaaacuaca

SEQ ID NO: 622803 - RNA, 61 nt, hsa
uguuaacuauaaacacacugcauacaauuuucuucugaauaacaaaugaaugcuuauugcu

SEQ ID NO: 622804 - RNA, 61 nt, hsa
ugguccagggauccuccuccuuucucuuuuacuucugaauucugaaauucaguuaguuacu

SEQ ID NO: 622805 - RNA, 61 nt, hsa
caaggucuucacuguauauauuuuguguguucuucugaaacucuugauuucuuauauggca

SEQ ID NO: 622806 - RNA, 61 nt, hsa
ugccccuuucugcccuccugcuccagccccacuucugaaaguaucagcuacugauccagcc

SEQ ID NO: 622807 - RNA, 61 nt, hsa
caaaggaggcucagagaagaaagacgugucccuucugaacugaugcuuucucacugucauc

SEQ ID NO: 622808 - RNA, 61 nt, hsa
aagccugccaacagugaccuuccgaaacagccuucugaauacaaagaggauucaguuucca

SEQ ID NO: 622809 - RNA, 61 nt, hsa
gaaaucugguuuucaaggccucuguggcuuucuucugaacuuaccaccagcccuggcugga

SEQ ID NO: 622810 - RNA, 61 nt, hsa
gccacuauucucaguuacaccucccagugcccuucugaaaagugccagcuauuucauuagg

SEQ ID NO: 622811 - RNA, 61 nt, hsa
aauggaugcauacccuuccugaaaugacucccuucugaaugaaugacaaagcagguuaccu

SEQ ID NO: 622812 - RNA, 61 nt, hsa
gccccuuccugguucuuaucucaaggcagagcuucugaauuucaggccuucauuccagagc

SEQ ID NO: 622813 - RNA, 61 nt, hsa
uuaaaauuguucaagaaaauuucuuugaacacuucugaaaguuuuuggaaacuuagaaaag

SEQ ID NO: 622814 - RNA, 61 nt, hsa
uggugcaaaaggauuggcccccauuauggugcuucugaauaaaucuugccaagauagacaa

SEQ ID NO: 622815 - RNA, 61 nt, hsa
uucucaaaauauaccucuugcccagcugccucuucugaaauccacuucacccacuccacuu

SEQ ID NO: 622816 - RNA, 61 nt, hsa
gucugugcccucagauguguugacagcugcucuucugaauugccacaccugugcuacacuu

SEQ ID NO: 622817 - RNA, 61 nt, hsa
aacccuaaggcccuucaagaucucaaagugccuucugaagcaucagagauuaaauauuguu

SEQ ID NO: 622818 - RNA, 61 nt, hsa
guguuuuuugacaaucacuuccuuaaagacucuucugaacuaguuggaccugguuaaucau

SEQ ID NO: 622819 - RNA, 61 nt, hsa
uaaccaccccuagaucugaguuuucagagugcuucugaaguacaguuuaaaaacacuuuuu

SEQ ID NO: 622820 - RNA, 61 nt, hsa
auauguugcuuguuugugacacuuagauaaucuucugaaauaauuuguuuuaaaguaaguu

SEQ ID NO: 622821 - RNA, 61 nt, hsa
uccaucugaaagguuacaaggaguguuguagcuucugaaggugcagaaaacaauuucuaaa

SEQ ID NO: 622822 - RNA, 61 nt, hsa
aaauauaugaugcugagucuguggaaugauacuucugaaaucaaaauuccucauaaggcau

SEQ ID NO: 622823 - RNA, 61 nt, hsa
agcuauccuuuuaaauuaugcuaauucucuucuucugaaauuauggucacacuauauacua

SEQ ID NO: 622824 - RNA, 61 nt, hsa
caaacuccucuccuggaucaaaaaugaaucacuucugaagucccugcagcccuuugccaag

SEQ ID NO: 622825 - RNA, 61 nt, hsa
auuuccauuauagcaauguuagugccaccaccuucugaacacaguggggagggcugugaag

SEQ ID NO: 622826 - RNA, 61 nt, hsa
caaggcuggcauauuaacaccugccuucuggcuucugaaagugagauuuguauaugggcug

SEQ ID NO: 622827 - RNA, 61 nt, hsa
cucgguuugguagacuuggacaucucucuggcuucugaagagccugaagcuggccuggacc

SEQ ID NO: 622828 - RNA, 61 nt, hsa
auuuuuauuggaagaguauuaacuggugccucuucugaaacacaccaacccauauuccucu

SEQ ID NO: 622829 - RNA, 61 nt, hsa
ggcugaguagccucagaaggguuuaggcgaccuucugaaacucacagaagucacgugaugg

SEQ ID NO: 622830 - RNA, 61 nt, hsa
accaaguccugcuacuguagaguggaaaugacuucugaauagcgguuuuaggacaggucug

SEQ ID NO: 622831 - RNA, 61 nt, hsa
cuuguacuugccuacuguaauauggauuucacuucugaacaguuuacagcacaauauuuau

SEQ ID NO: 622832 - RNA, 61 nt, hsa
uaaaaccuuugacuugagucugcugguaaagcuucugaauauugaguuugcugagaaauaa

SEQ ID NO: 622833 - RNA, 61 nt, hsa
uggguucaauuuaaaauaggagaggcuuucucuucugaaagauccauuuuaggucuuuuuc

SEQ ID NO: 622834 - RNA, 61 nt, hsa
gacuacaaagaaaagcagaugccaaaauacucuucugaaaacagcaacccagguaagacuu

SEQ ID NO: 622835 - RNA, 61 nt, hsa
gcuguugguaggagugaaaaccaguauaauucuucugaaaaacauuuaucagaaacuuaaa

SEQ ID NO: 622836 - RNA, 61 nt, hsa
ugugucuacaacagggccacauauuaaauuacuucugaauggugaauucaucuuacaaaau

SEQ ID NO: 622837 - RNA, 61 nt, hsa
agcugaaaccuaaggcaacauuuccgaagaccuucugaagaucucagauaaagugaccagg

SEQ ID NO: 622838 - RNA, 61 nt, hsa
gagcauauauugcauuuaaagaaagauaaagcuucugaaauacuacugcaauugcuucccu

SEQ ID NO: 622839 - RNA, 61 nt, hsa
uuuuugaggcaucuaauauuuacauauuugccuucugaacuuuguuuugaccuguauccuu

SEQ ID NO: 622840 - RNA, 61 nt, hsa
uuuucucuacuuccugucugcaugcccaaggcuucugaagcagccaaugucgaugcaacaa

SEQ ID NO: 622841 - RNA, 61 nt, hsa
agcuacacuacaaaaacaaauuuugucuguacuucugaaaagaauuuuguuguuucucagc

SEQ ID NO: 622842 - RNA, 61 nt, hsa
ucuccuggcaagagaaaaagacuuaacuagacuucugaacuugaacaguuucagguuauau

SEQ ID NO: 622843 - RNA, 61 nt, hsa
aacauaaauacagcaagaaaauguguuugggcuucugaagaguugucugcuuaccuuaaca

SEQ ID NO: 622844 - RNA, 61 nt, hsa
gucugacuauuccaggauccaauauuacugccuucugaaacuuccucuuuaggguaaccau

SEQ ID NO: 622845 - RNA, 54 nt, hsa
augaacgacacacauguuagagcccuucugaaaaaguauccugcuucugauaug

SEQ ID NO: 622846 - RNA, 61 nt, hsa
uuugccugggcauugaggcauuuccauacaucuucugaaaacuaggcggagguuuccaaau

SEQ ID NO: 622847 - RNA, 61 nt, hsa
aaaauaagcugcaauuuuguacagauaccaacuucugaaaagcugguguuuuuacaacuag

SEQ ID NO: 622848 - RNA, 61 nt, hsa
cucaagcaaaggaauuucugaaaguaucagucuucugaauucugaguuuugaaaauauauu

SEQ ID NO: 622849 - RNA, 61 nt, hsa
uauauuggcauguuuagaugucagguuuagucuucugaagaugaaguucagccauuuugua

SEQ ID NO: 622850 - RNA, 61 nt, hsa
ggaauuagcuagaauaugaccauuaaaugugcuucugaaauauauuuugagauagguuuag

SEQ ID NO: 622851 - RNA, 61 nt, hsa
gaaauaguuuucucaaccauuuaaaaauauucuucugaacucaucaaaguagaagagcccc

SEQ ID NO: 622852 - RNA, 61 nt, hsa
cucaucuccucccuggauucuggauuaggagcuucugaaucuuuuccagggauaggcaggu

SEQ ID NO: 622853 - RNA, 61 nt, hsa
aggggaaagaaauccaucugcucaugaagcacuucugaaaauauaggugauugccugaaug

SEQ ID NO: 622854 - RNA, 61 nt, hsa
agaauccaugccuguguaaugcugguccaugcuucugaaccugugucugccaagcgccuau

SEQ ID NO: 622855 - RNA, 61 nt, hsa
ucuacuguacccugauuauuacuuccaucuacuucugaaugugagacuuucccuuuuugcu

SEQ ID NO: 622856 - RNA, 61 nt, hsa
guauuuuccuuuauguuaauucaauuauauacuucugaauggcaccuuacuuuuuggaaac

SEQ ID NO: 622857 - RNA, 61 nt, hsa
gaagucugaggcucaaagaaaaguaaucccucuucugaauccacaccccaucaauuaucuu

SEQ ID NO: 622858 - RNA, 61 nt, hsa
gacuuugaagcacugaaaguuacugaagugccuucugaaucaaggauuuaauuaaggccac

SEQ ID NO: 622859 - RNA, 61 nt, hsa
uggaaauauuuuuauuuuuacagauuuugcacuucugaauucagguuaaaaacuaacuugu

SEQ ID NO: 622860 - RNA, 61 nt, hsa
guuucggaguuugguaaaguuuacaggguagcuucugaaauuaacucaaacuuuugaccaa

SEQ ID NO: 622861 - RNA, 61 nt, hsa
gaccagguucaugucuguuuccccuuggggacuucugaaccuuccugcccgggagucugua

SEQ ID NO: 622862 - RNA, 61 nt, hsa
uuauauuauuaaagggcuuuuaauuugugaacuucugaaggcaugaguguuuucucuuucu

SEQ ID NO: 622863 - RNA, 61 nt, hsa
uuccccugugcuuuuaccaguagcaugaccccuucugaagccauccguagaaaguacuuug

SEQ ID NO: 622864 - RNA, 61 nt, hsa
agaagucauaguugaccacagacauguuauucuucugaaagagccacauuuugguuuuauu

SEQ ID NO: 622865 - RNA, 61 nt, hsa
aaguauuugguagcugaauaaggggucagaacuucugaaaccagagaucuguaaucaucuc

SEQ ID NO: 622866 - RNA, 61 nt, hsa
agaaaugcagguucccaggucccacccuggacuucugaagggguguggcaucuguguuucu

SEQ ID NO: 622867 - RNA, 61 nt, hsa
aaugaggacaacaggauaauaucuuugaugacuucugaaaguuaugcuucccuucauguua

SEQ ID NO: 622868 - RNA, 61 nt, hsa
auaaccaauauguggaaauggacacagggaucuucugaaguugcuuugaaucaaaaggcag

SEQ ID NO: 622869 - RNA, 61 nt, hsa
ucauagguaggagggcuuagauuuuaaggcacuucugaaagucaaucccuggacaaggcag

SEQ ID NO: 622870 - RNA, 61 nt, hsa
uggaauccugaaagggcacuuaauuuguaaacuucugaagacugagaacuuuuuugaggcc

SEQ ID NO: 622871 - RNA, 61 nt, hsa
ucugguuuauacauccccacucaugagcauacuucugaaggaaaacuuuacaaaaagagcc

SEQ ID NO: 622872 - RNA, 61 nt, hsa
uuucuugccuuauuaagacauaauuuucucccuucugaaaugagugagggaaguucauaag

SEQ ID NO: 622873 - RNA, 61 nt, hsa
uuaauaaugacuuaagggucaagauuuuuuucuucugaaaauuauguucugaguuaggcag

SEQ ID NO: 622874 - RNA, 61 nt, hsa
caggcagugcucucuaacaggaccaucacagcuucugaacugagccggagagagagaaugg

SEQ ID NO: 622875 - RNA, 61 nt, hsa
ucacacuacccuggucccugauugcaaggagcuucugaagcaagggugaauccuucccaca

SEQ ID NO: 622876 - RNA, 61 nt, hsa
gagagcagcccaaccaauccccaauccuuuucuucugaaacugagcaggaaggguaaggaa

SEQ ID NO: 622877 - RNA, 61 nt, hsa
gcacccuucacuggcauccucaaucauuaaccuucugaaagcucacaguacacauuaguau

SEQ ID NO: 622878 - RNA, 61 nt, hsa
gugaaacaauuauuuauuugcugaaagagcucuucugaacuguguccuuuuaauuuuugcu

SEQ ID NO: 622879 - RNA, 61 nt, hsa
ugguuuggaguugagauaucagucucggaaacuucugaaaaaugcuaauaauuacccaagg

SEQ ID NO: 622880 - RNA, 61 nt, hsa
augaucacuugggcaguauaagaaaauguagcuucugaauauuggccaccucuaugcugca

SEQ ID NO: 622881 - RNA, 61 nt, hsa
gucacaauaacuuagaaacauugcgcauauucuucugaaauagcacuuaaaaaugauuagu

SEQ ID NO: 622882 - RNA, 61 nt, hsa
gaggucagaugacauaaugaauauguucuaacuucugaaacuuuuggagcuuguuuuugcc

SEQ ID NO: 622883 - RNA, 61 nt, hsa
uuugauaauuaagcacccauaccauuuauaacuucugaauuuaaaaaguuauacaaugcca

SEQ ID NO: 622884 - RNA, 61 nt, hsa
gcaaauagaagccgaguguuaagguguuuugcuucugaaagagggcugugccuuccguuuc

SEQ ID NO: 622885 - RNA, 61 nt, hsa
augcccuuggcguugccuauggcaccuuucccuucugaaagucugguuccugcccagugac

SEQ ID NO: 622886 - RNA, 61 nt, hsa
ugaaaaucaaggugucagcagagcugugcuccuucugaaggcucuagggagaagccgguuc

SEQ ID NO: 622887 - RNA, 61 nt, hsa
auacugcggagacucuggccaagcugaugaccuucugaagugucacuggcaccauaugcaa

SEQ ID NO: 622888 - RNA, 61 nt, hsa
gggcagagguucaacccacaccuccacuuugcuucugaaggcccauucauuagaccacuug

SEQ ID NO: 622889 - RNA, 61 nt, hsa
cauguugcgcuuugcaucagcaaggcauugacuucugaaaaaaugaucugaaaaaaguuuc

SEQ ID NO: 622890 - RNA, 61 nt, hsa
accuaggauuuagggcugcaguugcugucugcuucugaaucacugggggugucuccuaaga

SEQ ID NO: 622891 - RNA, 61 nt, hsa
acaaaucugauggcuccugcagcacuuuuuccuucugaaaauauuuacauuuugcuaaccu

SEQ ID NO: 622892 - RNA, 61 nt, hsa
aauaauauauaccaacagauuguuugucacgcuucugaaccaaugacugaaugucaagaug

SEQ ID NO: 622893 - RNA, 61 nt, hsa
gugaggugugccccucccagggagaauaaagcuucugaagagagaccguccacaucucugc

SEQ ID NO: 622894 - RNA, 61 nt, hsa
ccagagggacauggcaauguuaccagcccaccuucugaagccugggaggugugaacccagg

SEQ ID NO: 622895 - RNA, 61 nt, hsa
gcgugguuuauagacuggggugccauguguacuucugaaaauauuuuaaccagcccaccca

SEQ ID NO: 622896 - RNA, 61 nt, hsa
uuuagagcauagaagaagcggcaccugccaucuucugaaaacuccaaagggaaauuucagu

SEQ ID NO: 622897 - RNA, 61 nt, hsa
aagguaggguuugaggauuccugagugugggcuucugaaacuucauaaauguucagcuuca

SEQ ID NO: 622898 - RNA, 61 nt, hsa
auuugcguauuaauuaugggcaagcacacaccuucugaauagaaauauuguucauuacuca

SEQ ID NO: 622899 - RNA, 61 nt, hsa
cauccugggcuuuucccagaggagaugggggcuucugaagauggacuuaccugggaccugc

SEQ ID NO: 622900 - RNA, 61 nt, hsa
aacauugccucugggugucauguggaccagacuucugaauagagaauauuuauaacuuuug

SEQ ID NO: 622901 - RNA, 61 nt, hsa
uaggauuuuguaacacgucaaccauuugaugcuucugaaaaguacuuucaacuugcgaagg

SEQ ID NO: 622902 - RNA, 61 nt, hsa
uuuguuagcaauaacugaccuucaguuuacccuucugaaggagcagggacucagcacagaa

SEQ ID NO: 622903 - RNA, 61 nt, hsa
gucucuccagauagcacuacgauguauuccgcuucugaacaggaucccaugccagugugga

SEQ ID NO: 622904 - RNA, 61 nt, hsa
ugaaaugaagagaaauagccagcaggugauucuucugaauccuuuagugugaugguuuccc

SEQ ID NO: 622905 - RNA, 61 nt, hsa
uguuuagauuguauuaacuaucuucuuuggacuucugaagagaccacucaauccauccaug

SEQ ID NO: 622906 - RNA, 61 nt, hsa
gucuuuugguaauaguggcagguauuuauuccuucugaauauauaccccauuauaggaaua

SEQ ID NO: 622907 - RNA, 61 nt, hsa
cuuccuaagaaaaggaaucuugcccuugaaucuucugaaguaccuagcacagugucuucaa

SEQ ID NO: 622908 - RNA, 61 nt, hsa
aauguuugugaaacaccuuuggagaggugcacuucugaaugcugccucugccguaaauccu

SEQ ID NO: 622909 - RNA, 61 nt, hsa
auagaagcuuuuuuuuuuaaaaaauguauugcuucugaacuuuuuucugccacugcucccu

SEQ ID NO: 622910 - RNA, 61 nt, hsa
uuuguucaaacauaauaccaucuuuuugcuucuucugaacuuuagaucuccauaacacaug

SEQ ID NO: 622911 - RNA, 61 nt, hsa
ugcuuaaacuuuuuucagucagggugaugaucuucugaagcucuuggaugucauuugaucg

SEQ ID NO: 622912 - RNA, 61 nt, hsa
uagacucuauaguacccucucuauucacuagcuucugaaaagggaggaguauuuuuaguuu

SEQ ID NO: 622913 - RNA, 61 nt, hsa
gagaaaacuccgaagaggugugagcaggauucuucugaaugacugucuggaugguucauua

SEQ ID NO: 622914 - RNA, 61 nt, hsa
gaauuugcagaugcaagcuccucuccuaggucuucugaaugucuugaaacaucccaggucc

SEQ ID NO: 622915 - RNA, 61 nt, hsa
cccucgucucugcagggugucuguacacguucuucugaaagcuuuagacaguaacaguuug

SEQ ID NO: 622916 - RNA, 61 nt, hsa
auucauggacacuagacucccuuugccauuucuucugaaccggcccuccuguggacuagca

SEQ ID NO: 622917 - RNA, 61 nt, hsa
ugcacuaucuuuauuuuguaugucaguauuccuucugaacaauaagcauuuaucaauugau

SEQ ID NO: 622918 - RNA, 61 nt, hsa
agagaugucauagccugaagauuuacugaagcuucugaacaugccaccaugccaaagcuau

SEQ ID NO: 622919 - RNA, 61 nt, hsa
ccacuguccucugucaaucuaguuagacgugcuucugaaugacuguagaauuggaacuaga

SEQ ID NO: 622920 - RNA, 61 nt, hsa
acuuaaaagugcuugauauaaauagcuuuuccuucugaaccacguucuauguaaaagaaaa

SEQ ID NO: 622921 - RNA, 61 nt, hsa
uggaauacaaaauguacugacauuuuguuuucuucugaaaaaaauccuugcuaaauguacu

SEQ ID NO: 622922 - RNA, 61 nt, hsa
agauaauaugagggagaagggaacacauuuccuucugaacuuacuucccuaagucacuuuc

SEQ ID NO: 622923 - RNA, 61 nt, hsa
uuauauuuguauguaaauuauauuuauacaucuucugaaauauauuucaaaauaugugugu

SEQ ID NO: 622924 - RNA, 61 nt, hsa
uuacuugguuuaaaucacauuugauacuauccuucugaaaagucugagacagaucuacaaa

SEQ ID NO: 622925 - RNA, 61 nt, hsa
uucuuuaaguauauuaaucucuuuguaaucucuucugaaaucauuguaaagaaauaaaaau

SEQ ID NO: 622926 - RNA, 61 nt, hsa
auauuguuuuuacuauguuuaaaaaacuuuacuucugaaaggaacauaauuauaucuaggu

SEQ ID NO: 622927 - RNA, 61 nt, hsa
cugcauuuuauugacugggguuugaucucagcuucugaaaauguuuaaaaauuggaaggaa

SEQ ID NO: 622928 - RNA, 61 nt, hsa
gccuauaggaagacuagucucaugcuguuaccuucugaaacuguaccuuuauaaaucaauu

SEQ ID NO: 622929 - RNA, 61 nt, hsa
uaaacuuaaauaagugugugcagcauuucuacuucugaaguuauuaaagcuaaaacugcac

SEQ ID NO: 622930 - RNA, 61 nt, hsa
cucgucugugugcaucucacgcccgacguggcuucugaaacgugcauucaaccucaaacuu

SEQ ID NO: 622931 - RNA, 61 nt, hsa
aaauauuguuuauacaguuuguauaggcugacuucugaauaauugguaucuauuauuuuca

SEQ ID NO: 622932 - RNA, 61 nt, hsa
aaagccauauaugggggacaugcuaaaauggcuucugaaugaaauacgacagcagagaaag

SEQ ID NO: 622933 - RNA, 61 nt, hsa
uccugaccucagaugaucuaccagccucggccuucugaagugcugggauucaggugugagc

SEQ ID NO: 622934 - RNA, 60 nt, hsa
ccaagaaugaggcaaacugaauugagucaacuucugaagauaaaaccugaagaaguuacu

SEQ ID NO: 622935 - RNA, 55 nt, hsa
uucaaaaaauauuuuuaugaugcagcuucugaacauuuggacagacuugauuugu

SEQ ID NO: 622936 - RNA, 61 nt, hsa
gaaguacaaaaagccuuuagccuugaggugccuucugaaauuaaccaaauuucauccauau

SEQ ID NO: 622937 - RNA, 61 nt, hsa
acagagccucgggacaucaaaaacagcagaacuucugaaaccucugggucaucucucacac

SEQ ID NO: 622938 - RNA, 61 nt, hsa
agaagcaaaaaacgaaagaguucuguucagacuucugaagagcagccuguggcuacaaauc

SEQ ID NO: 622939 - RNA, 61 nt, hsa
cuagcugagauuagugguggauuuucucccacuucugaaauguucauuuauacugguugca

SEQ ID NO: 622940 - RNA, 61 nt, hsa
uuuucuucgacaaaaaaauaauaaaacguuucuucugaaaagcugaacguuucuguauaag

SEQ ID NO: 622941 - RNA, 61 nt, hsa
aggccuuaaugaucaaaucucacccuuucugcuucugaaguaugaaaaucuagucuuuuua

SEQ ID NO: 622942 - RNA, 61 nt, hsa
auuuuucuaccacccuguuacaucauaacaacuucugaaacacacaccagcccugaguucu

SEQ ID NO: 622943 - RNA, 61 nt, hsa
ggaaucuagccgggaguagcagaggcccugucuucugaagucucaggcuuagaaguuacca

SEQ ID NO: 622944 - RNA, 61 nt, hsa
cuuccaccagcauccugagaagaaaugauuacuucugaaaaacauccuuuuuuccagccuc

SEQ ID NO: 622945 - RNA, 61 nt, hsa
ccgcgaagccgccaacccaccggagagggggcuucugaacuuggacuccugggaacaugga

SEQ ID NO: 622946 - RNA, 61 nt, hsa
aaugacugcagacuggugggaucauaggagccuucugaaugaccaggacugcuuucuuugg

SEQ ID NO: 622947 - RNA, 61 nt, hsa
ugccaagagagauguaugugucacugcauggcuucugaaagcaggaugaauuuucugcagc

SEQ ID NO: 622948 - RNA, 61 nt, hsa
ugcugcaugccuggucuuuccucuguuucuccuucugaaaguuuucuauaccugucuccuu

SEQ ID NO: 622949 - RNA, 61 nt, hsa
cugccaucucgcuaaaucaucagucucggcucuucugaaauagaaggugccugaucuuccu

SEQ ID NO: 622950 - RNA, 61 nt, hsa
ccaaucuucuuuuuuaaaccaguuuaaggaacuucugaagauuuguccaccucugauuaca

SEQ ID NO: 622951 - RNA, 61 nt, hsa
auggggacccugagacuacuaaagcugcuuucuucugaagguccaguuggacagucuggga

SEQ ID NO: 622952 - RNA, 61 nt, hsa
agaguugaauaucucuuucccuaucaugcugcuucugaaaauucaguuuuggagcaagucc

SEQ ID NO: 622953 - RNA, 61 nt, hsa
uaaaugccaaauaaucuuccagguagugcugcuucugaaguuaucucuuaauccucuuaag

SEQ ID NO: 622954 - RNA, 61 nt, hsa
uaauugguuugggagggggcagugaugaugacuucugaaacaaaauuuggauuuccuuuua

SEQ ID NO: 622955 - RNA, 61 nt, hsa
cuuuaguggguuuuaaauaguuuuucugacccuucugaaaaauaacuacauaagugcuucu

SEQ ID NO: 622956 - RNA, 61 nt, hsa
uauuuauucacuuccccauuacgauguaaaucuucugaacugccuuuuuuuuaaaaagaag

SEQ ID NO: 622957 - RNA, 61 nt, hsa
cuagaccuguaaaacuucacugcaguggccacuucugaaucucuguaagguuuauuuaucu

SEQ ID NO: 622958 - RNA, 61 nt, hsa
uuguauaauggggccuguuacacaugacacucuucugaauugacuguauuucagugagcug

SEQ ID NO: 622959 - RNA, 61 nt, hsa
aguaccugguugaguggggaggagggggcaucuucugaacagccugccucugcccagcucc

SEQ ID NO: 622960 - RNA, 61 nt, hsa
aagaaacagcugagaggcacuauggauuagucuucugaagugaaggaaauauagaugucac

SEQ ID NO: 622961 - RNA, 61 nt, hsa
cagcuccucacagaggccugguuugcucagucuucugaacuccagggaccagcccuggugg

SEQ ID NO: 622962 - RNA, 61 nt, hsa
accucggucucgucaguaaggacuucacuuucuucugaacuggggcuugugaaagcuggcc

SEQ ID NO: 622963 - RNA, 61 nt, hsa
auuuuaaccugugucuuacuuccucagcugccuucugaaccuacuugucaaggugaauuua

SEQ ID NO: 622964 - RNA, 61 nt, hsa
gauaaaggccuuaacuuuaaacaucuuucaucuucugaaagcugcccaacuuaaauccuca

SEQ ID NO: 622965 - RNA, 61 nt, hsa
uuaucaaucugaucugcagccagguuauuuacuucugaagcauuggaguuaucgauugcca

SEQ ID NO: 622966 - RNA, 61 nt, hsa
cuggaacuggaguuggcaauaccuaguucugcuucugaaacuggaguaucauucuuuacau

SEQ ID NO: 622967 - RNA, 61 nt, hsa
aaauaacuugccuuacauaucagcccucccacuucugaaguucaaauuagugccucggaaa

SEQ ID NO: 622968 - RNA, 61 nt, hsa
uuguucugaucugugugugagugugugugaacuucugaaagacaauauuaaagagacuuag

SEQ ID NO: 622969 - RNA, 61 nt, hsa
ccccacuuauucuccucuuuggaaucuucaacuucugaagugaauguggauacagcgccac

SEQ ID NO: 622970 - RNA, 61 nt, hsa
ugcccaacaggauaagcuggauccccuuggccuucugaauaucccagugucuucagguuuc

SEQ ID NO: 622971 - RNA, 61 nt, hsa
gggaaccauggugucaauacauaucauguagcuucugaaaaacuccacuguacacuuauag

SEQ ID NO: 622972 - RNA, 61 nt, hsa
aggggaaaaugcccacauuuuaacuuuuaaacuucugaauaaacuguguaaaaacaguagu

SEQ ID NO: 622973 - RNA, 61 nt, hsa
ugugugccugggaggcugccaggggguggggcuucugaagaccccuccucaauuucuuggc

SEQ ID NO: 622974 - RNA, 61 nt, hsa
uccugcuggccccuuuuccucuggccccccucuucugaaacaggaugugcacacaugggcc

SEQ ID NO: 622975 - RNA, 61 nt, hsa
ggaguggggaggugguaagaacaccugacaacuucugaauauuggacauuuuaaacacuua

SEQ ID NO: 622976 - RNA, 61 nt, hsa
ugcguaaguaccuccuugaugccugucggcacuucugaaaggcacaaggccaagaacuccu

SEQ ID NO: 622977 - RNA, 61 nt, hsa
gaagaauucagaaaaccacuuaagcaagacccuucugaaauaaaaaauguugcuuuuuaaa

SEQ ID NO: 622978 - RNA, 61 nt, hsa
cauaaaagcaaaucaacacuuuauaguuauucuucugaacuaagacaugucaauauucuuu

SEQ ID NO: 622979 - RNA, 61 nt, hsa
uguuuuuuuucucaacuaguuaagucaacugcuucugaaauaacucuguauuguagauuau

SEQ ID NO: 622980 - RNA, 61 nt, hsa
aaaaacuuauuaagguuaaauagaauuguuucuucugaauaaucuaacaaaggaaaauaua

SEQ ID NO: 622981 - RNA, 61 nt, hsa
cugugcauugcucaaaagcuguugggaacgccuucugaacaguugccuucagaacuaguuu

SEQ ID NO: 622982 - RNA, 61 nt, hsa
gcccaugucacaaacccuaucucaggaauuucuucugaauguucaauuuuuuucauugaag

SEQ ID NO: 622983 - RNA, 61 nt, hsa
auuguaauguaaggggcaagaaauuuguguucuucugaaugcuacuagcagcaccagccuu

SEQ ID NO: 622984 - RNA, 61 nt, hsa
uuuacaguuuugauuggguaauguuucuguucuucugaaaacagacccuuggcuucacaca

SEQ ID NO: 622985 - RNA, 61 nt, hsa
gcuuucuccagagaccuaauggccucaacaccuucugaacguggauagugccagaacacuu

SEQ ID NO: 622986 - RNA, 56 nt, hsa
uucauguagaaguuauaugaguguuucuucugaagaaccaaagcugaaauuuaaug

SEQ ID NO: 622987 - RNA, 61 nt, hsa
uuuuuccuuaacgcuagagauugcuacaaaucuucugaagggucucaauggcuucaggcua

SEQ ID NO: 622988 - RNA, 61 nt, hsa
auuaacacuauguguucaguuuucuugugggcuucugaaaguugccaucuucccuccgugg

SEQ ID NO: 622989 - RNA, 61 nt, hsa
uuuucagucaucccaguuuguacagacuuagcuucugaacucuaagaaugccaaagggacc

SEQ ID NO: 622990 - RNA, 61 nt, hsa
uucuuguucagauuaagaguugccaaaauaccuucugaacuacacugcauuguugugccga

SEQ ID NO: 622991 - RNA, 61 nt, hsa
uuuuuaugguguagauugaaauaauaguacacuucugaauuuuuauauaaaaugugguugg

SEQ ID NO: 622992 - RNA, 61 nt, hsa
gugugagccacugcacccagccuacuucacucuucugaauuauucugauuuauuuucaaca

SEQ ID NO: 622993 - RNA, 61 nt, hsa
acagucucugauuucaacacuaacauuccaucuucugaaauucugagauucuaacauccuu

SEQ ID NO: 622994 - RNA, 61 nt, hsa
ggcauaagccuuuuauggcccucuugcagaucuucugaacuaugcacauuugugcuuuuuu

SEQ ID NO: 622995 - RNA, 61 nt, hsa
uguaggcuuuauuuuaagcaguaauggguuacuucugaaacaucacuuguuugcuuaauuc

SEQ ID NO: 622996 - RNA, 61 nt, hsa
uuugagauuguaggccaacuguauuuucaagcuucugaacuuaggcaaaauauucaucgca

SEQ ID NO: 622997 - RNA, 61 nt, hsa
ggcccucugcagcccauccuuuccuuccguccuucugaaaccacauaccccaggcccaagc

SEQ ID NO: 622998 - RNA, 61 nt, hsa
caaggcagucgccagggcuucuuguccccaccuucugaaccuucuucaaacaguaguacaa

SEQ ID NO: 622999 - RNA, 61 nt, hsa
caaaagugguagggaaauuguucccucuccacuucugaaaguaugaugauguauuaaggau

SEQ ID NO: 623000 - RNA, 61 nt, hsa
uuaaucaugaauggaaaucggaaguaguaugcuucugaaacucuuuccagggaaacaucuc

SEQ ID NO: 623001 - RNA, 61 nt, hsa
cuucuaguuuaauaauacauacaugauuuuucuucugaaugucucuucucccugcaucacu

SEQ ID NO: 623002 - RNA, 61 nt, hsa
ggagggggaagugucugccuuuauguccuuucuucugaaauaaaaguaaaagcauuucugg

SEQ ID NO: 623003 - RNA, 61 nt, hsa
ugccuaaagauagaauggcuucucuguuuuucuucugaaauacaaccagaaacaauguguc

SEQ ID NO: 623004 - RNA, 61 nt, hsa
uugaaguauuuugcuggaauaaguucaaauucuucugaacucaaacugaggaauuucaccu

SEQ ID NO: 623005 - RNA, 61 nt, hsa
auagccagucaagcauagaauugcauccauucuucugaaauagguacugugccuaauuuuu

SEQ ID NO: 623006 - RNA, 61 nt, hsa
uugaaauggcugcagauagaucccgcagucccuucugaaaggaacuguguagccagcaggg

SEQ ID NO: 623007 - RNA, 61 nt, hsa
gauaacauuaguguauuucuccugugcuugccuucugaaguggcacaaaccuguguuuaua

SEQ ID NO: 623008 - RNA, 61 nt, hsa
uccgagauucagacauagccaugcugguggccuucugaaucacugcauggaugucccagga

SEQ ID NO: 623009 - RNA, 61 nt, hsa
agggaaagggagaaugguguacccuuuauuucuucugaaaucacacugaugacaucaguug

SEQ ID NO: 623010 - RNA, 61 nt, hsa
gaucguguugguauuuucagagaacaucccgcuucugaagcugcugcagcucccuccucag

SEQ ID NO: 623011 - RNA, 61 nt, hsa
acugcuagcaaaaucugaggaaacauaaauucuucugaagaaucauaggaagaguagacau

SEQ ID NO: 623012 - RNA, 61 nt, hsa
gcaaaguauccaucuugucuaucucccggcacuucugaaauauauugcuaccauuguauaa

SEQ ID NO: 623013 - RNA, 61 nt, hsa
aaggaucuuccaaaacagaggaccaaccagucuucugaaggucaugcccacagaagucauc

SEQ ID NO: 623014 - RNA, 61 nt, hsa
ugagaauggaaaacgcagaagagacguacaacuucugaaagaucucagaggacuggcauug

SEQ ID NO: 623015 - RNA, 61 nt, hsa
aauaaauugugcucuuugucauggcaaccagcuucugaaaagcccacugaaaauugccugu

SEQ ID NO: 623016 - RNA, 61 nt, hsa
auucaacuugcacugaccauaaaauguuucucuucugaacaagccccaucauuuggugaac

SEQ ID NO: 623017 - RNA, 61 nt, hsa
auugacagcuuucuagagccaguaaugggcucuucugaaggaugcugaauuagaagugaac

SEQ ID NO: 623018 - RNA, 61 nt, hsa
accacaagauugucugaaggccuucuaaaaccuucugaauguccugcagaaauauaacugu

SEQ ID NO: 623019 - RNA, 61 nt, hsa
ucuaaagauuucaaauaguggcagacagugucuucugaauguaaguuuugagaaauacgag

SEQ ID NO: 623020 - RNA, 61 nt, hsa
uugucugaauauuucuucuguuccuuucucucuucugaaauucuuauuauacauguuaaca

SEQ ID NO: 623021 - RNA, 61 nt, hsa
ggcucagguccagcugguuccucucuggcgccuucugaacccgucucagcagguccacagc

SEQ ID NO: 623022 - RNA, 61 nt, hsa
aguguugcaagcuggcuggauccaaccaucucuucugaaauaaugcauccaaaggguugau

SEQ ID NO: 623023 - RNA, 61 nt, hsa
cgccacgaccccccuggacgucuguaagacccuucugaacacucaggagaacguggcccuc

SEQ ID NO: 623024 - RNA, 61 nt, hsa
uucuguuuuguggaucucuuuccuagauuagcuucugaaaucauuauuagcuauaucauuu

SEQ ID NO: 623025 - RNA, 61 nt, hsa
caauccacuguuagaauaccuaugguuagggcuucugaacuaaaauaauggaaaauuuuaa

SEQ ID NO: 623026 - RNA, 61 nt, hsa
cugucgaugagacuguuuauuaccagauucacuucugaauuggccagaggaaaucugaaug

SEQ ID NO: 623027 - RNA, 61 nt, hsa
gguucccuucaauaacaaugaauggugcuuucuucugaaagacucagccuaauuaaaggau

SEQ ID NO: 623028 - RNA, 61 nt, hsa
cgcaugggcugagaacaccucuucccugaggcuucugaagguugcugucugucaugagugc

SEQ ID NO: 623029 - RNA, 61 nt, hsa
aauuaagcaguucuacucgaucaccaagaugcuucugaaaauugcauuuuauuaccauuuc

SEQ ID NO: 623030 - RNA, 61 nt, hsa
cacuuucuccugguguuuuucucucuggacccuucugaagcagagaccggacaagagccug

SEQ ID NO: 623031 - RNA, 61 nt, hsa
acacguguggcgggcagugggacccauagaucuucugaaaugaaacaaauaaucacauuga

SEQ ID NO: 623032 - RNA, 61 nt, hsa
cauggcccagggaggcgggugaaagcuccgucuucugaauucaucucuacaggcucaaaac

SEQ ID NO: 623033 - RNA, 61 nt, hsa
ccacugaaucuacacacagauuuuacugugacuucugaagcuguauagacucugcugugga

SEQ ID NO: 623034 - RNA, 61 nt, hsa
ugcccuucuuuccaaaacagcuacacaaaugcuucugaaugcccuggauacgcagaccgag

SEQ ID NO: 623035 - RNA, 61 nt, hsa
uuuccaagaaaaugugcaguauucucugcuacuucugaaucuguuuugucuuccuaaucua

SEQ ID NO: 623036 - RNA, 61 nt, hsa
uuuuaugguucucuuaaggaauuaauauucacuucugaaggacuuacuuguaauauauaau

SEQ ID NO: 623037 - RNA, 61 nt, hsa
auucuucuuaaaaguuucuaauguuauuuuccuucugaagucugagcccauuucugggggg

SEQ ID NO: 623038 - RNA, 61 nt, hsa
aacuugagcaggcuguucagcauuguuucugcuucugaaaucuguauaguacacugguuug

SEQ ID NO: 623039 - RNA, 61 nt, hsa
ggaaugaagcugcagauuuagagaacauuggcuucugaaaaaaaaaaagagugaagauagu

SEQ ID NO: 623040 - RNA, 61 nt, hsa
aaauugguguauuagacuauuuaucuuugaucuucugaauggauugcugucauggacacgg

SEQ ID NO: 623041 - RNA, 61 nt, hsa
ucaucgacgccugugacagggagaaaggauacuucugaacaaggagccuccaagcaaauca

SEQ ID NO: 623042 - RNA, 61 nt, hsa
uuggauuagcuuaaucaccaaguccugucaacuucugaaaugaaucucaaauuucuucccu

SEQ ID NO: 623043 - RNA, 61 nt, hsa
cugaaaugaaaucccauuggauuguacuucucuucugaaaagugugcuuuuugacccuacu

SEQ ID NO: 623044 - RNA, 61 nt, hsa
aggcucaacuucucuuccaaaaaucuucuggcuucugaacucuuccucugccucucuuuaa

SEQ ID NO: 623045 - RNA, 61 nt, hsa
aguggaguggccauaggcaaguuacuuaacacuucugaaccuccuuuugucuuucauaaaa

SEQ ID NO: 623046 - RNA, 61 nt, hsa
guaucuucagacucacagagugaauucagcucuucugaaucaagacccacccagucucuuu

SEQ ID NO: 623047 - RNA, 61 nt, hsa
uuuuggcagguuucugugccuuuauuucccucuucugaaaaaaagucuguguuuucauagu

SEQ ID NO: 623048 - RNA, 61 nt, hsa
agccugggguuccccuggcauuggccccagccuucugaaagccggcgcugcagccagaggc

SEQ ID NO: 623049 - RNA, 61 nt, hsa
cguagcccacgcccucucuggguggcagggccuucugaaggaaacuugcaggcgagcccaa

SEQ ID NO: 623050 - RNA, 59 nt, hsa
acagaauuaaacguguugccacaccugccggcuucugaacucuguccuuggcuuccugc

SEQ ID NO: 623051 - RNA, 61 nt, hsa
ccuuccuuucugcugccugaugucucaauggcuucugaaugacuguucuaauaaaugaucu

SEQ ID NO: 623052 - RNA, 61 nt, hsa
ucacuguaaauacacauucuuauucuugaaccuucugaaaauaaguugcagacaucaugaa

SEQ ID NO: 623053 - RNA, 61 nt, hsa
cugccuucuaccuacagugcauuugaacugccuucugaaagagguccagggagggauuuag

SEQ ID NO: 623054 - RNA, 61 nt, hsa
acauguagcuucuucugaaagaauuauuugccuucugaaaugugacccccaaguccuaucc

SEQ ID NO: 623055 - RNA, 61 nt, hsa
uacuacccauagaaaacuugacauguagcuucuucugaaagaauuauuugccuucugaaau

SEQ ID NO: 623056 - RNA, 61 nt, hsa
cugcugccuguuggggucggaagacaaggggcuucugaaaugggaguuccugagauacaac

SEQ ID NO: 623057 - RNA, 61 nt, hsa
ugguucccugacaaggguaccagguccaccccuucugaaaagcagcuguuaguuuacucuu

SEQ ID NO: 623058 - RNA, 61 nt, hsa
ggcucgagcagccuugggaagaggcaaggagcuucugaagaaacugccucugcacacacau

SEQ ID NO: 623059 - RNA, 61 nt, hsa
cacaacauuuuaauacagauugaaaggaccucuucugaagcuagaaacaaucuauaguuau

SEQ ID NO: 623060 - RNA, 61 nt, hsa
uguuauuuggaauuuuaaguucuaucagugacuucugaauccuuagaauggccucuuugua

SEQ ID NO: 623061 - RNA, 61 nt, hsa
uaugugacaacccucaucuugauccccaucccuucugaaaguaggaaguuggagcucuugc

SEQ ID NO: 623062 - RNA, 61 nt, hsa
gcagcgaugguauucgaucugugccaugacucuucugaauguuuggacagguuagaguugg

SEQ ID NO: 623063 - RNA, 61 nt, hsa
auggcuccgccucucugagccucugucucugcuucugaacagcggggccaauaaugaugcc

SEQ ID NO: 623064 - RNA, 61 nt, hsa
cauccaagaaauacuuuuuauugcugggagucuucugaaccucaccaaacugaggccagag

SEQ ID NO: 623065 - RNA, 61 nt, hsa
ucccccucccuaagcuccagggucccugaaucuucugaaaucucaaaugaguggaggccuc

SEQ ID NO: 623066 - RNA, 61 nt, hsa
gugcguucuggggcugugcugcuccuguuaccuucugaauccauauguagagauuucagcc

SEQ ID NO: 623067 - RNA, 61 nt, hsa
auuccuuguccgccaacccaccgugauucaucuucugaagcugggagugaaacugggucag

SEQ ID NO: 623068 - RNA, 61 nt, hsa
uuguaagaaauguuugucauaugcgugaugucuucugaaauauucuuauaaccuuaaugac

SEQ ID NO: 623069 - RNA, 61 nt, hsa
uccauuuauccuauuuugaucuuuuucaagucuucugaaaggaaguagacaguauuacacc

SEQ ID NO: 623070 - RNA, 61 nt, hsa
auguuuuucauuucccguguguuuccauuuccuucugaaauucugauuuuauccauuuuuu

SEQ ID NO: 623071 - RNA, 61 nt, hsa
augaccucugcaaacagaaucuuggauauuucuucugaaggauuauuugcacagacuuaaa

SEQ ID NO: 623072 - RNA, 61 nt, hsa
uccauuguccacacacacacaaccagauaaucuucugaaaguguaacucagaugaugccuc

SEQ ID NO: 623073 - RNA, 61 nt, hsa
cccugcucucuccuguugcucugggauugcacuucugaaugaaguagcagcucauaagcuu

SEQ ID NO: 623074 - RNA, 61 nt, hsa
agccaaucucucauuuagaccuggcuucuuucuucugaacaaaguaggguucaaaaugcag

SEQ ID NO: 623075 - RNA, 61 nt, hsa
aguuagugaguggaguugcccaagucuggggcuucugaaaugaccugguauuuuuauguuc

SEQ ID NO: 623076 - RNA, 57 nt, hsa
ucccuuucuucagaaauuaacuugugucuucugaaguuuuuguccuuggagacugca

SEQ ID NO: 623077 - RNA, 61 nt, hsa
gaggacacugcuaagggucucgaccccuuggcuucugaagacacgagccgugaguaggcag

SEQ ID NO: 623078 - RNA, 61 nt, hsa
cacugagaaaaagaaugagaaccaccuuauucuucugaaaaagacuuucuucucauccagu

SEQ ID NO: 623079 - RNA, 61 nt, hsa
aggaaaacggcacaacacaaucuugaggugccuucugaaucaucagauuaaauuaugcuuc

SEQ ID NO: 623080 - RNA, 61 nt, hsa
cuuuuuugucuuguuuuucuguuuuaguugucuucugaaaaaagagucguucccucuguuu

SEQ ID NO: 623081 - RNA, 61 nt, hsa
gauguuuuuaaaguuucuuuuguagaccgaacuucugaagaguaauaccaaaugccuaaaa

SEQ ID NO: 623082 - RNA, 61 nt, hsa
ugacuaaaacaucucuggugccaacguaauacuucugaaccaaaucacugugacucaagga

SEQ ID NO: 623083 - RNA, 61 nt, hsa
gugugguuguugauaccuugcaauaguauugcuucugaaaguaauaaaaaauuuuaggaga

SEQ ID NO: 623084 - RNA, 61 nt, hsa
uaucuucacaggugugaucauaccacauucacuucugaaacacucuuguugcgaucgcuaa

SEQ ID NO: 623085 - RNA, 61 nt, hsa
aacagcaccagcacagcauguauuuucuucucuucugaaaguucuggcuuguagaccccuc

SEQ ID NO: 623086 - RNA, 61 nt, hsa
uguuuguuuacucuuucuuugaaaacaucaccuucugaaauuugucuuuuagcucucucag

SEQ ID NO: 623087 - RNA, 61 nt, hsa
caggccuaugaagugcauagggaguguaugucuucugaaugguuuuauuguucuuguaauc

SEQ ID NO: 623088 - RNA, 61 nt, hsa
ggaguauguacaauucuucugggaagccagccuucugaacuuuuugguacuaaauccuuau

SEQ ID NO: 623089 - RNA, 61 nt, hsa
ugcugcugagugacugcaugaugagauacaacuucugaaugcugcacauucuuccaaaaug

SEQ ID NO: 623090 - RNA, 61 nt, hsa
uggucucccagcaccuggcccagguaacagccuucugaaagcagagccaaggagcugcuuc

SEQ ID NO: 623091 - RNA, 61 nt, hsa
auucuuguuaacuauaugugaaacauuuuuucuucugaagauucuuaaaaauugaaugugg

SEQ ID NO: 623092 - RNA, 61 nt, hsa
agaaaacugcucuguuuccccuuuaguaacacuucugaagaggaaaaacuucaauagccaa

SEQ ID NO: 623093 - RNA, 61 nt, hsa
uccauuuuggaaaaugauuaggcccgccaaacuucugaacuuuggaagcuggggauguuua

SEQ ID NO: 623094 - RNA, 61 nt, hsa
gcaagggccuaagagaaaagccagccaagugcuucugaauaaagaucccucucugggucuc

SEQ ID NO: 623095 - RNA, 61 nt, hsa
aagccaggcugagugagccacagaccaccugcuucugaacucaagcugcguuuauuaaugc

SEQ ID NO: 623096 - RNA, 61 nt, hsa
uucuaaauccuaggaagaaacgcuuggagugcuucugaauauacagaaguuccauuuaagg

SEQ ID NO: 623097 - RNA, 61 nt, hsa
auaaaagcagauaccuuuaaguuuguguagacuucugaauaagaugauagacgagaauuuu

SEQ ID NO: 623098 - RNA, 61 nt, hsa
auauaagucuccagagcacacaagaguauuucuucugaaaaaaauguuacaauuauacuag

SEQ ID NO: 623099 - RNA, 61 nt, hsa
ccagagaugucaucagagcuccucuguccugcuucugaaugugcugaucauuugaggaaua

SEQ ID NO: 623100 - RNA, 61 nt, hsa
cagggccagauaaggaacagcucgggccacucuucugaaggccaacguggaggaaagggag

SEQ ID NO: 623101 - RNA, 61 nt, hsa
uuuugagaaaaacuaaaucaugcuccugaaccuucugaacgcauuuguuauugaaggaaag

SEQ ID NO: 623102 - RNA, 61 nt, hsa
cuuguacacauuuuaauaaaauaaggguuggcuucugaacuacaaaacaaaugugcuaugc

SEQ ID NO: 623103 - RNA, 61 nt, hsa
cccaaggaaggccacuucucaacuggcagaacuucugaaguuuagaauuggaauuacuucc

SEQ ID NO: 623104 - RNA, 61 nt, hsa
aaaaaaagucacuuuuggcuaaucaugcagucuucugaaaagguuuaauagagaaaugcug

SEQ ID NO: 623105 - RNA, 61 nt, hsa
cagcuaauacaugcaauguggcuggugaacacuucugaauucagaaacuaucccagaucuc

SEQ ID NO: 623106 - RNA, 61 nt, hsa
ggauuaugaggucuugaguuuuuauaauguucuucugaaagccuuacauuuauaacaucau

SEQ ID NO: 623107 - RNA, 61 nt, hsa
uuaaucccugucuggacugagccuccguuggcuucugaacuggaauucugcagcuaacccu

SEQ ID NO: 623108 - RNA, 61 nt, hsa
guuugaaagcaaaaacaaaccacugucucugcuucugaaacgggaaucaguaacucuuugc

SEQ ID NO: 623109 - RNA, 61 nt, hsa
uaaacaugguuaaaauaaaacuuuugugguucuucugaaucuuaauauuucaaagccaggu

SEQ ID NO: 623110 - RNA, 61 nt, hsa
ucucacaagagcagaggccugaagauucuuucuucugaaagccaagcaccacaaggaaaaa

SEQ ID NO: 623111 - RNA, 61 nt, hsa
ugaaaauaaggaauugcuuauaaaccagccacuucugaauacaauauguagcugauuuaau

SEQ ID NO: 623112 - RNA, 59 nt, hsa
uauugauguuacccaguuuuaauaaaagaaucuucugaaggauggguccuccuaccuac

SEQ ID NO: 623113 - RNA, 61 nt, hsa
acugugucuacaguuuauccauauaacuucucuucugaaaacugaggaguguccucuguuc

SEQ ID NO: 623114 - RNA, 61 nt, hsa
acagacuguuccaccguugugcauauuguugcuucugaaccacaaacuguauaaauggaug

SEQ ID NO: 623115 - RNA, 61 nt, hsa
aacaucucccuuccggggcugcccucaagagcuucugaaaaacuaaugacucugcugccuu

SEQ ID NO: 623116 - RNA, 61 nt, hsa
aguagguucauguguuuucuuagguaaaguucuucugaaagaauuuucuauuuuuaaaaaa

SEQ ID NO: 623117 - RNA, 61 nt, hsa
auacuaaguuccauguauuuuuguuacaaaucuucugaaaaaaaacaaaacaaugugaaac

SEQ ID NO: 623118 - RNA, 61 nt, hsa
ccauaucuucuggcuaaccauauucaagauucuucugaaacuuggaggauguaaagaaucc

SEQ ID NO: 623119 - RNA, 61 nt, hsa
auguccuuccccucacuugugugaguggccccuucugaaucucuccagcagccagaggcac

SEQ ID NO: 623120 - RNA, 61 nt, hsa
uucuccaaacgcucgguuccuuugaagauuucuucugaacgugugugcgcacgcugggcgg

SEQ ID NO: 623121 - RNA, 61 nt, hsa
cccaagagcucaaaagcagaaauggccaggccuucugaaaacuuaaguccagaauugucac

SEQ ID NO: 623122 - RNA, 61 nt, hsa
uuguggccuccuuggauucuucugacuuuggcuucugaaaggaaggccuagauccagcccu

SEQ ID NO: 623123 - RNA, 61 nt, hsa
cuaaaaggcgcuucauguccaguguguggcccuucugaaacuuauggucaucucucccacu

SEQ ID NO: 623124 - RNA, 61 nt, hsa
gucauuugguacuggcuaccuggagccuuaucuucugaaggguuuuaaagaauggccaauu

SEQ ID NO: 623125 - RNA, 61 nt, hsa
gcucgugggcacuuuccacagcccaggagagcuucugaaaggacaguauagcugcccuugc

SEQ ID NO: 623126 - RNA, 61 nt, hsa
gagagacuuuaucaggaugaacccaggacugcuucugaaugcugcuacuugauuucuuucu

SEQ ID NO: 623127 - RNA, 61 nt, hsa
ggagagaccucaucaggaugaacccaggacgcuucugaaugcugcuacuuaauuccuuucu

SEQ ID NO: 623128 - RNA, 61 nt, hsa
auuugcuuaauauauaucuaccuaaaggagacuucugaauuguaaaugaacuuaaaaauag

SEQ ID NO: 623129 - RNA, 61 nt, hsa
uuuauucaugccugauuuguuuacaugaggacuucugaaauuaauccuuaaaacaaacuuc

SEQ ID NO: 623130 - RNA, 61 nt, hsa
guauacaaaaauaaaaaguggaaaaagguaucuucugaauguucaagagcauccuauagug

SEQ ID NO: 623131 - RNA, 61 nt, hsa
uggguguuggcuggguaaggggagccggggacuucugaaauagagcuggcucccuggggug

SEQ ID NO: 623132 - RNA, 61 nt, hsa
auaguugaguaaucaccucaguacuuaagcacuucugaacuuggguuucaugccugccccc

SEQ ID NO: 623133 - RNA, 61 nt, hsa
agaguuggugaagguugucucuuccgagggccuucugaagacagggcucuugaacagacaa

SEQ ID NO: 623134 - RNA, 61 nt, hsa
gcacaaagaacguugaaguucagauuaaucucuucugaaugauguuuuuuuccucugugau

SEQ ID NO: 623135 - RNA, 61 nt, hsa
auuuuugcagucuuaaaauuacacuucuugacuucugaaugucucuuauuugcgugcacug

SEQ ID NO: 623136 - RNA, 61 nt, hsa
acuuagcaaaauuagcaauauauuauccaaucuucugaacuugaucaagagcauggagaau

SEQ ID NO: 623137 - RNA, 61 nt, hsa
ucucucaacccagggacacccaaggauaugucuucugaagaucaaggcaagaaccucuuua

SEQ ID NO: 623138 - RNA, 61 nt, hsa
agaccuacuugaacagggcauauuuuuuagacuucugaacaucaguauguucgaggguacu

SEQ ID NO: 623139 - RNA, 61 nt, hsa
aaggaauaugacauacagugcuggccacaaccuucugaaggcccaugcccuggcuuggcau

SEQ ID NO: 623140 - RNA, 61 nt, hsa
ucuucuuccagcucguuagcagcauuagcaccuucugaauuccacccucucagaagaaucc

SEQ ID NO: 623141 - RNA, 61 nt, hsa
ggcuuucauuuggucagcacuagaacaguaucuucugaagacaaaacugaaugcuauagcu

SEQ ID NO: 623142 - RNA, 61 nt, hsa
gcugcaugagacaucuuucugaaaaugguaacuucugaaacagcaaagcuuccuguguuuc

SEQ ID NO: 623143 - RNA, 61 nt, hsa
uccucccagcccauaaccaguauuuuugcugcuucugaauacaaauugguugguuuugacu

SEQ ID NO: 623144 - RNA, 61 nt, hsa
gugaauuuugucuccugcuuggaaagucucucuucugaaccuggagccugaauacauuuuc

SEQ ID NO: 623145 - RNA, 61 nt, hsa
uuggucuucuuuucauuuuugauuagaggaacuucugaacuuggaaaggggaaguuggcag

SEQ ID NO: 623146 - RNA, 61 nt, hsa
guuuuuuucuaauggaaugaaccauuuuccucuucugaaaauucuguaucugagcacauca

SEQ ID NO: 623147 - RNA, 61 nt, hsa
cuucgguguaaucuaagcguuaucugcaccacuucugaauaauaaauguguuugaaaugca

SEQ ID NO: 623148 - RNA, 61 nt, hsa
guagauuuccacaaaucagacacauuauuuucuucugaacuuggcaauauaaccuaauaag

SEQ ID NO: 623149 - RNA, 61 nt, hsa
ggagcaucuuuggacucucuguuuuuaaaaccuucugaaccaugacuuggagccggcagag

SEQ ID NO: 623150 - RNA, 61 nt, hsa
gacuacaaagaaaaacagauacuaaaagucucuucugaaaacagcaauccagguaagacuu

SEQ ID NO: 623151 - RNA, 50 nt, hsa
ccaagaaaaagaggaaguaacuucugaacuuuggcccugagcuccauucu

SEQ ID NO: 623152 - RNA, 61 nt, hsa
ugaauuacuucuuguacagcugagauagcuucuucugaacuauuauuaaauaagugaauac

SEQ ID NO: 623153 - RNA, 61 nt, hsa
ugggauguagauagaaagcaccugaauugugcuucugaauuaaccaauccaggaacugcuu

SEQ ID NO: 623154 - RNA, 61 nt, hsa
ugugcaaauuacaggcaagacaacaaagccgcuucugaagaagaaaggaccgaagcugcug

SEQ ID NO: 623155 - RNA, 61 nt, hsa
uggaaaacaugaaaacagcaaucuucuuaugcuucugaauaaucaaagacuaauuugugau

SEQ ID NO: 623156 - RNA, 61 nt, hsa
gacccucauaugaccugcacagcucauuuuccuucugaaagaaacuacuaccuaggagaau

SEQ ID NO: 623157 - RNA, 61 nt, hsa
ggaggcugucagacuguucccccuaaacacacuucugaagguuguagggaccuugcccugc

SEQ ID NO: 623158 - RNA, 61 nt, hsa
ggcggaggggauccagccacuucccccucuucuucugaagaucagaacauucagcucugga

SEQ ID NO: 623159 - RNA, 61 nt, hsa
cucuuagaagcuaacccacuuaaauauuacucuucugaaugcuaguucucuuuuauucuug

SEQ ID NO: 623160 - RNA, 61 nt, hsa
agcacagagggccggccaccaguccucgaugcuucugaacccugaagcccgaugacaucuu

SEQ ID NO: 623161 - RNA, 61 nt, hsa
uuuaguaaaagaaagugaggaaaaggaagugcuucugaaaacaaaccuuucuggacggcag

SEQ ID NO: 623162 - RNA, 61 nt, hsa
gggugaccaaaugacgagcccucgccucuuucuucugaagaguacucuauaaaucuagugg

SEQ ID NO: 623163 - RNA, 61 nt, hsa
guuccccauccccaguaguuuacauuccugacuucugaauacagcacagcugagcccccug

SEQ ID NO: 623164 - RNA, 61 nt, hsa
uaaauaugcaauaaaguguuuacaggaugcccuucugaaggguaguccuuuguaaagcugu

SEQ ID NO: 623165 - RNA, 61 nt, hsa
agauacuuacugacuccacuccugacuucugcuucugaaaaaaugaaguagguguuuuccc

SEQ ID NO: 623166 - RNA, 61 nt, hsa
augaaaucauuuucacaaaauaagcagcuugcuucugaaaugcugucuuucccaguagcua

SEQ ID NO: 623167 - RNA, 61 nt, hsa
cugucauuccacuucauggaagagacggagccuucugaaaugagaucuacccugaaaaucu

SEQ ID NO: 623168 - RNA, 61 nt, hsa
ugccacgagcccauaauugaagagucaaagucuucugaagcugcacccucuuuacuucagu

SEQ ID NO: 623169 - RNA, 61 nt, hsa
gucuguuuaacucuucauguuccaucuuucucuucugaaguaaacuauuuugaaaguucuc

SEQ ID NO: 623170 - RNA, 61 nt, hsa
agggccuggccaccucauaggacucaguucccuucugaacacucgggggacaugggccucu

SEQ ID NO: 623171 - RNA, 61 nt, hsa
gagcccuaccauuacauccugauaucuggggcuucugaaggucuguacugggagugaagag

SEQ ID NO: 623172 - RNA, 61 nt, hsa
cuaaagguuuuguccuguaggacauggagaacuucugaagaauuuucaaggcgggugggau

SEQ ID NO: 623173 - RNA, 61 nt, hsa
aaugaauuauuucuguaguuggaaucuguaccuucugaaccucuacaccaauaacugcugc

SEQ ID NO: 623174 - RNA, 61 nt, hsa
ccaggacgucaggcugaccaacaccucagaccuucugaagcagcccauugcuggcccgcca

SEQ ID NO: 623175 - RNA, 61 nt, hsa
caguuuccucaggcaaggccucucugggccacuucugaaggguucugaugaaaacugacug

SEQ ID NO: 623176 - RNA, 61 nt, hsa
agacaaauuguuaagaguaucauguacuacacuucugaaacuuaacgugaucaucaccacu

SEQ ID NO: 623177 - RNA, 61 nt, hsa
gaaaccagaaugaucuucaggauaaaaagaacuucugaaucucugcaauaggaaauguuuc

SEQ ID NO: 623178 - RNA, 61 nt, hsa
gccggaguaucuauuucuacauagucagcuacuucugaaacugcagcaguggcuuagaaag

SEQ ID NO: 623179 - RNA, 61 nt, hsa
uaauuuuuauuuuugaagcuuaaauguguuucuucugaaagcuguuaaagauguauuuaug

SEQ ID NO: 623180 - RNA, 61 nt, hsa
ugaauuucuacaguuuaacauagcacagggccuucugaaaaucgcacuugucaaagacgac

SEQ ID NO: 623181 - RNA, 61 nt, hsa
ugggggcucagccaggugcugugacaccccccuucugaaugaagccuucugaccugggcug

SEQ ID NO: 623182 - RNA, 61 nt, hsa
ugaugccugugaacugaacucugacaacagacuucugaaauagacccacaagaggcaguuc

SEQ ID NO: 623183 - RNA, 61 nt, hsa
uuucugcccaguucuacccccucaugugcuucuucugaauacugaaugugacuguuugaaa

SEQ ID NO: 623184 - RNA, 61 nt, hsa
agagggaaugcuagguugauagggcugguggcuucugaauuugguauuugaacuaggaguc

SEQ ID NO: 623185 - RNA, 61 nt, hsa
auguucucugguaacacguagaguucagacccuucugaacucuguugauaauaccacacca

SEQ ID NO: 623186 - RNA, 61 nt, hsa
gcaucuuccucccuccuuuaauuaauggaaucuucugaauuuucccugaauguuuaaagau

SEQ ID NO: 623187 - RNA, 61 nt, hsa
ucugaaaugcgcccgccuggcggacagcucccuucugaagcagagaagccuccauggucac

SEQ ID NO: 623188 - RNA, 61 nt, hsa
uguaacagauacacuacaguagaagaacuuacuucugaaaugaagggaaaaaaaccacccc

SEQ ID NO: 623189 - RNA, 61 nt, hsa
ccacuuggggaguuucuuccuggcaucaugccuucugaauaaaugccgauuuuauccaugg

SEQ ID NO: 623190 - RNA, 61 nt, hsa
aaagacucuuuucuccucucuccgccaccggcuucugaacagccuggcgggaaauguaguc

SEQ ID NO: 623191 - RNA, 61 nt, hsa
gccuggccuggcucuggaagucacgucuuagcuucugaacaccguagcggguuaugaggaa

SEQ ID NO: 623192 - RNA, 61 nt, hsa
auuagauuuuugugaugaagagcuuccauuacuucugaaaacuauauuuaucugagugagu

SEQ ID NO: 623193 - RNA, 61 nt, hsa
auugaaacauaaaauuguagcuuuugguguccuucugaagggucagaauauguaauuauuu

SEQ ID NO: 623194 - RNA, 61 nt, hsa
guuuuccauuugggggccccaugggaaagagcuucugaacucuuuccuuuaugaacuccca

SEQ ID NO: 623195 - RNA, 61 nt, hsa
uucccaaguuucacaaugugauuguacaugacuucugaaauuaaaaagagagcaugagguu

SEQ ID NO: 623196 - RNA, 61 nt, hsa
gauuuuagaugauaaggcuacaauucagaaucuucugaaccaucuauguaaugaaugggga

SEQ ID NO: 623197 - RNA, 61 nt, hsa
gcuuuagaacaaacccuuuuugaucuuaaugcuucugaaaacuaggucugacucuggggau

SEQ ID NO: 623198 - RNA, 61 nt, hsa
gcaaaugucuccucccucccaugcuccuuggcuucugaaggcugaagcuccuuuggcuggg

SEQ ID NO: 623199 - RNA, 61 nt, hsa
gaagugccuucauccaggacaggaaguagcacuucugaaacaggaaguggucuggcuggaa

SEQ ID NO: 623200 - RNA, 61 nt, hsa
augcuuacugugguauuuggaauguauguaucuucugaacccuacaucaaguugaaaaggu

SEQ ID NO: 623201 - RNA, 61 nt, hsa
uuugaacaguuuaauaaacugguucugcucucuucugaaucucaugccuuuggcaccuugg

SEQ ID NO: 623202 - RNA, 61 nt, hsa
uagggagggauuucacucuucuucccagguucuucugaagcacccacacaaaaugcacacu

SEQ ID NO: 623203 - RNA, 61 nt, hsa
aagaggaucuggagaaccucauccagcuccccuucugaaucagcugggaugacuggcuuug

SEQ ID NO: 623204 - RNA, 61 nt, hsa
aggaaggggcucuguucccuguauuguccuccuucugaagccccuuggcucugccuuggcc

SEQ ID NO: 623205 - RNA, 61 nt, hsa
cuaagccgaguaagaagacauacaaaagccucuucugaaggaaaagacaguguaguccugc

SEQ ID NO: 623206 - RNA, 61 nt, hsa
cuuuugaacguaugugcucuuauaaaguggacuucugaaaaaugaauguaaaagacacugg

SEQ ID NO: 623207 - RNA, 61 nt, hsa
cccacacaugguccucacucauaucugucaccuucugaagccuagaucuuguuaacccauc

SEQ ID NO: 623208 - RNA, 61 nt, hsa
cgaaacugacaguauuaaggguaggauguugcuucugaaucacuguugaguucugauugug

SEQ ID NO: 623209 - RNA, 61 nt, hsa
ccugcgccucacccucagacuggugaccaggcuucugaaagccauucuggaucaguuggcu

SEQ ID NO: 623210 - RNA, 61 nt, hsa
ugacuuuuuuugugugaauaaagauaugaaacuucugaaucucaagaacugugguguguuu

SEQ ID NO: 623211 - RNA, 61 nt, hsa
caggguacgaacuggagggcuuguguguuagcuucugaauuggcaauuggaggcgguagug

SEQ ID NO: 623212 - RNA, 61 nt, hsa
ggaagaugagauuguaggugauauuuauuuucuucugaaacuuuuguauaguuugcaaauu

SEQ ID NO: 623213 - RNA, 61 nt, hsa
caaaaacuuaaauucauucagaaaguugccacuucugaaugaguagagcaggaaaaguaaa

SEQ ID NO: 623214 - RNA, 61 nt, hsa
guaagcuuccugggugaagguugauuuguaccuucugaauccugucacguguagacauggg

SEQ ID NO: 623215 - RNA, 61 nt, hsa
uuucaggggucaaguccuuccugcucauacacuucugaauacaguagauguugaacuuauc

SEQ ID NO: 623216 - RNA, 61 nt, hsa
ucuuuugucuuuaaaaccugauuuuuaaguucuucugaacuguagaaauagcuaucugauc

SEQ ID NO: 623217 - RNA, 61 nt, hsa
gauucccuauucacauugaauccuuuuugcccuucugaaacaauauucagucacaagucau

SEQ ID NO: 623218 - RNA, 61 nt, hsa
uuaaaacuagccaaauuagaauccuaacaaucuucugaacuccaguaccuauaacugggcu

SEQ ID NO: 623219 - RNA, 61 nt, hsa
guaaauaaacauauuuuuuuuacaaaaauaacuucugaauuuaucaguguuuugccguuaa

SEQ ID NO: 623220 - RNA, 61 nt, hsa
uugauauauaaccgugauugucucugcuuuucuucugaaauguagauaacugcuuuuugac

SEQ ID NO: 623221 - RNA, 61 nt, hsa
acgucugucuacauugaauugggaucugauucuucugaagauaccguuaauaaggcaacuu

SEQ ID NO: 623222 - RNA, 61 nt, hsa
augucaucuuuuucaccauucagaaacagugcuucugaauuugugauuuaaaggaauugua

SEQ ID NO: 623223 - RNA, 61 nt, hsa
cuccacaccuuggcuuuuaugacccugauggcuucugaaacaggaaaagagagaaggaaga

SEQ ID NO: 623224 - RNA, 61 nt, hsa
ggcccucuucaggcuuuggcagccacagauacuucugaacccuucacagagagcaggcagg

SEQ ID NO: 623225 - RNA, 61 nt, hsa
gcacuaugaacagagaacauuugccuguuggcuucugaaguggucagggccauggcugaca

SEQ ID NO: 623226 - RNA, 61 nt, hsa
aaagaauggagcccacuaauauuauauuuuucuucugaaauaaauauaaagucaagacuaa

SEQ ID NO: 623227 - RNA, 61 nt, hsa
caaagacccagaggccagagcaaaguaggaccuucugaagauucacuacugguguauccuu

SEQ ID NO: 623228 - RNA, 61 nt, hsa
uguaucgugccaaaguuguaucacuguuaaacuucugaagacauaaccaguugagucuuau

SEQ ID NO: 623229 - RNA, 61 nt, hsa
cuuguagaaaauaguuuuccagacacuuagccuucugaagugcucaucucuugcuuaaaug

SEQ ID NO: 623230 - RNA, 61 nt, hsa
aauuuagagauguuuucuacauauuucugcucuucugaacaacuucugcuacccacuaaau

SEQ ID NO: 623231 - RNA, 61 nt, hsa
caguuuuuuuaugguacucgaaaaaucaaaccuucugaaaauuaugauauuuguacuucau

SEQ ID NO: 623232 - RNA, 61 nt, hsa
uaauuaaaagagggauuaucacuaucugauacuucugaaagaaacacuuacaaaauuucuu

SEQ ID NO: 623233 - RNA, 61 nt, hsa
gugucuagaauuaaguaugggcauaaacuggcuucugaaucccuuuccagaguguuggauc

SEQ ID NO: 623234 - RNA, 61 nt, hsa
ggugaaacgguacgauggucucaacaccuuucuucugaacuguaauacauaucacaaaaag

SEQ ID NO: 623235 - RNA, 61 nt, hsa
cauucaggauucuguuccuuagguuuuuuuccuucugaaguguuucacgagagcccgggag

SEQ ID NO: 623236 - RNA, 61 nt, hsa
aagcagguguggggccuccuucugggcuuuucuucugaauuuagaggauuucuagaacgug

SEQ ID NO: 623237 - RNA, 61 nt, hsa
gagacacugauuuuuaaauaucaaaauuucccuucugaagucguucagauguguuccuuaa

SEQ ID NO: 623238 - RNA, 61 nt, hsa
ugaugcgcaugggcaaggccagcgcccggggcuucugaaccgagcgggguguuucauuuuu

SEQ ID NO: 623239 - RNA, 61 nt, hsa
ccagagguacaaggaggagcugguacuauuccuucugaaacuauuccaaucaaugggaaaa

SEQ ID NO: 623240 - RNA, 61 nt, hsa
uacuuagauuacuaaauauauauuucaucuacuucugaaguugauagucuucccccccccc

SEQ ID NO: 623241 - RNA, 61 nt, hsa
auggggcuguuacuuuuaaagucaaaauuuucuucugaaggcucauuuugguauuugaucu

SEQ ID NO: 623242 - RNA, 61 nt, hsa
cagcaaagccauucuuaagagucgugagguccuucugaauguaaaacuggagcccaggaga

SEQ ID NO: 623243 - RNA, 61 nt, hsa
gugguuggcagcuccaagccuuuaaaccuggcuucugaaacgauggcaucagagcccugga

SEQ ID NO: 623244 - RNA, 61 nt, hsa
auuugcaccucaucaugccccagaaauaauccuucugaagcaaagcaccacgaaugagguu

SEQ ID NO: 623245 - RNA, 61 nt, hsa
ugaucuuccauuaccuucacaucccgggguccuucugaacugaccuugaccucugaucucu

SEQ ID NO: 623246 - RNA, 61 nt, hsa
agcacccccauccccuuggcccuuccucaugcuucugaaguggacauauucagccuuggcg

SEQ ID NO: 623247 - RNA, 61 nt, hsa
gucucuauuuuuaaaaaagaaaaagaaccgacuucugaaucgcagcuccacucaugacuaa

SEQ ID NO: 623248 - RNA, 61 nt, hsa
ucucucuccaucgggccucgggacccuuucucuucugaaucugcuucccugcaguuuagau

SEQ ID NO: 623249 - RNA, 61 nt, hsa
agcacgacuaagagccuucugagcccagcgacuucugaagggccccuugcaaaguaauagg

SEQ ID NO: 623250 - RNA, 61 nt, hsa
cuccaguugagacacaagucacaaauccaggcuucugaaacuucggaccaaccagcuucaa

SEQ ID NO: 623251 - RNA, 61 nt, hsa
guucuagacgccccucccaagcguuccuggccuucugaacuccauacagccucuacagccg

SEQ ID NO: 623252 - RNA, 61 nt, hsa
cuucccacugaagggacacagagguccaguccuucugaagggcuaggaucggguucuggca

SEQ ID NO: 623253 - RNA, 61 nt, hsa
ccucagacucuccccaauagcggaagucgaucuucugaaggauggccaaucugcuccggcc

SEQ ID NO: 623254 - RNA, 61 nt, hsa
uugcaaaaaucaauuauuuaucaugaguauacuucugaaaugaucuguuucaucaaucuau

SEQ ID NO: 623255 - RNA, 61 nt, hsa
agccuucccugugugccaacgccagccuucgcuucugaaaaccaaacuccagccgcugcca

SEQ ID NO: 623256 - RNA, 61 nt, hsa
aaaucgaagaugucauggggucggggggaggcuucugaaagaugacugcguccuccucugc

SEQ ID NO: 623257 - RNA, 61 nt, hsa
aacacccuucugauggaaggcgggauucccgcuucugaaacucccccuggagucucacucc

SEQ ID NO: 623258 - RNA, 61 nt, hsa
agcagcuucaggggcaguccguuucucugugcuucugaaacccccuucucacguuucaggc

SEQ ID NO: 623259 - RNA, 56 nt, hsa
auauauuucagguuaacuagaaaaaucuucugaauaagaucuucccucuuugcccg

SEQ ID NO: 623260 - RNA, 61 nt, hsa
cuugcucacugugugaccaagugacaaacuccuucugaaccuguguucucccacuguacca

SEQ ID NO: 623261 - RNA, 61 nt, hsa
aacauucugaagccuucgguuguuccagcuccuucugaauacacaaaagaguucauacugg

SEQ ID NO: 623262 - RNA, 61 nt, hsa
uucuaucauucgugcuauuuauuuccuuaaacuucugaaaguuaaaaaguccagauaggag

SEQ ID NO: 623263 - RNA, 61 nt, hsa
auuucucucccaaaucacuaaguuuaauauacuucugaaguuuacaucaguuuuauuuuaa

SEQ ID NO: 623264 - RNA, 61 nt, hsa
ccagaguagaaaacuaugaaugugggauagccuucugaaaaagccacaaauuuaugaaaca

SEQ ID NO: 623265 - RNA, 61 nt, hsa
uucucuguccuuguuuccugccugucauguucuucugaauaguaacaacaagagcugauac

SEQ ID NO: 623266 - RNA, 61 nt, hsa
uuuuguuuguuuuguuuuuuugagauggagucuucugaaaauuuucucaucuucucuaacc

SEQ ID NO: 623267 - RNA, 61 nt, hsa
gacaccuucaguucuguuccuauuaaaggaccuucugaagggcuucucugucggucuugua

SEQ ID NO: 623268 - RNA, 61 nt, hsa
ucuauccuucugcugaaacugcaagcuaagccuucugaagaugguaaaggacuuggccaga

SEQ ID NO: 623269 - RNA, 61 nt, hsa
ggagcagaaagagaagguuuuuaaggaggggcuucugaauacuugggagauacggaacgga

SEQ ID NO: 623270 - RNA, 61 nt, hsa
gccuccuggccucagggcaugcccugccuaccuucugaaauguuuaccccauugaccaaac

SEQ ID NO: 623271 - RNA, 61 nt, hsa
uuugaaaucucugcaucacucauuggaagugcuucugaagagagcugcucuguguucaguu

SEQ ID NO: 623272 - RNA, 61 nt, hsa
agcacgucuaagagccuuaugagcccagcgacuucugaagggccccuugcaaaguaauagg

SEQ ID NO: 623273 - RNA, 61 nt, hsa
gugccuacuaugugcgagacauugggaggggcuucugaauuauucuggauaucgucauuuu

SEQ ID NO: 623274 - RNA, 61 nt, hsa
cccacaaagcaucaaaagacucacucacaaacuucugaacacaaacuccauggaugaaagc

SEQ ID NO: 623275 - RNA, 61 nt, hsa
ugcucagugaggaaaucucuuccaauuucugcuucugaaugauucaauguugggagcaaua

SEQ ID NO: 623276 - RNA, 61 nt, hsa
uggaguugagggaaggagcuguauuguggcacuucugaauuccccguuuuguuccauauug

SEQ ID NO: 623277 - RNA, 61 nt, hsa
gaguuuuuaaacuaucaauggcauuucaagucuucugaaacagcauggcuguaugugcgug

SEQ ID NO: 623278 - RNA, 61 nt, hsa
ugguagagcaauaaugcuuuuuaaaaauaaacuucugaaaacccaaggccagguacugcau

SEQ ID NO: 623279 - RNA, 61 nt, hsa
guauaucuuaagcauuuggaauuuuuuuuaucuucugaaaucauauaaaaagaaugucauu

SEQ ID NO: 623280 - RNA, 61 nt, hsa
gggggauggcuuaacuguaccuguuuggaugcuucugaauagaaauaaaguggguuuuccc

SEQ ID NO: 623281 - RNA, 61 nt, hsa
cgucuccauaaaaggcccaggaacacgggagcuucugaagagcugaacauguggagggagg

SEQ ID NO: 623282 - RNA, 61 nt, hsa
ugucugcucuagucauccagaaacccacucccuucugaagccccuccuugggccggguugu

SEQ ID NO: 623283 - RNA, 61 nt, hsa
aauuaauuauccuuaaaaaaguuaagcauaucuucugaacugaauacaucagcuggcauaa

SEQ ID NO: 623284 - RNA, 61 nt, hsa
uuccacccacccagcucugcccaugccucuccuucugaaccuugggagagggcugaacucu

SEQ ID NO: 623285 - RNA, 61 nt, hsa
agguuuuuauaaugaaguuguuuauuaaaaacuucugaaugauguguuugggaguugugaa

SEQ ID NO: 623286 - RNA, 61 nt, hsa
accugugcccagcuuuggucccccuucccaacuucugaagcacgugcugcagagccaccuu

SEQ ID NO: 623287 - RNA, 61 nt, hsa
agccuuggguuccaaccaggcaguagaugugcuucugaaccgcaaggagcaaacacugaaa

SEQ ID NO: 623288 - RNA, 61 nt, hsa
uuuuauuguaaccagaaucacccugaggucccuucugaacccucugggccugcgcuaauug

SEQ ID NO: 623289 - RNA, 61 nt, hsa
ugguagaggccgagcccagcaaagguggcuccuucugaauguguggucagcaucuguacaa

SEQ ID NO: 623290 - RNA, 61 nt, hsa
gcgccucugcccucucccagucccccuguggcuucugaaaaucucagggacagaugaggcu

SEQ ID NO: 623291 - RNA, 61 nt, hsa
caacaucuguuacauucuaaguguguucaggcuucugaagguaaagggacacuggauccag

SEQ ID NO: 623292 - RNA, 61 nt, hsa
gaggucaucaaccgaugguccucacaagccucuucugaagauggaaggccuuuugcccguu

SEQ ID NO: 623293 - RNA, 61 nt, hsa
cgccuggcaucucucugccgcagcauuuccccuucugaaccguccagugacugcuuucaau

SEQ ID NO: 623294 - RNA, 61 nt, hsa
aaugaggcugauagugaagaaaugaaaaugucuucugaagugaagcauauuuguggcgaag

SEQ ID NO: 623295 - RNA, 61 nt, hsa
acaguccuuauucagaaacuuuucggucagucuucugaagaaucucaaaaagcccacccaa

SEQ ID NO: 623296 - RNA, 61 nt, hsa
acuucacugucaccugugucccauagggugccuucugaauacuguuauuagaauaaguuug

SEQ ID NO: 623297 - RNA, 61 nt, hsa
ccuuucuauuucaguucauucacagaucucacuucugaaugugccacuuccaguagacaug

SEQ ID NO: 623298 - RNA, 61 nt, hsa
uccaggggacgauggaauacccagaacgcuccuucugaagaaauggggcccuguagcugca

SEQ ID NO: 623299 - RNA, 61 nt, hsa
uucaaaccuuuccuacuucaaacaggcuucucuucugaaaugaugacuuaaugucgaauau

SEQ ID NO: 623300 - RNA, 61 nt, hsa
cuaagggcagcccuccaugguccugucuguccuucugaaguguguccauccugaccugcgg

SEQ ID NO: 623301 - RNA, 61 nt, hsa
ggcgucaauaaagaccuggaaggauguugugcuucugaagccccacuggguguuacugcag

SEQ ID NO: 623302 - RNA, 61 nt, hsa
ugccucaguguccuucucauuucaguagggacuucugaaaugggggaggcaguguggaaua

SEQ ID NO: 623303 - RNA, 61 nt, hsa
cauguaauaugaucaggacccaccuccaguucuucugaaagugugacaguguccagccggu

SEQ ID NO: 623304 - RNA, 61 nt, hsa
caggcuguggauuacgucacugcaggaacugcuucugaaaggcuuuggccuuccucaguga

SEQ ID NO: 623305 - RNA, 61 nt, hsa
ugcuugauggaauuuuuuccugcuaguguagcuucugaaaggugcuuucuccauuuauuua

SEQ ID NO: 623306 - RNA, 61 nt, hsa
agcacaguauuuuuguaugaaaagugggagacuucugaacaguaauucauuuaauugcaaa

SEQ ID NO: 623307 - RNA, 61 nt, hsa
uuucccaggaacaaaucaaaagguggauuaucuucugaagaauggaaacuguuaguccaga

SEQ ID NO: 623308 - RNA, 61 nt, hsa
cgugaccggggcccacaucugugugucgugacuucugaagaguuuggccuaggccuaaaga

SEQ ID NO: 623309 - RNA, 61 nt, hsa
cccggcaucuaccccacucaggaaaccuugacuucugaauuccuaucagguccagagggug

SEQ ID NO: 623310 - RNA, 61 nt, hsa
gugacaaugcagcacuggcaugcauguccuccuucugaaggaccucauccuuccucacagg

SEQ ID NO: 623311 - RNA, 61 nt, hsa
auuuaauuugucuuuaaggacagucauuuggcuucugaauguuugaaacgauuuuaaaaaa

SEQ ID NO: 623312 - RNA, 61 nt, hsa
caggggugaggaguggggagaaaccagaaugcuucugaaacucccaccuguugcucugagc

SEQ ID NO: 623313 - RNA, 61 nt, hsa
uauuuuuuuucaugaaaaugucaacaugguucuucugaaucuaucacagugaaaaguucua

SEQ ID NO: 623314 - RNA, 61 nt, hsa
uauuuucccucaccagucuaggcaugacuggcuucugaaaaauuccagcacaccuccucga

SEQ ID NO: 623315 - RNA, 61 nt, hsa
gauauauucuaugcauagauguaaugcuaaccuucugaauauauuuugaauacauuuauau

SEQ ID NO: 623316 - RNA, 61 nt, hsa
auaauaaaauuuccccuaaucuuuucugaaucuucugaaaccaaauguaacuauguuuuau

SEQ ID NO: 623317 - RNA, 61 nt, hsa
uuguuuucuuggcuaguaauaguaguagauacuucugaaauaaauguucucucaagauccu

SEQ ID NO: 623318 - RNA, 61 nt, hsa
uguggaugacccuuagaauccauucucuggucuucugaaauaccaagggcagaugucaccu

SEQ ID NO: 623319 - RNA, 61 nt, hsa
augauguucagauuuuccagugaaaaauacccuucugaacaaaacauguacuuacucuccg

SEQ ID NO: 623320 - RNA, 61 nt, hsa
ugcugguggcuaacggcuugugcuugaaagucuucugaagucugaugugaauugagcuauc

SEQ ID NO: 623321 - RNA, 61 nt, hsa
uugguucuggcccccgcuuuuucuaacaugucuucugaaugcuuccuuuuucccugcacac

SEQ ID NO: 623322 - RNA, 61 nt, hsa
uccauaucauaguugcuuucuuuaauuguuccuucugaauaaacaguuuauuuaagauacu

SEQ ID NO: 623323 - RNA, 61 nt, hsa
gguguuuccaacgucauggaagcagcugacacuucugaaacucagccaaggacacuugaua

SEQ ID NO: 623324 - RNA, 61 nt, hsa
acgcuucaguauuuuaugcaauuuuuuuucacuucugaagggaaaguguauuauaaaaaaa

SEQ ID NO: 623325 - RNA, 61 nt, hsa
uuaauugugaaccuaccauguugccucccaucuucugaaaaaacaaaaaaauugagaggcu

SEQ ID NO: 623326 - RNA, 61 nt, hsa
aacauguugccaaaaugguggccuggcuugucuucugaacguuugguucaaauguguuuug

SEQ ID NO: 623327 - RNA, 61 nt, hsa
aagggggauuaaagcuacaccucaauccauucuucugaagugaaauuuacuugacacagua

SEQ ID NO: 623328 - RNA, 61 nt, hsa
gccuggcuuuuagcagccauaaagaacucuccuucugaauggcaagucucucagacucuug

SEQ ID NO: 623329 - RNA, 61 nt, hsa
aaacacuaguauaguguuguguagcuuaauccuucugaagucuuuuugucauguagcuauu

SEQ ID NO: 623330 - RNA, 61 nt, hsa
uugaguagagaaauuaugugugucauguggucuucugaaaauggaacaccauucuucagag

SEQ ID NO: 623331 - RNA, 61 nt, hsa
cuucguuacuugagcuucagcaacuuaagaacuucugaaguucuuaaaguucugaaguucu

SEQ ID NO: 623332 - RNA, 61 nt, hsa
ugcugcuuggauagaaauauuuuuacugguucuucugaauugacaguaaaccuguccauua

SEQ ID NO: 623333 - RNA, 61 nt, hsa
uacuuagaacaugagcaaggauuucaauugacuucugaaguaaaucugucuugaaaauaug

SEQ ID NO: 623334 - RNA, 61 nt, hsa
gggaauagaaaaaaauuguuuauuuuuuauucuucugaauuaaaccccacuuaugggugua

SEQ ID NO: 623335 - RNA, 61 nt, hsa
acugauagucaguuugcugugucagaaagcacuucugaaagcagauaugagucaccagaca

SEQ ID NO: 623336 - RNA, 61 nt, hsa
aaguggcacagccccagucggaauccagcggcuucugaaagugccuuggugugagaaggag

SEQ ID NO: 623337 - RNA, 54 nt, hsa
ggaagucugcaucaaaguaaaguucuucugaagugcugcuccauguuuccacca

SEQ ID NO: 623338 - RNA, 57 nt, hsa
agaagcugcuguggugcugacgggacccuucugaaguucgggacgcggcggcugcag

SEQ ID NO: 623339 - RNA, 61 nt, hsa
gauauacuugucuuaagauauuaaugaaacacuucugaacacugauaggaaguguccacau

SEQ ID NO: 623340 - RNA, 62 nt, hsa
cgggaagcuggcccaggucagguccgcaaaggcuucugaagaagaggaagggcgaguagggg

SEQ ID NO: 623341 - RNA, 62 nt, hsa
aucaugacuucuccuuuccagaguuuuggguccuucugaauuaaugguccuuuucgaacacc

SEQ ID NO: 623342 - RNA, 62 nt, hsa
cccccacaccuggaggcuggagccaggggccacuucugaacugcaccagcaccaggcccacc

SEQ ID NO: 623343 - RNA, 62 nt, hsa
agacggacagcguguggcaguguuuaaaugcucuucugaaggcugauacgacagcucucugu

SEQ ID NO: 623344 - RNA, 62 nt, hsa
uagagaguuugagccuuugcuggucacauugccuucugaagaggagggaguauuagauuaua

SEQ ID NO: 623345 - RNA, 62 nt, hsa
uaaaaagaccaaacauuugagauugucacagccuucugaaguuacucauuauaagucaagca

SEQ ID NO: 623346 - RNA, 62 nt, hsa
uucaucacuccuuccuaguucuacuguucaagcuucugaaauaaacaggacuugaucacaag

SEQ ID NO: 623347 - RNA, 62 nt, hsa
gggugcugaaccucgggaacgagcuauccuagcuucugaauccagguuaggauuauacuuga

SEQ ID NO: 623348 - RNA, 62 nt, hsa
ucuaacauguaauugcagauaacuuugacuuucuucugaauauuuuaucuuuccuuggcuuu

SEQ ID NO: 623349 - RNA, 62 nt, hsa
caguuaauguaagaauacuuuaaaucucuaagcuucugaaguguuagagguagagauggucu

SEQ ID NO: 623350 - RNA, 62 nt, hsa
aaaacccaagucaguuauuagauuuaaaucaccuucugaaaugcugcuauagggcugguauc

SEQ ID NO: 623351 - RNA, 62 nt, hsa
augcauuugugcaacuucaaacauauugggugcuucugaauuccugaugauuggauuuaagc

SEQ ID NO: 623352 - RNA, 62 nt, hsa
uccuagauguuaguguuguggauguccuuggucuucugaagauucagguccuccucuccggg

SEQ ID NO: 623353 - RNA, 62 nt, hsa
ucuugcucugccuuugaguuguuccgugaucacuucugaauaagcaguuugccuuuauaaaa

SEQ ID NO: 623354 - RNA, 62 nt, hsa
uauuaugauaguuuuuaagguuucaauucaaucuucugaacggcauaaguccuauuuuagcc

SEQ ID NO: 623355 - RNA, 62 nt, hsa
cuucugggacccagaugaguucuucacuagcccuucugaaccccuugcuccauaauuggucu

SEQ ID NO: 623356 - RNA, 62 nt, hsa
cagaggaaaaagaaaaacauuuccucuuauaacuucugaaguaauuuguaaaaaagauuugu

SEQ ID NO: 623357 - RNA, 62 nt, hsa
gugauucguguuuguacuuuauuuuuuugugccuucugaaaggaucuaaaacaaaaauauuu

SEQ ID NO: 623358 - RNA, 62 nt, hsa
ggcgagggaggggagguggccgucgaguugaccuucugaacaugagugucaacuccaggacu

SEQ ID NO: 623359 - RNA, 62 nt, hsa
cuuuuuccuuaacguuugaagucaguuuaaaacuucugaagugcugucuuuuuacauuuuac

SEQ ID NO: 623360 - RNA, 62 nt, hsa
accuuugucuaaucauuggauuuauugugucacuucugaaguuucacagaaaugaaugaauu

SEQ ID NO: 623361 - RNA, 62 nt, hsa
gagacuaauuuuuaagaauuacaaagcucauucuucugaaucuaauaucacuaacuccuaga

SEQ ID NO: 623362 - RNA, 62 nt, hsa
ucuucuuaaacucugaguuuauaaaauaacuacuucugaacuccugagaucuaguggauacc

SEQ ID NO: 623363 - RNA, 62 nt, hsa
gacuuugaaagacucuggugccuuguggugcccuucugaaauucaaacaguaaugcaaaagu

SEQ ID NO: 623364 - RNA, 62 nt, hsa
uuuguaacaaugaugaccccggccugucucaucuucugaagaggaaaagucaaaguguugcu

SEQ ID NO: 623365 - RNA, 62 nt, hsa
cuuaaccaaagaagcuguacuccggggggucucuucugaauaaagcaauuagcaaaucaugu

SEQ ID NO: 623366 - RNA, 62 nt, hsa
ucccccggaacccucuaccaaugccuucugaccuucugaagcuuuccgaauccucccaguug

SEQ ID NO: 623367 - RNA, 62 nt, hsa
cagaauuguucuuuuuccuguuguuuucuuaacuucugaaagagcugugggugguggggggc

SEQ ID NO: 623368 - RNA, 62 nt, hsa
caucccucuggggcuguucacgugguccuaaucuucugaacuuggcgcugccccuggcagcc

SEQ ID NO: 623369 - RNA, 62 nt, hsa
ucaauucuuugaucucaugcaaugcacacuuucuucugaauuagcaaacugaauaaacuaca

SEQ ID NO: 623370 - RNA, 62 nt, hsa
auguuaacuauaaacacacugcauacaauuuucuucugaauaacaaaugaaugcuuauugcu

SEQ ID NO: 623371 - RNA, 62 nt, hsa
cugguccagggauccuccuccuuucucuuuuacuucugaauucugaaauucaguuaguuacu

SEQ ID NO: 623372 - RNA, 62 nt, hsa
ccaaggucuucacuguauauauuuuguguguucuucugaaacucuugauuucuuauauggca

SEQ ID NO: 623373 - RNA, 62 nt, hsa
cugccccuuucugcccuccugcuccagccccacuucugaaaguaucagcuacugauccagcc

SEQ ID NO: 623374 - RNA, 62 nt, hsa
acaaaggaggcucagagaagaaagacgugucccuucugaacugaugcuuucucacugucauc

SEQ ID NO: 623375 - RNA, 62 nt, hsa
gaagccugccaacagugaccuuccgaaacagccuucugaauacaaagaggauucaguuucca

SEQ ID NO: 623376 - RNA, 62 nt, hsa
ugaaaucugguuuucaaggccucuguggcuuucuucugaacuuaccaccagcccuggcugga

SEQ ID NO: 623377 - RNA, 62 nt, hsa
agccacuauucucaguuacaccucccagugcccuucugaaaagugccagcuauuucauuagg

SEQ ID NO: 623378 - RNA, 62 nt, hsa
aaauggaugcauacccuuccugaaaugacucccuucugaaugaaugacaaagcagguuaccu

SEQ ID NO: 623379 - RNA, 62 nt, hsa
ugccccuuccugguucuuaucucaaggcagagcuucugaauuucaggccuucauuccagagc

SEQ ID NO: 623380 - RNA, 62 nt, hsa
auuaaaauuguucaagaaaauuucuuugaacacuucugaaaguuuuuggaaacuuagaaaag

SEQ ID NO: 623381 - RNA, 62 nt, hsa
cuggugcaaaaggauuggcccccauuauggugcuucugaauaaaucuugccaagauagacaa

SEQ ID NO: 623382 - RNA, 62 nt, hsa
cuucucaaaauauaccucuugcccagcugccucuucugaaauccacuucacccacuccacuu

SEQ ID NO: 623383 - RNA, 62 nt, hsa
ggucugugcccucagauguguugacagcugcucuucugaauugccacaccugugcuacacuu

SEQ ID NO: 623384 - RNA, 62 nt, hsa
caacccuaaggcccuucaagaucucaaagugccuucugaagcaucagagauuaaauauuguu

SEQ ID NO: 623385 - RNA, 62 nt, hsa
aguguuuuuugacaaucacuuccuuaaagacucuucugaacuaguuggaccugguuaaucau

SEQ ID NO: 623386 - RNA, 62 nt, hsa
cuaaccaccccuagaucugaguuuucagagugcuucugaaguacaguuuaaaaacacuuuuu

SEQ ID NO: 623387 - RNA, 62 nt, hsa
uauauguugcuuguuugugacacuuagauaaucuucugaaauaauuuguuuuaaaguaaguu

SEQ ID NO: 623388 - RNA, 62 nt, hsa
uuccaucugaaagguuacaaggaguguuguagcuucugaaggugcagaaaacaauuucuaaa

SEQ ID NO: 623389 - RNA, 62 nt, hsa
uaaauauaugaugcugagucuguggaaugauacuucugaaaucaaaauuccucauaaggcau

SEQ ID NO: 623390 - RNA, 62 nt, hsa
uagcuauccuuuuaaauuaugcuaauucucuucuucugaaauuauggucacacuauauacua

SEQ ID NO: 623391 - RNA, 62 nt, hsa
ccaaacuccucuccuggaucaaaaaugaaucacuucugaagucccugcagcccuuugccaag

SEQ ID NO: 623392 - RNA, 62 nt, hsa
cauuuccauuauagcaauguuagugccaccaccuucugaacacaguggggagggcugugaag

SEQ ID NO: 623393 - RNA, 62 nt, hsa
gcaaggcuggcauauuaacaccugccuucuggcuucugaaagugagauuuguauaugggcug

SEQ ID NO: 623394 - RNA, 62 nt, hsa
acucgguuugguagacuuggacaucucucuggcuucugaagagccugaagcuggccuggacc

SEQ ID NO: 623395 - RNA, 62 nt, hsa
cauuuuuauuggaagaguauuaacuggugccucuucugaaacacaccaacccauauuccucu

SEQ ID NO: 623396 - RNA, 62 nt, hsa
aggcugaguagccucagaaggguuuaggcgaccuucugaaacucacagaagucacgugaugg

SEQ ID NO: 623397 - RNA, 62 nt, hsa
caccaaguccugcuacuguagaguggaaaugacuucugaauagcgguuuuaggacaggucug

SEQ ID NO: 623398 - RNA, 62 nt, hsa
ccuuguacuugccuacuguaauauggauuucacuucugaacaguuuacagcacaauauuuau

SEQ ID NO: 623399 - RNA, 62 nt, hsa
uuaaaaccuuugacuugagucugcugguaaagcuucugaauauugaguuugcugagaaauaa

SEQ ID NO: 623400 - RNA, 62 nt, hsa
cuggguucaauuuaaaauaggagaggcuuucucuucugaaagauccauuuuaggucuuuuuc

SEQ ID NO: 623401 - RNA, 62 nt, hsa
ugacuacaaagaaaagcagaugccaaaauacucuucugaaaacagcaacccagguaagacuu

SEQ ID NO: 623402 - RNA, 62 nt, hsa
cgcuguugguaggagugaaaaccaguauaauucuucugaaaaacauuuaucagaaacuuaaa

SEQ ID NO: 623403 - RNA, 62 nt, hsa
cugugucuacaacagggccacauauuaaauuacuucugaauggugaauucaucuuacaaaau

SEQ ID NO: 623404 - RNA, 62 nt, hsa
uagcugaaaccuaaggcaacauuuccgaagaccuucugaagaucucagauaaagugaccagg

SEQ ID NO: 623405 - RNA, 62 nt, hsa
ugagcauauauugcauuuaaagaaagauaaagcuucugaaauacuacugcaauugcuucccu

SEQ ID NO: 623406 - RNA, 62 nt, hsa
auuuuugaggcaucuaauauuuacauauuugccuucugaacuuuguuuugaccuguauccuu

SEQ ID NO: 623407 - RNA, 62 nt, hsa
auuuucucuacuuccugucugcaugcccaaggcuucugaagcagccaaugucgaugcaacaa

SEQ ID NO: 623408 - RNA, 62 nt, hsa
uagcuacacuacaaaaacaaauuuugucuguacuucugaaaagaauuuuguuguuucucagc

SEQ ID NO: 623409 - RNA, 62 nt, hsa
uucuccuggcaagagaaaaagacuuaacuagacuucugaacuugaacaguuucagguuauau

SEQ ID NO: 623410 - RNA, 62 nt, hsa
caacauaaauacagcaagaaaauguguuugggcuucugaagaguugucugcuuaccuuaaca

SEQ ID NO: 623411 - RNA, 62 nt, hsa
ugucugacuauuccaggauccaauauuacugccuucugaaacuuccucuuuaggguaaccau

SEQ ID NO: 623412 - RNA, 54 nt, hsa; identical to SEQ ID NO: 622845

SEQ ID NO: 623413 - RNA, 62 nt, hsa
guuugccugggcauugaggcauuuccauacaucuucugaaaacuaggcggagguuuccaaau

SEQ ID NO: 623414 - RNA, 62 nt, hsa
gaaaauaagcugcaauuuuguacagauaccaacuucugaaaagcugguguuuuuacaacuag

SEQ ID NO: 623415 - RNA, 62 nt, hsa
acucaagcaaaggaauuucugaaaguaucagucuucugaauucugaguuuugaaaauauauu

SEQ ID NO: 623416 - RNA, 62 nt, hsa
uuauauuggcauguuuagaugucagguuuagucuucugaagaugaaguucagccauuuugua

SEQ ID NO: 623417 - RNA, 62 nt, hsa
aggaauuagcuagaauaugaccauuaaaugugcuucugaaauauauuuugagauagguuuag

SEQ ID NO: 623418 - RNA, 62 nt, hsa
ggaaauaguuuucucaaccauuuaaaaauauucuucugaacucaucaaaguagaagagcccc

SEQ ID NO: 623419 - RNA, 62 nt, hsa
gcucaucuccucccuggauucuggauuaggagcuucugaaucuuuuccagggauaggcaggu

SEQ ID NO: 623420 - RNA, 62 nt, hsa
gaggggaaagaaauccaucugcucaugaagcacuucugaaaauauaggugauugccugaaug

SEQ ID NO: 623421 - RNA, 62 nt, hsa
cagaauccaugccuguguaaugcugguccaugcuucugaaccugugucugccaagcgccuau

SEQ ID NO: 623422 - RNA, 62 nt, hsa
uucuacuguacccugauuauuacuuccaucuacuucugaaugugagacuuucccuuuuugcu

SEQ ID NO: 623423 - RNA, 62 nt, hsa
aguauuuuccuuuauguuaauucaauuauauacuucugaauggcaccuuacuuuuuggaaac

SEQ ID NO: 623424 - RNA, 62 nt, hsa
agaagucugaggcucaaagaaaaguaaucccucuucugaauccacaccccaucaauuaucuu

SEQ ID NO: 623425 - RNA, 62 nt, hsa
ugacuuugaagcacugaaaguuacugaagugccuucugaaucaaggauuuaauuaaggccac

SEQ ID NO: 623426 - RNA, 62 nt, hsa
auggaaauauuuuuauuuuuacagauuuugcacuucugaauucagguuaaaaacuaacuugu

SEQ ID NO: 623427 - RNA, 62 nt, hsa
aguuucggaguuugguaaaguuuacaggguagcuucugaaauuaacucaaacuuuugaccaa

SEQ ID NO: 623428 - RNA, 62 nt, hsa
agaccagguucaugucuguuuccccuuggggacuucugaaccuuccugcccgggagucugua

SEQ ID NO: 623429 - RNA, 62 nt, hsa
uuuauauuauuaaagggcuuuuaauuugugaacuucugaaggcaugaguguuuucucuuucu

SEQ ID NO: 623430 - RNA, 62 nt, hsa
guuccccugugcuuuuaccaguagcaugaccccuucugaagccauccguagaaaguacuuug

SEQ ID NO: 623431 - RNA, 62 nt, hsa
uagaagucauaguugaccacagacauguuauucuucugaaagagccacauuuugguuuuauu

SEQ ID NO: 623432 - RNA, 62 nt, hsa
uaaguauuugguagcugaauaaggggucagaacuucugaaaccagagaucuguaaucaucuc

SEQ ID NO: 623433 - RNA, 62 nt, hsa
cagaaaugcagguucccaggucccacccuggacuucugaagggguguggcaucuguguuucu

SEQ ID NO: 623434 - RNA, 62 nt, hsa
aaaugaggacaacaggauaauaucuuugaugacuucugaaaguuaugcuucccuucauguua

SEQ ID NO: 623435 - RNA, 62 nt, hsa
aauaaccaauauguggaaauggacacagggaucuucugaaguugcuuugaaucaaaaggcag

SEQ ID NO: 623436 - RNA, 62 nt, hsa
uucauagguaggagggcuuagauuuuaaggcacuucugaaagucaaucccuggacaaggcag

SEQ ID NO: 623437 - RNA, 62 nt, hsa
cuggaauccugaaagggcacuuaauuuguaaacuucugaagacugagaacuuuuuugaggcc

SEQ ID NO: 623438 - RNA, 62 nt, hsa
cucugguuuauacauccccacucaugagcauacuucugaaggaaaacuuuacaaaaagagcc

SEQ ID NO: 623439 - RNA, 62 nt, hsa
uuuucuugccuuauuaagacauaauuuucucccuucugaaaugagugagggaaguucauaag

SEQ ID NO: 623440 - RNA, 62 nt, hsa
uuuaauaaugacuuaagggucaagauuuuuuucuucugaaaauuauguucugaguuaggcag

SEQ ID NO: 623441 - RNA, 62 nt, hsa
gcaggcagugcucucuaacaggaccaucacagcuucugaacugagccggagagagagaaugg

SEQ ID NO: 623442 - RNA, 62 nt, hsa
gucacacuacccuggucccugauugcaaggagcuucugaagcaagggugaauccuucccaca

SEQ ID NO: 623443 - RNA, 62 nt, hsa
ggagagcagcccaaccaauccccaauccuuuucuucugaaacugagcaggaaggguaaggaa

SEQ ID NO: 623444 - RNA, 62 nt, hsa
ugcacccuucacuggcauccucaaucauuaaccuucugaaagcucacaguacacauuaguau

SEQ ID NO: 623445 - RNA, 62 nt, hsa
ugugaaacaauuauuuauuugcugaaagagcucuucugaacuguguccuuuuaauuuuugcu

SEQ ID NO: 623446 - RNA, 62 nt, hsa
uugguuuggaguugagauaucagucucggaaacuucugaaaaaugcuaauaauuacccaagg

SEQ ID NO: 623447 - RNA, 62 nt, hsa
caugaucacuugggcaguauaagaaaauguagcuucugaauauuggccaccucuaugcugca

SEQ ID NO: 623448 - RNA, 62 nt, hsa
agucacaauaacuuagaaacauugcgcauauucuucugaaauagcacuuaaaaaugauuagu

SEQ ID NO: 623449 - RNA, 62 nt, hsa
agaggucagaugacauaaugaauauguucuaacuucugaaacuuuuggagcuuguuuuugcc

SEQ ID NO: 623450 - RNA, 62 nt, hsa
auuugauaauuaagcacccauaccauuuauaacuucugaauuuaaaaaguuauacaaugcca

SEQ ID NO: 623451 - RNA, 62 nt, hsa
agcaaauagaagccgaguguuaagguguuuugcuucugaaagagggcugugccuuccguuuc

SEQ ID NO: 623452 - RNA, 62 nt, hsa
caugcccuuggcguugccuauggcaccuuucccuucugaaagucugguuccugcccagugac

SEQ ID NO: 623453 - RNA, 62 nt, hsa
augaaaaucaaggugucagcagagcugugcuccuucugaaggcucuagggagaagccgguuc

SEQ ID NO: 623454 - RNA, 62 nt, hsa
gauacugcggagacucuggccaagcugaugaccuucugaagugucacuggcaccauaugcaa

SEQ ID NO: 623455 - RNA, 62 nt, hsa
ugggcagagguucaacccacaccuccacuuugcuucugaaggcccauucauuagaccacuug

SEQ ID NO: 623456 - RNA, 62 nt, hsa
gcauguugcgcuuugcaucagcaaggcauugacuucugaaaaaaugaucugaaaaaaguuuc

SEQ ID NO: 623457 - RNA, 62 nt, hsa
gaccuaggauuuagggcugcaguugcugucugcuucugaaucacugggggugucuccuaaga

SEQ ID NO: 623458 - RNA, 62 nt, hsa
uacaaaucugauggcuccugcagcacuuuuuccuucugaaaauauuuacauuuugcuaaccu

SEQ ID NO: 623459 - RNA, 62 nt, hsa
uaauaauauauaccaacagauuguuugucacgcuucugaaccaaugacugaaugucaagaug

SEQ ID NO: 623460 - RNA, 62 nt, hsa
ggugaggugugccccucccagggagaauaaagcuucugaagagagaccguccacaucucugc

SEQ ID NO: 623461 - RNA, 62 nt, hsa
uccagagggacauggcaauguuaccagcccaccuucugaagccugggaggugugaacccagg

SEQ ID NO: 623462 - RNA, 62 nt, hsa
ugcgugguuuauagacuggggugccauguguacuucugaaaauauuuuaaccagcccaccca

SEQ ID NO: 623463 - RNA, 62 nt, hsa
uuuuagagcauagaagaagcggcaccugccaucuucugaaaacuccaaagggaaauuucagu

SEQ ID NO: 623464 - RNA, 62 nt, hsa
aaagguaggguuugaggauuccugagugugggcuucugaaacuucauaaauguucagcuuca

SEQ ID NO: 623465 - RNA, 62 nt, hsa
uauuugcguauuaauuaugggcaagcacacaccuucugaauagaaauauuguucauuacuca

SEQ ID NO: 623466 - RNA, 62 nt, hsa
ccauccugggcuuuucccagaggagaugggggcuucugaagauggacuuaccugggaccugc

SEQ ID NO: 623467 - RNA, 62 nt, hsa
gaacauugccucugggugucauguggaccagacuucugaauagagaauauuuauaacuuuug

SEQ ID NO: 623468 - RNA, 62 nt, hsa
guaggauuuuguaacacgucaaccauuugaugcuucugaaaaguacuuucaacuugcgaagg

SEQ ID NO: 623469 - RNA, 62 nt, hsa
cuuuguuagcaauaacugaccuucaguuuacccuucugaaggagcagggacucagcacagaa

SEQ ID NO: 623470 - RNA, 62 nt, hsa
agucucuccagauagcacuacgauguauuccgcuucugaacaggaucccaugccagugugga

SEQ ID NO: 623471 - RNA, 62 nt, hsa
uugaaaugaagagaaauagccagcaggugauucuucugaauccuuuagugugaugguuuccc

SEQ ID NO: 623472 - RNA, 62 nt, hsa
guguuuagauuguauuaacuaucuucuuuggacuucugaagagaccacucaauccauccaug

SEQ ID NO: 623473 - RNA, 62 nt, hsa
agucuuuugguaauaguggcagguauuuauuccuucugaauauauaccccauuauaggaaua

SEQ ID NO: 623474 - RNA, 62 nt, hsa
acuuccuaagaaaaggaaucuugcccuugaaucuucugaaguaccuagcacagugucuucaa

SEQ ID NO: 623475 - RNA, 62 nt, hsa
caauguuugugaaacaccuuuggagaggugcacuucugaaugcugccucugccguaaauccu

SEQ ID NO: 623476 - RNA, 62 nt, hsa
aauagaagcuuuuuuuuuuaaaaaauguauugcuucugaacuuuuuucugccacugcucccu

SEQ ID NO: 623477 - RNA, 62 nt, hsa
uuuuguucaaacauaauaccaucuuuuugcuucuucugaacuuuagaucuccauaacacaug

SEQ ID NO: 623478 - RNA, 62 nt, hsa
gugcuuaaacuuuuuucagucagggugaugaucuucugaagcucuuggaugucauuugaucg

SEQ ID NO: 623479 - RNA, 62 nt, hsa
guagacucuauaguacccucucuauucacuagcuucugaaaagggaggaguauuuuuaguuu

SEQ ID NO: 623480 - RNA, 62 nt, hsa
ugagaaaacuccgaagaggugugagcaggauucuucugaaugacugucuggaugguucauua

SEQ ID NO: 623481 - RNA, 62 nt, hsa
agaauuugcagaugcaagcuccucuccuaggucuucugaaugucuugaaacaucccaggucc

SEQ ID NO: 623482 - RNA, 62 nt, hsa
acccucgucucugcagggugucuguacacguucuucugaaagcuuuagacaguaacaguuug

SEQ ID NO: 623483 - RNA, 62 nt, hsa
gauucauggacacuagacucccuuugccauuucuucugaaccggcccuccuguggacuagca

SEQ ID NO: 623484 - RNA, 62 nt, hsa
uugcacuaucuuuauuuuguaugucaguauuccuucugaacaauaagcauuuaucaauugau

SEQ ID NO: 623485 - RNA, 62 nt, hsa
uagagaugucauagccugaagauuuacugaagcuucugaacaugccaccaugccaaagcuau

SEQ ID NO: 623486 - RNA, 62 nt, hsa
uccacuguccucugucaaucuaguuagacgugcuucugaaugacuguagaauuggaacuaga

SEQ ID NO: 623487 - RNA, 62 nt, hsa
uacuuaaaagugcuugauauaaauagcuuuuccuucugaaccacguucuauguaaaagaaaa

SEQ ID NO: 623488 - RNA, 62 nt, hsa
auggaauacaaaauguacugacauuuuguuuucuucugaaaaaaauccuugcuaaauguacu

SEQ ID NO: 623489 - RNA, 62 nt, hsa
aagauaauaugagggagaagggaacacauuuccuucugaacuuacuucccuaagucacuuuc

SEQ ID NO: 623490 - RNA, 62 nt, hsa
auuauauuuguauguaaauuauauuuauacaucuucugaaauauauuucaaaauaugugugu

SEQ ID NO: 623491 - RNA, 62 nt, hsa
guuacuugguuuaaaucacauuugauacuauccuucugaaaagucugagacagaucuacaaa

SEQ ID NO: 623492 - RNA, 62 nt, hsa
auucuuuaaguauauuaaucucuuuguaaucucuucugaaaucauuguaaagaaauaaaaau

SEQ ID NO: 623493 - RNA, 62 nt, hsa
cauauuguuuuuacuauguuuaaaaaacuuuacuucugaaaggaacauaauuauaucuaggu

SEQ ID NO: 623494 - RNA, 62 nt, hsa
ccugcauuuuauugacugggguuugaucucagcuucugaaaauguuuaaaaauuggaaggaa

SEQ ID NO: 623495 - RNA, 62 nt, hsa
ugccuauaggaagacuagucucaugcuguuaccuucugaaacuguaccuuuauaaaucaauu

SEQ ID NO: 623496 - RNA, 62 nt, hsa
uuaaacuuaaauaagugugugcagcauuucuacuucugaaguuauuaaagcuaaaacugcac

SEQ ID NO: 623497 - RNA, 62 nt, hsa
ccucgucugugugcaucucacgcccgacguggcuucugaaacgugcauucaaccucaaacuu

SEQ ID NO: 623498 - RNA, 62 nt, hsa
aaaauauuguuuauacaguuuguauaggcugacuucugaauaauugguaucuauuauuuuca

SEQ ID NO: 623499 - RNA, 62 nt, hsa
aaaagccauauaugggggacaugcuaaaauggcuucugaaugaaauacgacagcagagaaag

SEQ ID NO: 623500 - RNA, 62 nt, hsa
cuccugaccucagaugaucuaccagccucggccuucugaagugcugggauucaggugugagc

SEQ ID NO: 623501 - RNA, 60 nt, hsa; identical to SEQ ID NO: 622934

SEQ ID NO: 623502 - RNA, 55 nt, hsa; identical to SEQ ID NO: 622935

SEQ ID NO: 623503 - RNA, 62 nt, hsa
agaaguacaaaaagccuuuagccuugaggugccuucugaaauuaaccaaauuucauccauau

SEQ ID NO: 623504 - RNA, 62 nt, hsa
cacagagccucgggacaucaaaaacagcagaacuucugaaaccucugggucaucucucacac

SEQ ID NO: 623505 - RNA, 62 nt, hsa
uagaagcaaaaaacgaaagaguucuguucagacuucugaagagcagccuguggcuacaaauc

SEQ ID NO: 623506 - RNA, 62 nt, hsa
ucuagcugagauuagugguggauuuucucccacuucugaaauguucauuuauacugguugca

SEQ ID NO: 623507 - RNA, 62 nt, hsa
uuuuucuucgacaaaaaaauaauaaaacguuucuucugaaaagcugaacguuucuguauaag

SEQ ID NO: 623508 - RNA, 62 nt, hsa
gaggccuuaaugaucaaaucucacccuuucugcuucugaaguaugaaaaucuagucuuuuua

SEQ ID NO: 623509 - RNA, 62 nt, hsa
gauuuuucuaccacccuguuacaucauaacaacuucugaaacacacaccagcccugaguucu

SEQ ID NO: 623510 - RNA, 62 nt, hsa
aggaaucuagccgggaguagcagaggcccugucuucugaagucucaggcuuagaaguuacca

SEQ ID NO: 623511 - RNA, 62 nt, hsa
gcuuccaccagcauccugagaagaaaugauuacuucugaaaaacauccuuuuuuccagccuc

SEQ ID NO: 623512 - RNA, 62 nt, hsa
accgcgaagccgccaacccaccggagagggggcuucugaacuuggacuccugggaacaugga

SEQ ID NO: 623513 - RNA, 62 nt, hsa
uaaugacugcagacuggugggaucauaggagccuucugaaugaccaggacugcuuucuuugg

SEQ ID NO: 623514 - RNA, 62 nt, hsa
cugccaagagagauguaugugucacugcauggcuucugaaagcaggaugaauuuucugcagc

SEQ ID NO: 623515 - RNA, 62 nt, hsa
gugcugcaugccuggucuuuccucuguuucuccuucugaaaguuuucuauaccugucuccuu

SEQ ID NO: 623516 - RNA, 62 nt, hsa
ucugccaucucgcuaaaucaucagucucggcucuucugaaauagaaggugccugaucuuccu

SEQ ID NO: 623517 - RNA, 62 nt, hsa
cccaaucuucuuuuuuaaaccaguuuaaggaacuucugaagauuuguccaccucugauuaca

SEQ ID NO: 623518 - RNA, 62 nt, hsa
cauggggacccugagacuacuaaagcugcuuucuucugaagguccaguuggacagucuggga

SEQ ID NO: 623519 - RNA, 62 nt, hsa
cagaguugaauaucucuuucccuaucaugcugcuucugaaaauucaguuuuggagcaagucc

SEQ ID NO: 623520 - RNA, 62 nt, hsa
uuaaaugccaaauaaucuuccagguagugcugcuucugaaguuaucucuuaauccucuuaag

SEQ ID NO: 623521 - RNA, 62 nt, hsa
guaauugguuugggagggggcagugaugaugacuucugaaacaaaauuuggauuuccuuuua

SEQ ID NO: 623522 - RNA, 62 nt, hsa
ucuuuaguggguuuuaaauaguuuuucugacccuucugaaaaauaacuacauaagugcuucu

SEQ ID NO: 623523 - RNA, 62 nt, hsa
guauuuauucacuuccccauuacgauguaaaucuucugaacugccuuuuuuuuaaaaagaag

SEQ ID NO: 623524 - RNA, 62 nt, hsa
acuagaccuguaaaacuucacugcaguggccacuucugaaucucuguaagguuuauuuaucu

SEQ ID NO: 623525 - RNA, 62 nt, hsa
auuguauaauggggccuguuacacaugacacucuucugaauugacuguauuucagugagcug

SEQ ID NO: 623526 - RNA, 62 nt, hsa
caguaccugguugaguggggaggagggggcaucuucugaacagccugccucugcccagcucc

SEQ ID NO: 623527 - RNA, 62 nt, hsa
uaagaaacagcugagaggcacuauggauuagucuucugaagugaaggaaauauagaugucac

SEQ ID NO: 623528 - RNA, 62 nt, hsa
ccagcuccucacagaggccugguuugcucagucuucugaacuccagggaccagcccuggugg

SEQ ID NO: 623529 - RNA, 62 nt, hsa
caccucggucucgucaguaaggacuucacuuucuucugaacuggggcuugugaaagcuggcc

SEQ ID NO: 623530 - RNA, 62 nt, hsa
gauuuuaaccugugucuuacuuccucagcugccuucugaaccuacuugucaaggugaauuua

SEQ ID NO: 623531 - RNA, 62 nt, hsa
agauaaaggccuuaacuuuaaacaucuuucaucuucugaaagcugcccaacuuaaauccuca

SEQ ID NO: 623532 - RNA, 62 nt, hsa
guuaucaaucugaucugcagccagguuauuuacuucugaagcauuggaguuaucgauugcca

SEQ ID NO: 623533 - RNA, 62 nt, hsa
ccuggaacuggaguuggcaauaccuaguucugcuucugaaacuggaguaucauucuuuacau

SEQ ID NO: 623534 - RNA, 62 nt, hsa
uaaauaacuugccuuacauaucagcccucccacuucugaaguucaaauuagugccucggaaa

SEQ ID NO: 623535 - RNA, 62 nt, hsa
cuuguucugaucugugugugagugugugugaacuucugaaagacaauauuaaagagacuuag

SEQ ID NO: 623536 - RNA, 62 nt, hsa
uccccacuuauucuccucuuuggaaucuucaacuucugaagugaauguggauacagcgccac

SEQ ID NO: 623537 - RNA, 62 nt, hsa
uugcccaacaggauaagcuggauccccuuggccuucugaauaucccagugucuucagguuuc

SEQ ID NO: 623538 - RNA, 62 nt, hsa
ugggaaccauggugucaauacauaucauguagcuucugaaaaacuccacuguacacuuauag

SEQ ID NO: 623539 - RNA, 62 nt, hsa
caggggaaaaugcccacauuuuaacuuuuaaacuucugaauaaacuguguaaaaacaguagu

SEQ ID NO: 623540 - RNA, 62 nt, hsa
cugugugccugggaggcugccaggggguggggcuucugaagaccccuccucaauuucuuggc

SEQ ID NO: 623541 - RNA, 62 nt, hsa
guccugcuggccccuuuuccucuggccccccucuucugaaacaggaugugcacacaugggcc

SEQ ID NO: 623542 - RNA, 62 nt, hsa
gggaguggggaggugguaagaacaccugacaacuucugaauauuggacauuuuaaacacuua

SEQ ID NO: 623543 - RNA, 62 nt, hsa
cugcguaaguaccuccuugaugccugucggcacuucugaaaggcacaaggccaagaacuccu

SEQ ID NO: 623544 - RNA, 62 nt, hsa
agaagaauucagaaaaccacuuaagcaagacccuucugaaauaaaaaauguugcuuuuuaaa

SEQ ID NO: 623545 - RNA, 62 nt, hsa
gcauaaaagcaaaucaacacuuuauaguuauucuucugaacuaagacaugucaauauucuuu

SEQ ID NO: 623546 - RNA, 62 nt, hsa
uuguuuuuuuucucaacuaguuaagucaacugcuucugaaauaacucuguauuguagauuau

SEQ ID NO: 623547 - RNA, 62 nt, hsa
caaaaacuuauuaagguuaaauagaauuguuucuucugaauaaucuaacaaaggaaaauaua

SEQ ID NO: 623548 - RNA, 62 nt, hsa
gcugugcauugcucaaaagcuguugggaacgccuucugaacaguugccuucagaacuaguuu

SEQ ID NO: 623549 - RNA, 62 nt, hsa
ggcccaugucacaaacccuaucucaggaauuucuucugaauguucaauuuuuuucauugaag

SEQ ID NO: 623550 - RNA, 62 nt, hsa
cauuguaauguaaggggcaagaaauuuguguucuucugaaugcuacuagcagcaccagccuu

SEQ ID NO: 623551 - RNA, 62 nt, hsa
uuuuacaguuuugauuggguaauguuucuguucuucugaaaacagacccuuggcuucacaca

SEQ ID NO: 623552 - RNA, 62 nt, hsa
agcuuucuccagagaccuaauggccucaacaccuucugaacguggauagugccagaacacuu

SEQ ID NO: 623553 - RNA, 56 nt, hsa; identical to SEQ ID NO: 622986

SEQ ID NO: 623554 - RNA, 62 nt, hsa
auuuuuccuuaacgcuagagauugcuacaaaucuucugaagggucucaauggcuucaggcua

SEQ ID NO: 623555 - RNA, 62 nt, hsa
aauuaacacuauguguucaguuuucuugugggcuucugaaaguugccaucuucccuccgugg

SEQ ID NO: 623556 - RNA, 62 nt, hsa
uuuuucagucaucccaguuuguacagacuuagcuucugaacucuaagaaugccaaagggacc

SEQ ID NO: 623557 - RNA, 62 nt, hsa
auucuuguucagauuaagaguugccaaaauaccuucugaacuacacugcauuguugugccga

SEQ ID NO: 623558 - RNA, 62 nt, hsa
auuuuuaugguguagauugaaauaauaguacacuucugaauuuuuauauaaaaugugguugg

SEQ ID NO: 623559 - RNA, 62 nt, hsa
ggugugagccacugcacccagccuacuucacucuucugaauuauucugauuuauuuucaaca

SEQ ID NO: 623560 - RNA, 62 nt, hsa
aacagucucugauuucaacacuaacauuccaucuucugaaauucugagauucuaacauccuu

SEQ ID NO: 623561 - RNA, 62 nt, hsa
gggcauaagccuuuuauggcccucuugcagaucuucugaacuaugcacauuugugcuuuuuu

SEQ ID NO: 623562 - RNA, 62 nt, hsa
auguaggcuuuauuuuaagcaguaauggguuacuucugaaacaucacuuguuugcuuaauuc

SEQ ID NO: 623563 - RNA, 62 nt, hsa
auuugagauuguaggccaacuguauuuucaagcuucugaacuuaggcaaaauauucaucgca

SEQ ID NO: 623564 - RNA, 62 nt, hsa
gggcccucugcagcccauccuuuccuuccguccuucugaaaccacauaccccaggcccaagc

SEQ ID NO: 623565 - RNA, 62 nt, hsa
ccaaggcagucgccagggcuucuuguccccaccuucugaaccuucuucaaacaguaguacaa

SEQ ID NO: 623566 - RNA, 62 nt, hsa
acaaaagugguagggaaauuguucccucuccacuucugaaaguaugaugauguauuaaggau

SEQ ID NO: 623567 - RNA, 62 nt, hsa
uuuaaucaugaauggaaaucggaaguaguaugcuucugaaacucuuuccagggaaacaucuc

SEQ ID NO: 623568 - RNA, 62 nt, hsa
acuucuaguuuaauaauacauacaugauuuuucuucugaaugucucuucucccugcaucacu

SEQ ID NO: 623569 - RNA, 62 nt, hsa
gggagggggaagugucugccuuuauguccuuucuucugaaauaaaaguaaaagcauuucugg

SEQ ID NO: 623570 - RNA, 62 nt, hsa
cugccuaaagauagaauggcuucucuguuuuucuucugaaauacaaccagaaacaauguguc

SEQ ID NO: 623571 - RNA, 62 nt, hsa
auugaaguauuuugcuggaauaaguucaaauucuucugaacucaaacugaggaauuucaccu

SEQ ID NO: 623572 - RNA, 62 nt, hsa
cauagccagucaagcauagaauugcauccauucuucugaaauagguacugugccuaauuuuu

SEQ ID NO: 623573 - RNA, 62 nt, hsa
auugaaauggcugcagauagaucccgcagucccuucugaaaggaacuguguagccagcaggg

SEQ ID NO: 623574 - RNA, 62 nt, hsa
agauaacauuaguguauuucuccugugcuugccuucugaaguggcacaaaccuguguuuaua

SEQ ID NO: 623575 - RNA, 62 nt, hsa
uuccgagauucagacauagccaugcugguggccuucugaaucacugcauggaugucccagga

SEQ ID NO: 623576 - RNA, 62 nt, hsa
gagggaaagggagaaugguguacccuuuauuucuucugaaaucacacugaugacaucaguug

SEQ ID NO: 623577 - RNA, 62 nt, hsa
ggaucguguugguauuuucagagaacaucccgcuucugaagcugcugcagcucccuccucag

SEQ ID NO: 623578 - RNA, 62 nt, hsa
aacugcuagcaaaaucugaggaaacauaaauucuucugaagaaucauaggaagaguagacau

SEQ ID NO: 623579 - RNA, 62 nt, hsa
ggcaaaguauccaucuugucuaucucccggcacuucugaaauauauugcuaccauuguauaa

SEQ ID NO: 623580 - RNA, 62 nt, hsa
caaggaucuuccaaaacagaggaccaaccagucuucugaaggucaugcccacagaagucauc

SEQ ID NO: 623581 - RNA, 62 nt, hsa
gugagaauggaaaacgcagaagagacguacaacuucugaaagaucucagaggacuggcauug

SEQ ID NO: 623582 - RNA, 62 nt, hsa
gaauaaauugugcucuuugucauggcaaccagcuucugaaaagcccacugaaaauugccugu

SEQ ID NO: 623583 - RNA, 62 nt, hsa
uauucaacuugcacugaccauaaaauguuucucuucugaacaagccccaucauuuggugaac

SEQ ID NO: 623584 - RNA, 62 nt, hsa
cauugacagcuuucuagagccaguaaugggcucuucugaaggaugcugaauuagaagugaac

SEQ ID NO: 623585 - RNA, 62 nt, hsa
gaccacaagauugucugaaggccuucuaaaaccuucugaauguccugcagaaauauaacugu

SEQ ID NO: 623586 - RNA, 62 nt, hsa
cucuaaagauuucaaauaguggcagacagugucuucugaauguaaguuuugagaaauacgag

SEQ ID NO: 623587 - RNA, 62 nt, hsa
auugucugaauauuucuucuguuccuuucucucuucugaaauucuuauuauacauguuaaca

SEQ ID NO: 623588 - RNA, 62 nt, hsa
aggcucagguccagcugguuccucucuggcgccuucugaacccgucucagcagguccacagc

SEQ ID NO: 623589 - RNA, 62 nt, hsa
caguguugcaagcuggcuggauccaaccaucucuucugaaauaaugcauccaaaggguugau

SEQ ID NO: 623590 - RNA, 62 nt, hsa
ccgccacgaccccccuggacgucuguaagacccuucugaacacucaggagaacguggcccuc

SEQ ID NO: 623591 - RNA, 62 nt, hsa
auucuguuuuguggaucucuuuccuagauuagcuucugaaaucauuauuagcuauaucauuu

SEQ ID NO: 623592 - RNA, 62 nt, hsa
acaauccacuguuagaauaccuaugguuagggcuucugaacuaaaauaauggaaaauuuuaa

SEQ ID NO: 623593 - RNA, 62 nt, hsa
ccugucgaugagacuguuuauuaccagauucacuucugaauuggccagaggaaaucugaaug

SEQ ID NO: 623594 - RNA, 62 nt, hsa
cgguucccuucaauaacaaugaauggugcuuucuucugaaagacucagccuaauuaaaggau

SEQ ID NO: 623595 - RNA, 62 nt, hsa
gcgcaugggcugagaacaccucuucccugaggcuucugaagguugcugucugucaugagugc

SEQ ID NO: 623596 - RNA, 62 nt, hsa
aaauuaagcaguucuacucgaucaccaagaugcuucugaaaauugcauuuuauuaccauuuc

SEQ ID NO: 623597 - RNA, 62 nt, hsa
ucacuuucuccugguguuuuucucucuggacccuucugaagcagagaccggacaagagccug

SEQ ID NO: 623598 - RNA, 62 nt, hsa
gacacguguggcgggcagugggacccauagaucuucugaaaugaaacaaauaaucacauuga

SEQ ID NO: 623599 - RNA, 62 nt, hsa
ucauggcccagggaggcgggugaaagcuccgucuucugaauucaucucuacaggcucaaaac

SEQ ID NO: 623600 - RNA, 62 nt, hsa
uccacugaaucuacacacagauuuuacugugacuucugaagcuguauagacucugcugugga

SEQ ID NO: 623601 - RNA, 62 nt, hsa
gugcccuucuuuccaaaacagcuacacaaaugcuucugaaugcccuggauacgcagaccgag

SEQ ID NO: 623602 - RNA, 62 nt, hsa
uuuuccaagaaaaugugcaguauucucugcuacuucugaaucuguuuugucuuccuaaucua

SEQ ID NO: 623603 - RNA, 62 nt, hsa
auuuuaugguucucuuaaggaauuaauauucacuucugaaggacuuacuuguaauauauaau

SEQ ID NO: 623604 - RNA, 62 nt, hsa
gauucuucuuaaaaguuucuaauguuauuuuccuucugaagucugagcccauuucugggggg

SEQ ID NO: 623605 - RNA, 62 nt, hsa
aaacuugagcaggcuguucagcauuguuucugcuucugaaaucuguauaguacacugguuug

SEQ ID NO: 623606 - RNA, 62 nt, hsa
uggaaugaagcugcagauuuagagaacauuggcuucugaaaaaaaaaaagagugaagauagu

SEQ ID NO: 623607 - RNA, 62 nt, hsa
gaaauugguguauuagacuauuuaucuuugaucuucugaauggauugcugucauggacacgg

SEQ ID NO: 623608 - RNA, 62 nt, hsa
cucaucgacgccugugacagggagaaaggauacuucugaacaaggagccuccaagcaaauca

SEQ ID NO: 623609 - RNA, 62 nt, hsa
guuggauuagcuuaaucaccaaguccugucaacuucugaaaugaaucucaaauuucuucccu

SEQ ID NO: 623610 - RNA, 62 nt, hsa
acugaaaugaaaucccauuggauuguacuucucuucugaaaagugugcuuuuugacccuacu

SEQ ID NO: 623611 - RNA, 62 nt, hsa
gaggcucaacuucucuuccaaaaaucuucuggcuucugaacucuuccucugccucucuuuaa

SEQ ID NO: 623612 - RNA, 62 nt, hsa
uaguggaguggccauaggcaaguuacuuaacacuucugaaccuccuuuugucuuucauaaaa

SEQ ID NO: 623613 - RNA, 62 nt, hsa
uguaucuucagacucacagagugaauucagcucuucugaaucaagacccacccagucucuuu

SEQ ID NO: 623614 - RNA, 62 nt, hsa
auuuuggcagguuucugugccuuuauuucccucuucugaaaaaaagucuguguuuucauagu

SEQ ID NO: 623615 - RNA, 62 nt, hsa
gagccugggguuccccuggcauuggccccagccuucugaaagccggcgcugcagccagaggc

SEQ ID NO: 623616 - RNA, 62 nt, hsa
ccguagcccacgcccucucuggguggcagggccuucugaaggaaacuugcaggcgagcccaa

SEQ ID NO: 623617 - RNA, 60 nt, hsa
cacagaauuaaacguguugccacaccugccggcuucugaacucuguccuuggcuuccugc

SEQ ID NO: 623618 - RNA, 62 nt, hsa
accuuccuuucugcugccugaugucucaauggcuucugaaugacuguucuaauaaaugaucu

SEQ ID NO: 623619 - RNA, 62 nt, hsa
cucacuguaaauacacauucuuauucuugaaccuucugaaaauaaguugcagacaucaugaa

SEQ ID NO: 623620 - RNA, 62 nt, hsa
ucugccuucuaccuacagugcauuugaacugccuucugaaagagguccagggagggauuuag

SEQ ID NO: 623621 - RNA, 62 nt, hsa
gacauguagcuucuucugaaagaauuauuugccuucugaaaugugacccccaaguccuaucc

SEQ ID NO: 623622 - RNA, 62 nt, hsa
auacuacccauagaaaacuugacauguagcuucuucugaaagaauuauuugccuucugaaau

SEQ ID NO: 623623 - RNA, 62 nt, hsa
ucugcugccuguuggggucggaagacaaggggcuucugaaaugggaguuccugagauacaac

SEQ ID NO: 623624 - RNA, 62 nt, hsa
uugguucccugacaaggguaccagguccaccccuucugaaaagcagcuguuaguuuacucuu

SEQ ID NO: 623625 - RNA, 62 nt, hsa
uggcucgagcagccuugggaagaggcaaggagcuucugaagaaacugccucugcacacacau

SEQ ID NO: 623626 - RNA, 62 nt, hsa
acacaacauuuuaauacagauugaaaggaccucuucugaagcuagaaacaaucuauaguuau

SEQ ID NO: 623627 - RNA, 62 nt, hsa
auguuauuuggaauuuuaaguucuaucagugacuucugaauccuuagaauggccucuuugua

SEQ ID NO: 623628 - RNA, 62 nt, hsa
uuaugugacaacccucaucuugauccccaucccuucugaaaguaggaaguuggagcucuugc

SEQ ID NO: 623629 - RNA, 62 nt, hsa
agcagcgaugguauucgaucugugccaugacucuucugaauguuuggacagguuagaguugg

SEQ ID NO: 623630 - RNA, 62 nt, hsa
cauggcuccgccucucugagccucugucucugcuucugaacagcggggccaauaaugaugcc

SEQ ID NO: 623631 - RNA, 62 nt, hsa
ucauccaagaaauacuuuuuauugcugggagucuucugaaccucaccaaacugaggccagag

SEQ ID NO: 623632 - RNA, 62 nt, hsa
cucccccucccuaagcuccagggucccugaaucuucugaaaucucaaaugaguggaggccuc

SEQ ID NO: 623633 - RNA, 62 nt, hsa
agugcguucuggggcugugcugcuccuguuaccuucugaauccauauguagagauuucagcc

SEQ ID NO: 623634 - RNA, 62 nt, hsa
cauuccuuguccgccaacccaccgugauucaucuucugaagcugggagugaaacugggucag

SEQ ID NO: 623635 - RNA, 62 nt, hsa
cuuguaagaaauguuugucauaugcgugaugucuucugaaauauucuuauaaccuuaaugac

SEQ ID NO: 623636 - RNA, 62 nt, hsa
guccauuuauccuauuuugaucuuuuucaagucuucugaaaggaaguagacaguauuacacc

SEQ ID NO: 623637 - RNA, 62 nt, hsa
aauguuuuucauuucccguguguuuccauuuccuucugaaauucugauuuuauccauuuuuu

SEQ ID NO: 623638 - RNA, 62 nt, hsa
aaugaccucugcaaacagaaucuuggauauuucuucugaaggauuauuugcacagacuuaaa

SEQ ID NO: 623639 - RNA, 62 nt, hsa
auccauuguccacacacacacaaccagauaaucuucugaaaguguaacucagaugaugccuc

SEQ ID NO: 623640 - RNA, 62 nt, hsa
gcccugcucucuccuguugcucugggauugcacuucugaaugaaguagcagcucauaagcuu

SEQ ID NO: 623641 - RNA, 62 nt, hsa
aagccaaucucucauuuagaccuggcuucuuucuucugaacaaaguaggguucaaaaugcag

SEQ ID NO: 623642 - RNA, 62 nt, hsa
aaguuagugaguggaguugcccaagucuggggcuucugaaaugaccugguauuuuuauguuc

SEQ ID NO: 623643 - RNA, 57 nt, hsa; identical to SEQ ID NO: 623076

SEQ ID NO: 623644 - RNA, 62 nt, hsa
ggaggacacugcuaagggucucgaccccuuggcuucugaagacacgagccgugaguaggcag

SEQ ID NO: 623645 - RNA, 62 nt, hsa
gcacugagaaaaagaaugagaaccaccuuauucuucugaaaaagacuuucuucucauccagu

SEQ ID NO: 623646 - RNA, 62 nt, hsa
gaggaaaacggcacaacacaaucuugaggugccuucugaaucaucagauuaaauuaugcuuc

SEQ ID NO: 623647 - RNA, 62 nt, hsa
ccuuuuuugucuuguuuuucuguuuuaguugucuucugaaaaaagagucguucccucuguuu

SEQ ID NO: 623648 - RNA, 62 nt, hsa
agauguuuuuaaaguuucuuuuguagaccgaacuucugaagaguaauaccaaaugccuaaaa

SEQ ID NO: 623649 - RNA, 62 nt, hsa
uugacuaaaacaucucuggugccaacguaauacuucugaaccaaaucacugugacucaagga

SEQ ID NO: 623650 - RNA, 62 nt, hsa
agugugguuguugauaccuugcaauaguauugcuucugaaaguaauaaaaaauuuuaggaga

SEQ ID NO: 623651 - RNA, 62 nt, hsa
cuaucuucacaggugugaucauaccacauucacuucugaaacacucuuguugcgaucgcuaa

SEQ ID NO: 623652 - RNA, 62 nt, hsa
aaacagcaccagcacagcauguauuuucuucucuucugaaaguucuggcuuguagaccccuc

SEQ ID NO: 623653 - RNA, 62 nt, hsa
cuguuuguuuacucuuucuuugaaaacaucaccuucugaaauuugucuuuuagcucucucag

SEQ ID NO: 623654 - RNA, 62 nt, hsa
gcaggccuaugaagugcauagggaguguaugucuucugaaugguuuuauuguucuuguaauc

SEQ ID NO: 623655 - RNA, 62 nt, hsa
aggaguauguacaauucuucugggaagccagccuucugaacuuuuugguacuaaauccuuau

SEQ ID NO: 623656 - RNA, 62 nt, hsa
augcugcugagugacugcaugaugagauacaacuucugaaugcugcacauucuuccaaaaug

SEQ ID NO: 623657 - RNA, 62 nt, hsa
cuggucucccagcaccuggcccagguaacagccuucugaaagcagagccaaggagcugcuuc

SEQ ID NO: 623658 - RNA, 62 nt, hsa
cauucuuguuaacuauaugugaaacauuuuuucuucugaagauucuuaaaaauugaaugugg

SEQ ID NO: 623659 - RNA, 62 nt, hsa
aagaaaacugcucuguuuccccuuuaguaacacuucugaagaggaaaaacuucaauagccaa

SEQ ID NO: 623660 - RNA, 62 nt, hsa
uuccauuuuggaaaaugauuaggcccgccaaacuucugaacuuuggaagcuggggauguuua

SEQ ID NO: 623661 - RNA, 62 nt, hsa
agcaagggccuaagagaaaagccagccaagugcuucugaauaaagaucccucucugggucuc

SEQ ID NO: 623662 - RNA, 62 nt, hsa
gaagccaggcugagugagccacagaccaccugcuucugaacucaagcugcguuuauuaaugc

SEQ ID NO: 623663 - RNA, 62 nt, hsa
uuucuaaauccuaggaagaaacgcuuggagugcuucugaauauacagaaguuccauuuaagg

SEQ ID NO: 623664 - RNA, 62 nt, hsa
cauaaaagcagauaccuuuaaguuuguguagacuucugaauaagaugauagacgagaauuuu

SEQ ID NO: 623665 - RNA, 62 nt, hsa
aauauaagucuccagagcacacaagaguauuucuucugaaaaaaauguuacaauuauacuag

SEQ ID NO: 623666 - RNA, 62 nt, hsa
cccagagaugucaucagagcuccucuguccugcuucugaaugugcugaucauuugaggaaua

SEQ ID NO: 623667 - RNA, 62 nt, hsa
ccagggccagauaaggaacagcucgggccacucuucugaaggccaacguggaggaaagggag

SEQ ID NO: 623668 - RNA, 62 nt, hsa
auuuugagaaaaacuaaaucaugcuccugaaccuucugaacgcauuuguuauugaaggaaag

SEQ ID NO: 623669 - RNA, 62 nt, hsa
ucuuguacacauuuuaauaaaauaaggguuggcuucugaacuacaaaacaaaugugcuaugc

SEQ ID NO: 623670 - RNA, 62 nt, hsa
gcccaaggaaggccacuucucaacuggcagaacuucugaaguuuagaauuggaauuacuucc

SEQ ID NO: 623671 - RNA, 62 nt, hsa
aaaaaaaagucacuuuuggcuaaucaugcagucuucugaaaagguuuaauagagaaaugcug

SEQ ID NO: 623672 - RNA, 62 nt, hsa
ccagcuaauacaugcaauguggcuggugaacacuucugaauucagaaacuaucccagaucuc

SEQ ID NO: 623673 - RNA, 62 nt, hsa
aggauuaugaggucuugaguuuuuauaauguucuucugaaagccuuacauuuauaacaucau

SEQ ID NO: 623674 - RNA, 62 nt, hsa
guuaaucccugucuggacugagccuccguuggcuucugaacuggaauucugcagcuaacccu

SEQ ID NO: 623675 - RNA, 62 nt, hsa
cguuugaaagcaaaaacaaaccacugucucugcuucugaaacgggaaucaguaacucuuugc

SEQ ID NO: 623676 - RNA, 62 nt, hsa
guaaacaugguuaaaauaaaacuuuugugguucuucugaaucuuaauauuucaaagccaggu

SEQ ID NO: 623677 - RNA, 62 nt, hsa
cucucacaagagcagaggccugaagauucuuucuucugaaagccaagcaccacaaggaaaaa

SEQ ID NO: 623678 - RNA, 62 nt, hsa
cugaaaauaaggaauugcuuauaaaccagccacuucugaauacaauauguagcugauuuaau

SEQ ID NO: 623679 - RNA, 60 nt, hsa
uuauugauguuacccaguuuuaauaaaagaaucuucugaaggauggguccuccuaccuac

SEQ ID NO: 623680 - RNA, 62 nt, hsa
aacugugucuacaguuuauccauauaacuucucuucugaaaacugaggaguguccucuguuc

SEQ ID NO: 623681 - RNA, 62 nt, hsa
cacagacuguuccaccguugugcauauuguugcuucugaaccacaaacuguauaaauggaug

SEQ ID NO: 623682 - RNA, 62 nt, hsa
gaacaucucccuuccggggcugcccucaagagcuucugaaaaacuaaugacucugcugccuu

SEQ ID NO: 623683 - RNA, 62 nt, hsa
aaguagguucauguguuuucuuagguaaaguucuucugaaagaauuuucuauuuuuaaaaaa

SEQ ID NO: 623684 - RNA, 62 nt, hsa
uauacuaaguuccauguauuuuuguuacaaaucuucugaaaaaaaacaaaacaaugugaaac

SEQ ID NO: 623685 - RNA, 62 nt, hsa
accauaucuucuggcuaaccauauucaagauucuucugaaacuuggaggauguaaagaaucc

SEQ ID NO: 623686 - RNA, 62 nt, hsa
cauguccuuccccucacuugugugaguggccccuucugaaucucuccagcagccagaggcac

SEQ ID NO: 623687 - RNA, 62 nt, hsa
uuucuccaaacgcucgguuccuuugaagauuucuucugaacgugugugcgcacgcugggcgg

SEQ ID NO: 623688 - RNA, 62 nt, hsa
ucccaagagcucaaaagcagaaauggccaggccuucugaaaacuuaaguccagaauugucac

SEQ ID NO: 623689 - RNA, 62 nt, hsa
guuguggccuccuuggauucuucugacuuuggcuucugaaaggaaggccuagauccagcccu

SEQ ID NO: 623690 - RNA, 62 nt, hsa
acuaaaaggcgcuucauguccaguguguggcccuucugaaacuuauggucaucucucccacu

SEQ ID NO: 623691 - RNA, 62 nt, hsa
agucauuugguacuggcuaccuggagccuuaucuucugaaggguuuuaaagaauggccaauu

SEQ ID NO: 623692 - RNA, 62 nt, hsa
ggcucgugggcacuuuccacagcccaggagagcuucugaaaggacaguauagcugcccuugc

SEQ ID NO: 623693 - RNA, 62 nt, hsa
ggagagacuuuaucaggaugaacccaggacugcuucugaaugcugcuacuugauuucuuucu

SEQ ID NO: 623694 - RNA, 62 nt, hsa
gggagagaccucaucaggaugaacccaggacgcuucugaaugcugcuacuuaauuccuuucu

SEQ ID NO: 623695 - RNA, 62 nt, hsa
cauuugcuuaauauauaucuaccuaaaggagacuucugaauuguaaaugaacuuaaaaauag

SEQ ID NO: 623696 - RNA, 62 nt, hsa
cuuuauucaugccugauuuguuuacaugaggacuucugaaauuaauccuuaaaacaaacuuc

SEQ ID NO: 623697 - RNA, 62 nt, hsa
aguauacaaaaauaaaaaguggaaaaagguaucuucugaauguucaagagcauccuauagug

SEQ ID NO: 623698 - RNA, 62 nt, hsa
uuggguguuggcuggguaaggggagccggggacuucugaaauagagcuggcucccuggggug

SEQ ID NO: 623699 - RNA, 62 nt, hsa
cauaguugaguaaucaccucaguacuuaagcacuucugaacuuggguuucaugccugccccc

SEQ ID NO: 623700 - RNA, 62 nt, hsa
aagaguuggugaagguugucucuuccgagggccuucugaagacagggcucuugaacagacaa

SEQ ID NO: 623701 - RNA, 62 nt, hsa
agcacaaagaacguugaaguucagauuaaucucuucugaaugauguuuuuuuccucugugau

SEQ ID NO: 623702 - RNA, 62 nt, hsa
aauuuuugcagucuuaaaauuacacuucuugacuucugaaugucucuuauuugcgugcacug

SEQ ID NO: 623703 - RNA, 62 nt, hsa
aacuuagcaaaauuagcaauauauuauccaaucuucugaacuugaucaagagcauggagaau

SEQ ID NO: 623704 - RNA, 62 nt, hsa
cucucucaacccagggacacccaaggauaugucuucugaagaucaaggcaagaaccucuuua

SEQ ID NO: 623705 - RNA, 62 nt, hsa
aagaccuacuugaacagggcauauuuuuuagacuucugaacaucaguauguucgaggguacu

SEQ ID NO: 623706 - RNA, 62 nt, hsa
caaggaauaugacauacagugcuggccacaaccuucugaaggcccaugcccuggcuuggcau

SEQ ID NO: 623707 - RNA, 62 nt, hsa
cucuucuuccagcucguuagcagcauuagcaccuucugaauuccacccucucagaagaaucc

SEQ ID NO: 623708 - RNA, 62 nt, hsa
aggcuuucauuuggucagcacuagaacaguaucuucugaagacaaaacugaaugcuauagcu

SEQ ID NO: 623709 - RNA, 62 nt, hsa
ggcugcaugagacaucuuucugaaaaugguaacuucugaaacagcaaagcuuccuguguuuc

SEQ ID NO: 623710 - RNA, 62 nt, hsa
cuccucccagcccauaaccaguauuuuugcugcuucugaauacaaauugguugguuuugacu

SEQ ID NO: 623711 - RNA, 62 nt, hsa
agugaauuuugucuccugcuuggaaagucucucuucugaaccuggagccugaauacauuuuc

SEQ ID NO: 623712 - RNA, 62 nt, hsa
uuuggucuucuuuucauuuuugauuagaggaacuucugaacuuggaaaggggaaguuggcag

SEQ ID NO: 623713 - RNA, 62 nt, hsa
uguuuuuuucuaauggaaugaaccauuuuccucuucugaaaauucuguaucugagcacauca

SEQ ID NO: 623714 - RNA, 62 nt, hsa
ucuucgguguaaucuaagcguuaucugcaccacuucugaauaauaaauguguuugaaaugca

SEQ ID NO: 623715 - RNA, 62 nt, hsa
gguagauuuccacaaaucagacacauuauuuucuucugaacuuggcaauauaaccuaauaag

SEQ ID NO: 623716 - RNA, 62 nt, hsa
gggagcaucuuuggacucucuguuuuuaaaaccuucugaaccaugacuuggagccggcagag

SEQ ID NO: 623717 - RNA, 62 nt, hsa
ugacuacaaagaaaaacagauacuaaaagucucuucugaaaacagcaauccagguaagacuu

SEQ ID NO: 623718 - RNA, 50 nt, hsa; identical to SEQ ID NO: 623151

SEQ ID NO: 623719 - RNA, 62 nt, hsa
cugaauuacuucuuguacagcugagauagcuucuucugaacuauuauuaaauaagugaauac

SEQ ID NO: 623720 - RNA, 62 nt, hsa
gugggauguagauagaaagcaccugaauugugcuucugaauuaaccaauccaggaacugcuu

SEQ ID NO: 623721 - RNA, 62 nt, hsa
augugcaaauuacaggcaagacaacaaagccgcuucugaagaagaaaggaccgaagcugcug

SEQ ID NO: 623722 - RNA, 62 nt, hsa
auggaaaacaugaaaacagcaaucuucuuaugcuucugaauaaucaaagacuaauuugugau

SEQ ID NO: 623723 - RNA, 62 nt, hsa
agacccucauaugaccugcacagcucauuuuccuucugaaagaaacuacuaccuaggagaau

SEQ ID NO: 623724 - RNA, 62 nt, hsa
aggaggcugucagacuguucccccuaaacacacuucugaagguuguagggaccuugcccugc

SEQ ID NO: 623725 - RNA, 62 nt, hsa
gggcggaggggauccagccacuucccccucuucuucugaagaucagaacauucagcucugga

SEQ ID NO: 623726 - RNA, 62 nt, hsa
ccucuuagaagcuaacccacuuaaauauuacucuucugaaugcuaguucucuuuuauucuug

SEQ ID NO: 623727 - RNA, 62 nt, hsa
gagcacagagggccggccaccaguccucgaugcuucugaacccugaagcccgaugacaucuu

SEQ ID NO: 623728 - RNA, 62 nt, hsa
uuuuaguaaaagaaagugaggaaaaggaagugcuucugaaaacaaaccuuucuggacggcag

SEQ ID NO: 623729 - RNA, 62 nt, hsa
agggugaccaaaugacgagcccucgccucuuucuucugaagaguacucuauaaaucuagugg

SEQ ID NO: 623730 - RNA, 62 nt, hsa
uguuccccauccccaguaguuuacauuccugacuucugaauacagcacagcugagcccccug

SEQ ID NO: 623731 - RNA, 62 nt, hsa
uuaaauaugcaauaaaguguuuacaggaugcccuucugaaggguaguccuuuguaaagcugu

SEQ ID NO: 623732 - RNA, 62 nt, hsa
gagauacuuacugacuccacuccugacuucugcuucugaaaaaaugaaguagguguuuuccc

SEQ ID NO: 623733 - RNA, 62 nt, hsa
uaugaaaucauuuucacaaaauaagcagcuugcuucugaaaugcugucuuucccaguagcua

SEQ ID NO: 623734 - RNA, 62 nt, hsa
ccugucauuccacuucauggaagagacggagccuucugaaaugagaucuacccugaaaaucu

SEQ ID NO: 623735 - RNA, 62 nt, hsa
cugccacgagcccauaauugaagagucaaagucuucugaagcugcacccucuuuacuucagu

SEQ ID NO: 623736 - RNA, 62 nt, hsa
agucuguuuaacucuucauguuccaucuuucucuucugaaguaaacuauuuugaaaguucuc

SEQ ID NO: 623737 - RNA, 62 nt, hsa
cagggccuggccaccucauaggacucaguucccuucugaacacucgggggacaugggccucu

SEQ ID NO: 623738 - RNA, 62 nt, hsa
ugagcccuaccauuacauccugauaucuggggcuucugaaggucuguacugggagugaagag

SEQ ID NO: 623739 - RNA, 62 nt, hsa
gcuaaagguuuuguccuguaggacauggagaacuucugaagaauuuucaaggcgggugggau

SEQ ID NO: 623740 - RNA, 62 nt, hsa
aaaugaauuauuucuguaguuggaaucuguaccuucugaaccucuacaccaauaacugcugc

SEQ ID NO: 623741 - RNA, 62 nt, hsa
gccaggacgucaggcugaccaacaccucagaccuucugaagcagcccauugcuggcccgcca

SEQ ID NO: 623742 - RNA, 62 nt, hsa
acaguuuccucaggcaaggccucucugggccacuucugaaggguucugaugaaaacugacug

SEQ ID NO: 623743 - RNA, 62 nt, hsa
uagacaaauuguuaagaguaucauguacuacacuucugaaacuuaacgugaucaucaccacu

SEQ ID NO: 623744 - RNA, 62 nt, hsa
agaaaccagaaugaucuucaggauaaaaagaacuucugaaucucugcaauaggaaauguuuc

SEQ ID NO: 623745 - RNA, 62 nt, hsa
ggccggaguaucuauuucuacauagucagcuacuucugaaacugcagcaguggcuuagaaag

SEQ ID NO: 623746 - RNA, 62 nt, hsa
auaauuuuuauuuuugaagcuuaaauguguuucuucugaaagcuguuaaagauguauuuaug

SEQ ID NO: 623747 - RNA, 62 nt, hsa
gugaauuucuacaguuuaacauagcacagggccuucugaaaaucgcacuugucaaagacgac

SEQ ID NO: 623748 - RNA, 62 nt, hsa
augggggcucagccaggugcugugacaccccccuucugaaugaagccuucugaccugggcug

SEQ ID NO: 623749 - RNA, 62 nt, hsa
uugaugccugugaacugaacucugacaacagacuucugaaauagacccacaagaggcaguuc

SEQ ID NO: 623750 - RNA, 62 nt, hsa
guuucugcccaguucuacccccucaugugcuucuucugaauacugaaugugacuguuugaaa

SEQ ID NO: 623751 - RNA, 62 nt, hsa
aagagggaaugcuagguugauagggcugguggcuucugaauuugguauuugaacuaggaguc

SEQ ID NO: 623752 - RNA, 62 nt, hsa
uauguucucugguaacacguagaguucagacccuucugaacucuguugauaauaccacacca

SEQ ID NO: 623753 - RNA, 62 nt, hsa
agcaucuuccucccuccuuuaauuaauggaaucuucugaauuuucccugaauguuuaaagau

SEQ ID NO: 623754 - RNA, 62 nt, hsa
gucugaaaugcgcccgccuggcggacagcucccuucugaagcagagaagccuccauggucac

SEQ ID NO: 623755 - RNA, 62 nt, hsa
auguaacagauacacuacaguagaagaacuuacuucugaaaugaagggaaaaaaaccacccc

SEQ ID NO: 623756 - RNA, 62 nt, hsa
cccacuuggggaguuucuuccuggcaucaugccuucugaauaaaugccgauuuuauccaugg

SEQ ID NO: 623757 - RNA, 62 nt, hsa
gaaagacucuuuucuccucucuccgccaccggcuucugaacagccuggcgggaaauguaguc

SEQ ID NO: 623758 - RNA, 62 nt, hsa
ugccuggccuggcucuggaagucacgucuuagcuucugaacaccguagcggguuaugaggaa

SEQ ID NO: 623759 - RNA, 62 nt, hsa
uauuagauuuuugugaugaagagcuuccauuacuucugaaaacuauauuuaucugagugagu

SEQ ID NO: 623760 - RNA, 62 nt, hsa
gauugaaacauaaaauuguagcuuuugguguccuucugaagggucagaauauguaauuauuu

SEQ ID NO: 623761 - RNA, 62 nt, hsa
uguuuuccauuugggggccccaugggaaagagcuucugaacucuuuccuuuaugaacuccca

SEQ ID NO: 623762 - RNA, 62 nt, hsa
uuucccaaguuucacaaugugauuguacaugacuucugaaauuaaaaagagagcaugagguu

SEQ ID NO: 623763 - RNA, 62 nt, hsa
ggauuuuagaugauaaggcuacaauucagaaucuucugaaccaucuauguaaugaaugggga

SEQ ID NO: 623764 - RNA, 62 nt, hsa
ugcuuuagaacaaacccuuuuugaucuuaaugcuucugaaaacuaggucugacucuggggau

SEQ ID NO: 623765 - RNA, 62 nt, hsa
ggcaaaugucuccucccucccaugcuccuuggcuucugaaggcugaagcuccuuuggcuggg

SEQ ID NO: 623766 - RNA, 62 nt, hsa
ggaagugccuucauccaggacaggaaguagcacuucugaaacaggaaguggucuggcuggaa

SEQ ID NO: 623767 - RNA, 62 nt, hsa
aaugcuuacugugguauuuggaauguauguaucuucugaacccuacaucaaguugaaaaggu

SEQ ID NO: 623768 - RNA, 62 nt, hsa
auuugaacaguuuaauaaacugguucugcucucuucugaaucucaugccuuuggcaccuugg

SEQ ID NO: 623769 - RNA, 62 nt, hsa
auagggagggauuucacucuucuucccagguucuucugaagcacccacacaaaaugcacacu

SEQ ID NO: 623770 - RNA, 62 nt, hsa
aaagaggaucuggagaaccucauccagcuccccuucugaaucagcugggaugacuggcuuug

SEQ ID NO: 623771 - RNA, 62 nt, hsa
caggaaggggcucuguucccuguauuguccuccuucugaagccccuuggcucugccuuggcc

SEQ ID NO: 623772 - RNA, 62 nt, hsa
acuaagccgaguaagaagacauacaaaagccucuucugaaggaaaagacaguguaguccugc

SEQ ID NO: 623773 - RNA, 62 nt, hsa
gcuuuugaacguaugugcucuuauaaaguggacuucugaaaaaugaauguaaaagacacugg

SEQ ID NO: 623774 - RNA, 62 nt, hsa
ccccacacaugguccucacucauaucugucaccuucugaagccuagaucuuguuaacccauc

SEQ ID NO: 623775 - RNA, 62 nt, hsa
ucgaaacugacaguauuaaggguaggauguugcuucugaaucacuguugaguucugauugug

SEQ ID NO: 623776 - RNA, 62 nt, hsa
cccugcgccucacccucagacuggugaccaggcuucugaaagccauucuggaucaguuggcu

SEQ ID NO: 623777 - RNA, 62 nt, hsa
gugacuuuuuuugugugaauaaagauaugaaacuucugaaucucaagaacugugguguguuu

SEQ ID NO: 623778 - RNA, 62 nt, hsa
ucaggguacgaacuggagggcuuguguguuagcuucugaauuggcaauuggaggcgguagug

SEQ ID NO: 623779 - RNA, 62 nt, hsa
uggaagaugagauuguaggugauauuuauuuucuucugaaacuuuuguauaguuugcaaauu

SEQ ID NO: 623780 - RNA, 62 nt, hsa
gcaaaaacuuaaauucauucagaaaguugccacuucugaaugaguagagcaggaaaaguaaa

SEQ ID NO: 623781 - RNA, 62 nt, hsa
uguaagcuuccugggugaagguugauuuguaccuucugaauccugucacguguagacauggg

SEQ ID NO: 623782 - RNA, 62 nt, hsa
cuuucaggggucaaguccuuccugcucauacacuucugaauacaguagauguugaacuuauc

SEQ ID NO: 623783 - RNA, 62 nt, hsa
uucuuuugucuuuaaaaccugauuuuuaaguucuucugaacuguagaaauagcuaucugauc

SEQ ID NO: 623784 - RNA, 62 nt, hsa
ggauucccuauucacauugaauccuuuuugcccuucugaaacaauauucagucacaagucau

SEQ ID NO: 623785 - RNA, 62 nt, hsa
cuuaaaacuagccaaauuagaauccuaacaaucuucugaacuccaguaccuauaacugggcu

SEQ ID NO: 623786 - RNA, 62 nt, hsa
aguaaauaaacauauuuuuuuuacaaaaauaacuucugaauuuaucaguguuuugccguuaa

SEQ ID NO: 623787 - RNA, 62 nt, hsa
auugauauauaaccgugauugucucugcuuuucuucugaaauguagauaacugcuuuuugac

SEQ ID NO: 623788 - RNA, 62 nt, hsa
gacgucugucuacauugaauugggaucugauucuucugaagauaccguuaauaaggcaacuu

SEQ ID NO: 623789 - RNA, 62 nt, hsa
uaugucaucuuuuucaccauucagaaacagugcuucugaauuugugauuuaaaggaauugua

SEQ ID NO: 623790 - RNA, 62 nt, hsa
ccuccacaccuuggcuuuuaugacccugauggcuucugaaacaggaaaagagagaaggaaga

SEQ ID NO: 623791 - RNA, 62 nt, hsa
aggcccucuucaggcuuuggcagccacagauacuucugaacccuucacagagagcaggcagg

SEQ ID NO: 623792 - RNA, 62 nt, hsa
ggcacuaugaacagagaacauuugccuguuggcuucugaaguggucagggccauggcugaca

SEQ ID NO: 623793 - RNA, 62 nt, hsa
aaaagaauggagcccacuaauauuauauuuuucuucugaaauaaauauaaagucaagacuaa

SEQ ID NO: 623794 - RNA, 62 nt, hsa
ccaaagacccagaggccagagcaaaguaggaccuucugaagauucacuacugguguauccuu

SEQ ID NO: 623795 - RNA, 62 nt, hsa
cuguaucgugccaaaguuguaucacuguuaaacuucugaagacauaaccaguugagucuuau

SEQ ID NO: 623796 - RNA, 62 nt, hsa
ccuuguagaaaauaguuuuccagacacuuagccuucugaagugcucaucucuugcuuaaaug

SEQ ID NO: 623797 - RNA, 62 nt, hsa
aaauuuagagauguuuucuacauauuucugcucuucugaacaacuucugcuacccacuaaau

SEQ ID NO: 623798 - RNA, 62 nt, hsa
ucaguuuuuuuaugguacucgaaaaaucaaaccuucugaaaauuaugauauuuguacuucau

SEQ ID NO: 623799 - RNA, 62 nt, hsa
auaauuaaaagagggauuaucacuaucugauacuucugaaagaaacacuuacaaaauuucuu

SEQ ID NO: 623800 - RNA, 62 nt, hsa
ugugucuagaauuaaguaugggcauaaacuggcuucugaaucccuuuccagaguguuggauc

SEQ ID NO: 623801 - RNA, 62 nt, hsa
aggugaaacgguacgauggucucaacaccuuucuucugaacuguaauacauaucacaaaaag

SEQ ID NO: 623802 - RNA, 62 nt, hsa
ccauucaggauucuguuccuuagguuuuuuuccuucugaaguguuucacgagagcccgggag

SEQ ID NO: 623803 - RNA, 62 nt, hsa
caagcagguguggggccuccuucugggcuuuucuucugaauuuagaggauuucuagaacgug

SEQ ID NO: 623804 - RNA, 62 nt, hsa
agagacacugauuuuuaaauaucaaaauuucccuucugaagucguucagauguguuccuuaa

SEQ ID NO: 623805 - RNA, 62 nt, hsa
gugaugcgcaugggcaaggccagcgcccggggcuucugaaccgagcgggguguuucauuuuu

SEQ ID NO: 623806 - RNA, 62 nt, hsa
accagagguacaaggaggagcugguacuauuccuucugaaacuauuccaaucaaugggaaaa

SEQ ID NO: 623807 - RNA, 62 nt, hsa
auacuuagauuacuaaauauauauuucaucuacuucugaaguugauagucuucccccccccc

SEQ ID NO: 623808 - RNA, 62 nt, hsa
cauggggcuguuacuuuuaaagucaaaauuuucuucugaaggcucauuuugguauuugaucu

SEQ ID NO: 623809 - RNA, 62 nt, hsa
ucagcaaagccauucuuaagagucgugagguccuucugaauguaaaacuggagcccaggaga

SEQ ID NO: 623810 - RNA, 62 nt, hsa
ggugguuggcagcuccaagccuuuaaaccuggcuucugaaacgauggcaucagagcccugga

SEQ ID NO: 623811 - RNA, 62 nt, hsa
aauuugcaccucaucaugccccagaaauaauccuucugaagcaaagcaccacgaaugagguu

SEQ ID NO: 623812 - RNA, 62 nt, hsa
uugaucuuccauuaccuucacaucccgggguccuucugaacugaccuugaccucugaucucu

SEQ ID NO: 623813 - RNA, 62 nt, hsa
uagcacccccauccccuuggcccuuccucaugcuucugaaguggacauauucagccuuggcg

SEQ ID NO: 623814 - RNA, 62 nt, hsa
cgucucuauuuuuaaaaaagaaaaagaaccgacuucugaaucgcagcuccacucaugacuaa

SEQ ID NO: 623815 - RNA, 62 nt, hsa
aucucucuccaucgggccucgggacccuuucucuucugaaucugcuucccugcaguuuagau

SEQ ID NO: 623816 - RNA, 62 nt, hsa
aagcacgacuaagagccuucugagcccagcgacuucugaagggccccuugcaaaguaauagg

SEQ ID NO: 623817 - RNA, 62 nt, hsa
ccuccaguugagacacaagucacaaauccaggcuucugaaacuucggaccaaccagcuucaa

SEQ ID NO: 623818 - RNA, 62 nt, hsa
gguucuagacgccccucccaagcguuccuggccuucugaacuccauacagccucuacagccg

SEQ ID NO: 623819 - RNA, 62 nt, hsa
gcuucccacugaagggacacagagguccaguccuucugaagggcuaggaucggguucuggca

SEQ ID NO: 623820 - RNA, 62 nt, hsa
uccucagacucuccccaauagcggaagucgaucuucugaaggauggccaaucugcuccggcc

SEQ ID NO: 623821 - RNA, 62 nt, hsa
uuugcaaaaaucaauuauuuaucaugaguauacuucugaaaugaucuguuucaucaaucuau

SEQ ID NO: 623822 - RNA, 62 nt, hsa
cagccuucccugugugccaacgccagccuucgcuucugaaaaccaaacuccagccgcugcca

SEQ ID NO: 623823 - RNA, 62 nt, hsa
gaaaucgaagaugucauggggucggggggaggcuucugaaagaugacugcguccuccucugc

SEQ ID NO: 623824 - RNA, 62 nt, hsa
caacacccuucugauggaaggcgggauucccgcuucugaaacucccccuggagucucacucc

SEQ ID NO: 623825 - RNA, 62 nt, hsa
aagcagcuucaggggcaguccguuucucugugcuucugaaacccccuucucacguuucaggc

SEQ ID NO: 623826 - RNA, 56 nt, hsa; identical to SEQ ID NO: 623259

SEQ ID NO: 623827 - RNA, 62 nt, hsa
ucuugcucacugugugaccaagugacaaacuccuucugaaccuguguucucccacuguacca

SEQ ID NO: 623828 - RNA, 62 nt, hsa
caacauucugaagccuucgguuguuccagcuccuucugaauacacaaaagaguucauacugg

SEQ ID NO: 623829 - RNA, 62 nt, hsa
auucuaucauucgugcuauuuauuuccuuaaacuucugaaaguuaaaaaguccagauaggag

SEQ ID NO: 623830 - RNA, 62 nt, hsa
aauuucucucccaaaucacuaaguuuaauauacuucugaaguuuacaucaguuuuauuuuaa

SEQ ID NO: 623831 - RNA, 62 nt, hsa
uccagaguagaaaacuaugaaugugggauagccuucugaaaaagccacaaauuuaugaaaca

SEQ ID NO: 623832 - RNA, 62 nt, hsa
uuucucuguccuuguuuccugccugucauguucuucugaauaguaacaacaagagcugauac

SEQ ID NO: 623833 - RNA, 62 nt, hsa
guuuuguuuguuuuguuuuuuugagauggagucuucugaaaauuuucucaucuucucuaacc

SEQ ID NO: 623834 - RNA, 62 nt, hsa
ugacaccuucaguucuguuccuauuaaaggaccuucugaagggcuucucugucggucuugua

SEQ ID NO: 623835 - RNA, 62 nt, hsa
gucuauccuucugcugaaacugcaagcuaagccuucugaagaugguaaaggacuuggccaga

SEQ ID NO: 623836 - RNA, 62 nt, hsa
gggagcagaaagagaagguuuuuaaggaggggcuucugaauacuugggagauacggaacgga

SEQ ID NO: 623837 - RNA, 62 nt, hsa
ggccuccuggccucagggcaugcccugccuaccuucugaaauguuuaccccauugaccaaac

SEQ ID NO: 623838 - RNA, 62 nt, hsa
uuuugaaaucucugcaucacucauuggaagugcuucugaagagagcugcucuguguucaguu

SEQ ID NO: 623839 - RNA, 62 nt, hsa
aagcacgucuaagagccuuaugagcccagcgacuucugaagggccccuugcaaaguaauagg

SEQ ID NO: 623840 - RNA, 62 nt, hsa
ggugccuacuaugugcgagacauugggaggggcuucugaauuauucuggauaucgucauuuu

SEQ ID NO: 623841 - RNA, 62 nt, hsa
acccacaaagcaucaaaagacucacucacaaacuucugaacacaaacuccauggaugaaagc

SEQ ID NO: 623842 - RNA, 62 nt, hsa
cugcucagugaggaaaucucuuccaauuucugcuucugaaugauucaauguugggagcaaua

SEQ ID NO: 623843 - RNA, 62 nt, hsa
cuggaguugagggaaggagcuguauuguggcacuucugaauuccccguuuuguuccauauug

SEQ ID NO: 623844 - RNA, 62 nt, hsa
agaguuuuuaaacuaucaauggcauuucaagucuucugaaacagcauggcuguaugugcgug

SEQ ID NO: 623845 - RNA, 62 nt, hsa
augguagagcaauaaugcuuuuuaaaaauaaacuucugaaaacccaaggccagguacugcau

SEQ ID NO: 623846 - RNA, 62 nt, hsa
uguauaucuuaagcauuuggaauuuuuuuuaucuucugaaaucauauaaaaagaaugucauu

SEQ ID NO: 623847 - RNA, 62 nt, hsa
ugggggauggcuuaacuguaccuguuuggaugcuucugaauagaaauaaaguggguuuuccc

SEQ ID NO: 623848 - RNA, 62 nt, hsa
acgucuccauaaaaggcccaggaacacgggagcuucugaagagcugaacauguggagggagg

SEQ ID NO: 623849 - RNA, 62 nt, hsa
gugucugcucuagucauccagaaacccacucccuucugaagccccuccuugggccggguugu

SEQ ID NO: 623850 - RNA, 62 nt, hsa
aaauuaauuauccuuaaaaaaguuaagcauaucuucugaacugaauacaucagcuggcauaa

SEQ ID NO: 623851 - RNA, 62 nt, hsa
auuccacccacccagcucugcccaugccucuccuucugaaccuugggagagggcugaacucu

SEQ ID NO: 623852 - RNA, 62 nt, hsa
aagguuuuuauaaugaaguuguuuauuaaaaacuucugaaugauguguuugggaguugugaa

SEQ ID NO: 623853 - RNA, 62 nt, hsa
gaccugugcccagcuuuggucccccuucccaacuucugaagcacgugcugcagagccaccuu

SEQ ID NO: 623854 - RNA, 62 nt, hsa
aagccuuggguuccaaccaggcaguagaugugcuucugaaccgcaaggagcaaacacugaaa

SEQ ID NO: 623855 - RNA, 62 nt, hsa
uuuuuauuguaaccagaaucacccugaggucccuucugaacccucugggccugcgcuaauug

SEQ ID NO: 623856 - RNA, 62 nt, hsa
uugguagaggccgagcccagcaaagguggcuccuucugaauguguggucagcaucuguacaa

SEQ ID NO: 623857 - RNA, 62 nt, hsa
ugcgccucugcccucucccagucccccuguggcuucugaaaaucucagggacagaugaggcu

SEQ ID NO: 623858 - RNA, 62 nt, hsa
acaacaucuguuacauucuaaguguguucaggcuucugaagguaaagggacacuggauccag

SEQ ID NO: 623859 - RNA, 62 nt, hsa
ggaggucaucaaccgaugguccucacaagccucuucugaagauggaaggccuuuugcccguu

SEQ ID NO: 623860 - RNA, 62 nt, hsa
ccgccuggcaucucucugccgcagcauuuccccuucugaaccguccagugacugcuuucaau

SEQ ID NO: 623861 - RNA, 62 nt, hsa
uaaugaggcugauagugaagaaaugaaaaugucuucugaagugaagcauauuuguggcgaag

SEQ ID NO: 623862 - RNA, 62 nt, hsa
aacaguccuuauucagaaacuuuucggucagucuucugaagaaucucaaaaagcccacccaa

SEQ ID NO: 623863 - RNA, 62 nt, hsa
aacuucacugucaccugugucccauagggugccuucugaauacuguuauuagaauaaguuug

SEQ ID NO: 623864 - RNA, 62 nt, hsa
gccuuucuauuucaguucauucacagaucucacuucugaaugugccacuuccaguagacaug

SEQ ID NO: 623865 - RNA, 62 nt, hsa
uuccaggggacgauggaauacccagaacgcuccuucugaagaaauggggcccuguagcugca

SEQ ID NO: 623866 - RNA, 62 nt, hsa
uuucaaaccuuuccuacuucaaacaggcuucucuucugaaaugaugacuuaaugucgaauau

SEQ ID NO: 623867 - RNA, 62 nt, hsa
ccuaagggcagcccuccaugguccugucuguccuucugaaguguguccauccugaccugcgg

SEQ ID NO: 623868 - RNA, 62 nt, hsa
uggcgucaauaaagaccuggaaggauguugugcuucugaagccccacuggguguuacugcag

SEQ ID NO: 623869 - RNA, 62 nt, hsa
gugccucaguguccuucucauuucaguagggacuucugaaaugggggaggcaguguggaaua

SEQ ID NO: 623870 - RNA, 62 nt, hsa
ucauguaauaugaucaggacccaccuccaguucuucugaaagugugacaguguccagccggu

SEQ ID NO: 623871 - RNA, 62 nt, hsa
ccaggcuguggauuacgucacugcaggaacugcuucugaaaggcuuuggccuuccucaguga

SEQ ID NO: 623872 - RNA, 62 nt, hsa
augcuugauggaauuuuuuccugcuaguguagcuucugaaaggugcuuucuccauuuauuua

SEQ ID NO: 623873 - RNA, 62 nt, hsa
uagcacaguauuuuuguaugaaaagugggagacuucugaacaguaauucauuuaauugcaaa

SEQ ID NO: 623874 - RNA, 62 nt, hsa
cuuucccaggaacaaaucaaaagguggauuaucuucugaagaauggaaacuguuaguccaga

SEQ ID NO: 623875 - RNA, 62 nt, hsa
gcgugaccggggcccacaucugugugucgugacuucugaagaguuuggccuaggccuaaaga

SEQ ID NO: 623876 - RNA, 62 nt, hsa
ccccggcaucuaccccacucaggaaaccuugacuucugaauuccuaucagguccagagggug

SEQ ID NO: 623877 - RNA, 62 nt, hsa
ggugacaaugcagcacuggcaugcauguccuccuucugaaggaccucauccuuccucacagg

SEQ ID NO: 623878 - RNA, 62 nt, hsa
cauuuaauuugucuuuaaggacagucauuuggcuucugaauguuugaaacgauuuuaaaaaa

SEQ ID NO: 623879 - RNA, 62 nt, hsa
gcaggggugaggaguggggagaaaccagaaugcuucugaaacucccaccuguugcucugagc

SEQ ID NO: 623880 - RNA, 62 nt, hsa
cuauuuuuuuucaugaaaaugucaacaugguucuucugaaucuaucacagugaaaaguucua

SEQ ID NO: 623881 - RNA, 62 nt, hsa
guauuuucccucaccagucuaggcaugacuggcuucugaaaaauuccagcacaccuccucga

SEQ ID NO: 623882 - RNA, 62 nt, hsa
ggauauauucuaugcauagauguaaugcuaaccuucugaauauauuuugaauacauuuauau

SEQ ID NO: 623883 - RNA, 62 nt, hsa
aauaauaaaauuuccccuaaucuuuucugaaucuucugaaaccaaauguaacuauguuuuau

SEQ ID NO: 623884 - RNA, 62 nt, hsa
uuuguuuucuuggcuaguaauaguaguagauacuucugaaauaaauguucucucaagauccu

SEQ ID NO: 623885 - RNA, 62 nt, hsa
uuguggaugacccuuagaauccauucucuggucuucugaaauaccaagggcagaugucaccu

SEQ ID NO: 623886 - RNA, 62 nt, hsa
caugauguucagauuuuccagugaaaaauacccuucugaacaaaacauguacuuacucuccg

SEQ ID NO: 623887 - RNA, 62 nt, hsa
uugcugguggcuaacggcuugugcuugaaagucuucugaagucugaugugaauugagcuauc

SEQ ID NO: 623888 - RNA, 62 nt, hsa
cuugguucuggcccccgcuuuuucuaacaugucuucugaaugcuuccuuuuucccugcacac

SEQ ID NO: 623889 - RNA, 62 nt, hsa
auccauaucauaguugcuuucuuuaauuguuccuucugaauaaacaguuuauuuaagauacu

SEQ ID NO: 623890 - RNA, 62 nt, hsa
ggguguuuccaacgucauggaagcagcugacacuucugaaacucagccaaggacacuugaua

SEQ ID NO: 623891 - RNA, 62 nt, hsa
uacgcuucaguauuuuaugcaauuuuuuuucacuucugaagggaaaguguauuauaaaaaaa

SEQ ID NO: 623892 - RNA, 62 nt, hsa
uuuaauugugaaccuaccauguugccucccaucuucugaaaaaacaaaaaaauugagaggcu

SEQ ID NO: 623893 - RNA, 62 nt, hsa
aaacauguugccaaaaugguggccuggcuugucuucugaacguuugguucaaauguguuuug

SEQ ID NO: 623894 - RNA, 62 nt, hsa
caagggggauuaaagcuacaccucaauccauucuucugaagugaaauuuacuugacacagua

SEQ ID NO: 623895 - RNA, 62 nt, hsa
cgccuggcuuuuagcagccauaaagaacucuccuucugaauggcaagucucucagacucuug

SEQ ID NO: 623896 - RNA, 62 nt, hsa
aaaacacuaguauaguguuguguagcuuaauccuucugaagucuuuuugucauguagcuauu

SEQ ID NO: 623897 - RNA, 62 nt, hsa
uuugaguagagaaauuaugugugucauguggucuucugaaaauggaacaccauucuucagag

SEQ ID NO: 623898 - RNA, 62 nt, hsa
acuucguuacuugagcuucagcaacuuaagaacuucugaaguucuuaaaguucugaaguucu

SEQ ID NO: 623899 - RNA, 62 nt, hsa
gugcugcuuggauagaaauauuuuuacugguucuucugaauugacaguaaaccuguccauua

SEQ ID NO: 623900 - RNA, 62 nt, hsa
auacuuagaacaugagcaaggauuucaauugacuucugaaguaaaucugucuugaaaauaug

SEQ ID NO: 623901 - RNA, 62 nt, hsa
ugggaauagaaaaaaauuguuuauuuuuuauucuucugaauuaaaccccacuuaugggugua

SEQ ID NO: 623902 - RNA, 62 nt, hsa
uacugauagucaguuugcugugucagaaagcacuucugaaagcagauaugagucaccagaca

SEQ ID NO: 623903 - RNA, 62 nt, hsa
gaaguggcacagccccagucggaauccagcggcuucugaaagugccuuggugugagaaggag

SEQ ID NO: 623904 - RNA, 54 nt, hsa; identical to SEQ ID NO: 623337

SEQ ID NO: 623905 - RNA, 57 nt, hsa; identical to SEQ ID NO: 623338

SEQ ID NO: 623906 - RNA, 62 nt, hsa
ugauauacuugucuuaagauauuaaugaaacacuucugaacacugauaggaaguguccacau

SEQ ID NO: 623907 - RNA, 63 nt, hsa
uccagggaggccccagcaaccacaccaucuucuugcugugagaggucucaccccgggcuaccu

SEQ ID NO: 623908 - RNA, 63 nt, hsa
agaacucuuccagaaccaucaccuuugggaaccugcugugagagugcugagguaccagaagug

SEQ ID NO: 623909 - RNA, 63 nt, hsa
ugauacuuguacucccccuaccccuuugucaacugcugugaaugcuguaugguguguguucuc

SEQ ID NO: 623910 - RNA, 63 nt, hsa
auuguguucuucguaaagacugaggcaagcaagugcugugaaauaacaucaucuuagucccuu

SEQ ID NO: 623911 - RNA, 63 nt, hsa
ccgccggacucuuuucugcagcacacgccugugugcugugagccccccacucugccgugcuca

SEQ ID NO: 623912 - RNA, 63 nt, hsa
uugucuuauuuaaaauuggaaugugagacauguugcugugaccuguuuuucuuucucauucac

SEQ ID NO: 623913 - RNA, 63 nt, hsa
cuguucaacuuguaucaacuccucuuuucuaauugcugugaaauggcaacuguugauaaauua

SEQ ID NO: 623914 - RNA, 63 nt, hsa
aauaacaauugacauuccuugagcaaaauauacugcugugaauuugcaaacaagaaaucugag

SEQ ID NO: 623915 - RNA, 63 nt, hsa
ugaacuuggaaagaaaugcccaucuaugucccuugcugugagcaagaagucaaaguaaaacuu

SEQ ID NO: 623916 - RNA, 63 nt, hsa
ucacguuuuauagaugagguaaaaagucuugugugcugugaguuauaaugcuuuugccuuuuu

SEQ ID NO: 623917 - RNA, 63 nt, hsa
ggcaggccagucauguguuaaguugcgcuucuuugcugugaugugggugggggaggaagagua

SEQ ID NO: 623918 - RNA, 63 nt, hsa
uggccccuauguuguguucuggacugaggccuuugcugugaacugcaguguuucauacgaacc

SEQ ID NO: 623919 - RNA, 63 nt, hsa
cgcugcaugcuucaauccugaacgucacugacuugcugugaccauccaaauaauuuuccuguc

SEQ ID NO: 623920 - RNA, 63 nt, hsa
uagggcuacagacagucaugugugacuucucucugcugugaaaacucccagagucucuuuagg

SEQ ID NO: 623921 - RNA, 63 nt, hsa
aggcgcagucucacucugucgcccgggcuggagugcugugagcuguccguggugcugaauuca

SEQ ID NO: 623922 - RNA, 63 nt, hsa
aggacagcuugagccgggccccugggcuuggccugcugugauuccacuacaccuggcugaggu

SEQ ID NO: 623923 - RNA, 63 nt, hsa
aaaaagacuaaccugcccacccacuccuuauauugcugugagauugccccuaucuugugcucu

SEQ ID NO: 623924 - RNA, 63 nt, hsa
caggggaacgcccgagacccccaccucucacuuugcugugagcccgggaaccccagagaccac

SEQ ID NO: 623925 - RNA, 63 nt, hsa
acaccccagccuuaagucucuuggagaagcuggugcugugagccagaggaugucagcugccaa

SEQ ID NO: 623926 - RNA, 63 nt, hsa
aagaaguagagaagcuauuaucaauuaaaagcaugcugugaugugacuccuggaagugacgua

SEQ ID NO: 623927 - RNA, 63 nt, hsa
gccguuuggagggagggugggcacagcugggccugcugugaccacugggagggaagaggagag

SEQ ID NO: 623928 - RNA, 63 nt, hsa
agaaauuaaccaggaagauguuuccaccaagccugcugugagucaauugagggaguguuuggg

SEQ ID NO: 623929 - RNA, 63 nt, hsa
ggcuggggugggcagggaagggaagccgggggcugcugugagggaucuuggagcuucccugua

SEQ ID NO: 623930 - RNA, 63 nt, hsa
gcgccagugacagucagggaaggugccucuggaugcugugaagagucuacagagaagauucuu

SEQ ID NO: 623931 - RNA, 63 nt, hsa
auaccccauuuaggucagcacuugauucguuguugcugugaaauauguccaugggacaaaaga

SEQ ID NO: 623932 - RNA, 63 nt, hsa
aaugagucuggcgccgcccuucccgcccguugcugcugugauccguaguaauaaauucucaga

SEQ ID NO: 623933 - RNA, 63 nt, hsa
auccuguuuucugcaacauucuauacaaaacugugcugugaccuugcgguaggccuggaucug

SEQ ID NO: 623934 - RNA, 63 nt, hsa
aacugcguucaaaucaacguauuuauaugguacugcugugacgcggcacauacaccccagccg

SEQ ID NO: 623935 - RNA, 63 nt, hsa
gggcuaccaaggcugggaaaaaaaugcaauuguugcugugagugacuuugaaagacucuggug

SEQ ID NO: 623936 - RNA, 63 nt, hsa
uccgccggccaacacugucugucucaaauacugugcugugaguuguuucaauaaaggggcccc

SEQ ID NO: 623937 - RNA, 63 nt, hsa
ugcacuacugacauguggggccaggucacccuuugcugugaggcuguccuguacauuguggga

SEQ ID NO: 623938 - RNA, 63 nt, hsa
cgaagaguccccuuccuugcgugucagcacggaugcugugacugccaccugcguccucgucaa

SEQ ID NO: 623939 - RNA, 63 nt, hsa
caggguagggaaaucuccauaccuucucaauuuugcugugaaccuaaaacugccauauaaaga

SEQ ID NO: 623940 - RNA, 63 nt, hsa
ucauccaauuaaacauacugcuuaaaacaguguugcugugacuucagagacaagccuggaagg

SEQ ID NO: 623941 - RNA, 63 nt, hsa
aucuuuuuuaguuaacccuuucuugacucugagugcugugaauuucuuuacugauuucucuau

SEQ ID NO: 623942 - RNA, 63 nt, hsa
gucugcagcacggaaaagcacauaaucuuucuuugcugugacugaaauguaucccucguuuau

SEQ ID NO: 623943 - RNA, 63 nt, hsa
guggagcgaggguaguaggagcuuuucccagagugcugugacuugcaugauggauucuaggcu

SEQ ID NO: 623944 - RNA, 63 nt, hsa
aagucaggaaaagccuuucagcucacccauggcugcugugacuccuaccagggcuuucuuggc

SEQ ID NO: 623945 - RNA, 63 nt, hsa
cauuucaaaguuuggauuguaucaaguggcaugugcugugaccauuuauaauguuaguagaaa

SEQ ID NO: 623946 - RNA, 63 nt, hsa
cauguaugcuaaauuugugaguuagcaagacccugcugugauuacuauguuguacagaucuuc

SEQ ID NO: 623947 - RNA, 63 nt, hsa
agaaccgacauaacagaauuacugaaauaaaugugcugugaggaauggaaaauauggugcagg

SEQ ID NO: 623948 - RNA, 63 nt, hsa
aauccgguguguuaaggugauuugugaaacaguugcugugaacuuucaugucaccuacauaug

SEQ ID NO: 623949 - RNA, 63 nt, hsa
gcagugcuuucagucuuccaugugagcucgugcugcugugaccugcuauauguagucucguug

SEQ ID NO: 623950 - RNA, 63 nt, hsa
aaagucuauaaccugaaaauguuucauguucucugcugugaaacucuuaaaacaaggagugua

SEQ ID NO: 623951 - RNA, 63 nt, hsa
aauacgacaguguuccaaaucccaucaacaaaaugcugugaacaacaacaacaaaaaauaaau

SEQ ID NO: 623952 - RNA, 63 nt, hsa
gaacacugcucgcuacaagcuggccguggcagaugcugugauugagaaguuugccccaauuaa

SEQ ID NO: 623953 - RNA, 63 nt, hsa
uugguccauggcuacacugcaacuuccguccagugcugugaugcccaugacaccugcaaaaua

SEQ ID NO: 623954 - RNA, 63 nt, hsa
cuaaacuuuuugacgggaacacugcagagacaaugcugugaguuuccaaccucagcccaucug

SEQ ID NO: 623955 - RNA, 63 nt, hsa
ccucucagauuccccuuguggaaaaaaaaauucugcugugaagaugaaaauaaaaauggagag

SEQ ID NO: 623956 - RNA, 63 nt, hsa
cuugauccuguuagcaggugguaauaccaugggugcugugacacuaacagucauugagaggug

SEQ ID NO: 623957 - RNA, 63 nt, hsa
guuccugcccuuccugagucuaggcagcucugcugcugugaucugcacacccuccaaccuggg

SEQ ID NO: 623958 - RNA, 63 nt, hsa
accauguuucugucuccccagcacccagcacagugcugugaaccuuggcagaugcuagauaaa

SEQ ID NO: 623959 - RNA, 63 nt, hsa
uuuuucuccagugcaagcccuggcugaggccaaugcugugaagcuccacagagccacauucug

SEQ ID NO: 623960 - RNA, 63 nt, hsa
ccuccaaaccuggccugagccuccugaaguugcugcugugaaucugaaagacuugaaaagccu

SEQ ID NO: 623961 - RNA, 63 nt, hsa
gaauucauacuagaauucaggugcuuugcuagaugcugugacagguaugccaccaacacugcu

SEQ ID NO: 623962 - RNA, 63 nt, hsa
caauuuugugauuauuaguacagaguacagcuaugcugugacuguuuuggaaagccaguuuua

SEQ ID NO: 623963 - RNA, 63 nt, hsa
caggggugauccacccgccucgggcucccaaagugcugugauuacaggcaugagccaccaugc

SEQ ID NO: 623964 - RNA, 63 nt, hsa
uugugaggugagagaaaacuaauguuuacuuucugcugugaacugaacugcagcuauagaaug

SEQ ID NO: 623965 - RNA, 63 nt, hsa
agauuuuauaaggaaaacaaauauaauaaccagugcugugaaaugcagaagaaaggcuuguuu

SEQ ID NO: 623966 - RNA, 63 nt, hsa
aauuacuagauugcacuagcuugucucuaaaauugcugugacuccagauacuuugcacugaag

SEQ ID NO: 623967 - RNA, 63 nt, hsa
aaagucagucuauguacauacugcuuauugaugugcugugauaugagggaaucugaaauguuu

SEQ ID NO: 623968 - RNA, 63 nt, hsa
uagcguuccuuauucuuugagggaaacugugcuugcugugauccauuuugucucuagcuucua

SEQ ID NO: 623969 - RNA, 63 nt, hsa
cuuuuuguguugcaucaaacagaagauuuugacugcugugacuuuguacugcaugaucaacuu

SEQ ID NO: 623970 - RNA, 63 nt, hsa
gugaaucugcuuacucacuagaacuucccugugugcugugagccagcggaaccacuuguacaa

SEQ ID NO: 623971 - RNA, 63 nt, hsa
cauucuugugacuggcaggcugcccucggucgcugcugugaugaggauaugugcaaccuccau

SEQ ID NO: 623972 - RNA, 63 nt, hsa
ccuucauagaucuuuuuucuuuuuuuuaagccaugcugugaccuacaagcaaacuaaauagcc

SEQ ID NO: 623973 - RNA, 63 nt, hsa
cccacagaucaaucucugcagaugacagggaggugcugugagaagugcaccaggcagcuuucu

SEQ ID NO: 623974 - RNA, 63 nt, hsa
ggaaccugggcuguggcucucugucguuuguggugcugugauggugucuacuguuagaauagc

SEQ ID NO: 623975 - RNA, 63 nt, hsa
ccgggggccccaccuucccacggguucccacgcugcugugacugcccugccucuacgacaaaa

SEQ ID NO: 623976 - RNA, 63 nt, hsa
auuauucugauauuuaagagagccaauuuuaacugcugugaaaauguuuccagugcaagagaa

SEQ ID NO: 623977 - RNA, 63 nt, hsa
aaauuaaaaauguauuucaaacuauucuuacugugcugugaauuuauaucuucuucugcaaga

SEQ ID NO: 623978 - RNA, 63 nt, hsa
ccaccuuccaccaugguucugggcgccugauuuugcugugacucccagacccagccacuguuu

SEQ ID NO: 623979 - RNA, 63 nt, hsa
ugcuggacuucugccuuuguuggccugaugugcugcugugaugcugguccuucaucuuaggug

SEQ ID NO: 623980 - RNA, 63 nt, hsa
uaaugaggaaguugagguaaugcuuaacauuguugcugugagaauuuacugcccuauguuucc

SEQ ID NO: 623981 - RNA, 63 nt, hsa
gaccagaaaugcuugccaguacugccaaagcacugcugugaaaugugaaguacuuuguuuuuu

SEQ ID NO: 623982 - RNA, 63 nt, hsa
accucuuccaggcccugaaacaaaaaauacauuugcugugaagauugaaaaugaacaaaguua

SEQ ID NO: 623983 - RNA, 63 nt, hsa
aaugagccacgcuucugcauucuucuuagaaacugcugugaaaaacaauuuauguuugcaggg

SEQ ID NO: 623984 - RNA, 63 nt, hsa
uguacaggaagcuugcaaauuuucuguacaaugugcugugaaaaaucugaugacuuuaauuuu

SEQ ID NO: 623985 - RNA, 63 nt, hsa
aucuuuugaacccaggaguucagggucauagcaugcugugauugugccuacgaauagccacug

SEQ ID NO: 623986 - RNA, 63 nt, hsa
ugugccuaauagaagguugagaccagcagagacugcugugaguuucucccggcuccgaggcug

SEQ ID NO: 623987 - RNA, 63 nt, hsa
uuuacuuguauauaagccuucucauuugccaugugcugugaucuuacaaguuagauguuacua

SEQ ID NO: 623988 - RNA, 55 nt, hsa
uugaagauuuugcuugcuaggacggugcugugacugaaaggacccaggagucugg

SEQ ID NO: 623989 - RNA, 63 nt, hsa
guaaaaauauugaauggaacuucuauaugaggaugcugugaucuaaaaauuaaaucucagugg

SEQ ID NO: 623990 - RNA, 63 nt, hsa
acaaggcugauuuuaggcagcauguguucacugugcugugauuucaucuacugucucccagaa

SEQ ID NO: 623991 - RNA, 63 nt, hsa
ccauccucucugaucugugagaaacagcuaagcugcugugacuucccuuuaggacaauguugu

SEQ ID NO: 623992 - RNA, 63 nt, hsa
ggcggccagagccuggggccuccagccugggacugcugugaugggguaucacggugauggucc

SEQ ID NO: 623993 - RNA, 63 nt, hsa
uuaauuuugcuauaaauguguggaaucacaaguugcugugauacuucauuuuuaaauugugaa

SEQ ID NO: 623994 - RNA, 63 nt, hsa
caaggguaaaauauauauauauaucuauauaagugcugugacuguaaaaguguacuuuccauu

SEQ ID NO: 623995 - RNA, 63 nt, hsa
auucaguuucaaacucuucucacauuaaaauuuugcugugaacucuuacuaaaaugaguuuua

SEQ ID NO: 623996 - RNA, 63 nt, hsa
gagggguuuucuguuuguuuggguuuuguuucuugcugugacugaaacaagaagguuauugca

SEQ ID NO: 623997 - RNA, 63 nt, hsa
uccuguugaucaauuuuuuuuggaagaugcaauugcugugacaagguaaggaagauauuaauu

SEQ ID NO: 623998 - RNA, 63 nt, hsa
agaagaaugaaggacaugccaguccccgaucgcugcugugagcaccucaguggcucccucaga

SEQ ID NO: 623999 - RNA, 63 nt, hsa
ugaggggucccacagcuuuuccuggcuaccacuugcugugaccuuauacauguugggguuugc

SEQ ID NO: 624000 - RNA, 63 nt, hsa
ucucuguccagcaccucuugguuaaauaauguaugcugugagacaugaaauuaaaacagaccu

SEQ ID NO: 624001 - RNA, 63 nt, hsa
uggucugggaagccacccaccccagggcaaugcugcugugaugugccuuucccugcaguccuu

SEQ ID NO: 624002 - RNA, 63 nt, hsa
aauuuuuaccggauuugcugaaaugggcacuucugcugugaugcuaguguugauuuugcucuc

SEQ ID NO: 624003 - RNA, 63 nt, hsa
ugcaucucugcguauuuucaaguuuuuuuaucuugcugugagagcauauguugugacugucgu

SEQ ID NO: 624004 - RNA, 63 nt, hsa
ccaccaggcugucagcugaccucuuuugccugcugcugugaagguauagcaccaccccagguc

SEQ ID NO: 624005 - RNA, 63 nt, hsa
aacuguaacuguaauguaauggaaauuaacuagugcugugauuuucaaauuuuuagccaggua

SEQ ID NO: 624006 - RNA, 63 nt, hsa
uccuuauuccaguaacauuuuuauguacucaucugcugugaaaagucuuuagguucauuaaaa

SEQ ID NO: 624007 - RNA, 63 nt, hsa
uaaaacuaggcuacagguauagcugaccaaguuugcugugaaaaauccuuguuauaucuauuu

SEQ ID NO: 624008 - RNA, 63 nt, hsa
caggagaaucgcuugaaucugggaggcagagguugcugugagccgagaucgugccacugcacu

SEQ ID NO: 624009 - RNA, 63 nt, hsa
ucucuucagaagauaauuuucaaaagggagcaaugcugugaaugcagcuugcuucucucuaca

SEQ ID NO: 624010 - RNA, 63 nt, hsa
uucauuguaauacucaugccuaccucgcaugguugcugugaggcaccuaugacaggacguggg

SEQ ID NO: 624011 - RNA, 63 nt, hsa
uuguuuccauagccuuuuauaaugcauauaugaugcugugaacagaaauaaauuauuuauaca

SEQ ID NO: 624012 - RNA, 63 nt, hsa
auggcccaccauucucacuggaaaacaguggucugcugugaaaggccagcucucggcagcccc

SEQ ID NO: 624013 - RNA, 63 nt, hsa
accaucuggguccccuguggccgucacagugucugcugugauugagaugcgcacagguugggg

SEQ ID NO: 624014 - RNA, 63 nt, hsa
cuuuaaagaugccuagugaaaagccuacuaaagugcugugagauugggguuuagaacauuuua

SEQ ID NO: 624015 - RNA, 63 nt, hsa
agggcucccacagcugguucccaggccagugagugcugugagaauacaguagcacaaguccuu

SEQ ID NO: 624016 - RNA, 63 nt, hsa
cauuguugguucugaacuuuuacaguucaggccugcugugaaucuuugaugaagcuuuaaggu

SEQ ID NO: 624017 - RNA, 63 nt, hsa
caguuacucuggugauaguuuucaccuuuauucugcugugaaacaaucaaaucaaagccuugu

SEQ ID NO: 624018 - RNA, 63 nt, hsa
gagcuggcuguugcuggacuacaugcuggccacugcugugaccacgacacugcuggggcagcu

SEQ ID NO: 624019 - RNA, 63 nt, hsa
uaaaaaaaaugcccccuccuucugcaggagcucugcugugauucauuccaauaaagguacaau

SEQ ID NO: 624020 - RNA, 63 nt, hsa
auggauucaagggaaaccuacauuaaggaaaauugcugugaauuaugaaaacaccaaguuuga

SEQ ID NO: 624021 - RNA, 63 nt, hsa
ccaguugccuuuuaucccaaaguuguuguaaccugcugugauacgaugcuucaagagaaaaug

SEQ ID NO: 624022 - RNA, 63 nt, hsa
gauuuuuuuucccccuuuccccacuuccuugacugcugugaugugaauuaaagauaaauacgu

SEQ ID NO: 624023 - RNA, 63 nt, hsa
ucaaggauguuuuccucaguuguuuccuguaagugcugugaccuuuucuggaauccaccuguu

SEQ ID NO: 624024 - RNA, 63 nt, hsa
cugaguacgauucaguauguuccuguggaugucugcugugacuaauauaaauuucuugcagaa

SEQ ID NO: 624025 - RNA, 63 nt, hsa
ugugucugcagggagccagggcugcggcacaugugcugugaaacuggcacccaccuggcgugc

SEQ ID NO: 624026 - RNA, 63 nt, hsa
aaaaaagaugaauacaaacguuuuugcagguucugcugugaaaugugguuugauuuuuuuggu

SEQ ID NO: 624027 - RNA, 63 nt, hsa
aaugagauacuguauuaucagaccaggaggcauugcugugaaagauaauuuccuauucuaaaa

SEQ ID NO: 624028 - RNA, 63 nt, hsa
aguaaauaaauuuuaugggcgggugccaaauacugcugugaaucuauuuguauaguauccaug

SEQ ID NO: 624029 - RNA, 63 nt, hsa
ugcucugugcucacaccucggcugcaugcacccugcugugacggaggcuaguguggaagaggu

SEQ ID NO: 624030 - RNA, 63 nt, hsa
uuuuacagcuuaagagaguaaggccuugggcugugcugugaccugcccaagauuugacacugg

SEQ ID NO: 624031 - RNA, 63 nt, hsa
cacaagaaucauuugaaccuaggagguggcgguugcugugagccaagaucaugccacuccacu

SEQ ID NO: 624032 - RNA, 63 nt, hsa
aucacuugagcccaggaggucgaggcugcagugugcugugauugugacacugcccuccagccu

SEQ ID NO: 624033 - RNA, 63 nt, hsa
guuuuuucugugcugucuguacauugcuucugcugcugugauuucuaaaccugugcuguuauu

SEQ ID NO: 624034 - RNA, 63 nt, hsa
gaggagcauguccacugaguaucuuccuuauguugcugugauauugauagcuuuuauuuucua

SEQ ID NO: 624035 - RNA, 63 nt, hsa
gugugaaacccuacaaugugaaaggaaagugcuugcugugauguuccuacuguggcccagcug

SEQ ID NO: 624036 - RNA, 63 nt, hsa
gagucgcuggagaugagcucgccugcaggcagcugcugugagcuggccuaccugccugcccca

SEQ ID NO: 624037 - RNA, 63 nt, hsa
aguuuuuugagucuugagcuugggcuguggcccugcugugaucauaccuugagcacgacgaag

SEQ ID NO: 624038 - RNA, 63 nt, hsa
cagguaaggcggaggcugcuggugugaggaccaugcugugagcagcagggcgagagugcccag

SEQ ID NO: 624039 - RNA, 63 nt, hsa
uuuagauuguaugccacuuuuguuuaagaacugugcugugaucacuguauuaauuuugguuua

SEQ ID NO: 624040 - RNA, 63 nt, hsa
cauggcaagaaggaaauggcagaaaacgggcaaugcugugagagccauuggaagacuguccuc

SEQ ID NO: 624041 - RNA, 63 nt, hsa
uacaacaauuuuaaugauucccuuguucauuuuugcugugaaaugcacugaaaaaaauccuca

SEQ ID NO: 624042 - RNA, 63 nt, hsa
cccagaucgcucccuuggcuuugaggccgaagcugcugugacuguguccccuuacugagcgca

SEQ ID NO: 624043 - RNA, 63 nt, hsa
augugcauguucuuagccaccgccucccuccuuugcugugacaucaccacucuuuccugaugc

SEQ ID NO: 624044 - RNA, 63 nt, hsa
uaauauuugguauuucuuuuaaaguauuuuuugugcugugaacauuuucugccaaagaccaug

SEQ ID NO: 624045 - RNA, 63 nt, hsa
uuaugcuuuguugccucugagggucuuuagaccugcugugaaaggaucacauuuguuguggug

SEQ ID NO: 624046 - RNA, 63 nt, hsa
uuauaugguauguaacaaaucugaauuauguuaugcugugaauuauucagugcauuauaagaa

SEQ ID NO: 624047 - RNA, 63 nt, hsa
augcuaaguucuaggcuggaaauaagggcaaaaugcugugaaagaagaggaaauguuuacuuc

SEQ ID NO: 624048 - RNA, 63 nt, hsa
guguaucuucuuugucccaauuaaacaguugcuugcugugauguaaucuuaaaauaucuuugu

SEQ ID NO: 624049 - RNA, 63 nt, hsa
gccuuauuuuguuggugcuuugcauuuugauauugcugugagccuugcaugacaucaugaggc

SEQ ID NO: 624050 - RNA, 63 nt, hsa
acauagauauauaagugaucucaguuucuuguuugcugugauacuaauguguuguuuuaacuu

SEQ ID NO: 624051 - RNA, 63 nt, hsa
aggaagucacagaaacaugucucaauucccaugugcugugacuguagacugucuuaccauaga

SEQ ID NO: 624052 - RNA, 63 nt, hsa
acacauuuacuguccaauuuaaaacuuuggaauugcugugauuaaagugaucaaaaugccaaa

SEQ ID NO: 624053 - RNA, 63 nt, hsa
gguggccaccugcaccagcgucagggcccagggugcugugaccgaugagaccucagcucagcc

SEQ ID NO: 624054 - RNA, 63 nt, hsa
uuauucaccuauuuuuauaauaaacguucuugcugcugugacugcucugagaauuuguguugg

SEQ ID NO: 624055 - RNA, 63 nt, hsa
ccucacucccucuguguguguugaccacgucucugcugugaauaggauuucaugcaguggucu

SEQ ID NO: 624056 - RNA, 63 nt, hsa
ugauaccuacucagugagguacuuugcuuggauugcugugauucuuaaaaaaaaaaaaaaaaa

SEQ ID NO: 624057 - RNA, 63 nt, hsa
aguuugugaaaugaugagggcauuuuaucugcuugcugugaccagcguguguacacauaaacc

SEQ ID NO: 624058 - RNA, 63 nt, hsa
gauaugguucugaguuauagugucuuauuuagaugcugugaauuauugauguauuacauuauu

SEQ ID NO: 624059 - RNA, 63 nt, hsa
ugguggcuuuaaguguagagaugggauggcaaaugcugugaaugcagaauguaaaauugguaa

SEQ ID NO: 624060 - RNA, 63 nt, hsa
uugauuaggguaguauauuauagucaucuguuaugcugugaaauuuggaauucaguauuauca

SEQ ID NO: 624061 - RNA, 63 nt, hsa
uuguguggcaaaugagaaauccuuuauuuauugugcugugaucucucuguguggaaugccuug

SEQ ID NO: 624062 - RNA, 63 nt, hsa
uuaucugacaaugggacaaccagggacugcucaugcugugacgucacauccucucaccaugcg

SEQ ID NO: 624063 - RNA, 63 nt, hsa
aaaaaagcaaauuauuuuuuuuuauuuuuuuucugcugugacguuuuagucccagacugaauu

SEQ ID NO: 624064 - RNA, 63 nt, hsa
cugccaccaaaccaccagcagaguagccgccgcugcugugagccuggggacgacauggcaggc

SEQ ID NO: 624065 - RNA, 63 nt, hsa
uuauuaaaucuaguugucacuuuauuuuggaccugcugugaucucgacaggaaacgugccaca

SEQ ID NO: 624066 - RNA, 63 nt, hsa
cacaauaacuuuacauuccuagcuuuacagucuugcugugaauucucugguguucauuaaagu

SEQ ID NO: 624067 - RNA, 63 nt, hsa
cgagaagaacugggcgacucccagucccaccugugcugugacagucccacguggcuaugacag

SEQ ID NO: 624068 - RNA, 63 nt, hsa
uagccuggaggggcuugaguggaugggagcugaugcugugauuuugagcugugguuacaugca

SEQ ID NO: 624069 - RNA, 63 nt, hsa
ucucuucauuauucucugcuauauauaaaacggugcugugagggaggggaaaagcauuuuuca

SEQ ID NO: 624070 - RNA, 63 nt, hsa
auuucauuuugggguacagcaggguguuuuaagugcugugacuucagcuaaugaucuuuucuu

SEQ ID NO: 624071 - RNA, 63 nt, hsa
gcaaaccaauggugauccucuauuuugugaugaugcugugacaauaaguuugaaccuuuuuuu

SEQ ID NO: 624072 - RNA, 63 nt, hsa
ccacggaacguugucaagagguagugagauuguugcugugagcaaggcucugggagagucacc

SEQ ID NO: 624073 - RNA, 63 nt, hsa
accucauguuccacccgccacggccucccaaagugcugugauuaccggugugagccacugcgc

SEQ ID NO: 624074 - RNA, 63 nt, hsa
aaaauguuauauuaauggaguuauugcuauuuuugcugugauaaugguauuaugcaagaccau

SEQ ID NO: 624075 - RNA, 63 nt, hsa
caagcuggaguuuuuaaucuggacucucuggcuugcugugaccccuaaggcaaugcuucucuu

SEQ ID NO: 624076 - RNA, 63 nt, hsa
cugguauuccacauccaauauggauuucuagaaugcugugauuaaaggagccagccaggugua

SEQ ID NO: 624077 - RNA, 63 nt, hsa
gaguuaaguaagauuagagugagugugcucuguugcugugaugcugucagccacagcuuccug

SEQ ID NO: 624078 - RNA, 63 nt, hsa
ugcaaccgacugacguuacuguaguuccuagaaugcugugagggcgggggguucagaucaaca

SEQ ID NO: 624079 - RNA, 63 nt, hsa
accauucaagcccaggaguuccagccugaaguaugcugugaucaugccugugaauaaccacug

SEQ ID NO: 624080 - RNA, 63 nt, hsa
cucuuaucauuuaaagugguguacaguacacucugcugugaugguauugcgggauucagagau

SEQ ID NO: 624081 - RNA, 63 nt, hsa
cacugaccagcccaaaucauaaucauguuuucuugcugugauagguuuugcaagccuuuucau

SEQ ID NO: 624082 - RNA, 63 nt, hsa
cuuuaugcagccauauaaacuguucucuaggcaugcugugacauuuuaauaaaaagcaaaagg

SEQ ID NO: 624083 - RNA, 63 nt, hsa
augagcaacagaggguccuuauuuaaacauaagugcugugacuuaggugaauuuucaauuuaa

SEQ ID NO: 624084 - RNA, 63 nt, hsa
uauauuuuauagaaccaucauuggaaaugaaacugcugugaauguggauucuucccacacaga

SEQ ID NO: 624085 - RNA, 63 nt, hsa
acaccgaaugacucaguccagagggucagaugcugcugugagaggcacagagcccuuuccgca

SEQ ID NO: 624086 - RNA, 63 nt, hsa
accaaaaacuccuuuucccuaggaagucaaaaaugcugugauuuaaaauaucuaauuauauuu

SEQ ID NO: 624087 - RNA, 63 nt, hsa
uucauucuuggcucccuacuaucuauaaacagcugcugugaagaagaaaaguugaauaagagu

SEQ ID NO: 624088 - RNA, 63 nt, hsa
ugacauggaaauagaugcaggcaggcuggucccugcugugauuaacgaguaacuccaaguaca

SEQ ID NO: 624089 - RNA, 63 nt, hsa
gacuggauucaacuugcuugggagggucugugcugcugugagaaccgcucuccucugacuugg

SEQ ID NO: 624090 - RNA, 63 nt, hsa
aaagauagcuguaugcucaagugccauguguuuugcugugaugucccugccaaggccauugcc

SEQ ID NO: 624091 - RNA, 63 nt, hsa
acagugaacucaggcagcuggcucuguguuggcugcugugagggcugagucugguucccuagg

SEQ ID NO: 624092 - RNA, 63 nt, hsa
aaggccacccucuccagccccuuguccccccugugcugugagcccaagucccuugugaccacu

SEQ ID NO: 624093 - RNA, 63 nt, hsa
ccccauagugaguaucccuccucugugugcucaugcugugaaucccccccauucuaccacuuc

SEQ ID NO: 624094 - RNA, 63 nt, hsa
auacguauucucuuuugucucuucauuuauaacugcugugaauuguacauuucuguguuuuuu

SEQ ID NO: 624095 - RNA, 63 nt, hsa
aacaggcuuuaggcaaguggaaaauucaaaaugugcugugaaaggacaaucucaggcugaaau

SEQ ID NO: 624096 - RNA, 63 nt, hsa
agaccacccugccccaccugccccuucccccuuugcugugacacuucuucaucucaccccccc

SEQ ID NO: 624097 - RNA, 63 nt, hsa
uauuaccuguucugcuucaccaggagaucaugcugcugugauacugaguuuucuaaacagcau

SEQ ID NO: 624098 - RNA, 63 nt, hsa
uguggcacggggccuaugugucucugucgcgucugcugugaagcacaugaugcucuauuuauu

SEQ ID NO: 624099 - RNA, 63 nt, hsa
gcagcuauaguugaacaagcagucuuuaaaaacugcugugaaacacaggccaucagggaaaac

SEQ ID NO: 624100 - RNA, 63 nt, hsa
gcuucagcaccuccagguugguucuggguguccugcugugagggguagaacgggaggcugcug

SEQ ID NO: 624101 - RNA, 63 nt, hsa
cacuuuccuucaggcucugugaauacuucaaccugcugugauuuggggccguuuguacucugc

SEQ ID NO: 624102 - RNA, 63 nt, hsa
gagcuuguauauacuucacucacuuuucuuuauugcugugaauagucugugugcacaaugggc

SEQ ID NO: 624103 - RNA, 63 nt, hsa
cauguggaguuguugggcgagagguguucucugugcugugaauucaguggggagcuguagcgg

SEQ ID NO: 624104 - RNA, 63 nt, hsa
uuuugguguguuucuguugauuucuuuuuuguaugcugugauaaaagagaaaugaaaagugcc

SEQ ID NO: 624105 - RNA, 63 nt, hsa
uagacugccaguugucuagugacaucugaugcuugcugugaacuuuuaagauccccgaauccu

SEQ ID NO: 624106 - RNA, 63 nt, hsa
aauaacaaaaucacuguaccuuccucucaauuuugcugugaaccugaaauggcuuuaaauuaa

SEQ ID NO: 624107 - RNA, 63 nt, hsa
ucucuucuguguuuagguauucucugccacucuugcugugaaauugaagugcauguagaaaaa

SEQ ID NO: 624108 - RNA, 63 nt, hsa
auguuugcaguauagguuccuggcuacuguuuaugcugugauuucacucugucuaucaugggc

SEQ ID NO: 624109 - RNA, 63 nt, hsa
uaauuugucauuuuugauguaaaauauaaucacugcugugauaaauaaacuaucuauugauca

SEQ ID NO: 624110 - RNA, 63 nt, hsa
agauaccuucacggccgcugcuggagcuucuguugcugugaauacuucucucagugugagagg

SEQ ID NO: 624111 - RNA, 50 nt, hsa
aaauggcaaccuuaauguagugcugugagaauucuccuuugagauuucag

SEQ ID NO: 624112 - RNA, 63 nt, hsa
uaaaauaggucuuuguuauuuucaacuguucuaugcugugacgaugaggaggagaugucuguu

SEQ ID NO: 624113 - RNA, 63 nt, hsa
agaggacugaaaaaacaaauuuuaacuagcaaaugcugugaauuacucuuccuccccuucucu

SEQ ID NO: 624114 - RNA, 63 nt, hsa
acauacucaaaagcuguuacacuuucucugaucugcugugauccacugaaaaugugcuggggu

SEQ ID NO: 624115 - RNA, 63 nt, hsa
gaggagaaaaaauguagcuggcugcaaacccagugcugugaggugacuuauaugagguuccag

SEQ ID NO: 624116 - RNA, 63 nt, hsa
cugacugauagacucugagcacuaauaucauagugcugugaugauggacaauuacauaguacc

SEQ ID NO: 624117 - RNA, 63 nt, hsa
uuuguuuauuuguuuuugcuguugaaacaaugcugcugugaacauuguaucuagcaguuauau

SEQ ID NO: 624118 - RNA, 63 nt, hsa
accucaugauccacccgccucgaccucccaaagugcugugauuacaggugugagccacugcac

SEQ ID NO: 624119 - RNA, 63 nt, hsa
ucaaacucccgaucucaagccacccucccaaaaugcugugauuauaggccagagccauuguuc

SEQ ID NO: 624120 - RNA, 63 nt, hsa
ucgcaguguugggcuuggugacuggagcaaagcugcugugagagaguguccuuucccaucugu

SEQ ID NO: 624121 - RNA, 63 nt, hsa
augugggaaaucucuguaccuuccucuccauuuugcugugaacuuaaaacugcucuaaaaaaa

SEQ ID NO: 624122 - RNA, 63 nt, hsa
aguaaccacugaccugugagcuggguccaggaaugcugugaggaacaacuuaaaaguaagaag

SEQ ID NO: 624123 - RNA, 63 nt, hsa
augcacagcagcacauaugugccucauguguccugcugugaugcagcgaguggcacacagcau

SEQ ID NO: 624124 - RNA, 63 nt, hsa
aauugaaguguuguugcuauggugacguccuuuugcugugaauaaaggugcucuuugcagcaa

SEQ ID NO: 624125 - RNA, 63 nt, hsa
ggccugggcugccgacaccugggccagagccccugcugugauuggugcucccugggccucccg

SEQ ID NO: 624126 - RNA, 63 nt, hsa
cccacacacacaguuuuugucuaaugaaaauguugcugugauuauuuauaauugguaguauuu

SEQ ID NO: 624127 - RNA, 63 nt, hsa
acuguauguuauuggcacguguuguuuacauuuugcugugacauuuaaaaauauuucuuuaaa

SEQ ID NO: 624128 - RNA, 63 nt, hsa
accuguuaucccuacgcuucccagagagaacaaugcugugagagaguuuagcauugugucacu

SEQ ID NO: 624129 - RNA, 63 nt, hsa
ugguuauuacccuguguaccuugucccucauuuugcugugacacccugaaaaagcugaccaca

SEQ ID NO: 624130 - RNA, 63 nt, hsa
aaagauaggcaggggcucuuggaagacguuccgugcugugaccuccgagcccuccugguggga

SEQ ID NO: 624131 - RNA, 63 nt, hsa
aggccugagcgcugcccugcaccuccgcagaccugcugugaugacuugccauuaaaagcauug

SEQ ID NO: 624132 - RNA, 63 nt, hsa
gugugcacgcaugaccguguggguggcggcguuugcugugaaccacgcucaggccacacagag

SEQ ID NO: 624133 - RNA, 63 nt, hsa
agccacacaagccuuauguucucaucucaaaaaugcugugacagcuuuuuggcugcuuuaacc

SEQ ID NO: 624134 - RNA, 63 nt, hsa
cucuuguauucgguguccauucaguaucaguauugcugugauauuuugggugccauauugugc

SEQ ID NO: 624135 - RNA, 63 nt, hsa
guuugccacagccucugccuggaaccuggcucgugcugugaccagaagggaaaggcggcuguu

SEQ ID NO: 624136 - RNA, 63 nt, hsa
ccugcucaguaaagcacuugcaaccgucuguuaugcugugacacauggccccucccccugcca

SEQ ID NO: 624137 - RNA, 63 nt, hsa
cuuugcacaggagccuguuucuaaagaaacccaugcugugaaauagagacuuuucuacugauc

SEQ ID NO: 624138 - RNA, 63 nt, hsa
aacuacuccacguguuuuuccauccaaucacacugcugugauucagggaucuuucuucuaaga

SEQ ID NO: 624139 - RNA, 63 nt, hsa
uuuuucagugagcguggugacugcagagguuagugcugugaaaagcugggcuaaauauucuuu

SEQ ID NO: 624140 - RNA, 63 nt, hsa
ucucccagggcagaggggcgagggagaggcuuuugcugugagaguagccgucacgugucucuu

SEQ ID NO: 624141 - RNA, 63 nt, hsa
uccucuuggacuugagggcauugugaaaagcuuugcugugauuuaaaaaugccagcaauuuua

SEQ ID NO: 624142 - RNA, 63 nt, hsa
aacuugaaaaaaaaaaaagaaauagaagauuccugcugugaauaaacauacuucuuguguaaa

SEQ ID NO: 624143 - RNA, 63 nt, hsa
gagaagguacugaaauaaugaucuuggaauauuugcugugaagggagaaagggagagaaaacu

SEQ ID NO: 624144 - RNA, 63 nt, hsa
ucgugggaaccaauauguacauguuugcaauuaugcugugagaauuuaaauguguuagaugga

SEQ ID NO: 624145 - RNA, 63 nt, hsa
gcaccauuauguuuacuaaucacauguucugugugcugugacgacugucaaagaguaucuggc

SEQ ID NO: 624146 - RNA, 63 nt, hsa
ugacuaguuuguuggacuuaaacgacgauuugcugcugugaacccagcagggucgccucccuc

SEQ ID NO: 624147 - RNA, 63 nt, hsa
uagugguguuuccuccuaggguucccgguggugugcugugaagaugucuuccucucggacccu

SEQ ID NO: 624148 - RNA, 63 nt, hsa
auuguuaaaaacuagacucuaaacaccccuuccugcugugaggauagugggugugacaaugga

SEQ ID NO: 624149 - RNA, 63 nt, hsa
aucuauuggguuccccccuccccccaccuuuuuugcugugaaacugaaauagugaacuuuucu

SEQ ID NO: 624150 - RNA, 63 nt, hsa
uuugguagcccuaacugucugagcaguaguggcugcugugauguaaacuuagggugcugagau

SEQ ID NO: 624151 - RNA, 63 nt, hsa
ccucucucucaaaauaaacuaaccuauucauauugcugugaaugcuuuaucuuggagauagaa

SEQ ID NO: 624152 - RNA, 63 nt, hsa
caaacagugguccuaaaauacgaggucuucacuugcugugaaugacguauccccagucaggga

SEQ ID NO: 624153 - RNA, 63 nt, hsa
cggugcaccuggugacccuggguggaggggacuugcugugaagucuuccucgcccucugcccu

SEQ ID NO: 624154 - RNA, 63 nt, hsa
cacaacucaauuauuucggcaucuuuucaccuaugcugugauuuguuuuuuuuuuuucuucuc

SEQ ID NO: 624155 - RNA, 63 nt, hsa
auuuaauuuuuuaauuuuaauuuuuaauuuuuuugcugugaaggucaagcugaaauuuaccau

SEQ ID NO: 624156 - RNA, 63 nt, hsa
agauggucguaggggagcguguggggcauaaagugcugugaacuuuuccaucuuguuguuuua

SEQ ID NO: 624157 - RNA, 63 nt, hsa
caaaauaugguacaugcuggauaguaguuauguugcugugaaaacuguagggucaaagccuua

SEQ ID NO: 624158 - RNA, 63 nt, hsa
aaauaaaaccaaguucuugacauuggucuguuuugcugugaauauuggaaaugcuuaggaucu

SEQ ID NO: 624159 - RNA, 63 nt, hsa
uuuugcuucuaggauauaguauguuguauaugaugcugugauugcccuggaguuccugccaug

SEQ ID NO: 624160 - RNA, 63 nt, hsa
gggaugagugacuuuauugauuugagcagcauaugcugugauuggcugcccugcaaauuuguu

SEQ ID NO: 624161 - RNA, 63 nt, hsa
aagcugcugugcuuccccguccacguguaucucugcugugacacacugagcugacgcacauuu

SEQ ID NO: 624162 - RNA, 63 nt, hsa
ccccugacuuaucccaagcaugcuuccuuuagcugcugugagaauuugucuuccucaccagcc

SEQ ID NO: 624163 - RNA, 63 nt, hsa
uuuaugggaagacagagugaugcaccuucccgcugcugugagguugauuaaacuugagcugug

SEQ ID NO: 624164 - RNA, 63 nt, hsa
aaaugagcaguuaagauauaaacaauuuaugcaugcugugacuuagucuauggauuuauucca

SEQ ID NO: 624165 - RNA, 63 nt, hsa
aauuuggaccauucagauuuuauguugguuuuuugcugugaagugcugcgcucuaguaacugc

SEQ ID NO: 624166 - RNA, 63 nt, hsa
uggcaggaugguuugagcacaggagacggagguugcugugagcugagaucgccccacugcuuu

SEQ ID NO: 624167 - RNA, 63 nt, hsa
aauaaaacaugacuuuguuuauuuaaaguuucuugcugugaaaaagaacucccuaccugugag

SEQ ID NO: 624168 - RNA, 63 nt, hsa
uuagcuagcauuagcauaauuaccgacguugcaugcugugaggaggcuacaaaggccaggcug

SEQ ID NO: 624169 - RNA, 63 nt, hsa
aucacugaacuacuaaaguuuuacagaaaguagugcugugauugauugcccuagccaauucac

SEQ ID NO: 624170 - RNA, 63 nt, hsa
cacaaguuucacgauucucauucaaguccuuacugcugugaagaacaaauaccaacugugcaa

SEQ ID NO: 624171 - RNA, 63 nt, hsa
ucaguccagagaugcuggcccucgcccagucuaugcugugaguguccuuaugggugcaagaga

SEQ ID NO: 624172 - RNA, 63 nt, hsa
uggcuccaggcuccucaugaggccaugcaagggugcugugauuuugucccuugccuuccugcc

SEQ ID NO: 624173 - RNA, 63 nt, hsa
cucagccauaaaaaggaaugaaguacugacacaugcugugacaucagugaacccugaaaacau

SEQ ID NO: 624174 - RNA, 63 nt, hsa
uuaaggacaauuuacagcaaaugaaauuuaugaugcugugacaagaaauuuaaagaaucaaaa

SEQ ID NO: 624175 - RNA, 63 nt, hsa
cucugaaaaggccugggagcagaauggcuggccugcugugagcaggagaggagauucuaagaa

SEQ ID NO: 624176 - RNA, 63 nt, hsa
auuaccuuugcuccucuccugugauucccaccaugcugugacccucagcugucucccuuugcu

SEQ ID NO: 624177 - RNA, 63 nt, hsa
cuuagccuccugagcaucugggacuacagccauugcugugaauuacgugagggaaagauauug

SEQ ID NO: 624178 - RNA, 63 nt, hsa
cugcauucugcgagucugugcucauuaacaaugugcugugaccaugugacucagcaauccugc

SEQ ID NO: 624179 - RNA, 63 nt, hsa
gggcccaggcauggucuugugucuuaagacagcugcugugaccaaagggagaauggagauaac

SEQ ID NO: 624180 - RNA, 63 nt, hsa
ggcggcugcuguuuccacacguggacucggaucugcugugacaccgucagcccgacagucucu

SEQ ID NO: 624181 - RNA, 63 nt, hsa
uggggucuucucuguggcugguagacaccaagcugcugugacugaccacgguaccacgggcug

SEQ ID NO: 624182 - RNA, 63 nt, hsa
ugucacugcccccuccccagccuguguccacagugcugugaucccgagggaaguccuccaguc

SEQ ID NO: 624183 - RNA, 63 nt, hsa
ucuuaggcccggccacuucugcuaccuuugcgcugcugugagccucacccugggccccugggc

SEQ ID NO: 624184 - RNA, 63 nt, hsa
ggugugcccauacagacauuccccggagccggcugcugugaacucgcccccguguggauaguc

SEQ ID NO: 624185 - RNA, 63 nt, hsa
gccaugcuguccagcacgggggccgcuggugcuugcugugagacugagcugggcucugagugu

SEQ ID NO: 624186 - RNA, 63 nt, hsa
gcuuccccuucccucuagcaugugggaagggacugcugugaagaaugacagauguggggccuc

SEQ ID NO: 624187 - RNA, 63 nt, hsa
acuuaaugaaauguuaaagccaauuaaaaagcaugcugugaugcccagcuucccuuuccacag

SEQ ID NO: 624188 - RNA, 63 nt, hsa
guaaauuaacagccaccuauagaagaguccaucugcugugaaggagagacagagaacucuggg

SEQ ID NO: 624189 - RNA, 63 nt, hsa
uauaaaauggggauaauagcacuaccuaccaagugcugugaggcucaaaugagccaaagguua

SEQ ID NO: 624190 - RNA, 63 nt, hsa
gacuucccaggagcaccaguccccucacagaggugcugugagcgaggccuccuucgguccagg

SEQ ID NO: 624191 - RNA, 63 nt, hsa
uucaaguaugucuguuguaaccaauaaguuuauugcugugaaauuacuucugaugguagagaa

SEQ ID NO: 624192 - RNA, 63 nt, hsa
uaugcguuucauguagccagcagaacugaagugugcugugacaagccaaugugaauuucuacc

SEQ ID NO: 624193 - RNA, 63 nt, hsa
cgggacccacggggaccaaggucacacguuccgugcugugaagcuguccagaugugccucuuu

SEQ ID NO: 624194 - RNA, 63 nt, hsa
uugugccaaaggucacuuuucuuuccugccuucugcugugagcccugagauccuccucccagc

SEQ ID NO: 624195 - RNA, 63 nt, hsa
ugacucauauccccuauuuaacagggucucuagugcugugaaaaaaaaaaugcugaacauugc

SEQ ID NO: 624196 - RNA, 63 nt, hsa
augucccacuuuuuuaaccacuccgcacaucagugcugugaaggcaaccucaccauguauuuu

SEQ ID NO: 624197 - RNA, 63 nt, hsa
uaaugucauacaaaaaauguauuuguuuuuuugugcugugagaauugauguuuguagauuaau

SEQ ID NO: 624198 - RNA, 63 nt, hsa
uccuugcuuuucauggaaacacaguaaccuguaugcugugauuccuguucacuacuguguaaa

SEQ ID NO: 624199 - RNA, 63 nt, hsa
cugcagaugucuaacacauaagccaggacauucugcugugagugacuuauuguacccaacucu

SEQ ID NO: 624200 - RNA, 63 nt, hsa
gagucccagaauugcugacagcagaggcuuugcugcugugaaucccaccugccaccagccugc

SEQ ID NO: 624201 - RNA, 63 nt, hsa
cagaaccagaccccgagccacucgcuuccucugugcugugacaacauuggugccaggggagau

SEQ ID NO: 624202 - RNA, 63 nt, hsa
cacgucucccucauauacacagacccaggauuaugcugugagccugcaggcuuuggaaguggc

SEQ ID NO: 624203 - RNA, 63 nt, hsa
cccacccucugguccuucugaccccacuuaugcugcugugaauuuuuuuuuuaaaugauucca

SEQ ID NO: 624204 - RNA, 63 nt, hsa
uugaauuccuccacuuucuuauauagccucagaugcugugaugucugaccuuguggauauuug

SEQ ID NO: 624205 - RNA, 63 nt, hsa
ccggcccugccuguagauacgccccgcugucugugcugugagagucgccgcucgcuggggggg

SEQ ID NO: 624206 - RNA, 63 nt, hsa
uuugcagaguuuuaaguuguucugucugaacucugcugugaucccaugaugugacccugaugg

SEQ ID NO: 624207 - RNA, 63 nt, hsa
aacuaaggugcuaaaucugcgaucaucgucauuugcugugaacugaaauuaaaacuauucaug

SEQ ID NO: 624208 - RNA, 63 nt, hsa
gagaaguauguaguaccucgguauuaacagaccugcugugaugcaguuacacuuucacguauu

SEQ ID NO: 624209 - RNA, 63 nt, hsa
gucccagcuacucaggaggcugaggcaggagaaugcugugaacccuggaggcagagcuugcag

SEQ ID NO: 624210 - RNA, 63 nt, hsa
acauauucaauucuugcuaacauagcaguacuuugcugugagcaggucagcaggaacccuuuu

SEQ ID NO: 624211 - RNA, 63 nt, hsa
uacaauuaguuugaaaaauuggagauuuugauuugcugugaugaaaauccuggauggcugacc

SEQ ID NO: 624212 - RNA, 63 nt, hsa
uucugccaggccucgagcauccaagcaugauuuugcugugacaaaucuaaaaucaaccaggcu

SEQ ID NO: 624213 - RNA, 63 nt, hsa
ugccaggccccaagcaucugagcaugaugauuuugcugugacaauucuaagaucaaccagguu

SEQ ID NO: 624214 - RNA, 63 nt, hsa
gauuucauuaauggaucuugugaauggguugauugcugugaaaauaaugcccccuuuccccuu

SEQ ID NO: 624215 - RNA, 59 nt, hsa
agggcacacugacagccuagaggugguuaugcugugacgcugcugucucuaaccaccaa

SEQ ID NO: 624216 - RNA, 63 nt, hsa
gaacacuauuccuauaagauagcugaaagaagcugcugugaggagcucagcuccaaacacagg

SEQ ID NO: 624217 - RNA, 63 nt, hsa
aauuuguagaacucaucuaacuaaaguaaauucugcugugacuaauccaauauacucagaaug

SEQ ID NO: 624218 - RNA, 63 nt, hsa
uggaaggaccgcuuaagcccagguguucaaggcugcugugagcuguguucgagccacuacacu

SEQ ID NO: 624219 - RNA, 63 nt, hsa
cugcagaauagauuuaagucgcuguguuuucugugcugugauguccuuguacugucuuaaguu

SEQ ID NO: 624220 - RNA, 63 nt, hsa
cuucucccuuuuaucccaauaaguuauugcuacugcugugaggccauagguacuagacaacca

SEQ ID NO: 624221 - RNA, 63 nt, hsa
ggugaacaggauuguuacuuuuaagccuaccucugcugugacccaucaugugggucuuuuguu

SEQ ID NO: 624222 - RNA, 63 nt, hsa
uucuguuguacuuuaauuauuguuuugccuuguugcugugaccucccuaagacacugaagaua

SEQ ID NO: 624223 - RNA, 63 nt, hsa
aaaaagucaucuguucauuaggagaacucaaguugcugugacuuuucucauccaaaagacuca

SEQ ID NO: 624224 - RNA, 63 nt, hsa
aaauaucuguacuucuucgaucuucaccuuuugugcugugauucuucaguuucuaaaccagca

SEQ ID NO: 624225 - RNA, 63 nt, hsa
aauccuauuuauauuauuuuucaguccugugaaugcugugaaaagauuuauuccuuugaggcc

SEQ ID NO: 624226 - RNA, 63 nt, hsa
guguguguguguguguauauauauauauaugcaugcugugaaacuugacuacacaacauaaau

SEQ ID NO: 624227 - RNA, 63 nt, hsa
ccuggccccuugcuguucccaagugcacgaugcugcugugacugaggaguggaugaugcucgu

SEQ ID NO: 624228 - RNA, 63 nt, hsa
caucgagaggucuggaugguuuuauagcaacuuugcugugauuccguuuguaucuguaaauau

SEQ ID NO: 624229 - RNA, 63 nt, hsa
aaggauccucaccacccaaaggguggugggcacugcugugaccaccccagcugcagagucagu

SEQ ID NO: 624230 - RNA, 63 nt, hsa
gcuuuaggcaccaucuguucccaucgcgccugcugcugugacccguuuuggaaaacuggugug

SEQ ID NO: 624231 - RNA, 63 nt, hsa
gucaugagaaugcaacaggagcaaaccaaguguugcugugacauugauucagauguuuggcaa

SEQ ID NO: 624232 - RNA, 59 nt, hsa
aggggcuggcggccgccugagaccugagcugcugugaaagccccugcacaaucagccag

SEQ ID NO: 624233 - RNA, 63 nt, hsa
ucucggccuugggaaggaaggcagugccugcucugcugugagccgccaggaacccuccuccug

SEQ ID NO: 624234 - RNA, 63 nt, hsa
gaucauuucaugaggaucuuuccuuugacugggugcugugaggacacaccugggucugugccu

SEQ ID NO: 624235 - RNA, 63 nt, hsa
caagcaggcugcauuuuagcuauggaagugaccugcugugacacugugcucucuucugugggc

SEQ ID NO: 624236 - RNA, 63 nt, hsa
gaggaaugauccuagugguaggucagaagaagaugcugugaacaccaggacuuuaaucuuaug

SEQ ID NO: 624237 - RNA, 63 nt, hsa
auuugcuacugucauuuccucuaguaucacuuuugcugugaugauguguucuuguguauuaua

SEQ ID NO: 624238 - RNA, 63 nt, hsa
ucccacaagcccaccgcugugcguguugaggggugcugugagaaggcugugcccauguggggc

SEQ ID NO: 624239 - RNA, 63 nt, hsa
gaagccccauccccccugccaccgggcgaucccugcugugagccgaagcucucccugccccgc

SEQ ID NO: 624240 - RNA, 63 nt, hsa
gacgaaaacucacgcccuugcccuaacgcgcuuugcugugagccuggccccugcccagggcuu

SEQ ID NO: 624241 - RNA, 63 nt, hsa
ugcugcagacagcuuaucucccuaacccugaaaugcugugagcuugacuugacucccaacccu

SEQ ID NO: 624242 - RNA, 63 nt, hsa
aaaucaguugcgcguucugaaauauuuuaccacugcugugaacaagugaacacauugugucac

SEQ ID NO: 624243 - RNA, 63 nt, hsa
ccuuaaacuuugggguugcuuucugcaaaaaguugcugugacucaugccauagacaagguuga

SEQ ID NO: 624244 - RNA, 63 nt, hsa
ggggggccuuccuuuccuccugggcaccccgugugcugugaucuccugggcuuucaggcuuga

SEQ ID NO: 624245 - RNA, 63 nt, hsa
ggagggucuugucugcugugauucgacucuggaugcugugagcuugaugcuggccagggaagc

SEQ ID NO: 624246 - RNA, 63 nt, hsa
uuccccggguugguggccauggagggucuugucugcugugauucgacucuggaugcugugagc

SEQ ID NO: 624247 - RNA, 63 nt, hsa
cugugaacugggacagaagcagaggaggcugccugcugugauacccccuuaccucccccagug

SEQ ID NO: 624248 - RNA, 63 nt, hsa
cuaugaaacacacaggguucuagauuugaacucugcugugaagugacuggaagggagcagagg

SEQ ID NO: 624249 - RNA, 63 nt, hsa
gcaaagggugcauuucaggguguggccaccaggugcugugaguuucuguggcucauggccucu

SEQ ID NO: 624250 - RNA, 63 nt, hsa
caagaaugauuggugcuuauuuuuucaaaaauuugcugugaacaacgugaugacaacaagcaa

SEQ ID NO: 624251 - RNA, 63 nt, hsa
uucuaccugcuuggccuggggccucuggaagucugcugugaauuuguauucccuuucaccucc

SEQ ID NO: 624252 - RNA, 63 nt, hsa
cugugaauugaaauguucguuuucuccugccugugcugugacucgagucacacucaagggaac

SEQ ID NO: 624253 - RNA, 63 nt, hsa
accagcuggccugcugcucugcacagcaccggcugcugugaagacucuggccauggugacugg

SEQ ID NO: 624254 - RNA, 63 nt, hsa
gacauggucagauuuccagcucccccuacucccugcugugaaacaaucccucucccugugaga

SEQ ID NO: 624255 - RNA, 63 nt, hsa
uccuuucccucugcccugccauuccuauuacaaugcugugaaaaaaguucugcuucuuaggug

SEQ ID NO: 624256 - RNA, 63 nt, hsa
cauagugagagcagugguggagcaauagaagauugcugugacaccaggcugcuuacugucuuu

SEQ ID NO: 624257 - RNA, 63 nt, hsa
acuucaggagucacugauucagcacuaauuuccugcugugaaaacucaucuuucauuuuugcc

SEQ ID NO: 624258 - RNA, 63 nt, hsa
aauuugcuguaaagcuuuggacauacacuuagcugcugugagccacuaauaacauugggcuaa

SEQ ID NO: 624259 - RNA, 63 nt, hsa
uagcugcuuccuggacgugcgcgcccaggccagugcugugagcaggcggggaggaggcugccg

SEQ ID NO: 624260 - RNA, 63 nt, hsa
uguaaaauggacacacaauccuccuccagggacugcugugaaaucaagaaaucggaaaauacu

SEQ ID NO: 624261 - RNA, 63 nt, hsa
cgccccaccuugcagcuaaaugugauccugccuugcugugaaauuucuguaccuucaaccugg

SEQ ID NO: 624262 - RNA, 63 nt, hsa
gcacuccccacccugcucccuucccagagggauugcugugaaauuuuuuugguggcaaauaaa

SEQ ID NO: 624263 - RNA, 63 nt, hsa
ggcucuucauccucuucaaaaaauuugcaugucugcugugaauuuucaucuaguuccccaauc

SEQ ID NO: 624264 - RNA, 63 nt, hsa
agaauuuucacugguugccugcaucuuuggcucugcugugaucugauuggaggagggacaguu

SEQ ID NO: 624265 - RNA, 63 nt, hsa
uguaaauacauaaaaaauauacaaauuuuuggcugcugugaagauguaauuuuaucuuuuaac

SEQ ID NO: 624266 - RNA, 63 nt, hsa
ugggcuucacuggagaaauggacuuacugcaaaugcugugauguuucuuagaggaacuucaua

SEQ ID NO: 624267 - RNA, 63 nt, hsa
gcauccaguagaggacuggcguuggagucacacugcugugaaaucacguugcaguccagcgca

SEQ ID NO: 624268 - RNA, 63 nt, hsa
gcucaauuuccugauuguaguagagguuaagauugcugugagcuuuaucagauaagagaccga

SEQ ID NO: 624269 - RNA, 63 nt, hsa
uguauauccccaguugucagcagacccggacaaugcugugagagaagcauuggggcacaaaua

SEQ ID NO: 624270 - RNA, 63 nt, hsa
ggagucgccacagauguacccacuagcccagguugcugugagucagcggaagcucccguuaug

SEQ ID NO: 624271 - RNA, 63 nt, hsa
gaacggcgucacuucucagacacugaagaacucugcugugaagcaaaacacucaaaccuuuaa

SEQ ID NO: 624272 - RNA, 63 nt, hsa
uacauaaaaaaguguuuacccugaaauucaggaugcugugauacacugaaaggaaaaauguac

SEQ ID NO: 624273 - RNA, 63 nt, hsa
gcagcaggugaccuccccuuccagacccagccaugcugugauaccggcggaccaggacugcag

SEQ ID NO: 624274 - RNA, 63 nt, hsa
guuguuuuaguuuugggauauuacaaauaaagcugcugugaacauuuguguacaagucuguau

SEQ ID NO: 624275 - RNA, 63 nt, hsa
uuaaacaugaaugaagauagguuguaaacugaaugcugugauaauacucuguauucuuuaugg

SEQ ID NO: 624276 - RNA, 63 nt, hsa
aucucagauacuauuuuugcaaagaaacuuuggugcugugaaaggggugagggacaucccuaa

SEQ ID NO: 624277 - RNA, 63 nt, hsa
ggagagggucugaagccugugcugucugcugcuugcugugaauggcccucccgggucaugaca

SEQ ID NO: 624278 - RNA, 63 nt, hsa
auuuagucuuuaaauuuuuuagguuaauuuucuugcugugauauauaugaggaauuuacuacu

SEQ ID NO: 624279 - RNA, 63 nt, hsa
caagaacuccucccacccaacuuccccuuagagugcugugagaugagaguggguaaaucaggg

SEQ ID NO: 624280 - RNA, 63 nt, hsa
cagugggcagcaggucugaguacucucauaugaugcugugauuuuccuggaguugacagaaac

SEQ ID NO: 624281 - RNA, 63 nt, hsa
agaggugaaacaggcaagugaaauggacaccucugcugugaauguuuuagagaaggaaauuca

SEQ ID NO: 624282 - RNA, 63 nt, hsa
uugaauuacucuucaugggcccacauuagguugugcugugaauuacuuaaggcagugauacug

SEQ ID NO: 624283 - RNA, 63 nt, hsa
ugggugaguggaugaaauggagaacagagugagugcugugaacggugugaaauagaagccaac

SEQ ID NO: 624284 - RNA, 63 nt, hsa
cuggcguaaguggcccacaucauggggaaggagugcugugauugacuaguaauggcuaccacg

SEQ ID NO: 624285 - RNA, 63 nt, hsa
gugcggcccuugcugcuggagaucugaggucacugcugugagcugggagaacugcuguguacc

SEQ ID NO: 624286 - RNA, 63 nt, hsa
uguguuuacuuagaugugaagaguucuccuuacugcugugauggaauaacaagggucagauuu

SEQ ID NO: 624287 - RNA, 63 nt, hsa
uuuguuuccagguuugguuauuaugaauaaaguugcugugaauacuuacguguaagucuuuuu

SEQ ID NO: 624288 - RNA, 63 nt, hsa
cacuaacaugcuauauaaaauguuaaagucugaugcugugaaagcaaucuagugcuauauuuc

SEQ ID NO: 624289 - RNA, 63 nt, hsa
auaagcauccaccccaaauguugguuguauuuaugcugugauaaaaauaggugagagaucaua

SEQ ID NO: 624290 - RNA, 63 nt, hsa
gcugacagugaccaagacacuaacaaaggcuccugcugugacaugucuguuagggaggcacuc

SEQ ID NO: 624291 - RNA, 63 nt, hsa
cauuagugaauauuuaguuguuuucauaaacgaugcugugaugaagacucauguacauauuua

SEQ ID NO: 624292 - RNA, 63 nt, hsa
uuuucauugauauaaauacuuguacuguacuucugcugugagauucccuagugucaaaauuaa

SEQ ID NO: 624293 - RNA, 63 nt, hsa
acaaaacaauguucuugguuuuaauguuccaguugcugugaaauagaacuccuacaaucaaaa

SEQ ID NO: 624294 - RNA, 63 nt, hsa
guggagagaugagaagaauauaugcagcaaaggugcugugagcccaguuccaacggcuguguu

SEQ ID NO: 624295 - RNA, 63 nt, hsa
gcgcugcucuggguggguuagcaaccccagggcugcugugauaggaagucccuguuguucucc

SEQ ID NO: 624296 - RNA, 63 nt, hsa
auuggaucagugugaguccugaagcacuuucagugcugugagaacgacauccacuuuggguuu

SEQ ID NO: 624297 - RNA, 63 nt, hsa
ucuaaaacagcacuaucgagguauuugguaacuugcugugaaaugacugcaucaugcaugcac

SEQ ID NO: 624298 - RNA, 63 nt, hsa
ucacagaccucugcuuggaguauuuaggaugacugcugugaaauggagaacaguuucaucagg

SEQ ID NO: 624299 - RNA, 63 nt, hsa
uaagugaagggaaauaaaccucgucaugcuccaugcugugagguguccuuuggauauucugug

SEQ ID NO: 624300 - RNA, 63 nt, hsa
cacauuuuguguagacaauuuuaaugucagugcugcugugaacuaaaguaugucauuuaugcu

SEQ ID NO: 624301 - RNA, 63 nt, hsa
cauagauggagaguuugagggcuuucgcagaaaugcugugauucuguuuuaaguccauaccuu

SEQ ID NO: 624302 - RNA, 63 nt, hsa
uuuuucuucuguuguauccauuugaguccugcaugcugugaaaugcugagaacagaagcauua

SEQ ID NO: 624303 - RNA, 63 nt, hsa
aaugaauuuccuuuaccuuucuggaacacaagcugcugugaaccaaacugauaucaagugauu

SEQ ID NO: 624304 - RNA, 63 nt, hsa
caucuuuuuuaaaaacaaauaaaugaauaaagcugcugugacacacacacaaaaggaauuuaa

SEQ ID NO: 624305 - RNA, 63 nt, hsa
cuuccuuccccaccagggaggacaacaucuucaugcugugauugaagcauccauucagaacac

SEQ ID NO: 624306 - RNA, 63 nt, hsa
ucaguuucccucuguauacaaggaucagauucuugcugugacccaagaacuccugaaaucaua

SEQ ID NO: 624307 - RNA, 63 nt, hsa
agggagcagacagugagcaaacgccagcagggcugcugugaauuuguguaaggauugagggac

SEQ ID NO: 624308 - RNA, 56 nt, hsa
gaaagagaguccagaaguaauucagaugcugugaaccagauuuccuuuucuuuguu

SEQ ID NO: 624309 - RNA, 63 nt, hsa
ugcaccagagcacgcacaggagccugggcgcgcugcugugaaacguccugaccugugaucaca

SEQ ID NO: 624310 - RNA, 63 nt, hsa
cucuccacagcugccucuucccucuuccuucccugcugugaaagaaguaacuacaguuagggc

SEQ ID NO: 624311 - RNA, 63 nt, hsa
ugagccaccgugcccggcuauuuucaguucuuaugcugugaccacuuugccuuguagcuuuuu

SEQ ID NO: 624312 - RNA, 63 nt, hsa
acauuuagaagauuacuuugggcuggugggacaugcugugaauuuagauuacaaaugaauauu

SEQ ID NO: 624313 - RNA, 63 nt, hsa
gcauuauacacaguagagaagaacugaagacacugcugugacaguauugcaguccaaggcauc

SEQ ID NO: 624314 - RNA, 63 nt, hsa
gguucccacucuuucgugguuccuaacgugaagugcugugauguuucugcccugccuaaggaa

SEQ ID NO: 624315 - RNA, 63 nt, hsa
aaaugaccauuguuuauaaacaguuaugaaaaaugcugugacuugaaaucuuucccacaucuc

SEQ ID NO: 624316 - RNA, 63 nt, hsa
agaguuguuuucaguuuuuugcccuaauaaagcugcugugaacauucauguacagguuuuuau

SEQ ID NO: 624317 - RNA, 63 nt, hsa
gcccgagccgauggcgccugugcugaggauuugugcugugauuugggcaaaucauuccagguc

SEQ ID NO: 624318 - RNA, 63 nt, hsa
aaggggaagauaagauuucugucuacuaagugaugcugugauaccuuaggcacuaaagcagag

SEQ ID NO: 624319 - RNA, 63 nt, hsa
cuuguccuccucggcccugccccacuucagggcugcugugagauggaauuccaggaaagaacu

SEQ ID NO: 624320 - RNA, 63 nt, hsa
aaggcagcgugccgagccagcaagaggaaggggugcugugaggcuugcccaggagcaagugag

SEQ ID NO: 624321 - RNA, 63 nt, hsa
gcagggacaggucuugggucuuugucaucuuggugcugugagagguaggagggcagccugccc

SEQ ID NO: 624322 - RNA, 63 nt, hsa
uuuagaauuuuauuucccugauucaguuuuugcugcugugaaacagcucugaugaacacuaaa

SEQ ID NO: 624323 - RNA, 63 nt, hsa
ccacuaacuuucucacuaagugagaaugagaacugcugugauagggagagugaaggagggaua

SEQ ID NO: 624324 - RNA, 63 nt, hsa
acaaaaccccucacuuccucugagagggccaaaugcugugagucugaaguaugugccuggugu

SEQ ID NO: 624325 - RNA, 63 nt, hsa
caggcauuaaauaaaaccgaggguuguugauuuugcugugacaguacacuaaaucaauacuau

SEQ ID NO: 624326 - RNA, 63 nt, hsa
ugcauuucacuuuguggucaggccgugucuuugugcugugacugcaucaccuuuauggagugu

SEQ ID NO: 624327 - RNA, 63 nt, hsa
accccugccaaaacuacccuuucccccauggggugcugugaaacucaaggagaugacugugga

SEQ ID NO: 624328 - RNA, 63 nt, hsa
uuggacaggcccagucuucucccaucauugcccugcugugacuccaaagaaaggagcuucuug

SEQ ID NO: 624329 - RNA, 63 nt, hsa
uaaauggaccacaacucuggggugucguuuuugugcugugacuuccuaauuauugcuaaagaa

SEQ ID NO: 624330 - RNA, 63 nt, hsa
ccagcaugcaggaaggaguuuggagagaguguuugcugugauccauugaaagcuccacauuaa

SEQ ID NO: 624331 - RNA, 63 nt, hsa
aagagggauaaaccuuuggaggggucaugaugcugcugugaagauaaaaguagaauauaaaag

SEQ ID NO: 624332 - RNA, 63 nt, hsa
cuuuguguguugcaucaaacagaagauucugacugcugugacuuuguaccgcaugaucaacuu

SEQ ID NO: 624333 - RNA, 63 nt, hsa
guucacuaauacuuuccuuuucaaugucaagacugcugugaggcccauccaguguacuuugca

SEQ ID NO: 624334 - RNA, 63 nt, hsa
uugcacaaaguauauccuaugcaauuucugauuugcugugaaaucagaaagcagguauacacu

SEQ ID NO: 624335 - RNA, 63 nt, hsa
aauguauacguguuaggguaaaacucguugaagugcugugauuguccuguauucaauuuugua

SEQ ID NO: 624336 - RNA, 63 nt, hsa
gcucugacacgucccuugcaaagucuccgcaggugcugugaagagccuuccaugguagagauu

SEQ ID NO: 624337 - RNA, 63 nt, hsa
ggagaaaugcuuagaaauucagcauuugacccuugcugugaauuaagcccaauuaauuccugu

SEQ ID NO: 624338 - RNA, 63 nt, hsa
cucuuagcauucaaacugcagauacuaaacagaugcugugauuuauuaaagaguuagccauau

SEQ ID NO: 624339 - RNA, 63 nt, hsa
uggccuugcagagcucaagaagggggcuuccaaugcugugagaauuccgagcuguucccuggg

SEQ ID NO: 624340 - RNA, 63 nt, hsa
guguagaagguguaaacuauuuugggcuugaugugcugugaauguugcuuuuuuuuuuccuuu

SEQ ID NO: 624341 - RNA, 58 nt, hsa
uacaggcucugacccagugacuuccaaaugcugugaccuguuuggcucccaucuauac

SEQ ID NO: 624342 - RNA, 63 nt, hsa
uccauuucauuuuugcuuuacuuugcauuugauugcugugaagaugaaagcauuagacuuuua

SEQ ID NO: 624343 - RNA, 63 nt, hsa
caggaagugggaguguuuuuauuguuagcuaauugcugugacugcaggaagugggaguguuuc

SEQ ID NO: 624344 - RNA, 63 nt, hsa
uuagugguguugcagcugucuacuggcugcaugugcugugaauaucccaaggaacuggcugug

SEQ ID NO: 624345 - RNA, 63 nt, hsa
cccuggcaacccagcaccggggaagccgucagcugcugugacaauaaaaccugccccgugucu

SEQ ID NO: 624346 - RNA, 63 nt, hsa
aaaucccuccccacguggggaugagaaccuuccugcugugaugugacaccuucggggacauug

SEQ ID NO: 624347 - RNA, 63 nt, hsa
uuugugcaaccagggcccacggcgccccuccugugcugugacgugugugucguggcuggcccc

SEQ ID NO: 624348 - RNA, 63 nt, hsa
cgccuaccgcccuggccgugucugucuggugugugcugugaaccccugcacccaaccccacau

SEQ ID NO: 624349 - RNA, 63 nt, hsa
ccugcagacgucugguggcagcgucuacuccauugcugugacaaaucaccacauugucugugg

SEQ ID NO: 624350 - RNA, 63 nt, hsa
guggccuugagguuggugugcacaggcacuggcugcugugagugggggggcauggggcaguuu

SEQ ID NO: 624351 - RNA, 63 nt, hsa
agacgguuucugauuuuuccacuauuuaaauaaugcugugaugaauaucuuuaaaaucuucug

SEQ ID NO: 624352 - RNA, 63 nt, hsa
cacgaggcccuugaggaaugaugaugcacauucugcugugaggaggcccagaaaaggccaacc

SEQ ID NO: 624353 - RNA, 63 nt, hsa
ugggucuccauccuccaugggggcucagccaggugcugugacaccccccuucugaaugaagcc

SEQ ID NO: 624354 - RNA, 63 nt, hsa
agaagaggccgaggagugaggcagcagccucuaugcugugauuuccacaccggguccgugcag

SEQ ID NO: 624355 - RNA, 63 nt, hsa
cugcagcuccaaggaacauugccucucuggaucugcugugaccaggguguggcugacaccugg

SEQ ID NO: 624356 - RNA, 63 nt, hsa
acuggauggcaagaaugcugcugaugguggaacugcugugaccuuaggacuggcuccacaggg

SEQ ID NO: 624357 - RNA, 63 nt, hsa
auccuguugauaguaguuuguuuuuguggugggugcugugaagaguaaacauuacucagugga

SEQ ID NO: 624358 - RNA, 63 nt, hsa
aaaaugcucaacccuguguccugggccugggccugcugugacugaccuacaguggacuuucuc

SEQ ID NO: 624359 - RNA, 63 nt, hsa
agguaggaggaucgcuugagccuggguagaggcugcugugagcugaaauggcgccacugcacu

SEQ ID NO: 624360 - RNA, 63 nt, hsa
agacugaucucaaaucugaacugcagcuuucgcugcugugaguuggggauaugauagucagcu

SEQ ID NO: 624361 - RNA, 63 nt, hsa
auccacacaggaugccggagagacagccccuugugcugugagcagagcaggcaguggcucugg

SEQ ID NO: 624362 - RNA, 63 nt, hsa
gcagggugccugaccugugugccggcugcucacugcugugaccagcagccgagcccuuggccc

SEQ ID NO: 624363 - RNA, 63 nt, hsa
ccggugccucggucacucugggggcaguuuagaugcugugaaauuaaaccuguucuaagugua

SEQ ID NO: 624364 - RNA, 63 nt, hsa
ggccccugacgugcagccacacacagaaaaggcugcugugaacauuuuaugcuucgacuuuuu

SEQ ID NO: 624365 - RNA, 63 nt, hsa
gugggaacaacugggccugggauggggcuucacugcugugacuuccuccugccaggggauuug

SEQ ID NO: 624366 - RNA, 63 nt, hsa
gggcggcugcaccuggcugucaccugggugugcugcugugagggguccuugcguggcccccau

SEQ ID NO: 624367 - RNA, 63 nt, hsa
ggcccagaggacuggggugacucacgggcccugugcugugauguugagagcugagaaaaaccu

SEQ ID NO: 624368 - RNA, 63 nt, hsa
ugugaaaucugcaaaaagagcugacauuccagcugcugugaucaugaauuuggggguguacug

SEQ ID NO: 624369 - RNA, 63 nt, hsa
auuaaauaaguguuguuuucuccucuuuaauauugcugugaacaguggugcccauuguagcau

SEQ ID NO: 624370 - RNA, 63 nt, hsa
ccauuccugauuugacagguuucuggucagaauugcugugaggaaaagaggaaucccuccucc

SEQ ID NO: 624371 - RNA, 63 nt, hsa
cuccucagggcaccagaggacucacucacugguugcugugaugauauccagugucccucugcc

SEQ ID NO: 624372 - RNA, 63 nt, hsa
cauuuuuuugacucuuggccaaaauuuagaagaugcugugaauaucauuuugaacuuguguaa

SEQ ID NO: 624373 - RNA, 63 nt, hsa
ggcucugaagccaagggccgucccgugccacggugcugugaguauuccuccguuagcuuuccc

SEQ ID NO: 624374 - RNA, 63 nt, hsa
uccaggcuucaggccugaacaaaacaggcuguuugcugugaggagcuagaugacaccaagaca

SEQ ID NO: 624375 - RNA, 63 nt, hsa
uuugcagacugauuucauuggauggauacuuaaugcugugaaacaugauaggauuaacauaau

SEQ ID NO: 624376 - RNA, 63 nt, hsa
gaacuuagaugugaaaaucuacacacugggagaugcugugagccccaagguuuugauggaguu

SEQ ID NO: 624377 - RNA, 63 nt, hsa
gucauuugcaaaacacacauaauaccgucagagugcugugaaaaaccuuaaggguguguggau

SEQ ID NO: 624378 - RNA, 63 nt, hsa
accgguuggccaugagaucuccccacuuaaaggugcugugagcuugucucuaagauauauacc

SEQ ID NO: 624379 - RNA, 63 nt, hsa
cucgccgucccucccaggucgggcaguggaggcugcugugaaaacucugguacgaaucucauc

SEQ ID NO: 624380 - RNA, 63 nt, hsa
gagagccgucuucagcugggcugggguuggggcugcugugaggaaaaccugccauuguggccc

SEQ ID NO: 624381 - RNA, 63 nt, hsa
gucauccaugcccucccaggacccuccacucacugcugugagugcgccucaccagaaccaguu

SEQ ID NO: 624382 - RNA, 63 nt, hsa
ggguaaaggguauuuuaacuuagggguaguuccugcugugagugguuacagcugauccucggg

SEQ ID NO: 624383 - RNA, 63 nt, hsa
cagcaacccucaguacauacuaaguaugcucagugcugugaaaguggauuacaccaaauuaag

SEQ ID NO: 624384 - RNA, 63 nt, hsa
uuuggaaguuuuaacuucaaugaaguaauuauuugcugugaaagaaacaaacauugaauuacu

SEQ ID NO: 624385 - RNA, 63 nt, hsa
guccaaccuaaccaguccccaguuccccagcccugcugugacuuccauuuccaucguccuuuc

SEQ ID NO: 624386 - RNA, 63 nt, hsa
aacuaacaagacugguccaguacccuucaaccaugcugugaucggugcaagucaagaacucuu

SEQ ID NO: 624387 - RNA, 63 nt, hsa
ggaacugggccugcagccuuccucuucugggacugcugugaggcagaggaaugauggagaauc

SEQ ID NO: 624388 - RNA, 63 nt, hsa
uuuucuuucacugauaccacugaauggaacuggugcugugacuccugcugcuggggauuuaug

SEQ ID NO: 624389 - RNA, 63 nt, hsa
cucaugggacaccuuucccacagccuccucgauugcugugagcagaggccacucggaguuagg

SEQ ID NO: 624390 - RNA, 63 nt, hsa
agugagccuucagugggugcaaggcgccauacuugcugugagagagcugaguagaguguuggu

SEQ ID NO: 624391 - RNA, 63 nt, hsa
cugcucauuaaacugauuccaggagauuggauuugcugugacuagauacagauggagcaaaug

SEQ ID NO: 624392 - RNA, 63 nt, hsa
cuucgccccaucucccaaauaagugggcccuugugcugugaggaagaccaaagccucagggaa

SEQ ID NO: 624393 - RNA, 63 nt, hsa
cuguuccuguuuguguguuugaauagucugaaaugcugugacuuuuuuugugugaauaaagau

SEQ ID NO: 624394 - RNA, 63 nt, hsa
gcugccugcacacuguagacgucccagggccugugcugugaucaccugccuuuggaccacauu

SEQ ID NO: 624395 - RNA, 63 nt, hsa
cccuugcccggggcagaggcagaagcccacauaugcugugacgcuggccaccuuuucucagcu

SEQ ID NO: 624396 - RNA, 63 nt, hsa
gcaucgcugugugaggacggcacggccagcgccugcugugagugggucucccaagacuaggcc

SEQ ID NO: 624397 - RNA, 63 nt, hsa
ccaaccccagcccacacauuguaccaucucuucugcugugacuggguugccugaauuuguggg

SEQ ID NO: 624398 - RNA, 63 nt, hsa
aaucuuagacagcaaacucuuucgccaaacgacugcugugaauuuuaccugauuaacauuccu

SEQ ID NO: 624399 - RNA, 63 nt, hsa
aaauaagggccuggagcugaguaguagccagucugcugugaccacaggcucagguccgacccu

SEQ ID NO: 624400 - RNA, 63 nt, hsa
cgugccugccaccucuuugcccccaggcuuuuuugcugugagggagccaccagggggugauuu

SEQ ID NO: 624401 - RNA, 63 nt, hsa
aauuccuuaagccaaaugguguuccaaguugguugcugugacaaccuccaggaagagccacuu

SEQ ID NO: 624402 - RNA, 63 nt, hsa
ccacggggcauuaucuugucugugauuccggguugcugugacagccgguagagccucugcccu

SEQ ID NO: 624403 - RNA, 63 nt, hsa
gaagagcccaggacccaagcgucuuggcaggggugcugugaauguccaguggucccagcuccc

SEQ ID NO: 624404 - RNA, 55 nt, hsa
gugccuccucuugcugcuaaaucucugcugugaacacaccacuuccuuauuacgu

SEQ ID NO: 624405 - RNA, 63 nt, hsa
ugaaccuaggccagcuugcuuagcgggucacccugcugugaaguccuggcagguguugguaau

SEQ ID NO: 624406 - RNA, 63 nt, hsa
ugggcgagccccucggccccucacccuccaggcugcugugagagugucaaguguguaagggcc

SEQ ID NO: 624407 - RNA, 63 nt, hsa
aggaaaaauguaggaauuuauuuuuucuuuaacugcugugaacucacuuugaggggguaggag

SEQ ID NO: 624408 - RNA, 63 nt, hsa
auugcguuaaaaaaaaaauuaacuaaaccaagaugcugugauuuuuuaaguugcaauauguuu

SEQ ID NO: 624409 - RNA, 63 nt, hsa
uguucacucuuccgugucugaugucuugcugaaugcugugacucauaguuuacuuuuguucaa

SEQ ID NO: 624410 - RNA, 63 nt, hsa
gggaguguucccgugccugggagaguggaccugugcugugaguguguggaugcgugugaacgc

SEQ ID NO: 624411 - RNA, 63 nt, hsa
ggcccugggcauuucugcugagaaccaaacugcugcugugauaaccucuccuuuggccccuaa

SEQ ID NO: 624412 - RNA, 63 nt, hsa
uucaguaccauggauuugaaaugaacucauccuugcugugagcauccaggagcccuugagaag

SEQ ID NO: 624413 - RNA, 63 nt, hsa
cagagcuaagcauacaggcuugggggugagcccugcugugagaguucaggcccugggaggcuc

SEQ ID NO: 624414 - RNA, 63 nt, hsa
agucugucgugcaccgaugagaacucuccuuauugcugugaagggcagacaaugcauggcuga

SEQ ID NO: 624415 - RNA, 63 nt, hsa
auguacgcacuaaaaaaaaugugugcuugcugcugcugugagugaaccauugcuuaagauaaa

SEQ ID NO: 624416 - RNA, 63 nt, hsa
uuuucaagcagcaucuucugguuuaaacuuguuugcugugaacaauugucgaaaagagucuuc

SEQ ID NO: 624417 - RNA, 63 nt, hsa
gaucccuccuuugugggucgcacacauguuuccugcugugagcuggggccuccuuccauugca

SEQ ID NO: 624418 - RNA, 63 nt, hsa
aagaaaaaaaaaaaaggugacagccgcaguuggugcugugagaaguguccugggccuuccgag

SEQ ID NO: 624419 - RNA, 63 nt, hsa
gucauuccuaaccugggauuucuagacacauccugcugugauguaaacagaaaucacgaauuc

SEQ ID NO: 624420 - RNA, 63 nt, hsa
aguccccuaaacauacuaugucuuugccacgugugcugugacuucucugugggugauuuaauu

SEQ ID NO: 624421 - RNA, 63 nt, hsa
cggggaggccauggcaugccccgggcguucgcuugcugugaauuccuguccucguguccccga

SEQ ID NO: 624422 - RNA, 63 nt, hsa
ucagcccuuaccuguuugccagccgugaccaccugcugugaggcccgaccacccacccagaau

SEQ ID NO: 624423 - RNA, 63 nt, hsa
gugcgugugaacggcuuuggguccugcugguuuugcugugagcugcaguguucugugggucug

SEQ ID NO: 624424 - RNA, 63 nt, hsa
ucccugcccaaaucugucuccuagaaucuuaugugcugugaauaauaggccuucacugccccu

SEQ ID NO: 624425 - RNA, 63 nt, hsa
gagucuagauucaaagguucuagguuucaaagaugcugugagucuuugguucuaaggaccuga

SEQ ID NO: 624426 - RNA, 63 nt, hsa
aacaaauggcaugugacuuuguaaguguagaauugcugugagguauggggcuaggggcgucag

SEQ ID NO: 624427 - RNA, 63 nt, hsa
caggagaauggcuugaacccaggagguggagguugcugugagccaagaucgcaccauugcacu

SEQ ID NO: 624428 - RNA, 63 nt, hsa
cguugggccgcucugauuucaggcagcaggggcugcugugaugccguccugcuggagugauuu

SEQ ID NO: 624429 - RNA, 63 nt, hsa
cugcuaaaagcgaauguagucaggccccuuucaugcugugagaccuccuggaacacuggcauc

SEQ ID NO: 624430 - RNA, 63 nt, hsa
gaaguagguauaagaaguccuaucucauagggaugcugugagcauuaaauaaagguacacaug

SEQ ID NO: 624431 - RNA, 63 nt, hsa
gagagcagaucugaccacuugccagccccugucugcugugaauuaccauuuccuuuguccuuc

SEQ ID NO: 624432 - RNA, 63 nt, hsa
cggacgccagauggcugcgcgcuuugucagcagugcugugagaaguucuccccuggggugggg

SEQ ID NO: 624433 - RNA, 63 nt, hsa
agaccaagucucacucugucacccacgcuggagugcugugaugcgaucucggcucucugcaac

SEQ ID NO: 624434 - RNA, 63 nt, hsa
gagucuugcucugucacccaggcuggagugcagugcugugaucuuggcucacugcaagcuccg

SEQ ID NO: 624435 - RNA, 63 nt, hsa
acaagauuucccaaagaagaaaggccuuauauaugcugugaauguguuuuugcuuguuaguuu

SEQ ID NO: 624436 - RNA, 63 nt, hsa
agagcccauauuucaccuugaggagggugcugcugcugugacagccugcaguguuuugaaaca

SEQ ID NO: 624437 - RNA, 63 nt, hsa
cuccugaggccggaccccgcccaggcagggagcugcugugaguccagcugaggcccacccagg

SEQ ID NO: 624438 - RNA, 63 nt, hsa
ucccuggugcuggggacugugccaggccaugcuugcugugacuccgccccugcccccucuccc

SEQ ID NO: 624439 - RNA, 63 nt, hsa
accuuguccuuccuggaagccacuagaagccggugcugugaaaauacucuguuuauuaaagac

SEQ ID NO: 624440 - RNA, 63 nt, hsa
cacgagauucacuugaaccugggagguggagguugcugugagcugacaccacgccacugcacu

SEQ ID NO: 624441 - RNA, 63 nt, hsa
uggagccuguuaccuccgcauuugacacgagucugcugugaaccccgcaaccuccuccccacc

SEQ ID NO: 624442 - RNA, 63 nt, hsa
uuuuuuucuguccagguuguucauauaauaauaugcugugagcaucuuuccaugacauuaaau

SEQ ID NO: 624443 - RNA, 63 nt, hsa
aaaagaaguacagauuuuuuaaaaagcuaauauugcugugauucaacucucuaguuacuugau

SEQ ID NO: 624444 - RNA, 63 nt, hsa
accucaugcucugcccagcuuggcuucccaaagugcugugauuacaggcuuaagccacagcgc

SEQ ID NO: 624445 - RNA, 63 nt, hsa
ugcagaggggugaacaggccccaauauuuggggugcugugauaccccucuucuacccacaagg

SEQ ID NO: 624446 - RNA, 63 nt, hsa
ccucggauucccagguuccugccccuuuggggcugcugugacuccgcgaccuaggaaccgugg

SEQ ID NO: 624447 - RNA, 63 nt, hsa
gauagccugauaaacucauccuauuaaaauguaugcugugauacacaggcaaauuugauguua

SEQ ID NO: 624448 - RNA, 63 nt, hsa
uguuuuccugguuuuaagugcuauaaauaaagaugcugugaaaucuacauacagcuuuugcuu

SEQ ID NO: 624449 - RNA, 63 nt, hsa
agugaugccaccuccaagcuuguccuaggugucugcugugaaccuccagugaccccagagacu

SEQ ID NO: 624450 - RNA, 63 nt, hsa
ugacaugaaacagcaggcuacaaaaccacugcaugcugugaucccaauuuuguguuuuucuuu

SEQ ID NO: 624451 - RNA, 63 nt, hsa
aguguuugguacaaggaucuacuaugaacuugcugcugugauaggcaagaaucucaugagaca

SEQ ID NO: 624452 - RNA, 63 nt, hsa
gaaucaugagccugcuggaagcccagccccuacugcugugaacccuggggccugacugcucag

SEQ ID NO: 624453 - RNA, 63 nt, hsa
cuuuugauggcuauguuuuggagagagcaaucuugcugugaaacaguguggauguaaauuuua

SEQ ID NO: 624454 - RNA, 63 nt, hsa
ccuuuuuucucuacauuuuuaauuuauuaaacuugcugugaaaacacuuugauuuucuaagag

SEQ ID NO: 624455 - RNA, 63 nt, hsa
ugcauaccgugaauuuauaguuaaggaucccuuugcugugaggguagaaaaccucaccaacug

SEQ ID NO: 624456 - RNA, 63 nt, hsa
aaugaucagccaccuuaccuucuacuggguaccugcugugagucugccuaugccagaaggauu

SEQ ID NO: 624457 - RNA, 63 nt, hsa
ugcagagccuggccugcucuugugggcugugguugcugugacaguuucguuuucugaaucuuu

SEQ ID NO: 624458 - RNA, 63 nt, hsa
caccaggguuuggggaaaucaccaucccgcggaugcugugaccucccuucuacggagaugcag

SEQ ID NO: 624459 - RNA, 63 nt, hsa
gcaggcacugguuuuguugccccagggcugcuuugcugugaugaugauugcauuucaacacau

SEQ ID NO: 624460 - RNA, 63 nt, hsa
aacauuccguaguuuagaaguagacguugccaaugcugugacucaaggccacggcucuacuaa

SEQ ID NO: 624461 - RNA, 63 nt, hsa
guuugcgugucggcucuugcgguggaguccuguugcugugagggagugcuggccgcaggcagc

SEQ ID NO: 624462 - RNA, 63 nt, hsa
auccccacaugugcacugugguuccaguguagcugcugugagcccacugccacugccucagaa

SEQ ID NO: 624463 - RNA, 63 nt, hsa
cccagagcuaagacagacugcgaaucacuuuucugcugugagggugauggugccugaugcggu

SEQ ID NO: 624464 - RNA, 63 nt, hsa
aaaacucaucuggaguucucaaagaccuggggcugcugugaagcuggaacugcgggagcccca

SEQ ID NO: 624465 - RNA, 63 nt, hsa
auacacuuucccacguugaggugguguguucugugcugugacuauagaaaucuuggucagggc

SEQ ID NO: 624466 - RNA, 63 nt, hsa
ccuguguauuguuuaagcucgccaagucuguguugcugugaaaugaaugaaggagaggcuccu

SEQ ID NO: 624467 - RNA, 63 nt, hsa
uucaggacccaguagccacauguggcuaguggcugcugugacgggcaacacagauauggaaca

SEQ ID NO: 624468 - RNA, 63 nt, hsa
ucacaucauuuuuuauaggguagaucuucauauugcugugauuaaugcauccagauuguuuuc

SEQ ID NO: 624469 - RNA, 63 nt, hsa
cuccugagccuguggguccccacucacccccuuugcugugaggaaugcucugugccagaaaca

SEQ ID NO: 624470 - RNA, 63 nt, hsa
aaugggauggggaaccugccggaguccagaggcugcugugaccaagcccccuuuugugugaau

SEQ ID NO: 624471 - RNA, 63 nt, hsa
ggaacauuuuuuguuuaaagugaacuacagcugugcugugaagagaguucuuuauaaagccug

SEQ ID NO: 624472 - RNA, 63 nt, hsa
cugcucccaggugugcaucuuacuggaugagguugcugugauugagauaguuaaauacaugcu

SEQ ID NO: 624473 - RNA, 63 nt, hsa
cuuugccuaauccaaugaguguuacagagagcuugcugugacuagaaccauaaaucuuaaagg

SEQ ID NO: 624474 - RNA, 63 nt, hsa
aauauguacauaucuagguauaugcuuucucucugcugugaaauuauuuuuagaauuauaaau

SEQ ID NO: 624475 - RNA, 63 nt, hsa
auuuuaugugacugcuuuuuugccucacaauuaugcugugaauuuuacaaaaauuuauuuucu

SEQ ID NO: 624476 - RNA, 63 nt, hsa
uuccacaucagaacucccuucaaacacaaagauugcugugaaaacgaaaauguguagacgcac

SEQ ID NO: 624477 - RNA, 63 nt, hsa
gcauuuuguaagcacuuuggagccacuaucaaaugcugugaagagaaauguacccagauguau

SEQ ID NO: 624478 - RNA, 63 nt, hsa
gcauuuaauaaauaauucuaaugugccauauuuugcugugagugaccuuaacauuuauauuuu

SEQ ID NO: 624479 - RNA, 63 nt, hsa
ggagggaaacugugaaugcuucugauuuagcaaugcugugaauaaaaagaaagauuuuauacc

SEQ ID NO: 624480 - RNA, 63 nt, hsa
gguaguccuguuuuccuaauaacuuuguuacugugcugugaaagauuacagauuugaacaugu

SEQ ID NO: 624481 - RNA, 63 nt, hsa
gacuaggaguccuguugaaauuaggaauaagugugcugugagggaagggcugccuuauuuuag

SEQ ID NO: 624482 - RNA, 63 nt, hsa
aaaguagccaucuccuuguuccagcugaaaaccugcugugagaguuuugacagagcacuuuau

SEQ ID NO: 624483 - RNA, 63 nt, hsa
caggacauuccuucuaugagcgcuucagaauuuugcugugaacaguccucuuggacacagguu

SEQ ID NO: 624484 - RNA, 63 nt, hsa
auauguagucccauuggugcuaaugagaguagcugcugugaaacaggaauaaaaugugucugu

SEQ ID NO: 624485 - RNA, 63 nt, hsa
ucaguggcaggggguauuucaguauuauacaacugcugugaccagacuuguauacuggcugaa

SEQ ID NO: 624486 - RNA, 63 nt, hsa
agccuacugaguagcuuucauuuacugaucaucugcugugacuguggcccugucuggagguuc

SEQ ID NO: 624487 - RNA, 63 nt, hsa
gaugggggagggggauuguuucagcuucucuggugcugugaugccccaggagaguccuaaucu

SEQ ID NO: 624488 - RNA, 63 nt, hsa
aagggcuuggguucugaggaagcagauguuucaugcugugaggccuugcaccaggugggggcc

SEQ ID NO: 624489 - RNA, 63 nt, hsa
uacagccagcauugccccucugugccccauuccugcugugagcagggccguccgggcuuccug

SEQ ID NO: 624490 - RNA, 63 nt, hsa
agcccugcccaaccugauucugaugacugcggaugcugugacggacccaaggggcaaauaggg

SEQ ID NO: 624491 - RNA, 63 nt, hsa
ugagcuggugccugccuugcauuuuccuucuggugcugugaagaccauaggcuggcaggcagc

SEQ ID NO: 624492 - RNA, 63 nt, hsa
gagacugauccucucuguguaaauucugcccggugcugugaaggcuggacgguggaggaccug

SEQ ID NO: 624493 - RNA, 63 nt, hsa
ccuucaggagguggagcucgucgucagcucuccugcugugauguggaagcuucugauauuuga

SEQ ID NO: 624494 - RNA, 63 nt, hsa
cgacaguggaugcuggguccauaucacacacauugcugugaacaggaaacuccugugaccaca

SEQ ID NO: 624495 - RNA, 63 nt, hsa
uuuugguuggguugacacuaacuuuucuuaagaugcugugagaaucauuucauccaaaugcca

SEQ ID NO: 624496 - RNA, 63 nt, hsa
ggcccaggccuucuagcaggaggucuugaagugugcugugaaccgagggaucucaggaguugg

SEQ ID NO: 624497 - RNA, 63 nt, hsa
ccagggaauucccagugaccuccccuccacaccugcugugauccugccaacauuuagcuuugg

SEQ ID NO: 624498 - RNA, 63 nt, hsa
ccucccacacaguuggacccgugauucucagggugcugugauggggugaggguagggggagca

SEQ ID NO: 624499 - RNA, 63 nt, hsa
cacggaaacaaccaucuggggacugcugggaaaugcugugaaugcggagggaagugauguuug

SEQ ID NO: 624500 - RNA, 63 nt, hsa
ggacagggccagauuucauguugacccuggggaugcugugaauuucuccugcaggagagacau

SEQ ID NO: 624501 - RNA, 63 nt, hsa
cccgcagcacgccucuccccaccuucuugggacugcugugaacaugccuccuccugcccuccg

SEQ ID NO: 624502 - RNA, 63 nt, hsa
cuggucccguccccugcagggcucaguuugcacugcugugaagcaggaaggccagggaggucc

SEQ ID NO: 624503 - RNA, 63 nt, hsa
ccaucugugaaauuaauuuuccauccagacagcugcugugagcaaaugaacauaaaugcucgc

SEQ ID NO: 624504 - RNA, 63 nt, hsa
cauggggcuucuugugcccuaaaggggacuggcugcugugaucuucuaaggggcccagggcca

SEQ ID NO: 624505 - RNA, 63 nt, hsa
aggggugaaucuccuuccuuucucucccugcuuugcugugaagggagaaauuagccugggccu

SEQ ID NO: 624506 - RNA, 63 nt, hsa
ugucaugcccagcuuggagugccacguggccgcugcugugacaggcaguguucuugggggugg

SEQ ID NO: 624507 - RNA, 63 nt, hsa
ccucugaaguacgcuggagcuguguuguacaggugcugugagaccuacccuauucagaauuaa

SEQ ID NO: 624508 - RNA, 63 nt, hsa
aacguaaaaagcugugccaaaaaaaaagcaaaaugcugugauaaaccaaacagggaaggggga

SEQ ID NO: 624509 - RNA, 63 nt, hsa
guguuuaacugaguuagaauguugaaacugacuugcugugacuuaugugcagcuuuccaguug

SEQ ID NO: 624510 - RNA, 63 nt, hsa
ucugugccugaccuugaggagucuugugugcauugcugugaauuagcucacuuggugauaugu

SEQ ID NO: 624511 - RNA, 63 nt, hsa
ugcauuuuccuaauaugccuuuacugauccguuugcugugaacccuauguuauuuccaugugu

SEQ ID NO: 624512 - RNA, 63 nt, hsa
acuguuauccuauuuagauggccaugaagaggaugcugugaaauucccaacaaacauugaugc

SEQ ID NO: 624513 - RNA, 63 nt, hsa
aauauuauuugucuuuccugcccccuaucuguuugcugugauagugcaaagaagcacaggaaa

SEQ ID NO: 624514 - RNA, 63 nt, hsa
gggagugaagugugaggacccuuuucccccgcuugcugugaaagcacagauucauugacuaca

SEQ ID NO: 624515 - RNA, 63 nt, hsa
cacccagguggccgccucugggcccaaggcacaugcugugagcuuccugugagcccaggcucu

SEQ ID NO: 624516 - RNA, 63 nt, hsa
gccgaggaguccucgguagaccaccuugaugucugcugugacaucagaggugccaccaccaaa

SEQ ID NO: 624517 - RNA, 63 nt, hsa
agaagcugcgggcuucgguguggagggguggagugcugugaucucgacaacuuacuuucaaag

SEQ ID NO: 624518 - RNA, 63 nt, hsa
ucugagcuagugcuccuaaacacuggacauuuuugcugugaaccacagucgggaagguuuaau

SEQ ID NO: 624519 - RNA, 63 nt, hsa
acaaaaaggguauaagggaauaaggaugaacucugcugugaagagcaagccacuguagugagg

SEQ ID NO: 624520 - RNA, 63 nt, hsa
aacauuggaagauuauugagagcccuagaaagcugcugugaucccaguagaaaauauguccca

SEQ ID NO: 624521 - RNA, 63 nt, hsa
aaaugaaguugucucuacuucugcucaucaaauugcugugauagugaauuauuuauucauggg

SEQ ID NO: 624522 - RNA, 63 nt, hsa
ugagaaaauucuucucaucuugagaacucuuauugcugugaaagggagugguugguaaaauca

SEQ ID NO: 624523 - RNA, 63 nt, hsa
cagcuuucauucacuuuauuacucucucauauaugcugugagaaguuguaauauuaauuggcc

SEQ ID NO: 624524 - RNA, 63 nt, hsa
auuuuguaaaacauuuugggaaaucuuccaucuugcugugauuugcaauagguauuuucuugg

SEQ ID NO: 624525 - RNA, 63 nt, hsa
agccuauuugggacagcauuccucucucucugcugcugugacaucucccucuccuugcuggcu

SEQ ID NO: 624526 - RNA, 63 nt, hsa
aauugucaccugcuucucugcccagcuuuucauugcugugacagugauggcgaaagaggguaa

SEQ ID NO: 624527 - RNA, 63 nt, hsa
agacucgugugcggguggaugggggugccugagugcugugaccaagggacugaauugcugaca

SEQ ID NO: 624528 - RNA, 63 nt, hsa
cugacuucucucuuaaaaaguacagagagccugugcugugaacccccuucaaugggaaaaagc

SEQ ID NO: 624529 - RNA, 63 nt, hsa
gcauccacacaauuccagugggcccucggugccugcugugaacugcuuucccucggaauguuu

SEQ ID NO: 624530 - RNA, 63 nt, hsa
cuccgcgacacgggggaacuguuuucuugaugaugcugugaaccuuuauaucauuuucuaugu

SEQ ID NO: 624531 - RNA, 63 nt, hsa
cuguuuacucaguuacucccuguaacuauguuaugcugugaaguaggcaauacaguuguuaaa

SEQ ID NO: 624532 - RNA, 64 nt, hsa; identical to SEQ ID NO: 195747

SEQ ID NO: 624533 - RNA, 64 nt, hsa; identical to SEQ ID NO: 195748

SEQ ID NO: 624534 - RNA, 64 nt, hsa; identical to SEQ ID NO: 195749

SEQ ID NO: 624535 - RNA, 64 nt, hsa; identical to SEQ ID NO: 195750

SEQ ID NO: 624536 - RNA, 64 nt, hsa; identical to SEQ ID NO: 195751

SEQ ID NO: 624537 - RNA, 64 nt, hsa; identical to SEQ ID NO: 195752

SEQ ID NO: 624538 - RNA, 64 nt, hsa; identical to SEQ ID NO: 520094

SEQ ID NO: 624539 - RNA, 64 nt, hsa; identical to SEQ ID NO: 520095

SEQ ID NO: 624540 - RNA, 64 nt, hsa; identical to SEQ ID NO: 520096

SEQ ID NO: 624541 - RNA, 64 nt, hsa; identical to SEQ ID NO: 520097

SEQ ID NO: 624542 - RNA, 64 nt, hsa; identical to SEQ ID NO: 520098

SEQ ID NO: 624543 - RNA, 64 nt, hsa; identical to SEQ ID NO: 520099

SEQ ID NO: 624544 - RNA, 64 nt, hsa; identical to SEQ ID NO: 520100

SEQ ID NO: 624545 - RNA, 64 nt, hsa; identical to SEQ ID NO: 520101

SEQ ID NO: 624546 - RNA, 64 nt, hsa; identical to SEQ ID NO: 520102

SEQ ID NO: 624547 - RNA, 64 nt, hsa; identical to SEQ ID NO: 520103

SEQ ID NO: 624548 - RNA, 64 nt, hsa; identical to SEQ ID NO: 520104

SEQ ID NO: 624549 - RNA, 64 nt, hsa; identical to SEQ ID NO: 520105

SEQ ID NO: 624550 - RNA, 64 nt, hsa; identical to SEQ ID NO: 520106

SEQ ID NO: 624551 - RNA, 64 nt, hsa; identical to SEQ ID NO: 520107

SEQ ID NO: 624552 - RNA, 64 nt, hsa; identical to SEQ ID NO: 520108

SEQ ID NO: 624553 - RNA, 64 nt, hsa; identical to SEQ ID NO: 520109

SEQ ID NO: 624554 - RNA, 64 nt, hsa; identical to SEQ ID NO: 520110

SEQ ID NO: 624555 - RNA, 64 nt, hsa; identical to SEQ ID NO: 520111

SEQ ID NO: 624556 - RNA, 64 nt, hsa; identical to SEQ ID NO: 520112

SEQ ID NO: 624557 - RNA, 64 nt, hsa
acuugguguagggggagaggggaaaggggucuggcccaucgaggggccccuucugccagggccu

SEQ ID NO: 624558 - RNA, 64 nt, hsa
uuuuuuuguuuuuuggcucuuucaaagguaauggcccaucgaugagcauuuuuaacauacucca

SEQ ID NO: 624559 - RNA, 64 nt, hsa
gacuguuuccccuacaucuuuugagccacagucgcccaucgaauaagcaaauuuguuuuugaga

SEQ ID NO: 624560 - RNA, 64 nt, hsa
cagagauuuuagcauugccuuggcauaacaagggcccaucgauucccuacuaaugagaggcagg

SEQ ID NO: 624561 - RNA, 64 nt, hsa
gcuuuuacaaugaguuccuuaggugguauuuuaacccaucgaucuauaaugaugacucuuggca

SEQ ID NO: 624562 - RNA, 64 nt, hsa
uaaaugaagccucuuuggggugaagccuggacaucccaucgaaugaaaggacacuaguacagcg

SEQ ID NO: 624563 - RNA, 64 nt, hsa
augcaugucucacucacccuccacagcacucagucccaucgacguucacugaacauuggcuuuc

SEQ ID NO: 624564 - RNA, 64 nt, hsa
ggaaaagcuugggcggugcccagcgugcccgcugcccaucgacgucuguccuggggacguggag

SEQ ID NO: 624565 - RNA, 64 nt, hsa
gcuaugugcccuacauggcaaggcaccaugacugcccaucgagaugccaagaagggcuauggaa

SEQ ID NO: 624566 - RNA, 64 nt, hsa
caaugcugagaaugagagcggcggagacaagccccccaucgaucccaguaagugucuccucccu

SEQ ID NO: 624567 - RNA, 64 nt, hsa
caggccugcagucucauccugcccuugccauccucccaucgaugugccacgugggugucacgug

SEQ ID NO: 624568 - RNA, 64 nt, hsa
cgacuggucgcacucgcagcugcuggacuugggccccaucgacgcgcucaacuucuucugugag

SEQ ID NO: 624569 - RNA, 64 nt, hsa
ugcacccggugagugaggacagucccagcugagucccaucgauguugaaucucaugccacugca

SEQ ID NO: 624570 - RNA, 64 nt, hsa
ugacaguggcaacugaaaacagucccagaaugaccccaucgagaugaaauuaaacagauuagaa

SEQ ID NO: 624571 - RNA, 64 nt, hsa
ucacagccaccuccccaccuccccgcaagcuggucccaucgaccagcaagcccagccccagggc

SEQ ID NO: 624572 - RNA, 64 nt, hsa
ucaaugucaucacucaauauugcgaagcacaugccccaucgagccuacugggcagagcagcaga

SEQ ID NO: 624573 - RNA, 64 nt, hsa
uaaacaggcuucuggcaguagcuuugguuccuaucccaucgaaauuccccaaagcccugggcca

SEQ ID NO: 624574 - RNA, 64 nt, hsa
uaauguaaauauaaacagucacaauuaguauagacccaucgauauauuuuugauaauuuuucau

SEQ ID NO: 624575 - RNA, 64 nt, hsa
guacugagccugcggugcauggcucaggccuuuucccaucgacgucuagggggacucuggaccg

SEQ ID NO: 624576 - RNA, 64 nt, hsa
agacuaaucaucuucuuagcauuuuacugcgggucccaucgacuuagaaauggcuguugcguau

SEQ ID NO: 624577 - RNA, 64 nt, hsa
caguggcgcucccugucagagcuggaucaggccccccaucgaggagggagggcagacggaggcc

SEQ ID NO: 624578 - RNA, 64 nt, hsa
gauuucaccuguuuacuuaggguaucuacccagacccaucgauucugaguucgggagaugauuu

SEQ ID NO: 624579 - RNA, 64 nt, hsa
aaggagcgccgcccccugcuccacagcgcccagucccaucgaccacccaagggcugaggagugc

SEQ ID NO: 624580 - RNA, 64 nt, hsa
ugaaccuuguauaauuaacuuucaguuaugauuucccaucgacauuuucuuugcccuguuugua

SEQ ID NO: 624581 - RNA, 64 nt, hsa
ucagccugaguggacagcagugucccggcacaggcccaucgagccggguccaguacccaaccuu

SEQ ID NO: 624582 - RNA, 64 nt, hsa
gaauaacuuuuucaagcaauaucagugagugggucccaucgacaggguuccaggaccuggaaca

SEQ ID NO: 624583 - RNA, 64 nt, hsa
gaaaggggauagaaagcuccuuccucuauguccucccaucgagaucuguucuggggauggagcu

SEQ ID NO: 624584 - RNA, 64 nt, hsa
ccugcaugaaaauaaccuccaaggacccucugaccccaucgaccugggcccugcccacacaaca

SEQ ID NO: 624585 - RNA, 64 nt, hsa
gggcaccguggguguaagaugccuuucuccuccacccaucgaaaccagccaccccuucccugug

SEQ ID NO: 624586 - RNA, 64 nt, hsa
gccagggguuaggucugcaggcccgucugcgguccccaucgagcaucaaggggacgcugugugu

SEQ ID NO: 624587 - RNA, 64 nt, hsa
acaacuccagaaggucauuccagauccagagauccccaucgaacugaaggaucacuggguugca

SEQ ID NO: 624588 - RNA, 64 nt, hsa
uggcaccaacuuugugauugguuugucagugucccccaucgacucucuggggcugaucacuuag

SEQ ID NO: 624589 - RNA, 64 nt, hsa
ugggacccucgggagaccccguggcugucuccgccccaucgaggaggaggcccgucagccaugg

SEQ ID NO: 624590 - RNA, 64 nt, hsa
cccaggcccaacucugcuagcuucccagaccacccccaucgagugcggagagagugggagugcu

SEQ ID NO: 624591 - RNA, 64 nt, hsa
ccccggccagcgcccaccccagccuucugcccgccccaucgaggaggccccucgggggcagcac

SEQ ID NO: 624592 - RNA, 64 nt, hsa
ucgcccccgccccacccaucgcgccccggcccgucccaucgaggcccaugcaacccacgcucgg

SEQ ID NO: 624593 - RNA, 64 nt, hsa
acagagauaauauauauauagaaagauguauauagauguauauaugcccaaauauauugaaugu

SEQ ID NO: 624594 - RNA, 64 nt, hsa
gaagaaagaaacagagauaauauauauauagaaagauguauauagauguauauaugcccaaaua

SEQ ID NO: 624595 - RNA, 64 nt, hsa
ucuguucugauggcacugaguuuucauuguucuggauguauaagucugugugucagguacagcu

SEQ ID NO: 624596 - RNA, 64 nt, hsa
acaauguugggcauugagguguaaauuuugcccagauguauacccagugugaaauaucuucuaa

SEQ ID NO: 624597 - RNA, 64 nt, hsa
auuugggcuuagugguuacaaauauguguaaguggauguauauguacuuaaacuggcuuuguau

SEQ ID NO: 624598 - RNA, 64 nt, hsa
uauauauguauguguguauguguguguauauauagauguauauauauacacacacagagauaua

SEQ ID NO: 624599 - RNA, 64 nt, hsa
acauuuuacauguaaauagcacuggucauauacugauguauaugguuaucuggguuauaucuau

SEQ ID NO: 624600 - RNA, 64 nt, hsa
caguuaaauggcuauaggugggaaguaggauuuagauguauagaaaaguaagaaaaucuuacuu

SEQ ID NO: 624601 - RNA, 64 nt, hsa
gucuggcaaugacuuguauuggccaccaacuguagauguauauauggugcccuucugaugcuaa

SEQ ID NO: 624602 - RNA, 64 nt, hsa
aaagcaguggagguggggguugcuguugauugaagauguauauaauaucuccgguuuauaaaac

SEQ ID NO: 624603 - RNA, 64 nt, hsa
auguguguauauagugugugauguauaugugugugauguauacuauauaugcccacacaugcac

SEQ ID NO: 624604 - RNA, 64 nt, hsa
uaucacauauacuauauguguguauauagugugugauguauaugugugugauguauacuauaua

SEQ ID NO: 624605 - RNA, 64 nt, hsa
guauauacacauauaguguauauaguguaugugugauguauacuauacauaucacauauacuau

SEQ ID NO: 624606 - RNA, 64 nt, hsa
guuucaugugaguuuuuaccguuaggaugauuaagauguauauaggacaaaauguuaagucuuu

SEQ ID NO: 624607 - RNA, 64 nt, hsa
aaaggggcuaguauaucaguaggauauacuaugggauguauauauaucauugcuguuagagaaa

SEQ ID NO: 624608 - RNA, 64 nt, hsa
aauugucaucggacaaugaccgcuucuucauguagauguauauuauuuaggaagcaauggaauu

SEQ ID NO: 624609 - RNA, 64 nt, hsa
uacaugacaauuuguaaucauaagagaugguucagauguauaacagaaugggaaagccagcaga

SEQ ID NO: 624610 - RNA, 64 nt, hsa
agauuuaaagaugucuaugucuucuauuuuuauauaauuucauguucuaugaggaauuuaguac

SEQ ID NO: 624611 - RNA, 64 nt, hsa
gcaaaacuagaaaucuuuuaaugacaauuuucauuaauuucaggguuaucauuuuugagaaauc

SEQ ID NO: 624612 - RNA, 64 nt, hsa
gggccaaaaagagaaaagaaaagaaaauuucuacuaauuucagaccucuagagcaauucagucc

SEQ ID NO: 624613 - RNA, 64 nt, hsa
aguacuaaagaaagcaaacuuuuaauuuccucuguaauuucaacagagaucagcaaauaaauau

SEQ ID NO: 624614 - RNA, 64 nt, hsa
ccccuguuuguucuguaacuaguugcucucauuuuaauuucacuggccaccaucaucuuugcau

SEQ ID NO: 624615 - RNA, 64 nt, hsa
uauuccaugccugcccaauucaucuguuacuguuuaauuucaauucuucuggugagaauuagaa

SEQ ID NO: 624616 - RNA, 64 nt, hsa
ccauaaucacaaauggcucuuuuguguaauuguuuaauuucaccugaauaucauaaugcuuaaa

SEQ ID NO: 624617 - RNA, 64 nt, hsa
uaaaaaugauugaaauuuaucuugccauaucucauaauuucaugcacaaguugacugagcuaau

SEQ ID NO: 624618 - RNA, 64 nt, hsa
ucaagugcaauauaacaauguaaccaaaucuagauaauuucaaaguugucauuaauuuaguaag

SEQ ID NO: 624619 - RNA, 64 nt, hsa
uaaaauaagguaagaaguaaauauguaaaagagauaauuucaagcauaagugcaauguaaauaa

SEQ ID NO: 624620 - RNA, 64 nt, hsa
ugacaucugagaacacagaauaauccaucauuuuuaauuucaagauauugguacauuuuauagg

SEQ ID NO: 624621 - RNA, 64 nt, hsa
caguccagacgcacugaucuuugcaaaggagacuuaauuucaaaucuguaauuaccauacauaa

SEQ ID NO: 624622 - RNA, 64 nt, hsa
uaugaacuacaguggagcuacacucauugaaauguaauuucaguucuaaaaagauguaauaauc

SEQ ID NO: 624623 - RNA, 64 nt, hsa
uuaauuugggaauuuguuguguugaaauggcauuuaauuucaaccuaaauacugacugcuggac

SEQ ID NO: 624624 - RNA, 64 nt, hsa
cuacuaaauauauauuaugcaagucaggaaucauuaauuucaaaauuuaaagccaugcuaaaau

SEQ ID NO: 624625 - RNA, 64 nt, hsa
gaaguuuugugcauuaaucuuaauucauauuuauuaauuucaagggaauauugaaagguuuuaa

SEQ ID NO: 624626 - RNA, 64 nt, hsa
aaaagagaauuagaaguuaacuguguauguacuuuaauuucaaaugcuuuuuuauaucuaaaaa

SEQ ID NO: 624627 - RNA, 64 nt, hsa
cauguauauuuugaccagaguauauuuaaguauauaauuucagcuuccuugauuuagaaauaug

SEQ ID NO: 624628 - RNA, 64 nt, hsa
uaugggagcuuaauauaucauaucuaauuuaaaauaauuucacugaaauaaacuccauugcuuu

SEQ ID NO: 624629 - RNA, 64 nt, hsa
gaauuggaauaugauuucucaaaaauuaauuugauaauuucauguaugaugugcauauaugcua

SEQ ID NO: 624630 - RNA, 64 nt, hsa
uucaguaaaaugaagcagucuuaagagugacuaauaauuucaaagugauuuuucgucuauucuu

SEQ ID NO: 624631 - RNA, 64 nt, hsa
gaguccuagucauauuaaacaugagagauacucuuaauuucaguaguacaguauggaauaguua

SEQ ID NO: 624632 - RNA, 64 nt, hsa
auaauaagugcccaaugaaaaaaucuauuaugguuaauuucauuucuugcuuugccaccuaagc

SEQ ID NO: 624633 - RNA, 64 nt, hsa
guuuuuguaaguuuaugcauacaguaauuuuaaguaauuucagaagaaauucugcaagcuuuuc

SEQ ID NO: 624634 - RNA, 64 nt, hsa
uugaagucugauuuuccuggacaguuuucugcuuuaauuucaugaaaagauuaugaucucagaa

SEQ ID NO: 624635 - RNA, 64 nt, hsa
uuagauuuuauaaugcaaagauucagauccaaaauaauuucauaccccauuuuuucacagaauu

SEQ ID NO: 624636 - RNA, 64 nt, hsa
gguuuuuauguguaagaagugaaagaaacuuugcuaauuucaaguucgaauuacaguugugaga

SEQ ID NO: 624637 - RNA, 64 nt, hsa
gguuaaaaaguagagaaccuccuuucuguucaacuaauuucacgugacagugcauguauuuauu

SEQ ID NO: 624638 - RNA, 64 nt, hsa
acacccucucacagacguaccaauguuauuuuuauaauuucauggauuuaguuauacauaccuu

SEQ ID NO: 624639 - RNA, 64 nt, hsa
acugcaucauuguucagcuaucauugcuugcacguaauuucauuuacugugacacuugcuucuu

SEQ ID NO: 624640 - RNA, 64 nt, hsa
cuucaguuaauuacuuugaacacuaccuuugcuguaauuucauuugagauuuucuaaggguaga

SEQ ID NO: 624641 - RNA, 64 nt, hsa
aaauaucuuaauuuuucauuagauucauaucauuuaauuucacauauucaacaccuuuaaaugu

SEQ ID NO: 624642 - RNA, 64 nt, hsa
gacuaccagccuguguuuuugucuuuaaaucucuuaauuucauuccucugcaaaaaaaaaaaaa

SEQ ID NO: 624643 - RNA, 64 nt, hsa
aacugacuugaaauaaugcuuguaaucaggaaaguaauuucauccaccgauuucaaaaccagau

SEQ ID NO: 624644 - RNA, 64 nt, hsa
caagccaauucucuuaacucuguaaugcagccaauaauuucaaacccguuuugcuuuugaguca

SEQ ID NO: 624645 - RNA, 64 nt, hsa
aaauagaaaauuucaccuccauauuccugagguguaauuucauuagacuaguuuuaguuuaaaa

SEQ ID NO: 624646 - RNA, 64 nt, hsa
auaauucuuauccagacaugggagccagugaauuuaauuucagagauuaaaaauucacuuuaga

SEQ ID NO: 624647 - RNA, 64 nt, hsa
auccauccauaucuauugaaauuguacagguccauaauuucauuuuaauuaauuauaggaaaga

SEQ ID NO: 624648 - RNA, 64 nt, hsa
cagcaauaucuuaugaaagucuggcuguucucaauaauuucauuuucuuggccaaagccaaaag

SEQ ID NO: 624649 - RNA, 64 nt, hsa
uuuuauaaacacuauauacuuaggcuacauaaaguaauuucacuaugauguuaccauggcugug

SEQ ID NO: 624650 - RNA, 64 nt, hsa
gugauacaguuuguuacuuuuaaguacauuuuaauaauuucagacaucugcauuuuuauugaac

SEQ ID NO: 624651 - RNA, 64 nt, hsa
cauaauacguaugaguuuuaccuuuucagaggaauaauuucaagucauuuauuugcucauuaau

SEQ ID NO: 624652 - RNA, 64 nt, hsa
cuuuucaaagcuauuuauuuuuaggacuaugugguaauuucaccuucaggugauaaggauuuuu

SEQ ID NO: 624653 - RNA, 64 nt, hsa
uaaaguuuggcugguagaauaaacuaccucaacuuaauuucauucuguucauaguagagcaaau

SEQ ID NO: 624654 - RNA, 64 nt, hsa
aaauucauuuuauaaaaauaguguuuuuuuuuuuuaauuucaguucauugacucuauaacugca

SEQ ID NO: 624655 - RNA, 64 nt, hsa
auuguuaccagcucaauaaauguguuuaacgaguuaauuucauuuuucuggcuuuggucuguuc

SEQ ID NO: 624656 - RNA, 64 nt, hsa
agcucugauggcaucaaacggacuuugcaucaaguaauuucagauaguguccuaggauccuuug

SEQ ID NO: 624657 - RNA, 64 nt, hsa
cuuaguccucaccucuuccuugucuuuuagaucuuaauuucaugcugauuacaaaaauccaguu

SEQ ID NO: 624658 - RNA, 64 nt, hsa
ugucuuugucacaaaauuucauuuuucucauaguuaauuucaucucuccgguaagauuuuauug

SEQ ID NO: 624659 - RNA, 64 nt, hsa
cuuauugggguauaaugaaaaucuuacugaaaguuaauuucacauucuuacaccccaaaaucug

SEQ ID NO: 624660 - RNA, 64 nt, hsa
gucauuagguacaauucacuccuuucacaucaguuaauuucauucuugacagaauccuuacaaa

SEQ ID NO: 624661 - RNA, 64 nt, hsa
cauuuuuaauuccucuuggugucaaauuuuuaaguaauuucaugcacacaggagaaaaugcaau

SEQ ID NO: 624662 - RNA, 64 nt, hsa
cauguguuuggaguuaaaauguguuuuucaguuauaauuucaauuuuuaaauuucuuggugcuu

SEQ ID NO: 624663 - RNA, 64 nt, hsa
gcuaucuaucuuuaucaaauggaaugaaacuagauaauuucaagaaacugaguaggacaaaggg

SEQ ID NO: 624664 - RNA, 64 nt, hsa
ucuuguuagauuuguuaccaguaaaauauuacuguaauuucauauacacagucuauacaaugaa

SEQ ID NO: 624665 - RNA, 64 nt, hsa
aacacaucuauguuucucuuauuaaaaguaaccuuaauuucauuggaauuuaagaauaaauaga

SEQ ID NO: 624666 - RNA, 64 nt, hsa
acugguaauauaaucuaaaucaagauuaccaaaauaauuucagagguugaugugguaaccuuua

SEQ ID NO: 624667 - RNA, 64 nt, hsa
uuugaauuuuaauuuuacucuuuuauacaugugauaauuucauaaagugagggaucccaaaaaa

SEQ ID NO: 624668 - RNA, 64 nt, hsa
auuuuauaaacacagccuuucuuuagcauugauuuaauuucagaacaucuucauauugauuauu

SEQ ID NO: 624669 - RNA, 64 nt, hsa; identical to SEQ ID NO: 337391

SEQ ID NO: 624670 - RNA, 64 nt, hsa; identical to SEQ ID NO: 337392

SEQ ID NO: 624671 - RNA, 64 nt, hsa; identical to SEQ ID NO: 337393

SEQ ID NO: 624672 - RNA, 64 nt, hsa; identical to SEQ ID NO: 337394

SEQ ID NO: 624673 - RNA, 64 nt, hsa; identical to SEQ ID NO: 337395

SEQ ID NO: 624674 - RNA, 64 nt, hsa; identical to SEQ ID NO: 337396

SEQ ID NO: 624675 - RNA, 64 nt, hsa; identical to SEQ ID NO: 337397

SEQ ID NO: 624676 - RNA, 64 nt, hsa; identical to SEQ ID NO: 337398

SEQ ID NO: 624677 - RNA, 64 nt, hsa; identical to SEQ ID NO: 337399

SEQ ID NO: 624678 - RNA, 64 nt, hsa; identical to SEQ ID NO: 337400

SEQ ID NO: 624679 - RNA, 64 nt, hsa; identical to SEQ ID NO: 337401

SEQ ID NO: 624680 - RNA, 64 nt, hsa; identical to SEQ ID NO: 337402

SEQ ID NO: 624681 - RNA, 64 nt, hsa; identical to SEQ ID NO: 337403

SEQ ID NO: 624682 - RNA, 64 nt, hsa; identical to SEQ ID NO: 337404

SEQ ID NO: 624683 - RNA, 64 nt, hsa; identical to SEQ ID NO: 337405

SEQ ID NO: 624684 - RNA, 64 nt, hsa; identical to SEQ ID NO: 337406

SEQ ID NO: 624685 - RNA, 64 nt, hsa; identical to SEQ ID NO: 337407

SEQ ID NO: 624686 - RNA, 64 nt, hsa; identical to SEQ ID NO: 337408

SEQ ID NO: 624687 - RNA, 64 nt, hsa; identical to SEQ ID NO: 337409

SEQ ID NO: 624688 - RNA, 64 nt, hsa; identical to SEQ ID NO: 337410

SEQ ID NO: 624689 - RNA, 64 nt, hsa; identical to SEQ ID NO: 337411

SEQ ID NO: 624690 - RNA, 64 nt, hsa; identical to SEQ ID NO: 337412

SEQ ID NO: 624691 - RNA, 64 nt, hsa; identical to SEQ ID NO: 337413

SEQ ID NO: 624692 - RNA, 64 nt, hsa; identical to SEQ ID NO: 337414

SEQ ID NO: 624693 - RNA, 64 nt, hsa; identical to SEQ ID NO: 337415

SEQ ID NO: 624694 - RNA, 64 nt, hsa; identical to SEQ ID NO: 337416

SEQ ID NO: 624695 - RNA, 64 nt, hsa; identical to SEQ ID NO: 337417

SEQ ID NO: 624696 - RNA, 64 nt, hsa
aaaugugaccggaugcgcucccagaagcuccgccggcgaccagacuccugccacgccuuccauc

SEQ ID NO: 624697 - RNA, 64 nt, hsa
ucucuccuucccagccaauuucugccuucuugacggcgaccagguggcugcugcaggagcuggu

SEQ ID NO: 624698 - RNA, 64 nt, hsa
gcuucgccaaugaggaggaggaggcagagguguaccugcggaagcugcagcagguguacaagcu

SEQ ID NO: 624699 - RNA, 64 nt, hsa
ucagcgaccuggucucccagaacaucaaugucuuccugcggaacacagucaaggucacgggcgu

SEQ ID NO: 624700 - RNA, 64 nt, hsa
agguggagcagcagcuacaagcagaggcugaacaccugcggaaggagcuggagaaucugacagg

SEQ ID NO: 624701 - RNA, 64 nt, hsa
agguggaacagcagcuacaagcagaggcugaacaccugcggaaggagcuggagaaucuggcagg

SEQ ID NO: 624702 - RNA, 64 nt, hsa
ccuggugaggcccugccauaaccaggcgcccagcccugcggaggaggccggggcucccaggaag

SEQ ID NO: 624703 - RNA, 64 nt, hsa
ggugggagcagcggagggggacgccccacggggcccugcggagccugaagccggagagcaggcg

SEQ ID NO: 624704 - RNA, 64 nt, hsa; identical to SEQ ID NO: 87480

SEQ ID NO: 624705 - RNA, 64 nt, hsa; identical to SEQ ID NO: 87481

SEQ ID NO: 624706 - RNA, 64 nt, hsa; identical to SEQ ID NO: 87482

SEQ ID NO: 624707 - RNA, 64 nt, hsa; identical to SEQ ID NO: 87483

SEQ ID NO: 624708 - RNA, 64 nt, hsa; identical to SEQ ID NO: 87484

SEQ ID NO: 624709 - RNA, 64 nt, hsa; identical to SEQ ID NO: 87485

SEQ ID NO: 624710 - RNA, 64 nt, hsa; identical to SEQ ID NO: 87486

SEQ ID NO: 624711 - RNA, 64 nt, hsa; identical to SEQ ID NO: 87487

SEQ ID NO: 624712 - RNA, 64 nt, hsa; identical to SEQ ID NO: 87488

SEQ ID NO: 624713 - RNA, 64 nt, hsa; identical to SEQ ID NO: 87489

SEQ ID NO: 624714 - RNA, 64 nt, hsa; identical to SEQ ID NO: 87490

SEQ ID NO: 624715 - RNA, 64 nt, hsa; identical to SEQ ID NO: 87491

SEQ ID NO: 624716 - RNA, 64 nt, hsa; identical to SEQ ID NO: 87492

SEQ ID NO: 624717 - RNA, 64 nt, hsa; identical to SEQ ID NO: 87493

SEQ ID NO: 624718 - RNA, 64 nt, hsa; identical to SEQ ID NO: 87494

SEQ ID NO: 624719 - RNA, 64 nt, hsa; identical to SEQ ID NO: 87495

SEQ ID NO: 624720 - RNA, 64 nt, hsa; identical to SEQ ID NO: 87496

SEQ ID NO: 624721 - RNA, 64 nt, hsa; identical to SEQ ID NO: 87497

SEQ ID NO: 624722 - RNA, 64 nt, hsa; identical to SEQ ID NO: 87498

SEQ ID NO: 624723 - RNA, 64 nt, hsa; identical to SEQ ID NO: 87499

SEQ ID NO: 624724 - RNA, 64 nt, hsa; identical to SEQ ID NO: 87500

SEQ ID NO: 624725 - RNA, 64 nt, hsa; identical to SEQ ID NO: 87501

SEQ ID NO: 624726 - RNA, 64 nt, hsa; identical to SEQ ID NO: 87502

SEQ ID NO: 624727 - RNA, 64 nt, hsa; identical to SEQ ID NO: 87503

SEQ ID NO: 624728 - RNA, 64 nt, hsa; identical to SEQ ID NO: 87504

SEQ ID NO: 624729 - RNA, 64 nt, hsa; identical to SEQ ID NO: 87505

SEQ ID NO: 624730 - RNA, 64 nt, hsa; identical to SEQ ID NO: 87506

SEQ ID NO: 624731 - RNA, 64 nt, hsa; identical to SEQ ID NO: 87507

SEQ ID NO: 624732 - RNA, 64 nt, hsa; identical to SEQ ID NO: 87508

SEQ ID NO: 624733 - RNA, 64 nt, hsa; identical to SEQ ID NO: 87509

SEQ ID NO: 624734 - RNA, 64 nt, hsa; identical to SEQ ID NO: 87510

SEQ ID NO: 624735 - RNA, 64 nt, hsa; identical to SEQ ID NO: 87511

SEQ ID NO: 624736 - RNA, 64 nt, hsa; identical to SEQ ID NO: 87512

SEQ ID NO: 624737 - RNA, 64 nt, hsa; identical to SEQ ID NO: 87513

SEQ ID NO: 624738 - RNA, 64 nt, hsa; identical to SEQ ID NO: 87514

SEQ ID NO: 624739 - RNA, 64 nt, hsa; identical to SEQ ID NO: 87515

SEQ ID NO: 624740 - RNA, 64 nt, hsa; identical to SEQ ID NO: 87516

SEQ ID NO: 624741 - RNA, 64 nt, hsa; identical to SEQ ID NO: 87517

SEQ ID NO: 624742 - RNA, 64 nt, hsa; identical to SEQ ID NO: 87518

SEQ ID NO: 624743 - RNA, 64 nt, hsa; identical to SEQ ID NO: 87519

SEQ ID NO: 624744 - RNA, 64 nt, hsa; identical to SEQ ID NO: 87520

SEQ ID NO: 624745 - RNA, 64 nt, hsa; identical to SEQ ID NO: 87521

SEQ ID NO: 624746 - RNA, 64 nt, hsa; identical to SEQ ID NO: 87522

SEQ ID NO: 624747 - RNA, 64 nt, hsa; identical to SEQ ID NO: 87523

SEQ ID NO: 624748 - RNA, 64 nt, hsa; identical to SEQ ID NO: 87524

SEQ ID NO: 624749 - RNA, 64 nt, hsa; identical to SEQ ID NO: 87525

SEQ ID NO: 624750 - RNA, 64 nt, hsa; identical to SEQ ID NO: 87526

SEQ ID NO: 624751 - RNA, 64 nt, hsa; identical to SEQ ID NO: 87527

SEQ ID NO: 624752 - RNA, 64 nt, hsa; identical to SEQ ID NO: 87528

SEQ ID NO: 624753 - RNA, 64 nt, hsa; identical to SEQ ID NO: 87529

SEQ ID NO: 624754 - RNA, 64 nt, hsa; identical to SEQ ID NO: 87530

SEQ ID NO: 624755 - RNA, 64 nt, hsa; identical to SEQ ID NO: 87531

SEQ ID NO: 624756 - RNA, 64 nt, hsa; identical to SEQ ID NO: 87532

SEQ ID NO: 624757 - RNA, 64 nt, hsa; identical to SEQ ID NO: 87533

SEQ ID NO: 624758 - RNA, 64 nt, hsa; identical to SEQ ID NO: 87534

SEQ ID NO: 624759 - RNA, 64 nt, hsa; identical to SEQ ID NO: 87535

SEQ ID NO: 624760 - RNA, 64 nt, hsa; identical to SEQ ID NO: 87536

SEQ ID NO: 624761 - RNA, 65 nt, hsa
aauuggcccuuuggcucuugcccuuggcucccuugggcagacagcaggcuuaggccauugauauc

SEQ ID NO: 624762 - RNA, 65 nt, hsa
agggucugaacugccuccauccuagggcaaccuggggcagacaggccuggugggggguggggaaa

SEQ ID NO: 624763 - RNA, 65 nt, hsa
agucgaggcugguaagggaccuucagggagagcugggcagacaggugggagauggagguagggcu

SEQ ID NO: 624764 - RNA, 65 nt, hsa
gugagaaagacaucugaggaaaauggaagaccuaaggcagacaggaaggaagcacaaaagacaag

SEQ ID NO: 624765 - RNA, 65 nt, hsa
aaccccaggcagaccgauaaaaagaccuccagauaggcagacagacagauggaccaccaaccugg

SEQ ID NO: 624766 - RNA, 65 nt, hsa
acagacuccuaaccaaccagauggacugccagacaggcagacaucagccacauggaauccugaca

SEQ ID NO: 624767 - RNA, 65 nt, hsa
augggcgagcgugcaccaucccuuuuugaaguguaggcagacacagggacuugaaguuguuacua

SEQ ID NO: 624768 - RNA, 65 nt, hsa
uaaaacugcguuaaaggcucgauuuuguaucugcaggcagacacggaucugagaaucuuuauuga

SEQ ID NO: 624769 - RNA, 65 nt, hsa
ccccaaaaggugacuuaauuaauaaagggcauuugggcagacacacuguguuggaccaacaaagu

SEQ ID NO: 624770 - RNA, 65 nt, hsa
ggggccugaaaagaggggcugcccuccugcgccaaggcagacacaagcugcgggcugugcggucc

SEQ ID NO: 624771 - RNA, 65 nt, hsa
aguaaagaugagcaaacauuuggaauuuacaugugggcagacauugggauaacaacuuucaucac

SEQ ID NO: 624772 - RNA, 65 nt, hsa
uaaguucugaucauuauauaagaagggaaaugccuggcagacaccauguaaguuauaagugucug

SEQ ID NO: 624773 - RNA, 65 nt, hsa
uaaugaauuaagaacacauucuaacaagggucuguggcagacauugccgagugacuuucuuaguc

SEQ ID NO: 624774 - RNA, 65 nt, hsa
uaaugaauuaagaacacauucuaacaagggucuguggcagacauugccgagugacuuucuaacau

SEQ ID NO: 624775 - RNA, 65 nt, hsa
acaagguucugcccuuauggagcucacacuccaguggcagacaaacagaccauaaauaaggaaac

SEQ ID NO: 624776 - RNA, 65 nt, hsa
ucucaagaccagagacccaacagcagugaucucagggcagacagcccuccacuccagcucugaga

SEQ ID NO: 624777 - RNA, 65 nt, hsa
cguuauugggccaccugacagcuggacagaaaaggggcagacacaccgaggaugcgauuuaaaau

SEQ ID NO: 624778 - RNA, 65 nt, hsa
ccugggcacggugacugcgguuauuccuggaggucggcagacaugccaaccuugggcuauuugag

SEQ ID NO: 624779 - RNA, 65 nt, hsa
gacacagagauggaauagaaaagaugagaggcagaggcagacaggcgcuggacagaggggcaggg

SEQ ID NO: 624780 - RNA, 65 nt, hsa
acagaggggcaggggagugccaagguuguccuggaggcagacagcccagcugagccuccuuaccu

SEQ ID NO: 624781 - RNA, 65 nt, hsa
aauguguggcucagugccuggacaaaugaugccauggcagacaguagacagaacaacacuucccu

SEQ ID NO: 624782 - RNA, 65 nt, hsa
gcaaagggugaaauccgcauugauggccucaauguggcagacaucggccuccaugaccugcgcuc

SEQ ID NO: 624783 - RNA, 65 nt, hsa
guacucugggucaagagaccagggaugcaggguuaggcagacagguccccagaguccucacccug

SEQ ID NO: 624784 - RNA, 65 nt, hsa
aaaacccaaaccaaaaacgcaaaccaaagcaggcaggcagacagcugcugggggaaauccugggg

SEQ ID NO: 624785 - RNA, 65 nt, hsa
aagcacgaaucaugauucugcuuucuguuagcuuaggcagacauugggccuucaccuacaaguuu

SEQ ID NO: 624786 - RNA, 65 nt, hsa
ugccauuugaaucagggucuccaguuucuagaaaaggcagacacugguugggaccaaagucucca

SEQ ID NO: 624787 - RNA, 65 nt, hsa
cuucucagacuugggaccugggugccugggauccuggcagacagagguuguguccagacagccag

SEQ ID NO: 624788 - RNA, 65 nt, hsa
gcucaggaagccggccugcagcaggagcagaggaaggcagacacccacaagaagaugacugaguu

SEQ ID NO: 624789 - RNA, 65 nt, hsa
ugccaucccaaauacuugggcagcagcucagcaugggcagacaugggggcuguggauucuuccag

SEQ ID NO: 624790 - RNA, 65 nt, hsa
cuaggaacugagcccaaggaaauagcgggguugcaggcagacauugagcugcgagacaaugggaa

SEQ ID NO: 624791 - RNA, 55 nt, hsa; identical to SEQ ID NO: 113265

SEQ ID NO: 624792 - RNA, 64 nt, hsa; identical to SEQ ID NO: 113266

SEQ ID NO: 624793 - RNA, 64 nt, hsa; identical to SEQ ID NO: 113267

SEQ ID NO: 624794 - RNA, 64 nt, hsa; identical to SEQ ID NO: 113268

SEQ ID NO: 624795 - RNA, 64 nt, hsa; identical to SEQ ID NO: 113269

SEQ ID NO: 624796 - RNA, 64 nt, hsa; identical to SEQ ID NO: 113270

SEQ ID NO: 624797 - RNA, 64 nt, hsa; identical to SEQ ID NO: 113271

SEQ ID NO: 624798 - RNA, 64 nt, hsa; identical to SEQ ID NO: 113272

SEQ ID NO: 624799 - RNA, 64 nt, hsa; identical to SEQ ID NO: 113273

SEQ ID NO: 624800 - RNA, 64 nt, hsa; identical to SEQ ID NO: 113274

SEQ ID NO: 624801 - RNA, 64 nt, hsa; identical to SEQ ID NO: 113275

SEQ ID NO: 624802 - RNA, 64 nt, hsa; identical to SEQ ID NO: 113276

SEQ ID NO: 624803 - RNA, 64 nt, hsa; identical to SEQ ID NO: 113277

SEQ ID NO: 624804 - RNA, 64 nt, hsa; identical to SEQ ID NO: 113278

SEQ ID NO: 624805 - RNA, 64 nt, hsa; identical to SEQ ID NO: 111894

SEQ ID NO: 624806 - RNA, 64 nt, hsa; identical to SEQ ID NO: 111895

SEQ ID NO: 624807 - RNA, 64 nt, hsa; identical to SEQ ID NO: 111896

SEQ ID NO: 624808 - RNA, 64 nt, hsa; identical to SEQ ID NO: 111897

SEQ ID NO: 624809 - RNA, 64 nt, hsa; identical to SEQ ID NO: 111898

SEQ ID NO: 624810 - RNA, 64 nt, hsa; identical to SEQ ID NO: 111899

SEQ ID NO: 624811 - RNA, 64 nt, hsa; identical to SEQ ID NO: 111900

SEQ ID NO: 624812 - RNA, 64 nt, hsa; identical to SEQ ID NO: 111901

SEQ ID NO: 624813 - RNA, 64 nt, hsa; identical to SEQ ID NO: 111902

SEQ ID NO: 624814 - RNA, 64 nt, hsa; identical to SEQ ID NO: 111903

SEQ ID NO: 624815 - RNA, 64 nt, hsa; identical to SEQ ID NO: 111904

SEQ ID NO: 624816 - RNA, 64 nt, hsa; identical to SEQ ID NO: 111905

SEQ ID NO: 624817 - RNA, 64 nt, hsa; identical to SEQ ID NO: 111906

SEQ ID NO: 624818 - RNA, 64 nt, hsa; identical to SEQ ID NO: 111907

SEQ ID NO: 624819 - RNA, 64 nt, hsa; identical to SEQ ID NO: 111908

SEQ ID NO: 624820 - RNA, 64 nt, hsa; identical to SEQ ID NO: 111909

SEQ ID NO: 624821 - RNA, 64 nt, hsa; identical to SEQ ID NO: 111910

SEQ ID NO: 624822 - RNA, 64 nt, hsa; identical to SEQ ID NO: 111911

SEQ ID NO: 624823 - RNA, 64 nt, hsa; identical to SEQ ID NO: 111912

SEQ ID NO: 624824 - RNA, 64 nt, hsa; identical to SEQ ID NO: 111913

SEQ ID NO: 624825 - RNA, 64 nt, hsa; identical to SEQ ID NO: 111914

SEQ ID NO: 624826 - RNA, 64 nt, hsa; identical to SEQ ID NO: 111915

SEQ ID NO: 624827 - RNA, 64 nt, hsa; identical to SEQ ID NO: 111916

SEQ ID NO: 624828 - RNA, 64 nt, hsa; identical to SEQ ID NO: 111917

SEQ ID NO: 624829 - RNA, 64 nt, hsa; identical to SEQ ID NO: 111918

SEQ ID NO: 624830 - RNA, 64 nt, hsa; identical to SEQ ID NO: 111919

SEQ ID NO: 624831 - RNA, 64 nt, hsa; identical to SEQ ID NO: 111920

SEQ ID NO: 624832 - RNA, 64 nt, hsa; identical to SEQ ID NO: 111921

SEQ ID NO: 624833 - RNA, 64 nt, hsa; identical to SEQ ID NO: 111922

SEQ ID NO: 624834 - RNA, 64 nt, hsa; identical to SEQ ID NO: 111923

SEQ ID NO: 624835 - RNA, 64 nt, hsa; identical to SEQ ID NO: 111924

SEQ ID NO: 624836 - RNA, 64 nt, hsa; identical to SEQ ID NO: 111925

SEQ ID NO: 624837 - RNA, 64 nt, hsa; identical to SEQ ID NO: 111926

SEQ ID NO: 624838 - RNA, 64 nt, hsa; identical to SEQ ID NO: 111927

SEQ ID NO: 624839 - RNA, 64 nt, hsa
uaaaauucaugugguuucuaugcaaaguucuucauaucaucacaacauuauuugauuuaaauaa

SEQ ID NO: 624840 - RNA, 64 nt, hsa
uauagccugaguaaaguuaaaagaauguaaaauauaucaucaaguucuuaaaauaauauacaug

SEQ ID NO: 624841 - RNA, 64 nt, hsa
uaugagcaugucuccucuuuucaguggguaacaguaucaucauauuccuuuauaguuacuaagu

SEQ ID NO: 624842 - RNA, 64 nt, hsa
agguugaagacaauuagugaaaguaauguuauaguaucaucauauucccuuuugcuaucugucc

SEQ ID NO: 624843 - RNA, 64 nt, hsa
guuguggaaaaguguucuagcaacagcauauacuuaucaucauugccuuuccacuacucuacua

SEQ ID NO: 624844 - RNA, 64 nt, hsa
gcuuuggauuaauauuggauauuacuguuuuuauuaucaucaacauuauuauuaguggauuucu

SEQ ID NO: 624845 - RNA, 64 nt, hsa
gcuacaauaauuccaacuaagugaacuucucaauuaucaucauacuuacuuaccuuauauuaac

SEQ ID NO: 624846 - RNA, 64 nt, hsa
uuaucaagcuggucaagguagaaauacugauauguaucaucaccuuuuccagauacaaacuugc

SEQ ID NO: 624847 - RNA, 64 nt, hsa
cagcugccaguuuugaauaaugaauaucauauuguaucaucaaugcugauauuuaacugaguug

SEQ ID NO: 624848 - RNA, 64 nt, hsa
cucccuucugucauuuucauugauuuaauuuguguaucaucaauaaaauuguauguuaaugcug

SEQ ID NO: 624849 - RNA, 64 nt, hsa
caaguugcuuggcagcacaacuaucuuugcaaaaaaaaguaaagaaaaaguaaaugaugguuua

SEQ ID NO: 624850 - RNA, 64 nt, hsa
gcagcacaacuaucuuugcaaaaaaaaguaaagaaaaaguaaaugaugguuuaaaaaauacaca

SEQ ID NO: 624851 - RNA, 64 nt, hsa
aguuuuaguuaagauuuucacacauuaauaucaaaaaaguaaguuuaguauuuguuucuccaug

SEQ ID NO: 624852 - RNA, 64 nt, hsa
uuuugaccauagggagauaauuuuuuuauaauacaaaaguaaccacuuggaauuuuaaagauaa

SEQ ID NO: 624853 - RNA, 64 nt, hsa
aauaaguggaauuauguaucuuuucuaaaguuaaaaaaguaaaauauuuuauuaugaguuauua

SEQ ID NO: 624854 - RNA, 64 nt, hsa
aggaagaugacaguauuuuuuucaaguuaucauaaaaaguaauucagaugacauuugagaagua

SEQ ID NO: 624855 - RNA, 64 nt, hsa
accaguuaguuuugccguggaucagaugguuuauaaaaguaauaaccauaaagcaaaaaauaau

SEQ ID NO: 624856 - RNA, 64 nt, hsa
gauauauuccaagccgccugacgaucuaauuguaaaaaguaaagcauacaaauacuagaagaaa

SEQ ID NO: 624857 - RNA, 64 nt, hsa
cagagcgagacuccgucucaaaaaaaaaaaaaaaaaaaguaauuggcagugacuaugggcgcac

SEQ ID NO: 624858 - RNA, 64 nt, hsa
cgccuccucuaauuacauaugauguucucuguucaaaaguaauuggcagugauuggccaggcgc

SEQ ID NO: 624859 - RNA, 64 nt, hsa
ggccuuugaugcuuuaauucuucuucaguucauuaaaaguaacuacuaaggaaagguuaaaaac

SEQ ID NO: 624860 - RNA, 64 nt, hsa
gaauaaaaaauuccuuucauaucguuauuguacaaaaaguaaagaguauccuaaagauuguauu

SEQ ID NO: 624861 - RNA, 64 nt, hsa
agaaagggaagaaaggggagaagggaagagguuaaaaaguaagugcucagaccuaugaacguaa

SEQ ID NO: 624862 - RNA, 64 nt, hsa
uuaagguacacugcauuuugcaaaaaaaaaaaaaaaaaguaaucuuuuagcaaccccaguauuc

SEQ ID NO: 624863 - RNA, 64 nt, hsa
uauggaugaaagcaaucugagagauuugaauagaaaaaguaaucaaguuaaaaccugcaaagcu

SEQ ID NO: 624864 - RNA, 64 nt, hsa
ucuuuguucaguugacuuacuguuucuuaccuuaaaaaguaauuguagauggaaaucaguugug

SEQ ID NO: 624865 - RNA, 64 nt, hsa
acaaagcuaguugccauauuucuauuuuauuuuaaaaaguaaacaugcggcugggcgugguggc

SEQ ID NO: 624866 - RNA, 64 nt, hsa
cugggcaacaagagcaaaaaucccucucaaaaaaaaaaguaaacaugggcacugauuguuuuaa

SEQ ID NO: 624867 - RNA, 64 nt, hsa
ugaaccagauauuuugccauuaucauuguuuaauaaaaguaaucccugcuggucauaggaaaac

SEQ ID NO: 624868 - RNA, 64 nt, hsa
uucagccugagcaacacgagcaaaacuccgucucaaaaguaaauaaaaauaaucaccuggaguu

SEQ ID NO: 624869 - RNA, 64 nt, hsa
ugguagaacagaacaagcaaaagauuaagaguucaaaaguaaaugcaaccaauuuaacauguag

SEQ ID NO: 624870 - RNA, 64 nt, hsa
ccuuucacaugugcuuuauuagacucugggagagaaaaguaaccaagugcuucagaacagguuu

SEQ ID NO: 624871 - RNA, 64 nt, hsa
uuuuaaaauugucaagaguuauucuguuuguuuaaaaaguaagaaaccucuguaagcaauagau

SEQ ID NO: 624872 - RNA, 64 nt, hsa
uuuaaaaacaccuuuagagccuaauuacuccaauaaaaguaacuagagguuuggagucugguua

SEQ ID NO: 624873 - RNA, 64 nt, hsa
augucuguugaugaaauagucacuguuuaaggaaaaaaguaauuaugagguguagcagauugca

SEQ ID NO: 624874 - RNA, 64 nt, hsa
uguauggcaauguuaacugaaccuguuuguauuaaaaaguaaaucccuaugaggaauguggaaa

SEQ ID NO: 624875 - RNA, 64 nt, hsa
cgugacuaccagagauuucuggaaaagcacucccaaaaguaaugagauguguauggcaauguua

SEQ ID NO: 624876 - RNA, 64 nt, hsa
aaaaaccugggcaccuaagcaaugagccacagcaaaaaguaaagaacaacaacaaaauaaagcu

SEQ ID NO: 624877 - RNA, 64 nt, hsa
ugucucugacauaaggagugccugaauagcuuggaaaaguaacaucuccuggccaucccuucau

SEQ ID NO: 624878 - RNA, 64 nt, hsa
ccauaauuuugcauacugaaaauccaauaaucagaaaaguaauuuugucacauuauuuauuaaa

SEQ ID NO: 624879 - RNA, 64 nt, hsa
ccuaguaaaaccuuguucuauuuuucaaucaucaaaaaguaauuauaaauacguauuacaaaca

SEQ ID NO: 624880 - RNA, 64 nt, hsa
aguccugccucguacuccccuuccccuaugauugaaaaguaaacaaaacccacauuuccuaucc

SEQ ID NO: 624881 - RNA, 64 nt, hsa
ccuugaugauucacuguuggggagaagaaacaagaaaaguaacugguugucaccuaugagaccc

SEQ ID NO: 624882 - RNA, 64 nt, hsa
gcaauaacaaacauuaaugaaagcaaaacauuauaaaaguaauuuuaauucaccacauacuuau

SEQ ID NO: 624883 - RNA, 64 nt, hsa
uuaauaaaaugcaauuucauguuagagcuagaauaaaaguaauugagcagucauuugcaaaugc

SEQ ID NO: 624884 - RNA, 64 nt, hsa
ugguuaucaacaacuaaauauaaauuacuuuggaaaaaguaaggcugucuugcaaaaugauccc

SEQ ID NO: 624885 - RNA, 64 nt, hsa
ccugaaauuucuaaugccuugaaaagcauauuacaaaaguaaugcuaccuuuugggaaacaaac

SEQ ID NO: 624886 - RNA, 64 nt, hsa
aacauaauucaaauauuuaaauauuuaagaggagaaaaguaacuagaaaaccaaugaaaaguga

SEQ ID NO: 624887 - RNA, 64 nt, hsa
ggagcacacuggggaagcaggcugcgggccuuccaaaaguaaaaaauggugauaugcaaucgaa

SEQ ID NO: 624888 - RNA, 64 nt, hsa
guauucaagauagauuccugauuuuucaauuaggaaaaguaaaauccaaaauguuagcaaaaca

SEQ ID NO: 624889 - RNA, 64 nt, hsa
agcuugguauggcaugaaaacucgacuuuauuccaaaaguaacuucaaaauuuaaaauacuaga

SEQ ID NO: 624890 - RNA, 64 nt, hsa
ucugguucaagacugucauuuucuauuucaaccgaaaaguaagcauuuaacccggugaauaaau

SEQ ID NO: 624891 - RNA, 64 nt, hsa
uacuauaaaaagccaggaccauguuagaauuaggaaaaguaaccagcauuacugcaccucuugu

SEQ ID NO: 624892 - RNA, 64 nt, hsa
uuuauuuuauuuagugccaaauguauuccauuuuaaaaguaagccagagugagucaaggcauau

SEQ ID NO: 624893 - RNA, 64 nt, hsa
auaaaacccaaucauaguaagugauuaacuagcaaaaaguaaagcuauuuauagcaaauuucua

SEQ ID NO: 624894 - RNA, 64 nt, hsa
cuaauuauucaguuauucaugacaauauuuuuuuaaaaguaagaaauucugaguugucuucuug

SEQ ID NO: 624895 - RNA, 64 nt, hsa
ccuacaaguguaaauugaaaaaucuuuauauuaaaaaaguaaacuguuaugaagcugcuaugua

SEQ ID NO: 624896 - RNA, 64 nt, hsa
aaaggagcaaagaaugcauaagcuauguguuggcaaaaguaauuuauauuaaaauuuugaccug

SEQ ID NO: 624897 - RNA, 64 nt, hsa
ggauuuuaaaccauaaaacuugaagauuaccuacaaaaguaacaguguggcuauaagccugagc

SEQ ID NO: 624898 - RNA, 64 nt, hsa
augguacaggcaaaugugacuggauuucccucaaaaaaguaacuauuaaacagucuugaucucu

SEQ ID NO: 624899 - RNA, 64 nt, hsa
ggccaacgguccaagggauuacaucugcaguuuaaaaaguaaauauauauucuaucguauucau

SEQ ID NO: 624900 - RNA, 64 nt, hsa
guccauucuggguccuagauuacugucauugucuaaaaguaacuuuuaaaaagcagaguucaug

SEQ ID NO: 624901 - RNA, 64 nt, hsa
uagucuugcacauuuuuucauuucuuacuugucuaaaaguaaaaaaaaauaucagccugucucc

SEQ ID NO: 624902 - RNA, 64 nt, hsa
uuuccuguuaccugauccuucuacaggauuuuuaaaaaguaagagaguuucagagaagccgauc

SEQ ID NO: 624903 - RNA, 64 nt, hsa
caagagugaaacuccaucuccaaaaaaaaaaagaaaaaguaacaaaaggaaauuauuuguuuuu

SEQ ID NO: 624904 - RNA, 64 nt, hsa
gagcuuucuagaauauuugccuaauugggaauuaaaaaguaaaauaauaggccaggcauggugg

SEQ ID NO: 624905 - RNA, 64 nt, hsa
gggugccacagcgagacccuaguuaagagaaaaaaaaaguaaaaacaaauugugggucaaagua

SEQ ID NO: 624906 - RNA, 64 nt, hsa
aaauuguaaccuaccaacuaacuuacaugcuuauaaaaguaaaggagaauaacuggccgggcac

SEQ ID NO: 624907 - RNA, 64 nt, hsa
auauuacuuuacacaguaagaugugaaauucacaaaaaguaaaccaaacaaaacgaaugaaaaa

SEQ ID NO: 624908 - RNA, 64 nt, hsa
uaccagccauuuaggugcuuucucuggcaucuauaaaaguaaauucuagugccugccaagugau

SEQ ID NO: 624909 - RNA, 64 nt, hsa
uggauaccauuuuguccagaugcaaaaacauuccaaaaguaauguguuuaguagagagagacuc

SEQ ID NO: 624910 - RNA, 64 nt, hsa
auaaaauuucucaggcagaguccuggauauaggaaaaaguaauuuaugaaguaaacuucaguug

SEQ ID NO: 624911 - RNA, 64 nt, hsa
auuugguggugggaaguagcugaagcaaagaaggaaaaguaauaccuuuaaccucacuagcuuc

SEQ ID NO: 624912 - RNA, 64 nt, hsa
aaaggaaaaguuuucuucauuuagcugcugauuuaaaaguaaaguucuccaauucuuuuuuuuu

SEQ ID NO: 624913 - RNA, 64 nt, hsa
guuccagagaugcauacacuuuuuucugacaagaaaaaguaaaaggugaugagggcaauucugu

SEQ ID NO: 624914 - RNA, 64 nt, hsa
uucuguauuuaccugacauuuauuuuaauguucaaaaaguaaacacuuuaaguuugauguguuu

SEQ ID NO: 624915 - RNA, 64 nt, hsa
cccaguucagaguugaauguuuauuauuaaagaaaaaaguaauguacauauggcuggauuuuuu

SEQ ID NO: 624916 - RNA, 64 nt, hsa
cuauauugaaaauguauauuauuuauauaacuuaaaaaguaaaaauaacuauguuuugagauau

SEQ ID NO: 624917 - RNA, 64 nt, hsa
augcaauaguagaaagcuacuuauuuuaaugaaaaaaaguaaaacuucguucuuuaucagccuc

SEQ ID NO: 624918 - RNA, 60 nt, hsa
aagaaugccaggaugaaugaagaguuuacuaaaaguaaccaucuaaagagcuuguggcca

SEQ ID NO: 624919 - RNA, 64 nt, hsa
ucucaaaacauaggcugaaagcacgaauuacucaaaaaguaagcaaaccaauaccuggugaauc

SEQ ID NO: 624920 - RNA, 64 nt, hsa
ugauuguuaaaacuuguuuguaauggguuggugcaaaaguaauugugguuuuuccauuacuuuc

SEQ ID NO: 624921 - RNA, 64 nt, hsa
uuuaaaauacccaacauguauuaugaaauaccucaaaaguaauuuaguuacauucuuaaacaau

SEQ ID NO: 624922 - RNA, 64 nt, hsa
caauauagcaagacuccaccccuccacaccccaaaaaaguaaguuuaggauuagaauauagcua

SEQ ID NO: 624923 - RNA, 64 nt, hsa
acauuugaauauuguguauuucauacuauucuuuaaaaguaaucuuauguccuuuccuacaugu

SEQ ID NO: 624924 - RNA, 64 nt, hsa
uuauugacuuuuguaacuuacuaauagggauguuaaaaguaacaaaaccaagucaaacuuggug

SEQ ID NO: 624925 - RNA, 64 nt, hsa
agaaaaaaaucacaaaaacaaacuuuuuuuauucaaaaguaacaaaguucuuguaagguaaaua

SEQ ID NO: 624926 - RNA, 64 nt, hsa
uuuaagauuaaagguacacugauggacaaaaaaaaaaaguaaaacauggcaaaaaauaaaauaa

SEQ ID NO: 624927 - RNA, 64 nt, hsa
uuaccagcaacuuaacuuuuaguugauuaaagcaaaaaguaaaccaugaaauugggagauuuua

SEQ ID NO: 624928 - RNA, 64 nt, hsa
uugguaaacaguauuauaaaaucaaaauauggguaaaaguaaauauuuaccagcaacuuaacuu

SEQ ID NO: 624929 - RNA, 64 nt, hsa
uauagaauuugcaaauucagaacauuuuauaccuaaaaguaauucugucuuuccuaaaguguuu

SEQ ID NO: 624930 - RNA, 64 nt, hsa
cauauuuuguauuucacucaaggcucugccaguaaaaaguaaugaaauuguaccuuucuaauga

SEQ ID NO: 624931 - RNA, 64 nt, hsa
uacuuuugacaacgccucaaacuuuucuaaccauaaaaguaauuauacuggugagaaauccuag

SEQ ID NO: 624932 - RNA, 64 nt, hsa
aguuauacuagaauauauuuuuuccagaugcaguaaaaguaaaauauuuaauccauaauuaagu

SEQ ID NO: 624933 - RNA, 64 nt, hsa
agagaaagagagagagagagaaagaaaaagaaagaaaaguaagaaagaaaaaagaaaaagaaag

SEQ ID NO: 624934 - RNA, 64 nt, hsa
aaagaaaaguaagaaagaaaaaagaaaaagaaagaaaaguaagaaagaaaaaaagaaaaagaaa

SEQ ID NO: 624935 - RNA, 64 nt, hsa
ccguuuauccaaaaagguacauguuuuuguauuaaaaaguaaacagggaucagugacuguauuc

SEQ ID NO: 624936 - RNA, 64 nt, hsa
cacauccaguuacauuacuguguucuuucuaaugaaaaguaaagguuuuauauagagaaacuug

SEQ ID NO: 624937 - RNA, 64 nt, hsa
auuucucuuuaauugauguuuuguuuuaaaaguuaaaaguaauucuuggcguggugguucacgc

SEQ ID NO: 624938 - RNA, 62 nt, hsa
aauuccuagcucaaacugugaauaguaaggauugaaaaguaaaguauguaaugcuaagggcu

SEQ ID NO: 624939 - RNA, 64 nt, hsa
ccaauaaaaauaccaucugaggguguuacuguccaaaaguaaagaauaagaugcaucacuaagc

SEQ ID NO: 624940 - RNA, 64 nt, hsa
gaauccauuuagauuaauguauguaauuucugauaaaaguaagagaaaugaggaacuuucgaac

SEQ ID NO: 624941 - RNA, 64 nt, hsa
guccuagagauuacauaaauaguguguagcccagaaaaguaaaauaggugucacgcuguuuuuu

SEQ ID NO: 624942 - RNA, 64 nt, hsa; identical to SEQ ID NO: 105402

SEQ ID NO: 624943 - RNA, 64 nt, hsa; identical to SEQ ID NO: 105403

SEQ ID NO: 624944 - RNA, 64 nt, hsa; identical to SEQ ID NO: 24478

SEQ ID NO: 624945 - RNA, 64 nt, hsa; identical to SEQ ID NO: 24479

SEQ ID NO: 624946 - RNA, 64 nt, hsa; identical to SEQ ID NO: 24480

SEQ ID NO: 624947 - RNA, 64 nt, hsa; identical to SEQ ID NO: 24481

SEQ ID NO: 624948 - RNA, 64 nt, hsa; identical to SEQ ID NO: 24482

SEQ ID NO: 624949 - RNA, 64 nt, hsa; identical to SEQ ID NO: 24483

SEQ ID NO: 624950 - RNA, 64 nt, hsa; identical to SEQ ID NO: 24484

SEQ ID NO: 624951 - RNA, 64 nt, hsa; identical to SEQ ID NO: 24485

SEQ ID NO: 624952 - RNA, 64 nt, hsa; identical to SEQ ID NO: 24486

SEQ ID NO: 624953 - RNA, 64 nt, hsa; identical to SEQ ID NO: 24487

SEQ ID NO: 624954 - RNA, 64 nt, hsa; identical to SEQ ID NO: 24488

SEQ ID NO: 624955 - RNA, 64 nt, hsa; identical to SEQ ID NO: 24489

SEQ ID NO: 624956 - RNA, 64 nt, hsa; identical to SEQ ID NO: 24490

SEQ ID NO: 624957 - RNA, 64 nt, hsa; identical to SEQ ID NO: 24491

SEQ ID NO: 624958 - RNA, 64 nt, hsa; identical to SEQ ID NO: 24492

SEQ ID NO: 624959 - RNA, 64 nt, hsa; identical to SEQ ID NO: 24493

SEQ ID NO: 624960 - RNA, 64 nt, hsa; identical to SEQ ID NO: 24494

SEQ ID NO: 624961 - RNA, 64 nt, hsa; identical to SEQ ID NO: 24495

SEQ ID NO: 624962 - RNA, 64 nt, hsa; identical to SEQ ID NO: 24496

SEQ ID NO: 624963 - RNA, 64 nt, hsa; identical to SEQ ID NO: 24497

SEQ ID NO: 624964 - RNA, 64 nt, hsa; identical to SEQ ID NO: 24498

SEQ ID NO: 624965 - RNA, 64 nt, hsa; identical to SEQ ID NO: 24499

SEQ ID NO: 624966 - RNA, 64 nt, hsa; identical to SEQ ID NO: 24500

SEQ ID NO: 624967 - RNA, 64 nt, hsa; identical to SEQ ID NO: 24501

SEQ ID NO: 624968 - RNA, 64 nt, hsa; identical to SEQ ID NO: 24502

SEQ ID NO: 624969 - RNA, 64 nt, hsa; identical to SEQ ID NO: 24503

SEQ ID NO: 624970 - RNA, 64 nt, hsa; identical to SEQ ID NO: 24504

SEQ ID NO: 624971 - RNA, 64 nt, hsa; identical to SEQ ID NO: 24505

SEQ ID NO: 624972 - RNA, 64 nt, hsa; identical to SEQ ID NO: 24506

SEQ ID NO: 624973 - RNA, 64 nt, hsa; identical to SEQ ID NO: 24507

SEQ ID NO: 624974 - RNA, 64 nt, hsa; identical to SEQ ID NO: 24508

SEQ ID NO: 624975 - RNA, 64 nt, hsa; identical to SEQ ID NO: 24509

SEQ ID NO: 624976 - RNA, 64 nt, hsa; identical to SEQ ID NO: 24510

SEQ ID NO: 624977 - RNA, 64 nt, hsa; identical to SEQ ID NO: 24511

SEQ ID NO: 624978 - RNA, 64 nt, hsa; identical to SEQ ID NO: 24512

SEQ ID NO: 624979 - RNA, 64 nt, hsa; identical to SEQ ID NO: 24513

SEQ ID NO: 624980 - RNA, 64 nt, hsa; identical to SEQ ID NO: 24514

SEQ ID NO: 624981 - RNA, 64 nt, hsa; identical to SEQ ID NO: 24515

SEQ ID NO: 624982 - RNA, 64 nt, hsa; identical to SEQ ID NO: 24516

SEQ ID NO: 624983 - RNA, 64 nt, hsa; identical to SEQ ID NO: 24517

SEQ ID NO: 624984 - RNA, 64 nt, hsa; identical to SEQ ID NO: 24518

SEQ ID NO: 624985 - RNA, 64 nt, hsa; identical to SEQ ID NO: 24519

SEQ ID NO: 624986 - RNA, 64 nt, hsa; identical to SEQ ID NO: 24520

SEQ ID NO: 624987 - RNA, 64 nt, hsa; identical to SEQ ID NO: 24521

SEQ ID NO: 624988 - RNA, 64 nt, hsa; identical to SEQ ID NO: 24522

SEQ ID NO: 624989 - RNA, 64 nt, hsa; identical to SEQ ID NO: 24523

SEQ ID NO: 624990 - RNA, 64 nt, hsa; identical to SEQ ID NO: 24524

SEQ ID NO: 624991 - RNA, 64 nt, hsa; identical to SEQ ID NO: 24525

SEQ ID NO: 624992 - RNA, 64 nt, hsa; identical to SEQ ID NO: 24526

SEQ ID NO: 624993 - RNA, 64 nt, hsa; identical to SEQ ID NO: 24527

SEQ ID NO: 624994 - RNA, 64 nt, hsa; identical to SEQ ID NO: 24528

SEQ ID NO: 624995 - RNA, 64 nt, hsa; identical to SEQ ID NO: 24529

SEQ ID NO: 624996 - RNA, 64 nt, hsa; identical to SEQ ID NO: 24530

SEQ ID NO: 624997 - RNA, 64 nt, hsa; identical to SEQ ID NO: 24531

SEQ ID NO: 624998 - RNA, 64 nt, hsa; identical to SEQ ID NO: 24532

SEQ ID NO: 624999 - RNA, 64 nt, hsa; identical to SEQ ID NO: 24533

SEQ ID NO: 625000 - RNA, 64 nt, hsa; identical to SEQ ID NO: 24534

SEQ ID NO: 625001 - RNA, 64 nt, hsa; identical to SEQ ID NO: 24535

SEQ ID NO: 625002 - RNA, 64 nt, hsa; identical to SEQ ID NO: 24536

SEQ ID NO: 625003 - RNA, 64 nt, hsa; identical to SEQ ID NO: 24537

SEQ ID NO: 625004 - RNA, 64 nt, hsa; identical to SEQ ID NO: 24538

SEQ ID NO: 625005 - RNA, 64 nt, hsa; identical to SEQ ID NO: 24539

SEQ ID NO: 625006 - RNA, 64 nt, hsa; identical to SEQ ID NO: 24540

SEQ ID NO: 625007 - RNA, 64 nt, hsa; identical to SEQ ID NO: 24541

SEQ ID NO: 625008 - RNA, 64 nt, hsa; identical to SEQ ID NO: 24542

SEQ ID NO: 625009 - RNA, 64 nt, hsa; identical to SEQ ID NO: 24543

SEQ ID NO: 625010 - RNA, 64 nt, hsa; identical to SEQ ID NO: 24544

SEQ ID NO: 625011 - RNA, 64 nt, hsa; identical to SEQ ID NO: 24545

SEQ ID NO: 625012 - RNA, 64 nt, hsa; identical to SEQ ID NO: 24546

SEQ ID NO: 625013 - RNA, 64 nt, hsa; identical to SEQ ID NO: 24547

SEQ ID NO: 625014 - RNA, 64 nt, hsa; identical to SEQ ID NO: 24548

SEQ ID NO: 625015 - RNA, 64 nt, hsa; identical to SEQ ID NO: 24549

SEQ ID NO: 625016 - RNA, 64 nt, hsa; identical to SEQ ID NO: 24550

SEQ ID NO: 625017 - RNA, 64 nt, hsa; identical to SEQ ID NO: 24551

SEQ ID NO: 625018 - RNA, 64 nt, hsa; identical to SEQ ID NO: 24552

SEQ ID NO: 625019 - RNA, 64 nt, hsa; identical to SEQ ID NO: 24553

SEQ ID NO: 625020 - RNA, 64 nt, hsa; identical to SEQ ID NO: 128083

SEQ ID NO: 625021 - RNA, 64 nt, hsa; identical to SEQ ID NO: 128084

SEQ ID NO: 625022 - RNA, 64 nt, hsa; identical to SEQ ID NO: 128085

SEQ ID NO: 625023 - RNA, 64 nt, hsa; identical to SEQ ID NO: 128086

SEQ ID NO: 625024 - RNA, 64 nt, hsa; identical to SEQ ID NO: 128087

SEQ ID NO: 625025 - RNA, 64 nt, hsa; identical to SEQ ID NO: 128088

SEQ ID NO: 625026 - RNA, 64 nt, hsa; identical to SEQ ID NO: 128089

SEQ ID NO: 625027 - RNA, 64 nt, hsa; identical to SEQ ID NO: 128090

SEQ ID NO: 625028 - RNA, 64 nt, hsa; identical to SEQ ID NO: 128091

SEQ ID NO: 625029 - RNA, 64 nt, hsa; identical to SEQ ID NO: 128092

SEQ ID NO: 625030 - RNA, 64 nt, hsa; identical to SEQ ID NO: 128093

SEQ ID NO: 625031 - RNA, 64 nt, hsa; identical to SEQ ID NO: 128094

SEQ ID NO: 625032 - RNA, 64 nt, hsa; identical to SEQ ID NO: 128095

SEQ ID NO: 625033 - RNA, 64 nt, hsa; identical to SEQ ID NO: 128096

SEQ ID NO: 625034 - RNA, 64 nt, hsa; identical to SEQ ID NO: 128097

SEQ ID NO: 625035 - RNA, 64 nt, hsa; identical to SEQ ID NO: 128098

SEQ ID NO: 625036 - RNA, 64 nt, hsa; identical to SEQ ID NO: 128099

SEQ ID NO: 625037 - RNA, 64 nt, hsa; identical to SEQ ID NO: 128100

SEQ ID NO: 625038 - RNA, 64 nt, hsa; identical to SEQ ID NO: 128101

SEQ ID NO: 625039 - RNA, 64 nt, hsa; identical to SEQ ID NO: 128102

SEQ ID NO: 625040 - RNA, 64 nt, hsa; identical to SEQ ID NO: 128103

SEQ ID NO: 625041 - RNA, 64 nt, hsa; identical to SEQ ID NO: 128104

SEQ ID NO: 625042 - RNA, 64 nt, hsa; identical to SEQ ID NO: 128105

SEQ ID NO: 625043 - RNA, 64 nt, hsa; identical to SEQ ID NO: 128106

SEQ ID NO: 625044 - RNA, 64 nt, hsa; identical to SEQ ID NO: 128107

SEQ ID NO: 625045 - RNA, 64 nt, hsa; identical to SEQ ID NO: 128108

SEQ ID NO: 625046 - RNA, 64 nt, hsa; identical to SEQ ID NO: 128109

SEQ ID NO: 625047 - RNA, 64 nt, hsa; identical to SEQ ID NO: 128110

SEQ ID NO: 625048 - RNA, 64 nt, hsa; identical to SEQ ID NO: 128111

SEQ ID NO: 625049 - RNA, 64 nt, hsa; identical to SEQ ID NO: 128112

SEQ ID NO: 625050 - RNA, 64 nt, hsa; identical to SEQ ID NO: 128113

SEQ ID NO: 625051 - RNA, 64 nt, hsa; identical to SEQ ID NO: 128114

SEQ ID NO: 625052 - RNA, 64 nt, hsa; identical to SEQ ID NO: 128115

SEQ ID NO: 625053 - RNA, 64 nt, hsa; identical to SEQ ID NO: 128116

SEQ ID NO: 625054 - RNA, 64 nt, hsa; identical to SEQ ID NO: 128117

SEQ ID NO: 625055 - RNA, 64 nt, hsa; identical to SEQ ID NO: 128118

SEQ ID NO: 625056 - RNA, 64 nt, hsa; identical to SEQ ID NO: 128119

SEQ ID NO: 625057 - RNA, 64 nt, hsa; identical to SEQ ID NO: 128120

SEQ ID NO: 625058 - RNA, 64 nt, hsa; identical to SEQ ID NO: 128121

SEQ ID NO: 625059 - RNA, 64 nt, hsa
aggcugaaguccucacccucucuuaaagcggcaccaacgugagagagacaggcagacagacaga

SEQ ID NO: 625060 - RNA, 64 nt, hsa
acuagacuuuaugaaauuaacagauaaaguucuucaacgugaugucaucuugugccuuucaugu

SEQ ID NO: 625061 - RNA, 64 nt, hsa
caagggcacccaugagcuccuaucaagaagugaucaacgugaccccuuuucacagauugaaagg

SEQ ID NO: 625062 - RNA, 64 nt, hsa
uggcuugaacucaggaguucgagacuagccugggcaacgugaugagacuccgucucuaccaaaa

SEQ ID NO: 625063 - RNA, 64 nt, hsa
cucccaccuaucaccccucacccauaacucaggucaacgugaccaaccuuccuugcuuacacau

SEQ ID NO: 625064 - RNA, 64 nt, hsa
augccccacugaggugcuguugguuuauugcuggcaacgugaauucucucaggggucuaggagg

SEQ ID NO: 625065 - RNA, 64 nt, hsa
ucuugaugugagcacuggagcuuuuuuuuuuuuacaacgugacaggaagaggagggagagggug

SEQ ID NO: 625066 - RNA, 64 nt, hsa
cuucuuuuuguguggggucaugggcuccaaaagccaacgugaacaauuaaaaauguauugagca

SEQ ID NO: 625067 - RNA, 64 nt, hsa
acuccaguuaagacaggaucuuaucagagguggacaacgugaagauuuccuuuuccauuuucaa

SEQ ID NO: 625068 - RNA, 64 nt, hsa
gcgagcugccuacaaauuacucugucuccaaaggcaacgugaaaagaaaugauggggaggaaaa

SEQ ID NO: 625069 - RNA, 64 nt, hsa
ccccccacacccacagcuugcucuucuaucuccacaacgugagccuggaagaggagaaaaugug

SEQ ID NO: 625070 - RNA, 64 nt, hsa
uacuuaauccaauauauccaaaauauuggcauuucaacgugaucacuauuaaaaauuuuaacgu

SEQ ID NO: 625071 - RNA, 64 nt, hsa
aagauaaacaaauaugauguucuuugacguaaaucaacgugaugauucuuucacauguaaacac

SEQ ID NO: 625072 - RNA, 64 nt, hsa
ggaaaccccagcggcagaugggccugugugcacccaacgugaugcuaugcaugucugaccgacg

SEQ ID NO: 625073 - RNA, 64 nt, hsa
aaggcauauagagauguugucauaacuaggucuucaacgugaaaauuaauuuuuauuguaucau

SEQ ID NO: 625074 - RNA, 64 nt, hsa
acacagggaaauggaucauugauuuuuuuuuaaucaacgugaaugaagaauguuuguuuauaua

SEQ ID NO: 625075 - RNA, 64 nt, hsa
cuguccuuccccuuccugguccuucagcccaugucaacgugacagacaccuuuguauguuccuu

SEQ ID NO: 625076 - RNA, 64 nt, hsa
ucgcucugcucggggagccugggcagagcagcagcaacgugagggucgcugugguggugguuuc

SEQ ID NO: 625077 - RNA, 64 nt, hsa
cugggugguggcugccacuagcccaggaacaugacaacgugaccacaccacacaugccuccaac

SEQ ID NO: 625078 - RNA, 64 nt, hsa
ucucagccgugcaggccuuugcaguugcccuggccaacgugacucagcgccucaaaugaagaga

SEQ ID NO: 625079 - RNA, 64 nt, hsa
cuacaaaaaauuuuauuguaauauuuuuauuuuacaacgugaucuuacagccuacagaaugcuc

SEQ ID NO: 625080 - RNA, 64 nt, hsa
aucuucacaaaguugucuuuucacuguguuuugucaacgugaaauuaaauuguaguuauaagca

SEQ ID NO: 625081 - RNA, 64 nt, hsa
gaacucugggggauauuccccugagcaaaacaaacaacgugagauuuuuacucaaacagaaaca

SEQ ID NO: 625082 - RNA, 64 nt, hsa
uggcacaaacuucagacucuaggcugaccauauacaacgugagagaaugaaacuauagaucaaa

SEQ ID NO: 625083 - RNA, 64 nt, hsa
agccuuuauccagcaguauuuuaaguggggaaugcaacgugaggccaacugaacaauucccccc

SEQ ID NO: 625084 - RNA, 64 nt, hsa
gagauucacagcaacugaucaaagggaguccagucaacgugagcaagcgugauuaugaugagga

SEQ ID NO: 625085 - RNA, 64 nt, hsa
gaaggcaaaggaagcugucucggguguuucugaacaacgugacucaugaggggcuuuggcuacc

SEQ ID NO: 625086 - RNA, 64 nt, hsa
gcugcuagcccagaccuguggacgaggcagaccacaacgugaaagaaggaccagccccuugacc

SEQ ID NO: 625087 - RNA, 64 nt, hsa
gccugccaggaacucugugauaacauagauugaucaacgugauguugauuacaucagcgucucc

SEQ ID NO: 625088 - RNA, 64 nt, hsa
auuaucuaguccccagauugaucaucuccccuggcaacgugacucuguuuuuuguguguguuuc

SEQ ID NO: 625089 - RNA, 64 nt, hsa
ugugcagaauccuugcugggguuucuacaguccccaacgugaacaguauuaagcaagaggugga

SEQ ID NO: 625090 - RNA, 64 nt, hsa
augaaaaaaauauuuuaaaaaacccagccaaaaccaacgugagcccugccugcucggacgccuu

SEQ ID NO: 625091 - RNA, 64 nt, hsa
ugccuuccggccccagaaggaucuuccuggaugccaacgugaaggaaagcuacugcccccuagu

SEQ ID NO: 625092 - RNA, 64 nt, hsa
gacucaacgcagaagaauggacgaaaugaccauccaacgugauuaaggauaggaaucgguaguu

SEQ ID NO: 625093 - RNA, 64 nt, hsa
uugggugaauucugcagguuuuaugggcuugucacaacgugaagggcuggaauguauauuacca

SEQ ID NO: 625094 - RNA, 64 nt, hsa
agauguccucuuaagaaaaugaugcaucaggaagcaacgugauggaggacuugggggaaaagga

SEQ ID NO: 625095 - RNA, 64 nt, hsa
uuccuccaaggcauccucuaccuagcuaggucaccaacgugaagaaguuaugccacugccacuu

SEQ ID NO: 625096 - RNA, 64 nt, hsa
cuaaucuuauacuguuacaguggcaaucgcauuucaacgugagcgugggaggggacaaacauuc

SEQ ID NO: 625097 - RNA, 64 nt, hsa
auuggugcuuauuuuuucaaaaauuugcugugaacaacgugaugacaacaagcaacauuuaucu

SEQ ID NO: 625098 - RNA, 51 nt, hsa
aaacucccucuucgucaugaccaacgugauccucaccaugaaccagacaca

SEQ ID NO: 625099 - RNA, 64 nt, hsa
aaaaauuucaucuuaaagcacuuucauuuuauaccaacgugaaaagugccauuuuuagaauaac

SEQ ID NO: 625100 - RNA, 64 nt, hsa
uuguuuacauauuggcuauggcugcugucuaguucaacgugagaguugaauaguugcaucagag

SEQ ID NO: 625101 - RNA, 51 nt, hsa
uuuuuuacuagguauuuugaccaacgugauuuagcugaugagccaucuuga

SEQ ID NO: 625102 - RNA, 64 nt, hsa
auuucaaguccuguuuauaagucuagucauucugcaacgugacauaucccccaaaaugaaguua

SEQ ID NO: 625103 - RNA, 64 nt, hsa
cccuccaggauguauaugcagacgccuccauuggcaacgugacgggcagcaacgccgucaaugu

SEQ ID NO: 625104 - RNA, 64 nt, hsa
aaggacaggacccucaggaauucagugccuucaacaacgugagagaaagagagaagccagccac

SEQ ID NO: 625105 - RNA, 64 nt, hsa
gacagccuugucacaccuccccggugcuguuuuacaacgugaggguagacgcugucaguaaccc

SEQ ID NO: 625106 - RNA, 64 nt, hsa
uagcagcagucacuaaauuggaaacaaaagguugcaacgugacaaaaaaaauuguguaguauuu

SEQ ID NO: 625107 - RNA, 64 nt, hsa
ccugccuggguucaaacucugcauccuucucuaacaacgugacuaccucaugucugcuucaagg

SEQ ID NO: 625108 - RNA, 64 nt, hsa
cuucuccuaguacaaccaaacagauaaccagaugcaacgugaagaucuagacuggacccugguu

SEQ ID NO: 625109 - RNA, 64 nt, hsa
guuuguagacuuuagaguucuuuaauucuuggcacaacgugacuguugagcuaacaccaaauag

SEQ ID NO: 625110 - RNA, 64 nt, hsa
auuucugcauuguuuguaucaccaccuaugcuaucaacgugagccugauguggcucaguuuccg

SEQ ID NO: 625111 - RNA, 64 nt, hsa
ugagcuagggagguggugcagucagccucgcucucaacgugacccggggaaugaccacccagag

SEQ ID NO: 625112 - RNA, 64 nt, hsa
uaugcucaaggaccuggaaacccaugcuucgagacaacgugacuuuaaugggaggguggguggg

SEQ ID NO: 625113 - RNA, 64 nt, hsa
cucagggagccccacagccccaagcucgcugaggcaacgugagaacaggcuaugggaaggcugc

SEQ ID NO: 625114 - RNA, 64 nt, hsa
ucucccaacaccagcugguguugcagagggaggucaacgugaguuuggaucucuuguacgcaga

SEQ ID NO: 625115 - RNA, 64 nt, hsa
aguuagcuuuguaagaaacagucaaacuguuuuccaacgugacauuuuauauucccaccaggaa

SEQ ID NO: 625116 - RNA, 64 nt, hsa
uuccagguucuggggagaacaaugauccacgggucaacgugaucacauuuccuucuauccuucu

SEQ ID NO: 625117 - RNA, 64 nt, hsa
gucagaggcugauucuuguagaauuaacagcccucaacgugaugagcuaugauaacacuaugaa

SEQ ID NO: 625118 - RNA, 64 nt, hsa
ucaauaagaugcaaaaucuuccaacuuuucaacccaacgugaugaauauuugauuuuguucuag

SEQ ID NO: 625119 - RNA, 64 nt, hsa
guguuuuguuuuguuuuuuuucuuaaaacaacagcaacgugaucuuggcugucugucauguguu

SEQ ID NO: 625120 - RNA, 54 nt, hsa
caggcucucgaagcucauaaaauucaacgugaggaagcaagugacaaggacgcc

SEQ ID NO: 625121 - RNA, 64 nt, hsa
acuucagauuguucaacaugagagaaaggcucagcaacgugaaauaacgcaaauggcuuccucu

SEQ ID NO: 625122 - RNA, 64 nt, hsa
guugugaacuggugggccguauguaacagcugaccaacgugaagauacugguacuugauagccu

SEQ ID NO: 625123 - RNA, 64 nt, hsa
ggagcugaggacucucacgauaugcaaguucauccaacgugaagauaccauaagcuuuuucucu

SEQ ID NO: 625124 - RNA, 64 nt, hsa
gucuuugcaaugccaacauaagggagaucuuggccaacgugaaauaaaauuacucauucaaaac

SEQ ID NO: 625125 - RNA, 64 nt, hsa
ccuccccaccucccacugcuuccugcaagggcaccaguuguaugagaaaguuggccuuuggacu

SEQ ID NO: 625126 - RNA, 64 nt, hsa
uuuuuuuuuuccaaacuacuuuuugucacugugacaguuguaaauaaaguuugaaaaugcuuuc

SEQ ID NO: 625127 - RNA, 64 nt, hsa
uuaaaaguuugccuguagagcaaaauaaaacagucaguuguagucauuaauccuugaggcccaa

SEQ ID NO: 625128 - RNA, 64 nt, hsa
uguguugcccaggcuggauugcaguggcuauucgcaguuguaaucauagcacacugcagccucg

SEQ ID NO: 625129 - RNA, 64 nt, hsa
aggauuacagguaugagccaccaugcccggcuggcaguuguauuuuuuaaagcccuucugauga

SEQ ID NO: 625130 - RNA, 64 nt, hsa
gccaaugaaaucauuucugggcgucagcgccaggcaguuguauuuuuuuuuuuuuuuuuuuuuu

SEQ ID NO: 625131 - RNA, 64 nt, hsa
ugggcucaugaagauauugcaucaugagcugcagcaguuguacucuuuuuugaugaccuaaaaa

SEQ ID NO: 625132 - RNA, 64 nt, hsa
ugauugugccuaugcaugaugaaugaaugaauuucaguuguacauugccuaaaucauaacuuga

SEQ ID NO: 625133 - RNA, 64 nt, hsa
auacccagcuaaagaauacauaucagaauauauccaguuguaaauagccauacccaguuguacu

SEQ ID NO: 625134 - RNA, 64 nt, hsa
uaucagaauauauccaguuguaaauagccauacccaguuguacuacaaugagcuuuuuaaaauc

SEQ ID NO: 625135 - RNA, 64 nt, hsa
uccauuuuuaaagcuucuuacuggugaaacagcccaguuguaguaggugccagucagucaaggc

SEQ ID NO: 625136 - RNA, 64 nt, hsa
uuacaggauauuccuagguaaaugaaggagccuucaguuguaaauuucaauuaccccaaaaugu

SEQ ID NO: 625137 - RNA, 64 nt, hsa
gucugucuauauuuaagguuucugggaguaguuuugucuauauuuaauccauagaugugcuccu

SEQ ID NO: 625138 - RNA, 64 nt, hsa
cuauuuuuggcuuccuacauaaauuaauaaagucugucuauauuuaagguuucugggaguaguu

SEQ ID NO: 625139 - RNA, 64 nt, hsa
uaagaaucaccaggccaguguuucuggguuugcuugucuauauguuugucuauauuuuuugccu

SEQ ID NO: 625140 - RNA, 64 nt, hsa
ggccaguguuucuggguuugcuugucuauauguuugucuauauuuuuugccuauacauuuuucc

SEQ ID NO: 625141 - RNA, 64 nt, hsa
gguagauaauuuuucaaaugugaauuaucuuuugugucuauauugauagcucuuaaaggaguga

SEQ ID NO: 625142 - RNA, 64 nt, hsa
uaacguuuuuguuacaugcauuguaauucugcuuugucuauaagauauggucaaguacagcucu

SEQ ID NO: 625143 - RNA, 64 nt, hsa
guucuguaugaaacugagauguugucuauagcuaugucuauaaacaaccugaagacuugugaaa

SEQ ID NO: 625144 - RNA, 64 nt, hsa
augauugaaugaguucuguaugaaacugagauguugucuauagcuaugucuauaaacaaccuga

SEQ ID NO: 625145 - RNA, 64 nt, hsa
gggaaaagaauuuccuuuucccccuuuuuuguguugucuauaggaauuaacuugggauuguuuu

SEQ ID NO: 625146 - RNA, 64 nt, hsa
uguuaauuuauaggcacauuugugguaauuuauaugucuauagaguaaguauaagagauaauuc

SEQ ID NO: 625147 - RNA, 64 nt, hsa
aaaucgcuguaugguauggucuucuacacauuuaugucuauagauaucuaucgaucaucuuucu

SEQ ID NO: 625148 - RNA, 64 nt, hsa
uggcguuuccuucuguuugguuuucagagccccaugucuauauaguccugagugcaaguaauua

SEQ ID NO: 625149 - RNA, 64 nt, hsa
cccccagaggugaaugagguauucuauaaguuagugucuauaauugugaaaguacaaacuucuu

SEQ ID NO: 625150 - RNA, 64 nt, hsa
uuuccucauguaucuuugcacucuugugcuaguaugucuauagugugaauacauucauaaauuu

SEQ ID NO: 625151 - RNA, 64 nt, hsa; identical to SEQ ID NO: 175895

SEQ ID NO: 625152 - RNA, 64 nt, hsa; identical to SEQ ID NO: 175896

SEQ ID NO: 625153 - RNA, 64 nt, hsa; identical to SEQ ID NO: 175897

SEQ ID NO: 625154 - RNA, 64 nt, hsa; identical to SEQ ID NO: 175898

SEQ ID NO: 625155 - RNA, 64 nt, hsa; identical to SEQ ID NO: 175899

SEQ ID NO: 625156 - RNA, 64 nt, hsa; identical to SEQ ID NO: 175900

SEQ ID NO: 625157 - RNA, 64 nt, hsa; identical to SEQ ID NO: 175901

SEQ ID NO: 625158 - RNA, 64 nt, hsa; identical to SEQ ID NO: 175902

SEQ ID NO: 625159 - RNA, 64 nt, hsa; identical to SEQ ID NO: 175903

SEQ ID NO: 625160 - RNA, 64 nt, hsa; identical to SEQ ID NO: 175904

SEQ ID NO: 625161 - RNA, 64 nt, hsa; identical to SEQ ID NO: 175905

SEQ ID NO: 625162 - RNA, 64 nt, hsa; identical to SEQ ID NO: 175906

SEQ ID NO: 625163 - RNA, 64 nt, hsa; identical to SEQ ID NO: 175907

SEQ ID NO: 625164 - RNA, 64 nt, hsa; identical to SEQ ID NO: 175908

SEQ ID NO: 625165 - RNA, 64 nt, hsa; identical to SEQ ID NO: 175909

SEQ ID NO: 625166 - RNA, 64 nt, hsa; identical to SEQ ID NO: 175910

SEQ ID NO: 625167 - RNA, 64 nt, hsa; identical to SEQ ID NO: 175911

SEQ ID NO: 625168 - RNA, 64 nt, hsa; identical to SEQ ID NO: 175912

SEQ ID NO: 625169 - RNA, 64 nt, hsa; identical to SEQ ID NO: 175913

SEQ ID NO: 625170 - RNA, 64 nt, hsa; identical to SEQ ID NO: 175914

SEQ ID NO: 625171 - RNA, 64 nt, hsa; identical to SEQ ID NO: 175915

SEQ ID NO: 625172 - RNA, 64 nt, hsa; identical to SEQ ID NO: 175916

SEQ ID NO: 625173 - RNA, 64 nt, hsa; identical to SEQ ID NO: 175917

SEQ ID NO: 625174 - RNA, 64 nt, hsa; identical to SEQ ID NO: 175918

SEQ ID NO: 625175 - RNA, 64 nt, hsa; identical to SEQ ID NO: 175919

SEQ ID NO: 625176 - RNA, 64 nt, hsa; identical to SEQ ID NO: 175920

SEQ ID NO: 625177 - RNA, 64 nt, hsa; identical to SEQ ID NO: 175921

SEQ ID NO: 625178 - RNA, 64 nt, hsa; identical to SEQ ID NO: 175922

SEQ ID NO: 625179 - RNA, 64 nt, hsa; identical to SEQ ID NO: 175923

SEQ ID NO: 625180 - RNA, 64 nt, hsa; identical to SEQ ID NO: 175924

SEQ ID NO: 625181 - RNA, 64 nt, hsa; identical to SEQ ID NO: 175925

SEQ ID NO: 625182 - RNA, 64 nt, hsa; identical to SEQ ID NO: 175926

SEQ ID NO: 625183 - RNA, 64 nt, hsa; identical to SEQ ID NO: 175927

SEQ ID NO: 625184 - RNA, 64 nt, hsa; identical to SEQ ID NO: 175928

SEQ ID NO: 625185 - RNA, 64 nt, hsa; identical to SEQ ID NO: 175929

SEQ ID NO: 625186 - RNA, 64 nt, hsa; identical to SEQ ID NO: 175930

SEQ ID NO: 625187 - RNA, 64 nt, hsa; identical to SEQ ID NO: 175931

SEQ ID NO: 625188 - RNA, 64 nt, hsa; identical to SEQ ID NO: 175932

SEQ ID NO: 625189 - RNA, 64 nt, hsa; identical to SEQ ID NO: 175933

SEQ ID NO: 625190 - RNA, 64 nt, hsa; identical to SEQ ID NO: 175934

SEQ ID NO: 625191 - RNA, 64 nt, hsa; identical to SEQ ID NO: 175935

SEQ ID NO: 625192 - RNA, 64 nt, hsa; identical to SEQ ID NO: 175936

SEQ ID NO: 625193 - RNA, 64 nt, hsa; identical to SEQ ID NO: 175937

SEQ ID NO: 625194 - RNA, 64 nt, hsa; identical to SEQ ID NO: 175938

SEQ ID NO: 625195 - RNA, 64 nt, hsa; identical to SEQ ID NO: 175939

SEQ ID NO: 625196 - RNA, 64 nt, hsa; identical to SEQ ID NO: 175940

SEQ ID NO: 625197 - RNA, 64 nt, hsa; identical to SEQ ID NO: 175941

SEQ ID NO: 625198 - RNA, 64 nt, hsa; identical to SEQ ID NO: 175942

SEQ ID NO: 625199 - RNA, 64 nt, hsa; identical to SEQ ID NO: 175943

SEQ ID NO: 625200 - RNA, 64 nt, hsa; identical to SEQ ID NO: 175944

SEQ ID NO: 625201 - RNA, 64 nt, hsa; identical to SEQ ID NO: 175945

SEQ ID NO: 625202 - RNA, 64 nt, hsa; identical to SEQ ID NO: 175946

SEQ ID NO: 625203 - RNA, 64 nt, hsa; identical to SEQ ID NO: 175947

SEQ ID NO: 625204 - RNA, 64 nt, hsa; identical to SEQ ID NO: 175948

SEQ ID NO: 625205 - RNA, 64 nt, hsa; identical to SEQ ID NO: 175949

SEQ ID NO: 625206 - RNA, 64 nt, hsa; identical to SEQ ID NO: 175950

SEQ ID NO: 625207 - RNA, 64 nt, hsa; identical to SEQ ID NO: 175951

SEQ ID NO: 625208 - RNA, 64 nt, hsa; identical to SEQ ID NO: 175952

SEQ ID NO: 625209 - RNA, 64 nt, hsa; identical to SEQ ID NO: 175953

SEQ ID NO: 625210 - RNA, 62 nt, hsa; identical to SEQ ID NO: 175954

SEQ ID NO: 625211 - RNA, 64 nt, hsa; identical to SEQ ID NO: 175955

SEQ ID NO: 625212 - RNA, 64 nt, hsa; identical to SEQ ID NO: 175956

SEQ ID NO: 625213 - RNA, 64 nt, hsa; identical to SEQ ID NO: 175957

SEQ ID NO: 625214 - RNA, 64 nt, hsa; identical to SEQ ID NO: 175958

SEQ ID NO: 625215 - RNA, 64 nt, hsa; identical to SEQ ID NO: 175959

SEQ ID NO: 625216 - RNA, 64 nt, hsa; identical to SEQ ID NO: 175960

SEQ ID NO: 625217 - RNA, 64 nt, hsa; identical to SEQ ID NO: 175961

SEQ ID NO: 625218 - RNA, 64 nt, hsa; identical to SEQ ID NO: 175962

SEQ ID NO: 625219 - RNA, 64 nt, hsa; identical to SEQ ID NO: 175963

SEQ ID NO: 625220 - RNA, 64 nt, hsa; identical to SEQ ID NO: 175964

SEQ ID NO: 625221 - RNA, 64 nt, hsa; identical to SEQ ID NO: 175965

SEQ ID NO: 625222 - RNA, 64 nt, hsa; identical to SEQ ID NO: 175966

SEQ ID NO: 625223 - RNA, 64 nt, hsa; identical to SEQ ID NO: 175967

SEQ ID NO: 625224 - RNA, 64 nt, hsa; identical to SEQ ID NO: 175968

SEQ ID NO: 625225 - RNA, 64 nt, hsa; identical to SEQ ID NO: 175969

SEQ ID NO: 625226 - RNA, 64 nt, hsa; identical to SEQ ID NO: 175970

SEQ ID NO: 625227 - RNA, 64 nt, hsa; identical to SEQ ID NO: 175971

SEQ ID NO: 625228 - RNA, 64 nt, hsa; identical to SEQ ID NO: 175972

SEQ ID NO: 625229 - RNA, 64 nt, hsa; identical to SEQ ID NO: 175973

SEQ ID NO: 625230 - RNA, 64 nt, hsa; identical to SEQ ID NO: 175974

SEQ ID NO: 625231 - RNA, 64 nt, hsa; identical to SEQ ID NO: 175975

SEQ ID NO: 625232 - RNA, 64 nt, hsa; identical to SEQ ID NO: 175976

SEQ ID NO: 625233 - RNA, 64 nt, hsa; identical to SEQ ID NO: 175977

SEQ ID NO: 625234 - RNA, 64 nt, hsa; identical to SEQ ID NO: 175978

SEQ ID NO: 625235 - RNA, 64 nt, hsa; identical to SEQ ID NO: 175979

SEQ ID NO: 625236 - RNA, 64 nt, hsa; identical to SEQ ID NO: 175980

SEQ ID NO: 625237 - RNA, 64 nt, hsa; identical to SEQ ID NO: 175981

SEQ ID NO: 625238 - RNA, 64 nt, hsa; identical to SEQ ID NO: 175982

SEQ ID NO: 625239 - RNA, 64 nt, hsa; identical to SEQ ID NO: 175983

SEQ ID NO: 625240 - RNA, 64 nt, hsa; identical to SEQ ID NO: 175984

SEQ ID NO: 625241 - RNA, 64 nt, hsa; identical to SEQ ID NO: 175985

SEQ ID NO: 625242 - RNA, 64 nt, hsa; identical to SEQ ID NO: 175986

SEQ ID NO: 625243 - RNA, 64 nt, hsa; identical to SEQ ID NO: 175987

SEQ ID NO: 625244 - RNA, 64 nt, hsa; identical to SEQ ID NO: 175988

SEQ ID NO: 625245 - RNA, 64 nt, hsa; identical to SEQ ID NO: 175989

SEQ ID NO: 625246 - RNA, 64 nt, hsa; identical to SEQ ID NO: 175990

SEQ ID NO: 625247 - RNA, 64 nt, hsa; identical to SEQ ID NO: 175991

SEQ ID NO: 625248 - RNA, 64 nt, hsa; identical to SEQ ID NO: 175992

SEQ ID NO: 625249 - RNA, 64 nt, hsa; identical to SEQ ID NO: 175993

SEQ ID NO: 625250 - RNA, 64 nt, hsa; identical to SEQ ID NO: 175994

SEQ ID NO: 625251 - RNA, 64 nt, hsa; identical to SEQ ID NO: 175995

SEQ ID NO: 625252 - RNA, 64 nt, hsa; identical to SEQ ID NO: 175996

SEQ ID NO: 625253 - RNA, 64 nt, hsa; identical to SEQ ID NO: 175997

SEQ ID NO: 625254 - RNA, 62 nt, hsa; identical to SEQ ID NO: 175998

SEQ ID NO: 625255 - RNA, 64 nt, hsa; identical to SEQ ID NO: 175999

SEQ ID NO: 625256 - RNA, 64 nt, hsa; identical to SEQ ID NO: 176000

SEQ ID NO: 625257 - RNA, 64 nt, hsa; identical to SEQ ID NO: 176001

SEQ ID NO: 625258 - RNA, 64 nt, hsa; identical to SEQ ID NO: 176002

SEQ ID NO: 625259 - RNA, 64 nt, hsa; identical to SEQ ID NO: 176003

SEQ ID NO: 625260 - RNA, 64 nt, hsa; identical to SEQ ID NO: 176004

SEQ ID NO: 625261 - RNA, 64 nt, hsa; identical to SEQ ID NO: 176005

SEQ ID NO: 625262 - RNA, 64 nt, hsa; identical to SEQ ID NO: 176006

SEQ ID NO: 625263 - RNA, 64 nt, hsa; identical to SEQ ID NO: 176007

SEQ ID NO: 625264 - RNA, 64 nt, hsa; identical to SEQ ID NO: 176008

SEQ ID NO: 625265 - RNA, 64 nt, hsa; identical to SEQ ID NO: 176009

SEQ ID NO: 625266 - RNA, 64 nt, hsa; identical to SEQ ID NO: 176010

SEQ ID NO: 625267 - RNA, 64 nt, hsa; identical to SEQ ID NO: 176011

SEQ ID NO: 625268 - RNA, 64 nt, hsa; identical to SEQ ID NO: 176012

SEQ ID NO: 625269 - RNA, 64 nt, hsa; identical to SEQ ID NO: 176013

SEQ ID NO: 625270 - RNA, 64 nt, hsa; identical to SEQ ID NO: 176014

SEQ ID NO: 625271 - RNA, 64 nt, hsa; identical to SEQ ID NO: 176015

SEQ ID NO: 625272 - RNA, 64 nt, hsa; identical to SEQ ID NO: 176016

SEQ ID NO: 625273 - RNA, 64 nt, hsa; identical to SEQ ID NO: 176017

SEQ ID NO: 625274 - RNA, 64 nt, hsa; identical to SEQ ID NO: 176018

SEQ ID NO: 625275 - RNA, 64 nt, hsa; identical to SEQ ID NO: 176019

SEQ ID NO: 625276 - RNA, 64 nt, hsa; identical to SEQ ID NO: 176020

SEQ ID NO: 625277 - RNA, 64 nt, hsa; identical to SEQ ID NO: 176021

SEQ ID NO: 625278 - RNA, 64 nt, hsa; identical to SEQ ID NO: 176022

SEQ ID NO: 625279 - RNA, 64 nt, hsa; identical to SEQ ID NO: 176023

SEQ ID NO: 625280 - RNA, 64 nt, hsa; identical to SEQ ID NO: 176024

SEQ ID NO: 625281 - RNA, 64 nt, hsa; identical to SEQ ID NO: 176025

SEQ ID NO: 625282 - RNA, 64 nt, hsa; identical to SEQ ID NO: 176026

SEQ ID NO: 625283 - RNA, 64 nt, hsa; identical to SEQ ID NO: 176027

SEQ ID NO: 625284 - RNA, 64 nt, hsa; identical to SEQ ID NO: 176028

SEQ ID NO: 625285 - RNA, 64 nt, hsa; identical to SEQ ID NO: 176029

SEQ ID NO: 625286 - RNA, 59 nt, hsa; identical to SEQ ID NO: 176030

SEQ ID NO: 625287 - RNA, 56 nt, hsa; identical to SEQ ID NO: 176031

SEQ ID NO: 625288 - RNA, 64 nt, hsa; identical to SEQ ID NO: 176032

SEQ ID NO: 625289 - RNA, 64 nt, hsa; identical to SEQ ID NO: 176033

SEQ ID NO: 625290 - RNA, 64 nt, hsa; identical to SEQ ID NO: 176034

SEQ ID NO: 625291 - RNA, 64 nt, hsa; identical to SEQ ID NO: 176035

SEQ ID NO: 625292 - RNA, 64 nt, hsa; identical to SEQ ID NO: 176036

SEQ ID NO: 625293 - RNA, 64 nt, hsa; identical to SEQ ID NO: 176037

SEQ ID NO: 625294 - RNA, 64 nt, hsa; identical to SEQ ID NO: 176038

SEQ ID NO: 625295 - RNA, 64 nt, hsa; identical to SEQ ID NO: 176039

SEQ ID NO: 625296 - RNA, 64 nt, hsa; identical to SEQ ID NO: 176040

SEQ ID NO: 625297 - RNA, 64 nt, hsa; identical to SEQ ID NO: 176041

SEQ ID NO: 625298 - RNA, 64 nt, hsa; identical to SEQ ID NO: 176042

SEQ ID NO: 625299 - RNA, 64 nt, hsa; identical to SEQ ID NO: 176043

SEQ ID NO: 625300 - RNA, 64 nt, hsa; identical to SEQ ID NO: 176044

SEQ ID NO: 625301 - RNA, 64 nt, hsa; identical to SEQ ID NO: 176045

SEQ ID NO: 625302 - RNA, 64 nt, hsa; identical to SEQ ID NO: 176046

SEQ ID NO: 625303 - RNA, 64 nt, hsa; identical to SEQ ID NO: 176047

SEQ ID NO: 625304 - RNA, 64 nt, hsa; identical to SEQ ID NO: 176048

SEQ ID NO: 625305 - RNA, 64 nt, hsa; identical to SEQ ID NO: 176049

SEQ ID NO: 625306 - RNA, 64 nt, hsa; identical to SEQ ID NO: 176050

SEQ ID NO: 625307 - RNA, 64 nt, hsa; identical to SEQ ID NO: 176051

SEQ ID NO: 625308 - RNA, 64 nt, hsa; identical to SEQ ID NO: 176052

SEQ ID NO: 625309 - RNA, 64 nt, hsa; identical to SEQ ID NO: 176053

SEQ ID NO: 625310 - RNA, 64 nt, hsa; identical to SEQ ID NO: 176054

SEQ ID NO: 625311 - RNA, 64 nt, hsa; identical to SEQ ID NO: 176055

SEQ ID NO: 625312 - RNA, 64 nt, hsa; identical to SEQ ID NO: 176056

SEQ ID NO: 625313 - RNA, 64 nt, hsa; identical to SEQ ID NO: 176057

SEQ ID NO: 625314 - RNA, 64 nt, hsa; identical to SEQ ID NO: 176058

SEQ ID NO: 625315 - RNA, 64 nt, hsa; identical to SEQ ID NO: 176059

SEQ ID NO: 625316 - RNA, 64 nt, hsa; identical to SEQ ID NO: 176060

SEQ ID NO: 625317 - RNA, 64 nt, hsa; identical to SEQ ID NO: 176061

SEQ ID NO: 625318 - RNA, 64 nt, hsa; identical to SEQ ID NO: 176062

SEQ ID NO: 625319 - RNA, 64 nt, hsa; identical to SEQ ID NO: 176063

SEQ ID NO: 625320 - RNA, 64 nt, hsa; identical to SEQ ID NO: 176064

SEQ ID NO: 625321 - RNA, 64 nt, hsa; identical to SEQ ID NO: 176065

SEQ ID NO: 625322 - RNA, 64 nt, hsa; identical to SEQ ID NO: 176066

SEQ ID NO: 625323 - RNA, 64 nt, hsa; identical to SEQ ID NO: 176067

SEQ ID NO: 625324 - RNA, 64 nt, hsa; identical to SEQ ID NO: 176068

SEQ ID NO: 625325 - RNA, 64 nt, hsa; identical to SEQ ID NO: 176069

SEQ ID NO: 625326 - RNA, 64 nt, hsa; identical to SEQ ID NO: 176070

SEQ ID NO: 625327 - RNA, 64 nt, hsa; identical to SEQ ID NO: 176071

SEQ ID NO: 625328 - RNA, 64 nt, hsa; identical to SEQ ID NO: 176072

SEQ ID NO: 625329 - RNA, 64 nt, hsa; identical to SEQ ID NO: 176073

SEQ ID NO: 625330 - RNA, 64 nt, hsa; identical to SEQ ID NO: 176074

SEQ ID NO: 625331 - RNA, 64 nt, hsa; identical to SEQ ID NO: 176075

SEQ ID NO: 625332 - RNA, 64 nt, hsa; identical to SEQ ID NO: 176076

SEQ ID NO: 625333 - RNA, 64 nt, hsa; identical to SEQ ID NO: 176077

SEQ ID NO: 625334 - RNA, 64 nt, hsa; identical to SEQ ID NO: 176078

SEQ ID NO: 625335 - RNA, 64 nt, hsa; identical to SEQ ID NO: 176079

SEQ ID NO: 625336 - RNA, 64 nt, hsa; identical to SEQ ID NO: 176080

SEQ ID NO: 625337 - RNA, 64 nt, hsa; identical to SEQ ID NO: 176081

SEQ ID NO: 625338 - RNA, 64 nt, hsa; identical to SEQ ID NO: 176082

SEQ ID NO: 625339 - RNA, 64 nt, hsa; identical to SEQ ID NO: 176083

SEQ ID NO: 625340 - RNA, 64 nt, hsa; identical to SEQ ID NO: 176084

SEQ ID NO: 625341 - RNA, 64 nt, hsa; identical to SEQ ID NO: 176085

SEQ ID NO: 625342 - RNA, 64 nt, hsa; identical to SEQ ID NO: 176086

SEQ ID NO: 625343 - RNA, 64 nt, hsa; identical to SEQ ID NO: 176087

SEQ ID NO: 625344 - RNA, 64 nt, hsa; identical to SEQ ID NO: 176088

SEQ ID NO: 625345 - RNA, 62 nt, hsa; identical to SEQ ID NO: 176089

SEQ ID NO: 625346 - RNA, 64 nt, hsa; identical to SEQ ID NO: 176090

SEQ ID NO: 625347 - RNA, 64 nt, hsa; identical to SEQ ID NO: 176091

SEQ ID NO: 625348 - RNA, 64 nt, hsa; identical to SEQ ID NO: 176092

SEQ ID NO: 625349 - RNA, 64 nt, hsa; identical to SEQ ID NO: 176093

SEQ ID NO: 625350 - RNA, 64 nt, hsa; identical to SEQ ID NO: 176094

SEQ ID NO: 625351 - RNA, 63 nt, hsa; identical to SEQ ID NO: 176095

SEQ ID NO: 625352 - RNA, 64 nt, hsa; identical to SEQ ID NO: 176096

SEQ ID NO: 625353 - RNA, 64 nt, hsa; identical to SEQ ID NO: 176097

SEQ ID NO: 625354 - RNA, 64 nt, hsa; identical to SEQ ID NO: 175895

SEQ ID NO: 625355 - RNA, 64 nt, hsa; identical to SEQ ID NO: 175896

SEQ ID NO: 625356 - RNA, 64 nt, hsa; identical to SEQ ID NO: 175897

SEQ ID NO: 625357 - RNA, 64 nt, hsa; identical to SEQ ID NO: 175898

SEQ ID NO: 625358 - RNA, 64 nt, hsa; identical to SEQ ID NO: 175899

SEQ ID NO: 625359 - RNA, 64 nt, hsa; identical to SEQ ID NO: 175900

SEQ ID NO: 625360 - RNA, 64 nt, hsa; identical to SEQ ID NO: 175901

SEQ ID NO: 625361 - RNA, 64 nt, hsa; identical to SEQ ID NO: 175902

SEQ ID NO: 625362 - RNA, 64 nt, hsa; identical to SEQ ID NO: 175903

SEQ ID NO: 625363 - RNA, 64 nt, hsa; identical to SEQ ID NO: 175904

SEQ ID NO: 625364 - RNA, 64 nt, hsa; identical to SEQ ID NO: 175905

SEQ ID NO: 625365 - RNA, 64 nt, hsa; identical to SEQ ID NO: 175906

SEQ ID NO: 625366 - RNA, 64 nt, hsa; identical to SEQ ID NO: 175907

SEQ ID NO: 625367 - RNA, 64 nt, hsa; identical to SEQ ID NO: 175908

SEQ ID NO: 625368 - RNA, 64 nt, hsa; identical to SEQ ID NO: 175909

SEQ ID NO: 625369 - RNA, 64 nt, hsa; identical to SEQ ID NO: 175910

SEQ ID NO: 625370 - RNA, 64 nt, hsa; identical to SEQ ID NO: 175911

SEQ ID NO: 625371 - RNA, 64 nt, hsa; identical to SEQ ID NO: 175912

SEQ ID NO: 625372 - RNA, 64 nt, hsa; identical to SEQ ID NO: 175913

SEQ ID NO: 625373 - RNA, 64 nt, hsa; identical to SEQ ID NO: 175914

SEQ ID NO: 625374 - RNA, 64 nt, hsa; identical to SEQ ID NO: 175915

SEQ ID NO: 625375 - RNA, 64 nt, hsa; identical to SEQ ID NO: 175916

SEQ ID NO: 625376 - RNA, 64 nt, hsa; identical to SEQ ID NO: 175917

SEQ ID NO: 625377 - RNA, 64 nt, hsa; identical to SEQ ID NO: 175918

SEQ ID NO: 625378 - RNA, 64 nt, hsa; identical to SEQ ID NO: 175919

SEQ ID NO: 625379 - RNA, 64 nt, hsa; identical to SEQ ID NO: 175920

SEQ ID NO: 625380 - RNA, 64 nt, hsa; identical to SEQ ID NO: 175921

SEQ ID NO: 625381 - RNA, 64 nt, hsa; identical to SEQ ID NO: 175922

SEQ ID NO: 625382 - RNA, 64 nt, hsa; identical to SEQ ID NO: 175923

SEQ ID NO: 625383 - RNA, 64 nt, hsa; identical to SEQ ID NO: 175924

SEQ ID NO: 625384 - RNA, 64 nt, hsa; identical to SEQ ID NO: 175925

SEQ ID NO: 625385 - RNA, 64 nt, hsa; identical to SEQ ID NO: 175926

SEQ ID NO: 625386 - RNA, 64 nt, hsa; identical to SEQ ID NO: 175927

SEQ ID NO: 625387 - RNA, 64 nt, hsa; identical to SEQ ID NO: 175928

SEQ ID NO: 625388 - RNA, 64 nt, hsa; identical to SEQ ID NO: 175929

SEQ ID NO: 625389 - RNA, 64 nt, hsa; identical to SEQ ID NO: 175930

SEQ ID NO: 625390 - RNA, 64 nt, hsa; identical to SEQ ID NO: 175931

SEQ ID NO: 625391 - RNA, 64 nt, hsa; identical to SEQ ID NO: 175932

SEQ ID NO: 625392 - RNA, 64 nt, hsa; identical to SEQ ID NO: 175933

SEQ ID NO: 625393 - RNA, 64 nt, hsa; identical to SEQ ID NO: 175934

SEQ ID NO: 625394 - RNA, 64 nt, hsa; identical to SEQ ID NO: 175935

SEQ ID NO: 625395 - RNA, 64 nt, hsa; identical to SEQ ID NO: 175936

SEQ ID NO: 625396 - RNA, 64 nt, hsa; identical to SEQ ID NO: 175937

SEQ ID NO: 625397 - RNA, 64 nt, hsa; identical to SEQ ID NO: 175938

SEQ ID NO: 625398 - RNA, 64 nt, hsa; identical to SEQ ID NO: 175939

SEQ ID NO: 625399 - RNA, 64 nt, hsa; identical to SEQ ID NO: 175940

SEQ ID NO: 625400 - RNA, 64 nt, hsa; identical to SEQ ID NO: 175941

SEQ ID NO: 625401 - RNA, 64 nt, hsa; identical to SEQ ID NO: 175942

SEQ ID NO: 625402 - RNA, 64 nt, hsa; identical to SEQ ID NO: 175943

SEQ ID NO: 625403 - RNA, 64 nt, hsa; identical to SEQ ID NO: 175944

SEQ ID NO: 625404 - RNA, 64 nt, hsa; identical to SEQ ID NO: 175945

SEQ ID NO: 625405 - RNA, 64 nt, hsa; identical to SEQ ID NO: 175946

SEQ ID NO: 625406 - RNA, 64 nt, hsa; identical to SEQ ID NO: 175947

SEQ ID NO: 625407 - RNA, 64 nt, hsa; identical to SEQ ID NO: 175948

SEQ ID NO: 625408 - RNA, 64 nt, hsa; identical to SEQ ID NO: 175949

SEQ ID NO: 625409 - RNA, 64 nt, hsa; identical to SEQ ID NO: 175950

SEQ ID NO: 625410 - RNA, 64 nt, hsa; identical to SEQ ID NO: 175951

SEQ ID NO: 625411 - RNA, 64 nt, hsa; identical to SEQ ID NO: 175952

SEQ ID NO: 625412 - RNA, 64 nt, hsa; identical to SEQ ID NO: 175953

SEQ ID NO: 625413 - RNA, 62 nt, hsa; identical to SEQ ID NO: 175954

SEQ ID NO: 625414 - RNA, 64 nt, hsa; identical to SEQ ID NO: 175955

SEQ ID NO: 625415 - RNA, 64 nt, hsa; identical to SEQ ID NO: 175956

SEQ ID NO: 625416 - RNA, 64 nt, hsa; identical to SEQ ID NO: 175957

SEQ ID NO: 625417 - RNA, 64 nt, hsa; identical to SEQ ID NO: 175958

SEQ ID NO: 625418 - RNA, 64 nt, hsa; identical to SEQ ID NO: 175959

SEQ ID NO: 625419 - RNA, 64 nt, hsa; identical to SEQ ID NO: 175960

SEQ ID NO: 625420 - RNA, 64 nt, hsa; identical to SEQ ID NO: 175961

SEQ ID NO: 625421 - RNA, 64 nt, hsa; identical to SEQ ID NO: 175962

SEQ ID NO: 625422 - RNA, 64 nt, hsa; identical to SEQ ID NO: 175963

SEQ ID NO: 625423 - RNA, 64 nt, hsa; identical to SEQ ID NO: 175964

SEQ ID NO: 625424 - RNA, 64 nt, hsa; identical to SEQ ID NO: 175965

SEQ ID NO: 625425 - RNA, 64 nt, hsa; identical to SEQ ID NO: 175966

SEQ ID NO: 625426 - RNA, 64 nt, hsa; identical to SEQ ID NO: 175967

SEQ ID NO: 625427 - RNA, 64 nt, hsa; identical to SEQ ID NO: 175968

SEQ ID NO: 625428 - RNA, 64 nt, hsa; identical to SEQ ID NO: 175969

SEQ ID NO: 625429 - RNA, 64 nt, hsa; identical to SEQ ID NO: 175970

SEQ ID NO: 625430 - RNA, 64 nt, hsa; identical to SEQ ID NO: 175971

SEQ ID NO: 625431 - RNA, 64 nt, hsa; identical to SEQ ID NO: 175972

SEQ ID NO: 625432 - RNA, 64 nt, hsa; identical to SEQ ID NO: 175973

SEQ ID NO: 625433 - RNA, 64 nt, hsa; identical to SEQ ID NO: 175974

SEQ ID NO: 625434 - RNA, 64 nt, hsa; identical to SEQ ID NO: 175975

SEQ ID NO: 625435 - RNA, 64 nt, hsa; identical to SEQ ID NO: 175976

SEQ ID NO: 625436 - RNA, 64 nt, hsa; identical to SEQ ID NO: 175977

SEQ ID NO: 625437 - RNA, 64 nt, hsa; identical to SEQ ID NO: 175978

SEQ ID NO: 625438 - RNA, 64 nt, hsa; identical to SEQ ID NO: 175979

SEQ ID NO: 625439 - RNA, 64 nt, hsa; identical to SEQ ID NO: 175980

SEQ ID NO: 625440 - RNA, 64 nt, hsa; identical to SEQ ID NO: 175981

SEQ ID NO: 625441 - RNA, 64 nt, hsa; identical to SEQ ID NO: 175982

SEQ ID NO: 625442 - RNA, 64 nt, hsa; identical to SEQ ID NO: 175983

SEQ ID NO: 625443 - RNA, 64 nt, hsa; identical to SEQ ID NO: 175984

SEQ ID NO: 625444 - RNA, 64 nt, hsa; identical to SEQ ID NO: 175985

SEQ ID NO: 625445 - RNA, 64 nt, hsa; identical to SEQ ID NO: 175986

SEQ ID NO: 625446 - RNA, 64 nt, hsa; identical to SEQ ID NO: 175987

SEQ ID NO: 625447 - RNA, 64 nt, hsa; identical to SEQ ID NO: 175988

SEQ ID NO: 625448 - RNA, 64 nt, hsa; identical to SEQ ID NO: 175989

SEQ ID NO: 625449 - RNA, 64 nt, hsa; identical to SEQ ID NO: 175990

SEQ ID NO: 625450 - RNA, 64 nt, hsa; identical to SEQ ID NO: 175991

SEQ ID NO: 625451 - RNA, 64 nt, hsa; identical to SEQ ID NO: 175992

SEQ ID NO: 625452 - RNA, 64 nt, hsa; identical to SEQ ID NO: 175993

SEQ ID NO: 625453 - RNA, 64 nt, hsa; identical to SEQ ID NO: 175994

SEQ ID NO: 625454 - RNA, 64 nt, hsa; identical to SEQ ID NO: 175995

SEQ ID NO: 625455 - RNA, 64 nt, hsa; identical to SEQ ID NO: 175996

SEQ ID NO: 625456 - RNA, 64 nt, hsa; identical to SEQ ID NO: 175997

SEQ ID NO: 625457 - RNA, 62 nt, hsa; identical to SEQ ID NO: 175998

SEQ ID NO: 625458 - RNA, 64 nt, hsa; identical to SEQ ID NO: 175999

SEQ ID NO: 625459 - RNA, 64 nt, hsa; identical to SEQ ID NO: 176000

SEQ ID NO: 625460 - RNA, 64 nt, hsa; identical to SEQ ID NO: 176001

SEQ ID NO: 625461 - RNA, 64 nt, hsa; identical to SEQ ID NO: 176002

SEQ ID NO: 625462 - RNA, 64 nt, hsa; identical to SEQ ID NO: 176003

SEQ ID NO: 625463 - RNA, 64 nt, hsa; identical to SEQ ID NO: 176004

SEQ ID NO: 625464 - RNA, 64 nt, hsa; identical to SEQ ID NO: 176005

SEQ ID NO: 625465 - RNA, 64 nt, hsa; identical to SEQ ID NO: 176006

SEQ ID NO: 625466 - RNA, 64 nt, hsa; identical to SEQ ID NO: 176007

SEQ ID NO: 625467 - RNA, 64 nt, hsa; identical to SEQ ID NO: 176008

SEQ ID NO: 625468 - RNA, 64 nt, hsa; identical to SEQ ID NO: 176009

SEQ ID NO: 625469 - RNA, 64 nt, hsa; identical to SEQ ID NO: 176010

SEQ ID NO: 625470 - RNA, 64 nt, hsa; identical to SEQ ID NO: 176011

SEQ ID NO: 625471 - RNA, 64 nt, hsa; identical to SEQ ID NO: 176012

SEQ ID NO: 625472 - RNA, 64 nt, hsa; identical to SEQ ID NO: 176013

SEQ ID NO: 625473 - RNA, 64 nt, hsa; identical to SEQ ID NO: 176014

SEQ ID NO: 625474 - RNA, 64 nt, hsa; identical to SEQ ID NO: 176015

SEQ ID NO: 625475 - RNA, 64 nt, hsa; identical to SEQ ID NO: 176016

SEQ ID NO: 625476 - RNA, 64 nt, hsa; identical to SEQ ID NO: 176017

SEQ ID NO: 625477 - RNA, 64 nt, hsa; identical to SEQ ID NO: 176018

SEQ ID NO: 625478 - RNA, 64 nt, hsa; identical to SEQ ID NO: 176019

SEQ ID NO: 625479 - RNA, 64 nt, hsa; identical to SEQ ID NO: 176020

SEQ ID NO: 625480 - RNA, 64 nt, hsa; identical to SEQ ID NO: 176021

SEQ ID NO: 625481 - RNA, 64 nt, hsa; identical to SEQ ID NO: 176022

SEQ ID NO: 625482 - RNA, 64 nt, hsa; identical to SEQ ID NO: 176023

SEQ ID NO: 625483 - RNA, 64 nt, hsa; identical to SEQ ID NO: 176024

SEQ ID NO: 625484 - RNA, 64 nt, hsa; identical to SEQ ID NO: 176025

SEQ ID NO: 625485 - RNA, 64 nt, hsa; identical to SEQ ID NO: 176026

SEQ ID NO: 625486 - RNA, 64 nt, hsa; identical to SEQ ID NO: 176027

SEQ ID NO: 625487 - RNA, 64 nt, hsa; identical to SEQ ID NO: 176028

SEQ ID NO: 625488 - RNA, 64 nt, hsa; identical to SEQ ID NO: 176029

SEQ ID NO: 625489 - RNA, 59 nt, hsa; identical to SEQ ID NO: 176030

SEQ ID NO: 625490 - RNA, 56 nt, hsa; identical to SEQ ID NO: 176031

SEQ ID NO: 625491 - RNA, 64 nt, hsa; identical to SEQ ID NO: 176032

SEQ ID NO: 625492 - RNA, 64 nt, hsa; identical to SEQ ID NO: 176033

SEQ ID NO: 625493 - RNA, 64 nt, hsa; identical to SEQ ID NO: 176034

SEQ ID NO: 625494 - RNA, 64 nt, hsa; identical to SEQ ID NO: 176035

SEQ ID NO: 625495 - RNA, 64 nt, hsa; identical to SEQ ID NO: 176036

SEQ ID NO: 625496 - RNA, 64 nt, hsa; identical to SEQ ID NO: 176037

SEQ ID NO: 625497 - RNA, 64 nt, hsa; identical to SEQ ID NO: 176038

SEQ ID NO: 625498 - RNA, 64 nt, hsa; identical to SEQ ID NO: 176039

SEQ ID NO: 625499 - RNA, 64 nt, hsa; identical to SEQ ID NO: 176040

SEQ ID NO: 625500 - RNA, 64 nt, hsa; identical to SEQ ID NO: 176041

SEQ ID NO: 625501 - RNA, 64 nt, hsa; identical to SEQ ID NO: 176042

SEQ ID NO: 625502 - RNA, 64 nt, hsa; identical to SEQ ID NO: 176043

SEQ ID NO: 625503 - RNA, 64 nt, hsa; identical to SEQ ID NO: 176044

SEQ ID NO: 625504 - RNA, 64 nt, hsa; identical to SEQ ID NO: 176045

SEQ ID NO: 625505 - RNA, 64 nt, hsa; identical to SEQ ID NO: 176046

SEQ ID NO: 625506 - RNA, 64 nt, hsa; identical to SEQ ID NO: 176047

SEQ ID NO: 625507 - RNA, 64 nt, hsa; identical to SEQ ID NO: 176048

SEQ ID NO: 625508 - RNA, 64 nt, hsa; identical to SEQ ID NO: 176049

SEQ ID NO: 625509 - RNA, 64 nt, hsa; identical to SEQ ID NO: 176050

SEQ ID NO: 625510 - RNA, 64 nt, hsa; identical to SEQ ID NO: 176051

SEQ ID NO: 625511 - RNA, 64 nt, hsa; identical to SEQ ID NO: 176052

SEQ ID NO: 625512 - RNA, 64 nt, hsa; identical to SEQ ID NO: 176053

SEQ ID NO: 625513 - RNA, 64 nt, hsa; identical to SEQ ID NO: 176054

SEQ ID NO: 625514 - RNA, 64 nt, hsa; identical to SEQ ID NO: 176055

SEQ ID NO: 625515 - RNA, 64 nt, hsa; identical to SEQ ID NO: 176056

SEQ ID NO: 625516 - RNA, 64 nt, hsa; identical to SEQ ID NO: 176057

SEQ ID NO: 625517 - RNA, 64 nt, hsa; identical to SEQ ID NO: 176058

SEQ ID NO: 625518 - RNA, 64 nt, hsa; identical to SEQ ID NO: 176059

SEQ ID NO: 625519 - RNA, 64 nt, hsa; identical to SEQ ID NO: 176060

SEQ ID NO: 625520 - RNA, 64 nt, hsa; identical to SEQ ID NO: 176061

SEQ ID NO: 625521 - RNA, 64 nt, hsa; identical to SEQ ID NO: 176062

SEQ ID NO: 625522 - RNA, 64 nt, hsa; identical to SEQ ID NO: 176063

SEQ ID NO: 625523 - RNA, 64 nt, hsa; identical to SEQ ID NO: 176064

SEQ ID NO: 625524 - RNA, 64 nt, hsa; identical to SEQ ID NO: 176065

SEQ ID NO: 625525 - RNA, 64 nt, hsa; identical to SEQ ID NO: 176066

SEQ ID NO: 625526 - RNA, 64 nt, hsa; identical to SEQ ID NO: 176067

SEQ ID NO: 625527 - RNA, 64 nt, hsa; identical to SEQ ID NO: 176068

SEQ ID NO: 625528 - RNA, 64 nt, hsa; identical to SEQ ID NO: 176069

SEQ ID NO: 625529 - RNA, 64 nt, hsa; identical to SEQ ID NO: 176070

SEQ ID NO: 625530 - RNA, 64 nt, hsa; identical to SEQ ID NO: 176071

SEQ ID NO: 625531 - RNA, 64 nt, hsa; identical to SEQ ID NO: 176072

SEQ ID NO: 625532 - RNA, 64 nt, hsa; identical to SEQ ID NO: 176073

SEQ ID NO: 625533 - RNA, 64 nt, hsa; identical to SEQ ID NO: 176074

SEQ ID NO: 625534 - RNA, 64 nt, hsa; identical to SEQ ID NO: 176075

SEQ ID NO: 625535 - RNA, 64 nt, hsa; identical to SEQ ID NO: 176076

SEQ ID NO: 625536 - RNA, 64 nt, hsa; identical to SEQ ID NO: 176077

SEQ ID NO: 625537 - RNA, 64 nt, hsa; identical to SEQ ID NO: 176078

SEQ ID NO: 625538 - RNA, 64 nt, hsa; identical to SEQ ID NO: 176079

SEQ ID NO: 625539 - RNA, 64 nt, hsa; identical to SEQ ID NO: 176080

SEQ ID NO: 625540 - RNA, 64 nt, hsa; identical to SEQ ID NO: 176081

SEQ ID NO: 625541 - RNA, 64 nt, hsa; identical to SEQ ID NO: 176082

SEQ ID NO: 625542 - RNA, 64 nt, hsa; identical to SEQ ID NO: 176083

SEQ ID NO: 625543 - RNA, 64 nt, hsa; identical to SEQ ID NO: 176084

SEQ ID NO: 625544 - RNA, 64 nt, hsa; identical to SEQ ID NO: 176085

SEQ ID NO: 625545 - RNA, 64 nt, hsa; identical to SEQ ID NO: 176086

SEQ ID NO: 625546 - RNA, 64 nt, hsa; identical to SEQ ID NO: 176087

SEQ ID NO: 625547 - RNA, 64 nt, hsa; identical to SEQ ID NO: 176088

SEQ ID NO: 625548 - RNA, 62 nt, hsa; identical to SEQ ID NO: 176089

SEQ ID NO: 625549 - RNA, 64 nt, hsa; identical to SEQ ID NO: 176090

SEQ ID NO: 625550 - RNA, 64 nt, hsa; identical to SEQ ID NO: 176091

SEQ ID NO: 625551 - RNA, 64 nt, hsa; identical to SEQ ID NO: 176092

SEQ ID NO: 625552 - RNA, 64 nt, hsa; identical to SEQ ID NO: 176093

SEQ ID NO: 625553 - RNA, 64 nt, hsa; identical to SEQ ID NO: 176094

SEQ ID NO: 625554 - RNA, 63 nt, hsa; identical to SEQ ID NO: 176095

SEQ ID NO: 625555 - RNA, 64 nt, hsa; identical to SEQ ID NO: 176096

SEQ ID NO: 625556 - RNA, 64 nt, hsa; identical to SEQ ID NO: 176097

SEQ ID NO: 625557 - RNA, 64 nt, hsa; identical to SEQ ID NO: 433812

SEQ ID NO: 625558 - RNA, 64 nt, hsa; identical to SEQ ID NO: 433813

SEQ ID NO: 625559 - RNA, 64 nt, hsa; identical to SEQ ID NO: 433814

SEQ ID NO: 625560 - RNA, 64 nt, hsa; identical to SEQ ID NO: 433815

SEQ ID NO: 625561 - RNA, 64 nt, hsa; identical to SEQ ID NO: 433816

SEQ ID NO: 625562 - RNA, 64 nt, hsa; identical to SEQ ID NO: 433817

SEQ ID NO: 625563 - RNA, 64 nt, hsa; identical to SEQ ID NO: 433818

SEQ ID NO: 625564 - RNA, 64 nt, hsa; identical to SEQ ID NO: 433819

SEQ ID NO: 625565 - RNA, 64 nt, hsa; identical to SEQ ID NO: 433820

SEQ ID NO: 625566 - RNA, 64 nt, hsa; identical to SEQ ID NO: 433821

SEQ ID NO: 625567 - RNA, 64 nt, hsa; identical to SEQ ID NO: 433822

SEQ ID NO: 625568 - RNA, 64 nt, hsa; identical to SEQ ID NO: 433823

SEQ ID NO: 625569 - RNA, 64 nt, hsa; identical to SEQ ID NO: 433824

SEQ ID NO: 625570 - RNA, 64 nt, hsa; identical to SEQ ID NO: 433825

SEQ ID NO: 625571 - RNA, 64 nt, hsa; identical to SEQ ID NO: 433826

SEQ ID NO: 625572 - RNA, 64 nt, hsa; identical to SEQ ID NO: 433827

SEQ ID NO: 625573 - RNA, 64 nt, hsa; identical to SEQ ID NO: 433828

SEQ ID NO: 625574 - RNA, 64 nt, hsa; identical to SEQ ID NO: 433829

SEQ ID NO: 625575 - RNA, 64 nt, hsa; identical to SEQ ID NO: 433830

SEQ ID NO: 625576 - RNA, 64 nt, hsa; identical to SEQ ID NO: 433831

SEQ ID NO: 625577 - RNA, 64 nt, hsa; identical to SEQ ID NO: 433832

SEQ ID NO: 625578 - RNA, 64 nt, hsa; identical to SEQ ID NO: 433833

SEQ ID NO: 625579 - RNA, 64 nt, hsa; identical to SEQ ID NO: 433834

SEQ ID NO: 625580 - RNA, 64 nt, hsa; identical to SEQ ID NO: 433835

SEQ ID NO: 625581 - RNA, 64 nt, hsa; identical to SEQ ID NO: 433836

SEQ ID NO: 625582 - RNA, 64 nt, hsa; identical to SEQ ID NO: 433837

SEQ ID NO: 625583 - RNA, 64 nt, hsa; identical to SEQ ID NO: 433838

SEQ ID NO: 625584 - RNA, 64 nt, hsa; identical to SEQ ID NO: 433839

SEQ ID NO: 625585 - RNA, 64 nt, hsa; identical to SEQ ID NO: 433840

SEQ ID NO: 625586 - RNA, 64 nt, hsa; identical to SEQ ID NO: 433841

SEQ ID NO: 625587 - RNA, 64 nt, hsa; identical to SEQ ID NO: 433842

SEQ ID NO: 625588 - RNA, 64 nt, hsa; identical to SEQ ID NO: 433843

SEQ ID NO: 625589 - RNA, 64 nt, hsa; identical to SEQ ID NO: 433844

SEQ ID NO: 625590 - RNA, 64 nt, hsa; identical to SEQ ID NO: 433845

SEQ ID NO: 625591 - RNA, 64 nt, hsa; identical to SEQ ID NO: 433846

SEQ ID NO: 625592 - RNA, 64 nt, hsa; identical to SEQ ID NO: 433847

SEQ ID NO: 625593 - RNA, 64 nt, hsa; identical to SEQ ID NO: 433848

SEQ ID NO: 625594 - RNA, 64 nt, hsa; identical to SEQ ID NO: 433849

SEQ ID NO: 625595 - RNA, 64 nt, hsa; identical to SEQ ID NO: 433850

SEQ ID NO: 625596 - RNA, 64 nt, hsa; identical to SEQ ID NO: 433851

SEQ ID NO: 625597 - RNA, 64 nt, hsa; identical to SEQ ID NO: 433852

SEQ ID NO: 625598 - RNA, 64 nt, hsa; identical to SEQ ID NO: 433853

SEQ ID NO: 625599 - RNA, 64 nt, hsa; identical to SEQ ID NO: 433854

SEQ ID NO: 625600 - RNA, 64 nt, hsa; identical to SEQ ID NO: 433855

SEQ ID NO: 625601 - RNA, 64 nt, hsa; identical to SEQ ID NO: 433856

SEQ ID NO: 625602 - RNA, 64 nt, hsa; identical to SEQ ID NO: 433857

SEQ ID NO: 625603 - RNA, 64 nt, hsa; identical to SEQ ID NO: 433858

SEQ ID NO: 625604 - RNA, 64 nt, hsa; identical to SEQ ID NO: 433859

SEQ ID NO: 625605 - RNA, 64 nt, hsa; identical to SEQ ID NO: 433860

SEQ ID NO: 625606 - RNA, 64 nt, hsa; identical to SEQ ID NO: 106142

SEQ ID NO: 625607 - RNA, 64 nt, hsa; identical to SEQ ID NO: 106143

SEQ ID NO: 625608 - RNA, 55 nt, hsa; identical to SEQ ID NO: 106144

SEQ ID NO: 625609 - RNA, 64 nt, hsa; identical to SEQ ID NO: 106145

SEQ ID NO: 625610 - RNA, 64 nt, hsa; identical to SEQ ID NO: 106146

SEQ ID NO: 625611 - RNA, 64 nt, hsa; identical to SEQ ID NO: 106147

SEQ ID NO: 625612 - RNA, 64 nt, hsa; identical to SEQ ID NO: 106148

SEQ ID NO: 625613 - RNA, 64 nt, hsa; identical to SEQ ID NO: 106149

SEQ ID NO: 625614 - RNA, 64 nt, hsa; identical to SEQ ID NO: 106150

SEQ ID NO: 625615 - RNA, 64 nt, hsa; identical to SEQ ID NO: 106151

SEQ ID NO: 625616 - RNA, 64 nt, hsa; identical to SEQ ID NO: 106152

SEQ ID NO: 625617 - RNA, 64 nt, hsa; identical to SEQ ID NO: 106153

SEQ ID NO: 625618 - RNA, 64 nt, hsa; identical to SEQ ID NO: 106154

SEQ ID NO: 625619 - RNA, 64 nt, hsa; identical to SEQ ID NO: 106155

SEQ ID NO: 625620 - RNA, 64 nt, hsa; identical to SEQ ID NO: 106156

SEQ ID NO: 625621 - RNA, 64 nt, hsa; identical to SEQ ID NO: 106157

SEQ ID NO: 625622 - RNA, 64 nt, hsa; identical to SEQ ID NO: 106158

SEQ ID NO: 625623 - RNA, 64 nt, hsa; identical to SEQ ID NO: 106159

SEQ ID NO: 625624 - RNA, 64 nt, hsa; identical to SEQ ID NO: 106160

SEQ ID NO: 625625 - RNA, 64 nt, hsa; identical to SEQ ID NO: 106161

SEQ ID NO: 625626 - RNA, 64 nt, hsa; identical to SEQ ID NO: 106162

SEQ ID NO: 625627 - RNA, 64 nt, hsa; identical to SEQ ID NO: 106163

SEQ ID NO: 625628 - RNA, 64 nt, hsa
ccccagaaauaguaaacuugcagcugccccuaaugcagcauauuuuucuuaccaaaggagucuu

SEQ ID NO: 625629 - RNA, 64 nt, hsa
cagagcuuucaagaacacacaaugcaaagugagcgcagcauagcuguuaacaaacauacaacuu

SEQ ID NO: 625630 - RNA, 64 nt, hsa
gccucugaaagacuauccauaguggacauuguuggcagcauaaaggccuuuuuuggcuuuagac

SEQ ID NO: 625631 - RNA, 64 nt, hsa
acacugacagaaucuucaucuagauauucgaguagcagcauaucuucucuuuuagugucauuac

SEQ ID NO: 625632 - RNA, 64 nt, hsa
uuuuuaagugaaaaguaaccuuucaggcauuucagcagcauacauugacaaucuaggguauaua

SEQ ID NO: 625633 - RNA, 64 nt, hsa
agcuggagcauuuccuucccuuuccagugaaggagcagcauagugaaauccuggcaccccucac

SEQ ID NO: 625634 - RNA, 64 nt, hsa
cauuuguuaaguuggagcuugcacauuuaaaccagcagcauacguuccagaagagcaucucaag

SEQ ID NO: 625635 - RNA, 64 nt, hsa
ucuuuuuugaagaguuuuucuugugcuugcuucggcagcauauauacugaaauuagaaaaagaa

SEQ ID NO: 625636 - RNA, 64 nt, hsa
ugcggcuggaggagaagaucacagagccauucuugguggugagccuagacucugagccugggau

SEQ ID NO: 625637 - RNA, 64 nt, hsa
gaacacaaccuuaggaccuugggccccaaaagcugguggugaaaugaggaggagccaauuuaag

SEQ ID NO: 625638 - RNA, 64 nt, hsa
cugaagccucuacuugaugagagacagaguuuuggguggugauagugaugugcugguggucauu

SEQ ID NO: 625639 - RNA, 64 nt, hsa
gcugcagcugaaaguaguuccccaggcugcccucgguggugaggacuggaugcuagacugcuga

SEQ ID NO: 625640 - RNA, 64 nt, hsa
agucucucgccugugcugucucaugggacucaaugguggugaagaaaucucaaucggacaccag

SEQ ID NO: 625641 - RNA, 64 nt, hsa
ggucucagggcgcaaacacaucccugcacccggugguggugauguugggaagauguuucccugc

SEQ ID NO: 625642 - RNA, 64 nt, hsa
gcgccuacugggcauccggccugugcugggcauggguggugacauuggcagaaauggccacugg

SEQ ID NO: 625643 - RNA, 64 nt, hsa
augacauccauccaucuguggugaaccaagugaagguggugacuucuggugacauaguaauaaa

SEQ ID NO: 625644 - RNA, 64 nt, hsa
agaauucugauuuauugagauugaauuaugccaccacguuuauguaaaaaugaagguggcaccg

SEQ ID NO: 625645 - RNA, 64 nt, hsa
ucuaucacaguuagaaggaaaugauagucaaauacacguuuagauuaaaacuaguuuaaaaaau

SEQ ID NO: 625646 - RNA, 64 nt, hsa
aauggagaacaaagccauguggguacuguaaacacacguuuaucuuuuggcccaaugccauaca

SEQ ID NO: 625647 - RNA, 64 nt, hsa
caagucucaaaagucauccuccuacucagugauucacguuuagugguuuauauuauuaagguuu

SEQ ID NO: 625648 - RNA, 64 nt, hsa
gaagaaaaaauauauauauaaaauuuuauguagacacguuuauuuaucuaggaaacuaagucua

SEQ ID NO: 625649 - RNA, 64 nt, hsa
gcaaaacaaaucagguccugauuuaaaauuuuaacacguuuagauagcuuauuuaaauucuaag

SEQ ID NO: 625650 - RNA, 64 nt, hsa
cccuuuuugugacauuaccaauuacaucuuuguccacguuuaauacuuuguuuuggaaaauuua

SEQ ID NO: 625651 - RNA, 64 nt, hsa
gcuggccuguuaacugauaacuagaacuuagguucacguuuauguaaaguguguaaaaccuagu

SEQ ID NO: 625652 - RNA, 64 nt, hsa
uagcauucagucauauaacaucugguuaucaaugcacguuuacacaauaaauacuugaguggag

SEQ ID NO: 625653 - RNA, 64 nt, hsa
aaaugcaaaaaccauggcauuagcguaaaaaggacacguuuauaguaugaaagcuggaacaugg

SEQ ID NO: 625654 - RNA, 64 nt, hsa
caguauauacuuccuuucuagaacccgacuugcccacguuuagggguucacucugcacccugau

SEQ ID NO: 625655 - RNA, 64 nt, hsa
agagaauucacacucaacaagacacuaccagcaccacguuuacagaggaugaaaacacuucaca

SEQ ID NO: 625656 - RNA, 64 nt, hsa
ucagguaaucauuuuaauaaaguucugcaaaauacacguuuaucuuacauucagaaauguggca

SEQ ID NO: 625657 - RNA, 64 nt, hsa
gagaaauggggcuuaauuaaguuguuuuuguggucacguuuauucuuguuacuucgcuguguuu

SEQ ID NO: 625658 - RNA, 64 nt, hsa
auuuacccagaaugucagauuccuuucccuuuagcacguuuaaaguucuguguauuuaauugua

SEQ ID NO: 625659 - RNA, 64 nt, hsa
aaauaaguagggacuuuuauuccauccuuuuuuucacguuuacauuuuaauuauuacaaguugc

SEQ ID NO: 625660 - RNA, 64 nt, hsa
aagugaaaacgcucagaauuucacacugugaauccacguuuacaacccuuacaggugggccuuc

SEQ ID NO: 625661 - RNA, 64 nt, hsa
aacccaagucaaaaccuuggcuccagcaugaaaacacguuuacaggaaaguguucuccuggguu

SEQ ID NO: 625662 - RNA, 64 nt, hsa
cccaacuccuuccucuuugcuuggguuccuuuuucacguuuaguaacuguuuuuuuuuuuuuuu

SEQ ID NO: 625663 - RNA, 64 nt, hsa
acuuuugccuucguaauguuaaccguuucaggaccacguuuauagcuucaggaccuggcuacgu

SEQ ID NO: 625664 - RNA, 64 nt, hsa
guuggugugagauaucaggaaugucucaugauaucacguuuaccauuuacaccaucugcaacca

SEQ ID NO: 625665 - RNA, 64 nt, hsa
uuugucaccccccucccccugccacccucccuggcacguuuauuucacagcagagccaagucug

SEQ ID NO: 625666 - RNA, 64 nt, hsa
cuucccuuggcucuggggccguguuggccccagccacguuuacaggaaggugugccccagagga

SEQ ID NO: 625667 - RNA, 64 nt, hsa
guaaauuuaauagauaaagugccuauaaaggaaacacguuuagaaaugauuucaaaaugauauu

SEQ ID NO: 625668 - RNA, 64 nt, hsa
uacauaagagaaagaggccagacauggugucucacacguuuaaucccagcacuuugggaggcag

SEQ ID NO: 625669 - RNA, 64 nt, hsa
accguaaugcacuaagcuuuuuuuuuuucuuuuacacguuuaaaaacuucuuaaagcacucugu

SEQ ID NO: 625670 - RNA, 64 nt, hsa
gagaauguuccgauuuuccaugaucuaagcaggccacguuuaaaauaacaucaaggcaagcgua

SEQ ID NO: 625671 - RNA, 64 nt, hsa
uuuuauuuuuaaaggauacguuucacuuaauaaacacguuuaugccuaucagcauguuugugau

SEQ ID NO: 625672 - RNA, 64 nt, hsa
aaccuuauuuucuuuuguaagagcugggagcaaacacguuuaugagugugucggaaucccgugc

SEQ ID NO: 625673 - RNA, 64 nt, hsa
uucagcaccuaacaauccuguaugcuuuugagaucacguuuagugcuauguccuagucuagaau

SEQ ID NO: 625674 - RNA, 64 nt, hsa
cggugacaugagcugugcccugccaucccacuggcacguuuacacucuguguacugccccguga

SEQ ID NO: 625675 - RNA, 64 nt, hsa
aggaaagaagaaaaaaauuaaugugugggagcugcacguuuacauguuuugagcuaugcuucaa

SEQ ID NO: 625676 - RNA, 64 nt, hsa
ucucugcaccuccuggcaaguuucuucuauuccccacguuuaaagcgauggcaccuccguccca

SEQ ID NO: 625677 - RNA, 64 nt, hsa
cagcacccagcaucaaaggacggacuucaggggacacguuuaguauauuaagacaugcugaugg

SEQ ID NO: 625678 - RNA, 64 nt, hsa
aaaucagacauaccucuguggcucuccucugguucacguuuacagagcauaaggcugucuugga

SEQ ID NO: 625679 - RNA, 64 nt, hsa
cugcuagaaccucauaccuguucuaguucaucuccacguuuauuuuaccaagagauccucuguc

SEQ ID NO: 625680 - RNA, 64 nt, hsa
cacuuuggcuguucaguaaggccaauguuaacaacacguuuagaggaggaaaaguucaaccuca

SEQ ID NO: 625681 - RNA, 64 nt, hsa
uuaucagaaaugauaaaauccaguuaccacauaucacguuuauaaaauccuuaauuaaaugagu

SEQ ID NO: 625682 - RNA, 64 nt, hsa
cccccugcagcuuguagccagccggggcgaguggcacguuuauuuaacuuuuaguaaagucaag

SEQ ID NO: 625683 - RNA, 64 nt, hsa
agcugagagugcccuagacaguaacuucuaaggucacguuuacuauuucagaggaaauaucuug

SEQ ID NO: 625684 - RNA, 64 nt, hsa
uaagaagauggaguagauaucagauaaaacaauucacguuuaauauguaaauguaccaauuaug

SEQ ID NO: 625685 - RNA, 64 nt, hsa
acuucuauauaaacacuuguagaaguacacuguucacguuuagccugccccacuuuuguauuca

SEQ ID NO: 625686 - RNA, 64 nt, hsa
uuugacuggcucuuuaaauagucuacaagacauucacguuuaacaucacuuuuagugaaauaaa

SEQ ID NO: 625687 - RNA, 64 nt, hsa
ccuaguuauuugagccugguuucaaugugagaaccacguuuacuguuauuguauuuaauuuucu

SEQ ID NO: 625688 - RNA, 64 nt, hsa
cucaaaugaugauaaaccuacaugugcaaaggcucacguuuaagauugucaagccagcagucua

SEQ ID NO: 625689 - RNA, 64 nt, hsa
acaaugacaacaacauuacuaaccuguggagucacacguuuauguaguagaagauggagcaaca

SEQ ID NO: 625690 - RNA, 64 nt, hsa
ggcuuuuuuggaaacugaggacccaacaacuaaccacguuuacacgacuugaguuuugaacccc

SEQ ID NO: 625691 - RNA, 64 nt, hsa
gaaaauauuuauuuuguuauaaauaauuuuauagcacguuuacucuagugcuagcuaauuugua

SEQ ID NO: 625692 - RNA, 64 nt, hsa
guuacauauucuagagaucguccugagugccaagcacguuuauaaguagggcguguauuccagu

SEQ ID NO: 625693 - RNA, 64 nt, hsa
ggguccaguacccaaccuucgcacgaguguguugcacguuuacacagggugggcugcccccacc

SEQ ID NO: 625694 - RNA, 64 nt, hsa
auggggagaaagaugguuaaaauacauaauaauccacguuuaaaaggagcgcacuuguggcuga

SEQ ID NO: 625695 - RNA, 64 nt, hsa
uguaagcacuggcuuuuauaagagcagcagccaacacguuuagcagacacugcgcguggagaag

SEQ ID NO: 625696 - RNA, 64 nt, hsa
ucucucggaagccaccgugugguucuuucacaggcacguuuauuuugcugaaauaaaaaguuuu

SEQ ID NO: 625697 - RNA, 64 nt, hsa
gugucugagggagcugcuggccacagugaacacccacguuuauuccugccugcuccggccagga

SEQ ID NO: 625698 - RNA, 64 nt, hsa
augacaacuuagggggcuugagccaugaaauacucacguuuaagucaguaaggauacacauguu

SEQ ID NO: 625699 - RNA, 64 nt, hsa
ugccuuuggaaaucggauguacuguucucuuguucacguuuagugguguuuugcuguuuuguuu

SEQ ID NO: 625700 - RNA, 64 nt, hsa
ugcuuugugauggauaaaaggcauuaaauaaaaccacguuuacauuuugaagugggguaggaug

SEQ ID NO: 625701 - RNA, 64 nt, hsa
aagccggcuuuccucuauuuugguuuauuuuugccacguuuaacacaaaugguaaacuccucca

SEQ ID NO: 625702 - RNA, 64 nt, hsa
augauaguagucacauacacuacacacacugugccacguuuaaaaagaaaaaaaacaauucucg

SEQ ID NO: 625703 - RNA, 64 nt, hsa
gcucuugggcucuuguuauacagucauauggcuacacguuuauguaaaguuugcaaaaguuugg

SEQ ID NO: 625704 - RNA, 64 nt, hsa
ucaagauccaucgaccuuaaacaggaaugcuuagcacguuuaccauacguuuaaaauccauucu

SEQ ID NO: 625705 - RNA, 64 nt, hsa
guuguauuauaguauauuucgcuguggaaaaugucacguuuagucaccuuggagcccacucacc

SEQ ID NO: 625706 - RNA, 64 nt, hsa
gagcuucuagcauugauuaauauaggauauugaccacguuuauguuuaaauuucauuuuguuca

SEQ ID NO: 625707 - RNA, 65 nt, hsa; identical to SEQ ID NO: 65698

SEQ ID NO: 625708 - RNA, 65 nt, hsa; identical to SEQ ID NO: 65699

SEQ ID NO: 625709 - RNA, 65 nt, hsa; identical to SEQ ID NO: 65706

SEQ ID NO: 625710 - RNA, 65 nt, hsa; identical to SEQ ID NO: 65707

SEQ ID NO: 625711 - RNA, 65 nt, hsa; identical to SEQ ID NO: 65720

SEQ ID NO: 625712 - RNA, 65 nt, hsa; identical to SEQ ID NO: 65721

SEQ ID NO: 625713 - RNA, 65 nt, hsa; identical to SEQ ID NO: 65744

SEQ ID NO: 625714 - RNA, 65 nt, hsa; identical to SEQ ID NO: 65745

SEQ ID NO: 625715 - RNA, 65 nt, hsa; identical to SEQ ID NO: 65788

SEQ ID NO: 625716 - RNA, 65 nt, hsa; identical to SEQ ID NO: 65789

SEQ ID NO: 625717 - RNA, 65 nt, hsa; identical to SEQ ID NO: 65808

SEQ ID NO: 625718 - RNA, 65 nt, hsa; identical to SEQ ID NO: 65809

SEQ ID NO: 625719 - RNA, 65 nt, hsa; identical to SEQ ID NO: 65810

SEQ ID NO: 625720 - RNA, 65 nt, hsa; identical to SEQ ID NO: 65811

SEQ ID NO: 625721 - RNA, 65 nt, hsa; identical to SEQ ID NO: 65827

SEQ ID NO: 625722 - RNA, 65 nt, hsa; identical to SEQ ID NO: 65828

SEQ ID NO: 625723 - RNA, 65 nt, hsa; identical to SEQ ID NO: 65831

SEQ ID NO: 625724 - RNA, 56 nt, hsa; identical to SEQ ID NO: 61369

SEQ ID NO: 625725 - RNA, 65 nt, hsa; identical to SEQ ID NO: 65853

SEQ ID NO: 625726 - RNA, 65 nt, hsa; identical to SEQ ID NO: 65854

SEQ ID NO: 625727 - RNA, 65 nt, hsa; identical to SEQ ID NO: 65891

SEQ ID NO: 625728 - RNA, 65 nt, hsa; identical to SEQ ID NO: 65892

SEQ ID NO: 625729 - RNA, 65 nt, hsa; identical to SEQ ID NO: 65896

SEQ ID NO: 625730 - RNA, 65 nt, hsa; identical to SEQ ID NO: 65897

SEQ ID NO: 625731 - RNA, 64 nt, hsa; identical to SEQ ID NO: 193740

SEQ ID NO: 625732 - RNA, 64 nt, hsa; identical to SEQ ID NO: 193741

SEQ ID NO: 625733 - RNA, 64 nt, hsa; identical to SEQ ID NO: 193742

SEQ ID NO: 625734 - RNA, 64 nt, hsa; identical to SEQ ID NO: 193743

SEQ ID NO: 625735 - RNA, 64 nt, hsa; identical to SEQ ID NO: 193744

SEQ ID NO: 625736 - RNA, 64 nt, hsa; identical to SEQ ID NO: 193745

SEQ ID NO: 625737 - RNA, 64 nt, hsa; identical to SEQ ID NO: 114759

SEQ ID NO: 625738 - RNA, 64 nt, hsa; identical to SEQ ID NO: 114760

SEQ ID NO: 625739 - RNA, 64 nt, hsa; identical to SEQ ID NO: 114761

SEQ ID NO: 625740 - RNA, 64 nt, hsa; identical to SEQ ID NO: 114762

SEQ ID NO: 625741 - RNA, 64 nt, hsa; identical to SEQ ID NO: 114763

SEQ ID NO: 625742 - RNA, 64 nt, hsa; identical to SEQ ID NO: 114764

SEQ ID NO: 625743 - RNA, 64 nt, hsa; identical to SEQ ID NO: 114765

SEQ ID NO: 625744 - RNA, 64 nt, hsa; identical to SEQ ID NO: 114766

SEQ ID NO: 625745 - RNA, 64 nt, hsa; identical to SEQ ID NO: 114767

SEQ ID NO: 625746 - RNA, 64 nt, hsa; identical to SEQ ID NO: 114768

SEQ ID NO: 625747 - RNA, 64 nt, hsa; identical to SEQ ID NO: 114769

SEQ ID NO: 625748 - RNA, 64 nt, hsa; identical to SEQ ID NO: 114770

SEQ ID NO: 625749 - RNA, 64 nt, hsa; identical to SEQ ID NO: 114771

SEQ ID NO: 625750 - RNA, 64 nt, hsa; identical to SEQ ID NO: 114772

SEQ ID NO: 625751 - RNA, 64 nt, hsa; identical to SEQ ID NO: 114773

SEQ ID NO: 625752 - RNA, 64 nt, hsa; identical to SEQ ID NO: 114774

SEQ ID NO: 625753 - RNA, 64 nt, hsa; identical to SEQ ID NO: 114775

SEQ ID NO: 625754 - RNA, 64 nt, hsa; identical to SEQ ID NO: 114776

SEQ ID NO: 625755 - RNA, 64 nt, hsa; identical to SEQ ID NO: 114777

SEQ ID NO: 625756 - RNA, 64 nt, hsa; identical to SEQ ID NO: 114778

SEQ ID NO: 625757 - RNA, 64 nt, hsa; identical to SEQ ID NO: 114779

SEQ ID NO: 625758 - RNA, 64 nt, hsa; identical to SEQ ID NO: 114780

SEQ ID NO: 625759 - RNA, 64 nt, hsa; identical to SEQ ID NO: 114781

SEQ ID NO: 625760 - RNA, 64 nt, hsa; identical to SEQ ID NO: 114782

SEQ ID NO: 625761 - RNA, 64 nt, hsa; identical to SEQ ID NO: 114783

SEQ ID NO: 625762 - RNA, 64 nt, hsa; identical to SEQ ID NO: 114784

SEQ ID NO: 625763 - RNA, 64 nt, hsa; identical to SEQ ID NO: 114785

SEQ ID NO: 625764 - RNA, 64 nt, hsa; identical to SEQ ID NO: 114786

SEQ ID NO: 625765 - RNA, 64 nt, hsa; identical to SEQ ID NO: 114787

SEQ ID NO: 625766 - RNA, 64 nt, hsa; identical to SEQ ID NO: 114788

SEQ ID NO: 625767 - RNA, 64 nt, hsa; identical to SEQ ID NO: 114789

SEQ ID NO: 625768 - RNA, 64 nt, hsa; identical to SEQ ID NO: 114790

SEQ ID NO: 625769 - RNA, 64 nt, hsa; identical to SEQ ID NO: 114791

SEQ ID NO: 625770 - RNA, 64 nt, hsa; identical to SEQ ID NO: 114792

SEQ ID NO: 625771 - RNA, 64 nt, hsa; identical to SEQ ID NO: 114793

SEQ ID NO: 625772 - RNA, 64 nt, hsa; identical to SEQ ID NO: 114794

SEQ ID NO: 625773 - RNA, 64 nt, hsa; identical to SEQ ID NO: 114795

SEQ ID NO: 625774 - RNA, 64 nt, hsa; identical to SEQ ID NO: 114796

SEQ ID NO: 625775 - RNA, 64 nt, hsa; identical to SEQ ID NO: 114797

SEQ ID NO: 625776 - RNA, 64 nt, hsa; identical to SEQ ID NO: 114798

SEQ ID NO: 625777 - RNA, 64 nt, hsa; identical to SEQ ID NO: 114799

SEQ ID NO: 625778 - RNA, 64 nt, hsa; identical to SEQ ID NO: 114800

SEQ ID NO: 625779 - RNA, 64 nt, hsa; identical to SEQ ID NO: 114801

SEQ ID NO: 625780 - RNA, 64 nt, hsa; identical to SEQ ID NO: 114802

SEQ ID NO: 625781 - RNA, 64 nt, hsa; identical to SEQ ID NO: 114803

SEQ ID NO: 625782 - RNA, 64 nt, hsa; identical to SEQ ID NO: 114804

SEQ ID NO: 625783 - RNA, 64 nt, hsa; identical to SEQ ID NO: 114805

SEQ ID NO: 625784 - RNA, 64 nt, hsa; identical to SEQ ID NO: 114806

SEQ ID NO: 625785 - RNA, 64 nt, hsa; identical to SEQ ID NO: 114807

SEQ ID NO: 625786 - RNA, 64 nt, hsa; identical to SEQ ID NO: 167852

SEQ ID NO: 625787 - RNA, 64 nt, hsa; identical to SEQ ID NO: 167853

SEQ ID NO: 625788 - RNA, 64 nt, hsa; identical to SEQ ID NO: 70884

SEQ ID NO: 625789 - RNA, 64 nt, hsa; identical to SEQ ID NO: 70885

SEQ ID NO: 625790 - RNA, 64 nt, hsa; identical to SEQ ID NO: 70886

SEQ ID NO: 625791 - RNA, 64 nt, hsa; identical to SEQ ID NO: 70887

SEQ ID NO: 625792 - RNA, 64 nt, hsa; identical to SEQ ID NO: 70888

SEQ ID NO: 625793 - RNA, 64 nt, hsa; identical to SEQ ID NO: 70889

SEQ ID NO: 625794 - RNA, 64 nt, hsa; identical to SEQ ID NO: 474161

SEQ ID NO: 625795 - RNA, 64 nt, hsa; identical to SEQ ID NO: 474162

SEQ ID NO: 625796 - RNA, 64 nt, hsa; identical to SEQ ID NO: 474163

SEQ ID NO: 625797 - RNA, 64 nt, hsa; identical to SEQ ID NO: 474164

SEQ ID NO: 625798 - RNA, 64 nt, hsa; identical to SEQ ID NO: 474165

SEQ ID NO: 625799 - RNA, 64 nt, hsa; identical to SEQ ID NO: 474166

SEQ ID NO: 625800 - RNA, 64 nt, hsa; identical to SEQ ID NO: 474167

SEQ ID NO: 625801 - RNA, 64 nt, hsa; identical to SEQ ID NO: 474168

SEQ ID NO: 625802 - RNA, 64 nt, hsa; identical to SEQ ID NO: 474169

SEQ ID NO: 625803 - RNA, 64 nt, hsa; identical to SEQ ID NO: 474170

SEQ ID NO: 625804 - RNA, 64 nt, hsa; identical to SEQ ID NO: 474171

SEQ ID NO: 625805 - RNA, 64 nt, hsa; identical to SEQ ID NO: 474172

SEQ ID NO: 625806 - RNA, 64 nt, hsa; identical to SEQ ID NO: 474173

SEQ ID NO: 625807 - RNA, 64 nt, hsa; identical to SEQ ID NO: 474174

SEQ ID NO: 625808 - RNA, 64 nt, hsa; identical to SEQ ID NO: 474175

SEQ ID NO: 625809 - RNA, 64 nt, hsa; identical to SEQ ID NO: 474176

SEQ ID NO: 625810 - RNA, 64 nt, hsa; identical to SEQ ID NO: 474177

SEQ ID NO: 625811 - RNA, 64 nt, hsa; identical to SEQ ID NO: 474178

SEQ ID NO: 625812 - RNA, 64 nt, hsa; identical to SEQ ID NO: 474179

SEQ ID NO: 625813 - RNA, 64 nt, hsa; identical to SEQ ID NO: 474180

SEQ ID NO: 625814 - RNA, 64 nt, hsa; identical to SEQ ID NO: 474181

SEQ ID NO: 625815 - RNA, 64 nt, hsa; identical to SEQ ID NO: 474182

SEQ ID NO: 625816 - RNA, 64 nt, hsa; identical to SEQ ID NO: 474183

SEQ ID NO: 625817 - RNA, 64 nt, hsa; identical to SEQ ID NO: 474184

SEQ ID NO: 625818 - RNA, 64 nt, hsa; identical to SEQ ID NO: 474185

SEQ ID NO: 625819 - RNA, 64 nt, hsa; identical to SEQ ID NO: 474186

SEQ ID NO: 625820 - RNA, 64 nt, hsa
caggaaccacauuuucaauccuccuucacugucuuccuaccauguucagcccagacuccugcca

SEQ ID NO: 625821 - RNA, 64 nt, hsa
ucaaaucagaccagcacugauuaauuaacccugcuccuaccaaucuuuuuuaaagcaguugaag

SEQ ID NO: 625822 - RNA, 64 nt, hsa
uaagauuaagauuauuuaugugauaaaugaaaucuccuaccaauccauccagccuuuaccaggg

SEQ ID NO: 625823 - RNA, 64 nt, hsa
aaauuuagcugggcaugguggugcacaucuguaguccuaccaacuugggaggcugaggcaggag

SEQ ID NO: 625824 - RNA, 64 nt, hsa
uccgccuuugucccauucugccccuguacauguuuccuaccaagcauguuucacauuuuccuau

SEQ ID NO: 625825 - RNA, 64 nt, hsa
uuguuuuguuuucuuguacuuaaaccugcuugcuuccuaccacagauucuuuauuuucccaaac

SEQ ID NO: 625826 - RNA, 64 nt, hsa
aaauaauuagguccccaacgaauuaaauauuauguccuaccaacuuauuagcugcuugaaaaau

SEQ ID NO: 625827 - RNA, 64 nt, hsa
augcauggaaacauggaggaacaguauuacaguguccuaccacucuaaucaagaaaagaauuac

SEQ ID NO: 625828 - RNA, 64 nt, hsa
gccucuccacagcccgugauccccugcuucuggcuccuaccacuggacagucauuguggauaga

SEQ ID NO: 625829 - RNA, 64 nt, hsa
aaugugugcccuaucuuuucucccaccuccuuccuccuaccacccagcccuauccauucucucc

SEQ ID NO: 625830 - RNA, 64 nt, hsa
caugucuuggcagugccaggcggucaucgagaguuccuaccagguggccaaggcguuggcagac

SEQ ID NO: 625831 - RNA, 64 nt, hsa
ucaggugauggcacugggcauagugccuaugugcuccuaccagauggagaggauguucaacacc

SEQ ID NO: 625832 - RNA, 64 nt, hsa
ggcucaaagaggccgagaaacccaguucuccugggccaaggaucccuucuggcaaagcugcugc

SEQ ID NO: 625833 - RNA, 64 nt, hsa
cacacgcccuccuggcugggccucaggaggaacagccaaggagaagaauggcccaaggaacuag

SEQ ID NO: 625834 - RNA, 64 nt, hsa
uccugaggcuuuccacaauguuccccuccugugagccaaggaggcaaacugcacaagcuuguaa

SEQ ID NO: 625835 - RNA, 64 nt, hsa
auuaauuaggaaaaccaauaguaaucacgucugagccaaggagcuggcccauuggucauucacu

SEQ ID NO: 625836 - RNA, 64 nt, hsa
gcauggaaguuuaaauuuucucuaaaauuaaaaugccaaggauaaagcuggcugcuuccaggag

SEQ ID NO: 625837 - RNA, 64 nt, hsa
auguguaaggaagggccuuccguauugggguucugccaaggacccguauucagggacccaugcu

SEQ ID NO: 625838 - RNA, 64 nt, hsa
cuccuaugguucccauaggcacaccuauucccaggccaaggagaguccuuccucuccccuuuug

SEQ ID NO: 625839 - RNA, 64 nt, hsa
guuuuuagaauauuucgucugaauaaguacaguagccaaggaauacaaacauaauugcauguuu

SEQ ID NO: 625840 - RNA, 64 nt, hsa
ggcuccuaugccuccuggcuucugaguggguuuggccaaggaguguccuggccagagaucagag

SEQ ID NO: 625841 - RNA, 64 nt, hsa
uccagguugccagucccugcacucuuccuuucuggccaaggaugaugucaguucugcugcuacu

SEQ ID NO: 625842 - RNA, 64 nt, hsa
aucuguguucaaagaugaagaccccucauuaaaagccaaggacguucuuaagauuggaacugac

SEQ ID NO: 625843 - RNA, 64 nt, hsa
guggcucaagccuguaaccccagcacuuugggaggccaaggagggaggaucacaaggucaggag

SEQ ID NO: 625844 - RNA, 64 nt, hsa
agggacaguugcuuuucagcaugggcccaggaaugccaaggagacaucuaugcacgaccuuggg

SEQ ID NO: 625845 - RNA, 64 nt, hsa
gcauggcugugaggauggggugaacucacgcacagccaaggacuccaaaaucacaacagcauua

SEQ ID NO: 625846 - RNA, 64 nt, hsa
cagcaauuuaaaacuaggacuuuuccccccauaagccaaggagguagaauuacuaauacaaggg

SEQ ID NO: 625847 - RNA, 64 nt, hsa
aaacagagaaaacuggggucgcgaagaaaucacagccaaggaagauuugaugcauucagauucu

SEQ ID NO: 625848 - RNA, 64 nt, hsa
cagcucacgacagugccaccuucucaccauuccagccaaggagagaugugacguuggaacugcu

SEQ ID NO: 625849 - RNA, 64 nt, hsa
cagaccaggcgcacguggcucauggggcagaauugccaaggacagcucacgacagugccaccuu

SEQ ID NO: 625850 - RNA, 64 nt, hsa
uguccuguccaccagcgccaacagccguggggaagccaaggagacccaagggguccaggaggug

SEQ ID NO: 625851 - RNA, 64 nt, hsa
ccgucugccagggcgccggccacaauccugcagggccaaggacuggacuccaggcaagucccug

SEQ ID NO: 625852 - RNA, 59 nt, hsa
agaagaaacgcagggagugauguggccgggccaaggacaggcagggagggaggccaggc

SEQ ID NO: 625853 - RNA, 64 nt, hsa
gggcggccggggcaggcuuagggcacaguuaggggccaaggagagggaaggccagggccccugu

SEQ ID NO: 625854 - RNA, 63 nt, hsa
auuuauuuuaaaacaagggcuagcuucaagcaugacuguuaauggcuccucugugacaaaaca

SEQ ID NO: 625855 - RNA, 63 nt, hsa
auuaaugaguauuuccuuucuccauaagugcaggacuguuacucacuacuaaacucuaccaag

SEQ ID NO: 625856 - RNA, 63 nt, hsa
ugcucagacagaagggacuguggucgcuccuccgacuguuauccagguuccaagccuagaggc

SEQ ID NO: 625857 - RNA, 63 nt, hsa
cucagacacagaagggacugcagucgugccucugacuguuaucccgguuccaagccuagagga

SEQ ID NO: 625858 - RNA, 63 nt, hsa
uguuuuaagacuuccacacaccaaggcuacaaugacuguuaaccuggaggaagucucugguau

SEQ ID NO: 625859 - RNA, 63 nt, hsa
auaaauuaagcauaaaauauguaaccaggaaaagacuguuaacauuacauuuaugcaaauuaa

SEQ ID NO: 625860 - RNA, 64 nt, hsa; identical to SEQ ID NO: 84809

SEQ ID NO: 625861 - RNA, 64 nt, hsa; identical to SEQ ID NO: 84810

SEQ ID NO: 625862 - RNA, 64 nt, hsa; identical to SEQ ID NO: 84811

SEQ ID NO: 625863 - RNA, 64 nt, hsa; identical to SEQ ID NO: 84812

SEQ ID NO: 625864 - RNA, 64 nt, hsa; identical to SEQ ID NO: 557328

SEQ ID NO: 625865 - RNA, 64 nt, hsa; identical to SEQ ID NO: 557329

SEQ ID NO: 625866 - RNA, 64 nt, hsa; identical to SEQ ID NO: 557330

SEQ ID NO: 625867 - RNA, 64 nt, hsa; identical to SEQ ID NO: 557331

SEQ ID NO: 625868 - RNA, 64 nt, hsa; identical to SEQ ID NO: 557332

SEQ ID NO: 625869 - RNA, 64 nt, hsa; identical to SEQ ID NO: 557333

SEQ ID NO: 625870 - RNA, 64 nt, hsa; identical to SEQ ID NO: 557334

SEQ ID NO: 625871 - RNA, 64 nt, hsa; identical to SEQ ID NO: 557335

SEQ ID NO: 625872 - RNA, 64 nt, hsa; identical to SEQ ID NO: 557336

SEQ ID NO: 625873 - RNA, 64 nt, hsa; identical to SEQ ID NO: 557337

SEQ ID NO: 625874 - RNA, 64 nt, hsa; identical to SEQ ID NO: 557338

SEQ ID NO: 625875 - RNA, 64 nt, hsa; identical to SEQ ID NO: 557339

SEQ ID NO: 625876 - RNA, 64 nt, hsa; identical to SEQ ID NO: 557340

SEQ ID NO: 625877 - RNA, 64 nt, hsa; identical to SEQ ID NO: 557341

SEQ ID NO: 625878 - RNA, 64 nt, hsa; identical to SEQ ID NO: 557342

SEQ ID NO: 625879 - RNA, 64 nt, hsa; identical to SEQ ID NO: 557343

SEQ ID NO: 625880 - RNA, 64 nt, hsa; identical to SEQ ID NO: 557344

SEQ ID NO: 625881 - RNA, 64 nt, hsa; identical to SEQ ID NO: 557345

SEQ ID NO: 625882 - RNA, 64 nt, hsa; identical to SEQ ID NO: 557346

SEQ ID NO: 625883 - RNA, 64 nt, hsa; identical to SEQ ID NO: 557347

SEQ ID NO: 625884 - RNA, 64 nt, hsa; identical to SEQ ID NO: 557348

SEQ ID NO: 625885 - RNA, 64 nt, hsa; identical to SEQ ID NO: 557349

SEQ ID NO: 625886 - RNA, 64 nt, hsa; identical to SEQ ID NO: 557350

SEQ ID NO: 625887 - RNA, 64 nt, hsa; identical to SEQ ID NO: 557351

SEQ ID NO: 625888 - RNA, 64 nt, hsa; identical to SEQ ID NO: 557352

SEQ ID NO: 625889 - RNA, 64 nt, hsa; identical to SEQ ID NO: 557353

SEQ ID NO: 625890 - RNA, 64 nt, hsa; identical to SEQ ID NO: 557354

SEQ ID NO: 625891 - RNA, 64 nt, hsa; identical to SEQ ID NO: 557355

SEQ ID NO: 625892 - RNA, 64 nt, hsa; identical to SEQ ID NO: 236779

SEQ ID NO: 625893 - RNA, 64 nt, hsa; identical to SEQ ID NO: 236780

SEQ ID NO: 625894 - RNA, 64 nt, hsa; identical to SEQ ID NO: 236781

SEQ ID NO: 625895 - RNA, 64 nt, hsa; identical to SEQ ID NO: 236782

SEQ ID NO: 625896 - RNA, 64 nt, hsa; identical to SEQ ID NO: 236783

SEQ ID NO: 625897 - RNA, 64 nt, hsa; identical to SEQ ID NO: 236784

SEQ ID NO: 625898 - RNA, 64 nt, hsa; identical to SEQ ID NO: 236785

SEQ ID NO: 625899 - RNA, 64 nt, hsa; identical to SEQ ID NO: 236786

SEQ ID NO: 625900 - RNA, 64 nt, hsa; identical to SEQ ID NO: 236787

SEQ ID NO: 625901 - RNA, 64 nt, hsa; identical to SEQ ID NO: 236788

SEQ ID NO: 625902 - RNA, 64 nt, hsa; identical to SEQ ID NO: 236789

SEQ ID NO: 625903 - RNA, 64 nt, hsa; identical to SEQ ID NO: 236790

SEQ ID NO: 625904 - RNA, 64 nt, hsa
uucaauuaccucccccugggucugucccacaacacgugggaauucugggagauacaauucaagu

SEQ ID NO: 625905 - RNA, 64 nt, hsa
uucaauuaccuccccuugggucucucccacaacacgugggaauucugguagauacaauuucaag

SEQ ID NO: 625906 - RNA, 64 nt, hsa; identical to SEQ ID NO: 193898

SEQ ID NO: 625907 - RNA, 64 nt, hsa; identical to SEQ ID NO: 193899

SEQ ID NO: 625908 - RNA, 64 nt, hsa; identical to SEQ ID NO: 193900

SEQ ID NO: 625909 - RNA, 64 nt, hsa; identical to SEQ ID NO: 193901

SEQ ID NO: 625910 - RNA, 64 nt, hsa; identical to SEQ ID NO: 193902

SEQ ID NO: 625911 - RNA, 64 nt, hsa; identical to SEQ ID NO: 193903

SEQ ID NO: 625912 - RNA, 64 nt, hsa; identical to SEQ ID NO: 193904

SEQ ID NO: 625913 - RNA, 64 nt, hsa; identical to SEQ ID NO: 193905

SEQ ID NO: 625914 - RNA, 64 nt, hsa; identical to SEQ ID NO: 193906

SEQ ID NO: 625915 - RNA, 64 nt, hsa; identical to SEQ ID NO: 193907

SEQ ID NO: 625916 - RNA, 64 nt, hsa; identical to SEQ ID NO: 193908

SEQ ID NO: 625917 - RNA, 64 nt, hsa; identical to SEQ ID NO: 193909

SEQ ID NO: 625918 - RNA, 64 nt, hsa; identical to SEQ ID NO: 193910

SEQ ID NO: 625919 - RNA, 64 nt, hsa; identical to SEQ ID NO: 193911

SEQ ID NO: 625920 - RNA, 64 nt, hsa; identical to SEQ ID NO: 193912

SEQ ID NO: 625921 - RNA, 64 nt, hsa; identical to SEQ ID NO: 193913

SEQ ID NO: 625922 - RNA, 64 nt, hsa; identical to SEQ ID NO: 193914

SEQ ID NO: 625923 - RNA, 64 nt, hsa; identical to SEQ ID NO: 193915

SEQ ID NO: 625924 - RNA, 64 nt, hsa; identical to SEQ ID NO: 193916

SEQ ID NO: 625925 - RNA, 64 nt, hsa; identical to SEQ ID NO: 193917

SEQ ID NO: 625926 - RNA, 64 nt, hsa; identical to SEQ ID NO: 193918

SEQ ID NO: 625927 - RNA, 64 nt, hsa; identical to SEQ ID NO: 193919

SEQ ID NO: 625928 - RNA, 64 nt, hsa; identical to SEQ ID NO: 266922

SEQ ID NO: 625929 - RNA, 64 nt, hsa; identical to SEQ ID NO: 266923

SEQ ID NO: 625930 - RNA, 64 nt, hsa; identical to SEQ ID NO: 266924

SEQ ID NO: 625931 - RNA, 64 nt, hsa; identical to SEQ ID NO: 266925

SEQ ID NO: 625932 - RNA, 64 nt, hsa; identical to SEQ ID NO: 266926

SEQ ID NO: 625933 - RNA, 64 nt, hsa; identical to SEQ ID NO: 266927

SEQ ID NO: 625934 - RNA, 64 nt, hsa; identical to SEQ ID NO: 266928

SEQ ID NO: 625935 - RNA, 64 nt, hsa; identical to SEQ ID NO: 266929

SEQ ID NO: 625936 - RNA, 64 nt, hsa; identical to SEQ ID NO: 266930

SEQ ID NO: 625937 - RNA, 64 nt, hsa; identical to SEQ ID NO: 266931

SEQ ID NO: 625938 - RNA, 64 nt, hsa; identical to SEQ ID NO: 266932

SEQ ID NO: 625939 - RNA, 64 nt, hsa; identical to SEQ ID NO: 266933

SEQ ID NO: 625940 - RNA, 64 nt, hsa; identical to SEQ ID NO: 266934

SEQ ID NO: 625941 - RNA, 64 nt, hsa; identical to SEQ ID NO: 266935

SEQ ID NO: 625942 - RNA, 64 nt, hsa; identical to SEQ ID NO: 266936

SEQ ID NO: 625943 - RNA, 64 nt, hsa; identical to SEQ ID NO: 266937

SEQ ID NO: 625944 - RNA, 64 nt, hsa; identical to SEQ ID NO: 266938

SEQ ID NO: 625945 - RNA, 64 nt, hsa; identical to SEQ ID NO: 266939

SEQ ID NO: 625946 - RNA, 64 nt, hsa; identical to SEQ ID NO: 266940

SEQ ID NO: 625947 - RNA, 64 nt, hsa; identical to SEQ ID NO: 266941

SEQ ID NO: 625948 - RNA, 64 nt, hsa; identical to SEQ ID NO: 266942

SEQ ID NO: 625949 - RNA, 64 nt, hsa; identical to SEQ ID NO: 266943

SEQ ID NO: 625950 - RNA, 64 nt, hsa; identical to SEQ ID NO: 266944

SEQ ID NO: 625951 - RNA, 64 nt, hsa; identical to SEQ ID NO: 266945

SEQ ID NO: 625952 - RNA, 64 nt, hsa; identical to SEQ ID NO: 266946

SEQ ID NO: 625953 - RNA, 64 nt, hsa; identical to SEQ ID NO: 266947

SEQ ID NO: 625954 - RNA, 64 nt, hsa; identical to SEQ ID NO: 266948

SEQ ID NO: 625955 - RNA, 64 nt, hsa; identical to SEQ ID NO: 266949

SEQ ID NO: 625956 - RNA, 64 nt, hsa; identical to SEQ ID NO: 266950

SEQ ID NO: 625957 - RNA, 64 nt, hsa; identical to SEQ ID NO: 266951

SEQ ID NO: 625958 - RNA, 64 nt, hsa; identical to SEQ ID NO: 266952

SEQ ID NO: 625959 - RNA, 64 nt, hsa; identical to SEQ ID NO: 266953

SEQ ID NO: 625960 - RNA, 64 nt, hsa; identical to SEQ ID NO: 266954

SEQ ID NO: 625961 - RNA, 64 nt, hsa; identical to SEQ ID NO: 266955

SEQ ID NO: 625962 - RNA, 64 nt, hsa; identical to SEQ ID NO: 266956

SEQ ID NO: 625963 - RNA, 64 nt, hsa; identical to SEQ ID NO: 266957

SEQ ID NO: 625964 - RNA, 64 nt, hsa; identical to SEQ ID NO: 266958

SEQ ID NO: 625965 - RNA, 63 nt, hsa; identical to SEQ ID NO: 266959

SEQ ID NO: 625966 - RNA, 64 nt, hsa; identical to SEQ ID NO: 266960

SEQ ID NO: 625967 - RNA, 64 nt, hsa; identical to SEQ ID NO: 266961

SEQ ID NO: 625968 - RNA, 64 nt, hsa; identical to SEQ ID NO: 266962

SEQ ID NO: 625969 - RNA, 64 nt, hsa; identical to SEQ ID NO: 266963

SEQ ID NO: 625970 - RNA, 64 nt, hsa; identical to SEQ ID NO: 266964

SEQ ID NO: 625971 - RNA, 64 nt, hsa; identical to SEQ ID NO: 266965

SEQ ID NO: 625972 - RNA, 64 nt, hsa; identical to SEQ ID NO: 266966

SEQ ID NO: 625973 - RNA, 64 nt, hsa; identical to SEQ ID NO: 266967

SEQ ID NO: 625974 - RNA, 64 nt, hsa; identical to SEQ ID NO: 266968

SEQ ID NO: 625975 - RNA, 64 nt, hsa; identical to SEQ ID NO: 266969

SEQ ID NO: 625976 - RNA, 64 nt, hsa; identical to SEQ ID NO: 266970

SEQ ID NO: 625977 - RNA, 64 nt, hsa; identical to SEQ ID NO: 266971

SEQ ID NO: 625978 - RNA, 64 nt, hsa; identical to SEQ ID NO: 266972

SEQ ID NO: 625979 - RNA, 64 nt, hsa; identical to SEQ ID NO: 266973

SEQ ID NO: 625980 - RNA, 64 nt, hsa; identical to SEQ ID NO: 266974

SEQ ID NO: 625981 - RNA, 64 nt, hsa; identical to SEQ ID NO: 266975

SEQ ID NO: 625982 - RNA, 64 nt, hsa; identical to SEQ ID NO: 266976

SEQ ID NO: 625983 - RNA, 64 nt, hsa; identical to SEQ ID NO: 266977

SEQ ID NO: 625984 - RNA, 64 nt, hsa; identical to SEQ ID NO: 266978

SEQ ID NO: 625985 - RNA, 64 nt, hsa; identical to SEQ ID NO: 266979

SEQ ID NO: 625986 - RNA, 64 nt, hsa; identical to SEQ ID NO: 266980

SEQ ID NO: 625987 - RNA, 64 nt, hsa; identical to SEQ ID NO: 266981

SEQ ID NO: 625988 - RNA, 64 nt, hsa; identical to SEQ ID NO: 266982

SEQ ID NO: 625989 - RNA, 64 nt, hsa; identical to SEQ ID NO: 266983

SEQ ID NO: 625990 - RNA, 64 nt, hsa; identical to SEQ ID NO: 279869

SEQ ID NO: 625991 - RNA, 64 nt, hsa; identical to SEQ ID NO: 279870

SEQ ID NO: 625992 - RNA, 64 nt, hsa; identical to SEQ ID NO: 279871

SEQ ID NO: 625993 - RNA, 64 nt, hsa; identical to SEQ ID NO: 279871

SEQ ID NO: 625994 - RNA, 64 nt, hsa; identical to SEQ ID NO: 279873

SEQ ID NO: 625995 - RNA, 64 nt, hsa; identical to SEQ ID NO: 279874

SEQ ID NO: 625996 - RNA, 64 nt, hsa; identical to SEQ ID NO: 279875

SEQ ID NO: 625997 - RNA, 64 nt, hsa; identical to SEQ ID NO: 279876

SEQ ID NO: 625998 - RNA, 64 nt, hsa; identical to SEQ ID NO: 279877

SEQ ID NO: 625999 - RNA, 64 nt, hsa; identical to SEQ ID NO: 279878

SEQ ID NO: 626000 - RNA, 64 nt, hsa; identical to SEQ ID NO: 279879

SEQ ID NO: 626001 - RNA, 64 nt, hsa; identical to SEQ ID NO: 279880

SEQ ID NO: 626002 - RNA, 64 nt, hsa; identical to SEQ ID NO: 279881

SEQ ID NO: 626003 - RNA, 64 nt, hsa; identical to SEQ ID NO: 279882

SEQ ID NO: 626004 - RNA, 64 nt, hsa; identical to SEQ ID NO: 279883

SEQ ID NO: 626005 - RNA, 64 nt, hsa; identical to SEQ ID NO: 279884

SEQ ID NO: 626006 - RNA, 64 nt, hsa; identical to SEQ ID NO: 279885

SEQ ID NO: 626007 - RNA, 64 nt, hsa; identical to SEQ ID NO: 279886

SEQ ID NO: 626008 - RNA, 64 nt, hsa; identical to SEQ ID NO: 279887

SEQ ID NO: 626009 - RNA, 64 nt, hsa; identical to SEQ ID NO: 279888

SEQ ID NO: 626010 - RNA, 64 nt, hsa; identical to SEQ ID NO: 279889

SEQ ID NO: 626011 - RNA, 64 nt, hsa; identical to SEQ ID NO: 279890

SEQ ID NO: 626012 - RNA, 64 nt, hsa; identical to SEQ ID NO: 279891

SEQ ID NO: 626013 - RNA, 64 nt, hsa; identical to SEQ ID NO: 279892

SEQ ID NO: 626014 - RNA, 64 nt, hsa; identical to SEQ ID NO: 279893

SEQ ID NO: 626015 - RNA, 64 nt, hsa; identical to SEQ ID NO: 279894

SEQ ID NO: 626016 - RNA, 64 nt, hsa; identical to SEQ ID NO: 279895

SEQ ID NO: 626017 - RNA, 64 nt, hsa; identical to SEQ ID NO: 279896

SEQ ID NO: 626018 - RNA, 64 nt, hsa; identical to SEQ ID NO: 279897

SEQ ID NO: 626019 - RNA, 64 nt, hsa; identical to SEQ ID NO: 279898

SEQ ID NO: 626020 - RNA, 64 nt, hsa; identical to SEQ ID NO: 279898

SEQ ID NO: 626021 - RNA, 64 nt, hsa; identical to SEQ ID NO: 189094

SEQ ID NO: 626022 - RNA, 64 nt, hsa; identical to SEQ ID NO: 189095

SEQ ID NO: 626023 - RNA, 64 nt, hsa; identical to SEQ ID NO: 189096

SEQ ID NO: 626024 - RNA, 64 nt, hsa; identical to SEQ ID NO: 189097

SEQ ID NO: 626025 - RNA, 64 nt, hsa; identical to SEQ ID NO: 189098

SEQ ID NO: 626026 - RNA, 64 nt, hsa; identical to SEQ ID NO: 189099

SEQ ID NO: 626027 - RNA, 64 nt, hsa; identical to SEQ ID NO: 189100

SEQ ID NO: 626028 - RNA, 64 nt, hsa; identical to SEQ ID NO: 189101

SEQ ID NO: 626029 - RNA, 64 nt, hsa; identical to SEQ ID NO: 189102

SEQ ID NO: 626030 - RNA, 64 nt, hsa; identical to SEQ ID NO: 189103

SEQ ID NO: 626031 - RNA, 64 nt, hsa; identical to SEQ ID NO: 189104

SEQ ID NO: 626032 - RNA, 64 nt, hsa; identical to SEQ ID NO: 189105

SEQ ID NO: 626033 - RNA, 64 nt, hsa; identical to SEQ ID NO: 189106

SEQ ID NO: 626034 - RNA, 64 nt, hsa; identical to SEQ ID NO: 189107

SEQ ID NO: 626035 - RNA, 64 nt, hsa; identical to SEQ ID NO: 189108

SEQ ID NO: 626036 - RNA, 64 nt, hsa; identical to SEQ ID NO: 189109

SEQ ID NO: 626037 - RNA, 64 nt, hsa; identical to SEQ ID NO: 189110

SEQ ID NO: 626038 - RNA, 64 nt, hsa; identical to SEQ ID NO: 189111

SEQ ID NO: 626039 - RNA, 64 nt, hsa; identical to SEQ ID NO: 189112

SEQ ID NO: 626040 - RNA, 64 nt, hsa; identical to SEQ ID NO: 189113

SEQ ID NO: 626041 - RNA, 64 nt, hsa; identical to SEQ ID NO: 189114

SEQ ID NO: 626042 - RNA, 64 nt, hsa; identical to SEQ ID NO: 189115

SEQ ID NO: 626043 - RNA, 64 nt, hsa; identical to SEQ ID NO: 189116

SEQ ID NO: 626044 - RNA, 64 nt, hsa; identical to SEQ ID NO: 189117

SEQ ID NO: 626045 - RNA, 64 nt, hsa; identical to SEQ ID NO: 189118

SEQ ID NO: 626046 - RNA, 64 nt, hsa; identical to SEQ ID NO: 189119

SEQ ID NO: 626047 - RNA, 64 nt, hsa
aacaggaaaaagaaucaccuauaaccucaccauccauagacagacacuguuaaaauuuuggcau

SEQ ID NO: 626048 - RNA, 64 nt, hsa
ggaucauaaacauuuuucuaaauccugaaaaaugcauagacauauuuuagugccuguauuucac

SEQ ID NO: 626049 - RNA, 64 nt, hsa; identical to SEQ ID NO: 129470

SEQ ID NO: 626050 - RNA, 64 nt, hsa; identical to SEQ ID NO: 129471

SEQ ID NO: 626051 - RNA, 64 nt, hsa; identical to SEQ ID NO: 129472

SEQ ID NO: 626052 - RNA, 64 nt, hsa; identical to SEQ ID NO: 129473

SEQ ID NO: 626053 - RNA, 64 nt, hsa; identical to SEQ ID NO: 129474

SEQ ID NO: 626054 - RNA, 64 nt, hsa; identical to SEQ ID NO: 129475

SEQ ID NO: 626055 - RNA, 64 nt, hsa; identical to SEQ ID NO: 129476

SEQ ID NO: 626056 - RNA, 64 nt, hsa; identical to SEQ ID NO: 129477

SEQ ID NO: 626057 - RNA, 64 nt, hsa; identical to SEQ ID NO: 129478

SEQ ID NO: 626058 - RNA, 64 nt, hsa; identical to SEQ ID NO: 129479

SEQ ID NO: 626059 - RNA, 64 nt, hsa; identical to SEQ ID NO: 243458

SEQ ID NO: 626060 - RNA, 64 nt, hsa; identical to SEQ ID NO: 243459

SEQ ID NO: 626061 - RNA, 64 nt, hsa; identical to SEQ ID NO: 243460

SEQ ID NO: 626062 - RNA, 64 nt, hsa; identical to SEQ ID NO: 243461

SEQ ID NO: 626063 - RNA, 64 nt, hsa; identical to SEQ ID NO: 243462

SEQ ID NO: 626064 - RNA, 64 nt, hsa; identical to SEQ ID NO: 357461

SEQ ID NO: 626065 - RNA, 64 nt, hsa; identical to SEQ ID NO: 357462

SEQ ID NO: 626066 - RNA, 64 nt, hsa; identical to SEQ ID NO: 357463

SEQ ID NO: 626067 - RNA, 64 nt, hsa; identical to SEQ ID NO: 357464

SEQ ID NO: 626068 - RNA, 64 nt, hsa; identical to SEQ ID NO: 357465

SEQ ID NO: 626069 - RNA, 64 nt, hsa; identical to SEQ ID NO: 357466

SEQ ID NO: 626070 - RNA, 64 nt, hsa; identical to SEQ ID NO: 357467

SEQ ID NO: 626071 - RNA, 64 nt, hsa; identical to SEQ ID NO: 357468

SEQ ID NO: 626072 - RNA, 64 nt, hsa; identical to SEQ ID NO: 357469

SEQ ID NO: 626073 - RNA, 64 nt, hsa; identical to SEQ ID NO: 357470

SEQ ID NO: 626074 - RNA, 64 nt, hsa; identical to SEQ ID NO: 357471

SEQ ID NO: 626075 - RNA, 64 nt, hsa; identical to SEQ ID NO: 357472

SEQ ID NO: 626076 - RNA, 64 nt, hsa; identical to SEQ ID NO: 357473

SEQ ID NO: 626077 - RNA, 64 nt, hsa; identical to SEQ ID NO: 357474

SEQ ID NO: 626078 - RNA, 64 nt, hsa; identical to SEQ ID NO: 357475

SEQ ID NO: 626079 - RNA, 64 nt, hsa; identical to SEQ ID NO: 357476

SEQ ID NO: 626080 - RNA, 64 nt, hsa; identical to SEQ ID NO: 357477

SEQ ID NO: 626081 - RNA, 64 nt, hsa; identical to SEQ ID NO: 357478

SEQ ID NO: 626082 - RNA, 64 nt, hsa; identical to SEQ ID NO: 357479

SEQ ID NO: 626083 - RNA, 64 nt, hsa; identical to SEQ ID NO: 357480

SEQ ID NO: 626084 - RNA, 64 nt, hsa; identical to SEQ ID NO: 357481

SEQ ID NO: 626085 - RNA, 64 nt, hsa; identical to SEQ ID NO: 357482

SEQ ID NO: 626086 - RNA, 64 nt, hsa; identical to SEQ ID NO: 357483

SEQ ID NO: 626087 - RNA, 64 nt, hsa; identical to SEQ ID NO: 357484

SEQ ID NO: 626088 - RNA, 64 nt, hsa; identical to SEQ ID NO: 357485

SEQ ID NO: 626089 - RNA, 64 nt, hsa; identical to SEQ ID NO: 357486

SEQ ID NO: 626090 - RNA, 64 nt, hsa; identical to SEQ ID NO: 357487

SEQ ID NO: 626091 - RNA, 64 nt, hsa; identical to SEQ ID NO: 357488

SEQ ID NO: 626092 - RNA, 64 nt, hsa; identical to SEQ ID NO: 357489

SEQ ID NO: 626093 - RNA, 64 nt, hsa; identical to SEQ ID NO: 357490

SEQ ID NO: 626094 - RNA, 64 nt, hsa; identical to SEQ ID NO: 357491

SEQ ID NO: 626095 - RNA, 64 nt, hsa; identical to SEQ ID NO: 357492

SEQ ID NO: 626096 - RNA, 64 nt, hsa; identical to SEQ ID NO: 357493

SEQ ID NO: 626097 - RNA, 64 nt, hsa; identical to SEQ ID NO: 357494

SEQ ID NO: 626098 - RNA, 64 nt, hsa; identical to SEQ ID NO: 357495

SEQ ID NO: 626099 - RNA, 64 nt, hsa; identical to SEQ ID NO: 357496

SEQ ID NO: 626100 - RNA, 64 nt, hsa; identical to SEQ ID NO: 357497

SEQ ID NO: 626101 - RNA, 64 nt, hsa; identical to SEQ ID NO: 357498

SEQ ID NO: 626102 - RNA, 64 nt, hsa; identical to SEQ ID NO: 357499

SEQ ID NO: 626103 - RNA, 64 nt, hsa; identical to SEQ ID NO: 357500

SEQ ID NO: 626104 - RNA, 64 nt, hsa; identical to SEQ ID NO: 357501

SEQ ID NO: 626105 - RNA, 64 nt, hsa; identical to SEQ ID NO: 357502

SEQ ID NO: 626106 - RNA, 64 nt, hsa; identical to SEQ ID NO: 357503

SEQ ID NO: 626107 - RNA, 64 nt, hsa; identical to SEQ ID NO: 357504

SEQ ID NO: 626108 - RNA, 64 nt, hsa; identical to SEQ ID NO: 357505

SEQ ID NO: 626109 - RNA, 64 nt, hsa; identical to SEQ ID NO: 357506

SEQ ID NO: 626110 - RNA, 64 nt, hsa; identical to SEQ ID NO: 357507

SEQ ID NO: 626111 - RNA, 64 nt, hsa; identical to SEQ ID NO: 357508

SEQ ID NO: 626112 - RNA, 64 nt, hsa; identical to SEQ ID NO: 357509

SEQ ID NO: 626113 - RNA, 64 nt, hsa; identical to SEQ ID NO: 357510

SEQ ID NO: 626114 - RNA, 64 nt, hsa; identical to SEQ ID NO: 357511

SEQ ID NO: 626115 - RNA, 64 nt, hsa; identical to SEQ ID NO: 357512

SEQ ID NO: 626116 - RNA, 64 nt, hsa; identical to SEQ ID NO: 357513

SEQ ID NO: 626117 - RNA, 64 nt, hsa; identical to SEQ ID NO: 357514

SEQ ID NO: 626118 - RNA, 64 nt, hsa; identical to SEQ ID NO: 357515

SEQ ID NO: 626119 - RNA, 64 nt, hsa; identical to SEQ ID NO: 357516

SEQ ID NO: 626120 - RNA, 64 nt, hsa; identical to SEQ ID NO: 357517

SEQ ID NO: 626121 - RNA, 64 nt, hsa; identical to SEQ ID NO: 357518

SEQ ID NO: 626122 - RNA, 64 nt, hsa; identical to SEQ ID NO: 357519

SEQ ID NO: 626123 - RNA, 64 nt, hsa; identical to SEQ ID NO: 357520

SEQ ID NO: 626124 - RNA, 64 nt, hsa; identical to SEQ ID NO: 357521

SEQ ID NO: 626125 - RNA, 64 nt, hsa; identical to SEQ ID NO: 357522

SEQ ID NO: 626126 - RNA, 64 nt, hsa; identical to SEQ ID NO: 357523

SEQ ID NO: 626127 - RNA, 64 nt, hsa; identical to SEQ ID NO: 357524

SEQ ID NO: 626128 - RNA, 64 nt, hsa; identical to SEQ ID NO: 357525

SEQ ID NO: 626129 - RNA, 64 nt, hsa; identical to SEQ ID NO: 357526

SEQ ID NO: 626130 - RNA, 64 nt, hsa; identical to SEQ ID NO: 357527

SEQ ID NO: 626131 - RNA, 64 nt, hsa; identical to SEQ ID NO: 357528

SEQ ID NO: 626132 - RNA, 64 nt, hsa; identical to SEQ ID NO: 357529

SEQ ID NO: 626133 - RNA, 64 nt, hsa; identical to SEQ ID NO: 357530

SEQ ID NO: 626134 - RNA, 64 nt, hsa; identical to SEQ ID NO: 357531

SEQ ID NO: 626135 - RNA, 64 nt, hsa; identical to SEQ ID NO: 357532

SEQ ID NO: 626136 - RNA, 64 nt, hsa; identical to SEQ ID NO: 357533

SEQ ID NO: 626137 - RNA, 64 nt, hsa; identical to SEQ ID NO: 357534

SEQ ID NO: 626138 - RNA, 64 nt, hsa; identical to SEQ ID NO: 357535

SEQ ID NO: 626139 - RNA, 64 nt, hsa; identical to SEQ ID NO: 357536

SEQ ID NO: 626140 - RNA, 64 nt, hsa; identical to SEQ ID NO: 357537

SEQ ID NO: 626141 - RNA, 64 nt, hsa; identical to SEQ ID NO: 357538

SEQ ID NO: 626142 - RNA, 64 nt, hsa; identical to SEQ ID NO: 357539

SEQ ID NO: 626143 - RNA, 64 nt, hsa; identical to SEQ ID NO: 357540

SEQ ID NO: 626144 - RNA, 64 nt, hsa; identical to SEQ ID NO: 357541

SEQ ID NO: 626145 - RNA, 64 nt, hsa; identical to SEQ ID NO: 357542

SEQ ID NO: 626146 - RNA, 64 nt, hsa; identical to SEQ ID NO: 357543

SEQ ID NO: 626147 - RNA, 64 nt, hsa; identical to SEQ ID NO: 357544

SEQ ID NO: 626148 - RNA, 64 nt, hsa; identical to SEQ ID NO: 357545

SEQ ID NO: 626149 - RNA, 64 nt, hsa; identical to SEQ ID NO: 357546

SEQ ID NO: 626150 - RNA, 64 nt, hsa; identical to SEQ ID NO: 357547

SEQ ID NO: 626151 - RNA, 64 nt, hsa; identical to SEQ ID NO: 357548

SEQ ID NO: 626152 - RNA, 64 nt, hsa; identical to SEQ ID NO: 357549

SEQ ID NO: 626153 - RNA, 64 nt, hsa; identical to SEQ ID NO: 357550

SEQ ID NO: 626154 - RNA, 64 nt, hsa; identical to SEQ ID NO: 357551

SEQ ID NO: 626155 - RNA, 64 nt, hsa; identical to SEQ ID NO: 357552

SEQ ID NO: 626156 - RNA, 64 nt, hsa; identical to SEQ ID NO: 357553

SEQ ID NO: 626157 - RNA, 64 nt, hsa; identical to SEQ ID NO: 357554

SEQ ID NO: 626158 - RNA, 64 nt, hsa; identical to SEQ ID NO: 357555

SEQ ID NO: 626159 - RNA, 64 nt, hsa; identical to SEQ ID NO: 357556

SEQ ID NO: 626160 - RNA, 64 nt, hsa; identical to SEQ ID NO: 357557

SEQ ID NO: 626161 - RNA, 64 nt, hsa; identical to SEQ ID NO: 357558

SEQ ID NO: 626162 - RNA, 64 nt, hsa; identical to SEQ ID NO: 357559

SEQ ID NO: 626163 - RNA, 64 nt, hsa; identical to SEQ ID NO: 357560

SEQ ID NO: 626164 - RNA, 64 nt, hsa; identical to SEQ ID NO: 357561

SEQ ID NO: 626165 - RNA, 64 nt, hsa; identical to SEQ ID NO: 357562

SEQ ID NO: 626166 - RNA, 64 nt, hsa; identical to SEQ ID NO: 357563

SEQ ID NO: 626167 - RNA, 64 nt, hsa; identical to SEQ ID NO: 357564

SEQ ID NO: 626168 - RNA, 64 nt, hsa; identical to SEQ ID NO: 357565

SEQ ID NO: 626169 - RNA, 64 nt, hsa; identical to SEQ ID NO: 357566

SEQ ID NO: 626170 - RNA, 64 nt, hsa; identical to SEQ ID NO: 357567

SEQ ID NO: 626171 - RNA, 64 nt, hsa; identical to SEQ ID NO: 357568

SEQ ID NO: 626172 - RNA, 64 nt, hsa; identical to SEQ ID NO: 357569

SEQ ID NO: 626173 - RNA, 64 nt, hsa; identical to SEQ ID NO: 357570

SEQ ID NO: 626174 - RNA, 64 nt, hsa; identical to SEQ ID NO: 357571

SEQ ID NO: 626175 - RNA, 64 nt, hsa; identical to SEQ ID NO: 357572

SEQ ID NO: 626176 - RNA, 64 nt, hsa; identical to SEQ ID NO: 357573

SEQ ID NO: 626177 - RNA, 64 nt, hsa; identical to SEQ ID NO: 357574

SEQ ID NO: 626178 - RNA, 64 nt, hsa; identical to SEQ ID NO: 357575

SEQ ID NO: 626179 - RNA, 64 nt, hsa; identical to SEQ ID NO: 357576

SEQ ID NO: 626180 - RNA, 64 nt, hsa; identical to SEQ ID NO: 357577

SEQ ID NO: 626181 - RNA, 64 nt, hsa; identical to SEQ ID NO: 357578

SEQ ID NO: 626182 - RNA, 64 nt, hsa; identical to SEQ ID NO: 357579

SEQ ID NO: 626183 - RNA, 64 nt, hsa; identical to SEQ ID NO: 357580

SEQ ID NO: 626184 - RNA, 64 nt, hsa; identical to SEQ ID NO: 357581

SEQ ID NO: 626185 - RNA, 64 nt, hsa; identical to SEQ ID NO: 357582

SEQ ID NO: 626186 - RNA, 64 nt, hsa; identical to SEQ ID NO: 357583

SEQ ID NO: 626187 - RNA, 64 nt, hsa; identical to SEQ ID NO: 357584

SEQ ID NO: 626188 - RNA, 64 nt, hsa; identical to SEQ ID NO: 357585

SEQ ID NO: 626189 - RNA, 64 nt, hsa; identical to SEQ ID NO: 357586

SEQ ID NO: 626190 - RNA, 64 nt, hsa; identical to SEQ ID NO: 357587

SEQ ID NO: 626191 - RNA, 64 nt, hsa; identical to SEQ ID NO: 357588

SEQ ID NO: 626192 - RNA, 64 nt, hsa; identical to SEQ ID NO: 357589

SEQ ID NO: 626193 - RNA, 64 nt, hsa; identical to SEQ ID NO: 357590

SEQ ID NO: 626194 - RNA, 64 nt, hsa; identical to SEQ ID NO: 357591

SEQ ID NO: 626195 - RNA, 64 nt, hsa; identical to SEQ ID NO: 357592

SEQ ID NO: 626196 - RNA, 64 nt, hsa; identical to SEQ ID NO: 357593

SEQ ID NO: 626197 - RNA, 64 nt, hsa; identical to SEQ ID NO: 357594

SEQ ID NO: 626198 - RNA, 64 nt, hsa; identical to SEQ ID NO: 357595

SEQ ID NO: 626199 - RNA, 64 nt, hsa; identical to SEQ ID NO: 357596

SEQ ID NO: 626200 - RNA, 64 nt, hsa; identical to SEQ ID NO: 357597

SEQ ID NO: 626201 - RNA, 64 nt, hsa; identical to SEQ ID NO: 357598

SEQ ID NO: 626202 - RNA, 64 nt, hsa; identical to SEQ ID NO: 357599

SEQ ID NO: 626203 - RNA, 64 nt, hsa; identical to SEQ ID NO: 357600

SEQ ID NO: 626204 - RNA, 64 nt, hsa; identical to SEQ ID NO: 357601

SEQ ID NO: 626205 - RNA, 64 nt, hsa; identical to SEQ ID NO: 357602

SEQ ID NO: 626206 - RNA, 64 nt, hsa; identical to SEQ ID NO: 357603

SEQ ID NO: 626207 - RNA, 64 nt, hsa; identical to SEQ ID NO: 357604

SEQ ID NO: 626208 - RNA, 64 nt, hsa; identical to SEQ ID NO: 357605

SEQ ID NO: 626209 - RNA, 64 nt, hsa; identical to SEQ ID NO: 357606

SEQ ID NO: 626210 - RNA, 64 nt, hsa; identical to SEQ ID NO: 357607

SEQ ID NO: 626211 - RNA, 64 nt, hsa; identical to SEQ ID NO: 357608

SEQ ID NO: 626212 - RNA, 64 nt, hsa; identical to SEQ ID NO: 357609

SEQ ID NO: 626213 - RNA, 64 nt, hsa; identical to SEQ ID NO: 357610

SEQ ID NO: 626214 - RNA, 64 nt, hsa; identical to SEQ ID NO: 357611

SEQ ID NO: 626215 - RNA, 64 nt, hsa; identical to SEQ ID NO: 357612

SEQ ID NO: 626216 - RNA, 64 nt, hsa; identical to SEQ ID NO: 357613

SEQ ID NO: 626217 - RNA, 64 nt, hsa; identical to SEQ ID NO: 357614

SEQ ID NO: 626218 - RNA, 64 nt, hsa; identical to SEQ ID NO: 357615

SEQ ID NO: 626219 - RNA, 64 nt, hsa; identical to SEQ ID NO: 357616

SEQ ID NO: 626220 - RNA, 64 nt, hsa; identical to SEQ ID NO: 357617

SEQ ID NO: 626221 - RNA, 64 nt, hsa; identical to SEQ ID NO: 357618

SEQ ID NO: 626222 - RNA, 64 nt, hsa; identical to SEQ ID NO: 357619

SEQ ID NO: 626223 - RNA, 64 nt, hsa; identical to SEQ ID NO: 175850

SEQ ID NO: 626224 - RNA, 64 nt, hsa; identical to SEQ ID NO: 175851

SEQ ID NO: 626225 - RNA, 64 nt, hsa; identical to SEQ ID NO: 175852

SEQ ID NO: 626226 - RNA, 64 nt, hsa; identical to SEQ ID NO: 175853

SEQ ID NO: 626227 - RNA, 64 nt, hsa; identical to SEQ ID NO: 175854

SEQ ID NO: 626228 - RNA, 64 nt, hsa; identical to SEQ ID NO: 175855

SEQ ID NO: 626229 - RNA, 64 nt, hsa; identical to SEQ ID NO: 175856

SEQ ID NO: 626230 - RNA, 64 nt, hsa; identical to SEQ ID NO: 175857

SEQ ID NO: 626231 - RNA, 64 nt, hsa; identical to SEQ ID NO: 175858

SEQ ID NO: 626232 - RNA, 64 nt, hsa; identical to SEQ ID NO: 175859

SEQ ID NO: 626233 - RNA, 64 nt, hsa; identical to SEQ ID NO: 175860

SEQ ID NO: 626234 - RNA, 64 nt, hsa; identical to SEQ ID NO: 175861

SEQ ID NO: 626235 - RNA, 64 nt, hsa; identical to SEQ ID NO: 175862

SEQ ID NO: 626236 - RNA, 64 nt, hsa; identical to SEQ ID NO: 175863

SEQ ID NO: 626237 - RNA, 64 nt, hsa
ugauauuguugucuguggcauauucuuuguauggcgaauuuaauaaauuauauuaaugugucuc

SEQ ID NO: 626238 - RNA, 64 nt, hsa
ugauaauguugcuguaauuuuuuaaaauaaaacacgaauuuaauaaaauaugggaaaggcacaa

SEQ ID NO: 626239 - RNA, 64 nt, hsa
cagaaagucuauuucuuugaaacgaaggaaguaucgaauuuacauuaguuuuuuucauacccuu

SEQ ID NO: 626240 - RNA, 64 nt, hsa
aguuucuaugaagagcaaguagcugaggagaggucgaauuuacugcuuuuuccaggacaauucu

SEQ ID NO: 626241 - RNA, 64 nt, hsa
ugaacacagugccuggacucccugcuccgugaggcgaauuuacaccggguccagcugcgucagc

SEQ ID NO: 626242 - RNA, 64 nt, hsa
ugauuuuucucuuccuuuuuauucacucuucccacgaauuuaaauguuuaaguuauauucauca

SEQ ID NO: 626243 - RNA, 64 nt, hsa
accucagcauugcaucguaucaucauuuucgcuacgaauuuauuuuucaacaauaagcuuuaac

SEQ ID NO: 626244 - RNA, 64 nt, hsa
gcaguuacuguuguacauugcauagauguacacacgaauuuaaaugugaugucuuuguauauau

SEQ ID NO: 626245 - RNA, 64 nt, hsa
ugacguagcgaguuagugagacuagacauaguaccgaauuuaguucaugcauuggucuuagagg

SEQ ID NO: 626246 - RNA, 64 nt, hsa
uaaaccgguucguauauauuuuucuucgcuguuacgaauuuacagcagcauuuguacauguaaa

SEQ ID NO: 626247 - RNA, 64 nt, hsa
gaggaagaagggauaauagacacaucaaaugccccgaauuuagucacaccaucuuaaaugacag

SEQ ID NO: 626248 - RNA, 64 nt, hsa
cugaggugacuuccuaacuaugugguuucauuagcgaauuuauuuuuugugcuggguggacauu

SEQ ID NO: 626249 - RNA, 64 nt, hsa
acuucaugaucacuaaauagauguugaaaauacacgaauuuagauacaagcuuuaaaaccaguu

SEQ ID NO: 626250 - RNA, 64 nt, hsa
ccaggccuuccuaaguuuuuguuaguugugucuucgaauuuauuguaguucaccgcuggucagu

SEQ ID NO: 626251 - RNA, 64 nt, hsa
aaauuacaaacuuuaggaacuuuuccagauguaucgaauuuaauuugacauugaugucacucuu

SEQ ID NO: 626252 - RNA, 55 nt, hsa
gagauucucugagugccugacaaaacgaauuuaaguaccagccaaguacacacga

SEQ ID NO: 626253 - RNA, 64 nt, hsa
cucuuccuauaaacuaaaauaacauuacaguuuccgaauuuagcaugggacauagucaguguuu

SEQ ID NO: 626254 - RNA, 64 nt, hsa
gaguaaacaacccagcccaguuaagaggagaugccgaauuuaaugaacccuauuugaauugcag

SEQ ID NO: 626255 - RNA, 64 nt, hsa
gggcucaaagacgcacucuuccacccuuuuggagcgaauuuagaaccucagcccuaucuccauu

SEQ ID NO: 626256 - RNA, 64 nt, hsa
accauagucccaagaauucagcuacaugaugacucgaauuuaaauuuagauuaaucaaaugguc

SEQ ID NO: 626257 - RNA, 64 nt, hsa
gggauugcagcguucucgaaguggcuguaggacucgaauuuacagaaagccacagaggugcaac

SEQ ID NO: 626258 - RNA, 64 nt, hsa
cguuccaagucuuaaugccacaccacuauuccagcgaauuuaugcuacaacugguaacaaugac

SEQ ID NO: 626259 - RNA, 64 nt, hsa
caaaaauaaaucuuaaaguuaguuuuuuguaacacgaauuuaacugucagacaguuaguguagg

SEQ ID NO: 626260 - RNA, 64 nt, hsa
ucuucauuuuuuuccccauugugauguuugguaacgaauuuaaaauguaguuuuaaauaaaguu

SEQ ID NO: 626261 - RNA, 64 nt, hsa
cuggagcccguucccgugcguguuaguuuggacacgaauuuagucuaaaaagcugucugguugu

SEQ ID NO: 626262 - RNA, 64 nt, hsa
uuaacguuuauaguugaauugggccaaaauguuucgaauuuauagaaauagaaaaguuguaacu

SEQ ID NO: 626263 - RNA, 64 nt, hsa
gcacagcaaacauuuugcaaacugcagcagaaaucgaauuuaaaacaaaaaggagggacuuuaa

SEQ ID NO: 626264 - RNA, 64 nt, hsa
ucaggggcauuuuggugcuguuaaaagcaagagccgaauuuagaaguucccuuaaaaagaaaca

SEQ ID NO: 626265 - RNA, 64 nt, hsa
uccacuguuucuuuccuucucugucuucuuagcucgaauuuaaauugcacaauuauuuucaggu

SEQ ID NO: 626266 - RNA, 64 nt, hsa
ccccacuacucaauacuaccucugaauguuacaacgaauuuacagucuaguacuuauuacaugc

SEQ ID NO: 626267 - RNA, 64 nt, hsa
aguugaguuagguuuuuccccaucuccuguagagcgaauuuacauauuguauuggguaaguguu

SEQ ID NO: 626268 - RNA, 64 nt, hsa
auaaguucauauauuugaaauaagauccuggaaacgaauuuaaauggugucaaacugcagagca

SEQ ID NO: 626269 - RNA, 64 nt, hsa
cauaauucuugaauucucuacuauuggcauguaacgaauuuaaauuuuuuauaacauagugcaa

SEQ ID NO: 626270 - RNA, 64 nt, hsa
gcgggggcgagggagggcgaacugucgaauguugcgaauuuauuaaacuuuugacaaaacuuag

SEQ ID NO: 626271 - RNA, 64 nt, hsa
uaauucuacaucuaaaaaaaccgauucccuaauucgaauuuauugguaccaaagcucucuuugg

SEQ ID NO: 626272 - RNA, 64 nt, hsa
aacucaucaaguguuggacuuucaauuauaagaucgaauuuaauuuccuuucccucauucugca

SEQ ID NO: 626273 - RNA, 64 nt, hsa
uauccccaaagcuuuuggguccucaagucaugcccgaauuuagaugcuggucauuuucuggaga

SEQ ID NO: 626274 - RNA, 64 nt, hsa
uucuaaaauugagaaauaucugaaauacagaauacgaauuuaauaaaggaagccuaccuuaugu

SEQ ID NO: 626275 - RNA, 64 nt, hsa
uggcaacuccauaaaaacauuucagauuuuaauccgaauuuagcuaaugagacuggauuuuugu

SEQ ID NO: 626276 - RNA, 64 nt, hsa
aguuuccuuggcccagucugugccauuuucucugcgaauuuaguauuguuuaucuuggucuuuu

SEQ ID NO: 626277 - RNA, 64 nt, hsa
uucuauguuuaagguuuugguuguugguaguagccgaauuuaacuggcacuuuauuuuacuucu

SEQ ID NO: 626278 - RNA, 64 nt, hsa
aagaaaccauuuuuaaugagaugaaaauauuuaacgaauuuaaaaagcuaaugacaauuuugag

SEQ ID NO: 626279 - RNA, 64 nt, hsa
gaguagcucguccucacuggucuacacugguugccgaauuuacuuguauuccuaacuguuuugu

SEQ ID NO: 626280 - RNA, 64 nt, hsa
acuccccaacucccucguuaaucacaggaucccacgaauuuaggcucagaagcaucgcuccucu

SEQ ID NO: 626281 - RNA, 64 nt, hsa
ggcuuagggaaguccaguaaagaaaccuauuuuccgaauuuauuugaucaugaacuccuuuuuu

SEQ ID NO: 626282 - RNA, 64 nt, hsa
uaaaagaagaaacaaagaggggaagauaugggagcgaauuuauuccaagaaucuacaaugacau

SEQ ID NO: 626283 - RNA, 64 nt, hsa
uuuaaaugaaaauguguaaucuaaaauauaccagcgaauuuaaaucuaaaaaugcuccuacuuu

SEQ ID NO: 626284 - RNA, 64 nt, hsa
cuuuaaaagaagaaacauggagaagaugugggagcgaauuuauugcaggaauccacaaugacuu

SEQ ID NO: 626285 - RNA, 64 nt, hsa; identical to SEQ ID NO: 218812

SEQ ID NO: 626286 - RNA, 64 nt, hsa; identical to SEQ ID NO: 218813

SEQ ID NO: 626287 - RNA, 64 nt, hsa; identical to SEQ ID NO: 218814

SEQ ID NO: 626288 - RNA, 64 nt, hsa; identical to SEQ ID NO: 218815

SEQ ID NO: 626289 - RNA, 64 nt, hsa; identical to SEQ ID NO: 218816

SEQ ID NO: 626290 - RNA, 64 nt, hsa; identical to SEQ ID NO: 218817

SEQ ID NO: 626291 - RNA, 64 nt, hsa; identical to SEQ ID NO: 218818

SEQ ID NO: 626292 - RNA, 64 nt, hsa; identical to SEQ ID NO: 218819

SEQ ID NO: 626293 - RNA, 64 nt, hsa; identical to SEQ ID NO: 218820

SEQ ID NO: 626294 - RNA, 64 nt, hsa; identical to SEQ ID NO: 218821

SEQ ID NO: 626295 - RNA, 64 nt, hsa; identical to SEQ ID NO: 218822

SEQ ID NO: 626296 - RNA, 64 nt, hsa; identical to SEQ ID NO: 218823

SEQ ID NO: 626297 - RNA, 64 nt, hsa; identical to SEQ ID NO: 218824

SEQ ID NO: 626298 - RNA, 64 nt, hsa; identical to SEQ ID NO: 218825

SEQ ID NO: 626299 - RNA, 64 nt, hsa; identical to SEQ ID NO: 218826

SEQ ID NO: 626300 - RNA, 64 nt, hsa; identical to SEQ ID NO: 218827

SEQ ID NO: 626301 - RNA, 64 nt, hsa; identical to SEQ ID NO: 218828

SEQ ID NO: 626302 - RNA, 64 nt, hsa; identical to SEQ ID NO: 218829

SEQ ID NO: 626303 - RNA, 64 nt, hsa; identical to SEQ ID NO: 218830

SEQ ID NO: 626304 - RNA, 64 nt, hsa; identical to SEQ ID NO: 218831

SEQ ID NO: 626305 - RNA, 64 nt, hsa; identical to SEQ ID NO: 218832

SEQ ID NO: 626306 - RNA, 64 nt, hsa; identical to SEQ ID NO: 218833

SEQ ID NO: 626307 - RNA, 64 nt, hsa; identical to SEQ ID NO: 218834

SEQ ID NO: 626308 - RNA, 64 nt, hsa; identical to SEQ ID NO: 218835

SEQ ID NO: 626309 - RNA, 64 nt, hsa; identical to SEQ ID NO: 218836

SEQ ID NO: 626310 - RNA, 64 nt, hsa; identical to SEQ ID NO: 86125

SEQ ID NO: 626311 - RNA, 64 nt, hsa; identical to SEQ ID NO: 86126

SEQ ID NO: 626312 - RNA, 64 nt, hsa; identical to SEQ ID NO: 86127

SEQ ID NO: 626313 - RNA, 64 nt, hsa; identical to SEQ ID NO: 86128

SEQ ID NO: 626314 - RNA, 58 nt, hsa; identical to SEQ ID NO: 86129

SEQ ID NO: 626315 - RNA, 64 nt, hsa; identical to SEQ ID NO: 86130

SEQ ID NO: 626316 - RNA, 64 nt, hsa; identical to SEQ ID NO: 86131

SEQ ID NO: 626317 - RNA, 64 nt, hsa; identical to SEQ ID NO: 86132

SEQ ID NO: 626318 - RNA, 64 nt, hsa; identical to SEQ ID NO: 86133

SEQ ID NO: 626319 - RNA, 64 nt, hsa; identical to SEQ ID NO: 86134

SEQ ID NO: 626320 - RNA, 64 nt, hsa; identical to SEQ ID NO: 86135

SEQ ID NO: 626321 - RNA, 64 nt, hsa; identical to SEQ ID NO: 86136

SEQ ID NO: 626322 - RNA, 64 nt, hsa; identical to SEQ ID NO: 86137

SEQ ID NO: 626323 - RNA, 64 nt, hsa; identical to SEQ ID NO: 86138

SEQ ID NO: 626324 - RNA, 64 nt, hsa; identical to SEQ ID NO: 86139

SEQ ID NO: 626325 - RNA, 64 nt, hsa; identical to SEQ ID NO: 86140

SEQ ID NO: 626326 - RNA, 64 nt, hsa; identical to SEQ ID NO: 86141

SEQ ID NO: 626327 - RNA, 64 nt, hsa; identical to SEQ ID NO: 86142

SEQ ID NO: 626328 - RNA, 64 nt, hsa; identical to SEQ ID NO: 86143

SEQ ID NO: 626329 - RNA, 64 nt, hsa; identical to SEQ ID NO: 86144

SEQ ID NO: 626330 - RNA, 64 nt, hsa; identical to SEQ ID NO: 86145

SEQ ID NO: 626331 - RNA, 64 nt, hsa; identical to SEQ ID NO: 86146

SEQ ID NO: 626332 - RNA, 64 nt, hsa; identical to SEQ ID NO: 86147

SEQ ID NO: 626333 - RNA, 64 nt, hsa; identical to SEQ ID NO: 86148

SEQ ID NO: 626334 - RNA, 64 nt, hsa; identical to SEQ ID NO: 86149

SEQ ID NO: 626335 - RNA, 64 nt, hsa; identical to SEQ ID NO: 86150

SEQ ID NO: 626336 - RNA, 64 nt, hsa; identical to SEQ ID NO: 86151

SEQ ID NO: 626337 - RNA, 64 nt, hsa; identical to SEQ ID NO: 86152

SEQ ID NO: 626338 - RNA, 64 nt, hsa; identical to SEQ ID NO: 86153

SEQ ID NO: 626339 - RNA, 64 nt, hsa; identical to SEQ ID NO: 86154

SEQ ID NO: 626340 - RNA, 64 nt, hsa; identical to SEQ ID NO: 86155

SEQ ID NO: 626341 - RNA, 64 nt, hsa; identical to SEQ ID NO: 86156

SEQ ID NO: 626342 - RNA, 64 nt, hsa; identical to SEQ ID NO: 86157

SEQ ID NO: 626343 - RNA, 64 nt, hsa; identical to SEQ ID NO: 86158

SEQ ID NO: 626344 - RNA, 64 nt, hsa; identical to SEQ ID NO: 86159

SEQ ID NO: 626345 - RNA, 64 nt, hsa; identical to SEQ ID NO: 86160

SEQ ID NO: 626346 - RNA, 64 nt, hsa; identical to SEQ ID NO: 86161

SEQ ID NO: 626347 - RNA, 64 nt, hsa; identical to SEQ ID NO: 86162

SEQ ID NO: 626348 - RNA, 64 nt, hsa; identical to SEQ ID NO: 86163

SEQ ID NO: 626349 - RNA, 60 nt, hsa; identical to SEQ ID NO: 86164

SEQ ID NO: 626350 - RNA, 64 nt, hsa; identical to SEQ ID NO: 86165

SEQ ID NO: 626351 - RNA, 64 nt, hsa; identical to SEQ ID NO: 86166

SEQ ID NO: 626352 - RNA, 64 nt, hsa; identical to SEQ ID NO: 86167

SEQ ID NO: 626353 - RNA, 64 nt, hsa; identical to SEQ ID NO: 86168

SEQ ID NO: 626354 - RNA, 64 nt, hsa; identical to SEQ ID NO: 86169

SEQ ID NO: 626355 - RNA, 64 nt, hsa; identical to SEQ ID NO: 86170

SEQ ID NO: 626356 - RNA, 64 nt, hsa; identical to SEQ ID NO: 86171

SEQ ID NO: 626357 - RNA, 64 nt, hsa; identical to SEQ ID NO: 86172

SEQ ID NO: 626358 - RNA, 64 nt, hsa; identical to SEQ ID NO: 86173

SEQ ID NO: 626359 - RNA, 64 nt, hsa; identical to SEQ ID NO: 86174

SEQ ID NO: 626360 - RNA, 64 nt, hsa; identical to SEQ ID NO: 86175

SEQ ID NO: 626361 - RNA, 64 nt, hsa; identical to SEQ ID NO: 86176

SEQ ID NO: 626362 - RNA, 64 nt, hsa; identical to SEQ ID NO: 86177

SEQ ID NO: 626363 - RNA, 64 nt, hsa; identical to SEQ ID NO: 86178

SEQ ID NO: 626364 - RNA, 64 nt, hsa; identical to SEQ ID NO: 86179

SEQ ID NO: 626365 - RNA, 64 nt, hsa; identical to SEQ ID NO: 86180

SEQ ID NO: 626366 - RNA, 64 nt, hsa; identical to SEQ ID NO: 86181

SEQ ID NO: 626367 - RNA, 64 nt, hsa; identical to SEQ ID NO: 86182

SEQ ID NO: 626368 - RNA, 64 nt, hsa; identical to SEQ ID NO: 86183

SEQ ID NO: 626369 - RNA, 64 nt, hsa; identical to SEQ ID NO: 86184

SEQ ID NO: 626370 - RNA, 64 nt, hsa; identical to SEQ ID NO: 86185

SEQ ID NO: 626371 - RNA, 64 nt, hsa; identical to SEQ ID NO: 86186

SEQ ID NO: 626372 - RNA, 64 nt, hsa; identical to SEQ ID NO: 432758

SEQ ID NO: 626373 - RNA, 64 nt, hsa; identical to SEQ ID NO: 432759

SEQ ID NO: 626374 - RNA, 64 nt, hsa; identical to SEQ ID NO: 432760

SEQ ID NO: 626375 - RNA, 64 nt, hsa; identical to SEQ ID NO: 432761

SEQ ID NO: 626376 - RNA, 64 nt, hsa; identical to SEQ ID NO: 166002

SEQ ID NO: 626377 - RNA, 64 nt, hsa; identical to SEQ ID NO: 166003

SEQ ID NO: 626378 - RNA, 64 nt, hsa; identical to SEQ ID NO: 166004

SEQ ID NO: 626379 - RNA, 64 nt, hsa; identical to SEQ ID NO: 166005

SEQ ID NO: 626380 - RNA, 64 nt, hsa; identical to SEQ ID NO: 166006

SEQ ID NO: 626381 - RNA, 64 nt, hsa; identical to SEQ ID NO: 166007

SEQ ID NO: 626382 - RNA, 64 nt, hsa; identical to SEQ ID NO: 166008

SEQ ID NO: 626383 - RNA, 64 nt, hsa; identical to SEQ ID NO: 166009

SEQ ID NO: 626384 - RNA, 64 nt, hsa; identical to SEQ ID NO: 166010

SEQ ID NO: 626385 - RNA, 60 nt, hsa; identical to SEQ ID NO: 166011

SEQ ID NO: 626386 - RNA, 64 nt, hsa; identical to SEQ ID NO: 166012

SEQ ID NO: 626387 - RNA, 64 nt, hsa; identical to SEQ ID NO: 154391

SEQ ID NO: 626388 - RNA, 64 nt, hsa; identical to SEQ ID NO: 154392

SEQ ID NO: 626389 - RNA, 64 nt, hsa; identical to SEQ ID NO: 154393

SEQ ID NO: 626390 - RNA, 64 nt, hsa; identical to SEQ ID NO: 154394

SEQ ID NO: 626391 - RNA, 64 nt, hsa; identical to SEQ ID NO: 154395

SEQ ID NO: 626392 - RNA, 64 nt, hsa; identical to SEQ ID NO: 154396

SEQ ID NO: 626393 - RNA, 64 nt, hsa; identical to SEQ ID NO: 154397

SEQ ID NO: 626394 - RNA, 64 nt, hsa; identical to SEQ ID NO: 154398

SEQ ID NO: 626395 - RNA, 64 nt, hsa; identical to SEQ ID NO: 154399

SEQ ID NO: 626396 - RNA, 64 nt, hsa; identical to SEQ ID NO: 154400

SEQ ID NO: 626397 - RNA, 64 nt, hsa; identical to SEQ ID NO: 154401

SEQ ID NO: 626398 - RNA, 64 nt, hsa; identical to SEQ ID NO: 154402

SEQ ID NO: 626399 - RNA, 64 nt, hsa; identical to SEQ ID NO: 154403

SEQ ID NO: 626400 - RNA, 64 nt, hsa
acuauauagccgagcuguucuuccuuccuauggaagucggaaacauggucagaacacgaucugg

SEQ ID NO: 626401 - RNA, 64 nt, hsa
agaacaucacuuuuaaccuugcuuuggcgaagggagucggaaagcugagucucuauggacgggg

SEQ ID NO: 626402 - RNA, 64 nt, hsa
gcugagaacaaaaucaccuauucacugcuuaugcagucggaagcuccagaagaacaaagagccc

SEQ ID NO: 626403 - RNA, 64 nt, hsa
ggugcuuuuggaagcaguguuaguguuccucaaaagucggaacaauugccuguugauauauuaa

SEQ ID NO: 626404 - RNA, 64 nt, hsa
gacccaagagaagcagaagucgcucgcacuggucagucggaaggcaagaucagauccuggagga

SEQ ID NO: 626405 - RNA, 64 nt, hsa
gugaaugacaggaaugaucuauuaccaggugacuagucggaaacuacacagacgugcacugguc

SEQ ID NO: 626406 - RNA, 64 nt, hsa
caucuuggguucuucucaauuugacauacuugggagucggaaugacuggaugggggauggguag

SEQ ID NO: 626407 - RNA, 64 nt, hsa
cagcuggaagugccuuguugccucugcccuuugaagucggaacaauuccuagcaccugucggaa

SEQ ID NO: 626408 - RNA, 64 nt, hsa
gaaugaaggguucugcugcuaaaaaaaaaaaaaaagucggaaaaaccaccugaucacaacuuuc

SEQ ID NO: 626409 - RNA, 64 nt, hsa
uauucuagggaaaugcuuuaaauggucaggcuccagucggaauuuuuuuaagaaaaaaguaguu

SEQ ID NO: 626410 - RNA, 64 nt, hsa
acugaguugauucugaccagacuugaugguuuuaagucggaaccgauaaauuuuaaaaaggaga

SEQ ID NO: 626411 - RNA, 64 nt, hsa
gucugauuuuggccccgcagcccagacgcagcugagucggaagcucccggggacgacgcugacu

SEQ ID NO: 626412 - RNA, 64 nt, hsa
agucuauuuuaguguuaggaagccccagcaggggagucggaagagcuuggaagagcuggggaga

SEQ ID NO: 626413 - RNA, 64 nt, hsa
uggcucuuucgucacccuuggacaagacaaaccaagucggaacagcagauaacaaugcagcaag

SEQ ID NO: 626414 - RNA, 64 nt, hsa
ccuggcccacuuaaacaagguuacaaaaaaucagagucggaagcagccaaauaggucaaccuaa

SEQ ID NO: 626415 - RNA, 64 nt, hsa
cugaucagaguuauccacuguauuuauaaggaagagucggaaaaaacaaugaccuuaguuuuuu

SEQ ID NO: 626416 - RNA, 64 nt, hsa
cguguuuauauacuauuuccuuugauguccuauaagucggaaaagaaaggggcaaagagaaccu

SEQ ID NO: 626417 - RNA, 64 nt, hsa
gaggggccgauccggggcccucucugcaccggacagucggaaaagcgucuuuaagagacucacu

SEQ ID NO: 626418 - RNA, 64 nt, hsa
cuuggguuccaauaaaggagaaacagggcacaggagucggaaggacuaguggcaauagugauga

SEQ ID NO: 626419 - RNA, 64 nt, hsa
gggggggguucccagauauucagggcaagggaccagucggaagggauucuggcuauugggggag

SEQ ID NO: 626420 - RNA, 64 nt, hsa
cagaguguuguaaaaggacaccuucacugaagcaagucggaaaguacaaugaaaauaaauauuu

SEQ ID NO: 626421 - RNA, 64 nt, hsa
acaaauucuguucauuggaaaggguuuuaaacggagucggaaccugaguagauuuccaaauuuu

SEQ ID NO: 626422 - RNA, 64 nt, hsa
ggaggcugaggcaggagaaucgcuugaaccaggcagucggaacuuguagugagccaagaucacg

SEQ ID NO: 626423 - RNA, 64 nt, hsa
cacccauggccaacagcccuuguugagugacgggagucggaaugugcuaccccguugugggaau

SEQ ID NO: 626424 - RNA, 64 nt, hsa
augagcuucccagagacagaagagacuggagcaaagucggaaacacagagaagcacggcuuccc

SEQ ID NO: 626425 - RNA, 64 nt, hsa
aaccuuucuagguaaaccgcuugccuucaucuugagucggaauauauuuaaauaaauuguguua

SEQ ID NO: 626426 - RNA, 64 nt, hsa
ccuucccauaagcuauagacccgaggaaacucagagucggaacggagaaagguggacuggaagg

SEQ ID NO: 626427 - RNA, 64 nt, hsa
aacucauaauagacuucccacucuagggcaguggagucggaagggcacacggggugcgucuccc

SEQ ID NO: 626428 - RNA, 64 nt, hsa
cagauuucacaucuuuggauucaucuuuccugugagucggaauugaagucuuccccaaaaauau

SEQ ID NO: 626429 - RNA, 64 nt, hsa
ccaaccuucuggccagagguuuuccugaugggugagucggaauuaggggucaguuuugucucca

SEQ ID NO: 626430 - RNA, 64 nt, hsa
aaugaacaaucugacaaaugugaagcuggccaaaagucggaaaaugagaaugaggguaauccug

SEQ ID NO: 626431 - RNA, 64 nt, hsa
ugauucuccuaaacuguauaguaaccugcuaaccagucggaaagagcuaccacccaauggagau

SEQ ID NO: 626432 - RNA, 64 nt, hsa
gccuacaggccuuggucuuggcuuguccucacccagucggaacucccuaccacuuucaggagag

SEQ ID NO: 626433 - RNA, 64 nt, hsa
ccagacccgauccauucagucacgguuccugcagagucggaaucuaaacuguauagcacuuugu

SEQ ID NO: 626434 - RNA, 64 nt, hsa
uaauaaaaagagaaaaaaacuauuuccuauagcuagucggaaugcaaacuuuugacguccugau

SEQ ID NO: 626435 - RNA, 64 nt, hsa
aaaaggccaccuaggcaauggaagcccucaaagaagucggaaugucauagucuugaaaugaaag

SEQ ID NO: 626436 - RNA, 64 nt, hsa
ccgccuucaggccgcucccccgagauucuggggcagucggaagaugugggcccugggugggagc

SEQ ID NO: 626437 - RNA, 64 nt, hsa
cucaaaguucauauuguguggcugaucugaagucagucggaauuuguaaacaggguagcaaaca

SEQ ID NO: 626438 - RNA, 64 nt, hsa
ggcccuggaccccucuguacaguccguaggaaaaagucggaaugcucucgacggccucguccca

SEQ ID NO: 626439 - RNA, 64 nt, hsa
ccaaagucguugccccucccugggccugggaaccagucggaacuggguuccaguccagcugugc

SEQ ID NO: 626440 - RNA, 64 nt, hsa
uaaaggaauuuguaggaaaugcagccaaaggugcagucggaaaagaugcaggggaaauguauuu

SEQ ID NO: 626441 - RNA, 64 nt, hsa
gagggagcagaacagccagccccuuccagguggcagucggaaggguuuuuguuuuuguuucugu

SEQ ID NO: 626442 - RNA, 64 nt, hsa
uugucucauugugccagaagcccugacaugcugcagucggaaguuuccuuuuccgugggaggga

SEQ ID NO: 626443 - RNA, 64 nt, hsa
agcagaggcaccggcgaugaaguggcacagccccagucggaauccagcggcuucugaaagugcc

SEQ ID NO: 626444 - RNA, 64 nt, hsa; identical to SEQ ID NO: 73453

SEQ ID NO: 626445 - RNA, 64 nt, hsa; identical to SEQ ID NO: 73454

SEQ ID NO: 626446 - RNA, 64 nt, hsa; identical to SEQ ID NO: 73455

SEQ ID NO: 626447 - RNA, 64 nt, hsa; identical to SEQ ID NO: 73456

SEQ ID NO: 626448 - RNA, 64 nt, hsa; identical to SEQ ID NO: 73457

SEQ ID NO: 626449 - RNA, 64 nt, hsa; identical to SEQ ID NO: 73458

SEQ ID NO: 626450 - RNA, 64 nt, hsa; identical to SEQ ID NO: 73459

SEQ ID NO: 626451 - RNA, 64 nt, hsa; identical to SEQ ID NO: 73460

SEQ ID NO: 626452 - RNA, 64 nt, hsa; identical to SEQ ID NO: 73461

SEQ ID NO: 626453 - RNA, 64 nt, hsa; identical to SEQ ID NO: 73462

SEQ ID NO: 626454 - RNA, 64 nt, hsa; identical to SEQ ID NO: 73463

SEQ ID NO: 626455 - RNA, 64 nt, hsa; identical to SEQ ID NO: 73464

SEQ ID NO: 626456 - RNA, 64 nt, hsa; identical to SEQ ID NO: 73465

SEQ ID NO: 626457 - RNA, 64 nt, hsa; identical to SEQ ID NO: 73466

SEQ ID NO: 626458 - RNA, 64 nt, hsa; identical to SEQ ID NO: 73467

SEQ ID NO: 626459 - RNA, 64 nt, hsa; identical to SEQ ID NO: 73468

SEQ ID NO: 626460 - RNA, 64 nt, hsa; identical to SEQ ID NO: 73469

SEQ ID NO: 626461 - RNA, 64 nt, hsa; identical to SEQ ID NO: 73470

SEQ ID NO: 626462 - RNA, 64 nt, hsa; identical to SEQ ID NO: 73471

SEQ ID NO: 626463 - RNA, 64 nt, hsa; identical to SEQ ID NO: 73472

SEQ ID NO: 626464 - RNA, 64 nt, hsa; identical to SEQ ID NO: 73473

SEQ ID NO: 626465 - RNA, 64 nt, hsa; identical to SEQ ID NO: 73474

SEQ ID NO: 626466 - RNA, 64 nt, hsa; identical to SEQ ID NO: 73475

SEQ ID NO: 626467 - RNA, 64 nt, hsa; identical to SEQ ID NO: 73476

SEQ ID NO: 626468 - RNA, 64 nt, hsa; identical to SEQ ID NO: 73477

SEQ ID NO: 626469 - RNA, 64 nt, hsa; identical to SEQ ID NO: 73478

SEQ ID NO: 626470 - RNA, 64 nt, hsa; identical to SEQ ID NO: 73479

SEQ ID NO: 626471 - RNA, 64 nt, hsa; identical to SEQ ID NO: 73480

SEQ ID NO: 626472 - RNA, 64 nt, hsa; identical to SEQ ID NO: 73481

SEQ ID NO: 626473 - RNA, 64 nt, hsa; identical to SEQ ID NO: 73482

SEQ ID NO: 626474 - RNA, 64 nt, hsa; identical to SEQ ID NO: 73483

SEQ ID NO: 626475 - RNA, 64 nt, hsa; identical to SEQ ID NO: 73484

SEQ ID NO: 626476 - RNA, 64 nt, hsa; identical to SEQ ID NO: 73485

SEQ ID NO: 626477 - RNA, 64 nt, hsa; identical to SEQ ID NO: 73486

SEQ ID NO: 626478 - RNA, 64 nt, hsa; identical to SEQ ID NO: 73487

SEQ ID NO: 626479 - RNA, 64 nt, hsa; identical to SEQ ID NO: 73488

SEQ ID NO: 626480 - RNA, 64 nt, hsa; identical to SEQ ID NO: 73489

SEQ ID NO: 626481 - RNA, 64 nt, hsa; identical to SEQ ID NO: 73490

SEQ ID NO: 626482 - RNA, 64 nt, hsa; identical to SEQ ID NO: 73491

SEQ ID NO: 626483 - RNA, 64 nt, hsa; identical to SEQ ID NO: 73492

SEQ ID NO: 626484 - RNA, 64 nt, hsa; identical to SEQ ID NO: 73493

SEQ ID NO: 626485 - RNA, 64 nt, hsa; identical to SEQ ID NO: 73494

SEQ ID NO: 626486 - RNA, 64 nt, hsa; identical to SEQ ID NO: 73495

SEQ ID NO: 626487 - RNA, 64 nt, hsa; identical to SEQ ID NO: 73496

SEQ ID NO: 626488 - RNA, 64 nt, hsa; identical to SEQ ID NO: 73497

SEQ ID NO: 626489 - RNA, 64 nt, hsa; identical to SEQ ID NO: 73498

SEQ ID NO: 626490 - RNA, 64 nt, hsa; identical to SEQ ID NO: 73499

SEQ ID NO: 626491 - RNA, 64 nt, hsa; identical to SEQ ID NO: 73500

SEQ ID NO: 626492 - RNA, 64 nt, hsa; identical to SEQ ID NO: 73501

SEQ ID NO: 626493 - RNA, 64 nt, hsa; identical to SEQ ID NO: 73502

SEQ ID NO: 626494 - RNA, 64 nt, hsa; identical to SEQ ID NO: 73503

SEQ ID NO: 626495 - RNA, 64 nt, hsa; identical to SEQ ID NO: 73504

SEQ ID NO: 626496 - RNA, 64 nt, hsa; identical to SEQ ID NO: 73505

SEQ ID NO: 626497 - RNA, 64 nt, hsa; identical to SEQ ID NO: 73506

SEQ ID NO: 626498 - RNA, 64 nt, hsa; identical to SEQ ID NO: 73507

SEQ ID NO: 626499 - RNA, 64 nt, hsa; identical to SEQ ID NO: 73508

SEQ ID NO: 626500 - RNA, 64 nt, hsa; identical to SEQ ID NO: 73509

SEQ ID NO: 626501 - RNA, 64 nt, hsa; identical to SEQ ID NO: 73510

SEQ ID NO: 626502 - RNA, 64 nt, hsa; identical to SEQ ID NO: 73511

SEQ ID NO: 626503 - RNA, 64 nt, hsa; identical to SEQ ID NO: 73512

SEQ ID NO: 626504 - RNA, 64 nt, hsa; identical to SEQ ID NO: 73513

SEQ ID NO: 626505 - RNA, 64 nt, hsa; identical to SEQ ID NO: 211620

SEQ ID NO: 626506 - RNA, 64 nt, hsa; identical to SEQ ID NO: 211621

SEQ ID NO: 626507 - RNA, 64 nt, hsa; identical to SEQ ID NO: 211622

SEQ ID NO: 626508 - RNA, 64 nt, hsa; identical to SEQ ID NO: 211623

SEQ ID NO: 626509 - RNA, 64 nt, hsa; identical to SEQ ID NO: 211624

SEQ ID NO: 626510 - RNA, 64 nt, hsa; identical to SEQ ID NO: 211625

SEQ ID NO: 626511 - RNA, 64 nt, hsa; identical to SEQ ID NO: 211626

SEQ ID NO: 626512 - RNA, 64 nt, hsa; identical to SEQ ID NO: 211627

SEQ ID NO: 626513 - RNA, 64 nt, hsa; identical to SEQ ID NO: 211628

SEQ ID NO: 626514 - RNA, 64 nt, hsa; identical to SEQ ID NO: 211629

SEQ ID NO: 626515 - RNA, 64 nt, hsa; identical to SEQ ID NO: 211630

SEQ ID NO: 626516 - RNA, 64 nt, hsa; identical to SEQ ID NO: 211631

SEQ ID NO: 626517 - RNA, 64 nt, hsa; identical to SEQ ID NO: 211632

SEQ ID NO: 626518 - RNA, 64 nt, hsa; identical to SEQ ID NO: 211633

SEQ ID NO: 626519 - RNA, 64 nt, hsa; identical to SEQ ID NO: 211634

SEQ ID NO: 626520 - RNA, 64 nt, hsa; identical to SEQ ID NO: 211635

SEQ ID NO: 626521 - RNA, 64 nt, hsa; identical to SEQ ID NO: 211636

SEQ ID NO: 626522 - RNA, 64 nt, hsa; identical to SEQ ID NO: 211637

SEQ ID NO: 626523 - RNA, 64 nt, hsa; identical to SEQ ID NO: 211638

SEQ ID NO: 626524 - RNA, 64 nt, hsa; identical to SEQ ID NO: 593177

SEQ ID NO: 626525 - RNA, 64 nt, hsa; identical to SEQ ID NO: 593178

SEQ ID NO: 626526 - RNA, 64 nt, hsa; identical to SEQ ID NO: 593179

SEQ ID NO: 626527 - RNA, 64 nt, hsa; identical to SEQ ID NO: 593180

SEQ ID NO: 626528 - RNA, 64 nt, hsa; identical to SEQ ID NO: 593181

SEQ ID NO: 626529 - RNA, 64 nt, hsa; identical to SEQ ID NO: 593182

SEQ ID NO: 626530 - RNA, 64 nt, hsa; identical to SEQ ID NO: 593183

SEQ ID NO: 626531 - RNA, 64 nt, hsa; identical to SEQ ID NO: 593184

SEQ ID NO: 626532 - RNA, 64 nt, hsa; identical to SEQ ID NO: 157838

SEQ ID NO: 626533 - RNA, 64 nt, hsa; identical to SEQ ID NO: 157839

SEQ ID NO: 626534 - RNA, 64 nt, hsa; identical to SEQ ID NO: 157840

SEQ ID NO: 626535 - RNA, 64 nt, hsa; identical to SEQ ID NO: 157841

SEQ ID NO: 626536 - RNA, 64 nt, hsa; identical to SEQ ID NO: 157842

SEQ ID NO: 626537 - RNA, 64 nt, hsa; identical to SEQ ID NO: 157843

SEQ ID NO: 626538 - RNA, 64 nt, hsa; identical to SEQ ID NO: 157844

SEQ ID NO: 626539 - RNA, 64 nt, hsa; identical to SEQ ID NO: 157845

SEQ ID NO: 626540 - RNA, 64 nt, hsa; identical to SEQ ID NO: 157846

SEQ ID NO: 626541 - RNA, 64 nt, hsa; identical to SEQ ID NO: 157847

SEQ ID NO: 626542 - RNA, 64 nt, hsa; identical to SEQ ID NO: 157848

SEQ ID NO: 626543 - RNA, 64 nt, hsa; identical to SEQ ID NO: 157849

SEQ ID NO: 626544 - RNA, 64 nt, hsa; identical to SEQ ID NO: 157850

SEQ ID NO: 626545 - RNA, 64 nt, hsa; identical to SEQ ID NO: 157851

SEQ ID NO: 626546 - RNA, 64 nt, hsa; identical to SEQ ID NO: 157852

SEQ ID NO: 626547 - RNA, 64 nt, hsa; identical to SEQ ID NO: 157853

SEQ ID NO: 626548 - RNA, 64 nt, hsa; identical to SEQ ID NO: 157854

SEQ ID NO: 626549 - RNA, 64 nt, hsa; identical to SEQ ID NO: 157855

SEQ ID NO: 626550 - RNA, 64 nt, hsa; identical to SEQ ID NO: 157856

SEQ ID NO: 626551 - RNA, 64 nt, hsa; identical to SEQ ID NO: 157857

SEQ ID NO: 626552 - RNA, 64 nt, hsa; identical to SEQ ID NO: 157858

SEQ ID NO: 626553 - RNA, 64 nt, hsa; identical to SEQ ID NO: 157859

SEQ ID NO: 626554 - RNA, 64 nt, hsa; identical to SEQ ID NO: 157860

SEQ ID NO: 626555 - RNA, 64 nt, hsa; identical to SEQ ID NO: 157861

SEQ ID NO: 626556 - RNA, 64 nt, hsa; identical to SEQ ID NO: 157862

SEQ ID NO: 626557 - RNA, 64 nt, hsa; identical to SEQ ID NO: 157863

SEQ ID NO: 626558 - RNA, 64 nt, hsa; identical to SEQ ID NO: 157864

SEQ ID NO: 626559 - RNA, 64 nt, hsa; identical to SEQ ID NO: 157865

SEQ ID NO: 626560 - RNA, 64 nt, hsa; identical to SEQ ID NO: 157866

SEQ ID NO: 626561 - RNA, 64 nt, hsa; identical to SEQ ID NO: 157867

SEQ ID NO: 626562 - RNA, 64 nt, hsa; identical to SEQ ID NO: 157868

SEQ ID NO: 626563 - RNA, 64 nt, hsa; identical to SEQ ID NO: 157869

SEQ ID NO: 626564 - RNA, 64 nt, hsa; identical to SEQ ID NO: 157870

SEQ ID NO: 626565 - RNA, 64 nt, hsa; identical to SEQ ID NO: 157871

SEQ ID NO: 626566 - RNA, 64 nt, hsa; identical to SEQ ID NO: 157872

SEQ ID NO: 626567 - RNA, 64 nt, hsa; identical to SEQ ID NO: 157873

SEQ ID NO: 626568 - RNA, 64 nt, hsa; identical to SEQ ID NO: 157874

SEQ ID NO: 626569 - RNA, 64 nt, hsa; identical to SEQ ID NO: 157875

SEQ ID NO: 626570 - RNA, 64 nt, hsa; identical to SEQ ID NO: 157876

SEQ ID NO: 626571 - RNA, 64 nt, hsa; identical to SEQ ID NO: 157877

SEQ ID NO: 626572 - RNA, 64 nt, hsa; identical to SEQ ID NO: 157878

SEQ ID NO: 626573 - RNA, 64 nt, hsa; identical to SEQ ID NO: 157879

SEQ ID NO: 626574 - RNA, 64 nt, hsa; identical to SEQ ID NO: 157880

SEQ ID NO: 626575 - RNA, 64 nt, hsa; identical to SEQ ID NO: 157881

SEQ ID NO: 626576 - RNA, 64 nt, hsa; identical to SEQ ID NO: 157882

SEQ ID NO: 626577 - RNA, 64 nt, hsa; identical to SEQ ID NO: 157883

SEQ ID NO: 626578 - RNA, 64 nt, hsa; identical to SEQ ID NO: 157884

SEQ ID NO: 626579 - RNA, 64 nt, hsa; identical to SEQ ID NO: 157885

SEQ ID NO: 626580 - RNA, 64 nt, hsa; identical to SEQ ID NO: 157886

SEQ ID NO: 626581 - RNA, 64 nt, hsa; identical to SEQ ID NO: 157887

SEQ ID NO: 626582 - RNA, 64 nt, hsa; identical to SEQ ID NO: 157888

SEQ ID NO: 626583 - RNA, 64 nt, hsa; identical to SEQ ID NO: 157889

SEQ ID NO: 626584 - RNA, 64 nt, hsa
aauugccuauuuagcuccucuuuucuuccuuuuuauuucauaagacugcuaggaagugauuuuu

SEQ ID NO: 626585 - RNA, 64 nt, hsa
aaguauucacugaguaggggugucccaugacacuauuucauauucuacagaaguaaaucagguu

SEQ ID NO: 626586 - RNA, 64 nt, hsa
cgugggauugguguaggguuaaaucaucaacauuauuucauaaaauaagaauuuguucuguguu

SEQ ID NO: 626587 - RNA, 64 nt, hsa
ucaacaauguguaauuaauauuuuugauacagugauuucauauuggaaucauuauuugugcaaa

SEQ ID NO: 626588 - RNA, 64 nt, hsa
ucauguaaaugugauggauuucuuaaucauauuuauuucauauuaauccaaguuuaucaaacuu

SEQ ID NO: 626589 - RNA, 64 nt, hsa
ugccuuguauuuagucagagggcuagaggugcagauuucauauuuucuuaaugaaaauauuuuc

SEQ ID NO: 626590 - RNA, 64 nt, hsa
gauuucauuugguuuaacuaagcuguacuaguucauuucauaaggaaaugauacuguagacaaa

SEQ ID NO: 626591 - RNA, 64 nt, hsa
ugcaauuuaaauaaaaauuacgacauuuuaagauauuucauagacaaaccaaacaaaaauauau

SEQ ID NO: 626592 - RNA, 64 nt, hsa
cagucggcccaagaaaucaaaauaaaggaaacacauuucauauacugcagguaacaaaagucaa

SEQ ID NO: 626593 - RNA, 64 nt, hsa
uuguugaaggagaaaaacuaaauaaauacgaguaauuucauagaaacgaauacacuaguguaca

SEQ ID NO: 626594 - RNA, 64 nt, hsa
guccucccuccaaacugaaacuaauuugauuuugauuucauauucaauaugcaauaauuauguu

SEQ ID NO: 626595 - RNA, 64 nt, hsa
uaggauuaaucugugaacaauggguuuacggucuauuucauaauugaaauauuuauuuuaaaaa

SEQ ID NO: 626596 - RNA, 64 nt, hsa
gccacagccugccuccaucagcuucuuauuuaguauuucauaugcccauuagcccuaugcuuca

SEQ ID NO: 626597 - RNA, 64 nt, hsa
uucuucugaaaaacauuuaucagaaacuuaaaauauuucauaccguuugauccaguagcuucuu

SEQ ID NO: 626598 - RNA, 64 nt, hsa
uaugaagugaacugagcgucacacccuguacuucauuucauauuucuagauaauucugaauuuu

SEQ ID NO: 626599 - RNA, 64 nt, hsa
uguugucauuuguauaucaguaauucagguacccauuucauagacauuuuacugagaaaugacc

SEQ ID NO: 626600 - RNA, 64 nt, hsa
ucuuuauauuauuaaauauauuuguuguuuggauauuucauauaaagauggcuauaauuacaua

SEQ ID NO: 626601 - RNA, 64 nt, hsa
aaacuuacuagauauaaauuaaaauuuuauaaauauuucauauuuuucugaguaaauaugauug

SEQ ID NO: 626602 - RNA, 64 nt, hsa
uccaagugguggcugacuguugcagggaaugagaauuucauaauacacugcuauuucagaccuc

SEQ ID NO: 626603 - RNA, 64 nt, hsa
aguguacuugauuacugggcauccuuguaauauaauuucauaccacugacacauuauacuugua

SEQ ID NO: 626604 - RNA, 64 nt, hsa
uuugaaauuaaagauauuccacucaacagacaauauuucauauuugauauuacaaucauuuauu

SEQ ID NO: 626605 - RNA, 64 nt, hsa
uuuuuugucucucuccugaucuuacuaaauccauauuucauaaauaacugagaauaauuaaaac

SEQ ID NO: 626606 - RNA, 64 nt, hsa
cuaggaaagaaguggaugggaauuguaggcauagauuucauaucaagggcauuucaagacagaa

SEQ ID NO: 626607 - RNA, 64 nt, hsa
uguuuuuguuauaagccauuugaauuuuuaaaaaauuucauacaugcaauggaauauagauaug

SEQ ID NO: 626608 - RNA, 64 nt, hsa
uuaaauauuguacuacugugcuuaucuuguaaagauuucauaaaaugauaguauugguuauuuu

SEQ ID NO: 626609 - RNA, 64 nt, hsa
uauaaauaguauuuuacaucuuauuuuugccuuuauuucauaaguaauuuaaaaaucacuggau

SEQ ID NO: 626610 - RNA, 64 nt, hsa
guuuugcacaacuguaacccuguuguuacuuuauauuucauaaucaggcaaaaauacuuacagu

SEQ ID NO: 626611 - RNA, 64 nt, hsa
uuaauucuucuaaauuaccacuugccauuaagcuauuucauaauaaauucuguacaguuucccc

SEQ ID NO: 626612 - RNA, 64 nt, hsa
uaaaauauugugacagauuugaaaucauguuugaauuucauaguaggaccaguacaagaauguc

SEQ ID NO: 626613 - RNA, 64 nt, hsa
uuuuucucuuacuguuuucucuacaguccuuuauauuucauaccaucucugccuuauaaguggu

SEQ ID NO: 626614 - RNA, 64 nt, hsa
ccauuuacuguagguaguauucucuuccuacuauauuucauaucuaccuacuacauuucauauc

SEQ ID NO: 626615 - RNA, 64 nt, hsa
ucucuuccuacuauauuucauaucuaccuacuacauuucauaucauuccuacuacauuucauau

SEQ ID NO: 626616 - RNA, 64 nt, hsa
aucuaccuacuacauuucauaucauuccuacuacauuucauaucuaccuacauuuacauguagg

SEQ ID NO: 626617 - RNA, 64 nt, hsa
gacagaguggggaaaaaaagcaauucacaaaaccauuucauauuuuuuaaaauauugugcuuaa

SEQ ID NO: 626618 - RNA, 64 nt, hsa
auuuuaaauaaaauagaauuacuacaauucugcaauuucauacuaccuaaaaaagacuagauuu

SEQ ID NO: 626619 - RNA, 64 nt, hsa
auaaguuugggcugaagaaaccuggccuuauaucauuucauauaaaaaagacgggauuuuaguu

SEQ ID NO: 626620 - RNA, 64 nt, hsa
cugcugaauuaaugugauuuuggucucuauugauauuucauagggcccugucuuauucaacuuu

SEQ ID NO: 626621 - RNA, 64 nt, hsa
uccuauggcuguacaauuacaucgauucuuccaaauuucauauuucauacauggcacuuuggca

SEQ ID NO: 626622 - RNA, 64 nt, hsa
gcuguacaauuacaucgauucuuccaaauuucauauuucauacauggcacuuuggcauaccgaa

SEQ ID NO: 626623 - RNA, 64 nt, hsa
uaaauaugacuagagaauauauuggguuugcuuuauuucauaggcuuaauucuuuguaaaucug

SEQ ID NO: 626624 - RNA, 64 nt, hsa
ccuugcauguaaaucauucaaggauuauaguaauauuucauauacugaaaagugucucauagga

SEQ ID NO: 626625 - RNA, 64 nt, hsa
ugauuugggaaauauucuuuacuacaaaggacuuauuucauaauuacaaauuuuccuucauauu

SEQ ID NO: 626626 - RNA, 64 nt, hsa
agcacauagcccuguuauauuugauuuauuuuacauuucauaugaaagcauaauuuuguccaca

SEQ ID NO: 626627 - RNA, 64 nt, hsa
uugguguugagaacaucaguugccuuauucuaagauuucauaaggcugaguuugcacgcuugga

SEQ ID NO: 626628 - RNA, 64 nt, hsa
ugguaacuucuagaaagccagaaaauggacucugauuucauagcauuuugauaaaaugccacaa

SEQ ID NO: 626629 - RNA, 64 nt, hsa
gcccauuguagcauauguuugauuuuuuuuuauuauuucauaagaaaacuacguuaauuuuacc

SEQ ID NO: 626630 - RNA, 64 nt, hsa
ugaggugaugauaguuggccucuggucuacaaagauuucauaacuccuuggaaagcuucuuaua

SEQ ID NO: 626631 - RNA, 64 nt, hsa
uacuuuuucauauauaauuagaucuuucuuuguaauuucauauguaguucuucauagggucuca

SEQ ID NO: 626632 - RNA, 64 nt, hsa
guaaacugagaucuuaagucuccuagucuacugaauuucauaugguguauaauacagauuuaua

SEQ ID NO: 626633 - RNA, 64 nt, hsa
ggcuuauaaucauuuuuauucugccauaugguuuauuucauauacacucacuuuuacacucacu

SEQ ID NO: 626634 - RNA, 64 nt, hsa
uuucaugucauauuacucagucuaaacaauaaauauuucauaauuuacaaaggaggaacggaag

SEQ ID NO: 626635 - RNA, 64 nt, hsa
uuguauuuuugaccugccuuuuauauguaugaauauuucauaguuuugcauaucagauguaggc

SEQ ID NO: 626636 - RNA, 64 nt, hsa
caauaaaacuuuauuuauggacacuaaaauuugaauuucauaaaauuuucccaugucaagaaua

SEQ ID NO: 626637 - RNA, 64 nt, hsa
gcaaaaaacaaaaacaaaaaacagugcauuagcaauuucauagcaagugcaugcacuaggaaaa

SEQ ID NO: 626638 - RNA, 64 nt, hsa
auuuuacacaaaaauauuuaugcagauuuucagaauuucauaucaggaaaugaccuuuuuaugu

SEQ ID NO: 626639 - RNA, 64 nt, hsa
ggugaugguagagaagcugcccggaauaaacugaauuucauauguucuaaaaugacuagcaaug

SEQ ID NO: 626640 - RNA, 64 nt, hsa
auuauuaagcugacuaagcaaugaucuaauacacauuucauauuuucuuuauaauaauuucuua

SEQ ID NO: 626641 - RNA, 64 nt, hsa
cgucauuuccagucacaguaggcgaucuuucguaauuucauaaaagcaguucguuugcaguaug

SEQ ID NO: 626642 - RNA, 64 nt, hsa
ucuaaaaaucuauagcagaguuucucuauuuuauauuucauagauuuaaaaaacccaaauaaag

SEQ ID NO: 626643 - RNA, 64 nt, hsa
uauuucucucucuguagauuugcuuauucuggucauuucauauaaauggaauucuacaauauuc

SEQ ID NO: 626644 - RNA, 64 nt, hsa
ucauuagccaguuuaacugauucaaacucuguuuauuucauacuaaacuagugaauaagugaaa

SEQ ID NO: 626645 - RNA, 64 nt, hsa
gcaguguaaguuauaugugaaaugagucuuugguauuucauauaggaauuauuuuuuuuuucau

SEQ ID NO: 626646 - RNA, 64 nt, hsa
caagaagagccaaauugacucucuaaaucugguguauggguauuaaauaaaauucauucucaag

SEQ ID NO: 626647 - RNA, 64 nt, hsa
aaacugucaaccuaccaaaaacgauauuguggcuuauggguauugcugucucauucuugguaua

SEQ ID NO: 626648 - RNA, 64 nt, hsa
aucuuuuuucacuguaagagguaaccuuuaacaauauggguauuaccuuugucucuucauaccg

SEQ ID NO: 626649 - RNA, 64 nt, hsa
gacuccguauuaugacuccauuagugagcugugguauggguaggauuuuccuacuucuucugua

SEQ ID NO: 626650 - RNA, 64 nt, hsa
uuguauaauucucugaaauacucagcuuuugucauauggguaaaaauuaaagaugucauugaac

SEQ ID NO: 626651 - RNA, 64 nt, hsa
uuccuuccacucuggagcagggugaggggaauguuauggguaacagacaugcaggcauggcucu

SEQ ID NO: 626652 - RNA, 64 nt, hsa
gacaaccaguccuccacaucacagcauuuagacauauggguaaaauguuauuucuagugaauug

SEQ ID NO: 626653 - RNA, 64 nt, hsa
aguucagaauuuuaaaguacauuuucgaugcuuuuauggguauuuuuguaguuucuuuguagag

SEQ ID NO: 626654 - RNA, 64 nt, hsa
aaaugaaugcuggucagugggacauuuugucaacuauggguauugggugcuuaacugucuaaua

SEQ ID NO: 626655 - RNA, 64 nt, hsa
ugggcccaauaaaacaacacacauuuuuaaaaaauauggguauugauguccggcugaagguaag

SEQ ID NO: 626656 - RNA, 64 nt, hsa
aaaauuuauaucuggguuaaguguuuaucauauauauggguacuuuguaauaucuaaaaacuua

SEQ ID NO: 626657 - RNA, 64 nt, hsa
cacccuggguuauaaggaggcuuaggagagagguuauggguauuggugucucuauccccaggaa

SEQ ID NO: 626658 - RNA, 64 nt, hsa
gccuucccuucaauuuuaaacugaagcauuuuaauauggguagaaacucuacaccaaauacacu

SEQ ID NO: 626659 - RNA, 64 nt, hsa
cuuuucagauauuugagagcagucgaagugguaguauggguaaguuaagcacuucuuaacauug

SEQ ID NO: 626660 - RNA, 64 nt, hsa
gggguauccuacugauacacacguauucaaaguuuauggguacaacaaagacauaguacaugua

SEQ ID NO: 626661 - RNA, 64 nt, hsa
uucauguuuuugaucaaaaacuauuugggauauguauggguaggguaaaucaguaagagguguu

SEQ ID NO: 626662 - RNA, 64 nt, hsa
ccacuccaccaugcuauuaagacucuggcagaguuauggguaggauauggaucccuacaugaau

SEQ ID NO: 626663 - RNA, 64 nt, hsa
uauugggcuuuugucuuuuaaagaauaugucuacuauggguauuuuuuuuuuaaauguuaaaau

SEQ ID NO: 626664 - RNA, 64 nt, hsa
uguguguauguguauguauaugacuuuaaauagcuauggguacaauauuaaaaaccacuggaac

SEQ ID NO: 626665 - RNA, 64 nt, hsa
uaaacuauaaauucauugaaaaugugaauucuauuauggguagccuuuuuaccaauuauaagga

SEQ ID NO: 626666 - RNA, 64 nt, hsa
uauguccaauuuccuggcucauuucauugugcucuauggguacguauaaaaagcaagaauucug

SEQ ID NO: 626667 - RNA, 64 nt, hsa
auuggcaaaauuuauucucauuauaccugcuucauauggguauauuacuauuaaaacagaauac

SEQ ID NO: 626668 - RNA, 64 nt, hsa
gaguguguguacacaugccuccuagaaacuacacuauggguaauuaauuaauuuauuucauaga

SEQ ID NO: 626669 - RNA, 64 nt, hsa
uuacauaacuuggugaaacugaaaaaguauaucauauggguacacaaggcuauuugccagcaua

SEQ ID NO: 626670 - RNA, 64 nt, hsa
agauuucuuggugguagcuauuuggguaaagguauauggguauuuuucuguacaugugaaauua

SEQ ID NO: 626671 - RNA, 64 nt, hsa
aucuuccugccucaggcuucugaguagcuaggacuauggguacauuccacagugcccagcuaau

SEQ ID NO: 626672 - RNA, 64 nt, hsa
aauuauggaaacagaugaaaagccucuguuuugauauggguaguauuuuuuacauuuuacacac

SEQ ID NO: 626673 - RNA, 64 nt, hsa
uauuggccaaaauauggacacaaauauagacuaauauggguaauuacccuuugguuuaucuaaa

SEQ ID NO: 626674 - RNA, 64 nt, hsa
uauaucuuauucuuaacuuuuguaaaccauguuuuauggguaacuuuuuaguuuucccaaaagg

SEQ ID NO: 626675 - RNA, 64 nt, hsa
guaaggcucaguaaaugacagaacuauuuuucauuauggguaacuggggaauaaaugggucacu

SEQ ID NO: 626676 - RNA, 64 nt, hsa
agucacauagagcuugggaguaccacuggaaacguauggguaggaguuuagguggcuucuguuu

SEQ ID NO: 626677 - RNA, 64 nt, hsa
ucugguauuuacagcaaaauacuguguauccuuuuauggguaaaacaaaagugaacauugcaug

SEQ ID NO: 626678 - RNA, 64 nt, hsa
aguauuccugugucuacuguuuuguuguuguuaauauggguaaagugagcccugaaauacaugc

SEQ ID NO: 626679 - RNA, 64 nt, hsa
aaucguaacaccuccauuuguauuacauaugguguauggguauugaugaggucaugguaucaua

SEQ ID NO: 626680 - RNA, 64 nt, hsa
guucucucuacucagaucccuuccagaaacuuuauauggguagaggaagccagggcggcaaaug

SEQ ID NO: 626681 - RNA, 64 nt, hsa
ccaguaaauugcuaaguaaugucaauaaaucgaguauggguauuaugcagugcaccuaaucugg

SEQ ID NO: 626682 - RNA, 64 nt, hsa
gcuuccccaggcauuaugaaccucugcuuaggaauauggguaggagugaaaggccuggcagaua

SEQ ID NO: 626683 - RNA, 64 nt, hsa
cuuuggucuucuauuccaaggguaagguugcgauuauggguaagauuggccagagguaggaaug

SEQ ID NO: 626684 - RNA, 64 nt, hsa
ccaagauauuauguguaaauuguguuauuauguauauggguaaagauguacaaauauauguccu

SEQ ID NO: 626685 - RNA, 64 nt, hsa
aagaucagaaaugcuagaauucuugacuuuuguguauggguaguaaaucuagcucacugaaaau

SEQ ID NO: 626686 - RNA, 64 nt, hsa
cauuuucuuagcaucauugcccacaguguugauauauggguaggauguuacaaaguauugaaua

SEQ ID NO: 626687 - RNA, 64 nt, hsa
gauggaaaucaaugaaaaagaggccuuguuuauauauggguagcuucacauuuaauuuauaaag

SEQ ID NO: 626688 - RNA, 64 nt, hsa
gggaagcuuauauaaaagugacccuuuugcaucauauggguaucuaaacuuaauuuacccaaua

SEQ ID NO: 626689 - RNA, 64 nt, hsa
accuauuggcuuucaguaacaaugguauaauaauuauggguaugaaaaugacucuucauaugac

SEQ ID NO: 626690 - RNA, 64 nt, hsa
uaaaaugucuuucccauccauaaccaaguccuccuauggguacauaaacccaaaguccccacuu

SEQ ID NO: 626691 - RNA, 64 nt, hsa
gcacuuguuugucagcccucucauacuaugaacauauggguagagaguauauuuucugcuguau

SEQ ID NO: 626692 - RNA, 64 nt, hsa
ggaauaaauccaaggaccaguuuuuacccaaauauauggguagcacaguuuaucacauagaaac

SEQ ID NO: 626693 - RNA, 64 nt, hsa
uuacugauuuugcucauccacuucccuacacaucuauggguaucacacccaagacuacccacca

SEQ ID NO: 626694 - RNA, 64 nt, hsa
cacccagaaagggggcccaacacccuuguccauuuauggguauuuuuuuucgaaguuauuaagc

SEQ ID NO: 626695 - RNA, 64 nt, hsa
cagauuacugguaaaaauuauuugaaaacaaacuuauggguaauaaaggcuagucagaacccua

SEQ ID NO: 626696 - RNA, 64 nt, hsa
ccaagaauuacagcuuuauuuauagagagugaauuauggguauuuuuucagaaaauauugucau

SEQ ID NO: 626697 - RNA, 64 nt, hsa
caucuuauuggcugugggcagagacuaggacccuuauggguacauuucaguaaucucucacugc

SEQ ID NO: 626698 - RNA, 64 nt, hsa
ugaauacuguugugaaagugaaaaacaaugauuguauggguacucaaaguauaauuucuacuga

SEQ ID NO: 626699 - RNA, 64 nt, hsa
uaagccaucacaccuggcccuagugacagguuuuuauggguacuuuuagaugaucuaagaaauc

SEQ ID NO: 626700 - RNA, 64 nt, hsa
auguaccacuagaaagguauuacauguguauaaguauggguaaaaaggcaagucacuaguuuga

SEQ ID NO: 626701 - RNA, 64 nt, hsa
gguguuugggccacgauuuuaaaaugacuuuuauuauggguauguguugccaaagcuggcuuuu

SEQ ID NO: 626702 - RNA, 64 nt, hsa
augggauuaaaaaaaguuaugggauaaaaaagguuauggguaacuuaugguauaaaaguuauga

SEQ ID NO: 626703 - RNA, 64 nt, hsa
cgagaaagaauuuuuuccaaggaaaugucucggauauggguacuguauuugaaagcuguuagcu

SEQ ID NO: 626704 - RNA, 64 nt, hsa
ggcaaaacacuuuuuucacccuuuggaaucauaguauggguagaaguuaugauuuaucuugaaa

SEQ ID NO: 626705 - RNA, 64 nt, hsa
gauaaccgacccagacugcuuugugacaugaagcuauggguaagcguuuuguaaacuucuguuc

SEQ ID NO: 626706 - RNA, 64 nt, hsa
ccaaaccugaccugaacuuacacugauaggaagcuauggguaauuaugauguguuccuuuuagu

SEQ ID NO: 626707 - RNA, 64 nt, hsa
aaaggaaaauuguuuaaaguauuauauguaaacauauggguauuuuuuauuuuguguaauuuua

SEQ ID NO: 626708 - RNA, 64 nt, hsa
gaaaguuaccuaaucccuccuaaagacacagcaguauggguauaacauccuugccuucccauuu

SEQ ID NO: 626709 - RNA, 64 nt, hsa
ccuuaauguuguuacaaagauaugguaacuguaauauggguaaaaguuuauucaagaaaagagu

SEQ ID NO: 626710 - RNA, 64 nt, hsa
uuugaaagggucuguauaaucauuuucuagaaaguauggguaucuauacuaauguuuuuauaug

SEQ ID NO: 626711 - RNA, 64 nt, hsa
aaacuuggucuugaauguacugggggcuucaagguauggguauauuuuucuuguguccuugcag

SEQ ID NO: 626712 - RNA, 64 nt, hsa
ugguuaagucacaacgacgaagugcugagaagguuauggguaccaggaagaaacaaacagaagu

SEQ ID NO: 626713 - RNA, 64 nt, hsa
aaugcaccaagcaauuaugguggaccuauuacccuauggguaagaaauaaauggaaauaugaca

SEQ ID NO: 626714 - RNA, 64 nt, hsa
agguuggaaacuaagucucauuuacugauucguuuauggguaguaccgggaugaacccaccacc

SEQ ID NO: 626715 - RNA, 64 nt, hsa
acaacaauaucaacaacaagagauugaaauaagcuauggguaaaauaaugccaguaauucagcu

SEQ ID NO: 626716 - RNA, 64 nt, hsa
uggaauauuuuugaggccuggaugaacuuugccauauggguagagguuacagagggaggugaua

SEQ ID NO: 626717 - RNA, 64 nt, hsa
uucaaaaaauguuguaacugaaagcacuguugaauauggguaucggcuuucuuuuucacuuuga

SEQ ID NO: 626718 - RNA, 64 nt, hsa
uuguuuucauuugguccaaauaauauuuuauuuguauggguaucuucuaagacuaaauagguag

SEQ ID NO: 626719 - RNA, 64 nt, hsa
uauccaccuccaucuucuuugcagccuggguggcuauggguacuucguggccgcacauccuaca

SEQ ID NO: 626720 - RNA, 64 nt, hsa
gcaacuuauuuguaagaaggauuuuuaaauuuuuuauggguagaauuguagucaggaaaacaga

SEQ ID NO: 626721 - RNA, 64 nt, hsa
gcucuuuuacuggguucuuaaccagaugguuguguauggguagcacuacuaaaaguuuagaacu

SEQ ID NO: 626722 - RNA, 64 nt, hsa
uuccagacacagaauacaugauaaauacugauauuauggguaaucugcuuuccauauuuaccua

SEQ ID NO: 626723 - RNA, 64 nt, hsa
cuuuuccugagcuuugaauauuagaucugaccaauauggguaaccaaugcccuuagguaaggua

SEQ ID NO: 626724 - RNA, 64 nt, hsa
gaaauaagugacccaacaaaauuuauucaucuguuauggguaagaucugccauaaauucuuccu

SEQ ID NO: 626725 - RNA, 64 nt, hsa
agauuaaauggacucaucaggguaagaggaauaauauggguaaaacaagaaauggcccgauagu

SEQ ID NO: 626726 - RNA, 64 nt, hsa
uaaaaguuuggcuuccuuucuugguagucaagaguauggguaauaaggaguuauaugucugcua

SEQ ID NO: 626727 - RNA, 64 nt, hsa
aaggggaucagcaugaguauagacaguagaaauguauggguagucuaaccacuuuuaucagaga

SEQ ID NO: 626728 - RNA, 64 nt, hsa
uuuuaaaaagcuccuguuuuuggaaaguagaauuuauggguacaacguauguucauuauuugua

SEQ ID NO: 626729 - RNA, 64 nt, hsa
gggcugcuucaaacucaaacacagagagaaacucuauggguaucaaacagcucaggcuguuuuu

SEQ ID NO: 626730 - RNA, 64 nt, hsa
ccaaagcugccugugccaugcccaaggccuagguuauggguacggcaaccacaugucccagauc

SEQ ID NO: 626731 - RNA, 64 nt, hsa
ggguuugcaguuuucugaguaggugaguuuugaauauggguaaaucagaauaaugagacaacuu

SEQ ID NO: 626732 - RNA, 64 nt, hsa
gaagagaugcagagaaauguggaauuuguggaccuauggguaauuuaugcuuuccuccuaaaaa

SEQ ID NO: 626733 - RNA, 64 nt, hsa
aaaccacuauggagaacugcuuagauucauugucuauggguacauuuuauaaaaaggcagauuc

SEQ ID NO: 626734 - RNA, 64 nt, hsa
aaauuauuuuauaucauacaguuuucauugauuauauggguauauauucaucuaauaaaucagu

SEQ ID NO: 626735 - RNA, 64 nt, hsa
aauccccacuuggaauucagcaccgcaaggaaauuauggguaugugagccauaauaugaugggc

SEQ ID NO: 626736 - RNA, 64 nt, hsa
caccgccuugguaaacaguauuauaaaaucaaaauauggguaaaaguaaauauuuaccagcaac

SEQ ID NO: 626737 - RNA, 64 nt, hsa
uauguuuauuccuacauuuuauucauuuuuaauguauggguaauugguggcacaugacuuuaca

SEQ ID NO: 626738 - RNA, 64 nt, hsa
ggugacacugcuccucuagaagcagguuugaaauuauggguauguuuucuugucacagugacug

SEQ ID NO: 626739 - RNA, 64 nt, hsa
ugaauauauauguauacacauacuuacauacuuauauggguaucuguauagauaauuuguauua

SEQ ID NO: 626740 - RNA, 64 nt, hsa
ccuucguagugucaguuuuuguuucagccuuccuuauggguaugcuguggcauaucccugagau

SEQ ID NO: 626741 - RNA, 64 nt, hsa
auuuuuaucaaccagucaacacauaaccuucuucuauggguauuuguuuguuuguuuguuuaaa

SEQ ID NO: 626742 - RNA, 64 nt, hsa
ccaccaaggccuccuaggaaaaauuguaggaauuuauggguauaauauuguggucugaauggcg

SEQ ID NO: 626743 - RNA, 64 nt, hsa
uacauacuuacuguaacacaucuaaaaaaauguauauggguaaggaccugaaagauccauggaa

SEQ ID NO: 626744 - RNA, 64 nt, hsa
ucaggaaggagagaagcgacaucaugauacauccuauggguauuaaaaagccaauagaauauua

SEQ ID NO: 626745 - RNA, 64 nt, hsa
agguuaggaauggguagauagcuaaguccuaaucuauggguacauuguugugucccaaaccaaa

SEQ ID NO: 626746 - RNA, 64 nt, hsa
gucucaggcaagcaaaagauuguccccuucugcauauggguaaaacugagacguccccgugagc

SEQ ID NO: 626747 - RNA, 64 nt, hsa
gguccuucucucauucuccgaacuuacuccuuuuuauggguaagucaacuagguuuacaguccc

SEQ ID NO: 626748 - RNA, 64 nt, hsa
ugaacaugauugcucucugucucuuuuuucagcuuauggguauuuaucuucuauuaguauuugu

SEQ ID NO: 626749 - RNA, 64 nt, hsa
uuuuuaaaacuucaaauaucucaccacagugaauuauggguaaggugauaauauguuuaauuag

SEQ ID NO: 626750 - RNA, 64 nt, hsa
aaugugagcaguguuugccuucagguggugggguuauggguaguuuuuauuuucuuccuucuac

SEQ ID NO: 626751 - RNA, 64 nt, hsa
gagagaacacagugcuauuugcauuucuguuccauauggguaguuaugggguuuaccuguuuua

SEQ ID NO: 626752 - RNA, 64 nt, hsa
uaagcccacuuuguucuuuuaauguaauggagcuuauggguagaagaccaugucuacuaauuac

SEQ ID NO: 626753 - RNA, 64 nt, hsa
acuguguuacacaaaguccuuguuuuaacuuagguauggguaaauuuacauuggugguauugca

SEQ ID NO: 626754 - RNA, 64 nt, hsa
aacaagaauaaaggcagcuguugucucuucuccuuauggguagggcucugacaaagcuucccga

SEQ ID NO: 626755 - RNA, 64 nt, hsa
gccuuuaugguugucauggcaaauucaggugauauauggguaugagguuugaacacugaggacu

SEQ ID NO: 626756 - RNA, 64 nt, hsa; identical to SEQ ID NO: 145614

SEQ ID NO: 626757 - RNA, 64 nt, hsa; identical to SEQ ID NO: 145615

SEQ ID NO: 626758 - RNA, 64 nt, hsa; identical to SEQ ID NO: 145616

SEQ ID NO: 626759 - RNA, 64 nt, hsa; identical to SEQ ID NO: 145617

SEQ ID NO: 626760 - RNA, 64 nt, hsa; identical to SEQ ID NO: 145618

SEQ ID NO: 626761 - RNA, 64 nt, hsa; identical to SEQ ID NO: 145619

SEQ ID NO: 626762 - RNA, 64 nt, hsa; identical to SEQ ID NO: 145620

SEQ ID NO: 626763 - RNA, 64 nt, hsa; identical to SEQ ID NO: 145621

SEQ ID NO: 626764 - RNA, 64 nt, hsa; identical to SEQ ID NO: 145622

SEQ ID NO: 626765 - RNA, 64 nt, hsa; identical to SEQ ID NO: 145623

SEQ ID NO: 626766 - RNA, 50 nt, hsa; identical to SEQ ID NO: 145624

SEQ ID NO: 626767 - RNA, 54 nt, hsa; identical to SEQ ID NO: 145625

SEQ ID NO: 626768 - RNA, 64 nt, hsa; identical to SEQ ID NO: 145626

SEQ ID NO: 626769 - RNA, 64 nt, hsa; identical to SEQ ID NO: 145627

SEQ ID NO: 626770 - RNA, 64 nt, hsa; identical to SEQ ID NO: 145628

SEQ ID NO: 626771 - RNA, 64 nt, hsa; identical to SEQ ID NO: 145629

SEQ ID NO: 626772 - RNA, 64 nt, hsa; identical to SEQ ID NO: 145630

SEQ ID NO: 626773 - RNA, 64 nt, hsa; identical to SEQ ID NO: 145631

SEQ ID NO: 626774 - RNA, 64 nt, hsa; identical to SEQ ID NO: 145632

SEQ ID NO: 626775 - RNA, 64 nt, hsa; identical to SEQ ID NO: 145633

SEQ ID NO: 626776 - RNA, 64 nt, hsa; identical to SEQ ID NO: 145634

SEQ ID NO: 626777 - RNA, 64 nt, hsa; identical to SEQ ID NO: 145635

SEQ ID NO: 626778 - RNA, 64 nt, hsa; identical to SEQ ID NO: 145636

SEQ ID NO: 626779 - RNA, 64 nt, hsa; identical to SEQ ID NO: 145637

SEQ ID NO: 626780 - RNA, 64 nt, hsa; identical to SEQ ID NO: 145638

SEQ ID NO: 626781 - RNA, 64 nt, hsa; identical to SEQ ID NO: 145639

SEQ ID NO: 626782 - RNA, 64 nt, hsa; identical to SEQ ID NO: 145640

SEQ ID NO: 626783 - RNA, 64 nt, hsa; identical to SEQ ID NO: 145641

SEQ ID NO: 626784 - RNA, 64 nt, hsa; identical to SEQ ID NO: 145642

SEQ ID NO: 626785 - RNA, 64 nt, hsa; identical to SEQ ID NO: 145643

SEQ ID NO: 626786 - RNA, 64 nt, hsa; identical to SEQ ID NO: 145644

SEQ ID NO: 626787 - RNA, 64 nt, hsa; identical to SEQ ID NO: 145645

SEQ ID NO: 626788 - RNA, 64 nt, hsa; identical to SEQ ID NO: 145646

SEQ ID NO: 626789 - RNA, 64 nt, hsa; identical to SEQ ID NO: 145647

SEQ ID NO: 626790 - RNA, 64 nt, hsa; identical to SEQ ID NO: 145648

SEQ ID NO: 626791 - RNA, 64 nt, hsa; identical to SEQ ID NO: 145649

SEQ ID NO: 626792 - RNA, 64 nt, hsa; identical to SEQ ID NO: 145650

SEQ ID NO: 626793 - RNA, 64 nt, hsa; identical to SEQ ID NO: 145651

SEQ ID NO: 626794 - RNA, 64 nt, hsa; identical to SEQ ID NO: 145652

SEQ ID NO: 626795 - RNA, 64 nt, hsa; identical to SEQ ID NO: 145653

SEQ ID NO: 626796 - RNA, 64 nt, hsa; identical to SEQ ID NO: 145654

SEQ ID NO: 626797 - RNA, 64 nt, hsa; identical to SEQ ID NO: 145655

SEQ ID NO: 626798 - RNA, 64 nt, hsa; identical to SEQ ID NO: 145656

SEQ ID NO: 626799 - RNA, 64 nt, hsa; identical to SEQ ID NO: 145657

SEQ ID NO: 626800 - RNA, 64 nt, hsa; identical to SEQ ID NO: 145658

SEQ ID NO: 626801 - RNA, 64 nt, hsa; identical to SEQ ID NO: 145659

SEQ ID NO: 626802 - RNA, 64 nt, hsa; identical to SEQ ID NO: 145660

SEQ ID NO: 626803 - RNA, 64 nt, hsa; identical to SEQ ID NO: 145661

SEQ ID NO: 626804 - RNA, 64 nt, hsa; identical to SEQ ID NO: 145662

SEQ ID NO: 626805 - RNA, 64 nt, hsa; identical to SEQ ID NO: 145663

SEQ ID NO: 626806 - RNA, 64 nt, hsa; identical to SEQ ID NO: 145664

SEQ ID NO: 626807 - RNA, 64 nt, hsa; identical to SEQ ID NO: 145665

SEQ ID NO: 626808 - RNA, 64 nt, hsa; identical to SEQ ID NO: 145666

SEQ ID NO: 626809 - RNA, 64 nt, hsa; identical to SEQ ID NO: 145667

SEQ ID NO: 626810 - RNA, 64 nt, hsa; identical to SEQ ID NO: 145668

SEQ ID NO: 626811 - RNA, 64 nt, hsa; identical to SEQ ID NO: 145669

SEQ ID NO: 626812 - RNA, 64 nt, hsa; identical to SEQ ID NO: 145670

SEQ ID NO: 626813 - RNA, 64 nt, hsa; identical to SEQ ID NO: 145671

SEQ ID NO: 626814 - RNA, 64 nt, hsa; identical to SEQ ID NO: 145672

SEQ ID NO: 626815 - RNA, 64 nt, hsa; identical to SEQ ID NO: 145673

SEQ ID NO: 626816 - RNA, 64 nt, hsa; identical to SEQ ID NO: 145674

SEQ ID NO: 626817 - RNA, 64 nt, hsa; identical to SEQ ID NO: 145675

SEQ ID NO: 626818 - RNA, 64 nt, hsa; identical to SEQ ID NO: 145676

SEQ ID NO: 626819 - RNA, 64 nt, hsa; identical to SEQ ID NO: 145677

SEQ ID NO: 626820 - RNA, 64 nt, hsa; identical to SEQ ID NO: 145678

SEQ ID NO: 626821 - RNA, 64 nt, hsa; identical to SEQ ID NO: 145679

SEQ ID NO: 626822 - RNA, 64 nt, hsa; identical to SEQ ID NO: 145680

SEQ ID NO: 626823 - RNA, 64 nt, hsa; identical to SEQ ID NO: 145681

SEQ ID NO: 626824 - RNA, 64 nt, hsa; identical to SEQ ID NO: 145682

SEQ ID NO: 626825 - RNA, 64 nt, hsa; identical to SEQ ID NO: 145683

SEQ ID NO: 626826 - RNA, 64 nt, hsa; identical to SEQ ID NO: 145684

SEQ ID NO: 626827 - RNA, 64 nt, hsa; identical to SEQ ID NO: 145685

SEQ ID NO: 626828 - RNA, 64 nt, hsa; identical to SEQ ID NO: 145686

SEQ ID NO: 626829 - RNA, 64 nt, hsa; identical to SEQ ID NO: 145687

SEQ ID NO: 626830 - RNA, 51 nt, hsa; identical to SEQ ID NO: 145688

SEQ ID NO: 626831 - RNA, 64 nt, hsa; identical to SEQ ID NO: 145689

SEQ ID NO: 626832 - RNA, 64 nt, hsa; identical to SEQ ID NO: 145690

SEQ ID NO: 626833 - RNA, 64 nt, hsa; identical to SEQ ID NO: 145691

SEQ ID NO: 626834 - RNA, 64 nt, hsa; identical to SEQ ID NO: 145692

SEQ ID NO: 626835 - RNA, 64 nt, hsa; identical to SEQ ID NO: 145693

SEQ ID NO: 626836 - RNA, 64 nt, hsa; identical to SEQ ID NO: 145694

SEQ ID NO: 626837 - RNA, 64 nt, hsa; identical to SEQ ID NO: 145695

SEQ ID NO: 626838 - RNA, 64 nt, hsa; identical to SEQ ID NO: 145696

SEQ ID NO: 626839 - RNA, 64 nt, hsa; identical to SEQ ID NO: 145697

SEQ ID NO: 626840 - RNA, 64 nt, hsa; identical to SEQ ID NO: 145698

SEQ ID NO: 626841 - RNA, 64 nt, hsa; identical to SEQ ID NO: 145699

SEQ ID NO: 626842 - RNA, 64 nt, hsa; identical to SEQ ID NO: 145700

SEQ ID NO: 626843 - RNA, 63 nt, hsa; identical to SEQ ID NO: 145701

SEQ ID NO: 626844 - RNA, 59 nt, hsa; identical to SEQ ID NO: 145702

SEQ ID NO: 626845 - RNA, 64 nt, hsa; identical to SEQ ID NO: 145703

SEQ ID NO: 626846 - RNA, 64 nt, hsa; identical to SEQ ID NO: 145704

SEQ ID NO: 626847 - RNA, 64 nt, hsa; identical to SEQ ID NO: 145705

SEQ ID NO: 626848 - RNA, 64 nt, hsa; identical to SEQ ID NO: 145706

SEQ ID NO: 626849 - RNA, 64 nt, hsa; identical to SEQ ID NO: 145707

SEQ ID NO: 626850 - RNA, 64 nt, hsa; identical to SEQ ID NO: 145708

SEQ ID NO: 626851 - RNA, 64 nt, hsa; identical to SEQ ID NO: 145709

SEQ ID NO: 626852 - RNA, 64 nt, hsa; identical to SEQ ID NO: 145710

SEQ ID NO: 626853 - RNA, 64 nt, hsa; identical to SEQ ID NO: 145711

SEQ ID NO: 626854 - RNA, 64 nt, hsa; identical to SEQ ID NO: 145712

SEQ ID NO: 626855 - RNA, 64 nt, hsa; identical to SEQ ID NO: 145713

SEQ ID NO: 626856 - RNA, 64 nt, hsa; identical to SEQ ID NO: 145714

SEQ ID NO: 626857 - RNA, 64 nt, hsa; identical to SEQ ID NO: 145715

SEQ ID NO: 626858 - RNA, 64 nt, hsa; identical to SEQ ID NO: 145716

SEQ ID NO: 626859 - RNA, 64 nt, hsa; identical to SEQ ID NO: 145717

SEQ ID NO: 626860 - RNA, 64 nt, hsa; identical to SEQ ID NO: 145718

SEQ ID NO: 626861 - RNA, 64 nt, hsa; identical to SEQ ID NO: 145719

SEQ ID NO: 626862 - RNA, 64 nt, hsa; identical to SEQ ID NO: 145720

SEQ ID NO: 626863 - RNA, 64 nt, hsa; identical to SEQ ID NO: 145721

SEQ ID NO: 626864 - RNA, 64 nt, hsa; identical to SEQ ID NO: 145722

SEQ ID NO: 626865 - RNA, 64 nt, hsa; identical to SEQ ID NO: 145723

SEQ ID NO: 626866 - RNA, 64 nt, hsa; identical to SEQ ID NO: 145724

SEQ ID NO: 626867 - RNA, 64 nt, hsa; identical to SEQ ID NO: 145725

SEQ ID NO: 626868 - RNA, 64 nt, hsa; identical to SEQ ID NO: 145726

SEQ ID NO: 626869 - RNA, 64 nt, hsa; identical to SEQ ID NO: 145727

SEQ ID NO: 626870 - RNA, 64 nt, hsa; identical to SEQ ID NO: 145728

SEQ ID NO: 626871 - RNA, 64 nt, hsa; identical to SEQ ID NO: 145729

SEQ ID NO: 626872 - RNA, 64 nt, hsa; identical to SEQ ID NO: 145730

SEQ ID NO: 626873 - RNA, 64 nt, hsa; identical to SEQ ID NO: 145731

SEQ ID NO: 626874 - RNA, 64 nt, hsa; identical to SEQ ID NO: 145732

SEQ ID NO: 626875 - RNA, 64 nt, hsa; identical to SEQ ID NO: 145733

SEQ ID NO: 626876 - RNA, 64 nt, hsa; identical to SEQ ID NO: 145734

SEQ ID NO: 626877 - RNA, 64 nt, hsa; identical to SEQ ID NO: 145735

SEQ ID NO: 626878 - RNA, 64 nt, hsa; identical to SEQ ID NO: 145736

SEQ ID NO: 626879 - RNA, 64 nt, hsa; identical to SEQ ID NO: 145737

SEQ ID NO: 626880 - RNA, 64 nt, hsa; identical to SEQ ID NO: 145738

SEQ ID NO: 626881 - RNA, 64 nt, hsa; identical to SEQ ID NO: 145739

SEQ ID NO: 626882 - RNA, 64 nt, hsa; identical to SEQ ID NO: 145740

SEQ ID NO: 626883 - RNA, 64 nt, hsa; identical to SEQ ID NO: 145741

SEQ ID NO: 626884 - RNA, 64 nt, hsa; identical to SEQ ID NO: 145742

SEQ ID NO: 626885 - RNA, 64 nt, hsa; identical to SEQ ID NO: 145743

SEQ ID NO: 626886 - RNA, 64 nt, hsa; identical to SEQ ID NO: 145744

SEQ ID NO: 626887 - RNA, 64 nt, hsa; identical to SEQ ID NO: 145745

SEQ ID NO: 626888 - RNA, 64 nt, hsa; identical to SEQ ID NO: 145746

SEQ ID NO: 626889 - RNA, 64 nt, hsa; identical to SEQ ID NO: 145747

SEQ ID NO: 626890 - RNA, 64 nt, hsa; identical to SEQ ID NO: 145748

SEQ ID NO: 626891 - RNA, 64 nt, hsa; identical to SEQ ID NO: 145749

SEQ ID NO: 626892 - RNA, 64 nt, hsa; identical to SEQ ID NO: 145750

SEQ ID NO: 626893 - RNA, 64 nt, hsa; identical to SEQ ID NO: 145751

SEQ ID NO: 626894 - RNA, 64 nt, hsa; identical to SEQ ID NO: 145752

SEQ ID NO: 626895 - RNA, 64 nt, hsa; identical to SEQ ID NO: 145753

SEQ ID NO: 626896 - RNA, 64 nt, hsa; identical to SEQ ID NO: 145754

SEQ ID NO: 626897 - RNA, 64 nt, hsa; identical to SEQ ID NO: 145755

SEQ ID NO: 626898 - RNA, 64 nt, hsa; identical to SEQ ID NO: 145756

SEQ ID NO: 626899 - RNA, 64 nt, hsa; identical to SEQ ID NO: 145757

SEQ ID NO: 626900 - RNA, 64 nt, hsa; identical to SEQ ID NO: 145758

SEQ ID NO: 626901 - RNA, 64 nt, hsa; identical to SEQ ID NO: 145759

SEQ ID NO: 626902 - RNA, 64 nt, hsa; identical to SEQ ID NO: 145760

SEQ ID NO: 626903 - RNA, 64 nt, hsa; identical to SEQ ID NO: 145761

SEQ ID NO: 626904 - RNA, 64 nt, hsa; identical to SEQ ID NO: 145762

SEQ ID NO: 626905 - RNA, 64 nt, hsa; identical to SEQ ID NO: 145763

SEQ ID NO: 626906 - RNA, 64 nt, hsa; identical to SEQ ID NO: 145764

SEQ ID NO: 626907 - RNA, 64 nt, hsa; identical to SEQ ID NO: 145765

SEQ ID NO: 626908 - RNA, 64 nt, hsa; identical to SEQ ID NO: 145766

SEQ ID NO: 626909 - RNA, 64 nt, hsa; identical to SEQ ID NO: 145767

SEQ ID NO: 626910 - RNA, 64 nt, hsa; identical to SEQ ID NO: 145768

SEQ ID NO: 626911 - RNA, 64 nt, hsa; identical to SEQ ID NO: 145769

SEQ ID NO: 626912 - RNA, 64 nt, hsa; identical to SEQ ID NO: 145770

SEQ ID NO: 626913 - RNA, 64 nt, hsa; identical to SEQ ID NO: 145771

SEQ ID NO: 626914 - RNA, 64 nt, hsa; identical to SEQ ID NO: 145772

SEQ ID NO: 626915 - RNA, 64 nt, hsa; identical to SEQ ID NO: 145773

SEQ ID NO: 626916 - RNA, 64 nt, hsa; identical to SEQ ID NO: 145774

SEQ ID NO: 626917 - RNA, 64 nt, hsa; identical to SEQ ID NO: 145775

SEQ ID NO: 626918 - RNA, 64 nt, hsa; identical to SEQ ID NO: 145776

SEQ ID NO: 626919 - RNA, 64 nt, hsa; identical to SEQ ID NO: 145777

SEQ ID NO: 626920 - RNA, 64 nt, hsa; identical to SEQ ID NO: 145778

SEQ ID NO: 626921 - RNA, 64 nt, hsa; identical to SEQ ID NO: 145779

SEQ ID NO: 626922 - RNA, 64 nt, hsa; identical to SEQ ID NO: 145780

SEQ ID NO: 626923 - RNA, 64 nt, hsa; identical to SEQ ID NO: 145781

SEQ ID NO: 626924 - RNA, 64 nt, hsa; identical to SEQ ID NO: 145782

SEQ ID NO: 626925 - RNA, 64 nt, hsa; identical to SEQ ID NO: 145783

SEQ ID NO: 626926 - RNA, 64 nt, hsa; identical to SEQ ID NO: 145784

SEQ ID NO: 626927 - RNA, 64 nt, hsa; identical to SEQ ID NO: 145785

SEQ ID NO: 626928 - RNA, 64 nt, hsa; identical to SEQ ID NO: 145786

SEQ ID NO: 626929 - RNA, 64 nt, hsa; identical to SEQ ID NO: 145787

SEQ ID NO: 626930 - RNA, 64 nt, hsa; identical to SEQ ID NO: 145788

SEQ ID NO: 626931 - RNA, 64 nt, hsa; identical to SEQ ID NO: 145789

SEQ ID NO: 626932 - RNA, 64 nt, hsa; identical to SEQ ID NO: 145790

SEQ ID NO: 626933 - RNA, 64 nt, hsa; identical to SEQ ID NO: 145791

SEQ ID NO: 626934 - RNA, 64 nt, hsa; identical to SEQ ID NO: 145792

SEQ ID NO: 626935 - RNA, 64 nt, hsa; identical to SEQ ID NO: 145793

SEQ ID NO: 626936 - RNA, 64 nt, hsa; identical to SEQ ID NO: 145794

SEQ ID NO: 626937 - RNA, 64 nt, hsa; identical to SEQ ID NO: 145795

SEQ ID NO: 626938 - RNA, 64 nt, hsa; identical to SEQ ID NO: 145796

SEQ ID NO: 626939 - RNA, 64 nt, hsa; identical to SEQ ID NO: 145797

SEQ ID NO: 626940 - RNA, 64 nt, hsa; identical to SEQ ID NO: 145798

SEQ ID NO: 626941 - RNA, 64 nt, hsa; identical to SEQ ID NO: 145799

SEQ ID NO: 626942 - RNA, 64 nt, hsa; identical to SEQ ID NO: 145800

SEQ ID NO: 626943 - RNA, 64 nt, hsa; identical to SEQ ID NO: 145801

SEQ ID NO: 626944 - RNA, 64 nt, hsa; identical to SEQ ID NO: 145802

SEQ ID NO: 626945 - RNA, 64 nt, hsa; identical to SEQ ID NO: 145803

SEQ ID NO: 626946 - RNA, 64 nt, hsa; identical to SEQ ID NO: 145804

SEQ ID NO: 626947 - RNA, 64 nt, hsa; identical to SEQ ID NO: 145805

SEQ ID NO: 626948 - RNA, 64 nt, hsa; identical to SEQ ID NO: 145806

SEQ ID NO: 626949 - RNA, 55 nt, hsa; identical to SEQ ID NO: 145807

SEQ ID NO: 626950 - RNA, 64 nt, hsa; identical to SEQ ID NO: 145808

SEQ ID NO: 626951 - RNA, 64 nt, hsa; identical to SEQ ID NO: 145809

SEQ ID NO: 626952 - RNA, 64 nt, hsa; identical to SEQ ID NO: 145810

SEQ ID NO: 626953 - RNA, 64 nt, hsa; identical to SEQ ID NO: 145811

SEQ ID NO: 626954 - RNA, 64 nt, hsa; identical to SEQ ID NO: 145812

SEQ ID NO: 626955 - RNA, 64 nt, hsa; identical to SEQ ID NO: 145813

SEQ ID NO: 626956 - RNA, 64 nt, hsa; identical to SEQ ID NO: 145814

SEQ ID NO: 626957 - RNA, 64 nt, hsa; identical to SEQ ID NO: 145815

SEQ ID NO: 626958 - RNA, 64 nt, hsa; identical to SEQ ID NO: 145816

SEQ ID NO: 626959 - RNA, 64 nt, hsa; identical to SEQ ID NO: 145817

SEQ ID NO: 626960 - RNA, 64 nt, hsa; identical to SEQ ID NO: 145818

SEQ ID NO: 626961 - RNA, 64 nt, hsa; identical to SEQ ID NO: 145819

SEQ ID NO: 626962 - RNA, 64 nt, hsa; identical to SEQ ID NO: 145820

SEQ ID NO: 626963 - RNA, 64 nt, hsa; identical to SEQ ID NO: 145821

SEQ ID NO: 626964 - RNA, 64 nt, hsa; identical to SEQ ID NO: 145822

SEQ ID NO: 626965 - RNA, 64 nt, hsa; identical to SEQ ID NO: 145823

SEQ ID NO: 626966 - RNA, 64 nt, hsa; identical to SEQ ID NO: 145824

SEQ ID NO: 626967 - RNA, 64 nt, hsa; identical to SEQ ID NO: 145825

SEQ ID NO: 626968 - RNA, 64 nt, hsa; identical to SEQ ID NO: 145826

SEQ ID NO: 626969 - RNA, 64 nt, hsa; identical to SEQ ID NO: 145827

SEQ ID NO: 626970 - RNA, 64 nt, hsa; identical to SEQ ID NO: 145828

SEQ ID NO: 626971 - RNA, 64 nt, hsa; identical to SEQ ID NO: 145829

SEQ ID NO: 626972 - RNA, 64 nt, hsa; identical to SEQ ID NO: 145830

SEQ ID NO: 626973 - RNA, 64 nt, hsa; identical to SEQ ID NO: 145831

SEQ ID NO: 626974 - RNA, 64 nt, hsa; identical to SEQ ID NO: 145832

SEQ ID NO: 626975 - RNA, 64 nt, hsa; identical to SEQ ID NO: 145833

SEQ ID NO: 626976 - RNA, 64 nt, hsa; identical to SEQ ID NO: 145834

SEQ ID NO: 626977 - RNA, 64 nt, hsa; identical to SEQ ID NO: 145835

SEQ ID NO: 626978 - RNA, 64 nt, hsa; identical to SEQ ID NO: 145836

SEQ ID NO: 626979 - RNA, 63 nt, hsa; identical to SEQ ID NO: 145837

SEQ ID NO: 626980 - RNA, 64 nt, hsa; identical to SEQ ID NO: 145838

SEQ ID NO: 626981 - RNA, 64 nt, hsa; identical to SEQ ID NO: 145839

SEQ ID NO: 626982 - RNA, 64 nt, hsa; identical to SEQ ID NO: 145840

SEQ ID NO: 626983 - RNA, 64 nt, hsa; identical to SEQ ID NO: 145841

SEQ ID NO: 626984 - RNA, 64 nt, hsa; identical to SEQ ID NO: 145842

SEQ ID NO: 626985 - RNA, 64 nt, hsa; identical to SEQ ID NO: 145843

SEQ ID NO: 626986 - RNA, 64 nt, hsa; identical to SEQ ID NO: 145844

SEQ ID NO: 626987 - RNA, 64 nt, hsa; identical to SEQ ID NO: 145845

SEQ ID NO: 626988 - RNA, 64 nt, hsa; identical to SEQ ID NO: 145846

SEQ ID NO: 626989 - RNA, 64 nt, hsa; identical to SEQ ID NO: 145847

SEQ ID NO: 626990 - RNA, 64 nt, hsa; identical to SEQ ID NO: 145848

SEQ ID NO: 626991 - RNA, 64 nt, hsa; identical to SEQ ID NO: 145849

SEQ ID NO: 626992 - RNA, 64 nt, hsa; identical to SEQ ID NO: 145850

SEQ ID NO: 626993 - RNA, 64 nt, hsa; identical to SEQ ID NO: 145851

SEQ ID NO: 626994 - RNA, 64 nt, hsa; identical to SEQ ID NO: 145852

SEQ ID NO: 626995 - RNA, 64 nt, hsa; identical to SEQ ID NO: 145853

SEQ ID NO: 626996 - RNA, 64 nt, hsa; identical to SEQ ID NO: 145854

SEQ ID NO: 626997 - RNA, 64 nt, hsa; identical to SEQ ID NO: 145855

SEQ ID NO: 626998 - RNA, 64 nt, hsa; identical to SEQ ID NO: 145856

SEQ ID NO: 626999 - RNA, 64 nt, hsa; identical to SEQ ID NO: 145857

SEQ ID NO: 627000 - RNA, 64 nt, hsa; identical to SEQ ID NO: 145858

SEQ ID NO: 627001 - RNA, 64 nt, hsa; identical to SEQ ID NO: 145859

SEQ ID NO: 627002 - RNA, 64 nt, hsa; identical to SEQ ID NO: 145860

SEQ ID NO: 627003 - RNA, 64 nt, hsa; identical to SEQ ID NO: 145861

SEQ ID NO: 627004 - RNA, 64 nt, hsa; identical to SEQ ID NO: 145862

SEQ ID NO: 627005 - RNA, 64 nt, hsa; identical to SEQ ID NO: 145863

SEQ ID NO: 627006 - RNA, 64 nt, hsa; identical to SEQ ID NO: 145864

SEQ ID NO: 627007 - RNA, 64 nt, hsa; identical to SEQ ID NO: 145865

SEQ ID NO: 627008 - RNA, 64 nt, hsa; identical to SEQ ID NO: 145866

SEQ ID NO: 627009 - RNA, 64 nt, hsa; identical to SEQ ID NO: 145867

SEQ ID NO: 627010 - RNA, 64 nt, hsa; identical to SEQ ID NO: 145868

SEQ ID NO: 627011 - RNA, 64 nt, hsa; identical to SEQ ID NO: 145869

SEQ ID NO: 627012 - RNA, 64 nt, hsa; identical to SEQ ID NO: 145870

SEQ ID NO: 627013 - RNA, 64 nt, hsa; identical to SEQ ID NO: 145871

SEQ ID NO: 627014 - RNA, 64 nt, hsa; identical to SEQ ID NO: 145872

SEQ ID NO: 627015 - RNA, 64 nt, hsa; identical to SEQ ID NO: 145873

SEQ ID NO: 627016 - RNA, 64 nt, hsa; identical to SEQ ID NO: 145874

SEQ ID NO: 627017 - RNA, 64 nt, hsa; identical to SEQ ID NO: 145875

SEQ ID NO: 627018 - RNA, 64 nt, hsa; identical to SEQ ID NO: 145876

SEQ ID NO: 627019 - RNA, 64 nt, hsa; identical to SEQ ID NO: 145877

SEQ ID NO: 627020 - RNA, 64 nt, hsa; identical to SEQ ID NO: 145878

SEQ ID NO: 627021 - RNA, 64 nt, hsa; identical to SEQ ID NO: 145879

SEQ ID NO: 627022 - RNA, 64 nt, hsa; identical to SEQ ID NO: 145880

SEQ ID NO: 627023 - RNA, 64 nt, hsa; identical to SEQ ID NO: 145881

SEQ ID NO: 627024 - RNA, 64 nt, hsa; identical to SEQ ID NO: 145882

SEQ ID NO: 627025 - RNA, 64 nt, hsa; identical to SEQ ID NO: 145883

SEQ ID NO: 627026 - RNA, 64 nt, hsa; identical to SEQ ID NO: 145884

SEQ ID NO: 627027 - RNA, 64 nt, hsa; identical to SEQ ID NO: 145885

SEQ ID NO: 627028 - RNA, 64 nt, hsa; identical to SEQ ID NO: 145886

SEQ ID NO: 627029 - RNA, 64 nt, hsa; identical to SEQ ID NO: 145887

SEQ ID NO: 627030 - RNA, 64 nt, hsa; identical to SEQ ID NO: 145888

SEQ ID NO: 627031 - RNA, 64 nt, hsa; identical to SEQ ID NO: 145889

SEQ ID NO: 627032 - RNA, 64 nt, hsa; identical to SEQ ID NO: 119656

SEQ ID NO: 627033 - RNA, 64 nt, hsa; identical to SEQ ID NO: 119657

SEQ ID NO: 627034 - RNA, 64 nt, hsa; identical to SEQ ID NO: 119658

SEQ ID NO: 627035 - RNA, 64 nt, hsa; identical to SEQ ID NO: 119659

SEQ ID NO: 627036 - RNA, 64 nt, hsa; identical to SEQ ID NO: 119660

SEQ ID NO: 627037 - RNA, 64 nt, hsa; identical to SEQ ID NO: 119661

SEQ ID NO: 627038 - RNA, 64 nt, hsa; identical to SEQ ID NO: 119662

SEQ ID NO: 627039 - RNA, 64 nt, hsa; identical to SEQ ID NO: 119663

SEQ ID NO: 627040 - RNA, 64 nt, hsa; identical to SEQ ID NO: 119664

SEQ ID NO: 627041 - RNA, 64 nt, hsa; identical to SEQ ID NO: 119665

SEQ ID NO: 627042 - RNA, 64 nt, hsa; identical to SEQ ID NO: 119666

SEQ ID NO: 627043 - RNA, 64 nt, hsa; identical to SEQ ID NO: 119667

SEQ ID NO: 627044 - RNA, 64 nt, hsa; identical to SEQ ID NO: 119668

SEQ ID NO: 627045 - RNA, 64 nt, hsa; identical to SEQ ID NO: 119669

SEQ ID NO: 627046 - RNA, 64 nt, hsa; identical to SEQ ID NO: 119670

SEQ ID NO: 627047 - RNA, 64 nt, hsa; identical to SEQ ID NO: 119671

SEQ ID NO: 627048 - RNA, 64 nt, hsa; identical to SEQ ID NO: 119672

SEQ ID NO: 627049 - RNA, 64 nt, hsa; identical to SEQ ID NO: 119673

SEQ ID NO: 627050 - RNA, 64 nt, hsa; identical to SEQ ID NO: 119674

SEQ ID NO: 627051 - RNA, 64 nt, hsa; identical to SEQ ID NO: 119675

SEQ ID NO: 627052 - RNA, 64 nt, hsa; identical to SEQ ID NO: 119676

SEQ ID NO: 627053 - RNA, 64 nt, hsa; identical to SEQ ID NO: 119677

SEQ ID NO: 627054 - RNA, 64 nt, hsa; identical to SEQ ID NO: 119678

SEQ ID NO: 627055 - RNA, 64 nt, hsa; identical to SEQ ID NO: 119679

SEQ ID NO: 627056 - RNA, 58 nt, hsa; identical to SEQ ID NO: 144416

SEQ ID NO: 627057 - RNA, 64 nt, hsa; identical to SEQ ID NO: 144417

SEQ ID NO: 627058 - RNA, 64 nt, hsa; identical to SEQ ID NO: 144418

SEQ ID NO: 627059 - RNA, 64 nt, hsa; identical to SEQ ID NO: 144419

SEQ ID NO: 627060 - RNA, 64 nt, hsa; identical to SEQ ID NO: 144420

SEQ ID NO: 627061 - RNA, 64 nt, hsa; identical to SEQ ID NO: 144421

SEQ ID NO: 627062 - RNA, 64 nt, hsa; identical to SEQ ID NO: 144422

SEQ ID NO: 627063 - RNA, 64 nt, hsa; identical to SEQ ID NO: 144423

SEQ ID NO: 627064 - RNA, 64 nt, hsa; identical to SEQ ID NO: 144424

SEQ ID NO: 627065 - RNA, 64 nt, hsa; identical to SEQ ID NO: 144425

SEQ ID NO: 627066 - RNA, 64 nt, hsa; identical to SEQ ID NO: 144426

SEQ ID NO: 627067 - RNA, 64 nt, hsa; identical to SEQ ID NO: 144427

SEQ ID NO: 627068 - RNA, 64 nt, hsa; identical to SEQ ID NO: 144428

SEQ ID NO: 627069 - RNA, 64 nt, hsa; identical to SEQ ID NO: 144429

SEQ ID NO: 627070 - RNA, 64 nt, hsa; identical to SEQ ID NO: 144430

SEQ ID NO: 627071 - RNA, 64 nt, hsa; identical to SEQ ID NO: 144431

SEQ ID NO: 627072 - RNA, 64 nt, hsa; identical to SEQ ID NO: 144432

SEQ ID NO: 627073 - RNA, 64 nt, hsa; identical to SEQ ID NO: 144433

SEQ ID NO: 627074 - RNA, 64 nt, hsa; identical to SEQ ID NO: 144434

SEQ ID NO: 627075 - RNA, 64 nt, hsa; identical to SEQ ID NO: 144435

SEQ ID NO: 627076 - RNA, 64 nt, hsa; identical to SEQ ID NO: 144436

SEQ ID NO: 627077 - RNA, 64 nt, hsa; identical to SEQ ID NO: 144437

SEQ ID NO: 627078 - RNA, 64 nt, hsa; identical to SEQ ID NO: 144438

SEQ ID NO: 627079 - RNA, 64 nt, hsa; identical to SEQ ID NO: 144439

SEQ ID NO: 627080 - RNA, 64 nt, hsa; identical to SEQ ID NO: 144440

SEQ ID NO: 627081 - RNA, 64 nt, hsa; identical to SEQ ID NO: 144441

SEQ ID NO: 627082 - RNA, 64 nt, hsa; identical to SEQ ID NO: 144442

SEQ ID NO: 627083 - RNA, 64 nt, hsa; identical to SEQ ID NO: 144443

SEQ ID NO: 627084 - RNA, 64 nt, hsa; identical to SEQ ID NO: 144444

SEQ ID NO: 627085 - RNA, 64 nt, hsa; identical to SEQ ID NO: 144445

SEQ ID NO: 627086 - RNA, 64 nt, hsa; identical to SEQ ID NO: 144446

SEQ ID NO: 627087 - RNA, 64 nt, hsa; identical to SEQ ID NO: 144447

SEQ ID NO: 627088 - RNA, 64 nt, hsa
aaauaguagcagagucauuguuacagguguacuauggcuguauuuuuagagauuaauuugugua

SEQ ID NO: 627089 - RNA, 64 nt, hsa
aaauagcaucugcucuucucuuacgcucucugucuggcuguacgucugguguucucaaugcuuu

SEQ ID NO: 627090 - RNA, 64 nt, hsa
cuacuaaaaaauacaaaaaauuagccgggcgugguggcuguagucgcagcuacucaggaggcug

SEQ ID NO: 627091 - RNA, 64 nt, hsa
ugcgcccguguguaugugcauaugugaguguguguggcuguaaccugcacgucucuucugucau

SEQ ID NO: 627092 - RNA, 64 nt, hsa
ugaaguguuaggauuacaggcgugagccugcgccuggcuguaauuacuauacccaguuuuuaca

SEQ ID NO: 627093 - RNA, 64 nt, hsa
uaaguaguagaaccaggaguuggauuuagcagucuggcuguagagucaucaauaguuugcacau

SEQ ID NO: 627094 - RNA, 64 nt, hsa
uacuuuggcuguauugaaaaauauaaauccaugauggcuguacaaauaauuuagccucauucau

SEQ ID NO: 627095 - RNA, 64 nt, hsa
aaaguaggcauuuuaauauuguaaacauauacuuuggcuguauugaaaaauauaaauccaugau

SEQ ID NO: 627096 - RNA, 64 nt, hsa
gaguacccaaauuggauuguauuuuaauggacaauggcuguauuuuuuccauguuagaaggauc

SEQ ID NO: 627097 - RNA, 64 nt, hsa
cagcuuaggaggcugcuaguuaggaagauggcaguggcuguaggcuggguugccagaaaagaug

SEQ ID NO: 627098 - RNA, 64 nt, hsa
cuaccugggaggagugaguuccuccaguuaaauguggcuguagauguuggaggcuagggaggcu

SEQ ID NO: 627099 - RNA, 64 nt, hsa
cuaaaaaaaagguuuuuuuuuuccuuuuggaauauggcuguaagaagcagcauuuugucuuauu

SEQ ID NO: 627100 - RNA, 64 nt, hsa
gcagcugcugguuuugguuuccaccuuacccuacuggcuguaaaaacacaaauguguacuuuau

SEQ ID NO: 627101 - RNA, 64 nt, hsa
gguuuauaaucugacaaagucaugaagcucaguuuggcuguaauuuaauuccccuucccuuauu

SEQ ID NO: 627102 - RNA, 64 nt, hsa
uuaagaguucuugauauuagauaacuccaacuucuggcuguagagcacccagccaagagaauaa

SEQ ID NO: 627103 - RNA, 64 nt, hsa
cauucuagaauguccaaagggaaucaggauucuguggcuguagacugaucacagagucaaggaa

SEQ ID NO: 627104 - RNA, 64 nt, hsa
aaucacaucuaauuuauaggguuuuugggaggauuaagucaauccguguaaaauucuuaauuau

SEQ ID NO: 627105 - RNA, 64 nt, hsa
auuuaaaaauguaauagggaaaauauuuaauuuuuaagucaaaaacuaugcuuuaaaggaauua

SEQ ID NO: 627106 - RNA, 64 nt, hsa
aacacuguaaaauagauugaugugucagcuauauuaagucaacguacaguuugcuugaguuaua

SEQ ID NO: 627107 - RNA, 64 nt, hsa
uauuuccuuuccucuggguuuaagugauuuuauuuaagucaacuaaggggauuuaacaguggac

SEQ ID NO: 627108 - RNA, 64 nt, hsa; identical to SEQ ID NO: 282609

SEQ ID NO: 627109 - RNA, 64 nt, hsa; identical to SEQ ID NO: 282610

SEQ ID NO: 627110 - RNA, 64 nt, hsa; identical to SEQ ID NO: 282611

SEQ ID NO: 627111 - RNA, 64 nt, hsa; identical to SEQ ID NO: 282612

SEQ ID NO: 627112 - RNA, 64 nt, hsa; identical to SEQ ID NO: 282613

SEQ ID NO: 627113 - RNA, 64 nt, hsa; identical to SEQ ID NO: 282614

SEQ ID NO: 627114 - RNA, 64 nt, hsa; identical to SEQ ID NO: 282615

SEQ ID NO: 627115 - RNA, 64 nt, hsa; identical to SEQ ID NO: 282616

SEQ ID NO: 627116 - RNA, 64 nt, hsa; identical to SEQ ID NO: 282617

SEQ ID NO: 627117 - RNA, 64 nt, hsa; identical to SEQ ID NO: 282618

SEQ ID NO: 627118 - RNA, 64 nt, hsa; identical to SEQ ID NO: 126433

SEQ ID NO: 627119 - RNA, 64 nt, hsa; identical to SEQ ID NO: 126434

SEQ ID NO: 627120 - RNA, 64 nt, hsa; identical to SEQ ID NO: 126435

SEQ ID NO: 627121 - RNA, 64 nt, hsa; identical to SEQ ID NO: 126436

SEQ ID NO: 627122 - RNA, 64 nt, hsa; identical to SEQ ID NO: 126437

SEQ ID NO: 627123 - RNA, 64 nt, hsa; identical to SEQ ID NO: 126438

SEQ ID NO: 627124 - RNA, 64 nt, hsa; identical to SEQ ID NO: 126439

SEQ ID NO: 627125 - RNA, 64 nt, hsa; identical to SEQ ID NO: 126440

SEQ ID NO: 627126 - RNA, 64 nt, hsa; identical to SEQ ID NO: 126441

SEQ ID NO: 627127 - RNA, 64 nt, hsa; identical to SEQ ID NO: 126442

SEQ ID NO: 627128 - RNA, 64 nt, hsa; identical to SEQ ID NO: 126443

SEQ ID NO: 627129 - RNA, 64 nt, hsa; identical to SEQ ID NO: 126444

SEQ ID NO: 627130 - RNA, 64 nt, hsa; identical to SEQ ID NO: 126445

SEQ ID NO: 627131 - RNA, 64 nt, hsa; identical to SEQ ID NO: 126446

SEQ ID NO: 627132 - RNA, 64 nt, hsa; identical to SEQ ID NO: 126447

SEQ ID NO: 627133 - RNA, 64 nt, hsa; identical to SEQ ID NO: 126448

SEQ ID NO: 627134 - RNA, 64 nt, hsa; identical to SEQ ID NO: 126449

SEQ ID NO: 627135 - RNA, 64 nt, hsa; identical to SEQ ID NO: 126450

SEQ ID NO: 627136 - RNA, 64 nt, hsa; identical to SEQ ID NO: 126451

SEQ ID NO: 627137 - RNA, 64 nt, hsa; identical to SEQ ID NO: 126452

SEQ ID NO: 627138 - RNA, 64 nt, hsa; identical to SEQ ID NO: 126453

SEQ ID NO: 627139 - RNA, 64 nt, hsa; identical to SEQ ID NO: 126454

SEQ ID NO: 627140 - RNA, 64 nt, hsa; identical to SEQ ID NO: 126455

SEQ ID NO: 627141 - RNA, 64 nt, hsa; identical to SEQ ID NO: 126456

SEQ ID NO: 627142 - RNA, 64 nt, hsa; identical to SEQ ID NO: 126457

SEQ ID NO: 627143 - RNA, 64 nt, hsa; identical to SEQ ID NO: 126458

SEQ ID NO: 627144 - RNA, 64 nt, hsa; identical to SEQ ID NO: 201795

SEQ ID NO: 627145 - RNA, 64 nt, hsa; identical to SEQ ID NO: 201796

SEQ ID NO: 627146 - RNA, 64 nt, hsa
aaggaagaagcaaaauaucacaucucuagaaguguugggaaaaauauaauuucuuucuuuacuu

SEQ ID NO: 627147 - RNA, 64 nt, hsa
cuagcauaauuuaaaaaaucaguguuuuuaggauuugggaaaauaaacuguaaauguuuauuug

SEQ ID NO: 627148 - RNA, 64 nt, hsa
aaaaagaacagaccuagcucugaauuuguuuggcuugggaaauuauggauucuuucaagccacu

SEQ ID NO: 627149 - RNA, 64 nt, hsa
guguaugauggauguguaugaaaaaaauguaucuuugggaaaacaauuacaguuuguuaauuug

SEQ ID NO: 627150 - RNA, 64 nt, hsa
caaaacguuggacuauuugggaaaaggaaaagaguugggaaaauugguuuuaagguaaguuuua

SEQ ID NO: 627151 - RNA, 64 nt, hsa
gccucauauauuucuccucaaaacguuggacuauuugggaaaaggaaaagaguugggaaaauug

SEQ ID NO: 627152 - RNA, 64 nt, hsa
ucuucauugugcacacaggacaaaucugaucucuuugggaaaaaauagaaauaaaacaaucucc

SEQ ID NO: 627153 - RNA, 64 nt, hsa
aaucuuaaaacuacaaguuguaaguauucugaaauugggaaacauuuauuuuaaaugcaaucag

SEQ ID NO: 627154 - RNA, 64 nt, hsa
aaagcucaggcugcauuagaguaugaauuuagcauugggaaaagcccuuauucuugaaucuaga

SEQ ID NO: 627155 - RNA, 64 nt, hsa
ugauuuuccuauuuuaacaguaccaacuaguuaauugggaaauguaaguucugaauguucacau

SEQ ID NO: 627156 - RNA, 64 nt, hsa
uauuagggugguauuuagucuauuagccacaaaauugggaaaggaguagaaaaagcaguaacug

SEQ ID NO: 627157 - RNA, 64 nt, hsa
acacccaaaguaucaggacgagaaugaggguccuuugggaaaggagaaguuaagcaacaucuag

SEQ ID NO: 627158 - RNA, 64 nt, hsa
ucugggcaaacaggugggacuguuagugacccauuugggaaaauagagcaucucagagaaggag

SEQ ID NO: 627159 - RNA, 64 nt, hsa
uucuagugccucuucccugcagggcagggaccccuugggaaaucgaggaggugggacgggcugg

SEQ ID NO: 627160 - RNA, 64 nt, hsa
auaauaacuacuuccaucccugcuuauuuuuaauuugggaaaauaaauacauucgaaggaaccu

SEQ ID NO: 627161 - RNA, 64 nt, hsa
uguugaucucaguauugucaggggaacagagaaguugggaaaagauuacugaaauauaccuuuu

SEQ ID NO: 627162 - RNA, 64 nt, hsa
uaaauugguaauagaagaugcugcuugcuuagaauugggaaauucggcugggugcagugacuca

SEQ ID NO: 627163 - RNA, 64 nt, hsa
agugagugagacucggucucaaacaaaaaccaaauugggaaauucuucuugaguuaaaaaagac

SEQ ID NO: 627164 - RNA, 64 nt, hsa
auuuaauaccagauaccuuaucuuacaauauugauugggaaaacauuugcugccauuacagagg

SEQ ID NO: 627165 - RNA, 64 nt, hsa
uuaaaccacuuaaacgaagaguucccuugaaacuuugggaaaacauguuaaugacaauauucca

SEQ ID NO: 627166 - RNA, 64 nt, hsa
uguuuucuuuaagcaccuuuuuuuuuuuuuuccauugggaaauggcugaugaguucacauuuag

SEQ ID NO: 627167 - RNA, 64 nt, hsa
ccuaagccccaucguagcacaguauuacaugugguugggaaaaauaaaaauacaguggugugga

SEQ ID NO: 627168 - RNA, 64 nt, hsa
auaauuuaaaaggaaaacuaaaaacuauuuugauuugggaaaaugagccuuaauuuguuaaacc

SEQ ID NO: 627169 - RNA, 64 nt, hsa
caacuccuaugaguggcaacugaaguucuuauuguugggaaagaacacuaguccuaccucugcc

SEQ ID NO: 627170 - RNA, 64 nt, hsa
uuggccuggccagagcagcagugcugaucuucauuugggaaaggauguuccuggguauuaccaa

SEQ ID NO: 627171 - RNA, 64 nt, hsa
auuuucuuucuuuugagguauuccauaaaaguaguugggaaaauuauuauguaaaauaauaaga

SEQ ID NO: 627172 - RNA, 64 nt, hsa
aaguugacaccaaugugucauaauauucuuuauuuugggaaauuaguguauuuuauaaaaauuu

SEQ ID NO: 627173 - RNA, 64 nt, hsa
uagaaaucccaguucucuaauuugguuuucuucuuugggaaaccaaacauacaaaugaaucagu

SEQ ID NO: 627174 - RNA, 64 nt, hsa
cuuuucuccuuguuauuugcccuucagaaugcacuugggaaaggcugguuccuuagccuccugg

SEQ ID NO: 627175 - RNA, 64 nt, hsa
acaaacauguuuuugugaaagcuacugaagugccuugggaaaugagaaaguuuuaauaaguaaa

SEQ ID NO: 627176 - RNA, 64 nt, hsa
cuuaauguguauagagaccccagucuacuauuauuugggaaaauuguuuagguuauaugggaaa

SEQ ID NO: 627177 - RNA, 64 nt, hsa
uucucuaauccacugaaauuauugugugcuaaauuugggaaacagaucuauucuaacucauuaa

SEQ ID NO: 627178 - RNA, 64 nt, hsa
uaaugucauuguaaccaucacuuaucuccucucauugggaaagcuacaugauaguauuuuuaug

SEQ ID NO: 627179 - RNA, 64 nt, hsa
aaauugaaacaaccauugcaauacagccaaagauuugggaaaaugugcaacugugauugucuug

SEQ ID NO: 627180 - RNA, 64 nt, hsa
uccagaagaauuccaccagauugcaugaguuagauugggaaaugggagugggagauaauauugg

SEQ ID NO: 627181 - RNA, 64 nt, hsa
caaauauaaucuuuaauaaacuugauuuaguuucuugggaaauuuauuuucuacgcuauucaaa

SEQ ID NO: 627182 - RNA, 64 nt, hsa
caggcacuuggugagaaugggaagcauccauucauugggaaaucacggggacagaggaggaauu

SEQ ID NO: 627183 - RNA, 64 nt, hsa
ccagcagcagcucagcagcagcagugagagggccuugggaaagacuuggaggguuuggcuuaua

SEQ ID NO: 627184 - RNA, 64 nt, hsa
ggcacaaauuuagucuggucauuuuguuuacacauugggaaaaaaauuaguuuauuaaacauua

SEQ ID NO: 627185 - RNA, 64 nt, hsa
ugacaucuggacuggauuuaugcuugaugcauuguugggaaaauaugcaauacaaacugguauc

SEQ ID NO: 627186 - RNA, 64 nt, hsa
aguagccgguggagauacaaguucucugacuguguugggaaaggauaagugcuaccguugagaa

SEQ ID NO: 627187 - RNA, 64 nt, hsa
accuaucugucuaccaguagcgguccuugcccauuugggaaacugagcuucuuucuucugcacu

SEQ ID NO: 627188 - RNA, 64 nt, hsa
uuuuucaguuacccuuuaaggagucccuuugucuuugggaaaguagcagaaugguccgcuucuu

SEQ ID NO: 627189 - RNA, 64 nt, hsa
aauaaacuaaagccuggauuugauauuacaaauuuugggaaaucuuagaauaaagaacgagaac

SEQ ID NO: 627190 - RNA, 64 nt, hsa
uuuuuaaaccaaguugagugaauugguaguggacuugggaaaucuuccccagcagaaucuggau

SEQ ID NO: 627191 - RNA, 64 nt, hsa
ugggggaaaaaggggauucuguggucagaugaguuugggaaaugcugaacacuucauucuucuu

SEQ ID NO: 627192 - RNA, 64 nt, hsa
agagcacacacucccuaauugucagaugguuuuuuugggaaaacucuuagauaguacagugagu

SEQ ID NO: 627193 - RNA, 64 nt, hsa
cuacucuccuucuuuuucugcuuucauuuuaauuuugggaaauuuuaaaguaaaaguuucaaag

SEQ ID NO: 627194 - RNA, 64 nt, hsa
uuugcaacagcacacauaguuucugguauauuuguugggaaagauaaaacucuagcaguuguug

SEQ ID NO: 627195 - RNA, 64 nt, hsa
aucuggagcuggcacuguggagaccacacacccuuugggaaagcucuugucucuucuuccccca

SEQ ID NO: 627196 - RNA, 64 nt, hsa
uguugcuucggggcauaagcugaucaccgucuaguugggaaaguaacccuacaggguuuguagg

SEQ ID NO: 627197 - RNA, 64 nt, hsa
ucucauuccaccucuucucagagcaacucuuccuuugggaaaagaguucuucagaucauagacc

SEQ ID NO: 627198 - RNA, 64 nt, hsa
uccagagucauucaggaaggacaagggaacacccuugggaaaugggcuaguggagggcuguuga

SEQ ID NO: 627199 - RNA, 64 nt, hsa
gcuagauaucuuucccucuuuuucacuuugagcuuugggaaaacucuuuaucuuaugaggcugu

SEQ ID NO: 627200 - RNA, 64 nt, hsa
uuucugugugacuuauuaggagauaggaagagcauugggaaacuugcacagcuagcuaugcauc

SEQ ID NO: 627201 - RNA, 64 nt, hsa
agaugaaaugucaauauaagaaaaaucaagguauuugggaaacaugggcauaaucagguaguuu

SEQ ID NO: 627202 - RNA, 64 nt, hsa
ccacaucugcguccucaagaccuguuucauccauuugggaaaagauguugggaaaggccacuuu

SEQ ID NO: 627203 - RNA, 64 nt, hsa
cucaagaccuguuucauccauuugggaaaagauguugggaaaggccacuuugcucgcaggggug

SEQ ID NO: 627204 - RNA, 64 nt, hsa
uaucuagucaagaagcccuuuuggagcaaagugguugggaaacucauuuacuggguccaccaaa

SEQ ID NO: 627205 - RNA, 64 nt, hsa
acaugaguaaagcagugugguacacuccagggacuugggaaaaugagcaaacacacagcguguu

SEQ ID NO: 627206 - RNA, 64 nt, hsa
uuccucauuguuggggaugaugagaagaaaugauuugggaaaauuaaguaacaacgaccuagaa

SEQ ID NO: 627207 - RNA, 64 nt, hsa
agagcagcaccaccccacuggggcauccccagacuugggaaacgugacucuuucuuaaugccac

SEQ ID NO: 627208 - RNA, 64 nt, hsa
uccauccucugccccucccccuggcuucuuucucuugggaaaacgggcaaaauaauugugcugg

SEQ ID NO: 627209 - RNA, 64 nt, hsa
auaagggccuccccaguccucuccgggagaugauuugggaaauuuuauaaugcuuguucuguua

SEQ ID NO: 627210 - RNA, 64 nt, hsa
uuuuaguaaauucagcuuaaauauaaguugaaauuugggaaauaauuuccaagcucuuggaagg

SEQ ID NO: 627211 - RNA, 64 nt, hsa
agggaaauuauuuuaaguuauuacauuuacuguauugggaaacuugaggagaacucuuuaguuc

SEQ ID NO: 627212 - RNA, 64 nt, hsa
cugauuucuugccaagaggucucccaggagauauuugggaaaugugaaguucguaucuuuaagg

SEQ ID NO: 627213 - RNA, 64 nt, hsa
ucuccagcuucucauucaugaugaccucucaaaguugggaaacaagcugauuucuugccaagag

SEQ ID NO: 627214 - RNA, 64 nt, hsa
uauuucuuugguacuaccauguauuguguaacuuuugggaaaguaagguggcuucccugcucuc

SEQ ID NO: 627215 - RNA, 64 nt, hsa
gaaaacagaggcuuuaaauuaaaucaucuauuccuugggaaagguauuuuguaccauaugggac

SEQ ID NO: 627216 - RNA, 64 nt, hsa
uaaauacagcuuuaucccaaaagcuuuaacuguauugggaaaacuuaaaaaauagcauccucaa

SEQ ID NO: 627217 - RNA, 64 nt, hsa
uuuuuacugggggggauuugugauaggaaaguccuugggaaacauuuccaaucuuucaaaauau

SEQ ID NO: 627218 - RNA, 64 nt, hsa
acgccucuuuccgaggugaaggugggaccauuccuugggaaaggauucacaguaagguuuuuug

SEQ ID NO: 627219 - RNA, 64 nt, hsa
auccaaaugaugaugugcaauuucauguuuuaacuugggaaacugaaaguguucccauauagcu

SEQ ID NO: 627220 - RNA, 64 nt, hsa
auacuuuuaugguuacuaacuaguacuuuccuaauugggaaaguagugcuuaaguuugcaaauu

SEQ ID NO: 627221 - RNA, 64 nt, hsa
aaaccaacuggcucauggagaaaacaaauuugacuugggaaagggauuauguaggaauaauguu

SEQ ID NO: 627222 - RNA, 64 nt, hsa
aucaggacccucauguuuaaaugguuauuucccuuugggaaaacuucagaaacugauguaucaa

SEQ ID NO: 627223 - RNA, 64 nt, hsa
ccccucacccauuccuagugcucuugguauacacuugggaaaauaauguccuccaggagaaagu

SEQ ID NO: 627224 - RNA, 64 nt, hsa
gucuauacaguauaaacuaccucacuugccuuucuugggaaaaaaaaaaugaauggacuuuaac

SEQ ID NO: 627225 - RNA, 64 nt, hsa
aaccagcuucugauaaacacaaucugcuaggaacuugggaaaggaaucagagagcugcccuuca

SEQ ID NO: 627226 - RNA, 64 nt, hsa
accuucuugucauugaaauuuggcaaagcugacuuugggaaagagggaccagaacuuccccucc

SEQ ID NO: 627227 - RNA, 64 nt, hsa
acucacaugaggauggaggaacagaacagaggacuugggaaaagucucaacuugaugggguagc

SEQ ID NO: 627228 - RNA, 64 nt, hsa
caagcugcuggcuuuaagcuuaugcaagugguaguugggaaaguaggagguguggaagaggguu

SEQ ID NO: 627229 - RNA, 64 nt, hsa
uaaaaaaaaggucagaaggacaaagcugguuuguuugggaaauggacugaucgaaagaaaacuu

SEQ ID NO: 627230 - RNA, 64 nt, hsa
cagccauaccucuuaacaccucauagaacacacuuugggaaacaguggggguaggaaaacucgg

SEQ ID NO: 627231 - RNA, 64 nt, hsa
cagagagaugcugaguuaggccugucaggucuccuugggaaaggcuucauauuugcaacuuuga

SEQ ID NO: 627232 - RNA, 64 nt, hsa
ugaaggugaugcugccaaagcacaagccaguuucuugggaaaauucaaguuacaguggaguauu

SEQ ID NO: 627233 - RNA, 64 nt, hsa
accuucaugcagagauuuuauuucaccuuuaguuuugggaaaagcgagaaacagaugaucuaua

SEQ ID NO: 627234 - RNA, 64 nt, hsa
uuaugcagaauaauccaggcgugagaguguucucuugggaaaugacuggggagacaccugaaag

SEQ ID NO: 627235 - RNA, 64 nt, hsa; identical to SEQ ID NO: 126265

SEQ ID NO: 627236 - RNA, 64 nt, hsa; identical to SEQ ID NO: 126266

SEQ ID NO: 627237 - RNA, 64 nt, hsa; identical to SEQ ID NO: 126267

SEQ ID NO: 627238 - RNA, 64 nt, hsa; identical to SEQ ID NO: 126268

SEQ ID NO: 627239 - RNA, 64 nt, hsa; identical to SEQ ID NO: 126269

SEQ ID NO: 627240 - RNA, 64 nt, hsa; identical to SEQ ID NO: 126270

SEQ ID NO: 627241 - RNA, 64 nt, hsa; identical to SEQ ID NO: 126271

SEQ ID NO: 627242 - RNA, 64 nt, hsa; identical to SEQ ID NO: 126272

SEQ ID NO: 627243 - RNA, 64 nt, hsa; identical to SEQ ID NO: 126273

SEQ ID NO: 627244 - RNA, 64 nt, hsa; identical to SEQ ID NO: 126274

SEQ ID NO: 627245 - RNA, 64 nt, hsa; identical to SEQ ID NO: 126275

SEQ ID NO: 627246 - RNA, 64 nt, hsa; identical to SEQ ID NO: 126276

SEQ ID NO: 627247 - RNA, 64 nt, hsa; identical to SEQ ID NO: 126277

SEQ ID NO: 627248 - RNA, 64 nt, hsa; identical to SEQ ID NO: 126278

SEQ ID NO: 627249 - RNA, 64 nt, hsa; identical to SEQ ID NO: 126279

SEQ ID NO: 627250 - RNA, 64 nt, hsa; identical to SEQ ID NO: 126280

SEQ ID NO: 627251 - RNA, 64 nt, hsa; identical to SEQ ID NO: 225698

SEQ ID NO: 627252 - RNA, 64 nt, hsa; identical to SEQ ID NO: 225699

SEQ ID NO: 627253 - RNA, 64 nt, hsa; identical to SEQ ID NO: 225700

SEQ ID NO: 627254 - RNA, 64 nt, hsa; identical to SEQ ID NO: 225701

SEQ ID NO: 627255 - RNA, 64 nt, hsa; identical to SEQ ID NO: 225702

SEQ ID NO: 627256 - RNA, 64 nt, hsa; identical to SEQ ID NO: 225703

SEQ ID NO: 627257 - RNA, 64 nt, hsa; identical to SEQ ID NO: 225704

SEQ ID NO: 627258 - RNA, 64 nt, hsa; identical to SEQ ID NO: 225705

SEQ ID NO: 627259 - RNA, 64 nt, hsa; identical to SEQ ID NO: 225706

SEQ ID NO: 627260 - RNA, 64 nt, hsa; identical to SEQ ID NO: 225707

SEQ ID NO: 627261 - RNA, 64 nt, hsa; identical to SEQ ID NO: 225708

SEQ ID NO: 627262 - RNA, 64 nt, hsa; identical to SEQ ID NO: 225709

SEQ ID NO: 627263 - RNA, 64 nt, hsa; identical to SEQ ID NO: 225710

SEQ ID NO: 627264 - RNA, 64 nt, hsa; identical to SEQ ID NO: 225711

SEQ ID NO: 627265 - RNA, 64 nt, hsa; identical to SEQ ID NO: 225712

SEQ ID NO: 627266 - RNA, 64 nt, hsa; identical to SEQ ID NO: 225713

SEQ ID NO: 627267 - RNA, 64 nt, hsa; identical to SEQ ID NO: 225714

SEQ ID NO: 627268 - RNA, 64 nt, hsa; identical to SEQ ID NO: 225715

SEQ ID NO: 627269 - RNA, 64 nt, hsa; identical to SEQ ID NO: 225716

SEQ ID NO: 627270 - RNA, 64 nt, hsa; identical to SEQ ID NO: 225717

SEQ ID NO: 627271 - RNA, 64 nt, hsa; identical to SEQ ID NO: 225718

SEQ ID NO: 627272 - RNA, 64 nt, hsa; identical to SEQ ID NO: 225719

SEQ ID NO: 627273 - RNA, 64 nt, hsa; identical to SEQ ID NO: 225720

SEQ ID NO: 627274 - RNA, 64 nt, hsa; identical to SEQ ID NO: 225721

SEQ ID NO: 627275 - RNA, 64 nt, hsa; identical to SEQ ID NO: 225722

SEQ ID NO: 627276 - RNA, 64 nt, hsa; identical to SEQ ID NO: 225723

SEQ ID NO: 627277 - RNA, 64 nt, hsa; identical to SEQ ID NO: 225724

SEQ ID NO: 627278 - RNA, 64 nt, hsa; identical to SEQ ID NO: 225725

SEQ ID NO: 627279 - RNA, 64 nt, hsa; identical to SEQ ID NO: 225726

SEQ ID NO: 627280 - RNA, 64 nt, hsa; identical to SEQ ID NO: 225727

SEQ ID NO: 627281 - RNA, 64 nt, hsa; identical to SEQ ID NO: 225728

SEQ ID NO: 627282 - RNA, 64 nt, hsa; identical to SEQ ID NO: 225729

SEQ ID NO: 627283 - RNA, 64 nt, hsa; identical to SEQ ID NO: 225730

SEQ ID NO: 627284 - RNA, 64 nt, hsa; identical to SEQ ID NO: 225731

SEQ ID NO: 627285 - RNA, 64 nt, hsa; identical to SEQ ID NO: 225732

SEQ ID NO: 627286 - RNA, 64 nt, hsa; identical to SEQ ID NO: 225733

SEQ ID NO: 627287 - RNA, 64 nt, hsa; identical to SEQ ID NO: 225734

SEQ ID NO: 627288 - RNA, 64 nt, hsa; identical to SEQ ID NO: 225735

SEQ ID NO: 627289 - RNA, 64 nt, hsa; identical to SEQ ID NO: 225736

SEQ ID NO: 627290 - RNA, 64 nt, hsa; identical to SEQ ID NO: 225737

SEQ ID NO: 627291 - RNA, 64 nt, hsa; identical to SEQ ID NO: 225738

SEQ ID NO: 627292 - RNA, 64 nt, hsa; identical to SEQ ID NO: 225739

SEQ ID NO: 627293 - RNA, 64 nt, hsa; identical to SEQ ID NO: 225740

SEQ ID NO: 627294 - RNA, 64 nt, hsa; identical to SEQ ID NO: 225741

SEQ ID NO: 627295 - RNA, 64 nt, hsa; identical to SEQ ID NO: 225742

SEQ ID NO: 627296 - RNA, 64 nt, hsa; identical to SEQ ID NO: 225743

SEQ ID NO: 627297 - RNA, 64 nt, hsa; identical to SEQ ID NO: 225744

SEQ ID NO: 627298 - RNA, 64 nt, hsa; identical to SEQ ID NO: 225745

SEQ ID NO: 627299 - RNA, 64 nt, hsa; identical to SEQ ID NO: 225746

SEQ ID NO: 627300 - RNA, 64 nt, hsa; identical to SEQ ID NO: 225747

SEQ ID NO: 627301 - RNA, 64 nt, hsa
uggaauuugucagcagauaucaguaacuuauugccgcuuauauuguacaauguuaaacuucaau

SEQ ID NO: 627302 - RNA, 64 nt, hsa
guuuuuauaaaagcaaaaggauauucacuuucagcgcuuauacugaaguauuagauuaaagcuu

SEQ ID NO: 627303 - RNA, 64 nt, hsa
caagcuaaaauacuaagaccagcauucuuaguggcgcuuauaaauuagcucucaccugguuucc

SEQ ID NO: 627304 - RNA, 64 nt, hsa
aauuaaaugggggcucuuacugacuuuaaauuagcgcuuauaaaauaaaaauguuuaguucaag

SEQ ID NO: 627305 - RNA, 64 nt, hsa
uuugaaaacuuucaccagaaagggauguaagucucgcuuauauuuugugaauaaaaugaucaaa

SEQ ID NO: 627306 - RNA, 64 nt, hsa
uuaugaugauuaauagcagcagcauguucaguuucgcuuauaugagaaacauguuuaggcaacu

SEQ ID NO: 627307 - RNA, 64 nt, hsa
ggaaucccugagggguagaaggggccagaaaaaacgcuuauaaaaccagaggcccucugagauc

SEQ ID NO: 627308 - RNA, 64 nt, hsa
ucuucugagugucuauguuaacuucccucuaucccgcuuauaaaaaaauucuccaacaaaaaua

SEQ ID NO: 627309 - RNA, 64 nt, hsa
uuuuuguauuuuuuuuuaaaguaaauucaacuuacgcuuauauaagccuuucacaaauccaaua

SEQ ID NO: 627310 - RNA, 64 nt, hsa
ccuuauuaaaugaaaccucacggauccuuuguuccgcuuauauuccaugcauaccacauaaaag

SEQ ID NO: 627311 - RNA, 64 nt, hsa
auacuuuauaagcagcauuguuaaauaguucuuacgcuuauacauucacagaacuacccuguuu

SEQ ID NO: 627312 - RNA, 64 nt, hsa
aacuggacuuuuuagaaguaaaguaaaagcauaucgcuuauaucauuucuugcugaauuugaua

SEQ ID NO: 627313 - RNA, 64 nt, hsa
cacaccaggggcgcccucugccuuccauaccccacgcuuauaaaacauaacuaagccaagagug

SEQ ID NO: 627314 - RNA, 64 nt, hsa
caaaaguugcaaauuauaugcaaguuuguccuaucgcuuauaaauguaguguuucauuggauuu

SEQ ID NO: 627315 - RNA, 64 nt, hsa
gcuuuuuugaguuuauguuuaaaauucauucuugcgcuuauaugcauggaugguuuacuugcuc

SEQ ID NO: 627316 - RNA, 64 nt, hsa
gaugaaaaugacugccagcaguggaaaugccagacgcuuauaaaaccuucagaucucaugagac

SEQ ID NO: 627317 - RNA, 64 nt, hsa
uuccugccgagugcucugaugcaauaguggaaaucgcuuauauguccuuggguugcugguugga

SEQ ID NO: 627318 - RNA, 64 nt, hsa
ucagagcccuagagcuggcuaguguaacacugacuaugaguaggugggcccacacuugaguuga

SEQ ID NO: 627319 - RNA, 64 nt, hsa
aagaguuuaguuuuuuuacuuuauaaacugugaauaugaguaugccagcugcauacgauguaac

SEQ ID NO: 627320 - RNA, 64 nt, hsa
aagaguuuaguuuuuuuacuuuauaaacugugaauaugaguaugccagcugcauuagauguaac

SEQ ID NO: 627321 - RNA, 64 nt, hsa
ucagagcccuagagcuggcuaguguaacacugacuaugaguaggugggcccaccacuugaguug

SEQ ID NO: 627322 - RNA, 64 nt, hsa
aguccaugcaugacagccucuauccuacaaggccuaugaguauggauugggggggccaaaagga

SEQ ID NO: 627323 - RNA, 64 nt, hsa
ccuggguuuguuuuccuuggggugguguagauuguaugaguaagaaguauuaauuuuuuaaaag

SEQ ID NO: 627324 - RNA, 64 nt, hsa
cccuaacccuacaugcauguuuuaugugcacucauaugaguaucuuuaaauauaaucccuuuac

SEQ ID NO: 627325 - RNA, 64 nt, hsa
accaccuuauuagcuaaaaauauauauaacacaauaugaguaauguuuaagaucuguuuuaaau

SEQ ID NO: 627326 - RNA, 64 nt, hsa
ugaguaaaucagauguugaauucuuuugccaagggaauuauagcugcagguucucucucacugc

SEQ ID NO: 627327 - RNA, 64 nt, hsa
ugcuuugcuuugucuggaagaaagauaaaauagugaauuauaaauaagucaggccgggcguggu

SEQ ID NO: 627328 - RNA, 64 nt, hsa
cccauagcacaacagguuuauagagauguauauagaauuauaguccuuauuuuuuuccuuugcg

SEQ ID NO: 627329 - RNA, 64 nt, hsa
uaagguucuuguguauauuuggggggugggggaugaauuauaaauuauauucagcccugagugg

SEQ ID NO: 627330 - RNA, 64 nt, hsa
cgaggaacauguagcgucuacacaggaaaguaaagaauuauagaauuaacuaauucuacuugaa

SEQ ID NO: 627331 - RNA, 64 nt, hsa
ccucuguguggcacauaggaaaaugugagaccuagaauuauagcaacuuuuuuuuucuguuaaa

SEQ ID NO: 627332 - RNA, 64 nt, hsa
uguauauuuuaagugggugaauuauaugguaugugaauuauaucucaauaaaguuguuaguaaa

SEQ ID NO: 627333 - RNA, 64 nt, hsa
uuaaaaaccauugaguuguauauuuuaagugggugaauuauaugguaugugaauuauaucucaa

SEQ ID NO: 627334 - RNA, 64 nt, hsa
aauaugacauaagcaaucauuuuaugcuguuuaugaauuauaaauguguuuauagcucauuugu

SEQ ID NO: 627335 - RNA, 64 nt, hsa
caggugcauauuaauuuucuugguucuuucagcugaauuauauugguccagaaguucaaaauca

SEQ ID NO: 627336 - RNA, 64 nt, hsa
gaaaaaaaaagauaaagguuguacgguggucuuugaauuauaugucuaauucuauguguuuugu

SEQ ID NO: 627337 - RNA, 64 nt, hsa
uuaaauauuaugugaaaucaaagcgccauauguagaauuauaucuucaggacuauuucacuaau

SEQ ID NO: 627338 - RNA, 64 nt, hsa
caccuaacagucagaggucaguaucucagcgugugaauuauagaggaaauacagagagaaccuc

SEQ ID NO: 627339 - RNA, 64 nt, hsa
uuuucaguagcuuuaucacaauauucacaauggagaauuauaugacaugguagcagaaauaggc

SEQ ID NO: 627340 - RNA, 64 nt, hsa
uuaaaaaaaccaacagcagcacaggauguauuaagaauuauaugaagucagguuuguuuuuuuu

SEQ ID NO: 627341 - RNA, 64 nt, hsa
gaauaaccuuuaaaggguuguuuuguuuuguuuugaauuauaggaguuauaaucuuuggagaug

SEQ ID NO: 627342 - RNA, 64 nt, hsa
ugaugcauccaauccuaaaacuuacauuccaaaggaauuauaucauuauguuccuaaggaguaa

SEQ ID NO: 627343 - RNA, 64 nt, hsa
guguguuuuauucagguuguguaaugcucccguagaauuauagaacaauuaaauaugguuaguu

SEQ ID NO: 627344 - RNA, 64 nt, hsa
guaucuugauucuauguugucuggaaaaaauauggaauuauauaaaaagggaugcuuuuauaua

SEQ ID NO: 627345 - RNA, 64 nt, hsa
aauuuucauguuugaaguucuaauauuaaguuuagaauuauaaugaucuacaguuguaucuuga

SEQ ID NO: 627346 - RNA, 64 nt, hsa
gauacucaaauuauaauaaaacucuucauuuugugaauuauagaagcuacuuuuuauaaagcca

SEQ ID NO: 627347 - RNA, 64 nt, hsa
aucuuugggaaggaacacuaaagauguuuugaaugaauuauaguccacuggcauuuuaguguau

SEQ ID NO: 627348 - RNA, 64 nt, hsa
guaaauuuuugugggaaauuuugugauaacuugagaauuauacuuguuugaaucaaggcaacuc

SEQ ID NO: 627349 - RNA, 64 nt, hsa
gcuuauuguaacauauaauauuagugaaaccauggaauuauaugaaaaugauacaugagaaaua

SEQ ID NO: 627350 - RNA, 64 nt, hsa
gcaccucucuaaagaaucuuuaguuuccgacguugaauuauagaccaguuugaguaaguacugc

SEQ ID NO: 627351 - RNA, 64 nt, hsa
uacagcagugcaguccagagguuaagauguauuagaauuauacaauaucaguuuaaaaaucugu

SEQ ID NO: 627352 - RNA, 64 nt, hsa
gcucacccaagcucucccuuacagaggcaacacagaauuauaaggaaucagaaaucccccuucu

SEQ ID NO: 627353 - RNA, 64 nt, hsa
aucucugagguucaguaucauuuuucaaauaaaggaauuauauuauuuccucugcauaauugaa

SEQ ID NO: 627354 - RNA, 64 nt, hsa
cugccauauuccaagucacauuauuuuaccaauggaauuauagaauuaacaguauuuuaaauua

SEQ ID NO: 627355 - RNA, 64 nt, hsa
gcagauauagugaacacuggaaagauuuauuaaagaauuauauuuguguauacuuuauaaauua

SEQ ID NO: 627356 - RNA, 64 nt, hsa
aacaacagaaaugcuccuggaacuucaaguugcugaauuauaaguuuauuuuuuaucaauaaau

SEQ ID NO: 627357 - RNA, 64 nt, hsa
auauauuuuuacauaaaagcuugaacauacagaugaauuauaaccuaugugaagaaaucuuaga

SEQ ID NO: 627358 - RNA, 64 nt, hsa
auagauauaaauaauucuaaacuuaaaaucacuagaauuauagcuuaaauauuaugaaauguac

SEQ ID NO: 627359 - RNA, 64 nt, hsa
cuuaaauuuugacuguacuaacuauaaauguaaugaauuauaauaauuauaaaugguauaaaug

SEQ ID NO: 627360 - RNA, 64 nt, hsa; identical to SEQ ID NO: 364007

SEQ ID NO: 627361 - RNA, 64 nt, hsa; identical to SEQ ID NO: 364008

SEQ ID NO: 627362 - RNA, 64 nt, hsa; identical to SEQ ID NO: 364009

SEQ ID NO: 627363 - RNA, 64 nt, hsa; identical to SEQ ID NO: 364010

SEQ ID NO: 627364 - RNA, 64 nt, hsa; identical to SEQ ID NO: 364011

SEQ ID NO: 627365 - RNA, 64 nt, hsa; identical to SEQ ID NO: 364012

SEQ ID NO: 627366 - RNA, 64 nt, hsa; identical to SEQ ID NO: 364013

SEQ ID NO: 627367 - RNA, 64 nt, hsa; identical to SEQ ID NO: 364014

SEQ ID NO: 627368 - RNA, 64 nt, hsa; identical to SEQ ID NO: 364015

SEQ ID NO: 627369 - RNA, 64 nt, hsa; identical to SEQ ID NO: 364016

SEQ ID NO: 627370 - RNA, 64 nt, hsa; identical to SEQ ID NO: 364017

SEQ ID NO: 627371 - RNA, 64 nt, hsa; identical to SEQ ID NO: 364018

SEQ ID NO: 627372 - RNA, 64 nt, hsa; identical to SEQ ID NO: 364019

SEQ ID NO: 627373 - RNA, 64 nt, hsa; identical to SEQ ID NO: 364020

SEQ ID NO: 627374 - RNA, 64 nt, hsa; identical to SEQ ID NO: 364021

SEQ ID NO: 627375 - RNA, 64 nt, hsa; identical to SEQ ID NO: 364022

SEQ ID NO: 627376 - RNA, 64 nt, hsa; identical to SEQ ID NO: 364023

SEQ ID NO: 627377 - RNA, 64 nt, hsa; identical to SEQ ID NO: 364024

SEQ ID NO: 627378 - RNA, 64 nt, hsa; identical to SEQ ID NO: 364025

SEQ ID NO: 627379 - RNA, 64 nt, hsa; identical to SEQ ID NO: 364026

SEQ ID NO: 627380 - RNA, 64 nt, hsa; identical to SEQ ID NO: 364027

SEQ ID NO: 627381 - RNA, 64 nt, hsa; identical to SEQ ID NO: 364028

SEQ ID NO: 627382 - RNA, 64 nt, hsa; identical to SEQ ID NO: 364029

SEQ ID NO: 627383 - RNA, 64 nt, hsa; identical to SEQ ID NO: 364030

SEQ ID NO: 627384 - RNA, 64 nt, hsa; identical to SEQ ID NO: 364031

SEQ ID NO: 627385 - RNA, 64 nt, hsa; identical to SEQ ID NO: 364032

SEQ ID NO: 627386 - RNA, 64 nt, hsa; identical to SEQ ID NO: 364033

SEQ ID NO: 627387 - RNA, 64 nt, hsa; identical to SEQ ID NO: 364034

SEQ ID NO: 627388 - RNA, 64 nt, hsa; identical to SEQ ID NO: 364035

SEQ ID NO: 627389 - RNA, 64 nt, hsa; identical to SEQ ID NO: 364036

SEQ ID NO: 627390 - RNA, 64 nt, hsa; identical to SEQ ID NO: 364037

SEQ ID NO: 627391 - RNA, 64 nt, hsa; identical to SEQ ID NO: 364038

SEQ ID NO: 627392 - RNA, 64 nt, hsa; identical to SEQ ID NO: 364039

SEQ ID NO: 627393 - RNA, 64 nt, hsa; identical to SEQ ID NO: 364040

SEQ ID NO: 627394 - RNA, 64 nt, hsa; identical to SEQ ID NO: 364041

SEQ ID NO: 627395 - RNA, 64 nt, hsa; identical to SEQ ID NO: 364042

SEQ ID NO: 627396 - RNA, 64 nt, hsa; identical to SEQ ID NO: 364043

SEQ ID NO: 627397 - RNA, 64 nt, hsa; identical to SEQ ID NO: 364044

SEQ ID NO: 627398 - RNA, 64 nt, hsa; identical to SEQ ID NO: 364045

SEQ ID NO: 627399 - RNA, 64 nt, hsa; identical to SEQ ID NO: 364046

SEQ ID NO: 627400 - RNA, 64 nt, hsa; identical to SEQ ID NO: 364047

SEQ ID NO: 627401 - RNA, 64 nt, hsa; identical to SEQ ID NO: 364048

SEQ ID NO: 627402 - RNA, 64 nt, hsa; identical to SEQ ID NO: 364049

SEQ ID NO: 627403 - RNA, 64 nt, hsa; identical to SEQ ID NO: 364050

SEQ ID NO: 627404 - RNA, 64 nt, hsa; identical to SEQ ID NO: 364051

SEQ ID NO: 627405 - RNA, 64 nt, hsa; identical to SEQ ID NO: 364052

SEQ ID NO: 627406 - RNA, 64 nt, hsa; identical to SEQ ID NO: 364053

SEQ ID NO: 627407 - RNA, 64 nt, hsa; identical to SEQ ID NO: 364054

SEQ ID NO: 627408 - RNA, 64 nt, hsa; identical to SEQ ID NO: 364055

SEQ ID NO: 627409 - RNA, 64 nt, hsa; identical to SEQ ID NO: 364056

SEQ ID NO: 627410 - RNA, 64 nt, hsa; identical to SEQ ID NO: 364057

SEQ ID NO: 627411 - RNA, 64 nt, hsa; identical to SEQ ID NO: 364058

SEQ ID NO: 627412 - RNA, 64 nt, hsa; identical to SEQ ID NO: 364059

SEQ ID NO: 627413 - RNA, 64 nt, hsa; identical to SEQ ID NO: 364060

SEQ ID NO: 627414 - RNA, 64 nt, hsa; identical to SEQ ID NO: 364061

SEQ ID NO: 627415 - RNA, 64 nt, hsa; identical to SEQ ID NO: 364062

SEQ ID NO: 627416 - RNA, 64 nt, hsa; identical to SEQ ID NO: 364063

SEQ ID NO: 627417 - RNA, 64 nt, hsa; identical to SEQ ID NO: 364064

SEQ ID NO: 627418 - RNA, 64 nt, hsa; identical to SEQ ID NO: 364065

SEQ ID NO: 627419 - RNA, 64 nt, hsa; identical to SEQ ID NO: 364066

SEQ ID NO: 627420 - RNA, 64 nt, hsa; identical to SEQ ID NO: 364067

SEQ ID NO: 627421 - RNA, 64 nt, hsa; identical to SEQ ID NO: 364068

SEQ ID NO: 627422 - RNA, 64 nt, hsa; identical to SEQ ID NO: 364069

SEQ ID NO: 627423 - RNA, 64 nt, hsa; identical to SEQ ID NO: 364070

SEQ ID NO: 627424 - RNA, 64 nt, hsa; identical to SEQ ID NO: 364071

SEQ ID NO: 627425 - RNA, 64 nt, hsa; identical to SEQ ID NO: 364072

SEQ ID NO: 627426 - RNA, 64 nt, hsa; identical to SEQ ID NO: 364073

SEQ ID NO: 627427 - RNA, 64 nt, hsa; identical to SEQ ID NO: 364074

SEQ ID NO: 627428 - RNA, 64 nt, hsa; identical to SEQ ID NO: 364075

SEQ ID NO: 627429 - RNA, 64 nt, hsa; identical to SEQ ID NO: 364076

SEQ ID NO: 627430 - RNA, 64 nt, hsa; identical to SEQ ID NO: 364077

SEQ ID NO: 627431 - RNA, 64 nt, hsa; identical to SEQ ID NO: 364078

SEQ ID NO: 627432 - RNA, 64 nt, hsa; identical to SEQ ID NO: 364079

SEQ ID NO: 627433 - RNA, 64 nt, hsa; identical to SEQ ID NO: 364080

SEQ ID NO: 627434 - RNA, 64 nt, hsa; identical to SEQ ID NO: 364081

SEQ ID NO: 627435 - RNA, 64 nt, hsa; identical to SEQ ID NO: 364082

SEQ ID NO: 627436 - RNA, 64 nt, hsa; identical to SEQ ID NO: 364083

SEQ ID NO: 627437 - RNA, 64 nt, hsa; identical to SEQ ID NO: 364084

SEQ ID NO: 627438 - RNA, 64 nt, hsa; identical to SEQ ID NO: 364085

SEQ ID NO: 627439 - RNA, 64 nt, hsa; identical to SEQ ID NO: 364086

SEQ ID NO: 627440 - RNA, 64 nt, hsa; identical to SEQ ID NO: 364087

SEQ ID NO: 627441 - RNA, 64 nt, hsa; identical to SEQ ID NO: 364088

SEQ ID NO: 627442 - RNA, 64 nt, hsa; identical to SEQ ID NO: 364089

SEQ ID NO: 627443 - RNA, 64 nt, hsa; identical to SEQ ID NO: 364090

SEQ ID NO: 627444 - RNA, 64 nt, hsa; identical to SEQ ID NO: 364091

SEQ ID NO: 627445 - RNA, 64 nt, hsa; identical to SEQ ID NO: 364092

SEQ ID NO: 627446 - RNA, 64 nt, hsa; identical to SEQ ID NO: 364093

SEQ ID NO: 627447 - RNA, 64 nt, hsa; identical to SEQ ID NO: 364094

SEQ ID NO: 627448 - RNA, 64 nt, hsa; identical to SEQ ID NO: 364095

SEQ ID NO: 627449 - RNA, 64 nt, hsa; identical to SEQ ID NO: 364096

SEQ ID NO: 627450 - RNA, 64 nt, hsa; identical to SEQ ID NO: 364097

SEQ ID NO: 627451 - RNA, 64 nt, hsa; identical to SEQ ID NO: 364098

SEQ ID NO: 627452 - RNA, 64 nt, hsa; identical to SEQ ID NO: 364099

SEQ ID NO: 627453 - RNA, 64 nt, hsa; identical to SEQ ID NO: 364100

SEQ ID NO: 627454 - RNA, 64 nt, hsa; identical to SEQ ID NO: 364101

SEQ ID NO: 627455 - RNA, 64 nt, hsa; identical to SEQ ID NO: 364102

SEQ ID NO: 627456 - RNA, 64 nt, hsa; identical to SEQ ID NO: 364103

SEQ ID NO: 627457 - RNA, 64 nt, hsa; identical to SEQ ID NO: 364104

SEQ ID NO: 627458 - RNA, 64 nt, hsa; identical to SEQ ID NO: 364105

SEQ ID NO: 627459 - RNA, 64 nt, hsa; identical to SEQ ID NO: 364106

SEQ ID NO: 627460 - RNA, 64 nt, hsa; identical to SEQ ID NO: 364107

SEQ ID NO: 627461 - RNA, 64 nt, hsa; identical to SEQ ID NO: 364108

SEQ ID NO: 627462 - RNA, 64 nt, hsa; identical to SEQ ID NO: 364109

SEQ ID NO: 627463 - RNA, 64 nt, hsa; identical to SEQ ID NO: 364110

SEQ ID NO: 627464 - RNA, 64 nt, hsa; identical to SEQ ID NO: 364111

SEQ ID NO: 627465 - RNA, 64 nt, hsa; identical to SEQ ID NO: 364112

SEQ ID NO: 627466 - RNA, 64 nt, hsa; identical to SEQ ID NO: 355376

SEQ ID NO: 627467 - RNA, 64 nt, hsa; identical to SEQ ID NO: 355377

SEQ ID NO: 627468 - RNA, 64 nt, hsa; identical to SEQ ID NO: 355378

SEQ ID NO: 627469 - RNA, 64 nt, hsa; identical to SEQ ID NO: 355379

SEQ ID NO: 627470 - RNA, 64 nt, hsa; identical to SEQ ID NO: 355380

SEQ ID NO: 627471 - RNA, 64 nt, hsa; identical to SEQ ID NO: 355381

SEQ ID NO: 627472 - RNA, 64 nt, hsa; identical to SEQ ID NO: 355382

SEQ ID NO: 627473 - RNA, 64 nt, hsa; identical to SEQ ID NO: 355383

SEQ ID NO: 627474 - RNA, 64 nt, hsa; identical to SEQ ID NO: 355384

SEQ ID NO: 627475 - RNA, 64 nt, hsa; identical to SEQ ID NO: 355385

SEQ ID NO: 627476 - RNA, 64 nt, hsa; identical to SEQ ID NO: 496529

SEQ ID NO: 627477 - RNA, 64 nt, hsa; identical to SEQ ID NO: 496530

SEQ ID NO: 627478 - RNA, 62 nt, hsa; identical to SEQ ID NO: 496531

SEQ ID NO: 627479 - RNA, 64 nt, hsa; identical to SEQ ID NO: 496532

SEQ ID NO: 627480 - RNA, 64 nt, hsa; identical to SEQ ID NO: 496533

SEQ ID NO: 627481 - RNA, 64 nt, hsa; identical to SEQ ID NO: 496534

SEQ ID NO: 627482 - RNA, 59 nt, hsa
agguguuucuagacccccgacuccgcaagagugaggaugaugggagcuggucaugggag

SEQ ID NO: 627483 - RNA, 59 nt, hsa
uuaacugacuucuguccacucuggagagcagugaggaauuaaucuugcuuuugcuuguc

SEQ ID NO: 627484 - RNA, 59 nt, hsa
uucaagcuggaagaagugagcaguguuggagugaggaccuguaaggcaggcccauucag

SEQ ID NO: 627485 - RNA, 59 nt, hsa
agucucugcccucauagaguugauugucuagugaggaagacaagcauuuuuaaaaaaua

SEQ ID NO: 627486 - RNA, 59 nt, hsa
ccucugcccggccgccaccccgucugggaagugaggagcgucucugccuggcugcccau

SEQ ID NO: 627487 - RNA, 59 nt, hsa
gccccucugccuggcugcccagucuggaaagugaggagcgucucugcccggccgccauc

SEQ ID NO: 627488 - RNA, 59 nt, hsa
ucucugcccggccgccaucccaucuaggaagugaggagcgccucuucccacccgccauc

SEQ ID NO: 627489 - RNA, 59 nt, hsa
ccucuucccacccgccaucccaucuaggaagugaggagcuucucugccuggccgcccau

SEQ ID NO: 627490 - RNA, 59 nt, hsa
gcaacucugcccagccgccccgucugagaagugaggagacccuccgccuggcaaccgcc

SEQ ID NO: 627491 - RNA, 59 nt, hsa
ccucugcccagcagccgccccgucugagaagugaggagccccucugcccagcagccacc

SEQ ID NO: 627492 - RNA, 59 nt, hsa
ccucugcccagcagccacccugucugggaagugaggagcgucuccgcccggcagccacc

SEQ ID NO: 627493 - RNA, 59 nt, hsa
gcgccucugcccagcugccccuacugggaagugaggagccccucugccccgccagccac

SEQ ID NO: 627494 - RNA, 59 nt, hsa
gcgccucugcccggcugccccuacugggaagugaggagccccucugcccggccagccgc

SEQ ID NO: 627495 - RNA, 59 nt, hsa
gcgccucugcccggccgccccuacugggaagugaggagccccucugcccggccaccacc

SEQ ID NO: 627496 - RNA, 59 nt, hsa
cgccgacucccuccuuccgggccugcucuagugaggagugccuaagccaggacccagaa

SEQ ID NO: 627497 - RNA, 59 nt, hsa
gggcagggacagccaccuuggaaggccgcagugaggagcugucuggaccaguggggcac

SEQ ID NO: 627498 - RNA, 59 nt, hsa
ccaucagcaggucaacccuaugcugggaaagugaggauuugggauuucugugcuauaaa

SEQ ID NO: 627499 - RNA, 59 nt, hsa
caaguuagcuaaaaaugagaugcguaugaagugaggaggcuggauccaagucuugauug

SEQ ID NO: 627500 - RNA, 59 nt, hsa
aaacagaugcagacauguguguugguaguagugaggagauugguauuagcaucaagucu

SEQ ID NO: 627501 - RNA, 59 nt, hsa
caugucaaguacuuagcuaaaaucaacaaagugaggacugugaagauaacuuucaugua

SEQ ID NO: 627502 - RNA, 59 nt, hsa
agguuguuggguuuugagcaggcuguuauagugaggaauguucauuuuuaaauguuccu

SEQ ID NO: 627503 - RNA, 59 nt, hsa
ggaccgagcccuguuacauggaugugaacagugaggaucagagguuuuaucagaacaca

SEQ ID NO: 627504 - RNA, 59 nt, hsa
augcuaaguguagauuauugagguuuguuagugaggaaaagaauaagaguucagaagcc

SEQ ID NO: 627505 - RNA, 59 nt, hsa
uuuguuaucagauagcgaaaucagggccuagugaggagcacaggucgacuacauaaugg

SEQ ID NO: 627506 - RNA, 59 nt, hsa
gcuuuacgagaccaugcaagacggggguuagugaggaaggaggauuuggggugggggug

SEQ ID NO: 627507 - RNA, 59 nt, hsa
ucuucauggaccagacucugcacccggugagugaggacagucccagcugagucccaucg

SEQ ID NO: 627508 - RNA, 59 nt, hsa
cagacuuuuaaaaugcccuugugucucccagugaggagcccuaagcauugacuucucua

SEQ ID NO: 627509 - RNA, 59 nt, hsa
agcugaagaguuuacugaagcaaauuaauagugaggaagccuauuugaacuacuuaaac

SEQ ID NO: 627510 - RNA, 59 nt, hsa
aguuuuagaggaaaagucaacaucuaacuagugaggaaaagugccuaauacaauuagaa

SEQ ID NO: 627511 - RNA, 59 nt, hsa
aaggcaaaggaaacuaaggaaggagguucagugaggaaaauaagguuguccaugagauu

SEQ ID NO: 627512 - RNA, 59 nt, hsa
aaggggugagacacaacagucugacuaugagugaggaaaauaucugggucuuuucguca

SEQ ID NO: 627513 - RNA, 59 nt, hsa
cuuucuaaaaggcauauauuuuucaaagaagugaggaugcaguuucucacguugcaacc

SEQ ID NO: 627514 - RNA, 59 nt, hsa
ccggccccucuggcccuucccucaagcccagugaggagguggguggaggcaugcagggg

SEQ ID NO: 627515 - RNA, 59 nt, hsa
gcagagaagggcaucugggacguggugccagugaggagcccaguuggcuggcacugggc

SEQ ID NO: 627516 - RNA, 59 nt, hsa
gcaguggugcuggcccaagugaaggccagagugaggacugaugcagcucuuuacggguc

SEQ ID NO: 627517 - RNA, 59 nt, hsa
aagauuaaguuaccggcccaaggugacacagugaggagguggcagagcuaggauuugaa

SEQ ID NO: 627518 - RNA, 59 nt, hsa
ccucugcccggccgccaccccgucuggaaagugaggagcgccucugcccggccgccauc

SEQ ID NO: 627519 - RNA, 59 nt, hsa
ccucugcccggccgccaucccaucuaggaagugaggagcgccucuucccagccgccauc

SEQ ID NO: 627520 - RNA, 59 nt, hsa
ccucuucccagccgccaucccaucuaggaagugaggagcgucucugcccggccgcccau

SEQ ID NO: 627521 - RNA, 59 nt, hsa
gcgucucugucuggccaccccgucugagaagugaggagaccuccgcccggcagccgccc

SEQ ID NO: 627522 - RNA, 59 nt, hsa
ccuccgcccggcagccgcccugucugagaagugaggagccccuccgcccggcagccacc

SEQ ID NO: 627523 - RNA, 59 nt, hsa
ccuccgcccggcagccaccccaucugggaagugaggagcgucuacgcccgggcagcugc

SEQ ID NO: 627524 - RNA, 59 nt, hsa
ccgccccugcccggccgccccuacugggaagugaggagccccucugccuggccaccacc

SEQ ID NO: 627525 - RNA, 59 nt, hsa
agaucugcagcuagcauaguuucaugcucagugaggaugauggucaccguguuuguugu

SEQ ID NO: 627526 - RNA, 59 nt, hsa
agccuccugaccaaugcccgcucuuggggagugaggauucugcacguggaugguacccu

SEQ ID NO: 627527 - RNA, 59 nt, hsa
uggcaaaggcaucucaggaacaucaccuuagugaggaaacaaaauguucugcuagcuug

SEQ ID NO: 627528 - RNA, 59 nt, hsa
aauuagaguccucagaagagaacuuaucuagugaggaugaagagcuucccugcuuccaa

SEQ ID NO: 627529 - RNA, 59 nt, hsa
cagcccagagacagagaagcuuaugaggaagugaggagguggcgucacaagggugggga

SEQ ID NO: 627530 - RNA, 59 nt, hsa
ggacggcaccugguaugcgggaggaacagagugaggagaggagggcagggcgugcaggg

SEQ ID NO: 627531 - RNA, 59 nt, hsa
ucaggacugaaugugaaagggaaguauugagugaggacauucccaaaaccaaaggacaa

SEQ ID NO: 627532 - RNA, 59 nt, hsa
ccagcacauaaugaauaaauaagaaaaugagugaggaguuauuaacaucauuuggaaaa

SEQ ID NO: 627533 - RNA, 59 nt, hsa
ccugaagacaccccugccccccuccagagagugaggagggggccugagacuggaccugg

SEQ ID NO: 627534 - RNA, 59 nt, hsa
gccaggaugcuucugccauccagggguguagugaggacccacggggagccugggccccu

SEQ ID NO: 627535 - RNA, 59 nt, hsa
gugaggaggagcccagaggaccccaggggagugaggagggagaacuuggaagggugcag

SEQ ID NO: 627536 - RNA, 59 nt, hsa
cacgcaccagcucuauuugggggaaguguagugaggaggagcccagaggaccccagggg

SEQ ID NO: 627537 - RNA, 59 nt, hsa
caggccaacuggcugagugauucgaagaaagugaggaauccucccuggacacuguaucg

SEQ ID NO: 627538 - RNA, 59 nt, hsa
cuccagcuccagccaccaccaggcugagcagugaggagagaaaguuucugccuggcccu

SEQ ID NO: 627539 - RNA, 59 nt, hsa
cugccaguugcaaauuugauaggauaguuagugaggauuauuaaccucugagcagugau

SEQ ID NO: 627540 - RNA, 59 nt, hsa
aagugguguuagcuuugagggcaaggcaaagugaggaagggcuggugcagggaaagcaa

SEQ ID NO: 627541 - RNA, 59 nt, hsa
gugaggaaaaaacauucagacaaauguucagugaggaaaaaaaggggaaguuggggaua

SEQ ID NO: 627542 - RNA, 59 nt, hsa
uguucagugugagugaggaaaacauguucagugaggaaaaaacauucagacaaauguuc

SEQ ID NO: 627543 - RNA, 59 nt, hsa
gccacaguuucagacaaauguucagugugagugaggaaaacauguucagugaggaaaaa

SEQ ID NO: 627544 - RNA, 64 nt, hsa; identical to SEQ ID NO: 503392

SEQ ID NO: 627545 - RNA, 64 nt, hsa; identical to SEQ ID NO: 503393

SEQ ID NO: 627546 - RNA, 64 nt, hsa; identical to SEQ ID NO: 503394

SEQ ID NO: 627547 - RNA, 64 nt, hsa; identical to SEQ ID NO: 503395

SEQ ID NO: 627548 - RNA, 64 nt, hsa; identical to SEQ ID NO: 503396

SEQ ID NO: 627549 - RNA, 64 nt, hsa; identical to SEQ ID NO: 503397

SEQ ID NO: 627550 - RNA, 64 nt, hsa; identical to SEQ ID NO: 503398

SEQ ID NO: 627551 - RNA, 64 nt, hsa; identical to SEQ ID NO: 503399

SEQ ID NO: 627552 - RNA, 64 nt, hsa; identical to SEQ ID NO: 503400

SEQ ID NO: 627553 - RNA, 64 nt, hsa; identical to SEQ ID NO: 503401

SEQ ID NO: 627554 - RNA, 64 nt, hsa; identical to SEQ ID NO: 503402

SEQ ID NO: 627555 - RNA, 64 nt, hsa; identical to SEQ ID NO: 503403

SEQ ID NO: 627556 - RNA, 64 nt, hsa; identical to SEQ ID NO: 503404

SEQ ID NO: 627557 - RNA, 64 nt, hsa; identical to SEQ ID NO: 503405

SEQ ID NO: 627558 - RNA, 64 nt, hsa; identical to SEQ ID NO: 503406

SEQ ID NO: 627559 - RNA, 64 nt, hsa; identical to SEQ ID NO: 503407

SEQ ID NO: 627560 - RNA, 64 nt, hsa; identical to SEQ ID NO: 156143

SEQ ID NO: 627561 - RNA, 64 nt, hsa; identical to SEQ ID NO: 156144

SEQ ID NO: 627562 - RNA, 64 nt, hsa; identical to SEQ ID NO: 156145

SEQ ID NO: 627563 - RNA, 64 nt, hsa; identical to SEQ ID NO: 156146

SEQ ID NO: 627564 - RNA, 64 nt, hsa; identical to SEQ ID NO: 156147

SEQ ID NO: 627565 - RNA, 64 nt, hsa; identical to SEQ ID NO: 156148

SEQ ID NO: 627566 - RNA, 64 nt, hsa; identical to SEQ ID NO: 156149

SEQ ID NO: 627567 - RNA, 64 nt, hsa; identical to SEQ ID NO: 156150

SEQ ID NO: 627568 - RNA, 64 nt, hsa; identical to SEQ ID NO: 156151

SEQ ID NO: 627569 - RNA, 64 nt, hsa; identical to SEQ ID NO: 156152

SEQ ID NO: 627570 - RNA, 64 nt, hsa; identical to SEQ ID NO: 156153

SEQ ID NO: 627571 - RNA, 64 nt, hsa; identical to SEQ ID NO: 156154

SEQ ID NO: 627572 - RNA, 64 nt, hsa; identical to SEQ ID NO: 156155

SEQ ID NO: 627573 - RNA, 64 nt, hsa; identical to SEQ ID NO: 156156

SEQ ID NO: 627574 - RNA, 64 nt, hsa; identical to SEQ ID NO: 156157

SEQ ID NO: 627575 - RNA, 64 nt, hsa; identical to SEQ ID NO: 156158

SEQ ID NO: 627576 - RNA, 64 nt, hsa; identical to SEQ ID NO: 156159

SEQ ID NO: 627577 - RNA, 64 nt, hsa; identical to SEQ ID NO: 156160

SEQ ID NO: 627578 - RNA, 64 nt, hsa; identical to SEQ ID NO: 156161

SEQ ID NO: 627579 - RNA, 64 nt, hsa; identical to SEQ ID NO: 156162

SEQ ID NO: 627580 - RNA, 64 nt, hsa; identical to SEQ ID NO: 156163

SEQ ID NO: 627581 - RNA, 64 nt, hsa; identical to SEQ ID NO: 156164

SEQ ID NO: 627582 - RNA, 64 nt, hsa; identical to SEQ ID NO: 156165

SEQ ID NO: 627583 - RNA, 64 nt, hsa; identical to SEQ ID NO: 156166

SEQ ID NO: 627584 - RNA, 64 nt, hsa; identical to SEQ ID NO: 156167

SEQ ID NO: 627585 - RNA, 64 nt, hsa; identical to SEQ ID NO: 156168

SEQ ID NO: 627586 - RNA, 64 nt, hsa; identical to SEQ ID NO: 156169

SEQ ID NO: 627587 - RNA, 64 nt, hsa; identical to SEQ ID NO: 156170

SEQ ID NO: 627588 - RNA, 64 nt, hsa; identical to SEQ ID NO: 156171

SEQ ID NO: 627589 - RNA, 64 nt, hsa; identical to SEQ ID NO: 156172

SEQ ID NO: 627590 - RNA, 64 nt, hsa; identical to SEQ ID NO: 156173

SEQ ID NO: 627591 - RNA, 64 nt, hsa; identical to SEQ ID NO: 156174

SEQ ID NO: 627592 - RNA, 64 nt, hsa; identical to SEQ ID NO: 156175

SEQ ID NO: 627593 - RNA, 64 nt, hsa; identical to SEQ ID NO: 156176

SEQ ID NO: 627594 - RNA, 64 nt, hsa; identical to SEQ ID NO: 156177

SEQ ID NO: 627595 - RNA, 64 nt, hsa; identical to SEQ ID NO: 156178

SEQ ID NO: 627596 - RNA, 64 nt, hsa; identical to SEQ ID NO: 156179

SEQ ID NO: 627597 - RNA, 64 nt, hsa; identical to SEQ ID NO: 156180

SEQ ID NO: 627598 - RNA, 64 nt, hsa; identical to SEQ ID NO: 156181

SEQ ID NO: 627599 - RNA, 64 nt, hsa; identical to SEQ ID NO: 156182

SEQ ID NO: 627600 - RNA, 64 nt, hsa; identical to SEQ ID NO: 156183

SEQ ID NO: 627601 - RNA, 64 nt, hsa; identical to SEQ ID NO: 156184

SEQ ID NO: 627602 - RNA, 64 nt, hsa; identical to SEQ ID NO: 156185

SEQ ID NO: 627603 - RNA, 64 nt, hsa; identical to SEQ ID NO: 156186

SEQ ID NO: 627604 - RNA, 64 nt, hsa; identical to SEQ ID NO: 156187

SEQ ID NO: 627605 - RNA, 64 nt, hsa; identical to SEQ ID NO: 156188

SEQ ID NO: 627606 - RNA, 64 nt, hsa; identical to SEQ ID NO: 156189

SEQ ID NO: 627607 - RNA, 64 nt, hsa; identical to SEQ ID NO: 156190

SEQ ID NO: 627608 - RNA, 64 nt, hsa; identical to SEQ ID NO: 156191

SEQ ID NO: 627609 - RNA, 64 nt, hsa; identical to SEQ ID NO: 156192

SEQ ID NO: 627610 - RNA, 64 nt, hsa; identical to SEQ ID NO: 156193

SEQ ID NO: 627611 - RNA, 64 nt, hsa; identical to SEQ ID NO: 156194

SEQ ID NO: 627612 - RNA, 64 nt, hsa; identical to SEQ ID NO: 156195

SEQ ID NO: 627613 - RNA, 64 nt, hsa; identical to SEQ ID NO: 156196

SEQ ID NO: 627614 - RNA, 64 nt, hsa; identical to SEQ ID NO: 156197

SEQ ID NO: 627615 - RNA, 64 nt, hsa; identical to SEQ ID NO: 156198

SEQ ID NO: 627616 - RNA, 64 nt, hsa; identical to SEQ ID NO: 156199

SEQ ID NO: 627617 - RNA, 64 nt, hsa; identical to SEQ ID NO: 156200

SEQ ID NO: 627618 - RNA, 64 nt, hsa; identical to SEQ ID NO: 156201

SEQ ID NO: 627619 - RNA, 64 nt, hsa; identical to SEQ ID NO: 156202

SEQ ID NO: 627620 - RNA, 64 nt, hsa; identical to SEQ ID NO: 156203

SEQ ID NO: 627621 - RNA, 64 nt, hsa; identical to SEQ ID NO: 156204

SEQ ID NO: 627622 - RNA, 64 nt, hsa; identical to SEQ ID NO: 156205

SEQ ID NO: 627623 - RNA, 64 nt, hsa; identical to SEQ ID NO: 156206

SEQ ID NO: 627624 - RNA, 64 nt, hsa; identical to SEQ ID NO: 156207

SEQ ID NO: 627625 - RNA, 64 nt, hsa; identical to SEQ ID NO: 156208

SEQ ID NO: 627626 - RNA, 64 nt, hsa; identical to SEQ ID NO: 156209

SEQ ID NO: 627627 - RNA, 53 nt, hsa; identical to SEQ ID NO: 156210

SEQ ID NO: 627628 - RNA, 64 nt, hsa; identical to SEQ ID NO: 156211

SEQ ID NO: 627629 - RNA, 64 nt, hsa; identical to SEQ ID NO: 156212

SEQ ID NO: 627630 - RNA, 64 nt, hsa; identical to SEQ ID NO: 156213

SEQ ID NO: 627631 - RNA, 64 nt, hsa; identical to SEQ ID NO: 156214

SEQ ID NO: 627632 - RNA, 64 nt, hsa; identical to SEQ ID NO: 156215

SEQ ID NO: 627633 - RNA, 64 nt, hsa; identical to SEQ ID NO: 156216

SEQ ID NO: 627634 - RNA, 64 nt, hsa; identical to SEQ ID NO: 156217

SEQ ID NO: 627635 - RNA, 64 nt, hsa; identical to SEQ ID NO: 156218

SEQ ID NO: 627636 - RNA, 64 nt, hsa; identical to SEQ ID NO: 156219

SEQ ID NO: 627637 - RNA, 64 nt, hsa; identical to SEQ ID NO: 156220

SEQ ID NO: 627638 - RNA, 64 nt, hsa; identical to SEQ ID NO: 156221

SEQ ID NO: 627639 - RNA, 64 nt, hsa; identical to SEQ ID NO: 156222

SEQ ID NO: 627640 - RNA, 64 nt, hsa; identical to SEQ ID NO: 156223

SEQ ID NO: 627641 - RNA, 64 nt, hsa; identical to SEQ ID NO: 156224

SEQ ID NO: 627642 - RNA, 64 nt, hsa; identical to SEQ ID NO: 156225

SEQ ID NO: 627643 - RNA, 64 nt, hsa; identical to SEQ ID NO: 156226

SEQ ID NO: 627644 - RNA, 64 nt, hsa; identical to SEQ ID NO: 156227

SEQ ID NO: 627645 - RNA, 64 nt, hsa; identical to SEQ ID NO: 156228

SEQ ID NO: 627646 - RNA, 64 nt, hsa; identical to SEQ ID NO: 156229

SEQ ID NO: 627647 - RNA, 64 nt, hsa; identical to SEQ ID NO: 156230

SEQ ID NO: 627648 - RNA, 64 nt, hsa; identical to SEQ ID NO: 156231

SEQ ID NO: 627649 - RNA, 64 nt, hsa; identical to SEQ ID NO: 156232

SEQ ID NO: 627650 - RNA, 64 nt, hsa; identical to SEQ ID NO: 156233

SEQ ID NO: 627651 - RNA, 64 nt, hsa; identical to SEQ ID NO: 156234

SEQ ID NO: 627652 - RNA, 64 nt, hsa; identical to SEQ ID NO: 156235

SEQ ID NO: 627653 - RNA, 64 nt, hsa; identical to SEQ ID NO: 156236

SEQ ID NO: 627654 - RNA, 64 nt, hsa; identical to SEQ ID NO: 156237

SEQ ID NO: 627655 - RNA, 64 nt, hsa; identical to SEQ ID NO: 156238

SEQ ID NO: 627656 - RNA, 64 nt, hsa; identical to SEQ ID NO: 156239

SEQ ID NO: 627657 - RNA, 64 nt, hsa; identical to SEQ ID NO: 156240

SEQ ID NO: 627658 - RNA, 64 nt, hsa; identical to SEQ ID NO: 156241

SEQ ID NO: 627659 - RNA, 64 nt, hsa; identical to SEQ ID NO: 156242

SEQ ID NO: 627660 - RNA, 64 nt, hsa; identical to SEQ ID NO: 156243

SEQ ID NO: 627661 - RNA, 64 nt, hsa; identical to SEQ ID NO: 156244

SEQ ID NO: 627662 - RNA, 64 nt, hsa; identical to SEQ ID NO: 156245

SEQ ID NO: 627663 - RNA, 64 nt, hsa; identical to SEQ ID NO: 156246

SEQ ID NO: 627664 - RNA, 64 nt, hsa; identical to SEQ ID NO: 156247

SEQ ID NO: 627665 - RNA, 64 nt, hsa; identical to SEQ ID NO: 156248

SEQ ID NO: 627666 - RNA, 64 nt, hsa; identical to SEQ ID NO: 156249

SEQ ID NO: 627667 - RNA, 64 nt, hsa; identical to SEQ ID NO: 156250

SEQ ID NO: 627668 - RNA, 64 nt, hsa; identical to SEQ ID NO: 156251

SEQ ID NO: 627669 - RNA, 64 nt, hsa; identical to SEQ ID NO: 156252

SEQ ID NO: 627670 - RNA, 64 nt, hsa; identical to SEQ ID NO: 156253

SEQ ID NO: 627671 - RNA, 64 nt, hsa; identical to SEQ ID NO: 156254

SEQ ID NO: 627672 - RNA, 64 nt, hsa; identical to SEQ ID NO: 156255

SEQ ID NO: 627673 - RNA, 64 nt, hsa; identical to SEQ ID NO: 156256

SEQ ID NO: 627674 - RNA, 64 nt, hsa; identical to SEQ ID NO: 156257

SEQ ID NO: 627675 - RNA, 64 nt, hsa; identical to SEQ ID NO: 156258

SEQ ID NO: 627676 - RNA, 64 nt, hsa; identical to SEQ ID NO: 156259

SEQ ID NO: 627677 - RNA, 64 nt, hsa; identical to SEQ ID NO: 156260

SEQ ID NO: 627678 - RNA, 64 nt, hsa; identical to SEQ ID NO: 156261

SEQ ID NO: 627679 - RNA, 64 nt, hsa; identical to SEQ ID NO: 156262

SEQ ID NO: 627680 - RNA, 64 nt, hsa; identical to SEQ ID NO: 156263

SEQ ID NO: 627681 - RNA, 64 nt, hsa; identical to SEQ ID NO: 156264

SEQ ID NO: 627682 - RNA, 64 nt, hsa; identical to SEQ ID NO: 156265

SEQ ID NO: 627683 - RNA, 64 nt, hsa; identical to SEQ ID NO: 156266

SEQ ID NO: 627684 - RNA, 64 nt, hsa; identical to SEQ ID NO: 156267

SEQ ID NO: 627685 - RNA, 64 nt, hsa; identical to SEQ ID NO: 156268

SEQ ID NO: 627686 - RNA, 64 nt, hsa; identical to SEQ ID NO: 156269

SEQ ID NO: 627687 - RNA, 64 nt, hsa; identical to SEQ ID NO: 156270

SEQ ID NO: 627688 - RNA, 64 nt, hsa; identical to SEQ ID NO: 156271

SEQ ID NO: 627689 - RNA, 64 nt, hsa; identical to SEQ ID NO: 156272

SEQ ID NO: 627690 - RNA, 64 nt, hsa; identical to SEQ ID NO: 156273

SEQ ID NO: 627691 - RNA, 64 nt, hsa; identical to SEQ ID NO: 156274

SEQ ID NO: 627692 - RNA, 64 nt, hsa; identical to SEQ ID NO: 156275

SEQ ID NO: 627693 - RNA, 64 nt, hsa; identical to SEQ ID NO: 156276

SEQ ID NO: 627694 - RNA, 64 nt, hsa; identical to SEQ ID NO: 156277

SEQ ID NO: 627695 - RNA, 64 nt, hsa; identical to SEQ ID NO: 156278

SEQ ID NO: 627696 - RNA, 64 nt, hsa; identical to SEQ ID NO: 156279

SEQ ID NO: 627697 - RNA, 64 nt, hsa; identical to SEQ ID NO: 156280

SEQ ID NO: 627698 - RNA, 64 nt, hsa; identical to SEQ ID NO: 156281

SEQ ID NO: 627699 - RNA, 64 nt, hsa; identical to SEQ ID NO: 156282

SEQ ID NO: 627700 - RNA, 64 nt, hsa; identical to SEQ ID NO: 156283

SEQ ID NO: 627701 - RNA, 64 nt, hsa; identical to SEQ ID NO: 156284

SEQ ID NO: 627702 - RNA, 64 nt, hsa; identical to SEQ ID NO: 156285

SEQ ID NO: 627703 - RNA, 64 nt, hsa; identical to SEQ ID NO: 156286

SEQ ID NO: 627704 - RNA, 64 nt, hsa; identical to SEQ ID NO: 156287

SEQ ID NO: 627705 - RNA, 64 nt, hsa; identical to SEQ ID NO: 60934

SEQ ID NO: 627706 - RNA, 64 nt, hsa; identical to SEQ ID NO: 60935

SEQ ID NO: 627707 - RNA, 64 nt, hsa; identical to SEQ ID NO: 60936

SEQ ID NO: 627708 - RNA, 64 nt, hsa; identical to SEQ ID NO: 60937

SEQ ID NO: 627709 - RNA, 64 nt, hsa; identical to SEQ ID NO: 60938

SEQ ID NO: 627710 - RNA, 64 nt, hsa; identical to SEQ ID NO: 60939

SEQ ID NO: 627711 - RNA, 64 nt, hsa; identical to SEQ ID NO: 60940

SEQ ID NO: 627712 - RNA, 64 nt, hsa; identical to SEQ ID NO: 60941

SEQ ID NO: 627713 - RNA, 64 nt, hsa; identical to SEQ ID NO: 60942

SEQ ID NO: 627714 - RNA, 64 nt, hsa; identical to SEQ ID NO: 60943

SEQ ID NO: 627715 - RNA, 64 nt, hsa; identical to SEQ ID NO: 60944

SEQ ID NO: 627716 - RNA, 64 nt, hsa; identical to SEQ ID NO: 60945

SEQ ID NO: 627717 - RNA, 64 nt, hsa; identical to SEQ ID NO: 60946

SEQ ID NO: 627718 - RNA, 64 nt, hsa; identical to SEQ ID NO: 60947

SEQ ID NO: 627719 - RNA, 64 nt, hsa; identical to SEQ ID NO: 60948

SEQ ID NO: 627720 - RNA, 64 nt, hsa; identical to SEQ ID NO: 60949

SEQ ID NO: 627721 - RNA, 64 nt, hsa; identical to SEQ ID NO: 60950

SEQ ID NO: 627722 - RNA, 64 nt, hsa; identical to SEQ ID NO: 60951

SEQ ID NO: 627723 - RNA, 64 nt, hsa; identical to SEQ ID NO: 60952

SEQ ID NO: 627724 - RNA, 64 nt, hsa; identical to SEQ ID NO: 60953

SEQ ID NO: 627725 - RNA, 64 nt, hsa; identical to SEQ ID NO: 60954

SEQ ID NO: 627726 - RNA, 64 nt, hsa; identical to SEQ ID NO: 60955

SEQ ID NO: 627727 - RNA, 64 nt, hsa; identical to SEQ ID NO: 60956

SEQ ID NO: 627728 - RNA, 64 nt, hsa; identical to SEQ ID NO: 60957

SEQ ID NO: 627729 - RNA, 64 nt, hsa; identical to SEQ ID NO: 60958

SEQ ID NO: 627730 - RNA, 64 nt, hsa; identical to SEQ ID NO: 60959

SEQ ID NO: 627731 - RNA, 64 nt, hsa; identical to SEQ ID NO: 60960

SEQ ID NO: 627732 - RNA, 64 nt, hsa; identical to SEQ ID NO: 60961

SEQ ID NO: 627733 - RNA, 64 nt, hsa; identical to SEQ ID NO: 60962

SEQ ID NO: 627734 - RNA, 64 nt, hsa; identical to SEQ ID NO: 60963

SEQ ID NO: 627735 - RNA, 64 nt, hsa; identical to SEQ ID NO: 60964

SEQ ID NO: 627736 - RNA, 64 nt, hsa; identical to SEQ ID NO: 60965

SEQ ID NO: 627737 - RNA, 64 nt, hsa; identical to SEQ ID NO: 60966

SEQ ID NO: 627738 - RNA, 64 nt, hsa; identical to SEQ ID NO: 60967

SEQ ID NO: 627739 - RNA, 64 nt, hsa; identical to SEQ ID NO: 60968

SEQ ID NO: 627740 - RNA, 64 nt, hsa; identical to SEQ ID NO: 60969

SEQ ID NO: 627741 - RNA, 64 nt, hsa; identical to SEQ ID NO: 60970

SEQ ID NO: 627742 - RNA, 64 nt, hsa; identical to SEQ ID NO: 60971

SEQ ID NO: 627743 - RNA, 64 nt, hsa; identical to SEQ ID NO: 60972

SEQ ID NO: 627744 - RNA, 64 nt, hsa; identical to SEQ ID NO: 60973

SEQ ID NO: 627745 - RNA, 64 nt, hsa; identical to SEQ ID NO: 60974

SEQ ID NO: 627746 - RNA, 64 nt, hsa; identical to SEQ ID NO: 60975

SEQ ID NO: 627747 - RNA, 64 nt, hsa; identical to SEQ ID NO: 60976

SEQ ID NO: 627748 - RNA, 64 nt, hsa; identical to SEQ ID NO: 60977

SEQ ID NO: 627749 - RNA, 64 nt, hsa; identical to SEQ ID NO: 60978

SEQ ID NO: 627750 - RNA, 64 nt, hsa; identical to SEQ ID NO: 60979

SEQ ID NO: 627751 - RNA, 64 nt, hsa; identical to SEQ ID NO: 60980

SEQ ID NO: 627752 - RNA, 64 nt, hsa; identical to SEQ ID NO: 60981

SEQ ID NO: 627753 - RNA, 64 nt, hsa; identical to SEQ ID NO: 60982

SEQ ID NO: 627754 - RNA, 64 nt, hsa; identical to SEQ ID NO: 60983

SEQ ID NO: 627755 - RNA, 64 nt, hsa; identical to SEQ ID NO: 60984

SEQ ID NO: 627756 - RNA, 64 nt, hsa; identical to SEQ ID NO: 60985

SEQ ID NO: 627757 - RNA, 64 nt, hsa; identical to SEQ ID NO: 60986

SEQ ID NO: 627758 - RNA, 64 nt, hsa; identical to SEQ ID NO: 60987

SEQ ID NO: 627759 - RNA, 64 nt, hsa; identical to SEQ ID NO: 60988

SEQ ID NO: 627760 - RNA, 64 nt, hsa; identical to SEQ ID NO: 60989

SEQ ID NO: 627761 - RNA, 64 nt, hsa; identical to SEQ ID NO: 60990

SEQ ID NO: 627762 - RNA, 64 nt, hsa; identical to SEQ ID NO: 60991

SEQ ID NO: 627763 - RNA, 64 nt, hsa; identical to SEQ ID NO: 60992

SEQ ID NO: 627764 - RNA, 64 nt, hsa; identical to SEQ ID NO: 60993

SEQ ID NO: 627765 - RNA, 64 nt, hsa; identical to SEQ ID NO: 60994

SEQ ID NO: 627766 - RNA, 64 nt, hsa; identical to SEQ ID NO: 60995

SEQ ID NO: 627767 - RNA, 64 nt, hsa; identical to SEQ ID NO: 60996

SEQ ID NO: 627768 - RNA, 64 nt, hsa; identical to SEQ ID NO: 60997

SEQ ID NO: 627769 - RNA, 64 nt, hsa; identical to SEQ ID NO: 60998

SEQ ID NO: 627770 - RNA, 64 nt, hsa; identical to SEQ ID NO: 60999

SEQ ID NO: 627771 - RNA, 64 nt, hsa; identical to SEQ ID NO: 61000

SEQ ID NO: 627772 - RNA, 64 nt, hsa; identical to SEQ ID NO: 61001

SEQ ID NO: 627773 - RNA, 64 nt, hsa; identical to SEQ ID NO: 61002

SEQ ID NO: 627774 - RNA, 64 nt, hsa; identical to SEQ ID NO: 61003

SEQ ID NO: 627775 - RNA, 64 nt, hsa; identical to SEQ ID NO: 61004

SEQ ID NO: 627776 - RNA, 64 nt, hsa; identical to SEQ ID NO: 61005

SEQ ID NO: 627777 - RNA, 64 nt, hsa; identical to SEQ ID NO: 61006

SEQ ID NO: 627778 - RNA, 64 nt, hsa; identical to SEQ ID NO: 61007

SEQ ID NO: 627779 - RNA, 64 nt, hsa; identical to SEQ ID NO: 61008

SEQ ID NO: 627780 - RNA, 64 nt, hsa; identical to SEQ ID NO: 61009

SEQ ID NO: 627781 - RNA, 64 nt, hsa; identical to SEQ ID NO: 61010

SEQ ID NO: 627782 - RNA, 64 nt, hsa; identical to SEQ ID NO: 61011

SEQ ID NO: 627783 - RNA, 64 nt, hsa; identical to SEQ ID NO: 61009

SEQ ID NO: 627784 - RNA, 64 nt, hsa; identical to SEQ ID NO: 61013

SEQ ID NO: 627785 - RNA, 64 nt, hsa; identical to SEQ ID NO: 61014

SEQ ID NO: 627786 - RNA, 64 nt, hsa; identical to SEQ ID NO: 61015

SEQ ID NO: 627787 - RNA, 64 nt, hsa; identical to SEQ ID NO: 61016

SEQ ID NO: 627788 - RNA, 64 nt, hsa; identical to SEQ ID NO: 61017

SEQ ID NO: 627789 - RNA, 64 nt, hsa; identical to SEQ ID NO: 61018

SEQ ID NO: 627790 - RNA, 64 nt, hsa; identical to SEQ ID NO: 61019

SEQ ID NO: 627791 - RNA, 64 nt, hsa; identical to SEQ ID NO: 61020

SEQ ID NO: 627792 - RNA, 64 nt, hsa; identical to SEQ ID NO: 61021

SEQ ID NO: 627793 - RNA, 64 nt, hsa; identical to SEQ ID NO: 61022

SEQ ID NO: 627794 - RNA, 64 nt, hsa; identical to SEQ ID NO: 61023

SEQ ID NO: 627795 - RNA, 64 nt, hsa; identical to SEQ ID NO: 61024

SEQ ID NO: 627796 - RNA, 64 nt, hsa; identical to SEQ ID NO: 61025

SEQ ID NO: 627797 - RNA, 64 nt, hsa; identical to SEQ ID NO: 61026

SEQ ID NO: 627798 - RNA, 64 nt, hsa; identical to SEQ ID NO: 61027

SEQ ID NO: 627799 - RNA, 64 nt, hsa; identical to SEQ ID NO: 61028

SEQ ID NO: 627800 - RNA, 64 nt, hsa; identical to SEQ ID NO: 61029

SEQ ID NO: 627801 - RNA, 64 nt, hsa; identical to SEQ ID NO: 61030

SEQ ID NO: 627802 - RNA, 64 nt, hsa; identical to SEQ ID NO: 61031

SEQ ID NO: 627803 - RNA, 64 nt, hsa; identical to SEQ ID NO: 61032

SEQ ID NO: 627804 - RNA, 64 nt, hsa; identical to SEQ ID NO: 61033

SEQ ID NO: 627805 - RNA, 64 nt, hsa; identical to SEQ ID NO: 61034

SEQ ID NO: 627806 - RNA, 64 nt, hsa; identical to SEQ ID NO: 120942

SEQ ID NO: 627807 - RNA, 64 nt, hsa; identical to SEQ ID NO: 120943

SEQ ID NO: 627808 - RNA, 64 nt, hsa; identical to SEQ ID NO: 120944

SEQ ID NO: 627809 - RNA, 64 nt, hsa; identical to SEQ ID NO: 120945

SEQ ID NO: 627810 - RNA, 64 nt, hsa; identical to SEQ ID NO: 120946

SEQ ID NO: 627811 - RNA, 64 nt, hsa; identical to SEQ ID NO: 120947

SEQ ID NO: 627812 - RNA, 64 nt, hsa; identical to SEQ ID NO: 120948

SEQ ID NO: 627813 - RNA, 64 nt, hsa; identical to SEQ ID NO: 120949

SEQ ID NO: 627814 - RNA, 64 nt, hsa; identical to SEQ ID NO: 120950

SEQ ID NO: 627815 - RNA, 64 nt, hsa; identical to SEQ ID NO: 120951

SEQ ID NO: 627816 - RNA, 64 nt, hsa; identical to SEQ ID NO: 120952

SEQ ID NO: 627817 - RNA, 64 nt, hsa; identical to SEQ ID NO: 120953

SEQ ID NO: 627818 - RNA, 64 nt, hsa; identical to SEQ ID NO: 120954

SEQ ID NO: 627819 - RNA, 64 nt, hsa; identical to SEQ ID NO: 120955

SEQ ID NO: 627820 - RNA, 64 nt, hsa; identical to SEQ ID NO: 120956

SEQ ID NO: 627821 - RNA, 64 nt, hsa; identical to SEQ ID NO: 120957

SEQ ID NO: 627822 - RNA, 64 nt, hsa; identical to SEQ ID NO: 120958

SEQ ID NO: 627823 - RNA, 64 nt, hsa; identical to SEQ ID NO: 120959

SEQ ID NO: 627824 - RNA, 64 nt, hsa; identical to SEQ ID NO: 120960

SEQ ID NO: 627825 - RNA, 64 nt, hsa; identical to SEQ ID NO: 120961

SEQ ID NO: 627826 - RNA, 64 nt, hsa; identical to SEQ ID NO: 120962

SEQ ID NO: 627827 - RNA, 64 nt, hsa; identical to SEQ ID NO: 120963

SEQ ID NO: 627828 - RNA, 64 nt, hsa; identical to SEQ ID NO: 120964

SEQ ID NO: 627829 - RNA, 62 nt, hsa; identical to SEQ ID NO: 120965

SEQ ID NO: 627830 - RNA, 64 nt, hsa; identical to SEQ ID NO: 120966

SEQ ID NO: 627831 - RNA, 64 nt, hsa; identical to SEQ ID NO: 120967

SEQ ID NO: 627832 - RNA, 64 nt, hsa; identical to SEQ ID NO: 120968

SEQ ID NO: 627833 - RNA, 64 nt, hsa; identical to SEQ ID NO: 120969

SEQ ID NO: 627834 - RNA, 64 nt, hsa; identical to SEQ ID NO: 120970

SEQ ID NO: 627835 - RNA, 64 nt, hsa; identical to SEQ ID NO: 120971

SEQ ID NO: 627836 - RNA, 64 nt, hsa; identical to SEQ ID NO: 96939

SEQ ID NO: 627837 - RNA, 64 nt, hsa; identical to SEQ ID NO: 96940

SEQ ID NO: 627838 - RNA, 64 nt, hsa; identical to SEQ ID NO: 96941

SEQ ID NO: 627839 - RNA, 64 nt, hsa; identical to SEQ ID NO: 96942

SEQ ID NO: 627840 - RNA, 64 nt, hsa; identical to SEQ ID NO: 96943

SEQ ID NO: 627841 - RNA, 64 nt, hsa; identical to SEQ ID NO: 96944

SEQ ID NO: 627842 - RNA, 64 nt, hsa; identical to SEQ ID NO: 96945

SEQ ID NO: 627843 - RNA, 64 nt, hsa; identical to SEQ ID NO: 96946

SEQ ID NO: 627844 - RNA, 64 nt, hsa; identical to SEQ ID NO: 96947

SEQ ID NO: 627845 - RNA, 64 nt, hsa; identical to SEQ ID NO: 96948

SEQ ID NO: 627846 - RNA, 64 nt, hsa; identical to SEQ ID NO: 96949

SEQ ID NO: 627847 - RNA, 64 nt, hsa; identical to SEQ ID NO: 96950

SEQ ID NO: 627848 - RNA, 64 nt, hsa; identical to SEQ ID NO: 96951

SEQ ID NO: 627849 - RNA, 64 nt, hsa; identical to SEQ ID NO: 96952

SEQ ID NO: 627850 - RNA, 64 nt, hsa; identical to SEQ ID NO: 96953

SEQ ID NO: 627851 - RNA, 64 nt, hsa; identical to SEQ ID NO: 96954

SEQ ID NO: 627852 - RNA, 64 nt, hsa; identical to SEQ ID NO: 96955

SEQ ID NO: 627853 - RNA, 64 nt, hsa; identical to SEQ ID NO: 96956

SEQ ID NO: 627854 - RNA, 64 nt, hsa
aaguaagugcugaguugauuuucuagguucuuacguauuugaaaaauaaaauugcaauucgaga

SEQ ID NO: 627855 - RNA, 64 nt, hsa
ccuuuguacagcagccaaaucaugaacucaaaauguauuugaucacaguucuauaauguuuuua

SEQ ID NO: 627856 - RNA, 64 nt, hsa
uuuuuuguuguuguucuuugaagaacagucuguaguauuugaaggguuugggggagggagaaaa

SEQ ID NO: 627857 - RNA, 64 nt, hsa
uuuuuuugucuuuaaaaaauaauuggcagcaacuguauuugaauaaaaugauuucuuaguauga

SEQ ID NO: 627858 - RNA, 64 nt, hsa
gaguuacugaacaguaacauagcugugauuuuugguauuugaaacacugguuuuaaauauuuug

SEQ ID NO: 627859 - RNA, 64 nt, hsa
uccauauggucaaaaaggacugaaaaauugugauguauuugauccuguaacaaaguuguggaca

SEQ ID NO: 627860 - RNA, 64 nt, hsa
cuggcuuuuucuuuuaaugaauacuuuuuaguuuguauuugacuuuauuuccuuuauucaaauc

SEQ ID NO: 627861 - RNA, 64 nt, hsa
cucaaaguaaagccugagcaguguucucaguaauguauuugaaggaaaaauacccugauuugaa

SEQ ID NO: 627862 - RNA, 64 nt, hsa
auuuguagcauucuuuaaaucuaucuacugaaauguauuugacauucaagcaguuauauucggu

SEQ ID NO: 627863 - RNA, 64 nt, hsa
uauggaauagaauuuauugcugaaucaugcuccaguauuugagugauguuuuaaauauccuaug

SEQ ID NO: 627864 - RNA, 64 nt, hsa
uguugcuauuugcccagugagaaaacagauucugguauuugauuugguuuuucucuuuguuucc

SEQ ID NO: 627865 - RNA, 64 nt, hsa
uuaguuuugccuucauagguuauaugccaagauaguauuugauaagucaaugacauuuggaugu

SEQ ID NO: 627866 - RNA, 64 nt, hsa
uacccacgaacuguuaaauauaaaaaaauucaaaguauuugacaucuuaagcaaauauccagaa

SEQ ID NO: 627867 - RNA, 64 nt, hsa
uuaacauuuccacuucuguuuaucacaaaagacuguauuugaaauaugcauacggaaaauugaa

SEQ ID NO: 627868 - RNA, 64 nt, hsa
aauguguccaaaauaucacugcauacaauaucugguauuugaagagaaaaacugacuuuuguau

SEQ ID NO: 627869 - RNA, 64 nt, hsa
gcugaauaaaccacaucaaaggaaagggaccacaguauuugaauguuugaaagucuguaaagcu

SEQ ID NO: 627870 - RNA, 64 nt, hsa
cacugugccuggccaaguuucaguucuauaugaaguauuugauguuuuguuugaaacaauacag

SEQ ID NO: 627871 - RNA, 64 nt, hsa
ggaaaauuaacucaucuaaaaagaaucuuauuagguauuugaacucuaaaacuaacagauaaga

SEQ ID NO: 627872 - RNA, 64 nt, hsa
ggaauagacucagggauuucaccaggucggugcaguauuugauuucuggugaggugaccacagc

SEQ ID NO: 627873 - RNA, 64 nt, hsa
uuuccacaaaucucuugccuuuucagggcaaaguguauuugaucagaaguggccauuuggauua

SEQ ID NO: 627874 - RNA, 64 nt, hsa
guuuaaagcagggcacauuguugcagcaaaauguguauuugacaaauuauacuugcaauuuugg

SEQ ID NO: 627875 - RNA, 64 nt, hsa
cugcaagacagaugggaauguguauaauaacuagguauuugagaaguucugaaguuugauguaa

SEQ ID NO: 627876 - RNA, 64 nt, hsa
auuuaugcuuuaauggucaagcuuuuaaaaauuuguauuugauaacauccugaauucucaguuu

SEQ ID NO: 627877 - RNA, 64 nt, hsa
cagcauuguuugauuuuucuugaguuugauuuuaguauuugagauaaauacuuuuacauucuaa

SEQ ID NO: 627878 - RNA, 64 nt, hsa
ugagcuuuacugaggaauauucucacgcucugugguauuugaaucauuuugccaggucauuucu

SEQ ID NO: 627879 - RNA, 64 nt, hsa
gcuauccuguugauuuuuaugucuagcuuaaaagguauuugaaaauguuccauuuguguuuuau

SEQ ID NO: 627880 - RNA, 64 nt, hsa
aaaucaauaauaauaugcaaacaguugugccuguguauuugaacuacauacagguauguuguua

SEQ ID NO: 627881 - RNA, 64 nt, hsa
ccuaaggaaaaaacagcaucaugaaaggcaaaaaguauuugaaacguaauuguuucaauuuucc

SEQ ID NO: 627882 - RNA, 64 nt, hsa
guuuuuuuucuuacucuccaauguaaauauaugaguauuugaguuuuuaaaucacuucaacauu

SEQ ID NO: 627883 - RNA, 64 nt, hsa
uauauauauaaaaauauauauguauaagaguuauguauuugaaaaaaauauauaaaagaauaua

SEQ ID NO: 627884 - RNA, 64 nt, hsa
acagcaaauccuaggcucagaggcacagugcuuuguauuugauauacaaagucucuagacuuuc

SEQ ID NO: 627885 - RNA, 64 nt, hsa
cuuugacuugguauuauaagcuggaguuauauauguauuugaaaacagaguaaauacuuaagag

SEQ ID NO: 627886 - RNA, 64 nt, hsa
uccuuucugagggaggcuggugccgcucugcaggguauuugaaccuguggaauuggaggaggcc

SEQ ID NO: 627887 - RNA, 64 nt, hsa
cuaaaaaaguaauuuagauuuaaaguucuuugauguauuugauuuucuaaaucuuuaugguuau

SEQ ID NO: 627888 - RNA, 64 nt, hsa
uucuaaauaaacuuaaccuguuccagaaugucauguauuugacuuuuaagcccuaucucaguug

SEQ ID NO: 627889 - RNA, 64 nt, hsa
guuuuuuaaugguuuauugcugcagguuuuuuguguauuugauuuuuaguuuuuaacuuauuuu

SEQ ID NO: 627890 - RNA, 64 nt, hsa
cuggcuauucuuuaaucaugucuuucugaaauguguauuugagauuagaaauugagguugagag

SEQ ID NO: 627891 - RNA, 64 nt, hsa
aagaaaucauauauguauggauauauuuuaauaaguauuugaguacagacuuugagguuucauc

SEQ ID NO: 627892 - RNA, 64 nt, hsa
augguuuuaggaaagugaaaauauuuuuguuuuuguauuugaagaagaaugaugcauuuugaca

SEQ ID NO: 627893 - RNA, 64 nt, hsa; identical to SEQ ID NO: 306996

SEQ ID NO: 627894 - RNA, 64 nt, hsa; identical to SEQ ID NO: 306997

SEQ ID NO: 627895 - RNA, 64 nt, hsa; identical to SEQ ID NO: 306998

SEQ ID NO: 627896 - RNA, 64 nt, hsa; identical to SEQ ID NO: 306999

SEQ ID NO: 627897 - RNA, 64 nt, hsa; identical to SEQ ID NO: 307000

SEQ ID NO: 627898 - RNA, 64 nt, hsa; identical to SEQ ID NO: 307001

SEQ ID NO: 627899 - RNA, 64 nt, hsa; identical to SEQ ID NO: 307002

SEQ ID NO: 627900 - RNA, 64 nt, hsa; identical to SEQ ID NO: 307003

SEQ ID NO: 627901 - RNA, 64 nt, hsa; identical to SEQ ID NO: 307004

SEQ ID NO: 627902 - RNA, 64 nt, hsa; identical to SEQ ID NO: 307005

SEQ ID NO: 627903 - RNA, 64 nt, hsa; identical to SEQ ID NO: 307006

SEQ ID NO: 627904 - RNA, 64 nt, hsa; identical to SEQ ID NO: 307007

SEQ ID NO: 627905 - RNA, 64 nt, hsa
gccagugaaauugcuuuccuaugguauaucuccuuaccagaaaaaucucuaaauaaaaaaaggu

SEQ ID NO: 627906 - RNA, 64 nt, hsa
cagacuuauuggacaauuauguuuuuugcaguguuaccagaaucaaggcucuguuuauucccca

SEQ ID NO: 627907 - RNA, 64 nt, hsa
cuuguaaacauuugccaaauccaacuguaauuaguaccagaacuuagaaggaaagucacaaagc

SEQ ID NO: 627908 - RNA, 64 nt, hsa
agaacuuagaaggaaagucacaaagcaugccuuuuaccagaauauugcuuugccuuuucuuaua

SEQ ID NO: 627909 - RNA, 64 nt, hsa
acucaaaaugcuguuggaauaugcagagaauugcuaccagaauauucaguaagguuucagggag

SEQ ID NO: 627910 - RNA, 64 nt, hsa
auaauguuucuccauaacagagaauguuaauggauaccagaauuuuauuuuuguauuuauguuc

SEQ ID NO: 627911 - RNA, 64 nt, hsa
agacacagugcgguaccagaauugccuuagaagauaccagaaggugcggucuagggaccaguga

SEQ ID NO: 627912 - RNA, 64 nt, hsa
gacauuuaaauaggccaacccagacacagugcgguaccagaauugccuuagaagauaccagaag

SEQ ID NO: 627913 - RNA, 64 nt, hsa
cuauuuuguaaacauaucugcuuuaauggggauguaccagaaacccaccucaccccggcucaca

SEQ ID NO: 627914 - RNA, 64 nt, hsa
ucaguagggacauugcagaagcuugaaaggccaauaccagaacacaggcugaugcuucugagaa

SEQ ID NO: 627915 - RNA, 64 nt, hsa; identical to SEQ ID NO: 103765

SEQ ID NO: 627916 - RNA, 64 nt, hsa; identical to SEQ ID NO: 103766

SEQ ID NO: 627917 - RNA, 53 nt, hsa; identical to SEQ ID NO: 103767

SEQ ID NO: 627918 - RNA, 64 nt, hsa; identical to SEQ ID NO: 103768

SEQ ID NO: 627919 - RNA, 64 nt, hsa; identical to SEQ ID NO: 103769

SEQ ID NO: 627920 - RNA, 64 nt, hsa; identical to SEQ ID NO: 103770

SEQ ID NO: 627921 - RNA, 53 nt, hsa; identical to SEQ ID NO: 103771

SEQ ID NO: 627922 - RNA, 64 nt, hsa; identical to SEQ ID NO: 103772

SEQ ID NO: 627923 - RNA, 64 nt, hsa; identical to SEQ ID NO: 103773

SEQ ID NO: 627924 - RNA, 64 nt, hsa; identical to SEQ ID NO: 103774

SEQ ID NO: 627925 - RNA, 64 nt, hsa; identical to SEQ ID NO: 103775

SEQ ID NO: 627926 - RNA, 64 nt, hsa; identical to SEQ ID NO: 103776

SEQ ID NO: 627927 - RNA, 64 nt, hsa
auauuaaauccacaauauuuuauuacauuuuuaacuuguauaaauuuuaggucaaauccuucaa

SEQ ID NO: 627928 - RNA, 64 nt, hsa
aucucaaugucaccuuguuugcauucuuggauagcuuguauauguaguaguuugaugaauaauu

SEQ ID NO: 627929 - RNA, 64 nt, hsa
ugggagccaccaugccugacccacacacuuuuuacuuguauagaugauuuuuggcuuggacaua

SEQ ID NO: 627930 - RNA, 64 nt, hsa
ccaagccuguccauggauauaucaaaugucuucacuuguauauuuucauggcuagguauuucua

SEQ ID NO: 627931 - RNA, 64 nt, hsa
ucucuuauuuuugacaaacaucaauaaaugcuuacuuguauauagagauaauaaaccuauuacc

SEQ ID NO: 627932 - RNA, 64 nt, hsa
uguugaugguguuuuauugucauguguugcuugccuuguauaguugacuucauugucuggauaa

SEQ ID NO: 627933 - RNA, 64 nt, hsa
ugggauuuucuuuucuuuucucugguaauauugacuuguauauuuuaagaaauaacagaaagcc

SEQ ID NO: 627934 - RNA, 64 nt, hsa
aaaaaguuuuaguuuugaugaguugugaguuuaccuuguauacuguaggcacacuuugcacuga

SEQ ID NO: 627935 - RNA, 64 nt, hsa
cagagaaauguguggucguauuuuuuacuuuugucuuguauauguauguauauuggguccucug

SEQ ID NO: 627936 - RNA, 64 nt, hsa
acaguuuugauaaagaggcucucauuuccugugucuuguauauucaguccuuucaauacgucca

SEQ ID NO: 627937 - RNA, 64 nt, hsa
uaacacuuaucuucuuaaguaaaugcucucauaacuuguauacauuuuugcagguacaaauuca

SEQ ID NO: 627938 - RNA, 64 nt, hsa
acauauguacaugaauauauauauauucauguaucuuguauauaaaauauaggcauauaccuca

SEQ ID NO: 627939 - RNA, 64 nt, hsa
aguuacauucucaaguuuuuaaaaucaaggggaacuuguauacugggccuguuuuucagccugu

SEQ ID NO: 627940 - RNA, 64 nt, hsa
uuaaauagucaucaauaugaagccaugauuaaugcuuguauaaugugaugcaauaaaauuuaaa

SEQ ID NO: 627941 - RNA, 64 nt, hsa
uggguuuucuuuuucuuuguuuuuuucuugaucacuuguauaggaaacaauauuuuccaguguu

SEQ ID NO: 627942 - RNA, 64 nt, hsa
ugagaugauuuuuaagugauaaauuaaacuucuucuuguauaaauucugcccagaucucuccac

SEQ ID NO: 627943 - RNA, 64 nt, hsa
gacuuuaaauuuuaaagagcucauuugcaaugcacuuguauacacuucaaaaauuauuguagac

SEQ ID NO: 627944 - RNA, 64 nt, hsa
uaaauggaaccucuccauguguauauaguauuuccuuguauaaagcacuuuacuaccuaccacu

SEQ ID NO: 627945 - RNA, 64 nt, hsa
uuauuuaaaagggauacuuuuguaaaaguaaaaccuuguauaaagaacaaaauguuucuuaauu

SEQ ID NO: 627946 - RNA, 64 nt, hsa
agaaagggggcuuagggaugagguccugguuuuucuuguauaaauaggagucaugggcguuagu

SEQ ID NO: 627947 - RNA, 64 nt, hsa
uguaccaacagaaauauuauuguaagaugccuuucuuguauaagauaugccaauauuugcuuua

SEQ ID NO: 627948 - RNA, 64 nt, hsa
ccuaaguggcuuagcugggucuuucauagccaaacuuguauauuuaaauucuuuguaauaauaa

SEQ ID NO: 627949 - RNA, 64 nt, hsa; identical to SEQ ID NO: 352993

SEQ ID NO: 627950 - RNA, 64 nt, hsa; identical to SEQ ID NO: 352994

SEQ ID NO: 627951 - RNA, 64 nt, hsa; identical to SEQ ID NO: 352995

SEQ ID NO: 627952 - RNA, 64 nt, hsa; identical to SEQ ID NO: 352996

SEQ ID NO: 627953 - RNA, 64 nt, hsa; identical to SEQ ID NO: 352997

SEQ ID NO: 627954 - RNA, 64 nt, hsa; identical to SEQ ID NO: 352998

SEQ ID NO: 627955 - RNA, 64 nt, hsa; identical to SEQ ID NO: 352999

SEQ ID NO: 627956 - RNA, 64 nt, hsa; identical to SEQ ID NO: 353000

SEQ ID NO: 627957 - RNA, 64 nt, hsa; identical to SEQ ID NO: 353001

SEQ ID NO: 627958 - RNA, 64 nt, hsa; identical to SEQ ID NO: 353002

SEQ ID NO: 627959 - RNA, 64 nt, hsa; identical to SEQ ID NO: 353003

SEQ ID NO: 627960 - RNA, 64 nt, hsa; identical to SEQ ID NO: 353004

SEQ ID NO: 627961 - RNA, 64 nt, hsa; identical to SEQ ID NO: 353005

SEQ ID NO: 627962 - RNA, 64 nt, hsa; identical to SEQ ID NO: 353006

SEQ ID NO: 627963 - RNA, 64 nt, hsa; identical to SEQ ID NO: 353007

SEQ ID NO: 627964 - RNA, 64 nt, hsa; identical to SEQ ID NO: 353008

SEQ ID NO: 627965 - RNA, 64 nt, hsa; identical to SEQ ID NO: 353009

SEQ ID NO: 627966 - RNA, 64 nt, hsa; identical to SEQ ID NO: 353010

SEQ ID NO: 627967 - RNA, 64 nt, hsa; identical to SEQ ID NO: 353011

SEQ ID NO: 627968 - RNA, 64 nt, hsa; identical to SEQ ID NO: 353012

SEQ ID NO: 627969 - RNA, 64 nt, hsa; identical to SEQ ID NO: 353013

SEQ ID NO: 627970 - RNA, 64 nt, hsa; identical to SEQ ID NO: 353014

SEQ ID NO: 627971 - RNA, 64 nt, hsa; identical to SEQ ID NO: 353015

SEQ ID NO: 627972 - RNA, 64 nt, hsa; identical to SEQ ID NO: 353016

SEQ ID NO: 627973 - RNA, 64 nt, hsa; identical to SEQ ID NO: 353017

SEQ ID NO: 627974 - RNA, 64 nt, hsa; identical to SEQ ID NO: 353018

SEQ ID NO: 627975 - RNA, 64 nt, hsa; identical to SEQ ID NO: 353019

SEQ ID NO: 627976 - RNA, 64 nt, hsa; identical to SEQ ID NO: 353020

SEQ ID NO: 627977 - RNA, 64 nt, hsa; identical to SEQ ID NO: 353021

SEQ ID NO: 627978 - RNA, 64 nt, hsa; identical to SEQ ID NO: 353022

SEQ ID NO: 627979 - RNA, 64 nt, hsa; identical to SEQ ID NO: 353023

SEQ ID NO: 627980 - RNA, 64 nt, hsa; identical to SEQ ID NO: 353024

SEQ ID NO: 627981 - RNA, 64 nt, hsa; identical to SEQ ID NO: 353025

SEQ ID NO: 627982 - RNA, 64 nt, hsa; identical to SEQ ID NO: 353026

SEQ ID NO: 627983 - RNA, 64 nt, hsa; identical to SEQ ID NO: 353027

SEQ ID NO: 627984 - RNA, 64 nt, hsa; identical to SEQ ID NO: 353028

SEQ ID NO: 627985 - RNA, 64 nt, hsa; identical to SEQ ID NO: 353029

SEQ ID NO: 627986 - RNA, 64 nt, hsa; identical to SEQ ID NO: 353030

SEQ ID NO: 627987 - RNA, 64 nt, hsa; identical to SEQ ID NO: 353031

SEQ ID NO: 627988 - RNA, 64 nt, hsa; identical to SEQ ID NO: 353032

SEQ ID NO: 627989 - RNA, 64 nt, hsa; identical to SEQ ID NO: 353033

SEQ ID NO: 627990 - RNA, 64 nt, hsa; identical to SEQ ID NO: 353034

SEQ ID NO: 627991 - RNA, 64 nt, hsa; identical to SEQ ID NO: 353035

SEQ ID NO: 627992 - RNA, 64 nt, hsa; identical to SEQ ID NO: 353036

SEQ ID NO: 627993 - RNA, 64 nt, hsa; identical to SEQ ID NO: 353037

SEQ ID NO: 627994 - RNA, 64 nt, hsa; identical to SEQ ID NO: 353038

SEQ ID NO: 627995 - RNA, 64 nt, hsa; identical to SEQ ID NO: 353039

SEQ ID NO: 627996 - RNA, 64 nt, hsa; identical to SEQ ID NO: 353040

SEQ ID NO: 627997 - RNA, 64 nt, hsa; identical to SEQ ID NO: 353041

SEQ ID NO: 627998 - RNA, 64 nt, hsa; identical to SEQ ID NO: 353042

SEQ ID NO: 627999 - RNA, 64 nt, hsa; identical to SEQ ID NO: 353043

SEQ ID NO: 628000 - RNA, 64 nt, hsa; identical to SEQ ID NO: 353044

SEQ ID NO: 628001 - RNA, 64 nt, hsa; identical to SEQ ID NO: 353045

SEQ ID NO: 628002 - RNA, 64 nt, hsa; identical to SEQ ID NO: 353046

SEQ ID NO: 628003 - RNA, 64 nt, hsa; identical to SEQ ID NO: 353047

SEQ ID NO: 628004 - RNA, 64 nt, hsa; identical to SEQ ID NO: 353048

SEQ ID NO: 628005 - RNA, 64 nt, hsa; identical to SEQ ID NO: 353049

SEQ ID NO: 628006 - RNA, 64 nt, hsa; identical to SEQ ID NO: 353050

SEQ ID NO: 628007 - RNA, 64 nt, hsa; identical to SEQ ID NO: 353051

SEQ ID NO: 628008 - RNA, 64 nt, hsa; identical to SEQ ID NO: 353052

SEQ ID NO: 628009 - RNA, 64 nt, hsa; identical to SEQ ID NO: 353053

SEQ ID NO: 628010 - RNA, 64 nt, hsa; identical to SEQ ID NO: 353054

SEQ ID NO: 628011 - RNA, 64 nt, hsa; identical to SEQ ID NO: 353055

SEQ ID NO: 628012 - RNA, 64 nt, hsa; identical to SEQ ID NO: 353056

SEQ ID NO: 628013 - RNA, 64 nt, hsa; identical to SEQ ID NO: 353057

SEQ ID NO: 628014 - RNA, 64 nt, hsa; identical to SEQ ID NO: 353058

SEQ ID NO: 628015 - RNA, 64 nt, hsa; identical to SEQ ID NO: 353059

SEQ ID NO: 628016 - RNA, 64 nt, hsa; identical to SEQ ID NO: 353060

SEQ ID NO: 628017 - RNA, 64 nt, hsa; identical to SEQ ID NO: 353061

SEQ ID NO: 628018 - RNA, 64 nt, hsa; identical to SEQ ID NO: 353062

SEQ ID NO: 628019 - RNA, 64 nt, hsa; identical to SEQ ID NO: 353063

SEQ ID NO: 628020 - RNA, 64 nt, hsa; identical to SEQ ID NO: 353064

SEQ ID NO: 628021 - RNA, 64 nt, hsa; identical to SEQ ID NO: 353065

SEQ ID NO: 628022 - RNA, 64 nt, hsa; identical to SEQ ID NO: 353066

SEQ ID NO: 628023 - RNA, 64 nt, hsa; identical to SEQ ID NO: 353067

SEQ ID NO: 628024 - RNA, 64 nt, hsa; identical to SEQ ID NO: 353068

SEQ ID NO: 628025 - RNA, 64 nt, hsa; identical to SEQ ID NO: 353069

SEQ ID NO: 628026 - RNA, 64 nt, hsa; identical to SEQ ID NO: 353070

SEQ ID NO: 628027 - RNA, 64 nt, hsa; identical to SEQ ID NO: 353071

SEQ ID NO: 628028 - RNA, 64 nt, hsa; identical to SEQ ID NO: 353072

SEQ ID NO: 628029 - RNA, 64 nt, hsa; identical to SEQ ID NO: 353073

SEQ ID NO: 628030 - RNA, 64 nt, hsa; identical to SEQ ID NO: 353074

SEQ ID NO: 628031 - RNA, 64 nt, hsa; identical to SEQ ID NO: 353075

SEQ ID NO: 628032 - RNA, 64 nt, hsa; identical to SEQ ID NO: 353076

SEQ ID NO: 628033 - RNA, 64 nt, hsa; identical to SEQ ID NO: 353077

SEQ ID NO: 628034 - RNA, 64 nt, hsa; identical to SEQ ID NO: 353078

SEQ ID NO: 628035 - RNA, 64 nt, hsa; identical to SEQ ID NO: 353079

SEQ ID NO: 628036 - RNA, 64 nt, hsa; identical to SEQ ID NO: 353080

SEQ ID NO: 628037 - RNA, 64 nt, hsa; identical to SEQ ID NO: 353081

SEQ ID NO: 628038 - RNA, 64 nt, hsa; identical to SEQ ID NO: 353082

SEQ ID NO: 628039 - RNA, 64 nt, hsa; identical to SEQ ID NO: 353083

SEQ ID NO: 628040 - RNA, 64 nt, hsa; identical to SEQ ID NO: 353084

SEQ ID NO: 628041 - RNA, 64 nt, hsa; identical to SEQ ID NO: 353085

SEQ ID NO: 628042 - RNA, 64 nt, hsa; identical to SEQ ID NO: 353086

SEQ ID NO: 628043 - RNA, 64 nt, hsa; identical to SEQ ID NO: 353087

SEQ ID NO: 628044 - RNA, 64 nt, hsa; identical to SEQ ID NO: 353088

SEQ ID NO: 628045 - RNA, 64 nt, hsa; identical to SEQ ID NO: 353089

SEQ ID NO: 628046 - RNA, 64 nt, hsa; identical to SEQ ID NO: 353090

SEQ ID NO: 628047 - RNA, 64 nt, hsa; identical to SEQ ID NO: 353091

SEQ ID NO: 628048 - RNA, 64 nt, hsa; identical to SEQ ID NO: 353092

SEQ ID NO: 628049 - RNA, 64 nt, hsa; identical to SEQ ID NO: 353093

SEQ ID NO: 628050 - RNA, 64 nt, hsa; identical to SEQ ID NO: 353094

SEQ ID NO: 628051 - RNA, 64 nt, hsa; identical to SEQ ID NO: 353095

SEQ ID NO: 628052 - RNA, 64 nt, hsa; identical to SEQ ID NO: 353096

SEQ ID NO: 628053 - RNA, 64 nt, hsa; identical to SEQ ID NO: 353097

SEQ ID NO: 628054 - RNA, 64 nt, hsa; identical to SEQ ID NO: 353098

SEQ ID NO: 628055 - RNA, 64 nt, hsa; identical to SEQ ID NO: 353099

SEQ ID NO: 628056 - RNA, 64 nt, hsa; identical to SEQ ID NO: 353100

SEQ ID NO: 628057 - RNA, 64 nt, hsa; identical to SEQ ID NO: 353101

SEQ ID NO: 628058 - RNA, 64 nt, hsa; identical to SEQ ID NO: 353102

SEQ ID NO: 628059 - RNA, 64 nt, hsa; identical to SEQ ID NO: 353103

SEQ ID NO: 628060 - RNA, 64 nt, hsa; identical to SEQ ID NO: 353104

SEQ ID NO: 628061 - RNA, 64 nt, hsa; identical to SEQ ID NO: 353105

SEQ ID NO: 628062 - RNA, 64 nt, hsa; identical to SEQ ID NO: 353106

SEQ ID NO: 628063 - RNA, 64 nt, hsa; identical to SEQ ID NO: 353107

SEQ ID NO: 628064 - RNA, 64 nt, hsa; identical to SEQ ID NO: 353108

SEQ ID NO: 628065 - RNA, 64 nt, hsa; identical to SEQ ID NO: 353109

SEQ ID NO: 628066 - RNA, 64 nt, hsa; identical to SEQ ID NO: 353110

SEQ ID NO: 628067 - RNA, 64 nt, hsa; identical to SEQ ID NO: 353111

SEQ ID NO: 628068 - RNA, 64 nt, hsa; identical to SEQ ID NO: 353112

SEQ ID NO: 628069 - RNA, 64 nt, hsa; identical to SEQ ID NO: 353113

SEQ ID NO: 628070 - RNA, 64 nt, hsa; identical to SEQ ID NO: 353114

SEQ ID NO: 628071 - RNA, 64 nt, hsa; identical to SEQ ID NO: 353115

SEQ ID NO: 628072 - RNA, 64 nt, hsa; identical to SEQ ID NO: 353116

SEQ ID NO: 628073 - RNA, 64 nt, hsa; identical to SEQ ID NO: 353117

SEQ ID NO: 628074 - RNA, 64 nt, hsa; identical to SEQ ID NO: 353118

SEQ ID NO: 628075 - RNA, 64 nt, hsa; identical to SEQ ID NO: 353119

SEQ ID NO: 628076 - RNA, 64 nt, hsa; identical to SEQ ID NO: 353120

SEQ ID NO: 628077 - RNA, 64 nt, hsa; identical to SEQ ID NO: 353121

SEQ ID NO: 628078 - RNA, 64 nt, hsa; identical to SEQ ID NO: 353122

SEQ ID NO: 628079 - RNA, 64 nt, hsa; identical to SEQ ID NO: 353123

SEQ ID NO: 628080 - RNA, 64 nt, hsa; identical to SEQ ID NO: 353124

SEQ ID NO: 628081 - RNA, 64 nt, hsa; identical to SEQ ID NO: 353125

SEQ ID NO: 628082 - RNA, 64 nt, hsa; identical to SEQ ID NO: 353126

SEQ ID NO: 628083 - RNA, 64 nt, hsa; identical to SEQ ID NO: 353127

SEQ ID NO: 628084 - RNA, 64 nt, hsa; identical to SEQ ID NO: 353128

SEQ ID NO: 628085 - RNA, 64 nt, hsa; identical to SEQ ID NO: 353129

SEQ ID NO: 628086 - RNA, 64 nt, hsa; identical to SEQ ID NO: 353130

SEQ ID NO: 628087 - RNA, 64 nt, hsa; identical to SEQ ID NO: 353131

SEQ ID NO: 628088 - RNA, 64 nt, hsa; identical to SEQ ID NO: 353132

SEQ ID NO: 628089 - RNA, 64 nt, hsa; identical to SEQ ID NO: 353133

SEQ ID NO: 628090 - RNA, 64 nt, hsa; identical to SEQ ID NO: 353134

SEQ ID NO: 628091 - RNA, 64 nt, hsa; identical to SEQ ID NO: 353135

SEQ ID NO: 628092 - RNA, 64 nt, hsa; identical to SEQ ID NO: 353136

SEQ ID NO: 628093 - RNA, 64 nt, hsa; identical to SEQ ID NO: 353137

SEQ ID NO: 628094 - RNA, 64 nt, hsa; identical to SEQ ID NO: 353138

SEQ ID NO: 628095 - RNA, 64 nt, hsa; identical to SEQ ID NO: 353139

SEQ ID NO: 628096 - RNA, 64 nt, hsa; identical to SEQ ID NO: 353140

SEQ ID NO: 628097 - RNA, 64 nt, hsa; identical to SEQ ID NO: 353141

SEQ ID NO: 628098 - RNA, 64 nt, hsa; identical to SEQ ID NO: 353142

SEQ ID NO: 628099 - RNA, 64 nt, hsa; identical to SEQ ID NO: 353143

SEQ ID NO: 628100 - RNA, 64 nt, hsa; identical to SEQ ID NO: 353144

SEQ ID NO: 628101 - RNA, 64 nt, hsa; identical to SEQ ID NO: 353145

SEQ ID NO: 628102 - RNA, 64 nt, hsa; identical to SEQ ID NO: 353146

SEQ ID NO: 628103 - RNA, 64 nt, hsa; identical to SEQ ID NO: 353147

SEQ ID NO: 628104 - RNA, 64 nt, hsa; identical to SEQ ID NO: 353148

SEQ ID NO: 628105 - RNA, 64 nt, hsa; identical to SEQ ID NO: 353149

SEQ ID NO: 628106 - RNA, 64 nt, hsa; identical to SEQ ID NO: 353150

SEQ ID NO: 628107 - RNA, 64 nt, hsa; identical to SEQ ID NO: 353151

SEQ ID NO: 628108 - RNA, 64 nt, hsa; identical to SEQ ID NO: 353152

SEQ ID NO: 628109 - RNA, 64 nt, hsa; identical to SEQ ID NO: 353153

SEQ ID NO: 628110 - RNA, 64 nt, hsa; identical to SEQ ID NO: 353154

SEQ ID NO: 628111 - RNA, 64 nt, hsa; identical to SEQ ID NO: 353155

SEQ ID NO: 628112 - RNA, 64 nt, hsa; identical to SEQ ID NO: 353156

SEQ ID NO: 628113 - RNA, 64 nt, hsa; identical to SEQ ID NO: 353157

SEQ ID NO: 628114 - RNA, 64 nt, hsa; identical to SEQ ID NO: 353158

SEQ ID NO: 628115 - RNA, 64 nt, hsa; identical to SEQ ID NO: 353159

SEQ ID NO: 628116 - RNA, 64 nt, hsa; identical to SEQ ID NO: 353160

SEQ ID NO: 628117 - RNA, 64 nt, hsa; identical to SEQ ID NO: 353161

SEQ ID NO: 628118 - RNA, 64 nt, hsa; identical to SEQ ID NO: 353162

SEQ ID NO: 628119 - RNA, 64 nt, hsa; identical to SEQ ID NO: 353163

SEQ ID NO: 628120 - RNA, 64 nt, hsa; identical to SEQ ID NO: 353164

SEQ ID NO: 628121 - RNA, 64 nt, hsa; identical to SEQ ID NO: 353165

SEQ ID NO: 628122 - RNA, 64 nt, hsa; identical to SEQ ID NO: 78063

SEQ ID NO: 628123 - RNA, 64 nt, hsa; identical to SEQ ID NO: 78064

SEQ ID NO: 628124 - RNA, 64 nt, hsa; identical to SEQ ID NO: 78065

SEQ ID NO: 628125 - RNA, 64 nt, hsa; identical to SEQ ID NO: 78066

SEQ ID NO: 628126 - RNA, 64 nt, hsa; identical to SEQ ID NO: 78067

SEQ ID NO: 628127 - RNA, 64 nt, hsa; identical to SEQ ID NO: 78068

SEQ ID NO: 628128 - RNA, 64 nt, hsa; identical to SEQ ID NO: 78069

SEQ ID NO: 628129 - RNA, 64 nt, hsa; identical to SEQ ID NO: 78070

SEQ ID NO: 628130 - RNA, 64 nt, hsa; identical to SEQ ID NO: 78071

SEQ ID NO: 628131 - RNA, 64 nt, hsa; identical to SEQ ID NO: 78072

SEQ ID NO: 628132 - RNA, 62 nt, hsa
gaaaugaagguuucauaaugaucauuuuguuaaaggucuacuuuaaucagaaauagcaacga

SEQ ID NO: 628133 - RNA, 62 nt, hsa
uggucuucagcuaaaaaauaggauaagaaauuaaggucuauuccauucuccauauccugggu

SEQ ID NO: 628134 - RNA, 62 nt, hsa
aggucuagagugauuuguauuggaugguaacuaaggucuauacaucuacucuuuuaauucuu

SEQ ID NO: 628135 - RNA, 62 nt, hsa
guaaggacaguuucgguaguuaaguggaauuaaaggucuagagugauuuguauuggauggua

SEQ ID NO: 628136 - RNA, 64 nt, hsa; identical to SEQ ID NO: 413778

SEQ ID NO: 628137 - RNA, 64 nt, hsa; identical to SEQ ID NO: 413779

SEQ ID NO: 628138 - RNA, 64 nt, hsa; identical to SEQ ID NO: 413780

SEQ ID NO: 628139 - RNA, 64 nt, hsa; identical to SEQ ID NO: 413781

SEQ ID NO: 628140 - RNA, 64 nt, hsa; identical to SEQ ID NO: 413782

SEQ ID NO: 628141 - RNA, 64 nt, hsa; identical to SEQ ID NO: 413783

SEQ ID NO: 628142 - RNA, 64 nt, hsa; identical to SEQ ID NO: 413784

SEQ ID NO: 628143 - RNA, 64 nt, hsa; identical to SEQ ID NO: 413785

SEQ ID NO: 628144 - RNA, 64 nt, hsa
agagaguauguauuuaaguccguuugggcugcuauaacagaauaccacagacuggguaacguga

SEQ ID NO: 628145 - RNA, 64 nt, hsa
ugguacuuuuauucagacuuguuuccuuucuaguuaacagaaauagugacauuuagagguuuua

SEQ ID NO: 628146 - RNA, 64 nt, hsa
ugucugcugccauuaacagaacagaaguaauggauaacagaauggaaauaagagaugccagaac

SEQ ID NO: 628147 - RNA, 64 nt, hsa
aaaucucaguaguuaaucaagugucugcugccauuaacagaacagaaguaauggauaacagaau

SEQ ID NO: 628148 - RNA, 64 nt, hsa
auauaugaaugucuuagccaauuuucugcuacuauaacagaauacgacagacuggguaauuuaa

SEQ ID NO: 628149 - RNA, 64 nt, hsa
aaauguuuucuauuuugcauauuuucaggcaugguaacagaaauuuaccuuuuaauaaauuaaa

SEQ ID NO: 628150 - RNA, 64 nt, hsa
ccggagaaggaaaagaacuuacgaccuuucuuuauaacagaaacucaacucuaaauucaacaag

SEQ ID NO: 628151 - RNA, 64 nt, hsa
aucuucauugucacuuugucuuaccucaauugaguaacagaauauagcuccugaaggaaacacu

SEQ ID NO: 628152 - RNA, 64 nt, hsa
cagcacacuugaugguuguugccgaaguauuuucuaacagaaacucuuagguggaauguuucug

SEQ ID NO: 628153 - RNA, 64 nt, hsa
agaaucaagaaacaaauuuuaauuaaacaaucuguaacagaaucaagaaacaaauacauuuuaa

SEQ ID NO: 628154 - RNA, 64 nt, hsa
uagcaucccuuuucacaugguuucuccauguauauaacagaaucaagaaacaaauuuuaauuaa

SEQ ID NO: 628155 - RNA, 64 nt, hsa
caccaagugcuacugucccuuuguaauuggcuucuaacagaauucaaccagaaauaauugauaa

SEQ ID NO: 628156 - RNA, 64 nt, hsa
cuccauuuuugccuucgaaugcauauuuaagaguuaacagaaugaaaaaaaaaagucuuguugg

SEQ ID NO: 628157 - RNA, 64 nt, hsa
uagaugaaucagugcccaagacauauuuucuguuuaacagaacuuucuacagauacauuuuuua

SEQ ID NO: 628158 - RNA, 64 nt, hsa
gaguggcagcugccugccaaaaucuguuccgcuguaacagaacugaauuuggaccccagcacag

SEQ ID NO: 628159 - RNA, 64 nt, hsa
gaccucugauugcaccacugcacuccaggcuggguaacagaaugagaccuuaucucaaaaauaa

SEQ ID NO: 628160 - RNA, 64 nt, hsa; identical to SEQ ID NO: 413778

SEQ ID NO: 628161 - RNA, 64 nt, hsa; identical to SEQ ID NO: 413779

SEQ ID NO: 628162 - RNA, 64 nt, hsa; identical to SEQ ID NO: 413780

SEQ ID NO: 628163 - RNA, 64 nt, hsa; identical to SEQ ID NO: 413781

SEQ ID NO: 628164 - RNA, 64 nt, hsa; identical to SEQ ID NO: 413782

SEQ ID NO: 628165 - RNA, 64 nt, hsa; identical to SEQ ID NO: 413783

SEQ ID NO: 628166 - RNA, 64 nt, hsa; identical to SEQ ID NO: 413784

SEQ ID NO: 628167 - RNA, 64 nt, hsa; identical to SEQ ID NO: 413785

SEQ ID NO: 628168 - RNA, 64 nt, hsa; identical to SEQ ID NO: 628144

SEQ ID NO: 628169 - RNA, 64 nt, hsa; identical to SEQ ID NO: 628145

SEQ ID NO: 628170 - RNA, 64 nt, hsa; identical to SEQ ID NO: 628146

SEQ ID NO: 628171 - RNA, 64 nt, hsa; identical to SEQ ID NO: 628147

SEQ ID NO: 628172 - RNA, 64 nt, hsa; identical to SEQ ID NO: 628148

SEQ ID NO: 628173 - RNA, 64 nt, hsa; identical to SEQ ID NO: 628149

SEQ ID NO: 628174 - RNA, 64 nt, hsa; identical to SEQ ID NO: 628150

SEQ ID NO: 628175 - RNA, 64 nt, hsa; identical to SEQ ID NO: 628151

SEQ ID NO: 628176 - RNA, 64 nt, hsa; identical to SEQ ID NO: 628152

SEQ ID NO: 628177 - RNA, 64 nt, hsa; identical to SEQ ID NO: 628153

SEQ ID NO: 628178 - RNA, 64 nt, hsa; identical to SEQ ID NO: 628154

SEQ ID NO: 628179 - RNA, 64 nt, hsa; identical to SEQ ID NO: 628155

SEQ ID NO: 628180 - RNA, 64 nt, hsa; identical to SEQ ID NO: 628156

SEQ ID NO: 628181 - RNA, 64 nt, hsa; identical to SEQ ID NO: 628157

SEQ ID NO: 628182 - RNA, 64 nt, hsa; identical to SEQ ID NO: 628158

SEQ ID NO: 628183 - RNA, 64 nt, hsa; identical to SEQ ID NO: 628159

SEQ ID NO: 628184 - RNA, 64 nt, hsa; identical to SEQ ID NO: 98228

SEQ ID NO: 628185 - RNA, 64 nt, hsa; identical to SEQ ID NO: 98229

SEQ ID NO: 628186 - RNA, 64 nt, hsa; identical to SEQ ID NO: 98230

SEQ ID NO: 628187 - RNA, 64 nt, hsa; identical to SEQ ID NO: 98231

SEQ ID NO: 628188 - RNA, 64 nt, hsa; identical to SEQ ID NO: 98232

SEQ ID NO: 628189 - RNA, 64 nt, hsa; identical to SEQ ID NO: 98233

SEQ ID NO: 628190 - RNA, 64 nt, hsa; identical to SEQ ID NO: 98234

SEQ ID NO: 628191 - RNA, 64 nt, hsa; identical to SEQ ID NO: 98235

SEQ ID NO: 628192 - RNA, 64 nt, hsa; identical to SEQ ID NO: 98236

SEQ ID NO: 628193 - RNA, 64 nt, hsa; identical to SEQ ID NO: 98237

SEQ ID NO: 628194 - RNA, 64 nt, hsa; identical to SEQ ID NO: 98238

SEQ ID NO: 628195 - RNA, 64 nt, hsa; identical to SEQ ID NO: 98239

SEQ ID NO: 628196 - RNA, 64 nt, hsa; identical to SEQ ID NO: 98240

SEQ ID NO: 628197 - RNA, 64 nt, hsa; identical to SEQ ID NO: 98241

SEQ ID NO: 628198 - RNA, 64 nt, hsa; identical to SEQ ID NO: 98242

SEQ ID NO: 628199 - RNA, 64 nt, hsa; identical to SEQ ID NO: 98243

SEQ ID NO: 628200 - RNA, 64 nt, hsa; identical to SEQ ID NO: 98244

SEQ ID NO: 628201 - RNA, 64 nt, hsa; identical to SEQ ID NO: 98245

SEQ ID NO: 628202 - RNA, 64 nt, hsa; identical to SEQ ID NO: 98246

SEQ ID NO: 628203 - RNA, 64 nt, hsa; identical to SEQ ID NO: 98247

SEQ ID NO: 628204 - RNA, 64 nt, hsa; identical to SEQ ID NO: 98248

SEQ ID NO: 628205 - RNA, 64 nt, hsa; identical to SEQ ID NO: 98249

SEQ ID NO: 628206 - RNA, 64 nt, hsa; identical to SEQ ID NO: 98250

SEQ ID NO: 628207 - RNA, 64 nt, hsa; identical to SEQ ID NO: 98251

SEQ ID NO: 628208 - RNA, 64 nt, hsa; identical to SEQ ID NO: 98252

SEQ ID NO: 628209 - RNA, 64 nt, hsa; identical to SEQ ID NO: 98253

SEQ ID NO: 628210 - RNA, 64 nt, hsa; identical to SEQ ID NO: 98254

SEQ ID NO: 628211 - RNA, 64 nt, hsa; identical to SEQ ID NO: 98255

SEQ ID NO: 628212 - RNA, 64 nt, hsa; identical to SEQ ID NO: 98256

SEQ ID NO: 628213 - RNA, 64 nt, hsa; identical to SEQ ID NO: 98257

SEQ ID NO: 628214 - RNA, 64 nt, hsa; identical to SEQ ID NO: 98258

SEQ ID NO: 628215 - RNA, 64 nt, hsa; identical to SEQ ID NO: 98259

SEQ ID NO: 628216 - RNA, 64 nt, hsa; identical to SEQ ID NO: 98260

SEQ ID NO: 628217 - RNA, 64 nt, hsa; identical to SEQ ID NO: 98261

SEQ ID NO: 628218 - RNA, 64 nt, hsa; identical to SEQ ID NO: 98262

SEQ ID NO: 628219 - RNA, 64 nt, hsa; identical to SEQ ID NO: 98263

SEQ ID NO: 628220 - RNA, 64 nt, hsa; identical to SEQ ID NO: 98264

SEQ ID NO: 628221 - RNA, 63 nt, hsa
ccuucucuuaagcaaucaguguguaaagauuugagggaagaaugaauaagagauacaaggucu

SEQ ID NO: 628222 - RNA, 63 nt, hsa
ugugaagaaaucauaacacuuggaggaaucagaagggaagaucaacagcaaggauggggcauc

SEQ ID NO: 628223 - RNA, 63 nt, hsa
auagucaugaaaagaaagggaagaaaggggagaagggaagagguuaaaaaguaagugcucaga

SEQ ID NO: 628224 - RNA, 63 nt, hsa
agcaaguuuaggagagaauagucaugaaaagaaagggaagaaaggggagaagggaagagguua

SEQ ID NO: 628225 - RNA, 63 nt, hsa
gggcugagguuggaggccuacuaauuucccuguagggaagacucccagcacuucuggaacugu

SEQ ID NO: 628226 - RNA, 63 nt, hsa
agcugacccguguaugugcagaugcaguuccgaagggaagaacaguccucgggugauucagag

SEQ ID NO: 628227 - RNA, 63 nt, hsa
cacaguucucuggaugcccagacaccucucuucagggaagaugagucugacugguuugcccca

SEQ ID NO: 628228 - RNA, 63 nt, hsa
cuucagggaagaugagucugacugguuugccccagggaagagcauauccuuaccauuauuuua

SEQ ID NO: 628229 - RNA, 63 nt, hsa
aguggcagcccagccaccuccuaucaaucaaucagggaagaaaugcaggggagacuggggccc

SEQ ID NO: 628230 - RNA, 63 nt, hsa
gaagacacugaccuuucccaucccgguagcuucagggaagaucauaguuaauaacgucucuca

SEQ ID NO: 628231 - RNA, 63 nt, hsa
ggauugcagaagacgagcgggagcggggagggcagggaagaugccugucggguuuuuagcaca

SEQ ID NO: 628232 - RNA, 63 nt, hsa
cagcagagaaguuuucuggaggucucugaacccagggaagacaagaaggaaagauuuuguugu

SEQ ID NO: 628233 - RNA, 63 nt, hsa
ucucucugaaagcagaaaaaggcacugauauaaagggaagagaaggaggcucaccggagggaa

SEQ ID NO: 628234 - RNA, 63 nt, hsa
cugauauaaagggaagagaaggaggcucaccggagggaagagaacauagugaagauucccgcc

SEQ ID NO: 628235 - RNA, 63 nt, hsa
uagaguaaauggacuugccuuaauuuauaaaggagggaagagguagaagggaaccaugggucc

SEQ ID NO: 628236 - RNA, 63 nt, hsa
ucugcaaccuaacguuuaauaguccgggucuacagggaagaacaaugacacagcuugagcguu

SEQ ID NO: 628237 - RNA, 63 nt, hsa
agacaggagggaagauauuagugauuagacagcagggaagauauuagugguaaagagugaaug

SEQ ID NO: 628238 - RNA, 63 nt, hsa
agacaggaaggaagacauuagugauuagacaggagggaagauauuagugauuagacagcaggg

SEQ ID NO: 628239 - RNA, 63 nt, hsa
aaagacuuauuuugaaaguuggaaggagaagggagggaagagagcagaagggaagaaggugua

SEQ ID NO: 628240 - RNA, 63 nt, hsa
aaguuggaaggagaagggagggaagagagcagaagggaagaagguguaagucaagcucuugaa

SEQ ID NO: 628241 - RNA, 63 nt, hsa
ccucugagugagaugcccaggaggaggagcccuagggaagaagucagggacagggaccaggau

SEQ ID NO: 628242 - RNA, 63 nt, hsa
cacuucuucccuauguccaggagagggcaauagagggaagacugaggcugaagaauugacggc

SEQ ID NO: 628243 - RNA, 63 nt, hsa
ucccuccguucugcuucagcuuccccuaagguuagggaagaaagaaucgggcucacgaaugcc

SEQ ID NO: 628244 - RNA, 63 nt, hsa
aaacccggaagaucagaugcaauugcucccaucagggaagaacccuauacuugguuugcuacc

SEQ ID NO: 628245 - RNA, 63 nt, hsa
aggagcugcuuguuguuuguugacagcuuggaaagggaagaucuuaugccuuuucuuuucugu

SEQ ID NO: 628246 - RNA, 63 nt, hsa
agaagcaggcggguugggugggaggaggaagaaagggaagaauuagguuugaauugcuuuuuu

SEQ ID NO: 628247 - RNA, 63 nt, hsa
agaagcaggcggguugggugggaggaggaagaaagggaagaauuagguuugaauugcuuuuua

SEQ ID NO: 628248 - RNA, 63 nt, hsa
caacuuagagcaauaacggcugccgcagcagccagggaagaccuugguuugguuuauguguca

SEQ ID NO: 628249 - RNA, 63 nt, hsa
uguggcucccuccuucccugucugggagguuggagggaagaaucuaggccuuagcuugcccuc

SEQ ID NO: 628250 - RNA, 63 nt, hsa
gaggggacuggaaagcugagacugaaaaucaagagggaagaggugaggaaggcccaccccugg

SEQ ID NO: 628251 - RNA, 63 nt, hsa
uuguggccucugggcuguaugccucugggguguagggaagaggcgggaggagucauggggaug

SEQ ID NO: 628252 - RNA, 63 nt, hsa
caguacaucuuuuguaaaaacccugaaaugggcagggaagaaaacagggauuuccccucucua

SEQ ID NO: 628253 - RNA, 63 nt, hsa
ucaaagguuuauugcuuagccauaugaaaaauaagggaagauuuuuuagcaaggggacccaca

SEQ ID NO: 628254 - RNA, 63 nt, hsa
gcagcucugggggcccuuuccacuucuggcuauagggaagaaccugaauacugaacuugauuc

SEQ ID NO: 628255 - RNA, 63 nt, hsa
aaaacguuuaugauauuaagaucaaagggaggaagggaagacagcaguauuaauucacccuag

SEQ ID NO: 628256 - RNA, 63 nt, hsa
augcugcauacuugccuaguagcaaaacaauacagggaagagucaaaagggcuucuccaacug

SEQ ID NO: 628257 - RNA, 63 nt, hsa
uccagguuauaaccugguaccagcagacuuugcagggaagaaagaguuguuccaaucauguaa

SEQ ID NO: 628258 - RNA, 63 nt, hsa
aucauguaaccuucuguaggggauuacugagacagggaagagaagugcaagaauugguugcug

SEQ ID NO: 628259 - RNA, 63 nt, hsa
uuucuccccucccgcuaguaucuuuacaggagcagggaagagcaguagaggauguauaauuuu

SEQ ID NO: 628260 - RNA, 63 nt, hsa
aggcuaaauaggaguuacagaaaacuguuaaauagggaagaacuacauuaaauuuaaauauuc

SEQ ID NO: 628261 - RNA, 63 nt, hsa
gaggugcccuucacucuaagcuuaacacuuaguagggaagagauucucaaaugagaaaaaggg

SEQ ID NO: 628262 - RNA, 63 nt, hsa
agaaaaagggcuccggcuauaugggcaacaaagagggaagauacagguugccaguuauacauu

SEQ ID NO: 628263 - RNA, 63 nt, hsa
agacuguugaagcucucaauagguggcaguuuuagggaagauuuccauucaguguagggaaga

SEQ ID NO: 628264 - RNA, 63 nt, hsa
guggcaguuuuagggaagauuuccauucaguguagggaagacauuuguaauaaugaaaacuga

SEQ ID NO: 628265 - RNA, 63 nt, hsa
cccccagcuuguuugccaugaacugauuccuggagggaagaccauuccuguuacaaaugaaaa

SEQ ID NO: 628266 - RNA, 63 nt, hsa
ugcauacaugcggggaccccagacugucagcacagggaagauggaucccauccuaauuuuuau

SEQ ID NO: 628267 - RNA, 63 nt, hsa
agcaccuuuuugacagugaacauggucuaaaaaagggaagauauuguagaagauuucacacac

SEQ ID NO: 628268 - RNA, 63 nt, hsa
aguguggcugaugguagccucuaguuugaagugagggaagaaugaguagucaggaacugguca

SEQ ID NO: 628269 - RNA, 63 nt, hsa
gaguagucaggaacuggucacuuugaaugugggagggaagauauucacgacaagguuuucuac

SEQ ID NO: 628270 - RNA, 63 nt, hsa
auucaccaugaaaaaacaagaauaacaaauagaagggaagagauaggaugggaaagcuaacaa

SEQ ID NO: 628271 - RNA, 63 nt, hsa
uuucugucaaacaaugagguuguagggggagguagggaagaaugagcugaauuuguagcauac

SEQ ID NO: 628272 - RNA, 63 nt, hsa
aaaaaacaauuccaaaugugaaacuagaaugagagggaagagauagcauggcaugcagcacac

SEQ ID NO: 628273 - RNA, 63 nt, hsa
uucgugacaauguacgccuuucccucagaauucagggaagagacugucgccugccuuccuccg

SEQ ID NO: 628274 - RNA, 63 nt, hsa
ugugcaggagccuucauuucagcuucaauuaauagggaagaauuuaugauagcucuauagaug

SEQ ID NO: 628275 - RNA, 63 nt, hsa
cuaccucacaguguccauacaaauuaguuccagagggaagauauaccacaaaauuacucaaaa

SEQ ID NO: 628276 - RNA, 63 nt, hsa
ccuggcugcccaucauguggccccacccaaucaagggaagaaggaggaaugcuggacuggagg

SEQ ID NO: 628277 - RNA, 63 nt, hsa
ggcuguaacguggcacugguagguugggacaccagggaagaagaucaacgccucacugaaaca

SEQ ID NO: 628278 - RNA, 63 nt, hsa
uagaggauugcagaagacgaguggggggagggcagggaagaugccugucggguuuuuagcaca

SEQ ID NO: 628279 - RNA, 63 nt, hsa
cuucggugcuucccgggcccggggucugucgggagggaagagaacugggccugaccuaccuga

SEQ ID NO: 628280 - RNA, 63 nt, hsa
uucacaccauaacuagguaacaguuugauaacuagggaagaaagcagaacaguuaagcagccg

SEQ ID NO: 628281 - RNA, 63 nt, hsa
ggccaccugcaggucacugaaacuucaagcaccagggaagaucuaacauuugagucccuucca

SEQ ID NO: 628282 - RNA, 63 nt, hsa
ucaaaaucuguagagcagggcaaguaacauggaagggaagaaaaggugaaaaauuagaaaugu

SEQ ID NO: 628283 - RNA, 63 nt, hsa
uggucccuaucuuccagcagguuagaggccuuuagggaagaaaagccugugugcagggaaaga

SEQ ID NO: 628284 - RNA, 63 nt, hsa
cuuacgaggauuucuggaagcuucuguaacuguagggaagaaagcuguaggggagcaugguuu

SEQ ID NO: 628285 - RNA, 63 nt, hsa
auggggagugagaugaguaauucagggaagagaagggaagagagaagagucuauuaugagcug

SEQ ID NO: 628286 - RNA, 63 nt, hsa
gacauacaagauggggagugagaugaguaauucagggaagagaagggaagagagaagagucua

SEQ ID NO: 628287 - RNA, 63 nt, hsa
guaaaauuuuuuuagaagagauggcuuauuaacagggaagaagcuuguuauauuccaguugua

SEQ ID NO: 628288 - RNA, 63 nt, hsa
agaauagccuuaguguuuagauuuuuuuaugauagggaagaugcggccaucacugggauauuu

SEQ ID NO: 628289 - RNA, 63 nt, hsa
gccacugacugggggcagagcucuggguggaagagggaagagauccuaauggaggcgccucca

SEQ ID NO: 628290 - RNA, 63 nt, hsa
ggugggaccauggugcucuuuaagcgugaucggagggaagacacacagcagggccaccauucc

SEQ ID NO: 628291 - RNA, 63 nt, hsa
gacuuugauacuaccagggucucucagggauggagggaagaccugaaagagaggacugguucu

SEQ ID NO: 628292 - RNA, 63 nt, hsa
cccuguuacuuauguagaaacugaggcccagagagggaagaugaccugccccaaguggugagc

SEQ ID NO: 628293 - RNA, 63 nt, hsa
auaauccuagacuggaagaguagaauaucauauagggaagaaaccuuaaacaccacaguguuc

SEQ ID NO: 628294 - RNA, 63 nt, hsa
gaaucaggcagucgcccacuucucuccagaugaagggaagacauucauaggucccaaaucugc

SEQ ID NO: 628295 - RNA, 63 nt, hsa
gggagaagaaggaagggaagggcagaaggaaggagggaagaaaagaaagcaaaggaacagaag

SEQ ID NO: 628296 - RNA, 63 nt, hsa
uuuccugucaguuggaccccucaccuggccuccagggaagaaugcagagaaaagcaaggagag

SEQ ID NO: 628297 - RNA, 64 nt, hsa; identical to SEQ ID NO: 98228

SEQ ID NO: 628298 - RNA, 64 nt, hsa; identical to SEQ ID NO: 98229

SEQ ID NO: 628299 - RNA, 64 nt, hsa; identical to SEQ ID NO: 98230

SEQ ID NO: 628300 - RNA, 64 nt, hsa; identical to SEQ ID NO: 98231

SEQ ID NO: 628301 - RNA, 64 nt, hsa; identical to SEQ ID NO: 98232

SEQ ID NO: 628302 - RNA, 64 nt, hsa; identical to SEQ ID NO: 98233

SEQ ID NO: 628303 - RNA, 64 nt, hsa; identical to SEQ ID NO: 98234

SEQ ID NO: 628304 - RNA, 64 nt, hsa; identical to SEQ ID NO: 98235

SEQ ID NO: 628305 - RNA, 64 nt, hsa; identical to SEQ ID NO: 98236

SEQ ID NO: 628306 - RNA, 64 nt, hsa; identical to SEQ ID NO: 98237

SEQ ID NO: 628307 - RNA, 64 nt, hsa; identical to SEQ ID NO: 98238

SEQ ID NO: 628308 - RNA, 64 nt, hsa; identical to SEQ ID NO: 98239

SEQ ID NO: 628309 - RNA, 64 nt, hsa; identical to SEQ ID NO: 98240

SEQ ID NO: 628310 - RNA, 64 nt, hsa; identical to SEQ ID NO: 98241

SEQ ID NO: 628311 - RNA, 64 nt, hsa; identical to SEQ ID NO: 98242

SEQ ID NO: 628312 - RNA, 64 nt, hsa; identical to SEQ ID NO: 98243

SEQ ID NO: 628313 - RNA, 64 nt, hsa; identical to SEQ ID NO: 98244

SEQ ID NO: 628314 - RNA, 64 nt, hsa; identical to SEQ ID NO: 98245

SEQ ID NO: 628315 - RNA, 64 nt, hsa; identical to SEQ ID NO: 98246

SEQ ID NO: 628316 - RNA, 64 nt, hsa; identical to SEQ ID NO: 98247

SEQ ID NO: 628317 - RNA, 64 nt, hsa; identical to SEQ ID NO: 98248

SEQ ID NO: 628318 - RNA, 64 nt, hsa; identical to SEQ ID NO: 98249

SEQ ID NO: 628319 - RNA, 64 nt, hsa; identical to SEQ ID NO: 98250

SEQ ID NO: 628320 - RNA, 64 nt, hsa; identical to SEQ ID NO: 98251

SEQ ID NO: 628321 - RNA, 64 nt, hsa; identical to SEQ ID NO: 98252

SEQ ID NO: 628322 - RNA, 64 nt, hsa; identical to SEQ ID NO: 98253

SEQ ID NO: 628323 - RNA, 64 nt, hsa; identical to SEQ ID NO: 98254

SEQ ID NO: 628324 - RNA, 64 nt, hsa; identical to SEQ ID NO: 98255

SEQ ID NO: 628325 - RNA, 64 nt, hsa; identical to SEQ ID NO: 98256

SEQ ID NO: 628326 - RNA, 64 nt, hsa; identical to SEQ ID NO: 98257

SEQ ID NO: 628327 - RNA, 64 nt, hsa; identical to SEQ ID NO: 98258

SEQ ID NO: 628328 - RNA, 64 nt, hsa; identical to SEQ ID NO: 98259

SEQ ID NO: 628329 - RNA, 64 nt, hsa; identical to SEQ ID NO: 98260

SEQ ID NO: 628330 - RNA, 64 nt, hsa; identical to SEQ ID NO: 98261

SEQ ID NO: 628331 - RNA, 64 nt, hsa; identical to SEQ ID NO: 98262

SEQ ID NO: 628332 - RNA, 64 nt, hsa; identical to SEQ ID NO: 98263

SEQ ID NO: 628333 - RNA, 64 nt, hsa; identical to SEQ ID NO: 98264

SEQ ID NO: 628334 - RNA, 63 nt, hsa; identical to SEQ ID NO: 628221

SEQ ID NO: 628335 - RNA, 63 nt, hsa; identical to SEQ ID NO: 628222

SEQ ID NO: 628336 - RNA, 63 nt, hsa; identical to SEQ ID NO: 628223

SEQ ID NO: 628337 - RNA, 63 nt, hsa; identical to SEQ ID NO: 628224

SEQ ID NO: 628338 - RNA, 63 nt, hsa; identical to SEQ ID NO: 628225

SEQ ID NO: 628339 - RNA, 63 nt, hsa; identical to SEQ ID NO: 628226

SEQ ID NO: 628340 - RNA, 63 nt, hsa; identical to SEQ ID NO: 628227

SEQ ID NO: 628341 - RNA, 63 nt, hsa; identical to SEQ ID NO: 628228

SEQ ID NO: 628342 - RNA, 63 nt, hsa; identical to SEQ ID NO: 628229

SEQ ID NO: 628343 - RNA, 63 nt, hsa; identical to SEQ ID NO: 628230

SEQ ID NO: 628344 - RNA, 63 nt, hsa; identical to SEQ ID NO: 628231

SEQ ID NO: 628345 - RNA, 63 nt, hsa; identical to SEQ ID NO: 628232

SEQ ID NO: 628346 - RNA, 63 nt, hsa; identical to SEQ ID NO: 628233

SEQ ID NO: 628347 - RNA, 63 nt, hsa; identical to SEQ ID NO: 628234

SEQ ID NO: 628348 - RNA, 63 nt, hsa; identical to SEQ ID NO: 628235

SEQ ID NO: 628349 - RNA, 63 nt, hsa; identical to SEQ ID NO: 628236

SEQ ID NO: 628350 - RNA, 63 nt, hsa; identical to SEQ ID NO: 628237

SEQ ID NO: 628351 - RNA, 63 nt, hsa; identical to SEQ ID NO: 628238

SEQ ID NO: 628352 - RNA, 63 nt, hsa; identical to SEQ ID NO: 628239

SEQ ID NO: 628353 - RNA, 63 nt, hsa; identical to SEQ ID NO: 628240

SEQ ID NO: 628354 - RNA, 63 nt, hsa; identical to SEQ ID NO: 628241

SEQ ID NO: 628355 - RNA, 63 nt, hsa; identical to SEQ ID NO: 628242

SEQ ID NO: 628356 - RNA, 63 nt, hsa; identical to SEQ ID NO: 628243

SEQ ID NO: 628357 - RNA, 63 nt, hsa; identical to SEQ ID NO: 628244

SEQ ID NO: 628358 - RNA, 63 nt, hsa; identical to SEQ ID NO: 628245

SEQ ID NO: 628359 - RNA, 63 nt, hsa; identical to SEQ ID NO: 628246

SEQ ID NO: 628360 - RNA, 63 nt, hsa; identical to SEQ ID NO: 628247

SEQ ID NO: 628361 - RNA, 63 nt, hsa; identical to SEQ ID NO: 628248

SEQ ID NO: 628362 - RNA, 63 nt, hsa; identical to SEQ ID NO: 628249

SEQ ID NO: 628363 - RNA, 63 nt, hsa; identical to SEQ ID NO: 628250

SEQ ID NO: 628364 - RNA, 63 nt, hsa; identical to SEQ ID NO: 628251

SEQ ID NO: 628365 - RNA, 63 nt, hsa; identical to SEQ ID NO: 628252

SEQ ID NO: 628366 - RNA, 63 nt, hsa; identical to SEQ ID NO: 628253

SEQ ID NO: 628367 - RNA, 63 nt, hsa; identical to SEQ ID NO: 628254

SEQ ID NO: 628368 - RNA, 63 nt, hsa; identical to SEQ ID NO: 628255

SEQ ID NO: 628369 - RNA, 63 nt, hsa; identical to SEQ ID NO: 628256

SEQ ID NO: 628370 - RNA, 63 nt, hsa; identical to SEQ ID NO: 628257

SEQ ID NO: 628371 - RNA, 63 nt, hsa; identical to SEQ ID NO: 628258

SEQ ID NO: 628372 - RNA, 63 nt, hsa; identical to SEQ ID NO: 628259

SEQ ID NO: 628373 - RNA, 63 nt, hsa; identical to SEQ ID NO: 628260

SEQ ID NO: 628374 - RNA, 63 nt, hsa; identical to SEQ ID NO: 628261

SEQ ID NO: 628375 - RNA, 63 nt, hsa; identical to SEQ ID NO: 628262

SEQ ID NO: 628376 - RNA, 63 nt, hsa; identical to SEQ ID NO: 628263

SEQ ID NO: 628377 - RNA, 63 nt, hsa; identical to SEQ ID NO: 628264

SEQ ID NO: 628378 - RNA, 63 nt, hsa; identical to SEQ ID NO: 628265

SEQ ID NO: 628379 - RNA, 63 nt, hsa; identical to SEQ ID NO: 628266

SEQ ID NO: 628380 - RNA, 63 nt, hsa; identical to SEQ ID NO: 628267

SEQ ID NO: 628381 - RNA, 63 nt, hsa; identical to SEQ ID NO: 628268

SEQ ID NO: 628382 - RNA, 63 nt, hsa; identical to SEQ ID NO: 628269

SEQ ID NO: 628383 - RNA, 63 nt, hsa; identical to SEQ ID NO: 628270

SEQ ID NO: 628384 - RNA, 63 nt, hsa; identical to SEQ ID NO: 628271

SEQ ID NO: 628385 - RNA, 63 nt, hsa; identical to SEQ ID NO: 628272

SEQ ID NO: 628386 - RNA, 63 nt, hsa; identical to SEQ ID NO: 628273

SEQ ID NO: 628387 - RNA, 63 nt, hsa; identical to SEQ ID NO: 628274

SEQ ID NO: 628388 - RNA, 63 nt, hsa; identical to SEQ ID NO: 628275

SEQ ID NO: 628389 - RNA, 63 nt, hsa; identical to SEQ ID NO: 628276

SEQ ID NO: 628390 - RNA, 63 nt, hsa; identical to SEQ ID NO: 628277

SEQ ID NO: 628391 - RNA, 63 nt, hsa; identical to SEQ ID NO: 628278

SEQ ID NO: 628392 - RNA, 63 nt, hsa; identical to SEQ ID NO: 628279

SEQ ID NO: 628393 - RNA, 63 nt, hsa; identical to SEQ ID NO: 628280

SEQ ID NO: 628394 - RNA, 63 nt, hsa; identical to SEQ ID NO: 628281

SEQ ID NO: 628395 - RNA, 63 nt, hsa; identical to SEQ ID NO: 628282

SEQ ID NO: 628396 - RNA, 63 nt, hsa; identical to SEQ ID NO: 628283

SEQ ID NO: 628397 - RNA, 63 nt, hsa; identical to SEQ ID NO: 628284

SEQ ID NO: 628398 - RNA, 63 nt, hsa; identical to SEQ ID NO: 628285

SEQ ID NO: 628399 - RNA, 63 nt, hsa; identical to SEQ ID NO: 628286

SEQ ID NO: 628400 - RNA, 63 nt, hsa; identical to SEQ ID NO: 628287

SEQ ID NO: 628401 - RNA, 63 nt, hsa; identical to SEQ ID NO: 628288

SEQ ID NO: 628402 - RNA, 63 nt, hsa; identical to SEQ ID NO: 628289

SEQ ID NO: 628403 - RNA, 63 nt, hsa; identical to SEQ ID NO: 628290

SEQ ID NO: 628404 - RNA, 63 nt, hsa; identical to SEQ ID NO: 628291

SEQ ID NO: 628405 - RNA, 63 nt, hsa; identical to SEQ ID NO: 628292

SEQ ID NO: 628406 - RNA, 63 nt, hsa; identical to SEQ ID NO: 628293

SEQ ID NO: 628407 - RNA, 63 nt, hsa; identical to SEQ ID NO: 628294

SEQ ID NO: 628408 - RNA, 63 nt, hsa; identical to SEQ ID NO: 628295

SEQ ID NO: 628409 - RNA, 63 nt, hsa; identical to SEQ ID NO: 628296

SEQ ID NO: 628410 - RNA, 64 nt, hsa
ggcaucuccaccugacuucacuuccauccagggccacuggcagcaucuggaacggcugaauucc

SEQ ID NO: 628411 - RNA, 64 nt, hsa
agccuuccaaguaacugggacuacaggugugcaucacuggcagugggaauuguggcuuguggcu

SEQ ID NO: 628412 - RNA, 64 nt, hsa
uugaaaaaaaaguuucagagaaguucuggcugaacacuggcaacaacaaagccaacagucaaaa

SEQ ID NO: 628413 - RNA, 64 nt, hsa
acaauuccaaaggaaucuccaguuuucaguugaucacuggcaaugaaaaauucucagucaguaa

SEQ ID NO: 628414 - RNA, 56 nt, hsa
gccccaagaagaagcugugaccugcccacuggcacacagcuggcacuggcacacac

SEQ ID NO: 628415 - RNA, 64 nt, hsa
agaagcugugaccugcccacuggcacacagcuggcacuggcacacaccugucccaugcccaccc

SEQ ID NO: 628416 - RNA, 64 nt, hsa
agggagggcagccuucugccaccugugucgccuccacuggcagucacgccaccagagccacccu

SEQ ID NO: 628417 - RNA, 64 nt, hsa
cuagacggccaccugcaggaccccacacucacugcacuggcagcgugcacuggcguauuuguaa

SEQ ID NO: 628418 - RNA, 64 nt, hsa
ucuggacgcguuuuguuggcugggcuucuggaggcacuggcaaggucaaacugcauuucuuuaa

SEQ ID NO: 628419 - RNA, 64 nt, hsa
ggguuuuggggaagccaguuagcugcugcuuuggcacuggcauggaggugagcagucaaggaug

SEQ ID NO: 628420 - RNA, 60 nt, hsa
gggcagggugggauggggaagaccaggagcagagucgagccucacagaagccagcgcggg

SEQ ID NO: 628421 - RNA, 60 nt, hsa
ucagccuaaacguuucaucaagaacacuacagagucgauacugugaguuuccaaccucag

SEQ ID NO: 628422 - RNA, 60 nt, hsa
cuccuccuuuggcauccauuuuuccaaagaagagucgaguccucugaggucugugcuuga

SEQ ID NO: 628423 - RNA, 60 nt, hsa
uuuaagaggagucucuucucaacuuaccugagagucgaauucuucucuucccuaaccaau

SEQ ID NO: 628424 - RNA, 60 nt, hsa
uugcaaucuuuaaacuuucaguggcugugcagagucgagggaggaaccagcucucugguu

SEQ ID NO: 628425 - RNA, 60 nt, hsa
aaauauucucucuaguuaaaaaugauuuaaagagucgacuauacaaaaaucaaucaccac

SEQ ID NO: 628426 - RNA, 60 nt, hsa
gaacaaugaucuucccauaaucaaaaguggagagucgaaaugcugugccaguugcucugg

SEQ ID NO: 628427 - RNA, 60 nt, hsa
aggagaacaguaagauggaugguuccggccagagucgauguggggaggaacagagggcug

SEQ ID NO: 628428 - RNA, 60 nt, hsa
cacugccacuguccuguggcucggggaaggagagucgaugcuguucccgcugcacggccc

SEQ ID NO: 628429 - RNA, 60 nt, hsa
uggacucuuuaaguuuuaccacugaaaaccagagucgauuuuucuccuaaauuuuuggca

SEQ ID NO: 628430 - RNA, 60 nt, hsa
guccccaguagucacuuuaggaguugggacagagucgagcacccugugaaagucucccuu

SEQ ID NO: 628431 - RNA, 60 nt, hsa
ccccaugacugcccauguuucugaggcuucagagucgaaguuuggauacauuucaagugc

SEQ ID NO: 628432 - RNA, 60 nt, hsa
aacagcccccuccucaccgcccgccgugcaagagucgagccggcagagcaaggggcgcgg

SEQ ID NO: 628433 - RNA, 60 nt, hsa
aucuugguggucuacacacccguucuguggagagucgauuuacauaagcuguguauacac

SEQ ID NO: 628434 - RNA, 60 nt, hsa
augaggaaaccaaggcauggagcaguucccagagucgaaucuagaucucaucugucaucc

SEQ ID NO: 628435 - RNA, 60 nt, hsa
gacaguggggacauuguggguuuggggcucagagucgagggacgggguguagccucggca

SEQ ID NO: 628436 - RNA, 60 nt, hsa
auaguaauaguguauggcauuggggucuucagagucgauauauagguagaucucuuuagu

SEQ ID NO: 628437 - RNA, 60 nt, hsa
ccgcuacggaacaaagaugaauacaguaaaagagucgaacacucauuuccaaggcccuaa

SEQ ID NO: 628438 - RNA, 60 nt, hsa
cacagguggauccacggcuuuccagugcggagagucgagaugcucccugcagcccaggcc

SEQ ID NO: 628439 - RNA, 60 nt, hsa
ugacccuaaaguuaguguggugcuccaagcagagucgacaucauggaaugaaccaaaucu

SEQ ID NO: 628440 - RNA, 60 nt, hsa
auuccuucugcugcagccuggagaccaccgagagucgagcuggggcacacacacaccugg

SEQ ID NO: 628441 - RNA, 60 nt, hsa
uuuuuuuuugagggaucagaagggaaggggagagucgagauguguguuaggcccucauau

SEQ ID NO: 628442 - RNA, 60 nt, hsa
cgaguggaauuugaguccuaaagaaauaaaagagucgaugcaugguccgugagucagugc

SEQ ID NO: 628443 - RNA, 60 nt, hsa
aaccaaaaagacagggaaaaccagauauuuagagucgaagcagcaugcaaaaaauaauaa

SEQ ID NO: 628444 - RNA, 60 nt, hsa
aacaggaauccucugcaaagcccaaucugcagagucgagaccccuggugcucucugcccc

SEQ ID NO: 628445 - RNA, 60 nt, hsa
agcccccugugcccacccagggcccggcacagagucgaugcucaauaaauguguguugac

SEQ ID NO: 628446 - RNA, 60 nt, hsa
uugguguugucauuguaaacaaacucuugaagagucgauuauuuccaguguucuaugaac

SEQ ID NO: 628447 - RNA, 60 nt, hsa
ggccugacauugcuuuugcucugcaacagcagagucgagucauugcaacaaagagcauau

SEQ ID NO: 628448 - RNA, 60 nt, hsa
gguuauauacucccacuucauacauuaccaagagucgaucacugauuuaaaauuuuuaau

SEQ ID NO: 628449 - RNA, 60 nt, hsa
agccacgucaugucuucuuuugggagggagagagucgauggcaggaggggguuuugggug

SEQ ID NO: 628450 - RNA, 60 nt, hsa
caauuuaucagaaauuauuucguauguuaaagagucgaaagacuauagcaucacucaguc

SEQ ID NO: 628451 - RNA, 60 nt, hsa
ucuggacucaguuuccccgucugagaaaugagagucgaaugcuacaguaucugcagucgc

SEQ ID NO: 628452 - RNA, 60 nt, hsa
acugagcaggauggauuuucuuuugauaaaagagucgaugccugaaagagaaaccauuuc

SEQ ID NO: 628453 - RNA, 60 nt, hsa
ugguuuagcaggucaccuaguugggucagaagagucgaugaucaccaagcaggaaaggga

SEQ ID NO: 628454 - RNA, 60 nt, hsa
gcuacgacuugggacggaaguggccugagaagagucgagugauauggcuuguagggugag

SEQ ID NO: 628455 - RNA, 60 nt, hsa
cugaaagcaagauuauccaguggguaaaugagagucgacuggauucugucaguucaaaaa

SEQ ID NO: 628456 - RNA, 64 nt, hsa
aaaagcagggacugccacugcauuucauaucacacuguuaaaaguuguguuuugaaauuuuaug

SEQ ID NO: 628457 - RNA, 64 nt, hsa
auugcucauuuuuuaaaaaauggacucuugaaaucuguuaaaauaaaauuguacauuuggagau

SEQ ID NO: 628458 - RNA, 64 nt, hsa
uuucacugccaugacacuaggcaaaaaauauuuccuguuaaaagaaagagaaaaagagagggau

SEQ ID NO: 628459 - RNA, 64 nt, hsa
gcugguuuuauaagugaccguauauuguaaagagcuguuaaaaaguauuauagaccuauucaug

SEQ ID NO: 628460 - RNA, 64 nt, hsa
gaaguuuaagcuuugugcucugauaaauuguguucuguuaaagagguuaguaggaugaaaacag

SEQ ID NO: 628461 - RNA, 64 nt, hsa
uuaucccuuuggauaaguaugcuuuauuuuaccucuguuaaaaauuaaaauaaaugauucuauu

SEQ ID NO: 628462 - RNA, 64 nt, hsa
ccucagcuagcuugcuguuaaaccacauugaagucuguuaaaagauauuuauuuuucuuguaaa

SEQ ID NO: 628463 - RNA, 64 nt, hsa
aauaacaacaaaauacaacuccucagcuagcuugcuguuaaaccacauugaagucuguuaaaag

SEQ ID NO: 628464 - RNA, 64 nt, hsa
cugccauuuucuuuugcaauuguaguuuuauguacuguuaaagaauuguauugaauucuuuuua

SEQ ID NO: 628465 - RNA, 64 nt, hsa
guuucauuuucuuuugcaauuuuaguuuuauguacuguuaaagaauuguacugaauucuuuuua

SEQ ID NO: 628466 - RNA, 64 nt, hsa
ugauggcuuauggaaggcuguuaaauuaauauuccuguuaaaggaaauuaaaguuugucuauuu

SEQ ID NO: 628467 - RNA, 64 nt, hsa
uuaugcuuacaaaauggugauggcuuauggaaggcuguuaaauuaauauuccuguuaaaggaaa

SEQ ID NO: 628468 - RNA, 64 nt, hsa
uaaaguuuuuuauauaugaauauuacauguaaagcuguuaaaauacauaacuucagugcaagag

SEQ ID NO: 628469 - RNA, 64 nt, hsa
ggccauuuguuacaguuucuucaugcauuacuuacuguuaaaacuguaccuuuugcgauuucac

SEQ ID NO: 628470 - RNA, 64 nt, hsa
caucccaucuucugccuccaguuggagcuuucagcuguuaaaacagucagaaacuauugauucu

SEQ ID NO: 628471 - RNA, 64 nt, hsa
ugugacauucgguccaggagagaaagagcaguuucuguuaaagauguaacaaauggauuuccaa

SEQ ID NO: 628472 - RNA, 64 nt, hsa
gcauuuuaacaagaugcccaggugaucugcaugccuguuaaagucugagcucuguugcagauaa

SEQ ID NO: 628473 - RNA, 64 nt, hsa
uccucauacuugcuggcaucccucaucugguggucuguuaaagcacagauugcugggccgcacc

SEQ ID NO: 628474 - RNA, 64 nt, hsa
auuuuguacuacguggcuuuguacaugugaugcucuguuaaaacauaaguggguaugaaggucc

SEQ ID NO: 628475 - RNA, 64 nt, hsa
caauauuuucauuuucgcaguauaauaauugcaccuguuaaauaaaguuuuguaaacauuuaau

SEQ ID NO: 628476 - RNA, 64 nt, hsa
uuauauaaaauaauccuuuaauauccaaaugaaucuguuaaaauguuugauuccuugggaaugg

SEQ ID NO: 628477 - RNA, 64 nt, hsa
ggguuaagcauggacagccagagcuuucuauguacuguuaaaauugaggucacauauuuucuuu

SEQ ID NO: 628478 - RNA, 64 nt, hsa
cagucugcuagaacuuuaaaaugaaggacaaauccuguuaaagaaauauuguuaaaaaucuuua

SEQ ID NO: 628479 - RNA, 64 nt, hsa
ucagaagcaguaggaauggccguauacaaccauccuguuaaacauuuaaauuuagcucugauag

SEQ ID NO: 628480 - RNA, 64 nt, hsa
cuuuuuuuaauggcagcuaaagauauacagauuacuguuaaauugcaguccuuuuuuuuuuaaa

SEQ ID NO: 628481 - RNA, 64 nt, hsa
aaaagacuggugaaucuuuuauuacaaaauguuucuguuaaaaugggaucaucaucuuugaaag

SEQ ID NO: 628482 - RNA, 64 nt, hsa
ugccuuugcuagugcaguguauuuuuucaaggugcuguuaaaagaaagucauguugucguuuac

SEQ ID NO: 628483 - RNA, 64 nt, hsa
cgaacaaggagaauuuucaaugaaauacuugauucuguuaaaaugcagaggugcuauaacauuc

SEQ ID NO: 628484 - RNA, 64 nt, hsa
cacugauaauggauauguaugaaguccaugcugucuguuaaauaaaaugccauucugcagaauu

SEQ ID NO: 628485 - RNA, 64 nt, hsa
ccacaacaacuguccuuucucaauuacacaaaugcuguuaaaaugugaucaaaccauggcauca

SEQ ID NO: 628486 - RNA, 64 nt, hsa
guaauaauuauucacaugugcauuuucuuuuuagcuguuaaauguacuaugccaucauccacca

SEQ ID NO: 628487 - RNA, 64 nt, hsa
auggaauaauagacauaauuaauucaauacacuacuguuaaaaucauuugcaaagcacucagcu

SEQ ID NO: 628488 - RNA, 64 nt, hsa
ggcaccaagaccccaaagggcccaggccaggagacuguuaaagugaaaaggcaaucuaugacuc

SEQ ID NO: 628489 - RNA, 64 nt, hsa
uugcccucugcaguugaucuccaaaguuuuaaaccuguuaaauuaauuuugacaaauaaguuac

SEQ ID NO: 628490 - RNA, 64 nt, hsa
ucuuuuauuuuacuguuuucuuuuuagaaacccacuguuaaaauuuaaaaaggugcuuuaaaau

SEQ ID NO: 628491 - RNA, 64 nt, hsa
auuuuggcccuuacgaaauacgucuuuuucagaacuguuaaaguuuugauguacaucgagcuga

SEQ ID NO: 628492 - RNA, 64 nt, hsa
gaaaauuaaauauuacugaagauuucgacuuccacuguuaaauguacaagauacaugaaauauu

SEQ ID NO: 628493 - RNA, 64 nt, hsa
ccaguuuaccaauacaugaguaacugaaguguaacuguuaaaugcuuguauacuaguuuuucuu

SEQ ID NO: 628494 - RNA, 64 nt, hsa
aacaucauucugaacccugaaauaauauuuuucucuguuaaacaauuuuuaucuguuugccacc

SEQ ID NO: 628495 - RNA, 64 nt, hsa
uuaaugugguagcaccuguaacuguguucuuguucuguuaaaaggauugauuugcuuuuauagu

SEQ ID NO: 628496 - RNA, 64 nt, hsa
cugcaugaguggacgucagaagaaucucuaugcccuguuaaauggggagacaaagggguggugg

SEQ ID NO: 628497 - RNA, 64 nt, hsa
uuguagguauuacaucccuggugucguauuuugccuguuaaaucguaacaagcaauaaacaacu

SEQ ID NO: 628498 - RNA, 64 nt, hsa
gagucuaacauauggucccaauuuauuaauacuucuguuaaauuugaugucaggucaacauuuu

SEQ ID NO: 628499 - RNA, 64 nt, hsa
gccauaucuccuuucccuacaaaagaaaagcauacuguuaaaaugugcuuaccaauacuguguu

SEQ ID NO: 628500 - RNA, 64 nt, hsa
gccuaaaugaauauuuaugugcaaacauaggcaacuguuaaaggcuggaauuuucaaaagaucc

SEQ ID NO: 628501 - RNA, 64 nt, hsa
uaaaagguguuuugguuauuuaauauaauaagagcuguuaaacuucuguuuaaauuuccaguuc

SEQ ID NO: 628502 - RNA, 64 nt, hsa
aaauaccugauuucuugucaucgagauucuuguacuguuaaaugaauauugccuuuuacugcuc

SEQ ID NO: 628503 - RNA, 64 nt, hsa
cuugguuccaugaaaaguaugcuuuguguuuuaacuguuaaaauaauuuaaaaauuaauuauuu

SEQ ID NO: 628504 - RNA, 64 nt, hsa
uugccuccaguggaagcagaaaggguuuuuucagcuguuaaauccuaaaaaucaauauaauuua

SEQ ID NO: 628505 - RNA, 64 nt, hsa
uauguaaauguuaaaaugagcaucucaaagaagucuguuaaaucaugacugaaaaaaaucaauc

SEQ ID NO: 628506 - RNA, 64 nt, hsa
agcaggcuuuaauuuaauguagauucauacugcucuguuaaagcugcauugaaauguuaaaaug

SEQ ID NO: 628507 - RNA, 64 nt, hsa
uauuuugggguagugugagcuuuuaauguuaagucuguuaaacuugagucaaauuaagcagacc

SEQ ID NO: 628508 - RNA, 64 nt, hsa
auucuguaaaauauccuguacaaaacaagacuauugccaguaauguauacaaauugucuuuuug

SEQ ID NO: 628509 - RNA, 64 nt, hsa
gcaaguuggcauuaacauuuaugcuuuaauuaaaugccaguauaccuaugugugcagcaguaaa

SEQ ID NO: 628510 - RNA, 64 nt, hsa
augagcuccacagccacagcugguuaggggcggcugccaguagaacagggcagaugccuggacu

SEQ ID NO: 628511 - RNA, 64 nt, hsa
uaaagguauaccaguuaaaguaguguguggcuggugccaguagaggucagucaagggaucccug

SEQ ID NO: 628512 - RNA, 64 nt, hsa
cugcuuggcugaccccacacccaggaccacuguccggcucuaacacagcuauuaagugcuaccu

SEQ ID NO: 628513 - RNA, 64 nt, hsa
uccuguucuugggaagcguugccugacggcuucucggcucuacccucacccuucuggccaggau

SEQ ID NO: 628514 - RNA, 64 nt, hsa; identical to SEQ ID NO: 561075

SEQ ID NO: 628515 - RNA, 64 nt, hsa; identical to SEQ ID NO: 561076

SEQ ID NO: 628516 - RNA, 64 nt, hsa; identical to SEQ ID NO: 561077

SEQ ID NO: 628517 - RNA, 64 nt, hsa; identical to SEQ ID NO: 561078

SEQ ID NO: 628518 - RNA, 64 nt, hsa; identical to SEQ ID NO: 561079

SEQ ID NO: 628519 - RNA, 64 nt, hsa; identical to SEQ ID NO: 561080

SEQ ID NO: 628520 - RNA, 64 nt, hsa
cguccaccucagccucccaaagugcugggauuacaggugugagccaccacgcccggcuauguuu

SEQ ID NO: 628521 - RNA, 64 nt, hsa
cuccugccucggccucccaaagugcugagacuacaggugugagccaccgugcucagccacuagc

SEQ ID NO: 628522 - RNA, 64 nt, hsa
cacccgccucagcuucccaaagugcugggauuacaggugugagucacugcacccagccgaguug

SEQ ID NO: 628523 - RNA, 64 nt, hsa
gccaaguuaacaaaucaacuuccauuuggauuguaggugugaaggcacaacucuaauugcuauu

SEQ ID NO: 628524 - RNA, 64 nt, hsa
ugugugugacaagccaguucuacaggcauuaccuaggugugagacuaaaagcuuuucuuauuga

SEQ ID NO: 628525 - RNA, 64 nt, hsa
gcuuuucuuauugacuuaaauuuggauaacagcaaggugugaggggggugguggguauggugug

SEQ ID NO: 628526 - RNA, 64 nt, hsa
ccgcccgccuuggccuccaaagugcugggauuacaggugugagcuaccgcgcccggccuauuau

SEQ ID NO: 628527 - RNA, 64 nt, hsa
ggccucagaaguaggacugaauucuacuauugcuaggugugagaaagugguggugagaaccuua

SEQ ID NO: 628528 - RNA, 64 nt, hsa
uuaauguggaauuuuccagcaaaauguuuaacucaggugugauuuuugaaaaugucucuguaau

SEQ ID NO: 628529 - RNA, 64 nt, hsa
cacccaccucagcgucccgaagugcugggauuacaggugugagccaccgcgccuggccugggcu

SEQ ID NO: 628530 - RNA, 64 nt, hsa
caccugccuuggcuucccaaaguccugggauuacaggugugagccaccacauccagccuaacuu

SEQ ID NO: 628531 - RNA, 64 nt, hsa
cccgccucgaccucucucaaagugcuggcauuacaggugugagccacggugcccggcccacaau

SEQ ID NO: 628532 - RNA, 64 nt, hsa
cucccaccucagccucccgaauagcugggacuacaggugugagucaccaagcccaguuaaucuu

SEQ ID NO: 628533 - RNA, 64 nt, hsa
cuccugccucagccucccaaagugcugggauuacaggugugaaccaccacacccagcccacuuc

SEQ ID NO: 628534 - RNA, 64 nt, hsa
cucccaccucagccuccuaaagcacugggauuacaggugugaaccaccguacccagccuaucuu

SEQ ID NO: 628535 - RNA, 64 nt, hsa
gcaaucaccuugaucuugggcuuucagcccccaaaggugugagaaaauaaacuucgguugauaa

SEQ ID NO: 628536 - RNA, 64 nt, hsa
ugcccgccuuggccucccaaagugcugggauuacaggugugagccgcugcgcucggccuucuuu

SEQ ID NO: 628537 - RNA, 64 nt, hsa
cgcccaccucggccucccaaagugcugggauuacaggugugagccuccacaccuggcuguuuuc

SEQ ID NO: 628538 - RNA, 64 nt, hsa
cucauggcucagccgccugaguagcugggauuacaggugugagccaacaagcccggcuaauuuu

SEQ ID NO: 628539 - RNA, 64 nt, hsa
cgccugccucggccucccaaagugcugggauuacaggugugagcugccgcacccagccaagaaa

SEQ ID NO: 628540 - RNA, 64 nt, hsa
auguuggccaggcuggucucgaacuccuggccucaggugugauccgcccgccuccgccucccca

SEQ ID NO: 628541 - RNA, 64 nt, hsa
cgcccgccuccgccuccccaagcgcugagauuacaggugugagccaccgugcccagccccucag

SEQ ID NO: 628542 - RNA, 64 nt, hsa
ugcgccugccucagccucccagugcugggauuauaggugugagccacugcgccuggcuaaguua

SEQ ID NO: 628543 - RNA, 64 nt, hsa
caccugccuugaccucccaaagugcuaggauaacaggugugagccaccgcacccugccaaguua

SEQ ID NO: 628544 - RNA, 64 nt, hsa
gguguggccccaccuguucuuuccuccccugccgaggugugaccccaccugcucuuuccucccu

SEQ ID NO: 628545 - RNA, 64 nt, hsa
caguggagggaggcugugcugugugucccccugcaggugugaccccgccugcucuuuccucccc

SEQ ID NO: 628546 - RNA, 64 nt, hsa
cuccugucuuggccucccaaagugcugagauuacaggugugagccacugugcccagcaguuucc

SEQ ID NO: 628547 - RNA, 64 nt, hsa
cacccgccuuggccucccaaagugcugggauuacaggugugagccaccacacccagccucugua

SEQ ID NO: 628548 - RNA, 64 nt, hsa
ugucuaccucggccuccuaaagugcugagauuacaggugugagccaccgugcccggcccauucu

SEQ ID NO: 628549 - RNA, 64 nt, hsa
gggcauauuaaaugaaagaauaucuaauugggggaggugugaagggaaagaaauucuuuucaaa

SEQ ID NO: 628550 - RNA, 64 nt, hsa; identical to SEQ ID NO: 475408

SEQ ID NO: 628551 - RNA, 57 nt, hsa; identical to SEQ ID NO: 475409

SEQ ID NO: 628552 - RNA, 64 nt, hsa; identical to SEQ ID NO: 489215

SEQ ID NO: 628553 - RNA, 64 nt, hsa; identical to SEQ ID NO: 489216

SEQ ID NO: 628554 - RNA, 64 nt, hsa; identical to SEQ ID NO: 489217

SEQ ID NO: 628555 - RNA, 64 nt, hsa; identical to SEQ ID NO: 489218

SEQ ID NO: 628556 - RNA, 64 nt, hsa; identical to SEQ ID NO: 489219

SEQ ID NO: 628557 - RNA, 64 nt, hsa; identical to SEQ ID NO: 489220

SEQ ID NO: 628558 - RNA, 64 nt, hsa; identical to SEQ ID NO: 489221

SEQ ID NO: 628559 - RNA, 64 nt, hsa; identical to SEQ ID NO: 489222

SEQ ID NO: 628560 - RNA, 64 nt, hsa; identical to SEQ ID NO: 489223

SEQ ID NO: 628561 - RNA, 64 nt, hsa; identical to SEQ ID NO: 489224

SEQ ID NO: 628562 - RNA, 64 nt, hsa; identical to SEQ ID NO: 489225

SEQ ID NO: 628563 - RNA, 64 nt, hsa; identical to SEQ ID NO: 489226

SEQ ID NO: 628564 - RNA, 64 nt, hsa; identical to SEQ ID NO: 489227

SEQ ID NO: 628565 - RNA, 64 nt, hsa; identical to SEQ ID NO: 489228

SEQ ID NO: 628566 - RNA, 64 nt, hsa; identical to SEQ ID NO: 489229

SEQ ID NO: 628567 - RNA, 64 nt, hsa; identical to SEQ ID NO: 489230

SEQ ID NO: 628568 - RNA, 64 nt, hsa; identical to SEQ ID NO: 489231

SEQ ID NO: 628569 - RNA, 64 nt, hsa; identical to SEQ ID NO: 489232

SEQ ID NO: 628570 - RNA, 64 nt, hsa; identical to SEQ ID NO: 489233

SEQ ID NO: 628571 - RNA, 64 nt, hsa; identical to SEQ ID NO: 489234

SEQ ID NO: 628572 - RNA, 64 nt, hsa; identical to SEQ ID NO: 489235

SEQ ID NO: 628573 - RNA, 64 nt, hsa; identical to SEQ ID NO: 489236

SEQ ID NO: 628574 - RNA, 64 nt, hsa; identical to SEQ ID NO: 489237

SEQ ID NO: 628575 - RNA, 64 nt, hsa; identical to SEQ ID NO: 489238

SEQ ID NO: 628576 - RNA, 64 nt, hsa; identical to SEQ ID NO: 489239

SEQ ID NO: 628577 - RNA, 64 nt, hsa; identical to SEQ ID NO: 489240

SEQ ID NO: 628578 - RNA, 64 nt, hsa; identical to SEQ ID NO: 489241

SEQ ID NO: 628579 - RNA, 64 nt, hsa; identical to SEQ ID NO: 489242

SEQ ID NO: 628580 - RNA, 64 nt, hsa; identical to SEQ ID NO: 489243

SEQ ID NO: 628581 - RNA, 53 nt, hsa; identical to SEQ ID NO: 489244

SEQ ID NO: 628582 - RNA, 64 nt, hsa; identical to SEQ ID NO: 489245

SEQ ID NO: 628583 - RNA, 64 nt, hsa; identical to SEQ ID NO: 489246

SEQ ID NO: 628584 - RNA, 64 nt, hsa; identical to SEQ ID NO: 489247

SEQ ID NO: 628585 - RNA, 64 nt, hsa; identical to SEQ ID NO: 489248

SEQ ID NO: 628586 - RNA, 64 nt, hsa; identical to SEQ ID NO: 511888

SEQ ID NO: 628587 - RNA, 64 nt, hsa; identical to SEQ ID NO: 511889

SEQ ID NO: 628588 - RNA, 64 nt, hsa; identical to SEQ ID NO: 511890

SEQ ID NO: 628589 - RNA, 64 nt, hsa; identical to SEQ ID NO: 511891

SEQ ID NO: 628590 - RNA, 64 nt, hsa; identical to SEQ ID NO: 511892

SEQ ID NO: 628591 - RNA, 64 nt, hsa; identical to SEQ ID NO: 511893

SEQ ID NO: 628592 - RNA, 64 nt, hsa; identical to SEQ ID NO: 511894

SEQ ID NO: 628593 - RNA, 64 nt, hsa; identical to SEQ ID NO: 511895

SEQ ID NO: 628594 - RNA, 64 nt, hsa; identical to SEQ ID NO: 511896

SEQ ID NO: 628595 - RNA, 64 nt, hsa; identical to SEQ ID NO: 511897

SEQ ID NO: 628596 - RNA, 64 nt, hsa; identical to SEQ ID NO: 511898

SEQ ID NO: 628597 - RNA, 64 nt, hsa; identical to SEQ ID NO: 511899

SEQ ID NO: 628598 - RNA, 64 nt, hsa; identical to SEQ ID NO: 511900

SEQ ID NO: 628599 - RNA, 64 nt, hsa; identical to SEQ ID NO: 511901

SEQ ID NO: 628600 - RNA, 64 nt, hsa; identical to SEQ ID NO: 511902

SEQ ID NO: 628601 - RNA, 64 nt, hsa; identical to SEQ ID NO: 410642

SEQ ID NO: 628602 - RNA, 64 nt, hsa; identical to SEQ ID NO: 410643

SEQ ID NO: 628603 - RNA, 64 nt, hsa; identical to SEQ ID NO: 410644

SEQ ID NO: 628604 - RNA, 64 nt, hsa; identical to SEQ ID NO: 410645

SEQ ID NO: 628605 - RNA, 64 nt, hsa; identical to SEQ ID NO: 410646

SEQ ID NO: 628606 - RNA, 64 nt, hsa; identical to SEQ ID NO: 410647

SEQ ID NO: 628607 - RNA, 64 nt, hsa; identical to SEQ ID NO: 410648

SEQ ID NO: 628608 - RNA, 64 nt, hsa; identical to SEQ ID NO: 410649

SEQ ID NO: 628609 - RNA, 64 nt, hsa; identical to SEQ ID NO: 410650

SEQ ID NO: 628610 - RNA, 64 nt, hsa; identical to SEQ ID NO: 410651

SEQ ID NO: 628611 - RNA, 64 nt, hsa; identical to SEQ ID NO: 410652

SEQ ID NO: 628612 - RNA, 64 nt, hsa; identical to SEQ ID NO: 410653

SEQ ID NO: 628613 - RNA, 64 nt, hsa; identical to SEQ ID NO: 410654

SEQ ID NO: 628614 - RNA, 64 nt, hsa; identical to SEQ ID NO: 410655

SEQ ID NO: 628615 - RNA, 64 nt, hsa; identical to SEQ ID NO: 410656

SEQ ID NO: 628616 - RNA, 64 nt, hsa; identical to SEQ ID NO: 410657

SEQ ID NO: 628617 - RNA, 64 nt, hsa; identical to SEQ ID NO: 410658

SEQ ID NO: 628618 - RNA, 64 nt, hsa; identical to SEQ ID NO: 410659

SEQ ID NO: 628619 - RNA, 64 nt, hsa; identical to SEQ ID NO: 410660

SEQ ID NO: 628620 - RNA, 64 nt, hsa; identical to SEQ ID NO: 410661

SEQ ID NO: 628621 - RNA, 64 nt, hsa; identical to SEQ ID NO: 410662

SEQ ID NO: 628622 - RNA, 64 nt, hsa; identical to SEQ ID NO: 410663

SEQ ID NO: 628623 - RNA, 64 nt, hsa; identical to SEQ ID NO: 410664

SEQ ID NO: 628624 - RNA, 64 nt, hsa; identical to SEQ ID NO: 410665

SEQ ID NO: 628625 - RNA, 64 nt, hsa; identical to SEQ ID NO: 410666

SEQ ID NO: 628626 - RNA, 64 nt, hsa; identical to SEQ ID NO: 410667

SEQ ID NO: 628627 - RNA, 64 nt, hsa; identical to SEQ ID NO: 410668

SEQ ID NO: 628628 - RNA, 64 nt, hsa; identical to SEQ ID NO: 410669

SEQ ID NO: 628629 - RNA, 64 nt, hsa; identical to SEQ ID NO: 410670

SEQ ID NO: 628630 - RNA, 64 nt, hsa; identical to SEQ ID NO: 410671

SEQ ID NO: 628631 - RNA, 64 nt, hsa; identical to SEQ ID NO: 410672

SEQ ID NO: 628632 - RNA, 64 nt, hsa; identical to SEQ ID NO: 410673

SEQ ID NO: 628633 - RNA, 64 nt, hsa; identical to SEQ ID NO: 410674

SEQ ID NO: 628634 - RNA, 64 nt, hsa; identical to SEQ ID NO: 410675

SEQ ID NO: 628635 - RNA, 64 nt, hsa; identical to SEQ ID NO: 410676

SEQ ID NO: 628636 - RNA, 64 nt, hsa; identical to SEQ ID NO: 410677

SEQ ID NO: 628637 - RNA, 63 nt, hsa
ucggcaugucugcagccuguucuccuagccugcugcuuggagucagguugagcaucagugaga

SEQ ID NO: 628638 - RNA, 63 nt, hsa
uaaaaaaauaauugaaguguaagcuaaauaaaaugcuuggaguuuugccugggcuagugagag

SEQ ID NO: 628639 - RNA, 63 nt, hsa
acaaggcagcuuggucuaguggagauagcacugugcuuggaguucaggggaccuaggacaaau

SEQ ID NO: 628640 - RNA, 63 nt, hsa
guaagggaaaaauuaauuuuuuaaaaaacaccaugcuuggaggguggggguagaaauagacac

SEQ ID NO: 628641 - RNA, 63 nt, hsa
cucaagugaucuaccugccucugccucccgaagugcuuggauuacaggugugagccacugugu

SEQ ID NO: 628642 - RNA, 63 nt, hsa
agugaauauacuuaauauauucuaguacagguaugcuuggaaauagggcguuuccuuuucaug

SEQ ID NO: 628643 - RNA, 63 nt, hsa
aagguuuuuaaaacauggauguuaaggcuguuuugcuuggagaagacuugggacugggacagu

SEQ ID NO: 628644 - RNA, 63 nt, hsa
ugccuaauuuuauaaaaagucacuaagcucaagugcuuggaugaaaggacagcguggauaaaa

SEQ ID NO: 628645 - RNA, 63 nt, hsa
uuaucuuuguaauuauuuuuaauauguaaggaaugcuuggaauaucugcuguaugucaacuuu

SEQ ID NO: 628646 - RNA, 63 nt, hsa
ucagagguggcucuggaaugacaugugucaagcugcuuggaccucgugcuuuaagugccuaca

SEQ ID NO: 628647 - RNA, 63 nt, hsa
guuugguaaaugccagguugauagggcgcuggcugcuuggagcaaagggugcauuucagggug

SEQ ID NO: 628648 - RNA, 63 nt, hsa
agaggcaccucugcucuuguugggagggguggcugcuuggaaauaggcccaggggcucugcca

SEQ ID NO: 628649 - RNA, 63 nt, hsa
augaccauuuauuugccccuuucuccauccuguugcuuggaauguggaucugguagugagcca

SEQ ID NO: 628650 - RNA, 62 nt, hsa
uuucucuugcuauuuauauauauaugauaaaaaugcuuggaagaguccuuuaauuuaugguu

SEQ ID NO: 628651 - RNA, 63 nt, hsa
acagaaacgccugagagucacuuacccggccacugcuuggaagguuucccuccggggaaugcc

SEQ ID NO: 628652 - RNA, 63 nt, hsa
ccggcuguggcugacaguggcucuggccaggguugcuuggagaaggcucagugugccugggac

SEQ ID NO: 628653 - RNA, 63 nt, hsa
uguguuuguuuuucaagaaaugauucaaauugcugcuuggauuuugaaauuuacuguaacugu

SEQ ID NO: 628654 - RNA, 63 nt, hsa
gugcgcccguggggucugcgcuuggucuuucugugcuuggauuugcauauuuauugcauugcu

SEQ ID NO: 628655 - RNA, 63 nt, hsa
cccuuuguagccauccaaugggcauugugugggugcuuggaacccgggaugacugagggggac

SEQ ID NO: 628656 - RNA, 63 nt, hsa
gaccaggggucccggaggaacccauuugugcucugcuuggacagcaggccuggcacugggagg

SEQ ID NO: 628657 - RNA, 64 nt, hsa
aaaaguaauuuugcauugcuuugaaauuugagcucauuugcaaacccgagucugccugggaacc

SEQ ID NO: 628658 - RNA, 64 nt, hsa
aucauauguuuuuguuaaauuugcguuucaguuacauuugcauuuaagacaaguguucuauuua

SEQ ID NO: 628659 - RNA, 64 nt, hsa
agaucacaaccucaagaugguuaaaauccauugacauuugcacuuucaaacaugacaagucucg

SEQ ID NO: 628660 - RNA, 64 nt, hsa
ggcacuauuccuggaggguccagucauucaccagcauuugcaaauguccauagggagcaggugg

SEQ ID NO: 628661 - RNA, 64 nt, hsa
gaagcuuguauuaucagugaauauaaauguacuacauuugcaugccuuuuggguuugccuuaau

SEQ ID NO: 628662 - RNA, 64 nt, hsa
ugcaugccuuuuggguuugccuuaauucuuaccucauuugcauccuaucgaucuggaaagagcu

SEQ ID NO: 628663 - RNA, 64 nt, hsa
aggacuugaccaucuuuccaaccccuggggaagacauuugcaacugacuuggggaggacacagc

SEQ ID NO: 628664 - RNA, 64 nt, hsa
aauuguuucauuguuugacacuuaaugcacucgucauuugcauacgacaguagcauucugacca

SEQ ID NO: 628665 - RNA, 64 nt, hsa
uaaaugugauagcugugcaugcauuauauauuugcauuugcaaauuucccauuguuuuaacagc

SEQ ID NO: 628666 - RNA, 64 nt, hsa
aaaugacuguacugaauuuaaaaccguacaguuucauuugcauuuugacauuacuuuauuauac

SEQ ID NO: 628667 - RNA, 64 nt, hsa
caugauucuaagaacuggaagaaccuggugguuccauuugcaaaggcugugugugaaaugagua

SEQ ID NO: 628668 - RNA, 64 nt, hsa
acacuggccugugauugguccauuccaggaccuucauuugcauaagguaucaaaccacaucagc

SEQ ID NO: 628669 - RNA, 64 nt, hsa
acucuggccaaugauugguucauuccaggacauucauuugcauaaggagucaaaccacaccagu

SEQ ID NO: 628670 - RNA, 64 nt, hsa
ggacaggugccauuuaaauugccuccaugcuccccauuugcaccuagcuggaucaaguugggag

SEQ ID NO: 628671 - RNA, 64 nt, hsa
ucuacuccaggcucuguuuuguguauuuaucugccauuugcaucaugguuuuuaaaauuuauua

SEQ ID NO: 628672 - RNA, 64 nt, hsa
ugcaacgcugauuuuuuuuugcauucuguagucgcauuugcacuccauuuuuacauuaauucgc

SEQ ID NO: 628673 - RNA, 64 nt, hsa
auuagagucaguucuggcucugccuagcuguuuacauuugcaaauguagcaaacaagguaauga

SEQ ID NO: 628674 - RNA, 64 nt, hsa
ugucccauuauaggugcaaggcaccccauccacacauuugcaccacuacuccaagauaguauuu

SEQ ID NO: 628675 - RNA, 64 nt, hsa
cagaggcugguuauaaauuugaacucccucagcccauuugcaacucugccucuguucucuugca

SEQ ID NO: 628676 - RNA, 64 nt, hsa
ucggggugagaauaaaacacccccacauaacaugcauuugcaugggcccgaaccugugaaaugu

SEQ ID NO: 628677 - RNA, 64 nt, hsa
gaggcugauacacaaggccucucuuccacaugaucauuugcaaaccucccccagccccuaccau

SEQ ID NO: 628678 - RNA, 64 nt, hsa
cucaauuggcuuauuuuuuagaucaccugcaauucauuugcaaauugcaauaaaacacauuuua

SEQ ID NO: 628679 - RNA, 64 nt, hsa
gugagaugaucacgguuucuuuuguuuaucacgccauuugcaaaucagagcaagagcucuuucu

SEQ ID NO: 628680 - RNA, 64 nt, hsa
acaccuugagccuuaaaacggugcugcugggaaacauuugcacucuuuuagugcauuuccuccu

SEQ ID NO: 628681 - RNA, 64 nt, hsa
aaugagagauugcaaauguaguguaucacugagucauuugcaguguuuucugccacagaccuuu

SEQ ID NO: 628682 - RNA, 64 nt, hsa
gaguuaguccccauuaguucuuguaucacauuuucauuugcacgacauuacucgcagguggugg

SEQ ID NO: 628683 - RNA, 64 nt, hsa
uuucccuuucuuccugacuagccccaagucccuucauuugcaucugcuaugcaauagucccucu

SEQ ID NO: 628684 - RNA, 64 nt, hsa
uagaauauauuucuuauacuaggaaucucauuugcauuugcauagacuauacacauggggugga

SEQ ID NO: 628685 - RNA, 64 nt, hsa
aaauguuagaauauauuucuuauacuaggaaucucauuugcauuugcauagacuauacacaugg

SEQ ID NO: 628686 - RNA, 64 nt, hsa
aaaggggacuaaauagguaaugauuuuccuagugcauuugcauacugugauaauccugggccuu

SEQ ID NO: 628687 - RNA, 64 nt, hsa
gaaguuaguguccacuaggguccuauuaacuguacauuugcaagauuucauuauuuuugccucu

SEQ ID NO: 628688 - RNA, 64 nt, hsa
agccauuuaaauuauauccucauuuuaaaaguuacauuugcaaauauuucucccuaugauaaug

SEQ ID NO: 628689 - RNA, 64 nt, hsa
aagggaacauguucggacuggaaacauuucuuuacauuugcauuccuccauuucgccagcacaa

SEQ ID NO: 628690 - RNA, 64 nt, hsa
acaacuaagguggcugaagaccuuucuggcagggcauuugcaaggacccaaauccauucaacaa

SEQ ID NO: 628691 - RNA, 64 nt, hsa
gggcgcuccaggucuggagcagguauaauuggagcauuugcacugagaccccugccagagagga

SEQ ID NO: 628692 - RNA, 61 nt, hsa
aaggagaacagcuauauuguccuuucuauaagcuugucacugcaaaaaguugccuuuugcu

SEQ ID NO: 628693 - RNA, 61 nt, hsa
auaagcuugucacugcaaaaaguugccuuuugcuugucagguuuggauagaauauaauuga

SEQ ID NO: 628694 - RNA, 64 nt, hsa; identical to SEQ ID NO: 544158

SEQ ID NO: 628695 - RNA, 64 nt, hsa; identical to SEQ ID NO: 544159

SEQ ID NO: 628696 - RNA, 64 nt, hsa; identical to SEQ ID NO: 544160

SEQ ID NO: 628697 - RNA, 64 nt, hsa; identical to SEQ ID NO: 544161

SEQ ID NO: 628698 - RNA, 64 nt, hsa; identical to SEQ ID NO: 544162

SEQ ID NO: 628699 - RNA, 64 nt, hsa; identical to SEQ ID NO: 544163

SEQ ID NO: 628700 - RNA, 64 nt, hsa; identical to SEQ ID NO: 544164

SEQ ID NO: 628701 - RNA, 64 nt, hsa; identical to SEQ ID NO: 544165

SEQ ID NO: 628702 - RNA, 64 nt, hsa; identical to SEQ ID NO: 544166

SEQ ID NO: 628703 - RNA, 64 nt, hsa; identical to SEQ ID NO: 544167

SEQ ID NO: 628704 - RNA, 64 nt, hsa; identical to SEQ ID NO: 544168

SEQ ID NO: 628705 - RNA, 64 nt, hsa; identical to SEQ ID NO: 544169

SEQ ID NO: 628706 - RNA, 64 nt, hsa; identical to SEQ ID NO: 544170

SEQ ID NO: 628707 - RNA, 64 nt, hsa; identical to SEQ ID NO: 544171

SEQ ID NO: 628708 - RNA, 64 nt, hsa; identical to SEQ ID NO: 544172

SEQ ID NO: 628709 - RNA, 64 nt, hsa; identical to SEQ ID NO: 544173

SEQ ID NO: 628710 - RNA, 64 nt, hsa; identical to SEQ ID NO: 544174

SEQ ID NO: 628711 - RNA, 64 nt, hsa; identical to SEQ ID NO: 544175

SEQ ID NO: 628712 - RNA, 64 nt, hsa; identical to SEQ ID NO: 544176

SEQ ID NO: 628713 - RNA, 64 nt, hsa; identical to SEQ ID NO: 544177

SEQ ID NO: 628714 - RNA, 64 nt, hsa; identical to SEQ ID NO: 544178

SEQ ID NO: 628715 - RNA, 64 nt, hsa; identical to SEQ ID NO: 544179

SEQ ID NO: 628716 - RNA, 64 nt, hsa; identical to SEQ ID NO: 544180

SEQ ID NO: 628717 - RNA, 64 nt, hsa; identical to SEQ ID NO: 544181

SEQ ID NO: 628718 - RNA, 64 nt, hsa; identical to SEQ ID NO: 544182

SEQ ID NO: 628719 - RNA, 64 nt, hsa; identical to SEQ ID NO: 544183

SEQ ID NO: 628720 - RNA, 64 nt, hsa; identical to SEQ ID NO: 544184

SEQ ID NO: 628721 - RNA, 64 nt, hsa; identical to SEQ ID NO: 544185

SEQ ID NO: 628722 - RNA, 64 nt, hsa; identical to SEQ ID NO: 544186

SEQ ID NO: 628723 - RNA, 64 nt, hsa; identical to SEQ ID NO: 544187

SEQ ID NO: 628724 - RNA, 64 nt, hsa
guggcccuggugucucacacuuguauccuucugcccucgagaccuggcacagcaguaucccuug

SEQ ID NO: 628725 - RNA, 64 nt, hsa
caaggacucuaggucaaaugucaauaaauaugaaccucgagaaaguucugaaggccaugacacc

SEQ ID NO: 628726 - RNA, 55 nt, hsa
aaccccaacaaaguucuuaaaauauccucgagagagcugcuaucauguauuauau

SEQ ID NO: 628727 - RNA, 64 nt, hsa
aaaaggugcugagggauuggacagcucugacuuuccucgagacuauggauauaguccuucucag

SEQ ID NO: 628728 - RNA, 64 nt, hsa
gguucuugaagccuguucccugcccuucucugugcucuuagacccagcuggagccagcacccuc

SEQ ID NO: 628729 - RNA, 64 nt, hsa
cagcuagggcagaggggucaggaugucuguuugccucuuagagacaggugucucugcccccaca

SEQ ID NO: 628730 - RNA, 64 nt, hsa
uacaguugucagugaaacuacuuuggauuuuaaccucuuagaggaagaaaaaagguuagggaag

SEQ ID NO: 628731 - RNA, 64 nt, hsa
uguugauggggguuaccagcuugauccacuguugcucuuagaaggcccagaaagucuuugggca

SEQ ID NO: 628732 - RNA, 64 nt, hsa
ccuguguguuccuaccuuuucugaaccucuuagacucuuagaaauaaaaguagaagaaagacag

SEQ ID NO: 628733 - RNA, 64 nt, hsa
ugaccuccccuguguguuccuaccuuuucugaaccucuuagacucuuagaaauaaaaguagaag

SEQ ID NO: 628734 - RNA, 64 nt, hsa
auauuaccccuucauguccuaaagaagacauuuucucuuagagauuuucauuuuaguguaucuu

SEQ ID NO: 628735 - RNA, 64 nt, hsa
acaggguuacuguauacugaaggucugacaguagcucuuagacucgccuaucuuagguagucau

SEQ ID NO: 628736 - RNA, 64 nt, hsa; identical to SEQ ID NO: 532114

SEQ ID NO: 628737 - RNA, 64 nt, hsa; identical to SEQ ID NO: 532115

SEQ ID NO: 628738 - RNA, 64 nt, hsa; identical to SEQ ID NO: 532116

SEQ ID NO: 628739 - RNA, 64 nt, hsa; identical to SEQ ID NO: 532117

SEQ ID NO: 628740 - RNA, 64 nt, hsa; identical to SEQ ID NO: 532118

SEQ ID NO: 628741 - RNA, 64 nt, hsa; identical to SEQ ID NO: 532119

SEQ ID NO: 628742 - RNA, 64 nt, hsa; identical to SEQ ID NO: 532120

SEQ ID NO: 628743 - RNA, 64 nt, hsa; identical to SEQ ID NO: 532121

SEQ ID NO: 628744 - RNA, 64 nt, hsa; identical to SEQ ID NO: 532122

SEQ ID NO: 628745 - RNA, 64 nt, hsa; identical to SEQ ID NO: 532123

SEQ ID NO: 628746 - RNA, 64 nt, hsa; identical to SEQ ID NO: 532124

SEQ ID NO: 628747 - RNA, 64 nt, hsa; identical to SEQ ID NO: 532125

SEQ ID NO: 628748 - RNA, 64 nt, hsa; identical to SEQ ID NO: 532126

SEQ ID NO: 628749 - RNA, 64 nt, hsa; identical to SEQ ID NO: 532127

SEQ ID NO: 628750 - RNA, 64 nt, hsa; identical to SEQ ID NO: 532128

SEQ ID NO: 628751 - RNA, 64 nt, hsa; identical to SEQ ID NO: 532129

SEQ ID NO: 628752 - RNA, 64 nt, hsa; identical to SEQ ID NO: 532130

SEQ ID NO: 628753 - RNA, 64 nt, hsa; identical to SEQ ID NO: 532131

SEQ ID NO: 628754 - RNA, 64 nt, hsa; identical to SEQ ID NO: 532132

SEQ ID NO: 628755 - RNA, 64 nt, hsa; identical to SEQ ID NO: 532133

SEQ ID NO: 628756 - RNA, 64 nt, hsa; identical to SEQ ID NO: 532134

SEQ ID NO: 628757 - RNA, 64 nt, hsa; identical to SEQ ID NO: 532135

SEQ ID NO: 628758 - RNA, 64 nt, hsa; identical to SEQ ID NO: 532136

SEQ ID NO: 628759 - RNA, 64 nt, hsa; identical to SEQ ID NO: 532137

SEQ ID NO: 628760 - RNA, 64 nt, hsa; identical to SEQ ID NO: 532138

SEQ ID NO: 628761 - RNA, 64 nt, hsa; identical to SEQ ID NO: 532139

SEQ ID NO: 628762 - RNA, 64 nt, hsa; identical to SEQ ID NO: 532140

SEQ ID NO: 628763 - RNA, 64 nt, hsa; identical to SEQ ID NO: 532141

SEQ ID NO: 628764 - RNA, 64 nt, hsa; identical to SEQ ID NO: 532142

SEQ ID NO: 628765 - RNA, 64 nt, hsa; identical to SEQ ID NO: 532143

SEQ ID NO: 628766 - RNA, 64 nt, hsa; identical to SEQ ID NO: 532144

SEQ ID NO: 628767 - RNA, 64 nt, hsa; identical to SEQ ID NO: 532145

SEQ ID NO: 628768 - RNA, 64 nt, hsa; identical to SEQ ID NO: 532146

SEQ ID NO: 628769 - RNA, 64 nt, hsa; identical to SEQ ID NO: 532147

SEQ ID NO: 628770 - RNA, 64 nt, hsa; identical to SEQ ID NO: 532148

SEQ ID NO: 628771 - RNA, 64 nt, hsa; identical to SEQ ID NO: 532149

SEQ ID NO: 628772 - RNA, 64 nt, hsa; identical to SEQ ID NO: 532150

SEQ ID NO: 628773 - RNA, 64 nt, hsa; identical to SEQ ID NO: 532151

SEQ ID NO: 628774 - RNA, 64 nt, hsa; identical to SEQ ID NO: 532152

SEQ ID NO: 628775 - RNA, 64 nt, hsa; identical to SEQ ID NO: 532153

SEQ ID NO: 628776 - RNA, 64 nt, hsa; identical to SEQ ID NO: 532154

SEQ ID NO: 628777 - RNA, 64 nt, hsa; identical to SEQ ID NO: 532155

SEQ ID NO: 628778 - RNA, 64 nt, hsa; identical to SEQ ID NO: 532156

SEQ ID NO: 628779 - RNA, 64 nt, hsa; identical to SEQ ID NO: 532157

SEQ ID NO: 628780 - RNA, 64 nt, hsa; identical to SEQ ID NO: 532158

SEQ ID NO: 628781 - RNA, 64 nt, hsa; identical to SEQ ID NO: 532159

SEQ ID NO: 628782 - RNA, 64 nt, hsa; identical to SEQ ID NO: 532160

SEQ ID NO: 628783 - RNA, 64 nt, hsa; identical to SEQ ID NO: 532161

SEQ ID NO: 628784 - RNA, 64 nt, hsa; identical to SEQ ID NO: 532162

SEQ ID NO: 628785 - RNA, 64 nt, hsa; identical to SEQ ID NO: 532163

SEQ ID NO: 628786 - RNA, 64 nt, hsa
aacugcaaaaagcuagguaagcuauuuuguugcagcucauaagguggugaaaaggacucuccug

SEQ ID NO: 628787 - RNA, 64 nt, hsa
auaggcaaggacaacaugugcuuuuuggugagcugcucauaauuccugaaauguguggugccag

SEQ ID NO: 628788 - RNA, 64 nt, hsa
guuaacugugcguuaaauaagcaaauaaacaguggcucauaaaaauaaaagucgcauuccauau

SEQ ID NO: 628789 - RNA, 64 nt, hsa
cuuuggaugggccuuuuagaaaccucauuggccagcucauaaaauggaagcaauugcucauguu

SEQ ID NO: 628790 - RNA, 64 nt, hsa
cgcguggcccagauaagaauagguguuccuuugugcucauaaaacagaaugcggcgaugguugc

SEQ ID NO: 628791 - RNA, 64 nt, hsa
agggcugugcuacacuucccaguuacauucugaagcucauaaauguaugagaagguuugugauu

SEQ ID NO: 628792 - RNA, 64 nt, hsa
uguucuaagaauuccauuugccucuaugaucuuagcucauaaaaauauaauaugacuugauaaa

SEQ ID NO: 628793 - RNA, 64 nt, hsa
gcugaaguuauaaguuuaaaacucaauuucagaugcucauaaaaguuacuuagcuaaaauuuua

SEQ ID NO: 628794 - RNA, 64 nt, hsa
ggagauauuuuuuuuucuuaagagaacuuaaagaacuggugauuuuuuuuuaacaaaaaaaggg

SEQ ID NO: 628795 - RNA, 64 nt, hsa
ucgcggucuccggggugccugggagggccgaaccacuggugagggcguggggagcagggggugg

SEQ ID NO: 628796 - RNA, 64 nt, hsa
gggaacuagccacacaggaggccgggagacagggacuggugagaauggggcugaguggaggagg

SEQ ID NO: 628797 - RNA, 64 nt, hsa
ccuaaucccuggcucaggguuauugccaguggagacuggugagcugggccuacucucagcugcc

SEQ ID NO: 628798 - RNA, 64 nt, hsa
cuucaacuuuuucugcacacacgagguauuuuauacuggugagaaaccuuacaauguaaagaau

SEQ ID NO: 628799 - RNA, 64 nt, hsa
uugacaacaccucgaacuuucuaacauaaaucauacuggugaaaaauccuagaaaugugaaaaa

SEQ ID NO: 628800 - RNA, 64 nt, hsa
augcguaaaagaaauugccuguuucagccagaagacuggugaaaacacauacaucagacuaugu

SEQ ID NO: 628801 - RNA, 64 nt, hsa
agggccugcuuuccccagcuccaugcauggcuggacuggugauuccagggugcagaagggauuc

SEQ ID NO: 628802 - RNA, 64 nt, hsa
gagggcgcaucuuacucaacaucaaagaauuccuacuggugagaaacccuaugaauguaaugaa

SEQ ID NO: 628803 - RNA, 64 nt, hsa
uugauuguucaacucuuaacaccagagaauucacacuggugagaaacccuuugaaugucaggaa

SEQ ID NO: 628804 - RNA, 64 nt, hsa
gagagcccaucuuagucaacaucaaaauauucauacuggugagaaacccuaugaguuuaaggaa

SEQ ID NO: 628805 - RNA, 64 nt, hsa
gcuuucaaacuugaauaaacaucagacaauucacacuggugacaaacccuaugaauguaaagau

SEQ ID NO: 628806 - RNA, 64 nt, hsa
uguuuauucucugcugcaucuuacagaagaguaaacuggugagaguauauauuuuauauauaua

SEQ ID NO: 628807 - RNA, 64 nt, hsa
auugaaacuuuuuucauuuugaaaaguauugguuacuggugauguugaaauaugcauacuaauu

SEQ ID NO: 628808 - RNA, 64 nt, hsa
ugcacugugauaccuaccagucuccagggacuaugacccuaaaccagggccugcggcacuugcg

SEQ ID NO: 628809 - RNA, 64 nt, hsa
caccaagaugccuucuaaaggcugacauaccuuggacccuaauggggcagagaguauagcccua

SEQ ID NO: 628810 - RNA, 64 nt, hsa
ucacucggaaucaaaggugccaauuccaaaucaagacccuaaugauuucucccaagcaaaucag

SEQ ID NO: 628811 - RNA, 64 nt, hsa
agcugccgaagcagccacuggaaagaacccuggggacccuaauguuggacucucggcgcgacac

SEQ ID NO: 628812 - RNA, 64 nt, hsa; identical to SEQ ID NO: 107011

SEQ ID NO: 628813 - RNA, 64 nt, hsa; identical to SEQ ID NO: 107012

SEQ ID NO: 628814 - RNA, 64 nt, hsa; identical to SEQ ID NO: 107013

SEQ ID NO: 628815 - RNA, 64 nt, hsa; identical to SEQ ID NO: 107014

SEQ ID NO: 628816 - RNA, 64 nt, hsa; identical to SEQ ID NO: 107015

SEQ ID NO: 628817 - RNA, 64 nt, hsa; identical to SEQ ID NO: 107016

SEQ ID NO: 628818 - RNA, 64 nt, hsa; identical to SEQ ID NO: 107017

SEQ ID NO: 628819 - RNA, 64 nt, hsa; identical to SEQ ID NO: 107018

SEQ ID NO: 628820 - RNA, 64 nt, hsa; identical to SEQ ID NO: 107019

SEQ ID NO: 628821 - RNA, 64 nt, hsa; identical to SEQ ID NO: 107020

SEQ ID NO: 628822 - RNA, 64 nt, hsa; identical to SEQ ID NO: 107021

SEQ ID NO: 628823 - RNA, 64 nt, hsa; identical to SEQ ID NO: 107022

SEQ ID NO: 628824 - RNA, 64 nt, hsa; identical to SEQ ID NO: 107023

SEQ ID NO: 628825 - RNA, 64 nt, hsa; identical to SEQ ID NO: 107024

SEQ ID NO: 628826 - RNA, 64 nt, hsa; identical to SEQ ID NO: 107025

SEQ ID NO: 628827 - RNA, 64 nt, hsa; identical to SEQ ID NO: 107026

SEQ ID NO: 628828 - RNA, 64 nt, hsa; identical to SEQ ID NO: 107027

SEQ ID NO: 628829 - RNA, 64 nt, hsa; identical to SEQ ID NO: 107028

SEQ ID NO: 628830 - RNA, 64 nt, hsa; identical to SEQ ID NO: 107029

SEQ ID NO: 628831 - RNA, 64 nt, hsa; identical to SEQ ID NO: 107030

SEQ ID NO: 628832 - RNA, 64 nt, hsa; identical to SEQ ID NO: 107031

SEQ ID NO: 628833 - RNA, 64 nt, hsa; identical to SEQ ID NO: 107032

SEQ ID NO: 628834 - RNA, 64 nt, hsa; identical to SEQ ID NO: 436956

SEQ ID NO: 628835 - RNA, 64 nt, hsa; identical to SEQ ID NO: 436957

SEQ ID NO: 628836 - RNA, 63 nt, hsa
aggaaacuuugaaggguuaaauagagauuuaaaaaaauaaaauaaaaaggcugggcuagggug

SEQ ID NO: 628837 - RNA, 63 nt, hsa
acuuugaaggguuaaauagagauuuaaaaaaauaaaauaaaaaggcugggcuagggugcuuuu

SEQ ID NO: 628838 - RNA, 63 nt, hsa
uauuuguguucuaacaggaggaugaacuugcugaaaauaaaacuuugcuauguauuuacucuu

SEQ ID NO: 628839 - RNA, 63 nt, hsa
gcaccaguauauugcuggcagcuauuguauuaaaaaauaaaguauauuuucacuaucauaaag

SEQ ID NO: 628840 - RNA, 63 nt, hsa
aguuacuguuguuuacagugaguuuggggaaaaaaaauaaaauaaaaauggcuuucccagucc

SEQ ID NO: 628841 - RNA, 63 nt, hsa
cuguuguuuacagugaguuuggggaaaaaaaauaaaauaaaaauggcuuucccaguccuugca

SEQ ID NO: 628842 - RNA, 63 nt, hsa
augcuaucagaaacaguauuuucuucccaaaucaaaauaaaagaaauaugaucagagcuugaa

SEQ ID NO: 628843 - RNA, 63 nt, hsa
auaugaucagagcuugaacacaggcuuauuuuuaaaauaaaaauauuuuuaacauggguuucc

SEQ ID NO: 628844 - RNA, 63 nt, hsa
ugcuagcaugauuuuuuuauauauagaaguuuaaaaauaaaccaggucagguuuguauaugua

SEQ ID NO: 628845 - RNA, 63 nt, hsa
uucagccaucaguucaagagccaaugccuuuuuaaaauaaagcuucuguggucuuguuuuuaa

SEQ ID NO: 628846 - RNA, 63 nt, hsa
uuguaguggaguucauaucacauuauguuuugcaaaauaaaacuuguuuugucacaauauuuu

SEQ ID NO: 628847 - RNA, 63 nt, hsa
aauuuuaauaaauuauauaauuauacauauuguaaaauaaagaccgguauuuuauuuucugcu

SEQ ID NO: 628848 - RNA, 63 nt, hsa
ggauagaacccauacaugaauuaaaugaugcacaaaauaaauggcuguugaaauuuggaaaug

SEQ ID NO: 628849 - RNA, 63 nt, hsa
agcuaaugauagauagaaaugcccacucaaagaaaaauaaacagagacaaauguuaaaauugc

SEQ ID NO: 628850 - RNA, 63 nt, hsa
uacagacuguuuuucccccuguuguuucacuuuaaaauaaaaagaaauccuugauuaaucaga

SEQ ID NO: 628851 - RNA, 63 nt, hsa
auggacugccuuauugcuguugcuuaucauuugaaaauaaaauccagcucagguuguaacuug

SEQ ID NO: 628852 - RNA, 63 nt, hsa
ccauagaaacauucucguuuaaacaacaacaacaaaauaaauuuaucagcacuagauauuaga

SEQ ID NO: 628853 - RNA, 63 nt, hsa
cucuguagcuaacccuuauaaacuaggcucaguaaaauaaagcacucuuauuuuuugaucugg

SEQ ID NO: 628854 - RNA, 63 nt, hsa
guguauuuuuucagguuucuggaaauaaauaguaaaauaaauggcacaaauaguuucaauaaa

SEQ ID NO: 628855 - RNA, 63 nt, hsa
uaaagaaauuauauuuuguucuauugcuaggguaaaauaaauacauuuguguccaacugaaau

SEQ ID NO: 628856 - RNA, 63 nt, hsa
cuagugaacaaaaggugccuauucuuuuuuaaaaaaauaaaauaaaacauaaauauuacucuu

SEQ ID NO: 628857 - RNA, 63 nt, hsa
gaacaaaaggugccuauucuuuuuuaaaaaaauaaaauaaaacauaaauauuacucuuccaua

SEQ ID NO: 628858 - RNA, 63 nt, hsa
aauagccuagggcugaauuuuugucagauaaauaaaauaaaucauucauccuuuuuuuugauu

SEQ ID NO: 628859 - RNA, 63 nt, hsa
uaaauguauuuuagacuuccuguagggggcgauaaaauaaaaugcuaaacaacuggguauaca

SEQ ID NO: 628860 - RNA, 63 nt, hsa
aaaaucaugucaucuucuauuuguacagaaaugaaaauaaaauaugaaaauaaugaaagaaau

SEQ ID NO: 628861 - RNA, 63 nt, hsa
gggcaaaugucauuguuaccucuguguguuaagaaaauaaaaauauuuucuaaaggucuguau

SEQ ID NO: 628862 - RNA, 63 nt, hsa
gaacauuuuucuuuuauuguuuuaucuucacagaaaauaaaagguguuaauuugcuuuuuaaa

SEQ ID NO: 628863 - RNA, 63 nt, hsa
cugaguugauuuucuagguucuuacguauuugaaaaauaaaauugcaauucgagauaagugcu

SEQ ID NO: 628864 - RNA, 63 nt, hsa
auccugucucaaaaauuaauuaauuaauuaauuaaaauaaacuagguaaacuuggauaggcag

SEQ ID NO: 628865 - RNA, 63 nt, hsa
accuugugucuucucuuguaaaaaugaaacucaaaaauaaaauaaaugugucaaauuuugaaa

SEQ ID NO: 628866 - RNA, 63 nt, hsa
gugucuucucuuguaaaaaugaaacucaaaaauaaaauaaaugugucaaauuuugaaaaaaaa

SEQ ID NO: 628867 - RNA, 63 nt, hsa
gcuucccucaguucaccaaaguuaccaaaauguaaaauaaaauaagacuggcucagguaagua

SEQ ID NO: 628868 - RNA, 63 nt, hsa
uaaaucuagaaaccauuaguuugagaucucucaaaaauaaaaauaaaaauugcuuucagagag

SEQ ID NO: 628869 - RNA, 63 nt, hsa
uagaaaccauuaguuugagaucucucaaaaauaaaaauaaaaauugcuuucagagaguagccc

SEQ ID NO: 628870 - RNA, 63 nt, hsa
aaagcuaaauauggcacacuuguucuuuacagaaaaauaaagauauuuuaaacaaaauacuag

SEQ ID NO: 628871 - RNA, 63 nt, hsa
gguagcugugcagauguggaucaacauuuguuuaaaauaaaguauuaauacuuuaaagucaaa

SEQ ID NO: 628872 - RNA, 63 nt, hsa
aucggcggcacaaucacuuuguagaaacuguaaaaaauaaaaguaucuccuagucccuuaauu

SEQ ID NO: 628873 - RNA, 63 nt, hsa
uuauuuauucacacuugaauugcauuugugaucaaaauaaauguuuaaaucgcuaaaggaaaa

SEQ ID NO: 628874 - RNA, 63 nt, hsa
cacuggaagaguuuaguguuucuuguaugcuugaaaauaaaguauguacuguuuugaaugugu

SEQ ID NO: 628875 - RNA, 63 nt, hsa
agccuaggagacaaaacgagacuucauuuaaaaaaaauaaaaauaaaaauaaaaauaaaguca

SEQ ID NO: 628876 - RNA, 63 nt, hsa
ggagacaaaacgagacuucauuuaaaaaaaauaaaaauaaaaauaaaaauaaagucaucuugc

SEQ ID NO: 628877 - RNA, 63 nt, hsa
aaaacgagacuucauuuaaaaaaaauaaaaauaaaaauaaaaauaaagucaucuugccaccca

SEQ ID NO: 628878 - RNA, 63 nt, hsa
agacuucauuuaaaaaaaauaaaaauaaaaauaaaaauaaagucaucuugccacccacccccu

SEQ ID NO: 628879 - RNA, 63 nt, hsa
uugaaguauauucaaccaaauacuuuaauguauaaaauaaauauuauacaauauacuuguaua

SEQ ID NO: 628880 - RNA, 63 nt, hsa
cauuuuuuaaaaaauggacucuugaaaucuguuaaaauaaaauuguacauuuggagauguuuc

SEQ ID NO: 628881 - RNA, 63 nt, hsa
ccacccugggcaacagagcaagaccccaucucaaaaauaaauaaauauauauaaaaaauaaaa

SEQ ID NO: 628882 - RNA, 63 nt, hsa
gaccccaucucaaaaauaaauaaauauauauaaaaaauaaaaagcuauuucuaguuuauuuca

SEQ ID NO: 628883 - RNA, 63 nt, hsa
cuagagucauauaagaaauaaaaauugggcaauaaaauaaaaugauucaguguuucuuuucua

SEQ ID NO: 628884 - RNA, 63 nt, hsa
cugcaaaagggaucuucgaaacugggcagagaaaaaauaaaguggaauauuaaguaaaaguug

SEQ ID NO: 628885 - RNA, 63 nt, hsa
cauauugucaccuguaccugucacacaucuugaaaaauaaaacgauaauagaacuagugacua

SEQ ID NO: 628886 - RNA, 63 nt, hsa
gauugaagugcagagaaaaaucccuuagauugcaaaauaaaauaguugaacucucugucuuca

SEQ ID NO: 628887 - RNA, 63 nt, hsa
caaaaaauaaaauaaaauaaaauaaaauaaaauaaaauaaaauaaaauaaaauaaaauaaaau

SEQ ID NO: 628888 - RNA, 63 nt, hsa
ugucucaaaaaauaaaauaaaauaaaauaaaauaaaauaaaauaaaauaaaauaaaauaaaau

SEQ ID NO: 628889 - RNA, 63 nt, hsa
cacucugucucaaaaaauaaaauaaaauaaaauaaaauaaaauaaaauaaaauaaaauaaaau

SEQ ID NO: 628890 - RNA, 63 nt, hsa
agugacacucugucucaaaaaauaaaauaaaauaaaauaaaauaaaauaaaauaaaauaaaau

SEQ ID NO: 628891 - RNA, 63 nt, hsa
aacagagugacacucugucucaaaaaauaaaauaaaauaaaauaaaauaaaauaaaauaaaau

SEQ ID NO: 628892 - RNA, 63 nt, hsa
ugggcaacagagugacacucugucucaaaaaauaaaauaaaauaaaauaaaauaaaauaaaau

SEQ ID NO: 628893 - RNA, 63 nt, hsa
cagccugggcaacagagugacacucugucucaaaaaauaaaauaaaauaaaauaaaauaaaau

SEQ ID NO: 628894 - RNA, 63 nt, hsa
aaugagacucagucuccgaaaaauaaaaauuaaaaaauaaaggguauuucccuccuugccugu

SEQ ID NO: 628895 - RNA, 63 nt, hsa
agucuaagcaacauaaugagacucagucuccgaaaaauaaaaauuaaaaaauaaaggguauuu

SEQ ID NO: 628896 - RNA, 63 nt, hsa
auccacuuagagcaauaaccacuuuuuaaauguaaaauaaaaagacaaaugaaaaggcacauc

SEQ ID NO: 628897 - RNA, 63 nt, hsa
aggaggcugcacuacaaacccaaauucugcaaaaaaauaaaaauaagccacaaaacuaaaagg

SEQ ID NO: 628898 - RNA, 63 nt, hsa
uagugccaaaaacuuuuuaaaagguaaaaaaauaaaauaaaauuacaacaugaagauucagau

SEQ ID NO: 628899 - RNA, 63 nt, hsa
ccuuguagugccaaaaacuuuuuaaaagguaaaaaaauaaaauaaaauuacaacaugaagauu

SEQ ID NO: 628900 - RNA, 63 nt, hsa
guuucuuuuacugauuuaaaaacaaaacaaaaaaaaauaaaaaaguugugccugaaaugaauc

SEQ ID NO: 628901 - RNA, 63 nt, hsa
caguuuuaacaccuuccucguguuauguuuaaaaaaauaaauaaauuuaagaaaaccauuuua

SEQ ID NO: 628902 - RNA, 63 nt, hsa
aaaauaauguucuuuuuaugcaaauccccugugaaaauaaaauuuucaauguuuuuuuggucu

SEQ ID NO: 628903 - RNA, 63 nt, hsa
cauaauuuaaccauuagcaucuuuggccaaaccaaaauaaagaaaagcaucuucuccuaguug

SEQ ID NO: 628904 - RNA, 63 nt, hsa
caauuugaauaagucaugcuuuccuagaauuuaaaaauaaaaaagucuuccucuggaaagaga

SEQ ID NO: 628905 - RNA, 63 nt, hsa
agaaggaaacauauguucuccccuacauuaguaaaaauaaaaauggaauuuuuuacccauaca

SEQ ID NO: 628906 - RNA, 63 nt, hsa
gccuggacaacauagugagaccuugucuccacaaaaauaaaaaagaaacuauccaggaguggu

SEQ ID NO: 628907 - RNA, 63 nt, hsa
gccacuguagcgccuuuuuaaaauaaauaaaauaaaauaaagcaccauuuuguuucccuuuca

SEQ ID NO: 628908 - RNA, 63 nt, hsa
guccugccacuguagcgccuuuuuaaaauaaauaaaauaaaauaaagcaccauuuuguuuccc

SEQ ID NO: 628909 - RNA, 63 nt, hsa
cccagcagcguccugccacuguagcgccuuuuuaaaauaaauaaaauaaaauaaagcaccauu

SEQ ID NO: 628910 - RNA, 63 nt, hsa
agagugagacucugucucaaaaaauaaauaaauaaaauaaaaugaaauagaucuuauuauucu

SEQ ID NO: 628911 - RNA, 63 nt, hsa
cagucugggugacagagugagacucugucucaaaaaauaaauaaauaaaauaaaaugaaauag

SEQ ID NO: 628912 - RNA, 63 nt, hsa
aacaugaccaauguuuuucaucugccacaucucaaaauaaaacuucuggugaaacaaauuaaa

SEQ ID NO: 628913 - RNA, 63 nt, hsa
augacccauaguauuaaauacauaucauuuuuaaaaauaaaaaaaaacccaaaaauaaugcau

SEQ ID NO: 628914 - RNA, 63 nt, hsa
accauuuugcuaccaguuacauugaacugcuuuaaaauaaauaauaaaauuauuucuaaugau

SEQ ID NO: 628915 - RNA, 63 nt, hsa
guugccuuuuuaaaauaauuauacuugcacaugaaaauaaaauauaaagucaauaauaguccu

SEQ ID NO: 628916 - RNA, 52 nt, hsa; identical to SEQ ID NO: 61813

SEQ ID NO: 628917 - RNA, 63 nt, hsa
uuuuuuugcuuccuaauaacaaugacaacaaaaaaaauaaaugaccaguuuuguguugggggg

SEQ ID NO: 628918 - RNA, 63 nt, hsa
uucugcugagguuugaacuccuguuuuuauuguaaaauaaauugccccccauucugguccccu

SEQ ID NO: 628919 - RNA, 63 nt, hsa
gauucacucuuuucuccuguuuuguaaaaaauaaaaauaaauaauaacaauaauacgggggaa

SEQ ID NO: 628920 - RNA, 63 nt, hsa
caacccgauucacucuuuucuccuguuuuguaaaaaauaaaaauaaauaauaacaauaauacg

SEQ ID NO: 628921 - RNA, 63 nt, hsa
cagagcaagacucugucucaaaaaauaaaaauaaaaauaaauuugguucuaauagaacucagu

SEQ ID NO: 628922 - RNA, 63 nt, hsa
gggugacagagcaagacucugucucaaaaaauaaaaauaaaaauaaauuugguucuaauagaa

SEQ ID NO: 628923 - RNA, 63 nt, hsa
cagccugggugacagagcaagacucugucucaaaaaauaaaaauaaaaauaaauuugguucua

SEQ ID NO: 628924 - RNA, 63 nt, hsa
agcuauuguuauaguagcugcccuauaguuacaaaaauaaaaacuauaaaaacccauccccua

SEQ ID NO: 628925 - RNA, 63 nt, hsa
gccccguaaaaggguuaacagcacaauuuuuuaaaaauaaauuaagaaguauuuauaggauua

SEQ ID NO: 628926 - RNA, 63 nt, hsa
ggguacaagugguccaaacuaagauaagagacuaaaauaaaaugcuaaaucuuaaaagaaacu

SEQ ID NO: 628927 - RNA, 63 nt, hsa
gauaaagucgcacauuuuccacaauacauugcuaaaauaaagaggagaaaggcuuaggaaguu

SEQ ID NO: 628928 - RNA, 63 nt, hsa
uuuuuuaugagaaaaauacuguauuuaaaauguaaaauaaacuuuuaaaaagcaggcacuaau

SEQ ID NO: 628929 - RNA, 63 nt, hsa
acaugagcuacauguuaaauauuuaaagucuccaaaauaaaacaccccaacguugaccuuacc

SEQ ID NO: 628930 - RNA, 63 nt, hsa
ugaauuuucuuuucuguccaaacaaguaaaauaaaaauaaaagucuauuuagauguugauucu

SEQ ID NO: 628931 - RNA, 63 nt, hsa
agcugaugaauuuucuuuucuguccaaacaaguaaaauaaaaauaaaagucuauuuagauguu

SEQ ID NO: 628932 - RNA, 63 nt, hsa
cuuguuaagagugcaauauuauauuuuuauguaaaaauaaaaauuaauuuggggggauuauuu

SEQ ID NO: 628933 - RNA, 63 nt, hsa
uguaccaaauauuuuauggaauaucuaaauacuaaaauaaacuaugaaugaaucucaaaauua

SEQ ID NO: 628934 - RNA, 63 nt, hsa
ggauuaaacaaguauaaaauaaaauacauuuauaaaauaaaaaggaaaacagacuuaaauuuu

SEQ ID NO: 628935 - RNA, 63 nt, hsa
augugcuaggucuaagauggauuaaacaaguauaaaauaaaauacauuuauaaaauaaaaagg

SEQ ID NO: 628936 - RNA, 63 nt, hsa
uggguccaaagugauuuacauaaauuuauaaugaaaauaaacauguauaaaauuuaaaaaaac

SEQ ID NO: 628937 - RNA, 63 nt, hsa
agaaggauuuuauucucaacagaugcaaaaugcaaaauaaaauauuggcaaacaauacagcaa

SEQ ID NO: 628938 - RNA, 63 nt, hsa
gccgaauauaauggaaauaggaaaaauuagucgaaaauaaagguugauuuagaaaugaagaaa

SEQ ID NO: 628939 - RNA, 63 nt, hsa
uccagcuuggcgacagagcaagacccccucucaaaaauaaauaaaauaaaguaaaauaaauau

SEQ ID NO: 628940 - RNA, 63 nt, hsa
gcgacagagcaagacccccucucaaaaauaaauaaaauaaaguaaaauaaauauaaauaauug

SEQ ID NO: 628941 - RNA, 63 nt, hsa
aagacccccucucaaaaauaaauaaaauaaaguaaaauaaauauaaauaauuguggccgggug

SEQ ID NO: 628942 - RNA, 63 nt, hsa
ugagaccccugucuauauauuuuuuuaauuuaaaaaauaaaagaauaaaauuguguagcucag

SEQ ID NO: 628943 - RNA, 63 nt, hsa
uauuguagauacaauuuucugauuaaaucuggaaaaauaaaaggcagccuguuuuuucugcuu

SEQ ID NO: 628944 - RNA, 63 nt, hsa
uuguauuaacagcugagguagcuaaaguuauuuaaaauaaaauuaaauuuaugauccaaguag

SEQ ID NO: 628945 - RNA, 63 nt, hsa
auguacagauuaaaauuauugcuacauuugaggaaaauaaaauugcuugcuucuauguaauuc

SEQ ID NO: 628946 - RNA, 63 nt, hsa
uaccauuuauugguuuggggaccaucuuaauuaaaaauaaaugcccaaaauguagaacuuuaa

SEQ ID NO: 628947 - RNA, 63 nt, hsa
gggucuuuuuucuugagcuuauaauguaccuggaaaauaaaccucuugagaaaaagaaaaguu

SEQ ID NO: 628948 - RNA, 63 nt, hsa
auaguaccauacaugaguuauuucuaaguuugaaaaauaaaaagaaauugcaucacacuaauu

SEQ ID NO: 628949 - RNA, 63 nt, hsa
uaaauuaacaugaaauacuucauuuugauugagaaaauaaaaucagauuuuuucaaagucaau

SEQ ID NO: 628950 - RNA, 63 nt, hsa
gggagcaucuguauuuuuauguuaaaagcccacaaaauaaaaauaaaaaguaacugagaugaa

SEQ ID NO: 628951 - RNA, 63 nt, hsa
aucuguauuuuuauguuaaaagcccacaaaauaaaaauaaaaaguaacugagaugaauuuacc

SEQ ID NO: 628952 - RNA, 63 nt, hsa
ggcgcaauauuuaugggagugggagggauggggaaaauaaacuuaacucuacaaaagcaaacu

SEQ ID NO: 628953 - RNA, 63 nt, hsa
aucuaauauaccauuguauucacuaacuaacucaaaauaaacacauuuaaucuugacaucuca

SEQ ID NO: 628954 - RNA, 63 nt, hsa
uuuuaaaugcuacuuuguaaaggugaccuuuaaaaaauaaaaggaaaauaaagaauguuaguu

SEQ ID NO: 628955 - RNA, 63 nt, hsa
acuuuguaaaggugaccuuuaaaaaauaaaaggaaaauaaagaauguuaguuucauucugccg

SEQ ID NO: 628956 - RNA, 63 nt, hsa
acauagugaauuuuaaaauguagaagaaagcaaaaaauaaaauaaguccuaaagugaagaagc

SEQ ID NO: 628957 - RNA, 63 nt, hsa
aacaaaaugaaguuaacuuaguguuuagcauuaaaaauaaaaguuguaccuugacccuagaau

SEQ ID NO: 628958 - RNA, 63 nt, hsa
guagaccugauuuucaaaaucugcccucagaugaaaauaaaauaaacgaaacauuuagacaau

SEQ ID NO: 628959 - RNA, 63 nt, hsa
ccugauuuucaaaaucugcccucagaugaaaauaaaauaaacgaaacauuuagacaauggcua

SEQ ID NO: 628960 - RNA, 63 nt, hsa
gagcgagaccuugucucuaaaaauaauaguaauaaaauaaaaauaacguuuuaugacuauuua

SEQ ID NO: 628961 - RNA, 63 nt, hsa
gcuaaguuaaaauacaguuuaguuauuugcuuuaaaauaaacucuucuuuuuuucuuuaaagu

SEQ ID NO: 628962 - RNA, 63 nt, hsa
ggugaauuggcucucauggaaauuuggaauuacaaaauaaacguccuggggguuacccagaau

SEQ ID NO: 628963 - RNA, 63 nt, hsa
cagaauacagauuuaaaaguuugccuguagagcaaaauaaaacagucaguuguagucauuaau

SEQ ID NO: 628964 - RNA, 63 nt, hsa
gaauaaaguuauguucugauaguuuguacagaaaaaauaaaauggaugcccauguuuuauugc

SEQ ID NO: 628965 - RNA, 63 nt, hsa
cacuucacugccauuuucuauucacauaaaagaaaaauaaauguggaaauuucauccuuggaa

SEQ ID NO: 628966 - RNA, 63 nt, hsa
aaccagauaaaaguagcacaugugcuuuuguuaaaaauaaaguuaaaaguuaaaguuaaaaaa

SEQ ID NO: 628967 - RNA, 63 nt, hsa
uggaugucucgcuucacaauaaaacacagcuuaaaaauaaaauaacugaaagaaauagaauuc

SEQ ID NO: 628968 - RNA, 63 nt, hsa
uaaaagcaauagcuggaauauacucccaguuuuaaaauaaaugccugauugauuuaaagcaag

SEQ ID NO: 628969 - RNA, 63 nt, hsa
uauguauguuccuaaugcuuauggaacuccuccaaaauaaaguuacucaaagagagcaaauau

SEQ ID NO: 628970 - RNA, 63 nt, hsa
uuuugcaucauuuaaacaugcagaagauguuuaaaaauaaaaaaaaaacugcuuuauccuccu

SEQ ID NO: 628971 - RNA, 63 nt, hsa
ucuuuucaaauauuuguaggacaacuuugaaucaaaauaaauuauguuccuucuccaauuuga

SEQ ID NO: 628972 - RNA, 63 nt, hsa
ccccucaggggaauucggagcuagaggacauggaaaauaaagccaggaaagucaaaaaaacga

SEQ ID NO: 628973 - RNA, 63 nt, hsa
aagcgcaaagaggagaaugaagauccagaaaggaaaauaaagaagaagggcuucggcgccaug

SEQ ID NO: 628974 - RNA, 63 nt, hsa
aauaauuauuaaugaaagauuuuugaaauauaaaaaauaaauuaggcccaauccaagaaauug

SEQ ID NO: 628975 - RNA, 63 nt, hsa
uucaauauaaccagcaauuuagguggcaucuauaaaauaaaaaauuucuacuguggacauccc

SEQ ID NO: 628976 - RNA, 63 nt, hsa
caaagacuauuaaaggagcuguacagagguaaaaaaauaaauguggaacauuauuaacuuacu

SEQ ID NO: 628977 - RNA, 63 nt, hsa
uuuuaaaaugacuugacuauaaaaaaaaauuaaaaaauaaaaauaaaugacuuggcuguaaua

SEQ ID NO: 628978 - RNA, 63 nt, hsa
aaugacuugacuauaaaaaaaaauuaaaaaauaaaaauaaaugacuuggcuguaauaaggcau

SEQ ID NO: 628979 - RNA, 63 nt, hsa
ugaucauguuuugcuacaguuugcaggugaaaaaaaauaaauauuauaaaauaugcuauuguu

SEQ ID NO: 628980 - RNA, 63 nt, hsa
gggggcucuuacugacuuuaaauuagcgcuuauaaaauaaaaauguuuaguucaagaagagac

SEQ ID NO: 628981 - RNA, 63 nt, hsa
gcagccugggcgacagagcgagauucugccucaaaaauaaacaaauaaauuuuaaaaauaaau

SEQ ID NO: 628982 - RNA, 63 nt, hsa
gauucugccucaaaaauaaacaaauaaauuuuaaaaauaaauaaauaauaaaaggaaguguua

SEQ ID NO: 628983 - RNA, 63 nt, hsa
cauaagauaugagauacaugaaccugaacuauuaaaauaaaauauuauauuuaacccuuaguu

SEQ ID NO: 628984 - RNA, 63 nt, hsa
ccuggccaacauggcaaaaccacaucucuacuaaaaauaaaaaaauuagcugggugugguggu

SEQ ID NO: 628985 - RNA, 63 nt, hsa
uccagccggggugacagagugagacuccgacugaaaauaaauaaauaaauaaauaaauaaaua

SEQ ID NO: 628986 - RNA, 63 nt, hsa
uuguuaugaaauaaaaaaaagauggguuuuguaaaaauaaaaaaaaaauauuuuuagcagaac

SEQ ID NO: 628987 - RNA, 63 nt, hsa
ggguauaucuauuucugaagagguaagcugaucaaaauaaauagaguguaaauucuuuuuaau

SEQ ID NO: 628988 - RNA, 63 nt, hsa
gaaauuguucuuuuaaaauauguguaacuucuaaaaauaaaacuuaaaauuuauauguauuaa

SEQ ID NO: 628989 - RNA, 63 nt, hsa
uaguuuggguucauuucuauaacauuuuguaagaaaauaaaaguuugagcaccugauuauauu

SEQ ID NO: 628990 - RNA, 63 nt, hsa
gcuacagagcacccagugauuuuacugaggauuaaaauaaaaaaccguaggaaugggcucaac

SEQ ID NO: 628991 - RNA, 63 nt, hsa
aaaauauguuuacauuggauaaaggauuaggcaaaaauaaaauguuucaaggauuccugacca

SEQ ID NO: 628992 - RNA, 63 nt, hsa
cugcuuuacuuugauguaucauauuuuuaaauaaaaauaaauauuccuuuagaagaucacucu

SEQ ID NO: 628993 - RNA, 63 nt, hsa
auacuauugagaaaucuauggggaggauaugagaaaauaaauuccuucuaaaccacauuggaa

SEQ ID NO: 628994 - RNA, 63 nt, hsa
cuguucauacacccauuuugucccuuuauugaaaaaauaaaaaaaauuaaaguacacauugua

SEQ ID NO: 628995 - RNA, 63 nt, hsa
uuuucucuaaucagagauacagagguugaguauaaaauaaaccugcucagauaggacaauuaa

SEQ ID NO: 628996 - RNA, 63 nt, hsa
cucucugagagaaaaggguguuuuaaauuuaaaaaaauaaaaacaaaaaaguuugauugagac

SEQ ID NO: 628997 - RNA, 63 nt, hsa
augagguuaggucaugaggacaccaaaaaccuaaaaauaaacaaaaagccaaacaagccuuag

SEQ ID NO: 628998 - RNA, 63 nt, hsa
cuuaucggggcgaaccuuuuaggauuccaugugaaaauaaaauaugaggaaaaguuuaaccua

SEQ ID NO: 628999 - RNA, 63 nt, hsa
uuauacaauaauuuaaauauuuuuuaaaaccauaaaauaaauuuuuauaaggaauacuguuau

SEQ ID NO: 629000 - RNA, 63 nt, hsa
guacuccacaaguauguacaauuaaguauuuuaaaaauaaauggcaaacauuaaaaacaagag

SEQ ID NO: 629001 - RNA, 63 nt, hsa
uuuuucaauugccagcuacugcuuuuauucaucaaaauaaaauaacuuguucugaaguugucu

SEQ ID NO: 629002 - RNA, 63 nt, hsa
auaaaaucuugucuagcacaguuaaagucauuaaaaauaaaaaugacagcuuuagcacaauuu

SEQ ID NO: 629003 - RNA, 63 nt, hsa
gaguuauguuggauaguuuuauuucuguggcugaaaauaaaaucuugucuagcacaguuaaag

SEQ ID NO: 629004 - RNA, 63 nt, hsa
aaccuaaaugaccuaaauaagaacacuguaccuaaaauaaagaggcaacuuuauuaaugccua

SEQ ID NO: 629005 - RNA, 63 nt, hsa
ccuuuugucuuuuaaaauaaucccagaacaccaaaaauaaaaacaaacaauaacauguuuauc

SEQ ID NO: 629006 - RNA, 63 nt, hsa
caauuucccuucauauggauaugauuccagucaaaaauaaaaugcacaccaaaauguauacau

SEQ ID NO: 629007 - RNA, 63 nt, hsa
auguuuugaaaguguuuuauuaagaaucacacaaaaauaaauguauuaaaauuaaauucauuc

SEQ ID NO: 629008 - RNA, 63 nt, hsa
uuauuuuaagcuuguaaaauacacuguggugauaaaauaaaagagcuggguuugacuuuugag

SEQ ID NO: 629009 - RNA, 63 nt, hsa
uaguuuugagguaacugcauucauuaggggcugaaaauaaauguuaaaaauguuuaauuuggu

SEQ ID NO: 629010 - RNA, 63 nt, hsa
gagcaagacucuaucucaaaaauaaaauaaaauaaaauaaaauaauuaauaaaaugguguagu

SEQ ID NO: 629011 - RNA, 63 nt, hsa
caacagagcaagacucuaucucaaaaauaaaauaaaauaaaauaaaauaauuaauaaaauggu

SEQ ID NO: 629012 - RNA, 63 nt, hsa
cugagcaacagagcaagacucuaucucaaaaauaaaauaaaauaaaauaaaauaauuaauaaa

SEQ ID NO: 629013 - RNA, 63 nt, hsa
ccagccugagcaacagagcaagacucuaucucaaaaauaaaauaaaauaaaauaaaauaauua

SEQ ID NO: 629014 - RNA, 63 nt, hsa
auaauuguuggaccuccuugagauaguaacaacaaaauaaagcaagcuaucugcaccucaaaa

SEQ ID NO: 629015 - RNA, 63 nt, hsa
aaugagccacagcaaaaaguaaagaacaacaacaaaauaaagcuguuguuaaauuuuaaacaa

SEQ ID NO: 629016 - RNA, 63 nt, hsa
auucauuucacuuuaaagucuuuccgucucccuaaaauaaaaaccagaaucauaauuuucaag

SEQ ID NO: 629017 - RNA, 63 nt, hsa
uuauguauuauuuucuauagcucuucuauuuaaaaaauaaaaaaauacaguaaaguuuaaaaa

SEQ ID NO: 629018 - RNA, 63 nt, hsa
cauuuguuggcucuauuuuaauuuuuuucuuuuaaaauaaacagcugggaccaucccaaaaga

SEQ ID NO: 629019 - RNA, 63 nt, hsa
auggugcuaaaauucuuccuauaaaauuccuuaaaaauaaagaugguuuaaucacuaccauug

SEQ ID NO: 629020 - RNA, 63 nt, hsa
gcauuguuaggcuguuagaauuuuuugguuguuaaaauaaacgcauucaauaaauaugacuuu

SEQ ID NO: 629021 - RNA, 63 nt, hsa
cuuaauggguaauuuuugagguauguauuuaacaaaauaaacgacacugccgaaaaaaaaaaa

SEQ ID NO: 629022 - RNA, 63 nt, hsa
ugagauugugguuuuuucuuccuaauguaaaauaaaauaaaacacaucugccuucuugauauu

SEQ ID NO: 629023 - RNA, 63 nt, hsa
ugcuuugagauugugguuuuuucuuccuaauguaaaauaaaauaaaacacaucugccuucuug

SEQ ID NO: 629024 - RNA, 63 nt, hsa
cuaaacacaggcuacuuucuguuuacuccuaacaaaauaaagcaagcaaauuugagucaaaua

SEQ ID NO: 629025 - RNA, 63 nt, hsa
guaauauauuagaauauacaaauauguguguauaaaauaaacauacacacacacacacacccc

SEQ ID NO: 629026 - RNA, 63 nt, hsa
uuggauuugcauuuuuguauuuuguacaaaguaaaaauaaacuguuaugaguaguaaaaauaa

SEQ ID NO: 629027 - RNA, 63 nt, hsa
uuguuguuguuuuauauaaugcauguauucacuaaaauaaaauuuaaaaaacuccugucuugc

SEQ ID NO: 629028 - RNA, 63 nt, hsa
uauaauaaauuaacaagauucaccuaaccuuugaaaauaaaguaguauugaagacuuacaugg

SEQ ID NO: 629029 - RNA, 63 nt, hsa
cacauuuuucuacuauuugaccaaaaggaaaagaaaauaaagaagaacucuggaguggucuaa

SEQ ID NO: 629030 - RNA, 63 nt, hsa
gucucguuagaguauuugaugucaugcaccaaaaaaauaaaaccccaccuuguugcaaaagcu

SEQ ID NO: 629031 - RNA, 63 nt, hsa
cauuaucacacaaagagaccaauaaaaauaaaaaaaauaaaaaaaaaaaaagacgaacuauug

SEQ ID NO: 629032 - RNA, 63 nt, hsa
uguguaggucauuaucacacaaagagaccaauaaaaauaaaaaaaauaaaaaaaaaaaaagac

SEQ ID NO: 629033 - RNA, 63 nt, hsa
uucugaugagcacugacaaaggauaugguacuaaaaauaaaaugugaaaugucaaagacaugu

SEQ ID NO: 629034 - RNA, 63 nt, hsa
guaauaaauuuauugugguacaguaauaugcauaaaauaaacccauuuuaaugugcauucuga

SEQ ID NO: 629035 - RNA, 63 nt, hsa
ucaggaaucacuauguauuuccuucuugugauaaaaauaaaauuacgagaaggcaaugugagg

SEQ ID NO: 629036 - RNA, 63 nt, hsa
uuuguucuuguauugcuuucuuucaacaguuucaaaauaaaauaucauauaaauauugaggga

SEQ ID NO: 629037 - RNA, 63 nt, hsa
cauauauuuuaugaaucagaauaaccuucaaauaaaauaaaucuaagucgguuaaaauggauu

SEQ ID NO: 629038 - RNA, 63 nt, hsa
uaaauauauuuuuauagaaaaacaaaucuacauaaaauaaaucuacuguuuagugagcaguau

SEQ ID NO: 629039 - RNA, 63 nt, hsa
gcauaaucaaggcacuguaaaucuuauaauuuuaaaauaaauuacuuaagaacaguugucauu

SEQ ID NO: 629040 - RNA, 63 nt, hsa
auaauucuugcauuuuuuccccauaaccugguuaaaauaaauacgccauuggcaauacuucau

SEQ ID NO: 629041 - RNA, 63 nt, hsa
ugugucugauguuucuucucauguaagaaauaaaaaauaaaaauaaaauaaaauauauuggua

SEQ ID NO: 629042 - RNA, 63 nt, hsa
ugauguuucuucucauguaagaaauaaaaaauaaaaauaaaauaaaauauauugguauguaac

SEQ ID NO: 629043 - RNA, 63 nt, hsa
uuucuucucauguaagaaauaaaaaauaaaaauaaaauaaaauauauugguauguaacuacag

SEQ ID NO: 629044 - RNA, 63 nt, hsa
aaauaaaauauauugguauguaacuacaggaaaaaaauaaaaaauauauaguggacaguaacc

SEQ ID NO: 629045 - RNA, 63 nt, hsa
aaaaaaagauguuauacaaccaucaaaguggcaaaaauaaaaaaaaucaaguauuggcaaaga

SEQ ID NO: 629046 - RNA, 63 nt, hsa
auaaaaaugacaacaaaguaaaaggguaucccaaaaauaaaacuauccuuuuggaaaaaaaaa

SEQ ID NO: 629047 - RNA, 63 nt, hsa
aaucaccaagaaaaacagcuucucaguuaagugaaaauaaaccaguuaaaacagaaccuuuaa

SEQ ID NO: 629048 - RNA, 63 nt, hsa
aaccacaaggcuugagaauagaaauuaaaagcaaaaauaaaguucggccugggucucucuuug

SEQ ID NO: 629049 - RNA, 63 nt, hsa
gccugggcaacaagagcgaaacucuugucugaaaaaauaaaguucaucccaacuuucaagucu

SEQ ID NO: 629050 - RNA, 63 nt, hsa
ggguaacacggggagacccgucuuuaguaaauaaaaauaaauuuauuaauaaaacuaaaaauu

SEQ ID NO: 629051 - RNA, 63 nt, hsa
caggcauagaguucagacuuuuuuuaaauaguaaaaauaaaauuaaagcugaaaacugcaacu

SEQ ID NO: 629052 - RNA, 63 nt, hsa
auguaaauacuguuuuuaacaacuaugauuuggaaaauaaaucaaugcuauaacuauguugau

SEQ ID NO: 629053 - RNA, 63 nt, hsa
auggaucacacgauuucuuuaagggaauuaaaaaaaauaaaagaauuacggcuuuuacagcaa

SEQ ID NO: 629054 - RNA, 63 nt, hsa
ucuggacggacuuauuaaaauacaaacagacaaaaaauaaaacaaaacuugaguucuauuuac

SEQ ID NO: 629055 - RNA, 63 nt, hsa
uuuaaauuacaaccacaguugaauaauaaccuaaaaauaaauuuuaguuugcuaaaaauuuac

SEQ ID NO: 629056 - RNA, 63 nt, hsa
caguuaaucuaaagucuuauuauuucuucuaguaaaauaaaauauuguuagauuaguucucau

SEQ ID NO: 629057 - RNA, 63 nt, hsa
gauaauuacuuauuuguguuuuucaugguuaaaaaaauaaaagaagcacaaugaccaguacau

SEQ ID NO: 629058 - RNA, 63 nt, hsa
uuacuauaguguagcuacuggcuucauuuaauaaaaauaaaugauuuugaaauuaaauauaau

SEQ ID NO: 629059 - RNA, 63 nt, hsa
aacuccuuucauaucaagacaaguuauuuguaaaaaauaaagaagggguuuuaauacaaaccu

SEQ ID NO: 629060 - RNA, 63 nt, hsa
uuggauuaaaauguugacaugauuucacauuugaaaauaaacucaucucuuauuuugaaguua

SEQ ID NO: 629061 - RNA, 63 nt, hsa
uugaaggugagaugauaaacuugcaaaacucacaaaauaaagagucaaacuuuuagaaugaca

SEQ ID NO: 629062 - RNA, 63 nt, hsa
cuggacaacagagcaagacucugucucaaaaaaaaaauaaaaaauaaaaaauaaaaaauaaaa

SEQ ID NO: 629063 - RNA, 63 nt, hsa
acagagcaagacucugucucaaaaaaaaaauaaaaaauaaaaaauaaaaaauaaaagaaacau

SEQ ID NO: 629064 - RNA, 63 nt, hsa
aagacucugucucaaaaaaaaaauaaaaaauaaaaaauaaaaaauaaaagaaacauaagauaa

SEQ ID NO: 629065 - RNA, 63 nt, hsa
ugucucaaaaaaaaaauaaaaaauaaaaaauaaaaaauaaaagaaacauaagauaaguaccuc

SEQ ID NO: 629066 - RNA, 63 nt, hsa
ucugagcaacauggcaaaacccugugucuacaaaaaauaaaaaauuagcugggcaugacggcc

SEQ ID NO: 629067 - RNA, 63 nt, hsa
uuuuuaguucuuaaaaauuuauuuuuaaguucuaaaauaaaauaaaaauaaguucuuaaaauu

SEQ ID NO: 629068 - RNA, 63 nt, hsa
aguucuuaaaaauuuauuuuuaaguucuaaaauaaaauaaaaauaaguucuuaaaauuuauuu

SEQ ID NO: 629069 - RNA, 63 nt, hsa
aacucauccauagauaauucaagauuuguauucaaaauaaacauaguuuucacaguuacaaaa

SEQ ID NO: 629070 - RNA, 63 nt, hsa
uguauucaaaauaaacauaguuuucacaguuacaaaauaaaucaccuauuuuaucuuuuccuu

SEQ ID NO: 629071 - RNA, 63 nt, hsa
uuauuuuuuuuaauuuaaguccuaaauauaguuaaaauaaauaauguuuuaguaaaaugauac

SEQ ID NO: 629072 - RNA, 63 nt, hsa
ccagccaggugacauagcgagauccugucuaaaaaaauaaaaaauaaauaauggaacacagca

SEQ ID NO: 629073 - RNA, 63 nt, hsa
ggugacauagcgagauccugucuaaaaaaauaaaaaauaaauaauggaacacagcaaguccua

SEQ ID NO: 629074 - RNA, 63 nt, hsa
auugcuguaggauccuguucuuucagcaggugaaaaauaaaacgcaguucaaauuucaugguu

SEQ ID NO: 629075 - RNA, 63 nt, hsa
uuauuacugcaguaguugacuuugcuguauggaaaaauaaagugaaauugcccuaauaaaacu

SEQ ID NO: 629076 - RNA, 63 nt, hsa
auagguaaucaaugaauauugaaguuucagcuuaaaauaaacaguugugaaccaagaucuaua

SEQ ID NO: 629077 - RNA, 63 nt, hsa
gaaauuuuuaucaguuuccagucucaaaaauacaaaauaaaaacaaacguuuuuaauacuauu

SEQ ID NO: 629078 - RNA, 63 nt, hsa
aagccccauggaucaauacauaaacuaugcauaaaaauaaaauuucauauuuucgcucguaaa

SEQ ID NO: 629079 - RNA, 63 nt, hsa
guaagccucucuuacuccuguuaugcacuuuuuaaaauaaauacugaauuccagaaagaauuu

SEQ ID NO: 629080 - RNA, 63 nt, hsa
uaccucucugugccucaguuuucccaugcaugaaaaauaaaauaaaauaaaacggggauucua

SEQ ID NO: 629081 - RNA, 63 nt, hsa
cucugugccucaguuuucccaugcaugaaaaauaaaauaaaauaaaacggggauucuaauguu

SEQ ID NO: 629082 - RNA, 63 nt, hsa
ugccucaguuuucccaugcaugaaaaauaaaauaaaauaaaacggggauucuaauguuuguaa

SEQ ID NO: 629083 - RNA, 63 nt, hsa
uaacuauauauauugccaucacacacgaacaauaaaauaaaguguucuauuaaccugaucucu

SEQ ID NO: 629084 - RNA, 63 nt, hsa
accaaacaggaaagaacuaugucugaaauauaaaaaauaaaaauaaaaaaacaacuaugaaua

SEQ ID NO: 629085 - RNA, 63 nt, hsa
caggaaagaacuaugucugaaauauaaaaaauaaaaauaaaaaaacaacuaugaauaugcaca

SEQ ID NO: 629086 - RNA, 63 nt, hsa
cauuuugccugacaauugcaaaucagagcauacaaaauaaaacugugcaguuuuguuugguuu

SEQ ID NO: 629087 - RNA, 63 nt, hsa
ccugggcaacauagugagaccuugucucuacaaaaaauaaaauaaaauaaaaaccaaauuagc

SEQ ID NO: 629088 - RNA, 63 nt, hsa
gcaacauagugagaccuugucucuacaaaaaauaaaauaaaauaaaaaccaaauuagccagac

SEQ ID NO: 629089 - RNA, 63 nt, hsa
auagugagaccuugucucuacaaaaaauaaaauaaaauaaaaaccaaauuagccagacauggu

SEQ ID NO: 629090 - RNA, 63 nt, hsa
aauguacuaaaaaccaaugaacuuuaaaaaauaaaaauaaacaaaaaaaauucaacagaugaa

SEQ ID NO: 629091 - RNA, 63 nt, hsa
uuugagaauguacuaaaaaccaaugaacuuuaaaaaauaaaaauaaacaaaaaaaauucaaca

SEQ ID NO: 629092 - RNA, 63 nt, hsa
auaaauaacucuuauaacacaacaauaaggagaaaaauaaaucaauuuaaaaaaugggcuaac

SEQ ID NO: 629093 - RNA, 63 nt, hsa
caaaauuacucuacuguuaaaauugugcaaaauaaaauaaacauuuaaaaugacauuuuacag

SEQ ID NO: 629094 - RNA, 63 nt, hsa
cacagcaaaauuacucuacuguuaaaauugugcaaaauaaaauaaacauuuaaaaugacauuu

SEQ ID NO: 629095 - RNA, 63 nt, hsa
cucuuaaaauaaaauccauuuccuauuucucuuaaaauaaaauccauuauucuuaauauggcc

SEQ ID NO: 629096 - RNA, 63 nt, hsa
gauuaugcuuaacagcuguuuccuguuucucuuaaaauaaaauccauuuccuauuucucuuaa

SEQ ID NO: 629097 - RNA, 63 nt, hsa
gcugcugaguuaugcacagacuuuuuguugaccaaaauaaaauauaaaggguuuucuucuguu

SEQ ID NO: 629098 - RNA, 63 nt, hsa
acaauguuuguacuuaugcauuccccauggguaaaaauaaauaauagcauuguuaaagauagu

SEQ ID NO: 629099 - RNA, 63 nt, hsa
uuuauccaauuuuuacugaacuuuuuauguaaaaaaauaaaaucaauuaaagaacuuggcaug

SEQ ID NO: 629100 - RNA, 63 nt, hsa
ggucaagagagagagacccagacaagcaaacucaaaauaaagagaaaaggaaacgaagaagcu

SEQ ID NO: 629101 - RNA, 63 nt, hsa
cagccgccauccuucuccagaauucuuguaaauaaaauaaaucccucuuuguuuaaaccauug

SEQ ID NO: 629102 - RNA, 63 nt, hsa
aggugaggguuacacugaagaugcacaaucccuaaaauaaagaucaccacuuccccaaagaag

SEQ ID NO: 629103 - RNA, 63 nt, hsa
ucuuauucuucauguaaucccaccuucuaacaaaaaauaaauaaauauuuaaauuccaaggag

SEQ ID NO: 629104 - RNA, 63 nt, hsa
augaagacauuuaacgguugugcuguuuauaguaaaauaaaacucccuaccuugcuucaguua

SEQ ID NO: 629105 - RNA, 63 nt, hsa
guauauuaggauuuaaauuuaugccacaauuuaaaaauaaaaccagagguuauauacaauuua

SEQ ID NO: 629106 - RNA, 63 nt, hsa
gauuuaauuccuuuuuagaaagaaauuuagggcaaaauaaaguguauauuaggauuuaaauuu

SEQ ID NO: 629107 - RNA, 63 nt, hsa
cuaguacugugccgcuucccccuccccccacacaaaauaaaaacaguaucugccuucuggcuc

SEQ ID NO: 629108 - RNA, 63 nt, hsa
aaucaguguaacuaggggcuguguuucugcauuaaaauaaauguuucaggcuuugugguccug

SEQ ID NO: 629109 - RNA, 63 nt, hsa
uaaguaugcuuuauuuuaccucuguuaaaaauuaaaauaaaugauucuauucauauuugucag

SEQ ID NO: 629110 - RNA, 63 nt, hsa
aacuaaggcauuaaagaaaauagcaaauauuaaaaaauaaaacuguuacuuuuuuccuucuuu

SEQ ID NO: 629111 - RNA, 63 nt, hsa
acccugucucaaaaaauauauauuuaaaaaauaaaaauaaaagcugaccccaaagacaaauaa

SEQ ID NO: 629112 - RNA, 63 nt, hsa
agagagacccugucucaaaaaauauauauuuaaaaaauaaaaauaaaagcugaccccaaagac

SEQ ID NO: 629113 - RNA, 63 nt, hsa
ugaauguguuugaacauguuuugagauuuuuuuaaaauaaauuauuauuugacaacaauccaa

SEQ ID NO: 629114 - RNA, 63 nt, hsa
accgagugagacuguuucuaaaaauaaaaacaaaaaauaaauuucuucuugagguggggugga

SEQ ID NO: 629115 - RNA, 63 nt, hsa
uccagccugggugaccgagugagacuguuucuaaaaauaaaaacaaaaaauaaauuucuucuu

SEQ ID NO: 629116 - RNA, 63 nt, hsa
ucuuuagugucaguuaaauuaugaacuaacuugaaaauaaaaguuguuugacugaaagugauu

SEQ ID NO: 629117 - RNA, 63 nt, hsa
uuauuuuauccaaguaccccagugaauaggggaaaaauaaacacagugaaaaaaaaaaucaaa

SEQ ID NO: 629118 - RNA, 63 nt, hsa
uuuuauuauuuucaucuuuauugaucaaauuugaaaauaaaauucacaauguaauacuacuac

SEQ ID NO: 629119 - RNA, 63 nt, hsa
aaaaauaauaauaauaauaauaaaguaaaaauaaaaauaaaaaaguaaucagaagcuaaagua

SEQ ID NO: 629120 - RNA, 63 nt, hsa
caucucaaaaauaauaauaauaauaauaaaguaaaaauaaaaauaaaaaaguaaucagaagcu

SEQ ID NO: 629121 - RNA, 63 nt, hsa
agcccucauauaauagguuugaaaguacuccuuaaaauaaaacacuguuucccuuuggaacua

SEQ ID NO: 629122 - RNA, 63 nt, hsa
agugagacccugucacuaacaaaauuaaaaaauaaaauaaauauaaaauauaggcuuuaaaaa

SEQ ID NO: 629123 - RNA, 63 nt, hsa
aauaaagugagacccugucacuaacaaaauuaaaaaauaaaauaaauauaaaauauaggcuuu

SEQ ID NO: 629124 - RNA, 63 nt, hsa
uauguuauguauauuuuaccacaauaaaugcaaaaaauaaaaagucuguguucuaaacaauuc

SEQ ID NO: 629125 - RNA, 63 nt, hsa
uguuauauuucaauaagaagcuuaaaauguuuaaaaauaaaugguuaaaagguuuuauguuau

SEQ ID NO: 629126 - RNA, 63 nt, hsa
gcacaaagauuagcacacuuaaaagcaaaggaaaaaauaaaucagaacuccauaaauauuaaa

SEQ ID NO: 629127 - RNA, 63 nt, hsa
cauuuccuuccaguaaauccacccaaggagaggaaaauaaaaugacaacgcaagaccuagugg

SEQ ID NO: 629128 - RNA, 63 nt, hsa
ccacuugcagguuuauggaaacagcaguauuugaaaauaaauaaaaagugggagaauuccuug

SEQ ID NO: 629129 - RNA, 63 nt, hsa
uacacugggcagacuucagagcaguuuuuuaaaaaaauaaauauucuaauguagcuaucucgc

SEQ ID NO: 629130 - RNA, 63 nt, hsa
uguuuguuaguaugaaaaguuaacuuuuuuuccaaaauaaaagagugaauuuuucauguuaag

SEQ ID NO: 629131 - RNA, 63 nt, hsa
uuaaguuaaaaaucuuugucuuguacuauuucaaaaauaaaaagacagcaaugacuuuauauc

SEQ ID NO: 629132 - RNA, 63 nt, hsa
cugauguucuucacuaaauggauggccacaagaaaaauaaaguaaaugucuuaaauaauuuaa

SEQ ID NO: 629133 - RNA, 63 nt, hsa
guauggauacauccauucacugugguacauuuuaaaauaaaauauuuuagcagugaauaugga

SEQ ID NO: 629134 - RNA, 63 nt, hsa
gaauucaccacagcuggaauagcuguggaaaacaaaauaaaacaacaaaauuaauaaugaaau

SEQ ID NO: 629135 - RNA, 63 nt, hsa
ugccuuuuauuccuuuaaaauuucgccuggcaaaaaauaaauaaauggaacuaucacuuuaua

SEQ ID NO: 629136 - RNA, 63 nt, hsa
guaaugcaaacaaauuauuuuuuacaaaaaaacaaaauaaauaaaauuagacuuccuucccuc

SEQ ID NO: 629137 - RNA, 63 nt, hsa
gaaauauugaaaauauugaaaauauuauuauugaaaauaaaaucuugaucucaacuauccccc

SEQ ID NO: 629138 - RNA, 63 nt, hsa
auuugguuaguaccuucacugagcaauaguggaaaaauaaaaaaauaaguaaacagaaaaaac

SEQ ID NO: 629139 - RNA, 63 nt, hsa
cccauauuaugaagaaauacucugcaacucuuaaaaauaaauguaaugugccaggcgcaaugg

SEQ ID NO: 629140 - RNA, 63 nt, hsa
auagugagacuuggucucuaaaaaagaaaaaaaaaaauaaaacugauguaaugaauauauaau

SEQ ID NO: 629141 - RNA, 63 nt, hsa
cuacaaugaacauguuuuauuuuuacuuuuguuaaaauaaauaacauuuaauuugacggaaaa

SEQ ID NO: 629142 - RNA, 63 nt, hsa
aaagaaacaagagagaaaaaaaucaaaauaauuaaaauaaauuguuagagaaaaguuacuuua

SEQ ID NO: 629143 - RNA, 63 nt, hsa
ugucaacugaagaucugacuguacuaaauaugaaaaauaaagcagcacauacuuucucuacug

SEQ ID NO: 629144 - RNA, 63 nt, hsa
ccuuaaccuccagcagacuccugcucucuauccaaaauaaagaucacagagcagcaaguucau

SEQ ID NO: 629145 - RNA, 63 nt, hsa
guucuccucuaucuuagagggguauucuucuugaaaauaaaaaauauugaaaugcuguauuuu

SEQ ID NO: 629146 - RNA, 63 nt, hsa
uauauuuuagaaauuuguuaaugagaguaaaagaaaauaaauguguauagcucaguuuggaua

SEQ ID NO: 629147 - RNA, 63 nt, hsa
uguuuaaauguccauuuuuauucuuuauguuugaaaauaaauuauggggauccuauuuagcuc

SEQ ID NO: 629148 - RNA, 63 nt, hsa
augacuuuagugacauuauaaaacugaaacuggaaaauaaaauggcuuaucugcugauguuua

SEQ ID NO: 629149 - RNA, 63 nt, hsa
aauaaaauggcuuaucugcugauguuuaucuuuaaaauaaauaaaaucuugcuagugugaaua

SEQ ID NO: 629150 - RNA, 63 nt, hsa
uuaaauggaugcauacaguccacaucauacaauaaaauaaaagguaauucagggucccaaaga

SEQ ID NO: 629151 - RNA, 63 nt, hsa
agaauaacuauaaaauaugaaagcucuaaauuuaaaauaaauuuagagauagaaucaugguac

SEQ ID NO: 629152 - RNA, 63 nt, hsa
uuuauggucacaaguuaucccuccucaguaugaaaaauaaauuagauauugaaaaaugucuaa

SEQ ID NO: 629153 - RNA, 63 nt, hsa
uguagaauuuauuuuaacuaugaccuuuaauugaaaauaaauaauuaaaauaucagacauguu

SEQ ID NO: 629154 - RNA, 63 nt, hsa
uauauauuuaugauaaaucuuuuccauuuguacaaaauaaaauuccauuucauugugaccuac

SEQ ID NO: 629155 - RNA, 63 nt, hsa
cuauauuuauguaacuguauacugaauucugacaaaauaaaaaaagauaccuuauugacgaaa

SEQ ID NO: 629156 - RNA, 57 nt, hsa; identical to SEQ ID NO: 62053

SEQ ID NO: 629157 - RNA, 63 nt, hsa
ucaucucuagggauguuuaacauuuauaauugcaaaauaaaccaacuauaaaaaaagaaacua

SEQ ID NO: 629158 - RNA, 63 nt, hsa
cuuaauucuggguugcuuguuuuuuaggugacaaaaauaaaauauuguauuuuaauucauggg

SEQ ID NO: 629159 - RNA, 63 nt, hsa
accuuuccucugccugaaagacgugucucaagaaaaauaaauucuauuuuagaugcagguacu

SEQ ID NO: 629160 - RNA, 63 nt, hsa
aaaucaggagauggcugauucauaauggguaauaaaauaaauagcacuuucgagcugaugucg

SEQ ID NO: 629161 - RNA, 63 nt, hsa
acauucuaguaacuggccacuggaaaauaaauaaaaauaaaaacuaggguuuuaaaaguaucu

SEQ ID NO: 629162 - RNA, 63 nt, hsa
aaaaauaaaaacauucuaguaacuggccacuggaaaauaaauaaaaauaaaaacuaggguuuu

SEQ ID NO: 629163 - RNA, 63 nt, hsa
ucaaaccacagagaaaauauuuauaacaugcaaaaaauaaaaacauucuaguaacuggccacu

SEQ ID NO: 629164 - RNA, 63 nt, hsa
uuugaaagugagcauucauuuaaggauaaauaaaaaauaaaguaguaauaaagaauaaaauac

SEQ ID NO: 629165 - RNA, 63 nt, hsa
uucuuuauguuuuaugaaaguguugcagucccuaaaauaaaaauauugaggaacauugcuugu

SEQ ID NO: 629166 - RNA, 63 nt, hsa
acacauuaaccagaaagcuuaaacauuauuauuaaaauaaauuauuucauuugcacacaauga

SEQ ID NO: 629167 - RNA, 63 nt, hsa
aauguuuuuaaauauaaacaaauauucuuuacuaaaauaaaaacucuguguaauuuuuccauu

SEQ ID NO: 629168 - RNA, 63 nt, hsa
uuauuugucuucuuuuugcauugugaaaaaaacaaaauaaauuuugugugauaauuuugauga

SEQ ID NO: 629169 - RNA, 63 nt, hsa
aacaaaacagauaugcuuacucuaguuaaaaagaaaauaaaucucaugucagacccagaaagg

SEQ ID NO: 629170 - RNA, 63 nt, hsa
cucccaaauauguucaauucuuaugucgcucaaaaaauaaaauuuaauuuaaaaaguaucuga

SEQ ID NO: 629171 - RNA, 63 nt, hsa
uggaagcuaaaaaaauugauaucauagaaguaaaaaauaaaacagaggauacuacaggcuggg

SEQ ID NO: 629172 - RNA, 63 nt, hsa
agccugggugacagagugagacugucucaaaauaaaauaaaaauaacauauuggugaagaugc

SEQ ID NO: 629173 - RNA, 63 nt, hsa
acuccagccugggugacagagugagacugucucaaaauaaaauaaaaauaacauauuggugaa

SEQ ID NO: 629174 - RNA, 63 nt, hsa
aaauguaaaagucaccaaaaacuuaaaggcauuaaaauaaacuaaaaaaguacucauuucuuc

SEQ ID NO: 629175 - RNA, 63 nt, hsa
aauugaccuuaauuuguuuuccagaaucaaaagaaaauaaaauauaaauuuugaaacuaugag

SEQ ID NO: 629176 - RNA, 63 nt, hsa
gucucaaaaaaaaaaaaaaaaaaaggagagaagaaaauaaagaaggcuaauauauaauuuuuc

SEQ ID NO: 629177 - RNA, 63 nt, hsa
uugugcuuuaaaaaaauaaccucuuguaguuauaaaauaaaacguuugacuucuaaacucugu

SEQ ID NO: 629178 - RNA, 63 nt, hsa
gauuuuuuuaaaagucacaaaaacaauucacuaaaaauaaauaugucauugugcuuuaaaaaa

SEQ ID NO: 629179 - RNA, 63 nt, hsa
uucauauauaaaaguauauuuauugacuguaauaaaauaaaauaugauguaaacaaaaaaaau

SEQ ID NO: 629180 - RNA, 63 nt, hsa
auuuauucuauuaaauuguaagcuugcaaacucaaaauaaauuggcagauuuaccucucaugu

SEQ ID NO: 629181 - RNA, 63 nt, hsa
guuuugucgacaguaucuuuuaaaugagucuuaaaaauaaaggcauauuguucauguuuuucu

SEQ ID NO: 629182 - RNA, 63 nt, hsa
aacuucuagcuaaaauuguaucauugguccuaaaaaauaaaaaucuuuacuaauaggcaauug

SEQ ID NO: 629183 - RNA, 63 nt, hsa
aauguugaaaccaacugaacugccaacaaaauaaaaauaaaaagucuucacuauguagcauac

SEQ ID NO: 629184 - RNA, 63 nt, hsa
ucaauaaauguugaaaccaacugaacugccaacaaaauaaaaauaaaaagucuucacuaugua

SEQ ID NO: 629185 - RNA, 63 nt, hsa
uaauuuucugaaagauaauucuaagugaaauuuaaaauaaauaaauuuuuaaugaccuggguc

SEQ ID NO: 629186 - RNA, 63 nt, hsa
caaaaagaaaauacauaugcagucuagucagacaaaauaaaguuuugaagugcuacuauaaua

SEQ ID NO: 629187 - RNA, 63 nt, hsa
ugguggaauauauggagagaucuugaaagagguaaaauaaaccuucacugcuccacuccaggu

SEQ ID NO: 629188 - RNA, 63 nt, hsa
agaaaguaauaaauucuguaugaauaagcauaaaaaauaaauaaauaugcaauaacauuaaau

SEQ ID NO: 629189 - RNA, 63 nt, hsa
uguguucuaaagucuuuuuguaaaauaaacacaaaaauaaauuuauguugaauuggcacuuuc

SEQ ID NO: 629190 - RNA, 63 nt, hsa
uaguguuccucauguguucuaaagucuuuuuguaaaauaaacacaaaaauaaauuuauguuga

SEQ ID NO: 629191 - RNA, 63 nt, hsa
aaacaauaaagaagauucagacacugagggaaaaaaauaaagcuuuuuacuuaaauaaugcau

SEQ ID NO: 629192 - RNA, 63 nt, hsa
gacguaacuuagcauggaucaccaaucaaucaaaaaauaaauaaaucacuaaggauuggagaa

SEQ ID NO: 629193 - RNA, 63 nt, hsa
aaaacaaaauuuccaaaaacaaugaaggaaaccaaaauaaauauuucugcauuucaggugagu

SEQ ID NO: 629194 - RNA, 63 nt, hsa
aucauguugggauuaacuugccuuuuuccccaaaaaauaaacucucaggcaagcauuucuuua

SEQ ID NO: 629195 - RNA, 63 nt, hsa
uuugaaugcucaaacuaugggaaaucuuugguaaaaauaaagacaauaaaaucuucacaauaa

SEQ ID NO: 629196 - RNA, 63 nt, hsa
cucggugacaagagcgagacuccaucucaaaaaaaaauaaaaagaaucuuaaaauaggaacau

SEQ ID NO: 629197 - RNA, 63 nt, hsa
cauuucuaaugaggauucacauuaauauaauauaaaauaaauaggucaguuacuggucucuuu

SEQ ID NO: 629198 - RNA, 63 nt, hsa
uccgaauguuauguuuugcuuuuaucucacaguaaaauaaauauaauuaaugguuugcaugug

SEQ ID NO: 629199 - RNA, 63 nt, hsa
cugaagggaaagggcucuuuuccugcuguuucaaaaauaaaagaacacauuagauguuacugu

SEQ ID NO: 629200 - RNA, 63 nt, hsa
uagcuaaucucgguagaugucauuacaaccuggaaaauaaaucacccuaagugacacaaauug

SEQ ID NO: 629201 - RNA, 63 nt, hsa
auuugaagugauauauuugguuaaacauuucuaaaaauaaacuaccaauacuaaauaguaaga

SEQ ID NO: 629202 - RNA, 63 nt, hsa
uaaaaccacuaauuguuccguuaagcuucacagaaaauaaaaccucuauuacuagacauuuau

SEQ ID NO: 629203 - RNA, 63 nt, hsa
gagauugcaccacugcacuccagcuugggugauaaaauaaaauaaaauagucgugaaucuugu

SEQ ID NO: 629204 - RNA, 63 nt, hsa
ugcaccacugcacuccagcuugggugauaaaauaaaauaaaauagucgugaaucuuguucaaa

SEQ ID NO: 629205 - RNA, 63 nt, hsa
gaugcacaacaaaagaaacaucagaaguuuauaaaaauaaaucugacuauaugcauccucauu

SEQ ID NO: 629206 - RNA, 63 nt, hsa
ugucuucgagauguagaaauaaggaauauucugaaaauaaaaauuauacaguaguaaagauaa

SEQ ID NO: 629207 - RNA, 63 nt, hsa
accaucuuuauuauggucauauuucacagcaccaaaauaaaucaucuuuauuaaguagaugaa

SEQ ID NO: 629208 - RNA, 63 nt, hsa
agggauucacugacuagauuuuacugaacuaugaaaauaaauacacauaauuuuucacaaaau

SEQ ID NO: 629209 - RNA, 63 nt, hsa
cuccagccugggcgacagagugagacuaucucaaaaauaaauaaauaaauaaauaaauaguau

SEQ ID NO: 629210 - RNA, 63 nt, hsa
uucauucuuuaaauauuauugacuuacaguuuaaaaauaaauaaauaaaagcauacuauaguu

SEQ ID NO: 629211 - RNA, 63 nt, hsa
ugaauauuugcucauguuuucuaaauuccuuauaaaauaaaauuaauucgaauucaaucugca

SEQ ID NO: 629212 - RNA, 63 nt, hsa
uucuauuuucccuguauugguaucuccuuaaauaaaauaaaauauuccuauuguaagugauau

SEQ ID NO: 629213 - RNA, 63 nt, hsa
gugauaugagaaaucuuuaaccagccuuaucuaaaaauaaaaagagaagccauuguaagacau

SEQ ID NO: 629214 - RNA, 63 nt, hsa
cuccagccugggcaauaagagcaaaacuccaucaaaauaaaauaaaauaaaauauaaaauaac

SEQ ID NO: 629215 - RNA, 63 nt, hsa
gccugggcaauaagagcaaaacuccaucaaaauaaaauaaaauaaaauauaaaauaacuuaaa

SEQ ID NO: 629216 - RNA, 63 nt, hsa
ggcaauaagagcaaaacuccaucaaaauaaaauaaaauaaaauauaaaauaacuuaaaaagaa

SEQ ID NO: 629217 - RNA, 63 nt, hsa
uauguaacuuaaaucuagacaccaucaaagcauaaaauaaaaauaaaaagcguugcugaaucu

SEQ ID NO: 629218 - RNA, 63 nt, hsa
acuuaaaucuagacaccaucaaagcauaaaauaaaaauaaaaagcguugcugaaucugggucg

SEQ ID NO: 629219 - RNA, 63 nt, hsa
guuuuuggauugucaaagaggaugcuuagucuuaaaauaaaaauaaauuuaaaaaucaucuua

SEQ ID NO: 629220 - RNA, 63 nt, hsa
ggauugucaaagaggaugcuuagucuuaaaauaaaaauaaauuuaaaaaucaucuuauaauua

SEQ ID NO: 629221 - RNA, 63 nt, hsa
ugucuagauuauauagguuuagguugaaguuauaaaauaaaauaaaauucauuuuccacugga

SEQ ID NO: 629222 - RNA, 63 nt, hsa
agauuauauagguuuagguugaaguuauaaaauaaaauaaaauucauuuuccacuggaacucu

SEQ ID NO: 629223 - RNA, 63 nt, hsa
uccaccaauaucauguguagauauuauguauagaaaauaaaauaaauuauggcucuaacuucu

SEQ ID NO: 629224 - RNA, 63 nt, hsa
caauaucauguguagauauuauguauagaaaauaaaauaaauuauggcucuaacuucuguguu

SEQ ID NO: 629225 - RNA, 63 nt, hsa
auuaucccucaaaaaguuaccaccacaucagaaaaaauaaaaaaaaaauaguaaaguaggcag

SEQ ID NO: 629226 - RNA, 63 nt, hsa
uacagaguaauuacauggugauuuuugcaauguaaaauaaaguguuucugauuauuuucuaug

SEQ ID NO: 629227 - RNA, 63 nt, hsa
auacuucuccauacacagaccucugcagaaugcaaaauaaaacuugcagugaaugaauuuagc

SEQ ID NO: 629228 - RNA, 63 nt, hsa
gccaauuagcuucuacuaaccacgguucaacagaaaauaaauguguauuugugaauaacaaac

SEQ ID NO: 629229 - RNA, 63 nt, hsa
cccaucucugucaccuagccaggagggguagcaaaaauaaagucacgaggacauaguggucac

SEQ ID NO: 629230 - RNA, 63 nt, hsa
uaggugccuaguaaauguuaacuguucuuggaaaaaauaaaaacaucaguaacaaaagaaauu

SEQ ID NO: 629231 - RNA, 63 nt, hsa
ccaguuuucuuuaugaugauacaguguuaaaagaaaauaaauuacaauugaucugucauccau

SEQ ID NO: 629232 - RNA, 63 nt, hsa
gaccaccaguaaauaauccuccuucaaaaaauaaaaauaaaagaaaaaggaaaaucauucagg

SEQ ID NO: 629233 - RNA, 63 nt, hsa
cuuuuagaccaccaguaaauaauccuccuucaaaaaauaaaaauaaaagaaaaaggaaaauca

SEQ ID NO: 629234 - RNA, 63 nt, hsa
uguuuguucagucugaauuaaaauuagacuuugaaaauaaagcuuaaauaguuguuuccucua

SEQ ID NO: 629235 - RNA, 63 nt, hsa
augcaacuuuaauuuuguuuaacacuaucugccaaaauaaacuuuauucccuauaacuuaaaa

SEQ ID NO: 629236 - RNA, 63 nt, hsa
ccccacagagugccuagaaucuuaauaaugaauaaaauaaaaagcagcaauaugucauuaaca

SEQ ID NO: 629237 - RNA, 63 nt, hsa
uaaagaucagaugguaaucuuucaaauaagaaaaaaauaaagacguauguuugaccaaguagu

SEQ ID NO: 629238 - RNA, 63 nt, hsa
gacaaguuuauaucaaguuaaauguaaauggauaaaauaaaaucauuuucaguaugugauaua

SEQ ID NO: 629239 - RNA, 63 nt, hsa
gacccauuuugauaagucuuuauaaggaagaauaaaauaaacguguaagcaaaauuuucuuuu

SEQ ID NO: 629240 - RNA, 63 nt, hsa
uuuguuacuuuuguccccccagauuugggggacaaaauaaaauuaaucuuuuaaaauguguca

SEQ ID NO: 629241 - RNA, 63 nt, hsa
cagcaaaaugccugcaccaugacuguggcuuuuaaaauaaagaaauguguuuuuaucguaauu

SEQ ID NO: 629242 - RNA, 63 nt, hsa
aacuuggggcaauugaugcuaaaugguauuuuuaaaauaaauguuuuuauucuuuacucuuga

SEQ ID NO: 629243 - RNA, 63 nt, hsa
aaaaaaauauacaugcuuacucaggcuuucuuaaaaauaaauuuuuauagagauccuugagua

SEQ ID NO: 629244 - RNA, 63 nt, hsa
uuacagcaucaucacauuaccuguuugauguaaaaaauaaaaaauagaaagguguaaguauau

SEQ ID NO: 629245 - RNA, 63 nt, hsa
aaaauuauuucuaggguuuaaguaacuacaaguaaaauaaauuuauuucuuaaaaauaagugu

SEQ ID NO: 629246 - RNA, 63 nt, hsa
aauuguuuuacccucaagcugggaauauuuuucaaaauaaauacuauaauauagauaucaaau

SEQ ID NO: 629247 - RNA, 63 nt, hsa
cuaaucaacuacccuuucuuuuaucaaguaauuaaaauaaaucuacauaaagaaccaaaaagg

SEQ ID NO: 629248 - RNA, 63 nt, hsa
uauuaucgaggaguuuuaaaguacuguaacuuuaaaauaaauaacuacaaagcuucuuugucc

SEQ ID NO: 629249 - RNA, 63 nt, hsa
uucuguuugcagauaugauugauguauuucaccaaaauaaaauauuuuuauguuuauaaagug

SEQ ID NO: 629250 - RNA, 63 nt, hsa
ugagcaugcauggauauacccaauaguacacacaaaauaaauguuuacuuaagagccauucua

SEQ ID NO: 629251 - RNA, 63 nt, hsa
gaagaggucccaaauuuggaguaaagaugggagaaaauaaauaugugcuauuuccuuggcgag

SEQ ID NO: 629252 - RNA, 63 nt, hsa
cuuuugcugucuuucucuaaauaugauuacuuuaaaauaaaaaaguaacaaggugucuuuucc

SEQ ID NO: 629253 - RNA, 63 nt, hsa
ugccguauaggaugucagacaauaccacugguuaaaauaaagccuauuuuucaaauuuaguga

SEQ ID NO: 629254 - RNA, 63 nt, hsa
uuaauaguaugaucuuuaaaguuuugacaauauaaaauaaacuugguaacuguuuuacaaaua

SEQ ID NO: 629255 - RNA, 63 nt, hsa
uguuggucauaaguuaacuguauuaagaacaguaaaauaaauaaaaaccaauaguacuaauuu

SEQ ID NO: 629256 - RNA, 63 nt, hsa
ccaaagaauuugcuuuauguuuuuagcuauuuaaaaauaaauccaucaaaaauaaaguaugca

SEQ ID NO: 629257 - RNA, 63 nt, hsa
uauguuuuuagcuauuuaaaaauaaauccaucaaaaauaaaguaugcaaauguaucuuuuaaa

SEQ ID NO: 629258 - RNA, 63 nt, hsa
ucauguugugacaaauugaucacuuguguacgaaaaauaaaucuccuuaaaaacuaaauaaaa

SEQ ID NO: 629259 - RNA, 63 nt, hsa
auuaauacaguaguaguaaucauuuucuaggggaaaauaaaagaauaaaucacuauacugaua

SEQ ID NO: 629260 - RNA, 63 nt, hsa
aaaguguaggugaaaaaacuuguaacuguauugaaaauaaauaccauuaaacugugaucaguu

SEQ ID NO: 629261 - RNA, 63 nt, hsa
uuuguuuugguacauuugguugugcuuguggggaaaauaaaaacgcagagauccuuauauauu

SEQ ID NO: 629262 - RNA, 63 nt, hsa
uccagccugggugacaaagcaagacugugucucaaaauaaauaaauaaaauaaaauaaaauga

SEQ ID NO: 629263 - RNA, 63 nt, hsa
acaaagcaagacugugucucaaaauaaauaaauaaaauaaaauaaaaugacguacagagauuc

SEQ ID NO: 629264 - RNA, 63 nt, hsa
gcaagacugugucucaaaauaaauaaauaaaauaaaauaaaaugacguacagagauucuauau

SEQ ID NO: 629265 - RNA, 63 nt, hsa
guuuuaugcuauuccuguguucuccaaaacaagaaaauaaaaagacaugacuuauucucuguu

SEQ ID NO: 629266 - RNA, 63 nt, hsa
uguaugcuuuaaauagagaauuuauuucuuuuaaaaauaaagcuaucuuuccuuauccauguu

SEQ ID NO: 629267 - RNA, 63 nt, hsa
uucuuggauuucacccaacuaaaaggauuuuuaaaaauaaauaacagucuuaccuaaauuauu

SEQ ID NO: 629268 - RNA, 63 nt, hsa
ugagauaugacgguguacuuacugccuuguagcaaaauaaagaugugcccuuauuuuaccuac

SEQ ID NO: 629269 - RNA, 63 nt, hsa
auaaguuuacacacugugcaaucucacaaucugaaaauaaaguugaguuggcuguguuuucuc

SEQ ID NO: 629270 - RNA, 63 nt, hsa
aaauauauauggaacugaaacauuaacuuagcuaaaauaaaagcaaucuguguuugagaugaa

SEQ ID NO: 629271 - RNA, 63 nt, hsa
auuaaaaaaauaguuaugaaaucuuagccacaaaaaauaaaucagguaaacauuuuaaccugu

SEQ ID NO: 629272 - RNA, 63 nt, hsa
gaagauuuuuuugaagauuaauuuauacccuauaaaauaaaacuuguuagcuucgaugaaguc

SEQ ID NO: 629273 - RNA, 63 nt, hsa
gucaguuuagcauuacauugucuugagcaccagaaaauaaaauccauauauuaauaaaaaccu

SEQ ID NO: 629274 - RNA, 63 nt, hsa
augcuauaaguauguacauacaguuucacuucaaaaauaaaaaaaaaaucccuaaaaacucuc

SEQ ID NO: 629275 - RNA, 63 nt, hsa
uaguuguggccaccugcugacuauuugugguuuaaaauaaaagguuuacuugucugcagaaua

SEQ ID NO: 629276 - RNA, 63 nt, hsa
caugcuuuuuggaaauuuacaucauccucaaguaaaauaaauaucaguuaaauauuggaagcu

SEQ ID NO: 629277 - RNA, 63 nt, hsa
gagaaucaauugcugaaaguguuaaaauuucugaaaauaaaugcuuaauuacauauacaggaa

SEQ ID NO: 629278 - RNA, 63 nt, hsa
cugcaguuaaaucauauaauguuuguaugauuaaaaauaaauuucucagaauugugauuuuag

SEQ ID NO: 629279 - RNA, 63 nt, hsa
aaauguguauuuagaauauuuguauaacuguguaaaauaaaaaaggaauuauguggucagugc

SEQ ID NO: 629280 - RNA, 63 nt, hsa
guuacaaaccugugggccuguugcaauacuuuaaaaauaaaaaauuuuauuccauuugcuugu

SEQ ID NO: 629281 - RNA, 63 nt, hsa
aagugucacuaccguauuucuuguuuucaucaaaaaauaaaaauaauuuaaaaaauucugugu

SEQ ID NO: 629282 - RNA, 63 nt, hsa
aguacuuuugucuucucccaugugcuugaaggaaaaauaaagugucacuaccguauuucuugu

SEQ ID NO: 629283 - RNA, 63 nt, hsa
uuuggauuaaauuaguuugugaaggauuauggaaaaauaaaacugucacuguuggacgucagc

SEQ ID NO: 629284 - RNA, 63 nt, hsa
auauucucuauuugaauuauuucugucacaguaaaaauaaaauacuuugaguuuugagcuacu

SEQ ID NO: 629285 - RNA, 63 nt, hsa
aucauguuaaccucugcuuuuaucucagauguuaaaauaaaugguuuggugcuuuuuauaaaa

SEQ ID NO: 629286 - RNA, 63 nt, hsa
aaaaaaaaaacaaaaaaaaaaaaacaaaagaaaaaaauaaaaauacgguggcaauauuaugua

SEQ ID NO: 629287 - RNA, 63 nt, hsa
acauuauguguaacagauugauuuucucagcacaaaauaaaaagcaucuguauuaauguaaag

SEQ ID NO: 629288 - RNA, 63 nt, hsa
uaucuugguacauaccuauuugaaaaugcuacuaaaauaaaaauaaaucuuugccaaaaauuu

SEQ ID NO: 629289 - RNA, 63 nt, hsa
gguacauaccuauuugaaaaugcuacuaaaauaaaaauaaaucuuugccaaaaauuuuuuuuc

SEQ ID NO: 629290 - RNA, 63 nt, hsa
guuauggaaaaugucaaccuuuguaagaaaaccaaaauaaaaauugaaaaauaaaaaccauaa

SEQ ID NO: 629291 - RNA, 63 nt, hsa
caaccuuuguaagaaaaccaaaauaaaaauugaaaaauaaaaaccauaaacauuugcaccacu

SEQ ID NO: 629292 - RNA, 63 nt, hsa
agccuggauaacagagcgagacccugucucaaaaaaauaaaauaaaaaauaaaaacacccuug

SEQ ID NO: 629293 - RNA, 63 nt, hsa
ggauaacagagcgagacccugucucaaaaaaauaaaauaaaaaauaaaaacacccuugccugc

SEQ ID NO: 629294 - RNA, 63 nt, hsa
agagcgagacccugucucaaaaaaauaaaauaaaaaauaaaaacacccuugccugcgcuccau

SEQ ID NO: 629295 - RNA, 63 nt, hsa
gaagcacuaagacugcuucuaggcuuuauuuauaaaauaaacaccuuaucccuaacaugggca

SEQ ID NO: 629296 - RNA, 63 nt, hsa
ucauguacauuugaaaauauuugcacacauuuaaaaauaaauguaaaguugucuuuuaaacua

SEQ ID NO: 629297 - RNA, 63 nt, hsa
gucugcauuucuacuguaaaaugcaauuugaaaaaaauaaaacgcaaaaaaagaaacuguaaa

SEQ ID NO: 629298 - RNA, 63 nt, hsa
aauuaaauggaaugaaugauauguauauuacucaaaauaaaguuucuuucacuuuaauaauca

SEQ ID NO: 629299 - RNA, 63 nt, hsa
uauuugcuggugucguguaaauauugguauuuuaaaauaaaaacuguuacaucacuauuuuaa

SEQ ID NO: 629300 - RNA, 63 nt, hsa
ucacaacaauuugacacccuucauucauuuauaaaaauaaaugagcuaguucuuuaguaguua

SEQ ID NO: 629301 - RNA, 63 nt, hsa
accuuuaaacccauaaauuaauuuuauaucaauaaaauaaaauacuuucucuaguuuuggagc

SEQ ID NO: 629302 - RNA, 63 nt, hsa
uuuauuuauauuucacauaauguaaaguucuacaaaauaaagcuaguaggcaagaccccucag

SEQ ID NO: 629303 - RNA, 63 nt, hsa
agauuccuaauucuaugacaguguacauauaugaaaauaaaugaugaaaaaagaacuauaaua

SEQ ID NO: 629304 - RNA, 63 nt, hsa
uacaguuuugugauauaaaauaaagcugaguauaaaauaaaaccaaucaaacacagaauuuga

SEQ ID NO: 629305 - RNA, 63 nt, hsa
uaaccuuauaccugaauuacaguuuugugauauaaaauaaagcugaguauaaaauaaaaccaa

SEQ ID NO: 629306 - RNA, 61 nt, hsa
aaaucacauuuaaaauaaacugccucugacccaaaaauaaauauggcucuuuauuuuccuu

SEQ ID NO: 629307 - RNA, 63 nt, hsa
aagcugcuuauaaauguaaaugaaaucacauuuaaaauaaacugccucugacccaaaaauaaa

SEQ ID NO: 629308 - RNA, 63 nt, hsa
gcucuagguucuucagcacauuucccccaaaacaaaauaaaauugagggcauguugcauauug

SEQ ID NO: 629309 - RNA, 63 nt, hsa
uagaaacucuaaaaacaaaaauaauaauaaagaaaaauaaauaaaaaggagaggcagacaaug

SEQ ID NO: 629310 - RNA, 63 nt, hsa
gcuuguuacaauucgaccuaauaugugcauuguaaaauaaaugccauauuucaaacaaaacac

SEQ ID NO: 629311 - RNA, 63 nt, hsa
cccuucccaguauacuugaaaagcuuucuuguuaaaauaaaaggugucacugugguaggcauu

SEQ ID NO: 629312 - RNA, 63 nt, hsa
uggggagggcauggaagauccagcggaaaguugaaaauaaacuggaaugaucaucuuggcuug

SEQ ID NO: 629313 - RNA, 63 nt, hsa
aacacacacacacacacaccccucacauacuauaaaauaaaucuucacugcccuaucaaaaua

SEQ ID NO: 629314 - RNA, 63 nt, hsa
cauuuuacauaaaaugcuaaaauuuauuauaggaaaauaaaucaaacccaaagaaaguuuauu

SEQ ID NO: 629315 - RNA, 63 nt, hsa
auaagaaguccauauacugaagagcguuugauuaaaauaaagugacuauuaaccagaaaagaa

SEQ ID NO: 629316 - RNA, 63 nt, hsa
gaagaauuuauauuuggaaaguaaaaaaguaaaaaaauaaaucauccaacuucuuugcauuac

SEQ ID NO: 629317 - RNA, 63 nt, hsa
acaauuuuaaauaauucaucuuacaagucagguaaaauaaaaucgauucccagauuccauaca

SEQ ID NO: 629318 - RNA, 63 nt, hsa
aauuaguuaaaauauauuaaaaauauuauuaguaaaauaaaauuucacacaauaaaaaacaac

SEQ ID NO: 629319 - RNA, 63 nt, hsa
uacaugaagcucaaguguuaggauugacuuaugaaaauaaauuuuauuucuauccaaauuuga

SEQ ID NO: 629320 - RNA, 63 nt, hsa
uuguaacucaacugguaacaguaguaaucauacaaaauaaaaaccugcuucagugucuuaaug

SEQ ID NO: 629321 - RNA, 63 nt, hsa
aauaaagucuccuugguacugaaaucauuaucuaaaauaaaggaaauguuaucaaaagauguu

SEQ ID NO: 629322 - RNA, 63 nt, hsa
acuucuguaaagagaauaucaauauaaauaaggaaaauaaaucaaugaaauguuucaaugaua

SEQ ID NO: 629323 - RNA, 63 nt, hsa
ugcaucagaucauggaugcauuuuuauuaugaaaaaauaaaaugacuuuucaaauuauaauga

SEQ ID NO: 629324 - RNA, 63 nt, hsa
cucaugcuaaaaauacaacaaaagacaaagcaaaaaauaaaccuuugcuuuuuuuuuuuuuuu

SEQ ID NO: 629325 - RNA, 63 nt, hsa
agaaugaaaacugcugacguauuacaaaacagaaaaauaaaugauuuaaaaucaaaucaaaaa

SEQ ID NO: 629326 - RNA, 63 nt, hsa
ucuuaguucagaaauacauaaugucauauguuaaaaauaaagagauguagaaaucuaaaugaa

SEQ ID NO: 629327 - RNA, 63 nt, hsa
guuauuagcugauuuuacucauuuuauauuugcaaaauaaauuucuaauauuuauugaaauug

SEQ ID NO: 629328 - RNA, 63 nt, hsa
agaaaaggguguguuuggaugaaaguaaaaaaaaaaauaaaaucuuucacugucucuaauggc

SEQ ID NO: 629329 - RNA, 63 nt, hsa
uuuauuauuucaaaagaauaugucuuaaaagggaaaauaaaaacuuucuguugaaucacaaca

SEQ ID NO: 629330 - RNA, 63 nt, hsa
aaagcaaccugucuuacauucuuacauuaucuuaaaauaaauauuucugcccuugaaucaaga

SEQ ID NO: 629331 - RNA, 63 nt, hsa
uagccugggcaacggugagacccugccucaaaaaaaauaaaaauaaaaauaaaacacuuuaau

SEQ ID NO: 629332 - RNA, 63 nt, hsa
gggcaacggugagacccugccucaaaaaaaauaaaaauaaaaauaaaacacuuuaauuagaau

SEQ ID NO: 629333 - RNA, 63 nt, hsa
cggugagacccugccucaaaaaaaauaaaaauaaaaauaaaacacuuuaauuagaaucuauuu

SEQ ID NO: 629334 - RNA, 60 nt, hsa; identical to SEQ ID NO: 62231

SEQ ID NO: 629335 - RNA, 63 nt, hsa
aaagaaacauaaggacacauuuucaaauuaauaaaaauaaaggcauuuuaaggauggccugug

SEQ ID NO: 629336 - RNA, 63 nt, hsa
gagcacaauggucuuacauuggauuuuuguaaaaaaauaaaaauaaauggagacuuuaacuca

SEQ ID NO: 629337 - RNA, 63 nt, hsa
aauggucuuacauuggauuuuuguaaaaaaauaaaaauaaauggagacuuuaacucaagcagc

SEQ ID NO: 629338 - RNA, 63 nt, hsa
aaaccaaaguuuauuaauaauuuuuauauaacuaaaauaaaauagauguggagggaucuguga

SEQ ID NO: 629339 - RNA, 63 nt, hsa
ccagacuagugaguuaaguacaagaucucucuaaaaauaaacagaugaaaaucuauccccauu

SEQ ID NO: 629340 - RNA, 63 nt, hsa
gcagaaugaaguauguuuguuuauuuuucuuuaaaaauaaaggauuuuggaacucuggagagu

SEQ ID NO: 629341 - RNA, 63 nt, hsa
accuaggcaacauggugaaaccuugucucuaccaaaauaaaaauuagcugggcaugguggcac

SEQ ID NO: 629342 - RNA, 63 nt, hsa
gcuauaguggaaucuuugguuuugcaucauaguaaaauaaaauaaacccaucacauuuggaac

SEQ ID NO: 629343 - RNA, 63 nt, hsa
aguggaaucuuugguuuugcaucauaguaaaauaaaauaaacccaucacauuuggaacauaac

SEQ ID NO: 629344 - RNA, 63 nt, hsa
auauucauucagacaaaucagaaagggcacuugaaaauaaauuuugauucugagccaggagaa

SEQ ID NO: 629345 - RNA, 63 nt, hsa
cuauggugugaaauccuuuguuauuuuucuaaaaaaauaaaauuuaaaaagaaagaaaacuaa

SEQ ID NO: 629346 - RNA, 63 nt, hsa
guauuucaaagcucuuuuccuaacugguuaaguaaaauaaaaaauugagcuuucuagaauauu

SEQ ID NO: 629347 - RNA, 63 nt, hsa
aaaaaagagagaguaacuacagaagaacuuuaaaaaauaaaaaauaagcuuaccuuggauucu

SEQ ID NO: 629348 - RNA, 63 nt, hsa
guuuuguuuuucacaaagcucuuauuaugaagcaaaauaaaaauucuaguuucuuguaugauu

SEQ ID NO: 629349 - RNA, 63 nt, hsa
gaguauuugcacugcugaagagucacuaugagcaaaauaaaacaaauaagacucaaacugcuc

SEQ ID NO: 629350 - RNA, 63 nt, hsa
agcagaaaggcauggcuaauaauguugguggugaaaauaaauaaauaaguaaacaaaaugaag

SEQ ID NO: 629351 - RNA, 63 nt, hsa
aaaugcauauaaaucuugauaaacaaagucuauaaaauaaaacaugggacauuagcuuuggga

SEQ ID NO: 629352 - RNA, 63 nt, hsa
guuaaaauguuugauuccuugggaauggccuuaaaaauaaauguaauaaagucagaguggugg

SEQ ID NO: 629353 - RNA, 63 nt, hsa
ucucaguuuaauauaaaaugagcuaaguuuuuaaaaauaaauuauaaacuuggagauuagaaa

SEQ ID NO: 629354 - RNA, 63 nt, hsa
uuuuaaaaauaaauuauaaacuuggagauuagaaaaauaaagcaguugcuguagaauaggcug

SEQ ID NO: 629355 - RNA, 63 nt, hsa
uuuuaaccagacuuucucuuaaaaacauuagauaaaauaaaagauucaccggauggauucuga

SEQ ID NO: 629356 - RNA, 63 nt, hsa
guguaggagugaagacaggaucccgugcuuaaaaaaauaaaaaauaaaaaaauaaaaaaaaaa

SEQ ID NO: 629357 - RNA, 63 nt, hsa
agugaagacaggaucccgugcuuaaaaaaauaaaaaauaaaaaaauaaaaaaaaaauaagacu

SEQ ID NO: 629358 - RNA, 63 nt, hsa
caggaucccgugcuuaaaaaaauaaaaaauaaaaaaauaaaaaaaaaauaagacuuuaacugc

SEQ ID NO: 629359 - RNA, 63 nt, hsa
uugcuucucgggaaagcaaagaagcugcuuuaaaaaauaaaaaggggacuaaaaauuuguuuu

SEQ ID NO: 629360 - RNA, 63 nt, hsa
auauugugaaaaugaaucuguuaugauaaagaaaaaauaaaguggaaacuuuuagaguauuac

SEQ ID NO: 629361 - RNA, 63 nt, hsa
uuugcauguaaacaaugauuucaaaauacuugaaaaauaaaauuuuaacccaaaugaauaacu

SEQ ID NO: 629362 - RNA, 63 nt, hsa
uuaaaaccccauuuuccuaaagaacaaaguaguaaaauaaaaaaaaauuuaaaaaauuaaaaa

SEQ ID NO: 629363 - RNA, 63 nt, hsa
aguaguaaaauaaaaaaaaauuuaaaaaauuaaaaaauaaaaaaaagaggucacuaaaagacc

SEQ ID NO: 629364 - RNA, 63 nt, hsa
agugucucuauuuaugagaucacugaacuuuucaaaauaaagcuuuugcauagaauaaugaag

SEQ ID NO: 629365 - RNA, 63 nt, hsa
acugcuguaaagcaaaauauuugugaaagugccaaaauaaagucugucaugccaaaaguaaau

SEQ ID NO: 629366 - RNA, 63 nt, hsa
aguguguuaugaaugacuaagauucugauaaaaaaaauaaauuauuuacacaggguuuauaca

SEQ ID NO: 629367 - RNA, 63 nt, hsa
uuuuaaacccccaugaacacgaauacucugaaaaaaauaaaaagcuuucuggaagaagacacc

SEQ ID NO: 629368 - RNA, 63 nt, hsa
caauauacuauauguaauagggaauaccuugcuaaaauaaaacuuaggauauagugguaaugg

SEQ ID NO: 629369 - RNA, 63 nt, hsa
gagaacugugauuuaaaaguacuguuaauguaaaaaauaaagcaaguguaauuaauucuuuca

SEQ ID NO: 629370 - RNA, 63 nt, hsa
uugcauuuuauuaccauuucaaacuauuuuuuaaaaauaaauacaguuaacauagagugguuu

SEQ ID NO: 629371 - RNA, 63 nt, hsa
aggcuuauuaugauacuagugaguacauuaaguaaaauaaaauggaccagaaaagaaaagaaa

SEQ ID NO: 629372 - RNA, 63 nt, hsa
auacaaaguaaaauguuauaaaugugaaguuauaaaauaaauauaugcuaauaaaauccugag

SEQ ID NO: 629373 - RNA, 63 nt, hsa
gucaaaaaaaaaaauaccuuuuguaauguuugaaaaauaaagcuguuugacuugucagguguu

SEQ ID NO: 629374 - RNA, 63 nt, hsa
gguaaacaaagaaaugacaaaaauaaaauaaauaaaauaaaaauggauagguggugacccacu

SEQ ID NO: 629375 - RNA, 63 nt, hsa
aaaaggauagguaaacaaagaaaugacaaaaauaaaauaaauaaaauaaaaauggauaggugg

SEQ ID NO: 629376 - RNA, 63 nt, hsa
uuuaaaaaaggauagguaaacaaagaaaugacaaaaauaaaauaaauaaaauaaaaauggaua

SEQ ID NO: 629377 - RNA, 63 nt, hsa
auugcuuacuuuggaauacauuucuccuuugauaaaauaaaugagcuauguauuaacacugcc

SEQ ID NO: 629378 - RNA, 63 nt, hsa
aaaaggacaauuucaaaaaaauaaaauaaaauaaaaauaaauucaccuagucuaaggaugcua

SEQ ID NO: 629379 - RNA, 63 nt, hsa
caugaaaaaaggacaauuucaaaaaaauaaaauaaaauaaaaauaaauucaccuagucuaagg

SEQ ID NO: 629380 - RNA, 63 nt, hsa
uuugacaugaaaaaaggacaauuucaaaaaaauaaaauaaaauaaaaauaaauucaccuaguc

SEQ ID NO: 629381 - RNA, 63 nt, hsa
aauguuuugacaugaaaaaaggacaauuucaaaaaaauaaaauaaaauaaaaauaaauucacc

SEQ ID NO: 629382 - RNA, 63 nt, hsa
aaaaauaaauaacaagauaauugagaaaaaaauaaaauaaauucccaauuccauugggaaaaa

SEQ ID NO: 629383 - RNA, 63 nt, hsa
uugagaaaaauaaauaacaagauaauugagaaaaaaauaaaauaaauucccaauuccauuggg

SEQ ID NO: 629384 - RNA, 63 nt, hsa
acuugagccaaucugagagcaaaauaauugagaaaaauaaauaacaagauaauugagaaaaaa

SEQ ID NO: 629385 - RNA, 63 nt, hsa
uggaaccaugcgagugauaccuauuuauaaaauaaaauaaaccaagcacaaguacgaacuuag

SEQ ID NO: 629386 - RNA, 63 nt, hsa
gcauuuggaaccaugcgagugauaccuauuuauaaaauaaaauaaaccaagcacaaguacgaa

SEQ ID NO: 629387 - RNA, 63 nt, hsa
gucuauacacuucacacuuuauauaauaccucaaaaauaaaaauaugaaaacaguacacuguu

SEQ ID NO: 629388 - RNA, 63 nt, hsa
cacuuuucuaaggacugaagauuggcaaaaacuaaaauaaauuaaaacugcuuacaccagaag

SEQ ID NO: 629389 - RNA, 63 nt, hsa
agaauacuauuuccaaacucauauuacaaaaacaaaauaaaauaauaaaaaaagaaagcauga

SEQ ID NO: 629390 - RNA, 63 nt, hsa
uccacuaugccuuaaugguuuccuccauuugagaaaauaaagcuauucacauuguuaagaaaa

SEQ ID NO: 629391 - RNA, 63 nt, hsa
gugucuauaaaagaaacacuuugaagucuauaaaaaauaaaauaauuauaaauaucauuguac

SEQ ID NO: 629392 - RNA, 63 nt, hsa
uuucugccaaaauaaaccuguucuuccuuuuuuaaaauaaaauaaguucuuaaaaaauuuaua

SEQ ID NO: 629393 - RNA, 63 nt, hsa
aauuuugcauauucucuauuuuacuuuucugccaaaauaaaccuguucuuccuuuuuuaaaau

SEQ ID NO: 629394 - RNA, 63 nt, hsa
uuuuaagccauuuccucuucacuaugucuuauuaaaauaaaaccugucaaguucuuuucaaaa

SEQ ID NO: 629395 - RNA, 63 nt, hsa
gcccuggcaguggcuacauuugacacuuuagaaaaaauaaacauauuuaauaauuuuuguuuc

SEQ ID NO: 629396 - RNA, 63 nt, hsa
ugugaaaaaguaaagauaacuaaaaaauuuagaaaaauaaauccaguauuuguaaagugaaua

SEQ ID NO: 629397 - RNA, 63 nt, hsa
auuguucugucaauaauuguuaccaaagagauaaaaauaaaagcagaauguauaucaucccau

SEQ ID NO: 629398 - RNA, 63 nt, hsa
gccugggugacagagugagacucugucucaaaaaaaauaaaauaaaaagucaauuuagaaugu

SEQ ID NO: 629399 - RNA, 63 nt, hsa
ggugacagagugagacucugucucaaaaaaaauaaaauaaaaagucaauuuagaaugugaaau

SEQ ID NO: 629400 - RNA, 63 nt, hsa
gaauugaugguuguauaagaacuagcucauguaaaaauaaaauaacauuauuacauugccuca

SEQ ID NO: 629401 - RNA, 63 nt, hsa
gucgauugaauuggaccuuuucaguuguucagaaaaauaaaaauaauuucucauauuaaauac

SEQ ID NO: 629402 - RNA, 63 nt, hsa
acgauuuuuaaguaaguuggggaccaucaguuuaaaauaaaugcaauacuauuucaugauaaa

SEQ ID NO: 629403 - RNA, 63 nt, hsa
guuuuugucgugucuauaaaggaagaacaaaacaaaauaaaaacagagcccuagagaaaugcu

SEQ ID NO: 629404 - RNA, 63 nt, hsa
cuuuuuuaguaauagguccagauaugagugcuaaaaauaaagaugauagcauguucuucuguc

SEQ ID NO: 629405 - RNA, 63 nt, hsa
gucauuuaccaggauucccguagggcguuuuguaaaauaaacuauaauauuaaugaaaaguau

SEQ ID NO: 629406 - RNA, 63 nt, hsa
acuguaaauacauuuguaccucucuuguauucuaaaauaaaaauuacuuggaacauuuaucau

SEQ ID NO: 629407 - RNA, 63 nt, hsa
caguaaaacaaauguguauucaacaaaagaaaaaaaauaaaacaguaacacuuuaaaacaaga

SEQ ID NO: 629408 - RNA, 63 nt, hsa
aggcauuuuaaucugcacaguuuaucuucugccaaaauaaaaauuuacuauuuccuuuauaua

SEQ ID NO: 629409 - RNA, 63 nt, hsa
aauguacucuuuuacuuuuauauuaaaaaaaauaaaauaaauaugugccuaaaaccuccaguu

SEQ ID NO: 629410 - RNA, 63 nt, hsa
ucaacaauguacucuuuuacuuuuauauuaaaaaaaauaaaauaaauaugugccuaaaaccuc

SEQ ID NO: 629411 - RNA, 63 nt, hsa
agaguuguaggaugcagggcuaaauugcaaaauaaaauaaaauagccagcguacacaaugaga

SEQ ID NO: 629412 - RNA, 63 nt, hsa
uaucaagaguuguaggaugcagggcuaaauugcaaaauaaaauaaaauagccagcguacacaa

SEQ ID NO: 629413 - RNA, 63 nt, hsa
guacauuugaauugaauauauaauaaauauugcaaaauaaaauccaucuaaauagaaggguuc

SEQ ID NO: 629414 - RNA, 63 nt, hsa
agauagucucauauuuaggaaaacuuuccaaauaaaauaaauguuauucucugauaaagagcu

SEQ ID NO: 629415 - RNA, 63 nt, hsa
uuuuuuucuccuacaaggagauauggcuggaccaaaauaaaaugacaugaaacugcaaaaaug

SEQ ID NO: 629416 - RNA, 63 nt, hsa
acaaugacuguaacguguuauagauguaaagacaaaauaaagguuaaagagggcauaaaggag

SEQ ID NO: 629417 - RNA, 63 nt, hsa
uauguaauauauguaacaucuuccaauucuuuuaaaauaaaauuaauauuuauaauggauauu

SEQ ID NO: 629418 - RNA, 63 nt, hsa
gccucuuaaaaaaaaaaaaccugcuaggauuuaaaaauaaaaaucagaggccuaucuccacuu

SEQ ID NO: 629419 - RNA, 63 nt, hsa
aaucuguauuaaaaauaaaauuaauaaaaguaaaaaauaaaaauagaaacacaacucuacuag

SEQ ID NO: 629420 - RNA, 63 nt, hsa
guugaaaaugccccuuacugaaaaucuguauuaaaaauaaaauuaauaaaaguaaaaaauaaa

SEQ ID NO: 629421 - RNA, 63 nt, hsa
ccagucaacucuaagaagacuagauauuccuagaaaauaaagaagcaaaucucuuuaccggga

SEQ ID NO: 629422 - RNA, 63 nt, hsa
cacagcaagacucugucucaaaaauaaaugaauaaaauaaaaaccugccaccaaauuauuucu

SEQ ID NO: 629423 - RNA, 63 nt, hsa
ccagccugggcaacacagcaagacucugucucaaaaauaaaugaauaaaauaaaaaccugcca

SEQ ID NO: 629424 - RNA, 63 nt, hsa
cagucugggugacagagcaagacuccaucucaaaaaauaaauaaauagaaagagagagagagg

SEQ ID NO: 629425 - RNA, 63 nt, hsa
auuuaccaauguuguuuuuuuuuaacaagaaaaaaaauaaaagcacauugucauuuuuuuucc

SEQ ID NO: 629426 - RNA, 63 nt, hsa
agacaaaugaagccuaaucguuuuucuagaaggaaaauaaauucuaauugauaaugaauuucg

SEQ ID NO: 629427 - RNA, 63 nt, hsa
cacacacacacacacacacacacacacacacacaaaauaaauccgggugugccugaaccucag

SEQ ID NO: 629428 - RNA, 63 nt, hsa
gcuuuuugacagcuuuuugagaccucuuaagaaaaaauaaaaaguaaaaaaugaaaggaaucu

SEQ ID NO: 629429 - RNA, 63 nt, hsa
cgguuucugcuguauuaaugacaauuauucaugaaaauaaaaaaugaaauauuuuguauacua

SEQ ID NO: 629430 - RNA, 63 nt, hsa
cucaaacugaggcuuaaaguauucccuuuuauaaaaauaaaugcuugggguaggguggagugg

SEQ ID NO: 629431 - RNA, 63 nt, hsa
ggguggaguggggagggauuaaaacccauccaaaaaauaaauaaaaacuauauaggugcuaug

SEQ ID NO: 629432 - RNA, 63 nt, hsa
caguacagaggaaaacaggaaccugauuuuuuuaaaauaaauuuuaaauaaaauagaauuacu

SEQ ID NO: 629433 - RNA, 63 nt, hsa
guauaaaaaagcaaauacuuggugagugauuuaaaaauaaaaccaaaacaaaacacaaaaaga

SEQ ID NO: 629434 - RNA, 63 nt, hsa
aguuugaagcaguucuucaugccacuuaguuugaaaauaaaauucuagauaugcaaaugauuu

SEQ ID NO: 629435 - RNA, 63 nt, hsa
agauaugcaaaugauuuucuuagaaaacuucacaaaauaaaagaucuuguuuuuuuuuccaua

SEQ ID NO: 629436 - RNA, 63 nt, hsa
uugacaauugguagaaggugcacauuuuaagcaaaaauaaaaguuuuauaguuuuaaauacau

SEQ ID NO: 629437 - RNA, 63 nt, hsa
aauguuuucucucuuaaaauauuucuccuguguaaaauaaaucauuguuguuaguaaugguug

SEQ ID NO: 629438 - RNA, 63 nt, hsa
aagaagugcuuuuuggauauggcagcacuuguaaaaauaaagcaguaagcaaaauccuuuuaa

SEQ ID NO: 629439 - RNA, 63 nt, hsa
ggugacagagcgagacucugucucaaaaaaaaaaaaauaaagccgggcgugguggcucacgcc

SEQ ID NO: 629440 - RNA, 63 nt, hsa
caacaagagcgaaacugucucaaaaaaaagaagaaaauaaauaaauaaaaaucagagcacaag

SEQ ID NO: 629441 - RNA, 63 nt, hsa
agccaacuucuguauaccuucacccauuucaugaaaauaaaaucaaaagggaaaucaaaaaua

SEQ ID NO: 629442 - RNA, 63 nt, hsa
cauuucaugaaaauaaaaucaaaagggaaaucaaaaauaaagaaaacgcuaaagaaaaaacaa

SEQ ID NO: 629443 - RNA, 63 nt, hsa
aacacuugugucaaaaugauauagcuuaguauaaaaauaaaauucaacguuuuggccaaaaug

SEQ ID NO: 629444 - RNA, 63 nt, hsa
uuuugguuuacaguguaauaauaccucauuuaaaaaauaaaaaccacuacuguuacauuuuau

SEQ ID NO: 629445 - RNA, 63 nt, hsa
guuuauaguaguuugagcagaggaugauuugcaaaaauaaaaauaaaguuauuuuacucuccu

SEQ ID NO: 629446 - RNA, 63 nt, hsa
aguaguuugagcagaggaugauuugcaaaaauaaaaauaaaguuauuuuacucuccucuugca

SEQ ID NO: 629447 - RNA, 63 nt, hsa
aagggaaggauuuaaggaggugaagucgggucaaaaauaaaauauauauacauauauacauug

SEQ ID NO: 629448 - RNA, 63 nt, hsa
aagguuacugagugaguuauugggagucuuaauaaaauaaacuagauauuagguccauucauu

SEQ ID NO: 629449 - RNA, 63 nt, hsa
ugaacccuuccugagcuuuaugguccuaaaagcaaaauaaaaacuauucgaaugaaaagacaa

SEQ ID NO: 629450 - RNA, 63 nt, hsa
uuuauguuuagauagggcugggcaaggaaaaagaaaauaaagacaaccauauuuagcagugca

SEQ ID NO: 629451 - RNA, 63 nt, hsa
aaguaagaagcuauguaaacugacaaggaugcuaaaauaaaagucucugaaguauuccaugcc

SEQ ID NO: 629452 - RNA, 63 nt, hsa
uaucuguuuugguauauuguacacaaaccuacaaaaauaaacugaacuugcaauauuuuugca

SEQ ID NO: 629453 - RNA, 63 nt, hsa
gcugcaucuauaugucacugacauaaaguugaaaaaauaaaugcaggcaaauaacuagagacu

SEQ ID NO: 629454 - RNA, 63 nt, hsa
guuuuuuucucacuuccuacaaaaugcaaaugcaaaauaaauaacuaagcagcuuuuguuugg

SEQ ID NO: 629455 - RNA, 63 nt, hsa
aagacauuuccuaauuuauggggauuuuaauugaaaauaaacuugagucccaauagagcuguu

SEQ ID NO: 629456 - RNA, 63 nt, hsa
aaaaguuuucugaaaaaacuuuugcaauaaaaaaaaauaaauugcccaucaauaaguuugaua

SEQ ID NO: 629457 - RNA, 63 nt, hsa
uccauuaccuggcacuagcaacauuagaauuuuaaaauaaaauaauugggaaagaaggugggu

SEQ ID NO: 629458 - RNA, 63 nt, hsa
uuuuguccuuuccuucacugauuugcuuuaaaaaaaauaaaagauaaugauuuauugcagaau

SEQ ID NO: 629459 - RNA, 63 nt, hsa
caacagagcaagacucugccucaaaaaaaaauuaaaauaaauuuaaauacaaaaaaaaauagc

SEQ ID NO: 629460 - RNA, 63 nt, hsa
caaauuagcaucccauggcaaauauauuuugaaaaaauaaagaacuaucaggauugaaaacag

SEQ ID NO: 629461 - RNA, 63 nt, hsa
uuuuaaaaauauuguuugauuuuucuauuuucaaaaauaaaauucuguuucuaacuaaaaugu

SEQ ID NO: 629462 - RNA, 63 nt, hsa
caacauagcaagauuccaucucuaaaaaaaaugaaaauaaacauaagccacaaggaaugggug

SEQ ID NO: 629463 - RNA, 63 nt, hsa
uuuauuagagggagcauggccauaaaauaaaauaaaauaaaauuuagauuuaagucgagcuca

SEQ ID NO: 629464 - RNA, 63 nt, hsa
uuagauuuauuagagggagcauggccauaaaauaaaauaaaauaaaauuuagauuuaagucga

SEQ ID NO: 629465 - RNA, 63 nt, hsa
aaaauuuagauuuauuagagggagcauggccauaaaauaaaauaaaauaaaauuuagauuuaa

SEQ ID NO: 629466 - RNA, 63 nt, hsa
aaaacacuuuagaaucagcuagucaauuuccacaaaauaaagugcuagaauuugauuggauuu

SEQ ID NO: 629467 - RNA, 63 nt, hsa
uaucauuauuccaaaauacaaaauaaagaagauaaaauaaauuauauacccgagccauuaacc

SEQ ID NO: 629468 - RNA, 63 nt, hsa
uuuucagaugcagcuaucauuauuccaaaauacaaaauaaagaagauaaaauaaauuauauac

SEQ ID NO: 629469 - RNA, 63 nt, hsa
ucaaaaugcacuuuuuaauaaaaacugauacuuaaaauaaauggcuguuauuucuacuguguu

SEQ ID NO: 629470 - RNA, 63 nt, hsa
auggucaguaggcaaucuuaaauguuuuuauuuaaaauaaaguauuccuugaaaauauaaaua

SEQ ID NO: 629471 - RNA, 63 nt, hsa
aagugcuaagaacuccaugagagaagaugccauaaaauaaacaccucccuaauccuauuaucu

SEQ ID NO: 629472 - RNA, 63 nt, hsa
ucuuuagucaaaucucugcauuguuucaugcagaaaauaaagauacaauuaaggcugacauua

SEQ ID NO: 629473 - RNA, 63 nt, hsa
cacauugugcuacuacgacuuuauuuuuucuugaaaauaaagccuugaggaugugaacauaaa

SEQ ID NO: 629474 - RNA, 63 nt, hsa
cuaagauaguuuuaagauuuuugguuguauaacaaaauaaaaguuuacccaaaaguauaagau

SEQ ID NO: 629475 - RNA, 63 nt, hsa
cucauugugcuuucccuucccuucuuuauaaugaaaauaaaucuugagucguugacuuuugua

SEQ ID NO: 629476 - RNA, 63 nt, hsa
agauuguaggagaugacagacauaagguauuucaaaauaaaucucaggugcuauaacauguag

SEQ ID NO: 629477 - RNA, 63 nt, hsa
uaucuuugucuauaacugacagauguuuauauuaaaauaaaauauuguauuaaaaauuuaaaa

SEQ ID NO: 629478 - RNA, 63 nt, hsa
uguccuuuaagucugcuaggcucucaguacccuaaaauaaacuagauuguguugcuauuuuuu

SEQ ID NO: 629479 - RNA, 63 nt, hsa
guuguauuuaaaagguagccauguagagacacaaaaauaaaugaagaagcuggacaugguggg

SEQ ID NO: 629480 - RNA, 63 nt, hsa
guuuuuaaaagacugacaguguuuauuauuauuaaaauaaacaggguugguuauauugcaaua

SEQ ID NO: 629481 - RNA, 63 nt, hsa
aaaggaaaucaaauguuauuuuuaagaaaauggaaaauaaaaacuuuauaaacaccaucugcu

SEQ ID NO: 629482 - RNA, 63 nt, hsa
gguggaugucagaucugguagguugcagcagagaaaauaaaugugccuugagagaccacucag

SEQ ID NO: 629483 - RNA, 63 nt, hsa
cauucuauuguguucuacuucaccuaaaaaaauaaaauaaaaauguugaucaagacauggagu

SEQ ID NO: 629484 - RNA, 63 nt, hsa
ugagccauucuauuguguucuacuucaccuaaaaaaauaaaauaaaaauguugaucaagacau

SEQ ID NO: 629485 - RNA, 63 nt, hsa
gugcuuuaugugguaguguuguacccauucuuaaaaauaaaucacaucauauauauguguaaa

SEQ ID NO: 629486 - RNA, 63 nt, hsa
aacacauuugccuaucuucuuacccugaaacagaaaauaaauauugugcuuuaugugguagug

SEQ ID NO: 629487 - RNA, 63 nt, hsa
uaugaacaugauuuuucuuuauguacaaaaacuaaaauaaagucaauaaagacaauucugacu

SEQ ID NO: 629488 - RNA, 63 nt, hsa
uaaaagcuuuggaaacucuguaaaaugaacaauaaaauaaagcauauagcuacuuucaguuga

SEQ ID NO: 629489 - RNA, 63 nt, hsa
ugugucuacuuuaaaaaacuggaaauggaaaaaaaaauaaaucuuugccaaauccuucagauu

SEQ ID NO: 629490 - RNA, 63 nt, hsa
gauaauaaaaucgcuacuuuaagggguuuguccaaaauaaauauuguggccuuauauaucaca

SEQ ID NO: 629491 - RNA, 63 nt, hsa
uuuguucuguaaaugcugcguuccuaauuuaguaaaauaaaagaauagacacuaaaaucaugu

SEQ ID NO: 629492 - RNA, 63 nt, hsa
ccuggccaacauggcgaaaacccaucucuacuaaaaauaaaauuagccaugcguggugcuugu

SEQ ID NO: 629493 - RNA, 63 nt, hsa
aacacaaaauugguuucaaaauguuuucauguaaaaauaaauuaacuuuucuguaauuagauu

SEQ ID NO: 629494 - RNA, 63 nt, hsa
cugggcuacagagagcaagacucugucucaaaaaaaauaaaauaaaauaaauaaaaaaagaua

SEQ ID NO: 629495 - RNA, 63 nt, hsa
cuacagagagcaagacucugucucaaaaaaaauaaaauaaaauaaauaaaaaaagauauagua

SEQ ID NO: 629496 - RNA, 63 nt, hsa
gagagcaagacucugucucaaaaaaaauaaaauaaaauaaauaaaaaaagauauaguauuaau

SEQ ID NO: 629497 - RNA, 63 nt, hsa
aauaaaauuuucuacaucaaaguaagacuugagaaaauaaacuuauguguauauauguuuaaa

SEQ ID NO: 629498 - RNA, 63 nt, hsa
ccagccugggcgacagagcaagacuccaucucaaaaauaaaauaaaaaaagaaagaaagaaaa

SEQ ID NO: 629499 - RNA, 63 nt, hsa
cugggcgacagagcaagacuccaucucaaaaauaaaauaaaaaaagaaagaaagaaaagaaga

SEQ ID NO: 629500 - RNA, 63 nt, hsa
ggugggaaaugggggaucuucaauguuuauuuuaaaauaaaauaaaauaaguucuugacuuuu

SEQ ID NO: 629501 - RNA, 63 nt, hsa
gaaaugggggaucuucaauguuuauuuuaaaauaaaauaaaauaaguucuugacuuuucucau

SEQ ID NO: 629502 - RNA, 63 nt, hsa
aacacuggccauggccgugggaguacugggaguaaaauaaaaauaucgagguauagacuagca

SEQ ID NO: 629503 - RNA, 63 nt, hsa
uuuguuuucucuuauucuagguaaggcauauuaaaaauaaauauguaaagaagaaaaauaaaa

SEQ ID NO: 629504 - RNA, 63 nt, hsa
uaaggcauauuaaaaauaaauauguaaagaagaaaaauaaaaguugucuucauggaagcaacu

SEQ ID NO: 629505 - RNA, 63 nt, hsa
agugucaaauaaaaaauuaccaucauuaucauuaaaauaaauuuucacuguauuugagauggg

SEQ ID NO: 629506 - RNA, 63 nt, hsa
aacuacuuugucgguugcucugaggguuaaaugaaaauaaaaagaaaaugugaaacagcacca

SEQ ID NO: 629507 - RNA, 63 nt, hsa
ccagcccggccuacaagaacaaaacuccaucucaaaauaaauaaaaaaauaaauaaaaauaaa

SEQ ID NO: 629508 - RNA, 63 nt, hsa
acaagaacaaaacuccaucucaaaauaaauaaaaaaauaaauaaaaauaaaaauagacuauau

SEQ ID NO: 629509 - RNA, 63 nt, hsa
aacuccaucucaaaauaaauaaaaaaauaaauaaaaauaaaaauagacuauauauagucuuug

SEQ ID NO: 629510 - RNA, 63 nt, hsa
gucuuugaauucauuuauuuuaaauaaaugaauaaaauaaaauaaaaaagaauauucagucgu

SEQ ID NO: 629511 - RNA, 63 nt, hsa
ugaauucauuuauuuuaaauaaaugaauaaaauaaaauaaaaaagaauauucagucguuggca

SEQ ID NO: 629512 - RNA, 63 nt, hsa
aaauuuccuuaggagugcagagggcucauugggaaaauaaaaauaauaaaaauaaauaaaacu

SEQ ID NO: 629513 - RNA, 63 nt, hsa
ugcagagggcucauugggaaaauaaaaauaauaaaaauaaauaaaacuuccuaaaagaaaaga

SEQ ID NO: 629514 - RNA, 63 nt, hsa
ucccacauuuuaagauuuuaaaaaugaaaccaaaaaauaaauugaagaaaacuguaaacuuua

SEQ ID NO: 629515 - RNA, 63 nt, hsa
cagccuaggugacagucagacccugucucaaaaaaaauaaaaaaaauuuaaaauaaucuuggg

SEQ ID NO: 629516 - RNA, 63 nt, hsa
cauuucagagcaaucugcauauuuaacagaccuaaaauaaauccuauuaggcaagucaguuga

SEQ ID NO: 629517 - RNA, 63 nt, hsa
gucuacaauacaauaccuguauucaaaauaacaaaaauaaagccugauucuuuguuucuagaa

SEQ ID NO: 629518 - RNA, 63 nt, hsa
gagcaagacuccgucucacaaaaaugaauaaauaaaauaaaaauaaaaauguuacuuuuuaaa

SEQ ID NO: 629519 - RNA, 63 nt, hsa
gacuccgucucacaaaaaugaauaaauaaaauaaaaauaaaaauguuacuuuuuaaaaaguaa

SEQ ID NO: 629520 - RNA, 63 nt, hsa
auguaacaagccugcacauguaccccagaaucuaaaauaaaaauaaaaagaaaaacaaagaau

SEQ ID NO: 629521 - RNA, 63 nt, hsa
caagccugcacauguaccccagaaucuaaaauaaaaauaaaaagaaaaacaaagaauguacuc

SEQ ID NO: 629522 - RNA, 63 nt, hsa
gccugggugacagagcaagacccugucucaaaaaaaauaaaauaaaaggcuuucugccuucau

SEQ ID NO: 629523 - RNA, 63 nt, hsa
ggugacagagcaagacccugucucaaaaaaaauaaaauaaaaggcuuucugccuucauugccu

SEQ ID NO: 629524 - RNA, 63 nt, hsa
ggccaucagagcaaauuuggggguuucucaaauaaaauaaaaauaaaaacaaauacuguguuu

SEQ ID NO: 629525 - RNA, 63 nt, hsa
cagagcaaauuuggggguuucucaaauaaaauaaaaauaaaaacaaauacuguguuucagaag

SEQ ID NO: 629526 - RNA, 63 nt, hsa
agaacugagaugucuguaugacagccacuccuaaaaauaaacaacaacaaaaacaaaaaaaga

SEQ ID NO: 629527 - RNA, 63 nt, hsa
acaacaaaaacaaaaaaagaagaaaacuaaauaaaaauaaaaauaaaaauaagauccacuucu

SEQ ID NO: 629528 - RNA, 63 nt, hsa
aaaacaaaaaaagaagaaaacuaaauaaaaauaaaaauaaaaauaagauccacuucucucugc

SEQ ID NO: 629529 - RNA, 63 nt, hsa
aaguaaccuuauauuuaaaagaugauuuugcaaaaaauaaaaaauaaaaaauaugccuucugg

SEQ ID NO: 629530 - RNA, 63 nt, hsa
cuuauauuuaaaagaugauuuugcaaaaaauaaaaaauaaaaaauaugccuucuggagugaug

SEQ ID NO: 629531 - RNA, 63 nt, hsa
uguaugguuugcaaaagggcuuccuaaaaauaaaaaauaaaauuuaaaaaacugugccuccgu

SEQ ID NO: 629532 - RNA, 63 nt, hsa
uauaucuuguaugguuugcaaaagggcuuccuaaaaauaaaaaauaaaauuuaaaaaacugug

SEQ ID NO: 629533 - RNA, 63 nt, hsa
aaaccuucaucuaauacuuuggaucauugugaaaaaauaaauuccugaaguauaaagcaucua

SEQ ID NO: 629534 - RNA, 63 nt, hsa
aauauguauauuuauuauuugucaauuaaaagcaaaauaaaacaaaaaaccuucaucuaauac

SEQ ID NO: 629535 - RNA, 63 nt, hsa
cccuuuuaaaaaauaaaaauacuuuguagauuaaaaauaaaucagaauuucaaauuuaaaauu

SEQ ID NO: 629536 - RNA, 63 nt, hsa
uaagauuucaauaaugaaaugguucccuuuuaaaaaauaaaaauacuuuguagauuaaaaaua

SEQ ID NO: 629537 - RNA, 63 nt, hsa
caggaguauucuggaaucuuuuuacuuagauauaaaauaaaccucgaauauuaaaaaguugua

SEQ ID NO: 629538 - RNA, 63 nt, hsa
uuuuugcuauucugaucauuugucccccuuuuaaaaauaaacuucccaugucuuccauuugug

SEQ ID NO: 629539 - RNA, 63 nt, hsa
uuuucucuaggaaauauacuuuuacaaguaacaaaaauaaaaacucuuauaaauuucuauuuu

SEQ ID NO: 629540 - RNA, 63 nt, hsa
ucucauaacuugagaccuaaucucuguaaagcuaaaauaaagaaauagaacaaggcugaggau

SEQ ID NO: 629541 - RNA, 63 nt, hsa
agucgagagaucugaauagagaaaucagcaguuaaaauaaaauuaaaauagcucugaacauuu

SEQ ID NO: 629542 - RNA, 63 nt, hsa
gcacaccuuucugaaauccaagaaauggaauccaaaauaaauuuuccaauugcaaccaaacgu

SEQ ID NO: 629543 - RNA, 63 nt, hsa
acauuuauaggaggaaaaaaaucacuuugggagaaaauaaaauucaacucaagcauaaagcuu

SEQ ID NO: 629544 - RNA, 63 nt, hsa
gagccuacucuaguucaagaggcuaccugaaaaaaaauaaauaagauaaagggucagcaacaa

SEQ ID NO: 629545 - RNA, 63 nt, hsa
aaagaaaauuucucucgggaauaauuuuauagaaaaauaaagcuucugugucuaaggcaacua

SEQ ID NO: 629546 - RNA, 63 nt, hsa
cagcaaaacacacacacacacacacacacacacaaaauaaagacacacaaggacgucugcgca

SEQ ID NO: 629547 - RNA, 63 nt, hsa
acccauuaggcaugccuaauauuuaggcaagagaaaauaaaccaagauagauccauuuggaca

SEQ ID NO: 629548 - RNA, 63 nt, hsa
caagaacaccuuuguuuugcacugacaagauggaaaauaaauuauauuaauuuuugaaaccca

SEQ ID NO: 629549 - RNA, 63 nt, hsa
aaggaaaaaagguacuucuauuuugaaaaaauaaaaauaaaagccuuuggguucuugaaugga

SEQ ID NO: 629550 - RNA, 63 nt, hsa
uaauaaaaggaaaaaagguacuucuauuuugaaaaaauaaaaauaaaagccuuuggguucuug

SEQ ID NO: 629551 - RNA, 63 nt, hsa
uaauuuaaggauauauauuaauagaguauguuuaaaauaaauauuguuuucaucacugacuuu

SEQ ID NO: 629552 - RNA, 63 nt, hsa
aaaaugaauuacacuguaucuuauaugaaguaaaaaauaaaucagaggugagaauauuguuac

SEQ ID NO: 629553 - RNA, 63 nt, hsa
cuugggacuuauguauauauauaccuuuuaaauaaaauaaauuuucuaaauaaaaaguugaaa

SEQ ID NO: 629554 - RNA, 63 nt, hsa
auuuuuuuuuacuguaaguauggaucaaauugcaaaauaaagaaaaaugccaaccuuagaaaa

SEQ ID NO: 629555 - RNA, 63 nt, hsa
cagagugagacuccaucucaaaaacugaaaauaaaaauaaaaauauguauucuccuaacugaa

SEQ ID NO: 629556 - RNA, 63 nt, hsa
gggugacagagugagacuccaucucaaaaacugaaaauaaaaauaaaaauauguauucuccua

SEQ ID NO: 629557 - RNA, 63 nt, hsa
gggcaacaacagcaaaacuccaucucaaaaaauaaaauaaauaaauaaacaaauaaaaaauuc

SEQ ID NO: 629558 - RNA, 63 nt, hsa
agccugggcaacaacagcaaaacuccaucucaaaaaauaaaauaaauaaauaaacaaauaaaa

SEQ ID NO: 629559 - RNA, 63 nt, hsa
caguuggaaaaccuuuucaggcccucagucuaaaaaauaaaaaauaugagcaccauugaauuc

SEQ ID NO: 629560 - RNA, 63 nt, hsa
gaaggacucauccagcaaaguugccugggauucaaaauaaaggcauugcagaccgcacaggug

SEQ ID NO: 629561 - RNA, 63 nt, hsa
guguauacacuacauuuguuuauaaccagaagcaaaauaaacucagcccacaaagcuagaauc

SEQ ID NO: 629562 - RNA, 63 nt, hsa
cuuaaagauuaacuacaaagauaaacauggccaaaaauaaauaaauaaauauggccauauguc

SEQ ID NO: 629563 - RNA, 50 nt, hsa; identical to SEQ ID NO: 62460

SEQ ID NO: 629564 - RNA, 63 nt, hsa
aucuuuuaugcaccaaaguuggucuugaaaaggaaaauaaaaucacuuucuugcuugguaagc

SEQ ID NO: 629565 - RNA, 63 nt, hsa
gagagcaaaucaaaaccucuauccagacaagacaaaauaaaacucaccaucuccugaagaccu

SEQ ID NO: 629566 - RNA, 63 nt, hsa
uauaggccauaaagaaugggacugcauuggaccaaaauaaaugggaaaaucgugguuugaaaa

SEQ ID NO: 629567 - RNA, 63 nt, hsa
uacauacuuuugcaaaauaaguaaauaauaaauaaaauaaaagccaaccuucaaagaaacuug

SEQ ID NO: 629568 - RNA, 63 nt, hsa
ugcguuaaauaagcaaauaaacaguggcucauaaaaauaaaagucgcauuccauaucuuugga

SEQ ID NO: 629569 - RNA, 63 nt, hsa
ugagaaguagauuguuacccaguaaugaaauaaaaaauaaaaauaaaaggauuuuuuucucua

SEQ ID NO: 629570 - RNA, 63 nt, hsa
guagauuguuacccaguaaugaaauaaaaaauaaaaauaaaaggauuuuuuucucuauuguuu

SEQ ID NO: 629571 - RNA, 63 nt, hsa
aauuguaaguuguuaacuccuguauauaucauuaaaauaaaucugaaguugaaguaguguuuu

SEQ ID NO: 629572 - RNA, 63 nt, hsa
aaccuuaggauuccugaaaagaauuucaaaaaaaaaauaaagacacuguugccaaugugaccc

SEQ ID NO: 629573 - RNA, 63 nt, hsa
aacauacuaauggcauauauuuguuacaauuaaaaaauaaauuuacuacuuaauccuauguug

SEQ ID NO: 629574 - RNA, 63 nt, hsa
cugaguauuuaugugaaaacucucuagaagguaaaaauaaagauaauucuucaaaugaagucu

SEQ ID NO: 629575 - RNA, 63 nt, hsa
uugguggugaggaggaagaacaaauaauagaagaaaauaaaaaugagauagaagaaaaguaag

SEQ ID NO: 629576 - RNA, 63 nt, hsa
aaauuuuaacauuggcaucuaaaguguuauuugaaaauaaaauuauuuuccuguucauugauu

SEQ ID NO: 629577 - RNA, 63 nt, hsa
aacuuauugugaaaguugugcuguuuucuaaguaaaauaaaaaauaaaaaauuagcaauuuau

SEQ ID NO: 629578 - RNA, 63 nt, hsa
ugugaaaguugugcuguuuucuaaguaaaauaaaaaauaaaaaauuagcaauuuaugauagcc

SEQ ID NO: 629579 - RNA, 63 nt, hsa
guaaguuauuaaaugguuaaucauggccuuuuaaaaauaaaauaaagugauaccuuuacaaug

SEQ ID NO: 629580 - RNA, 63 nt, hsa
uuauuaaaugguuaaucauggccuuuuaaaaauaaaauaaagugauaccuuuacaaugaagac

SEQ ID NO: 629581 - RNA, 63 nt, hsa
uuuucgacacuggacuggaagaacaagucuauaaaaauaaaaauggacaauuaacagugguga

SEQ ID NO: 629582 - RNA, 63 nt, hsa
gguuggagaacgaaugaauacaaauuuuauuguaaaauaaaaauguauauaaagcauaugagc

SEQ ID NO: 629583 - RNA, 63 nt, hsa
uuaaaaaauaauaauaaaaauuuaaaaaaauuaaaaauaaaaaaaaccacagaaaacaacuuu

SEQ ID NO: 629584 - RNA, 63 nt, hsa
uuguagaagagauugagaaugguacucuaaucaaaaauaaaguuuuguagugggaccagaaau

SEQ ID NO: 629585 - RNA, 63 nt, hsa
acgaugugcaauacauuuuuuucucuuuccuugaaaauaaaaagagaaacaaguauuuugcua

SEQ ID NO: 629586 - RNA, 63 nt, hsa
auaugauauuuuucaugcuccacuauuuuauuaaaaauaaaauauguucuuuaguuugcugcu

SEQ ID NO: 629587 - RNA, 63 nt, hsa
ugcuacuguuuuuccuuuuuuuacuaugacaggaaaauaaaugcaauuuuaguggaauugauu

SEQ ID NO: 629588 - RNA, 63 nt, hsa
uaaagggcauugauagcauaccaaacaaaaggcaaaauaaagugaccuuuuuauauauuuuuu

SEQ ID NO: 629589 - RNA, 63 nt, hsa
ucacugaaauauuuaugacagugcauaauuugcaaaauaaaaaauguacacuagcauaauauu

SEQ ID NO: 629590 - RNA, 63 nt, hsa
uaauuguuaauauggaauaagcucaaauaugucaaaauaaauguaaaaaaugaguguugccca

SEQ ID NO: 629591 - RNA, 63 nt, hsa
guaaccccuuuuuccuuucuucuguuuaaaauaaaaauaaaauuuaucucagcuucuguuagc

SEQ ID NO: 629592 - RNA, 63 nt, hsa
aaaaauguaaccccuuuuuccuuucuucuguuuaaaauaaaaauaaaauuuaucucagcuucu

SEQ ID NO: 629593 - RNA, 63 nt, hsa
cuuguuucaugaagagaaaggacuugcauaaccaaaauaaacaaagcaagacaaauuaaaaau

SEQ ID NO: 629594 - RNA, 63 nt, hsa
auaaagcaagucuaucaacauuaaaaauacuaaaaaauaaagacacacacagagcauuuuagu

SEQ ID NO: 629595 - RNA, 63 nt, hsa
uccuuuugauaaauuuaaaauguuacuuauuuuaaaauaaaugaagugagauggcauggugag

SEQ ID NO: 629596 - RNA, 63 nt, hsa
agucugauccauauuuaauaaugcuuuaaaauaaaaauaaaaacaauccuuuugauaaauuua

SEQ ID NO: 629597 - RNA, 63 nt, hsa
uuuucaagucugauccauauuuaauaaugcuuuaaaauaaaaauaaaaacaauccuuuugaua

SEQ ID NO: 629598 - RNA, 63 nt, hsa
augaaauaauuuuucuaggguaaugccguaggaaaaauaaaacuucacauuuauguggcuugu

SEQ ID NO: 629599 - RNA, 63 nt, hsa
uuaaauuuaacucugguuucuaccagcucauacaaaauaaaugguuucugaaaauguuuaagu

SEQ ID NO: 629600 - RNA, 62 nt, hsa
uacuaggguauugaauaaaucuagucuuacuagaaaauaaaaggagcuguuuuguggcuuug

SEQ ID NO: 629601 - RNA, 63 nt, hsa
aacacacucgauuaaaaauguuaagcuaucugaaaaauaaaaugugcaagucuucaggauggc

SEQ ID NO: 629602 - RNA, 63 nt, hsa
gagcaagacuccaucucaaaaaauaaauagauaaaaauaaaaacccauggaaaugguuuaaga

SEQ ID NO: 629603 - RNA, 63 nt, hsa
cagccugggcaacagagcaagacuccaucucaaaaaauaaauagauaaaaauaaaaacccaug

SEQ ID NO: 629604 - RNA, 63 nt, hsa
cuucaacuccuuuuggcaagaaaacuguaacagaaaauaaauuuugaauguguacuuaagucu

SEQ ID NO: 629605 - RNA, 63 nt, hsa
agucuuuuccucccagaacuuaaaguaaaauaaaaaauaaauaaauaaauaaaaucuuuucca

SEQ ID NO: 629606 - RNA, 63 nt, hsa
uuaaagaagucuuuuccucccagaacuuaaaguaaaauaaaaaauaaauaaauaaauaaaauc

SEQ ID NO: 629607 - RNA, 63 nt, hsa
auagcaauaaaaguuagacgaaguguagaaaauaaaauaaauuucauaauguuagucuuauug

SEQ ID NO: 629608 - RNA, 63 nt, hsa
cuauaauagcaauaaaaguuagacgaaguguagaaaauaaaauaaauuucauaauguuagucu

SEQ ID NO: 629609 - RNA, 63 nt, hsa
auuaaggaaguauaugaucugacuuuucagaagaaaauaaacaaaugcauuauguaaggucag

SEQ ID NO: 629610 - RNA, 63 nt, hsa
ucuuggacuccucagccuuuggacucauaagccaaaauaaaucuguuuucuuuauaaauugcc

SEQ ID NO: 629611 - RNA, 63 nt, hsa
aucacauaagacaucaugauaacauuugaagaaaaaauaaaacuguagacccuaacaguugug

SEQ ID NO: 629612 - RNA, 63 nt, hsa
uaaagugcuaaaguguaaaaaaaaauaaaaauaaaaauaaauaaauaaauaaaauuaaaaaaa

SEQ ID NO: 629613 - RNA, 63 nt, hsa
agggaauaaagugcuaaaguguaaaaaaaaauaaaaauaaaaauaaauaaauaaauaaaauua

SEQ ID NO: 629614 - RNA, 63 nt, hsa
aacuucagggaauaaagugcuaaaguguaaaaaaaaauaaaaauaaaaauaaauaaauaaaua

SEQ ID NO: 629615 - RNA, 63 nt, hsa
uauuuacauuuucacucaucuaaaaaguauacaaaaauaaaaaguggaaaaagguaucuucug

SEQ ID NO: 629616 - RNA, 63 nt, hsa
cuguuuuugucaaggaugguuguguauguguuuaaaauaaaaccuguggugcacauuucuacc

SEQ ID NO: 629617 - RNA, 63 nt, hsa
cccauugucccuuuauuuaggauauugaaagaaaaaauaaacuuuauguauuaguguccuuua

SEQ ID NO: 629618 - RNA, 63 nt, hsa
aucuguucauauuuaacuuuguguguggucugcaaaauaaacagcaggacagaaauuguguug

SEQ ID NO: 629619 - RNA, 63 nt, hsa
aaauuuguuguaaacugcauguuuuauaaaauaaaaauaaaauaucguuuguuauuuaucuca

SEQ ID NO: 629620 - RNA, 63 nt, hsa
uuuuaaaaauuuguuguaaacugcauguuuuauaaaauaaaaauaaaauaucguuuguuauuu

SEQ ID NO: 629621 - RNA, 63 nt, hsa
gggugacagagcgagaccaugucucaaaaaauaaaaauaaaaaaaaauuguuuucauuaccuc

SEQ ID NO: 629622 - RNA, 63 nt, hsa
cagccugggugacagagcgagaccaugucucaaaaaauaaaaauaaaaaaaaauuguuuucau

SEQ ID NO: 629623 - RNA, 63 nt, hsa
uaagccauaaaauaaauuuuauuccaaaauaacaaaauaaauaaucuacuguacacaaucuga

SEQ ID NO: 629624 - RNA, 63 nt, hsa
cucucaaggcaggggucauagauccuaagccauaaaauaaauuuuauuccaaaauaacaaaau

SEQ ID NO: 629625 - RNA, 63 nt, hsa
aaaaauaauaaugcagugguuguuucugucaggaaaauaaaucuuacagaacaacugguggaa

SEQ ID NO: 629626 - RNA, 63 nt, hsa
agauauggaugccuucuaacaauugcuguuuguaaaauaaaucaggaugguagaaagugauua

SEQ ID NO: 629627 - RNA, 63 nt, hsa
ccccauuuuacugcaaaguugacaagcucagggaaaauaaauaguuggccagaauuaagcaac

SEQ ID NO: 629628 - RNA, 63 nt, hsa
uaauuuuuauuuucagaaccauuuuacagauuuaaaauaaacagguuugaggaauuaguuuaa

SEQ ID NO: 629629 - RNA, 63 nt, hsa
ccauuaacuagucuugaaaugccuuuguuuguaaaaauaaaauaaugguacuuucauuuuaua

SEQ ID NO: 629630 - RNA, 63 nt, hsa
ucuuugaaacaauauuauuuugaaauuggcuuuaaaauaaaaccauucagauugaaauucuaa

SEQ ID NO: 629631 - RNA, 63 nt, hsa
gucccauuucaauuuccaccaugggagagccuaaaaauaaauuaugacauuuaguaucuaagg

SEQ ID NO: 629632 - RNA, 63 nt, hsa
uuccuuuuguauuuguaauguugauuaagauguaaaauaaaaagugugccugauuauuuuugc

SEQ ID NO: 629633 - RNA, 63 nt, hsa
gaugcuccugucaaaagggaaaugaggcuuuuaaaaauaaaguaccuuaauucuuuauugacu

SEQ ID NO: 629634 - RNA, 63 nt, hsa
auuuaaggaaauucuuuaggauaaccauuucaaaaaauaaaauugcuaugcaaucuugaauau

SEQ ID NO: 629635 - RNA, 63 nt, hsa
auguaaaauuuuuacuaaugucauuauuuugaaaaaauaaauuuaaaaauacauucaaaauua

SEQ ID NO: 629636 - RNA, 63 nt, hsa
uuaguaaagcuuuucuuuuuuaauuuccaggaaaaaauaaaaagaguaugagucuucuguaau

SEQ ID NO: 629637 - RNA, 63 nt, hsa
aaccuggcaaaaucuuguuaaugucauugcuaaaaaauaaauaaaagcuagauacuggaaacc

SEQ ID NO: 629638 - RNA, 63 nt, hsa
auccacacaaccaaguucaugggaauuuuguguaaaauaaaagauaacaugccugagggagag

SEQ ID NO: 629639 - RNA, 63 nt, hsa
uuugauacgccucaucuuauccuacauuauuggaaaauaaaugagauguccacacaaauggau

SEQ ID NO: 629640 - RNA, 63 nt, hsa
aguuagaccucaucucuacaaaaauaaaaaauaaaaauaaaaaaaacuuagcuaggcauguug

SEQ ID NO: 629641 - RNA, 63 nt, hsa
aaacauaguuagaccucaucucuacaaaaauaaaaaauaaaaauaaaaaaaacuuagcuaggc

SEQ ID NO: 629642 - RNA, 63 nt, hsa
agccuggaaacauaguuagaccucaucucuacaaaaauaaaaaauaaaaauaaaaaaaacuua

SEQ ID NO: 629643 - RNA, 63 nt, hsa
auaauauaaaauaaaaacuuaaaaaaaauuuaaaaaauaaaaaaaguuuuaaaaacugaucaa

SEQ ID NO: 629644 - RNA, 63 nt, hsa
uuaagggaaaaacuuuuacuuuguagauaauauaaaauaaaaacuuaaaaaaaauuuaaaaaa

SEQ ID NO: 629645 - RNA, 63 nt, hsa
aaagcuggugacauauuuauacguuuuugugcaaaaauaaaugaauggcaauagauuuuaaaa

SEQ ID NO: 629646 - RNA, 63 nt, hsa
ccaauucuaagcagaaaaagaaaaaaaacacaaaaaauaaaaaaccccuacaaaaaaacuuua

SEQ ID NO: 629647 - RNA, 63 nt, hsa
cgcagugaacuuaaagcaaagaccucuuaguaaaaaauaaaaaaaaauaaaaaauaaaaauaa

SEQ ID NO: 629648 - RNA, 63 nt, hsa
uuaaagcaaagaccucuuaguaaaaaauaaaaaaaaauaaaaaauaaaaauaaaaaaaguuaa

SEQ ID NO: 629649 - RNA, 63 nt, hsa
aaagaccucuuaguaaaaaauaaaaaaaaauaaaaaauaaaaauaaaaaaaguuaaauuuauu

SEQ ID NO: 629650 - RNA, 63 nt, hsa
cucuuaguaaaaaauaaaaaaaaauaaaaaauaaaaauaaaaaaaguuaaauuuauuuauaga

SEQ ID NO: 629651 - RNA, 63 nt, hsa
cgagaaacuaugggaaaaaaaauugcaaaaucuaaaauaaaaaaugcaaaaucuaaaauaaaa

SEQ ID NO: 629652 - RNA, 63 nt, hsa
auugcaaaaucuaaaauaaaaaaugcaaaaucuaaaauaaaaaauggaaaggaaacuuugaac

SEQ ID NO: 629653 - RNA, 63 nt, hsa
caacaagagcaaaacuccgucucaaaaaagaugaaaauaaaauaaaauauauauuuacaggcc

SEQ ID NO: 629654 - RNA, 63 nt, hsa
agagcaaaacuccgucucaaaaaagaugaaaauaaaauaaaauauauauuuacaggccuacaa

SEQ ID NO: 629655 - RNA, 63 nt, hsa
uauuguuguuuaucuuguuuggaaguguguuucaaaauaaacaugucuagaauuuaaaguuuu

SEQ ID NO: 629656 - RNA, 63 nt, hsa
aaacugguuccaauuuuuuggucauuucucagaaaaauaaaauacuuauaaauccuauauuuu

SEQ ID NO: 629657 - RNA, 63 nt, hsa
cauggaguuuuuaaaaauuguuauaauuaaguaaaaauaaagcugaauugugucauuugugua

SEQ ID NO: 629658 - RNA, 63 nt, hsa
cuccaaucaaggucuuguugauauuauauaguaaaaauaaaaccaaaaauaaauauuauucaa

SEQ ID NO: 629659 - RNA, 63 nt, hsa
ucuuguugauauuauauaguaaaaauaaaaccaaaaauaaauauuauucaaguggcucuucua

SEQ ID NO: 629660 - RNA, 63 nt, hsa
augguaucuaauuaauaacuagucugacaucagaaaauaaaauugaggcugauuuuuaaaaau

SEQ ID NO: 629661 - RNA, 63 nt, hsa
gaaacccacuguuaaaauuuaaaaaggugcuuuaaaauaaaacgccuauaaagauugugcagu

SEQ ID NO: 629662 - RNA, 63 nt, hsa
aaaaugugggaauaccaaauguccuuuauaagaaaaauaaauuuuauuuuaagggacauacua

SEQ ID NO: 629663 - RNA, 63 nt, hsa
ucuaacuauucagggacauuuuuccauuuccaaaaaauaaaauuuauuaugcuuuauaaccuc

SEQ ID NO: 629664 - RNA, 63 nt, hsa
ucucacguugugaggguuuuuuuuuucucauuuaaaauaaaaaaggaagaaagaaaauaauuu

SEQ ID NO: 629665 - RNA, 63 nt, hsa
cagcuacauuuucaacaaaaaagcaaacagagaaaaauaaaugaacuuuaacacuguaaguuc

SEQ ID NO: 629666 - RNA, 63 nt, hsa
gagucuuugaagcugaaaauauaaaacaaauaaaaaauaaaaaaauaaaaacccacaaaaaug

SEQ ID NO: 629667 - RNA, 63 nt, hsa
gaagcugaaaauauaaaacaaauaaaaaauaaaaaaauaaaaacccacaaaaauguugaacca

SEQ ID NO: 629668 - RNA, 63 nt, hsa
uuuguuaguuccuguaugaaagauugugggggaaaaauaaacgucgugccguuagcuuuuucc

SEQ ID NO: 629669 - RNA, 63 nt, hsa
ucaaaggcaagauaucauuuauuggacuucuugaaaauaaaaguuacaaaauccaacaacaac

SEQ ID NO: 629670 - RNA, 63 nt, hsa
gcauucuuauucacuuuaugccgguauuuagaaaaaauaaauuauagcaaguaugauuucuaa

SEQ ID NO: 629671 - RNA, 63 nt, hsa
uaauuucuuuuuuuaaaggaaauuaauauuaguaaaauaaacaccucuuuaauggaagcugca

SEQ ID NO: 629672 - RNA, 63 nt, hsa
uaaaaauugagagguuuccuuuuauuaacuuuuaaaauaaagaaauaaguaguuucauuacga

SEQ ID NO: 629673 - RNA, 63 nt, hsa
ucagcaggaauuacacauuagaaagaagccagaaaaauaaauggcauauauccaaucacaagu

SEQ ID NO: 629674 - RNA, 63 nt, hsa
gugacuacagucaacaauaacuuuauacauuuaaaaauaaaagaguguaauugggacguuugu

SEQ ID NO: 629675 - RNA, 63 nt, hsa
guuuguuaggaaauggaauggucucuuugauuuaaaauaaauaaaaauagauuauuacgucuu

SEQ ID NO: 629676 - RNA, 63 nt, hsa
uuuuccaaguguagcuaaaauauuuuugcagguaaaauaaagcugauaguacauguguuguuc

SEQ ID NO: 629677 - RNA, 63 nt, hsa
ccaaaagcuuucacugaagguuuuuuuuucuuaaaaauaaaaaaaaauauauaaguguaacau

SEQ ID NO: 629678 - RNA, 63 nt, hsa
cagucagacauucgucaugggaaaguucagaaaaaaauaaaguccuuuuaagggaacuuccug

SEQ ID NO: 629679 - RNA, 63 nt, hsa
ccaaucuggcaacagagcgagaccuugucuuuaaaaauaaaaauaaaaacaucuuuacaacau

SEQ ID NO: 629680 - RNA, 63 nt, hsa
uggcaacagagcgagaccuugucuuuaaaaauaaaaauaaaaacaucuuuacaacauuccugu

SEQ ID NO: 629681 - RNA, 63 nt, hsa
ugagaauuagaaaauaagggacaacagggguuaaaaauaaacugauuuaauuugcucuauagu

SEQ ID NO: 629682 - RNA, 63 nt, hsa
uugucacaaaguaguccauuccugaucucacuuaaaauaaaucacaaguaaauuugaauuuuc

SEQ ID NO: 629683 - RNA, 63 nt, hsa
ucugacgaacugccuggaggaggggaauauauaaaaauaaaauuggugucacuucuuuucugc

SEQ ID NO: 629684 - RNA, 63 nt, hsa
ccauacgcucauagucacauauggaauuuugagaaaauaaagcaugcugucuuuaggaauuuu

SEQ ID NO: 629685 - RNA, 63 nt, hsa
acuuuggauuuuucuacaaaggcagugguguccaaaauaaaaucucugcccuaaauuuuacua

SEQ ID NO: 629686 - RNA, 63 nt, hsa
uuuagaaacaucuuuagcccaaaguaacuaguaaaaauaaauggagugguauccuaucuucuu

SEQ ID NO: 629687 - RNA, 63 nt, hsa
agauuuuuuuuuucacaguugaguuaguuugugaaaauaaagaacucuguagcucaccaaggu

SEQ ID NO: 629688 - RNA, 63 nt, hsa
uuccaguuuugcuugacaguuucuaaacaaacaaaaauaaacucaaugaaaggaaagauguuu

SEQ ID NO: 629689 - RNA, 63 nt, hsa
aauucauacaacaucagugguuacagcuauacuaaaauaaaacuuuauaugcuaauuaucuuc

SEQ ID NO: 629690 - RNA, 63 nt, hsa
cuuuauaugcuaauuaucuucaagggucuuucuaaaauaaaagggguuguuaggcuacugcaa

SEQ ID NO: 629691 - RNA, 63 nt, hsa
acugcagaccucuaaacauaaguaggaaaaagaaaaauaaaagaauauuaccaauaauuaaag

SEQ ID NO: 629692 - RNA, 63 nt, hsa
gaccucaucauuaauaagugaagaauacaucagaaaauaaaauauucacucuccauuagaaaa

SEQ ID NO: 629693 - RNA, 63 nt, hsa
cucaauguuucuggacauucucuuugauaacaaaaaauaaauuuuaaaaaggaauuuuguaaa

SEQ ID NO: 629694 - RNA, 63 nt, hsa
aauuuaaauaucuuuuaaagaaaaaaacaccuaaaaauaaaucuuaacagaaaauucuguucu

SEQ ID NO: 629695 - RNA, 63 nt, hsa
uuaaccaauacauuuaaaauuguacagaacaaaaaaauaaaaucaaagacugaucuuguacag

SEQ ID NO: 629696 - RNA, 63 nt, hsa
auuuagucaucagagauacuuuccuaaaaaggaaaaauaaaaaacaaaauggugccacuuugg

SEQ ID NO: 629697 - RNA, 63 nt, hsa
auuuugagaugucauacuguacacuguauuguaaaaauaaaaaguaaaauuauauuucaaauu

SEQ ID NO: 629698 - RNA, 63 nt, hsa
cucuuuauugaagacaaacacucaccaaaaagaaaaauaaaaguuuucagagaaacuaauuuu

SEQ ID NO: 629699 - RNA, 63 nt, hsa
cuguaccaaacugauuucaaaaguacuacauugaaaauaaaccggugacuguuuuucuucaua

SEQ ID NO: 629700 - RNA, 63 nt, hsa
uauauauauaauauauacauauauacauaguguaaaauaaaauguuucuuggacaagaaaucc

SEQ ID NO: 629701 - RNA, 63 nt, hsa
ugcccuuuuuacccguugacguuuauuuuacguaaaauaaacuguuguuuccaaugcaaucaa

SEQ ID NO: 629702 - RNA, 63 nt, hsa
uggacacauuuggaucacauuuauacaguuauaaaaauaaagguuugauuuuggucguucuuc

SEQ ID NO: 629703 - RNA, 63 nt, hsa
cuaaaaccucuuuaaaaacggucaguuaacuaaaaaauaaaaaucaagucuuuaggagaguag

SEQ ID NO: 629704 - RNA, 63 nt, hsa
ugccuaaaagagaagguaucuagaaaugccuuuaaaauaaauucagaguaccagaaaggguau

SEQ ID NO: 629705 - RNA, 63 nt, hsa
cccuaaaaugcuagaauaauaauaaaaaggccaaaaauaaaauuguuucucucucaaccacuu

SEQ ID NO: 629706 - RNA, 63 nt, hsa
gcaaauagguaucaucaaugaguuaaccaucuaaaaauaaaagaguggaagcccuaaaaugcu

SEQ ID NO: 629707 - RNA, 63 nt, hsa
uuccuaagaggucuagaaaugcuuaaacuauugaaaauaaaucaaauuauucaaagacuggau

SEQ ID NO: 629708 - RNA, 63 nt, hsa
aaaaauagcauagaaaucauauauuuauuucauaaaauaaauagaaacuuugucuccuguguu

SEQ ID NO: 629709 - RNA, 63 nt, hsa
guauauugguucgaaaucccagggaaaaaaauaaaaauaaaaaauuaaaggauuguugauaac

SEQ ID NO: 629710 - RNA, 63 nt, hsa
cuaggaguauauugguucgaaaucccagggaaaaaaauaaaaauaaaaaauuaaaggauuguu

SEQ ID NO: 629711 - RNA, 63 nt, hsa
aguagaucaaaauagaacacaauagagaacuucaaaauaaaacaggugugagaauugugugug

SEQ ID NO: 629712 - RNA, 63 nt, hsa
gauugacuauaccaaacauuauauuaaaaacacaaaauaaaaacuauaaaaauguacuuuagg

SEQ ID NO: 629713 - RNA, 63 nt, hsa
agccagaccuugucucaaaaaauaaaaaauaaaaaaauaaaaacaaaauaaggaauccuuuua

SEQ ID NO: 629714 - RNA, 63 nt, hsa
agagagagagccagaccuugucucaaaaaauaaaaaauaaaaaaauaaaaacaaaauaaggaa

SEQ ID NO: 629715 - RNA, 63 nt, hsa
gccugagagagagagagccagaccuugucucaaaaaauaaaaaauaaaaaaauaaaaacaaaa

SEQ ID NO: 629716 - RNA, 63 nt, hsa
cuuaaaacuguggauuggccuaggcuaaggacaaaaauaaacuaaguaccuguaguguauuua

SEQ ID NO: 629717 - RNA, 63 nt, hsa
uaguuuuucuaaauagacccuuaugggaguuugaaaauaaauacucacauauuucacuacuua

SEQ ID NO: 629718 - RNA, 63 nt, hsa
guaugagauagaaaaauuuuuauuacucaaaguaaaauaaauggaaauaucacugagcaguug

SEQ ID NO: 629719 - RNA, 63 nt, hsa
cuuaugauucagcagcuuggucacuugauuagaaaaauaaaccauuguuucuucaauugugac

SEQ ID NO: 629720 - RNA, 63 nt, hsa
gguguugagauuuacguggaacccuaaagcaguaaaauaaaaaaccugguugcagcacauuca

SEQ ID NO: 629721 - RNA, 63 nt, hsa
gaucuuuuguccauuccauuaauaacugaauaaaaaauaaauaaaauggauagaaaaaaacua

SEQ ID NO: 629722 - RNA, 63 nt, hsa
aagcauucugugauccccugguuacugaguuaaaaaauaaaaaaguacgaguuagacauauga

SEQ ID NO: 629723 - RNA, 63 nt, hsa
aaauaauuuugccuucuaggcuguugcucuaacaaaauaaaccuuagacauaucacaccuaaa

SEQ ID NO: 629724 - RNA, 63 nt, hsa
cucaggaccagccuagagagaucccaucucuaaaaaauaaaauauaagaaaauaaaacuuagg

SEQ ID NO: 629725 - RNA, 63 nt, hsa
gagagaucccaucucuaaaaaauaaaauauaagaaaauaaaacuuaggggauauacagauuua

SEQ ID NO: 629726 - RNA, 63 nt, hsa
ggauuguaggcaaacccaccuguggcaucacugaaaauaaauuugaucauaccuaagagguua

SEQ ID NO: 629727 - RNA, 63 nt, hsa
cugugugacuuggcuagaguugggaguucccccaaaauaaacguguccccauuuuaccagaac

SEQ ID NO: 629728 - RNA, 63 nt, hsa
cuccccuaauuuuuauucccagugccgauguucaaaauaaacuuucuccagucugggaaccuu

SEQ ID NO: 629729 - RNA, 63 nt, hsa
ugugcuuaauguaaagccgcuuuauaaaacuguaaaauaaaguuuuuuucuuaaaaagaauau

SEQ ID NO: 629730 - RNA, 63 nt, hsa
uaauaugaaauaacagacuaacauuuuaggggaaaaauaaauacaauuuagacucuaaaaagu

SEQ ID NO: 629731 - RNA, 63 nt, hsa
ucccuacaaugggaaaugucacaagaaugugcaaaaauaaaaaucugaggaaaaaacccacau

SEQ ID NO: 629732 - RNA, 63 nt, hsa
augugauguuguuaauuucuuuuauugcauuauaaaauaaaaggauuauguauuuuuaacuaa

SEQ ID NO: 629733 - RNA, 63 nt, hsa; identical to SEQ ID NO: 62630

SEQ ID NO: 629734 - RNA, 63 nt, hsa
aucaggucuccuaacuaccccaguuuguaaggaaaaauaaaaguuuuuauaaaauuaaaaaaa

SEQ ID NO: 629735 - RNA, 63 nt, hsa
aggaacacauaaguaaguugcuuuggugccaagaaaauaaaaaagcuauuaucaggucuccua

SEQ ID NO: 629736 - RNA, 63 nt, hsa
uuaaaauucuuggaaaauuuucagaauacuuuaaaaauaaaguuccaaguuacacaguuuggc

SEQ ID NO: 629737 - RNA, 63 nt, hsa
guauuguugaaucaauuacuuugguuucaugaaaaaauaaacgauaaauaucuuuaaagagaa

SEQ ID NO: 629738 - RNA, 63 nt, hsa
gauuaaaccaauugcagaucaaaaauauuagaaaaaauaaaaauaauacaaauaaaaauacag

SEQ ID NO: 629739 - RNA, 63 nt, hsa
cauuugccuauaaauaccuguaaacgacuuuaaaaaauaaaugauuauugcuuugugacaauu

SEQ ID NO: 629740 - RNA, 63 nt, hsa
uuucuguuuagcagcauuuuucacugcaauguuaaaauaaauaugacauugaauucgaacugu

SEQ ID NO: 629741 - RNA, 63 nt, hsa
uauggguacaacguauguucauuauuuguacauaaaauaaaaccauuuaaaaaguaaugcuga

SEQ ID NO: 629742 - RNA, 63 nt, hsa
acuaauggcaaaaauucauggcuagugauguauaaaauaaaauauucuuugcaguaaaauauu

SEQ ID NO: 629743 - RNA, 63 nt, hsa
cuuacugauuaauuuuuaacaagguagaauuuuaaaauaaaagauuuauaaauaacuuuuguu

SEQ ID NO: 629744 - RNA, 63 nt, hsa
uucuguugagggcaaaauauuauaaaucuauagaaaauaaacuguuugacuugaaucauuucu

SEQ ID NO: 629745 - RNA, 63 nt, hsa
cgcuauuuaaguuaaauuuaaaugaaauaaaauaaaauaaaaucaguuccugagucacacaau

SEQ ID NO: 629746 - RNA, 63 nt, hsa
agugucgcuauuuaaguuaaauuuaaaugaaauaaaauaaaauaaaaucaguuccugagucac

SEQ ID NO: 629747 - RNA, 63 nt, hsa
auguucacugugcagagggauuguaccuuguacaaaauaaaacaaauuucucaaacuaauuua

SEQ ID NO: 629748 - RNA, 63 nt, hsa
acaauacuuugggcaauaaucagaaaaagcaaaaaaauaaauaaaugaguacaucuccccuuc

SEQ ID NO: 629749 - RNA, 63 nt, hsa
gggcaauagcaagacuccaucucaaaauaaaauaaaauaaaacuuagagcaaaguuuaaaacu

SEQ ID NO: 629750 - RNA, 63 nt, hsa
agcuugggcaauagcaagacuccaucucaaaauaaaauaaaauaaaacuuagagcaaaguuua

SEQ ID NO: 629751 - RNA, 63 nt, hsa
acuccagcuugggcaauagcaagacuccaucucaaaauaaaauaaaauaaaacuuagagcaaa

SEQ ID NO: 629752 - RNA, 63 nt, hsa
guuucacaaguuuugggccaccuauuucaauaaaaaauaaaauauaaauuaaaaaaguugccg

SEQ ID NO: 629753 - RNA, 63 nt, hsa
uuucuuuuuacacuaauaacuuuuaugccuuuuaaaauaaauuuauuuucauaaaugguuugc

SEQ ID NO: 629754 - RNA, 63 nt, hsa
ggucuuucugggccuuacugugcugguauaauuaaaauaaaauauauuuuguucuauugguag

SEQ ID NO: 629755 - RNA, 63 nt, hsa
caaauguaauuuuaugucugcuuuaaggaaaauaaaauaaaauauuaauaggaguugugagcc

SEQ ID NO: 629756 - RNA, 63 nt, hsa
ucuuccaaauguaauuuuaugucugcuuuaaggaaaauaaaauaaaauauuaauaggaguugu

SEQ ID NO: 629757 - RNA, 63 nt, hsa
uacuauaacucugaucuuccauugagaauaacaaaaauaaauaucaauuuuacaccucauaug

SEQ ID NO: 629758 - RNA, 63 nt, hsa
gauuaauuuagauuagaaucauuaacaucaugaaaaauaaaaguacuacauuucuaacguauu

SEQ ID NO: 629759 - RNA, 63 nt, hsa
ugauguauaaaaaaguggauucaccuguuuuuaaaaauaaaacauugauaaaagguguuugga

SEQ ID NO: 629760 - RNA, 63 nt, hsa
auauauuuauauuuuugggggugggagaaauccaaaauaaaguaaaugcuuguuucauuuuua

SEQ ID NO: 629761 - RNA, 63 nt, hsa
agacaaagcauugacuuuuaaauguagacuuuuaaaauaaacuguuuucuuuuggaacuacaa

SEQ ID NO: 629762 - RNA, 63 nt, hsa
augugaaguuagugagucuuuuuguguuacuccaaaauaaaggcaaugauuuauuuuuuuccc

SEQ ID NO: 629763 - RNA, 63 nt, hsa
cagccuggaccacagagcaagacccuguguaaaaaaauaaaauaaaaaacagauuggaugucu

SEQ ID NO: 629764 - RNA, 63 nt, hsa
uggaccacagagcaagacccuguguaaaaaaauaaaauaaaaaacagauuggaugucuuucuu

SEQ ID NO: 629765 - RNA, 63 nt, hsa
gugagccacugugcccagccuaagccauuucuuaaaauaaaaaugcuaaaggacuaguaagua

SEQ ID NO: 629766 - RNA, 63 nt, hsa
cuuaaaauaaaaaugcuaaaggacuaguaaguaaaaauaaaacuuccuaugggauuucccagu

SEQ ID NO: 629767 - RNA, 63 nt, hsa
ggacuuuuacuuuuuauuacauaaaaauauuaaaaaauaaauaaaaaaaauaaaauuuuaaac

SEQ ID NO: 629768 - RNA, 63 nt, hsa
uuauuacauaaaaauauuaaaaaauaaauaaaaaaaauaaaauuuuaaacuaacuuaaccugc

SEQ ID NO: 629769 - RNA, 63 nt, hsa
gccuggaugacaagcaagacccucccuccaaagaaaauaaagcucaaaauaaaauaugauuug

SEQ ID NO: 629770 - RNA, 63 nt, hsa
agcaagacccucccuccaaagaaaauaaagcucaaaauaaaauaugauuuguguucauguaga

SEQ ID NO: 629771 - RNA, 63 nt, hsa
cugggcaacacagcgagacuccgucucaaggaaaaaauaaaaauaaaaagcgggcacgggccc

SEQ ID NO: 629772 - RNA, 63 nt, hsa
aacacagcgagacuccgucucaaggaaaaaauaaaaauaaaaagcgggcacgggcccgugaca

SEQ ID NO: 629773 - RNA, 63 nt, hsa
aacaagcaacaccuuaaaagaguuuuauuucugaaaauaaauuaauuuuuuguaaauaaaaug

SEQ ID NO: 629774 - RNA, 63 nt, hsa
aaauaaauuaauuuuuuguaaauaaaauguuuaaaaauaaaaaagaaacuaaaguuacuugua

SEQ ID NO: 629775 - RNA, 63 nt, hsa
aaagaaaacaaaauauaagggaaaaauaugagaaaaauaaaaauaaaaagagaauaauaggcc

SEQ ID NO: 629776 - RNA, 63 nt, hsa
aacaaaauauaagggaaaaauaugagaaaaauaaaaauaaaaagagaauaauaggccaggcac

SEQ ID NO: 629777 - RNA, 63 nt, hsa
uguccguucaucccugagaggucugaaagaauaaaaauaaauucuaaaaaaagccucugucug

SEQ ID NO: 629778 - RNA, 63 nt, hsa
cucuauaacugcagaaauuagauaauguuuuauaaaauaaauuugccacauaauaugggaugc

SEQ ID NO: 629779 - RNA, 63 nt, hsa
cucuuuuguaaauuacaguuauuucaguauuguaaaauaaauguugacucauuucaugcaggu

SEQ ID NO: 629780 - RNA, 63 nt, hsa
agcacucuggugcgggaagaagcagaagcaaaaaaaauaaaaauaaaaaaauaaauaaaaaua

SEQ ID NO: 629781 - RNA, 63 nt, hsa
cuggugcgggaagaagcagaagcaaaaaaaauaaaaauaaaaaaauaaauaaaaauaaaaaaa

SEQ ID NO: 629782 - RNA, 63 nt, hsa
ggaagaagcagaagcaaaaaaaauaaaaauaaaaaaauaaauaaaaauaaaaaaaauaaaaaa

SEQ ID NO: 629783 - RNA, 63 nt, hsa
gaagcaaaaaaaauaaaaauaaaaaaauaaauaaaaauaaaaaaaauaaaaaaggaaaaaaaa

SEQ ID NO: 629784 - RNA, 63 nt, hsa
aaaauaaaaauaaaaaaauaaauaaaaauaaaaaaaauaaaaaaggaaaaaaaaaaaagaaga

SEQ ID NO: 629785 - RNA, 63 nt, hsa
uguguacaaagagaugugaaauacuuucaggcaaaaauaaacuguaagugacucaucaauguc

SEQ ID NO: 629786 - RNA, 63 nt, hsa
ugugugaauugacuaccguuguuugcaaacccgaaaauaaaagacguucauuauguaugaaaa

SEQ ID NO: 629787 - RNA, 63 nt, hsa
aacauauagaaugcagagauuuuuuuuuccauuaaaauaaauggguauuggugguuaaaacug

SEQ ID NO: 629788 - RNA, 63 nt, hsa
aguuucaggaaugaaguagaagguaguuauuuaaaaauaaaaaacacaguccgucccuaccaa

SEQ ID NO: 629789 - RNA, 63 nt, hsa
gaaacuuccagugugaguugaccccaucauuuaaaaauaaaguccccggguuccuuaaugccu

SEQ ID NO: 629790 - RNA, 63 nt, hsa
ccagccugggcaacagagcuagacucugugucaaaaauaaaugacuagauaaaaaaaaaaauu

SEQ ID NO: 629791 - RNA, 63 nt, hsa
caguacugacuguguaagcuaaauugcugauccaaaauaaaaacccagacuagaauaggguuc

SEQ ID NO: 629792 - RNA, 63 nt, hsa
caacauagugagauucuguuaaaaaaauaaaauaaaauaaaaccaauuuuuaaaaagagaaua

SEQ ID NO: 629793 - RNA, 63 nt, hsa
cugggcaacauagugagauucuguuaaaaaaauaaaauaaaauaaaaccaauuuuuaaaaaga

SEQ ID NO: 629794 - RNA, 63 nt, hsa
ccaaccugggcaacauagugagauucuguuaaaaaaauaaaauaaaauaaaaccaauuuuuaa

SEQ ID NO: 629795 - RNA, 63 nt, hsa
ccuaggcaacauagugagacccugucucuacuaaaaauaaauuuaaaaaaaauuagcugagug

SEQ ID NO: 629796 - RNA, 63 nt, hsa
auuuccauccuguauuugcauaauacuugucuuaaaauaaaagcuuuuaugauugggaauuua

SEQ ID NO: 629797 - RNA, 63 nt, hsa
guaaaagggaaauuugaacaacaaaaaccaaaaaaaauaaaaauaaaaaacuucaaaaguuga

SEQ ID NO: 629798 - RNA, 63 nt, hsa
gggaaauuugaacaacaaaaaccaaaaaaaauaaaaauaaaaaacuucaaaaguugacaagaa

SEQ ID NO: 629799 - RNA, 63 nt, hsa
aaguugcuugagccaagugcuuaaaaaguuaauaaaauaaaaugaucuguaugauaccugcaa

SEQ ID NO: 629800 - RNA, 63 nt, hsa
aaaacuuuguguuuuggcaaucguuuuauaacuaaaauaaaaugaaagcuaaaucuacacgcu

SEQ ID NO: 629801 - RNA, 63 nt, hsa
aaaccacuggaaaacaugcauuuuggaaacuuuaaaauaaaugguuaacauggcauuucuaag

SEQ ID NO: 629802 - RNA, 63 nt, hsa
auaguaaggucaagaagaguaucaaaguauaauaaaauaaaaauuguauacucuccauauauu

SEQ ID NO: 629803 - RNA, 63 nt, hsa
gaaaucuugauugcuuccaguuuucagugauuaaaaauaaagccgcuauaaacauuugugugc

SEQ ID NO: 629804 - RNA, 63 nt, hsa
ucuagugccuugguuuucuuucuugaugcuggaaaaauaaacaaaccgguauugaguguuuag

SEQ ID NO: 629805 - RNA, 63 nt, hsa
cguagggaggcccugagaacuaaauuuugccccaaaauaaaaacagaaauuaugagauugccu

SEQ ID NO: 629806 - RNA, 63 nt, hsa
ucuauugaaaaaggaaaaucagcaauucagcaaaaaauaaauaaaaaauaaaaauguaaauau

SEQ ID NO: 629807 - RNA, 63 nt, hsa
aggaaaaucagcaauucagcaaaaaauaaauaaaaaauaaaaauguaaauaugauaguaauaa

SEQ ID NO: 629808 - RNA, 63 nt, hsa
ggagagagagagagaugcuguugagcacaugacaaaauaaaauaaaauggaugauucauucuu

SEQ ID NO: 629809 - RNA, 63 nt, hsa
gagagagagaugcuguugagcacaugacaaaauaaaauaaaauggaugauucauucuuaagug

SEQ ID NO: 629810 - RNA, 63 nt, hsa
uaaugagacaacuuguuaaucucuuuaauacuaaaaauaaauuacucuucuauuucagggacu

SEQ ID NO: 629811 - RNA, 63 nt, hsa
auuacucuucuauuucagggacuuagguaauuuaaaauaaaccuucaauuuauggucuucugu

SEQ ID NO: 629812 - RNA, 63 nt, hsa
guuaacucauuucucaugccauuagcucucuacaaaauaaagcaaaguaguucuagugugguc

SEQ ID NO: 629813 - RNA, 63 nt, hsa
uugccugcuaaacaaguuagaauaggaaauaguaaaauaaauccaaacaagaguguaauauug

SEQ ID NO: 629814 - RNA, 63 nt, hsa
aaugucauuacauagaacacuucagacacaggaaaaauaaacguggauuuuaaaaaaucaauc

SEQ ID NO: 629815 - RNA, 63 nt, hsa
aucuacauaaaugauuuacagguuaaaagaauaaaaauaaagguaacuuuaccuuucuuaaau

SEQ ID NO: 629816 - RNA, 63 nt, hsa
uagugagagacccuguaucugaaaguaauaauaaaaauaaaaaauauaaaugaggucucguug

SEQ ID NO: 629817 - RNA, 63 nt, hsa
agccugggcaacaaagcaagacucugucucaaaaaaauaaaaauaaaaaaaaaaucuuaguuc

SEQ ID NO: 629818 - RNA, 63 nt, hsa
ggcaacaaagcaagacucugucucaaaaaaauaaaaauaaaaaaaaaaucuuaguuccaugga

SEQ ID NO: 629819 - RNA, 63 nt, hsa
guauuaaaauucaacuauggauguauaugaaacaaaauaaauggagauaauuuuucucccaca

SEQ ID NO: 629820 - RNA, 63 nt, hsa
ucuuuuguacguaauaggacauuucauccuagaaaaauaaaguaauguuuuugacauuggauu

SEQ ID NO: 629821 - RNA, 63 nt, hsa
uaagaauuaaaaaaauacaaaaaagaaaaaaugaaaauaaaggaauaagaaguuaccuacucc

SEQ ID NO: 629822 - RNA, 63 nt, hsa
ccaacagaguaaaguggaaggaaguuuauucagaaaauaaaggaguaucacagcucuuuuaga

SEQ ID NO: 629823 - RNA, 63 nt, hsa
uuucaaauacaccuuuuugaucauuaaaauaaaaaaauaaaucuugcucuguuguauaagauc

SEQ ID NO: 629824 - RNA, 63 nt, hsa
cauagugcuuucaaauacaccuuuuugaucauuaaaauaaaaaaauaaaucuugcucuguugu

SEQ ID NO: 629825 - RNA, 63 nt, hsa
uuuguagaaauguaaagauuacuugagguguuuaaaauaaauuuuucauucagacuaccuuug

SEQ ID NO: 629826 - RNA, 63 nt, hsa
gcucuuacgaaaaacccagguuagaccgcauaaaaaauaaagugaacagugaggugguagcaa

SEQ ID NO: 629827 - RNA, 63 nt, hsa
acuuccagaauagugauuuuaaaaguaaaaauaaaaauaaaccuuacuuacaagcauaacaga

SEQ ID NO: 629828 - RNA, 63 nt, hsa
ucuuuaacuuccagaauagugauuuuaaaaguaaaaauaaaaauaaaccuuacuuacaagcau

SEQ ID NO: 629829 - RNA, 63 nt, hsa
uaagaaacucuaaagguuauaaaaugaaaacaaaaaauaaaauauuuguuuucugcuagaugc

SEQ ID NO: 629830 - RNA, 61 nt, hsa
guaucuaaaggauggaaaaauaaaacgcaauuaaaaauaaacagaugcccuauuuucugug

SEQ ID NO: 629831 - RNA, 63 nt, hsa
ccuuuuacauucuguguguaucuaaaggauggaaaaauaaaacgcaauuaaaaauaaacagau

SEQ ID NO: 629832 - RNA, 63 nt, hsa
guucuaggggguugaacuacauaguaaaaaaauaaaauaaauaguacuuaguguaaaauaauu

SEQ ID NO: 629833 - RNA, 63 nt, hsa
aaacaguucuaggggguugaacuacauaguaaaaaaauaaaauaaauaguacuuaguguaaaa

SEQ ID NO: 629834 - RNA, 63 nt, hsa
gaauuaaaaccaaucauaaguagaacccacuucaaaauaaaaaaacagcauuacuauuucuaa

SEQ ID NO: 629835 - RNA, 63 nt, hsa
uaaucuucauuuuaguauuuaugcuuagaugugaaaauaaauguuauuuguugaucauuucua

SEQ ID NO: 629836 - RNA, 63 nt, hsa
uuguccagccuauugcaggcuuuuccugacuuuaaaauaaauugugaucaauaauaguaccuu

SEQ ID NO: 629837 - RNA, 63 nt, hsa
ucaucucacaguaaagccuauuuccccaggaaaaaaauaaaugccuuugaaugaaaauucuga

SEQ ID NO: 629838 - RNA, 63 nt, hsa
uaauguuuuaagcuuaauagccuuugcacuuuuaaaauaaaaaccaaguaugcaaaucaaaga

SEQ ID NO: 629839 - RNA, 63 nt, hsa
caucuaggagcaaggugagaaaucacaaugagaaaaauaaauggaaacaccacugcuagggga

SEQ ID NO: 629840 - RNA, 63 nt, hsa
ucaagcacuccuaccuuaauuauugcacuagagaaaauaaauuccaaauuaggaaguguuucc

SEQ ID NO: 629841 - RNA, 63 nt, hsa
uucugguauuuugacauguuauaauacgcaaguaaaauaaaacaauaguuuacucagcucaug

SEQ ID NO: 629842 - RNA, 63 nt, hsa
gcaaaacauaaauuaaaacucaaaugccaggacaaaauaaaacaauauaccagauggagagga

SEQ ID NO: 629843 - RNA, 63 nt, hsa
cugugaccuaguuggugcaguggcuugaaugccaaaauaaagcgugugcacuggauagugugu

SEQ ID NO: 629844 - RNA, 63 nt, hsa
gaaccuccauauacauuaauuuuuuucugccuaaaaauaaaauugcguuguggcagcaauuug

SEQ ID NO: 629845 - RNA, 63 nt, hsa
acauuuacguuguuaccaagauuuuugcuauugaaaauaaaguuuuuaugaauauuuauauau

SEQ ID NO: 629846 - RNA, 63 nt, hsa
aaaaguggaaugggauauggcuuuugguaccugaaaauaaaugcuuuaauaauuguaagccag

SEQ ID NO: 629847 - RNA, 63 nt, hsa
cagaaauucucaaucacugaaaugaguaacugcaaaauaaauaguugauuguacuguucucau

SEQ ID NO: 629848 - RNA, 63 nt, hsa
uuaagagcucaauuugaaaaaucuguuacuaaaaaaauaaauuguaugucgauugaauuguac

SEQ ID NO: 629849 - RNA, 63 nt, hsa
uuccucugaaccccaaacuguaaauggcugucuaaaauaaagacauucauguuuguuaaaaac

SEQ ID NO: 629850 - RNA, 63 nt, hsa
ccuauggcacaaauuguaaaccuuuguuuuucuaaaauaaaguaauugaaaaccugcaauugu

SEQ ID NO: 629851 - RNA, 63 nt, hsa
auggggaaaaaaagucuugugauugacuuucgcaaaauaaacaggauuuacugaguagagguu

SEQ ID NO: 629852 - RNA, 63 nt, hsa
cuauguaaaaauaaaauucaaacgcccaggauuaaaauaaaauauaaucugaaaaccucaugu

SEQ ID NO: 629853 - RNA, 63 nt, hsa
guuuugagggaauauacuaaaugcagcuauguaaaaauaaaauucaaacgcccaggauuaaaa

SEQ ID NO: 629854 - RNA, 63 nt, hsa
gccugggcgacagagcaagacucugucucaaaaaaaauaaaaaauaaucagggcacaguggcu

SEQ ID NO: 629855 - RNA, 63 nt, hsa
ccagccugggcaacaagagcaaaacuccgucucaaaauaaaaagaaaagaaaagaauggacag

SEQ ID NO: 629856 - RNA, 63 nt, hsa
cugggcaauauagugaggcucccaucuguacuaaaaauaaaaaaguuaggcguggcgaugugc

SEQ ID NO: 629857 - RNA, 63 nt, hsa
gggcuucugcauccauucccucuuuuuguuuuuaaaauaaauuguauuuuugaaucaaggagg

SEQ ID NO: 629858 - RNA, 63 nt, hsa
cagccugggggacagagcacgacccugucuccaaaaauaaaauaaaaauaaaaauaaauauug

SEQ ID NO: 629859 - RNA, 63 nt, hsa
ugggggacagagcacgacccugucuccaaaaauaaaauaaaaauaaaaauaaauauuggcggg

SEQ ID NO: 629860 - RNA, 63 nt, hsa
acagagcacgacccugucuccaaaaauaaaauaaaaauaaaaauaaauauuggcgggggaacc

SEQ ID NO: 629861 - RNA, 63 nt, hsa
cacgacccugucuccaaaaauaaaauaaaaauaaaaauaaauauuggcgggggaacccucugg

SEQ ID NO: 629862 - RNA, 63 nt, hsa
agccugggcaauauagcaagaccccucacuacaaaaauaaaacaucaaaaacaaaaacaauua

SEQ ID NO: 629863 - RNA, 63 nt, hsa
ccaggcuggguaacagaaugagaccuuaucucaaaaauaaacaaacuaauaaaaagcaaaaaa

SEQ ID NO: 629864 - RNA, 63 nt, hsa
cccugaaugacugcauggauagaaccacuaagaaaaauaaacuuuuauauuuuuauagcuacu

SEQ ID NO: 629865 - RNA, 63 nt, hsa
ccuggucgacagagugagacuccaucucaagaaaaaauaaaaauaaaguuguucucugaagag

SEQ ID NO: 629866 - RNA, 63 nt, hsa
cgacagagugagacuccaucucaagaaaaaauaaaaauaaaguuguucucugaagagcaaaug

SEQ ID NO: 629867 - RNA, 63 nt, hsa
cuuaguccaucagcaucuuauucuggguaauaaaaaauaaaaauaaacggauaccuguuuucc

SEQ ID NO: 629868 - RNA, 63 nt, hsa
ccaucagcaucuuauucuggguaauaaaaaauaaaaauaaacggauaccuguuuuccacugcu

SEQ ID NO: 629869 - RNA, 63 nt, hsa
uuuauacgaaaauauauuuucaaagguguaguaaaaauaaaaaaaauuuuaauccaaauuugu

SEQ ID NO: 629870 - RNA, 63 nt, hsa
gaauauucuacuaaaugagaguucugaguauagaaaauaaaacuaaaguugguagaaaaauua

SEQ ID NO: 629871 - RNA, 63 nt, hsa
aauaacauuuaggaagcaaauagauuaaacacaaaaauaaaacuaaagcauaggaauuauguu

SEQ ID NO: 629872 - RNA, 63 nt, hsa
uuuaaauauaauuuuauuucuuucaacaaauauaaaauaaaaaacaacuuuggaacaaugacu

SEQ ID NO: 629873 - RNA, 63 nt, hsa
auugcugggaauauuugacucuccguauuggagaaaauaaaauuacaacauuacgacauacua

SEQ ID NO: 629874 - RNA, 63 nt, hsa
aguuuuuauaccuuaaaaagacugguagcauauaaaauaaaucuuaaaagcuaauuauacaca

SEQ ID NO: 629875 - RNA, 63 nt, hsa
ccugggcgacagagugagacucccucucaaaagaaaauaaaaauaaaaauaaacuggccaggu

SEQ ID NO: 629876 - RNA, 63 nt, hsa
cgacagagugagacucccucucaaaagaaaauaaaaauaaaaauaaacuggccaggugcggug

SEQ ID NO: 629877 - RNA, 63 nt, hsa
agugagacucccucucaaaagaaaauaaaaauaaaaauaaacuggccaggugcgguggcucac

SEQ ID NO: 629878 - RNA, 63 nt, hsa
ccugggcaagagagagagacuuugucucuauuaaaaauaaaaaugauuggccgagcauggugg

SEQ ID NO: 629879 - RNA, 63 nt, hsa
acaggcugcaccauaagacccacucacaauaaaaaaauaaaaggccgagccgggcaugguugc

SEQ ID NO: 629880 - RNA, 63 nt, hsa
gagccgggcaugguugcucacucccguaauaaaaaaauaaaagaacaggcugagccgggcaug

SEQ ID NO: 629881 - RNA, 63 nt, hsa
uucugcaaagauaaauaauaucccugcauuaucaaaauaaaguagcagaccucucaauucaca

SEQ ID NO: 629882 - RNA, 63 nt, hsa
auuaaugauacaugaaucuuggccacaaugagaaaaauaaaaaugaaaaaagagcaggcaucc

SEQ ID NO: 629883 - RNA, 63 nt, hsa
aacaagagcgaaacucugucucaaaauaaauaaaaaauaaaagacagaaagcaaggggugccu

SEQ ID NO: 629884 - RNA, 63 nt, hsa
ccagccugggcaacaagagcgaaacucugucucaaaauaaauaaaaaauaaaagacagaaagc

SEQ ID NO: 629885 - RNA, 63 nt, hsa
gugacagaaugagacucugugucaaaaaaauaaaaaauaaaaaaucuaagggcucaggaacca

SEQ ID NO: 629886 - RNA, 63 nt, hsa
agccugggugacagaaugagacucugugucaaaaaaauaaaaaauaaaaaaucuaagggcuca

SEQ ID NO: 629887 - RNA, 63 nt, hsa
uuaaagguauuuauuagaaaucaaagaacacucaaaauaaacucagugcucaaaggguuaagu

SEQ ID NO: 629888 - RNA, 63 nt, hsa
ugaagcacuuuugcauuaauuugguuaaaaaauaaaauaaaauaauaauaauguaugaagcuc

SEQ ID NO: 629889 - RNA, 63 nt, hsa
uacuuugaagcacuuuugcauuaauuugguuaaaaaauaaaauaaaauaauaauaauguauga

SEQ ID NO: 629890 - RNA, 63 nt, hsa
aauaaguauuuccgucaagaaaaaggaaacaacaaaauaaaaccaacccaaguaaagaacagc

SEQ ID NO: 629891 - RNA, 63 nt, hsa
auuugguuagggauuaugucagugugauuauaaaaaauaaaagaucguaugauaugagauaca

SEQ ID NO: 629892 - RNA, 63 nt, hsa
aaagcauuauggcugucacaagcuugugaaaggaaaauaaaaauuacuaagccaaagagaaaa

SEQ ID NO: 629893 - RNA, 63 nt, hsa
augcuuuaugaaaagguuauggggacgauucccaaaauaaaucaccaguuuguaaauggaaaa

SEQ ID NO: 629894 - RNA, 63 nt, hsa
gagcaaaauuucaucucaaaaauaagauaaaauaaaauaaacaaauaagacagcacuuuauac

SEQ ID NO: 629895 - RNA, 63 nt, hsa
aacaagagcaaaauuucaucucaaaaauaagauaaaauaaaauaaacaaauaagacagcacuu

SEQ ID NO: 629896 - RNA, 63 nt, hsa
uagauccagaguucagaagaccuugagacaaugaaaauaaacuugguaauaaucuuuuuucaa

SEQ ID NO: 629897 - RNA, 63 nt, hsa
uauagcaagacucugccucuauuauaaaaaaacaaaauaaaugaaaaggacuguaggaggcag

SEQ ID NO: 629898 - RNA, 63 nt, hsa
cucgcuucccccauagccaccccagaaauggugaaaauaaaauaaagcagguuuuucuccucu

SEQ ID NO: 629899 - RNA, 63 nt, hsa
uucccccauagccaccccagaaauggugaaaauaaaauaaagcagguuuuucuccucuaccuu

SEQ ID NO: 629900 - RNA, 63 nt, hsa
aaggucuuuuuaaaccaguuuagauuucaagaaaaaauaaauggaaaucaucgaaaauucauu

SEQ ID NO: 629901 - RNA, 63 nt, hsa
aucaucgaaaauucauuucacauuaauggucuaaaaauaaaccaaaggacauuaugugugcau

SEQ ID NO: 629902 - RNA, 63 nt, hsa
aauuaugcaugugauuuuaacauuuaauauucaaaaauaaaucucuugcuggauuugagagua

SEQ ID NO: 629903 - RNA, 63 nt, hsa
gcuuguagaaacaauuuugaaagccccuugaggaaaauaaaaaucaagaagaacacuuuucuc

SEQ ID NO: 629904 - RNA, 63 nt, hsa
cuccagccugggagggugagacuccaucuaaaaaaaauaaaauaaauggcaaccccuggucua

SEQ ID NO: 629905 - RNA, 63 nt, hsa
gccugggagggugagacuccaucuaaaaaaaauaaaauaaauggcaaccccuggucuaagaua

SEQ ID NO: 629906 - RNA, 63 nt, hsa
uuugccuauaugguagagcaauaaugcuuuuuaaaaauaaacuucugaaaacccaaggccagg

SEQ ID NO: 629907 - RNA, 63 nt, hsa
cuugacuuuaaaaaaauuauuaaaaacaaaaaaaaaauaaauuuuuuugcaauccuuuccuca

SEQ ID NO: 629908 - RNA, 63 nt, hsa
ugauauaaaggagauacauguuucuuccuuuaaaaaauaaacggaaguuacauuguuaauguu

SEQ ID NO: 629909 - RNA, 63 nt, hsa
cagggagccuaaugagguuuuuaauaucaucuaaaaauaaagcauugaagugaaguuggugaa

SEQ ID NO: 629910 - RNA, 63 nt, hsa
uucccacugcugggccucuaucuccaugacaacaaaauaaaaacagagguugcuugacucauu

SEQ ID NO: 629911 - RNA, 63 nt, hsa
aaaggccacaaaaguucccucucacuuucaguaaaaauaaauaaaacagcagcagcaaacaaa

SEQ ID NO: 629912 - RNA, 63 nt, hsa
uaaauauuguguugugcagcauuaaaaaaaaucaaaauaaaaauuaaaugugagcaaagaaug

SEQ ID NO: 629913 - RNA, 63 nt, hsa
gccuaggcaacaagagugaaauuccgucucaaaaaaauaaauaaauaaauaaauaaauaaguu

SEQ ID NO: 629914 - RNA, 63 nt, hsa
guuucuaaaacccuuaacacugguaagggcucaaaaauaaacguauguguucauauucgauca

SEQ ID NO: 629915 - RNA, 63 nt, hsa
agagcuccaugcacacagugucuucagaaggugaaaauaaauauuucccugugcuccuuuuac

SEQ ID NO: 629916 - RNA, 63 nt, hsa
uuuugugaugaucaauggacuuuaaugaaaaaaaaaauaaaaacaaccaaaaaaauugaagga

SEQ ID NO: 629917 - RNA, 63 nt, hsa
guccuaaacgucccauguauuuuucuaggcauaaaaauaaaaguuggcuaaaaauuuuaaaaa

SEQ ID NO: 629918 - RNA, 63 nt, hsa
aaguaguucuuuaaauaagagauaauuuaaagaaaaauaaauacuagacaucaaauuuagauc

SEQ ID NO: 629919 - RNA, 63 nt, hsa
aagucuguuaaagccauugucagcaaagcuuugaaaauaaaggacuucacaaaaacgguaaug

SEQ ID NO: 629920 - RNA, 63 nt, hsa
aggcaaaauccuugcuuaugacaucacuuguacaaaauaaacaaauaacaaugugcucucggg

SEQ ID NO: 629921 - RNA, 63 nt, hsa
uugacugucacuguuccuugucacugguagaccaaaauaaaaccagcucuacuggucuugugg

SEQ ID NO: 629922 - RNA, 63 nt, hsa
gaaccccuacaugaaacagaaacaaaaacacuaaaaauaaaaauggccauuugcuuuuucacc

SEQ ID NO: 629923 - RNA, 63 nt, hsa
aauccccucaaaaaaauaaaaauaaaaaaaauaaaaauaaaaaaacauuuuuuucaagcaggg

SEQ ID NO: 629924 - RNA, 63 nt, hsa
cugugcaauccccucaaaaaaauaaaaauaaaaaaaauaaaaauaaaaaaacauuuuuuucaa

SEQ ID NO: 629925 - RNA, 63 nt, hsa
ggaaauaaacugugcaauccccucaaaaaaauaaaaauaaaaaaaauaaaaauaaaaaaacau

SEQ ID NO: 629926 - RNA, 63 nt, hsa
guguuuggaaauaaacugugcaauccccucaaaaaaauaaaaauaaaaaaaauaaaaauaaaa

SEQ ID NO: 629927 - RNA, 63 nt, hsa
ugucauuuguaugcaauuuccuguuaccuugaaaaaauaaaaauguuaacaggaaugcagugu

SEQ ID NO: 629928 - RNA, 63 nt, hsa
agaauucaucuugaguuaucuuuuauuuagauaaaaauaaagaggcaaggaucuacugucauu

SEQ ID NO: 629929 - RNA, 63 nt, hsa
ucacucacugccaaaaauagaaagugaccaugaaaaauaaauucgcuggggaagggggcucca

SEQ ID NO: 629930 - RNA, 63 nt, hsa
caagacucugucucaauaaauaaauaauuaauuaaaauaaaaaacagcuuaaagagaaaaaug

SEQ ID NO: 629931 - RNA, 63 nt, hsa
gacuccgucucaaaaaaauaaauacauaaauaaaaaauaaaccaaccauaauccccagugcag

SEQ ID NO: 629932 - RNA, 63 nt, hsa
aggcugggcgacagagcgagacuccgucucaaaaaaauaaauacauaaauaaaaaauaaacca

SEQ ID NO: 629933 - RNA, 63 nt, hsa
guuuccuauuuuugguuuauuuauuuuagaagaaaaauaaaauuauuugggcauuuuuguuua

SEQ ID NO: 629934 - RNA, 63 nt, hsa
ugccuagcauuuuauagauauuuauuauuuaaaaaaauaaagauauguuuuuaaugaagagag

SEQ ID NO: 629935 - RNA, 63 nt, hsa
ucccuguauuugauaaaacacauaauuuugagaaaaauaaaguuuuaaauguaucuaugucuc

SEQ ID NO: 629936 - RNA, 63 nt, hsa
uuuguuauaccaauaaaugcuuuagcugcaacuaaaauaaaaaaguuaaagguaagaaaauga

SEQ ID NO: 629937 - RNA, 63 nt, hsa
cuaccaaaaauagccaguaguaucugaaaaugaaaaauaaaugaaguaucucuaggaaacagu

SEQ ID NO: 629938 - RNA, 63 nt, hsa
auuuaaaaaacugaaaagguauaccucaacccaaaaauaaagguuuguuuugguuuguuaugg

SEQ ID NO: 629939 - RNA, 63 nt, hsa
uuuuucuucuauuaaaauauaacauugugaaagaaaauaaaauuuaugcuauucuuugcuuug

SEQ ID NO: 629940 - RNA, 63 nt, hsa
uagaaauccaauuaagacucacuuggguaaaaaaaaauaaaaaaauaaacaaaauaaacugcu

SEQ ID NO: 629941 - RNA, 63 nt, hsa
caauuaagacucacuuggguaaaaaaaaauaaaaaaauaaacaaaauaaacugcucacuuauu

SEQ ID NO: 629942 - RNA, 63 nt, hsa
cucacuuggguaaaaaaaaauaaaaaaauaaacaaaauaaacugcucacuuauuugaaaaauu

SEQ ID NO: 629943 - RNA, 63 nt, hsa
uuacuuucuaucagcugagcaaccucucaagaaaaaauaaauaaauaaauaaaccucucuuua

SEQ ID NO: 629944 - RNA, 63 nt, hsa
cagccaacauugugagacauaaucucuacaaauaaaauaaauuaguuggacaugauggugugc

SEQ ID NO: 629945 - RNA, 63 nt, hsa
agccugagugacagagugagacuuugcaaccaaaaaauaaaauaauaauaauaaugaaauaaa

SEQ ID NO: 629946 - RNA, 63 nt, hsa
ucugaaagugaacucucauaauucaaauuguauaaaauaaagcuacauuucuaagagcuuggu

SEQ ID NO: 629947 - RNA, 63 nt, hsa
cugcauaggauuauccccugacauuccaagagcaaaauaaagcucuugagaguaauuguuguc

SEQ ID NO: 629948 - RNA, 63 nt, hsa
aggggucuagugcccugcauuccuuugaggcaaaaaauaaaugggcuaugacugguuaaaugu

SEQ ID NO: 629949 - RNA, 63 nt, hsa
auaucuguggaacauguaaauacugucaaauggaaaauaaaauaaguuauaauuuuugugaau

SEQ ID NO: 629950 - RNA, 63 nt, hsa
gauguaaauguuuuacuuucaacuguguucuuuaaaauaaauccuaccugguuuuuaaauuuu

SEQ ID NO: 629951 - RNA, 63 nt, hsa
ucuuggaaaaaauuuuaagaaucaaaaauaaagaaaauaaaaaaugcauacaguuaaacauuc

SEQ ID NO: 629952 - RNA, 63 nt, hsa
auuucuauuucuuggaaaaaauuuuaagaaucaaaaauaaagaaaauaaaaaaugcauacagu

SEQ ID NO: 629953 - RNA, 63 nt, hsa
uauuuaugcccuuauaucccaaaaaugucuuagaaaauaaaaauucugggccuuacuuguuuu

SEQ ID NO: 629954 - RNA, 63 nt, hsa
uaaucaauggauauccuucaguagugaaugcagaaaauaaaaauacacagguaauuuaguauc

SEQ ID NO: 629955 - RNA, 63 nt, hsa
acaguauuuuuauucauauuuaaacauuuuuacaaaauaaauaaaguguuuuacauaguaagg

SEQ ID NO: 629956 - RNA, 63 nt, hsa
uuuaaaccaaugccuauaaaaagcaagucuaccaaaauaaacuaagacuuucuaugugguuug

SEQ ID NO: 629957 - RNA, 63 nt, hsa
uuccuauucuuucuuaaauuugauggagaagggaaaauaaauugcaguuauugauucuugcca

SEQ ID NO: 629958 - RNA, 63 nt, hsa
cucaacuuuaauaaguuauccugacacuugauaaaaauaaauauuugguauuuuguggucaug

SEQ ID NO: 629959 - RNA, 63 nt, hsa
cuggaccacagagcaggccccugucucaaaaauaaaauaaaaaagugaaagaagcaagcugug

SEQ ID NO: 629960 - RNA, 63 nt, hsa
auagccuggaccacagagcaggccccugucucaaaaauaaaauaaaaaagugaaagaagcaag

SEQ ID NO: 629961 - RNA, 63 nt, hsa
ccugggucacauagcaagaccccgucucuacaaaaaauaaauuuaaaaaacuagccaggugug

SEQ ID NO: 629962 - RNA, 63 nt, hsa
auggugggguuuucugcuuuguuuuuauuuaagaaaauaaacacgacauauuuaaagaagguu

SEQ ID NO: 629963 - RNA, 63 nt, hsa
auuggaugaaagucaaagguugucuacuuuaagaaaauaaaauacccugaauggagcccagca

SEQ ID NO: 629964 - RNA, 63 nt, hsa
uuccccuuuaauuguggauaguuuaaaguuuaaaaaauaaaguucuugcugggcacaguggcu

SEQ ID NO: 629965 - RNA, 63 nt, hsa
cagcuugggcaacagagugagacuuaaucuugaaaaauaaauaaaugaaaaauaaaauucuug

SEQ ID NO: 629966 - RNA, 63 nt, hsa
agccugggugacagagugagacccuauuucaaaaaaauaaaaauuggaagaagagcuuaaaaa

SEQ ID NO: 629967 - RNA, 63 nt, hsa
gaauacaauguccuuccauagcaugggaagaagaaaauaaacaucuccuuuccaacagcugug

SEQ ID NO: 629968 - RNA, 63 nt, hsa
agguggccuuucucccaagcugguggauaaugaaaaauaaagcaucccaucucucggcguucc

SEQ ID NO: 629969 - RNA, 63 nt, hsa
ggcaucaucuuuuugcucuagcccuuccucuccaaaauaaaaucaaauaaaggaaaaucucca

SEQ ID NO: 629970 - RNA, 63 nt, hsa
guagauguuuuaauaacaauuuuuguccuucuuaaaauaaaaugaaagaaacuugcuucccuu

SEQ ID NO: 629971 - RNA, 63 nt, hsa
aaagaaacuugcuucccuuagccuuuguucuagaaaauaaacuugugcacuuugaccucuguc

SEQ ID NO: 629972 - RNA, 63 nt, hsa
auaguuagauauucuagauuuacauuaaauuguaaaauaaauggacuuauugaagcauaucuu

SEQ ID NO: 629973 - RNA, 63 nt, hsa
aggcugugucacuggcauguccuuaaccuuggcaaaauaaacuuucuaaauugaaaccugucu

SEQ ID NO: 629974 - RNA, 63 nt, hsa
cucuuuuuaaaaauaaaaccagacucuguucugaaaauaaaaaacuugagacuugugacaagc

SEQ ID NO: 629975 - RNA, 63 nt, hsa
cuagcauuuaucacuuuuuuccuucucuuuuuaaaaauaaaaccagacucuguucugaaaaua

SEQ ID NO: 629976 - RNA, 63 nt, hsa
accuugauuuugagcuggaauguuucaaugagcaaaauaaauuagacaaaaguuuacuuucuu

SEQ ID NO: 629977 - RNA, 63 nt, hsa
uuuuuaaaaagacuguuuuuaaaaaggugcuacaaaauaaagugcuaucuuuuucuguuucuc

SEQ ID NO: 629978 - RNA, 63 nt, hsa
gcagcacguggaggggaacacauacaugucuugaaaauaaacugcuagaauaaagaaaugcug

SEQ ID NO: 629979 - RNA, 63 nt, hsa
auacuagaguaucuagaagggugaaaacaaaaaaaaauaaaaagaaacacagacgcccaggug

SEQ ID NO: 629980 - RNA, 63 nt, hsa
ucuacugcacaccaacuguuuauagaauacacaaaaauaaaauguaauaacuguauucuguga

SEQ ID NO: 629981 - RNA, 63 nt, hsa
uuuagaaauuagcuccagguucuuaaacuaacaaaaauaaaaccuaagcaugccacagagcua

SEQ ID NO: 629982 - RNA, 63 nt, hsa
ugggagaggaaaugucagggcaugugcucugauaaaauaaaggcagggaaacaagcugaauua

SEQ ID NO: 629983 - RNA, 63 nt, hsa
caugauuugaaaaguacaccuugcaaaguuuuaaaaauaaaguuuuuaggcaaaugcgauaag

SEQ ID NO: 629984 - RNA, 63 nt, hsa
ugcugcaugacccuccaaguagaccuguggcuuaaaauaaagaaaaugcagcaaaaagaaugc

SEQ ID NO: 629985 - RNA, 63 nt, hsa
uguacacauugauauuuaaugacaaauuuacuuaaaauaaauugaccccuuguucuuacuugc

SEQ ID NO: 629986 - RNA, 63 nt, hsa
gcaacaugaugccagauuugagaaaggaucugcaaaauaaagauaccacaauucaucuuaaaa

SEQ ID NO: 629987 - RNA, 63 nt, hsa
augaggaauggauugucagguugcugaaguauaaaaauaaacucuugguuguccugugcuuau

SEQ ID NO: 629988 - RNA, 63 nt, hsa
cucuggcucaucuaguccugcuccuugugcuauaaaauaaaugcagacuaauuuccugcccaa

SEQ ID NO: 629989 - RNA, 63 nt, hsa
aaauaaggagaaaagagaaugggagagugagagaaaauaaaaaaggcaaaagggagagagagg

SEQ ID NO: 629990 - RNA, 63 nt, hsa
uguaauuuagguuuuucaacaaagcccuugucuaaaauaaaaggcauuauuggaaauauuuga

SEQ ID NO: 629991 - RNA, 63 nt, hsa
gaaagccuacaaugaaucauuguucaaccuugaaaaauaaaauuuuguaaaacaucgguugau

SEQ ID NO: 629992 - RNA, 63 nt, hsa
cuaacauacucacugugaacccagccuauugcaaaaauaaaaucuuuuuauaauauuaucuau

SEQ ID NO: 629993 - RNA, 63 nt, hsa
auuuuugacaugcuccuauuuuuguaacuugaaaaaauaaaauuuugccuugugacagauuuu

SEQ ID NO: 629994 - RNA, 63 nt, hsa
acuuuuaaaaaugacacauauuuaaacacuuagaaaauaaaguuaacacuuacugaagugcua

SEQ ID NO: 629995 - RNA, 63 nt, hsa
gccugauauuaguucuuagagcuucuuguggcaaaaauaaaaugauuuaauucugauguuuga

SEQ ID NO: 629996 - RNA, 63 nt, hsa
ucccauacuaucugcuuggauuuggagagccaaaaaauaaagcugauugucaugugauuaaau

SEQ ID NO: 629997 - RNA, 63 nt, hsa
ggugaagcauacuccaguguuuuagggguuuugaaaauaaauauuuaaauuucacaguccuca

SEQ ID NO: 629998 - RNA, 63 nt, hsa
gggccacagagcaagacuccgucucaaaacauaaaaauaaaaaaaauacaaauagcugacccg

SEQ ID NO: 629999 - RNA, 63 nt, hsa
aaaagcuuuuaagucucauguuugcugacuauaaaaauaaaucauaguaauaauauugaacau

SEQ ID NO: 630000 - RNA, 63 nt, hsa
gcccagauagguugaucuuaauguaacaacccaaaaauaaaugucauagucaagauuugguag

SEQ ID NO: 630001 - RNA, 63 nt, hsa
gaaacaccuuuuaagcugaaugcagaaaauuccaaaauaaaugaugucaccacaaugguguau

SEQ ID NO: 630002 - RNA, 63 nt, hsa
acuguaguagaaacuuuaguuuugaugaugcacaaaauaaacagcagugguucucaacuaggg

SEQ ID NO: 630003 - RNA, 63 nt, hsa
uuuugguucuacuugcuauaugccuccuuuguaaaaauaaacaccgaggcuuacuguaguaga

SEQ ID NO: 630004 - RNA, 63 nt, hsa
guaaagaaaucagauacaaacuacugcaauuagaaaauaaaauaugaacaacuuucaacaaug

SEQ ID NO: 630005 - RNA, 63 nt, hsa
uuccuauaauacagugcuauaagcuaugcacagaaaauaaaauguuugaaauccaagaauaau

SEQ ID NO: 630006 - RNA, 63 nt, hsa
aguuucugaaugaaaaagcuacagcugagaaauaaaauaaaaugucaugcugcagaauauguu

SEQ ID NO: 630007 - RNA, 63 nt, hsa
auauauaaauuuuaauuucauagcaacuuguaaaaaauaaaauacuuguugaaaagccuuuuu

SEQ ID NO: 630008 - RNA, 63 nt, hsa
guugacaugaagucaucuauguggaaaaaaauaaaaauaaaagugauuucacggaugugguuu

SEQ ID NO: 630009 - RNA, 63 nt, hsa
uuuguaguugacaugaagucaucuauguggaaaaaaauaaaaauaaaagugauuucacggaug

SEQ ID NO: 630010 - RNA, 63 nt, hsa
aauaauuguucaauguuuaagaauaauauuaacaaaauaaaggaguuuaaugcagugaucuuu

SEQ ID NO: 630011 - RNA, 63 nt, hsa
aucguuuaaauaggaaaaauuuaaugcuagcaaaaaauaaauuuagaaauauggcaugacaug

SEQ ID NO: 630012 - RNA, 63 nt, hsa
acagugaaacuccaucucaaaaaauaaauaaauaaaauaaauucuuaguucauacccuuccag

SEQ ID NO: 630013 - RNA, 63 nt, hsa
uccagccugggcaacagugaaacuccaucucaaaaaauaaauaaauaaaauaaauucuuaguu

SEQ ID NO: 630014 - RNA, 63 nt, hsa
aguggacgcaaaauaauguugugaguuuuuauaaaaauaaauuuuaaaaugauauauaagaca

SEQ ID NO: 630015 - RNA, 63 nt, hsa
caaaaacuaucacuugcuauaaagguaauuguaaaaauaaauacaguggacgcaaaauaaugu

SEQ ID NO: 630016 - RNA, 63 nt, hsa
cacccccacauccaaaggauguggagcucuuuaaaaauaaauugcucuggucccaccucugga

SEQ ID NO: 630017 - RNA, 63 nt, hsa
uuuaaaaaguaaagcaauauauacacagguaaaaaaauaaaauaguacagaagggcuuauaau

SEQ ID NO: 630018 - RNA, 63 nt, hsa
cuaauacauauuaaaagacauaacuaucaaaacaaaauaaauuugucuguuuucaaccaaaga

SEQ ID NO: 630019 - RNA, 63 nt, hsa
uauaaaguaaaauucaccauuuuaauuauaauaaaaauaaaguauauaauucaaugguuguca

SEQ ID NO: 630020 - RNA, 63 nt, hsa
gcuugggaaaaaugaaauuguauucccauuuuuaaaauaaauacaaauguuuauuucagaagg

SEQ ID NO: 630021 - RNA, 63 nt, hsa
uaguauuuuugcagccuaagaguucauuauuuaaaaauaaacuaaagaaauaugucaccuuug

SEQ ID NO: 630022 - RNA, 63 nt, hsa
uuuuuugauuaaaaaugugaacaagaaaauacuaaaauaaaaauccuuucgauuuagccaacu

SEQ ID NO: 630023 - RNA, 63 nt, hsa
cuauauuuuuauauucauguguaaacaaaaaauaaaauaaaauucugaucgcauaaaaauaug

SEQ ID NO: 630024 - RNA, 63 nt, hsa
uuuuucuauauuuuuauauucauguguaaacaaaaaauaaaauaaaauucugaucgcauaaaa

SEQ ID NO: 630025 - RNA, 63 nt, hsa
cugcaguaaggugguuuaaaccauaguuauauaaaaauaaaggucauucugaauaucagccuu

SEQ ID NO: 630026 - RNA, 63 nt, hsa
uccaaucacuuaguagccccucaaaguaguuagaaaauaaacagauuuuuccaguguugauuu

SEQ ID NO: 630027 - RNA, 63 nt, hsa
accccacuuauggguguaagccuacuagacuugaaaauaaaguauaaaacauuuccaaucacu

SEQ ID NO: 630028 - RNA, 63 nt, hsa
auaaaagguauucccagguauguuuggcaaaauaaaauaaagguaauuaaaaaccuaagaaau

SEQ ID NO: 630029 - RNA, 63 nt, hsa
aaaaaauaaaagguauucccagguauguuuggcaaaauaaaauaaagguaauuaaaaaccuaa

SEQ ID NO: 630030 - RNA, 63 nt, hsa
uaugguuuggaaccaucaccccaagguaaaaaaaaaauaaaagguauucccagguauguuugg

SEQ ID NO: 630031 - RNA, 63 nt, hsa
cucaguaaugcucacgauaccaauuguuuugacaaaauaaauuuacuaaacuuggccuaaaau

SEQ ID NO: 630032 - RNA, 63 nt, hsa
cacugcaugugcucuguuuauucugauuuuacuaaaauaaaaaguucaaaagucuuccugcug

SEQ ID NO: 630033 - RNA, 63 nt, hsa
uuuuguuuuuuagccuguuauauuuccuucuguaaaauaaaauauguccagaagaggcauguu

SEQ ID NO: 630034 - RNA, 63 nt, hsa
cuauugcugauacugucuuugcauaaaugaauaaaaauaaacuuuuuuucuucaaauguguuu

SEQ ID NO: 630035 - RNA, 63 nt, hsa; identical to SEQ ID NO: 630033

SEQ ID NO: 630036 - RNA, 63 nt, hsa; identical to SEQ ID NO: 630034

SEQ ID NO: 630037 - RNA, 63 nt, hsa
caacacagugagaacucaucucuguaaaaaauaaaaauaaaacauuaaaaaaaaacaugagcu

SEQ ID NO: 630038 - RNA, 63 nt, hsa
ccuaggcaacacagugagaacucaucucuguaaaaaauaaaaauaaaacauuaaaaaaaaaca

SEQ ID NO: 630039 - RNA, 64 nt, hsa; identical to SEQ ID NO: 45477

SEQ ID NO: 630040 - RNA, 64 nt, hsa; identical to SEQ ID NO: 45478

SEQ ID NO: 630041 - RNA, 64 nt, hsa; identical to SEQ ID NO: 45479

SEQ ID NO: 630042 - RNA, 64 nt, hsa; identical to SEQ ID NO: 45480

SEQ ID NO: 630043 - RNA, 64 nt, hsa; identical to SEQ ID NO: 45481

SEQ ID NO: 630044 - RNA, 64 nt, hsa; identical to SEQ ID NO: 45482

SEQ ID NO: 630045 - RNA, 64 nt, hsa; identical to SEQ ID NO: 45483

SEQ ID NO: 630046 - RNA, 64 nt, hsa; identical to SEQ ID NO: 45484

SEQ ID NO: 630047 - RNA, 64 nt, hsa; identical to SEQ ID NO: 45485

SEQ ID NO: 630048 - RNA, 64 nt, hsa; identical to SEQ ID NO: 45486

SEQ ID NO: 630049 - RNA, 64 nt, hsa; identical to SEQ ID NO: 45487

SEQ ID NO: 630050 - RNA, 56 nt, hsa; identical to SEQ ID NO: 45488

SEQ ID NO: 630051 - RNA, 64 nt, hsa; identical to SEQ ID NO: 45489

SEQ ID NO: 630052 - RNA, 64 nt, hsa; identical to SEQ ID NO: 45490

SEQ ID NO: 630053 - RNA, 64 nt, hsa; identical to SEQ ID NO: 45491

SEQ ID NO: 630054 - RNA, 64 nt, hsa; identical to SEQ ID NO: 45492

SEQ ID NO: 630055 - RNA, 64 nt, hsa; identical to SEQ ID NO: 45493

SEQ ID NO: 630056 - RNA, 64 nt, hsa; identical to SEQ ID NO: 45494

SEQ ID NO: 630057 - RNA, 64 nt, hsa; identical to SEQ ID NO: 45495

SEQ ID NO: 630058 - RNA, 64 nt, hsa; identical to SEQ ID NO: 45496

SEQ ID NO: 630059 - RNA, 64 nt, hsa; identical to SEQ ID NO: 45497

SEQ ID NO: 630060 - RNA, 64 nt, hsa; identical to SEQ ID NO: 45498

SEQ ID NO: 630061 - RNA, 64 nt, hsa; identical to SEQ ID NO: 45499

SEQ ID NO: 630062 - RNA, 64 nt, hsa; identical to SEQ ID NO: 45500

SEQ ID NO: 630063 - RNA, 64 nt, hsa; identical to SEQ ID NO: 45501

SEQ ID NO: 630064 - RNA, 64 nt, hsa; identical to SEQ ID NO: 45502

SEQ ID NO: 630065 - RNA, 64 nt, hsa; identical to SEQ ID NO: 45503

SEQ ID NO: 630066 - RNA, 64 nt, hsa; identical to SEQ ID NO: 45504

SEQ ID NO: 630067 - RNA, 64 nt, hsa; identical to SEQ ID NO: 45505

SEQ ID NO: 630068 - RNA, 64 nt, hsa; identical to SEQ ID NO: 45506

SEQ ID NO: 630069 - RNA, 64 nt, hsa; identical to SEQ ID NO: 45507

SEQ ID NO: 630070 - RNA, 64 nt, hsa; identical to SEQ ID NO: 45508

SEQ ID NO: 630071 - RNA, 64 nt, hsa; identical to SEQ ID NO: 45509

SEQ ID NO: 630072 - RNA, 64 nt, hsa; identical to SEQ ID NO: 45510

SEQ ID NO: 630073 - RNA, 64 nt, hsa; identical to SEQ ID NO: 45511

SEQ ID NO: 630074 - RNA, 64 nt, hsa; identical to SEQ ID NO: 45512

SEQ ID NO: 630075 - RNA, 64 nt, hsa; identical to SEQ ID NO: 45513

SEQ ID NO: 630076 - RNA, 64 nt, hsa; identical to SEQ ID NO: 45514

SEQ ID NO: 630077 - RNA, 64 nt, hsa; identical to SEQ ID NO: 45515

SEQ ID NO: 630078 - RNA, 64 nt, hsa; identical to SEQ ID NO: 45516

SEQ ID NO: 630079 - RNA, 64 nt, hsa; identical to SEQ ID NO: 45517

SEQ ID NO: 630080 - RNA, 64 nt, hsa; identical to SEQ ID NO: 45518

SEQ ID NO: 630081 - RNA, 64 nt, hsa; identical to SEQ ID NO: 45519

SEQ ID NO: 630082 - RNA, 64 nt, hsa; identical to SEQ ID NO: 45520

SEQ ID NO: 630083 - RNA, 64 nt, hsa; identical to SEQ ID NO: 45521

SEQ ID NO: 630084 - RNA, 64 nt, hsa; identical to SEQ ID NO: 45522

SEQ ID NO: 630085 - RNA, 64 nt, hsa; identical to SEQ ID NO: 45523

SEQ ID NO: 630086 - RNA, 64 nt, hsa; identical to SEQ ID NO: 45524

SEQ ID NO: 630087 - RNA, 64 nt, hsa; identical to SEQ ID NO: 45525

SEQ ID NO: 630088 - RNA, 64 nt, hsa; identical to SEQ ID NO: 45526

SEQ ID NO: 630089 - RNA, 64 nt, hsa; identical to SEQ ID NO: 45527

SEQ ID NO: 630090 - RNA, 64 nt, hsa; identical to SEQ ID NO: 45528

SEQ ID NO: 630091 - RNA, 64 nt, hsa; identical to SEQ ID NO: 45529

SEQ ID NO: 630092 - RNA, 64 nt, hsa; identical to SEQ ID NO: 45530

SEQ ID NO: 630093 - RNA, 64 nt, hsa; identical to SEQ ID NO: 45531

SEQ ID NO: 630094 - RNA, 64 nt, hsa; identical to SEQ ID NO: 45532

SEQ ID NO: 630095 - RNA, 64 nt, hsa; identical to SEQ ID NO: 45533

SEQ ID NO: 630096 - RNA, 64 nt, hsa; identical to SEQ ID NO: 45534

SEQ ID NO: 630097 - RNA, 64 nt, hsa; identical to SEQ ID NO: 45535

SEQ ID NO: 630098 - RNA, 64 nt, hsa; identical to SEQ ID NO: 45536

SEQ ID NO: 630099 - RNA, 64 nt, hsa; identical to SEQ ID NO: 45537

SEQ ID NO: 630100 - RNA, 64 nt, hsa; identical to SEQ ID NO: 45538

SEQ ID NO: 630101 - RNA, 64 nt, hsa; identical to SEQ ID NO: 45539

SEQ ID NO: 630102 - RNA, 64 nt, hsa; identical to SEQ ID NO: 45540

SEQ ID NO: 630103 - RNA, 64 nt, hsa; identical to SEQ ID NO: 45541

SEQ ID NO: 630104 - RNA, 64 nt, hsa; identical to SEQ ID NO: 45542

SEQ ID NO: 630105 - RNA, 64 nt, hsa; identical to SEQ ID NO: 45543

SEQ ID NO: 630106 - RNA, 64 nt, hsa; identical to SEQ ID NO: 45544

SEQ ID NO: 630107 - RNA, 64 nt, hsa; identical to SEQ ID NO: 45545

SEQ ID NO: 630108 - RNA, 64 nt, hsa; identical to SEQ ID NO: 45546

SEQ ID NO: 630109 - RNA, 64 nt, hsa; identical to SEQ ID NO: 45547

SEQ ID NO: 630110 - RNA, 64 nt, hsa; identical to SEQ ID NO: 45548

SEQ ID NO: 630111 - RNA, 64 nt, hsa; identical to SEQ ID NO: 45549

SEQ ID NO: 630112 - RNA, 64 nt, hsa; identical to SEQ ID NO: 45550

SEQ ID NO: 630113 - RNA, 64 nt, hsa; identical to SEQ ID NO: 45551

SEQ ID NO: 630114 - RNA, 64 nt, hsa; identical to SEQ ID NO: 45552

SEQ ID NO: 630115 - RNA, 64 nt, hsa; identical to SEQ ID NO: 45553

SEQ ID NO: 630116 - RNA, 64 nt, hsa; identical to SEQ ID NO: 45554

SEQ ID NO: 630117 - RNA, 64 nt, hsa; identical to SEQ ID NO: 45555

SEQ ID NO: 630118 - RNA, 64 nt, hsa; identical to SEQ ID NO: 45556

SEQ ID NO: 630119 - RNA, 64 nt, hsa; identical to SEQ ID NO: 45557

SEQ ID NO: 630120 - RNA, 64 nt, hsa; identical to SEQ ID NO: 45558

SEQ ID NO: 630121 - RNA, 64 nt, hsa; identical to SEQ ID NO: 45559

SEQ ID NO: 630122 - RNA, 64 nt, hsa; identical to SEQ ID NO: 45560

SEQ ID NO: 630123 - RNA, 64 nt, hsa; identical to SEQ ID NO: 45561

SEQ ID NO: 630124 - RNA, 64 nt, hsa; identical to SEQ ID NO: 45562

SEQ ID NO: 630125 - RNA, 64 nt, hsa; identical to SEQ ID NO: 45563

SEQ ID NO: 630126 - RNA, 64 nt, hsa; identical to SEQ ID NO: 45564

SEQ ID NO: 630127 - RNA, 64 nt, hsa; identical to SEQ ID NO: 45565

SEQ ID NO: 630128 - RNA, 64 nt, hsa; identical to SEQ ID NO: 45566

SEQ ID NO: 630129 - RNA, 64 nt, hsa; identical to SEQ ID NO: 45567

SEQ ID NO: 630130 - RNA, 64 nt, hsa; identical to SEQ ID NO: 45568

SEQ ID NO: 630131 - RNA, 64 nt, hsa; identical to SEQ ID NO: 45569

SEQ ID NO: 630132 - RNA, 64 nt, hsa; identical to SEQ ID NO: 45570

SEQ ID NO: 630133 - RNA, 64 nt, hsa; identical to SEQ ID NO: 45571

SEQ ID NO: 630134 - RNA, 64 nt, hsa; identical to SEQ ID NO: 45572

SEQ ID NO: 630135 - RNA, 64 nt, hsa; identical to SEQ ID NO: 45573

SEQ ID NO: 630136 - RNA, 64 nt, hsa; identical to SEQ ID NO: 45574

SEQ ID NO: 630137 - RNA, 64 nt, hsa; identical to SEQ ID NO: 45575

SEQ ID NO: 630138 - RNA, 64 nt, hsa; identical to SEQ ID NO: 45576

SEQ ID NO: 630139 - RNA, 64 nt, hsa; identical to SEQ ID NO: 45577

SEQ ID NO: 630140 - RNA, 64 nt, hsa; identical to SEQ ID NO: 45578

SEQ ID NO: 630141 - RNA, 64 nt, hsa; identical to SEQ ID NO: 45579

SEQ ID NO: 630142 - RNA, 64 nt, hsa; identical to SEQ ID NO: 45580

SEQ ID NO: 630143 - RNA, 64 nt, hsa; identical to SEQ ID NO: 45581

SEQ ID NO: 630144 - RNA, 64 nt, hsa; identical to SEQ ID NO: 45582

SEQ ID NO: 630145 - RNA, 64 nt, hsa; identical to SEQ ID NO: 45583

SEQ ID NO: 630146 - RNA, 64 nt, hsa; identical to SEQ ID NO: 45584

SEQ ID NO: 630147 - RNA, 64 nt, hsa; identical to SEQ ID NO: 45585

SEQ ID NO: 630148 - RNA, 64 nt, hsa; identical to SEQ ID NO: 45586

SEQ ID NO: 630149 - RNA, 64 nt, hsa; identical to SEQ ID NO: 45587

SEQ ID NO: 630150 - RNA, 64 nt, hsa; identical to SEQ ID NO: 45588

SEQ ID NO: 630151 - RNA, 64 nt, hsa; identical to SEQ ID NO: 45589

SEQ ID NO: 630152 - RNA, 64 nt, hsa; identical to SEQ ID NO: 45590

SEQ ID NO: 630153 - RNA, 64 nt, hsa; identical to SEQ ID NO: 45591

SEQ ID NO: 630154 - RNA, 64 nt, hsa; identical to SEQ ID NO: 45592

SEQ ID NO: 630155 - RNA, 64 nt, hsa; identical to SEQ ID NO: 45593

SEQ ID NO: 630156 - RNA, 64 nt, hsa; identical to SEQ ID NO: 45594

SEQ ID NO: 630157 - RNA, 64 nt, hsa; identical to SEQ ID NO: 45595

SEQ ID NO: 630158 - RNA, 64 nt, hsa; identical to SEQ ID NO: 45596

SEQ ID NO: 630159 - RNA, 64 nt, hsa; identical to SEQ ID NO: 45597

SEQ ID NO: 630160 - RNA, 64 nt, hsa; identical to SEQ ID NO: 45598

SEQ ID NO: 630161 - RNA, 64 nt, hsa; identical to SEQ ID NO: 45599

SEQ ID NO: 630162 - RNA, 64 nt, hsa; identical to SEQ ID NO: 45600

SEQ ID NO: 630163 - RNA, 64 nt, hsa; identical to SEQ ID NO: 45601

SEQ ID NO: 630164 - RNA, 64 nt, hsa; identical to SEQ ID NO: 45602

SEQ ID NO: 630165 - RNA, 64 nt, hsa; identical to SEQ ID NO: 45603

SEQ ID NO: 630166 - RNA, 64 nt, hsa; identical to SEQ ID NO: 45604

SEQ ID NO: 630167 - RNA, 64 nt, hsa; identical to SEQ ID NO: 45605

SEQ ID NO: 630168 - RNA, 64 nt, hsa; identical to SEQ ID NO: 45606

SEQ ID NO: 630169 - RNA, 64 nt, hsa; identical to SEQ ID NO: 45607

SEQ ID NO: 630170 - RNA, 64 nt, hsa; identical to SEQ ID NO: 45608

SEQ ID NO: 630171 - RNA, 64 nt, hsa; identical to SEQ ID NO: 45609

SEQ ID NO: 630172 - RNA, 64 nt, hsa; identical to SEQ ID NO: 45610

SEQ ID NO: 630173 - RNA, 64 nt, hsa; identical to SEQ ID NO: 45611

SEQ ID NO: 630174 - RNA, 64 nt, hsa; identical to SEQ ID NO: 45612

SEQ ID NO: 630175 - RNA, 64 nt, hsa; identical to SEQ ID NO: 45613

SEQ ID NO: 630176 - RNA, 64 nt, hsa; identical to SEQ ID NO: 45614

SEQ ID NO: 630177 - RNA, 64 nt, hsa; identical to SEQ ID NO: 45615

SEQ ID NO: 630178 - RNA, 64 nt, hsa; identical to SEQ ID NO: 45616

SEQ ID NO: 630179 - RNA, 64 nt, hsa; identical to SEQ ID NO: 45617

SEQ ID NO: 630180 - RNA, 64 nt, hsa; identical to SEQ ID NO: 45618

SEQ ID NO: 630181 - RNA, 64 nt, hsa; identical to SEQ ID NO: 45619

SEQ ID NO: 630182 - RNA, 64 nt, hsa; identical to SEQ ID NO: 45620

SEQ ID NO: 630183 - RNA, 64 nt, hsa; identical to SEQ ID NO: 45621

SEQ ID NO: 630184 - RNA, 64 nt, hsa; identical to SEQ ID NO: 45622

SEQ ID NO: 630185 - RNA, 64 nt, hsa; identical to SEQ ID NO: 45623

SEQ ID NO: 630186 - RNA, 64 nt, hsa; identical to SEQ ID NO: 45624

SEQ ID NO: 630187 - RNA, 64 nt, hsa; identical to SEQ ID NO: 45625

SEQ ID NO: 630188 - RNA, 64 nt, hsa; identical to SEQ ID NO: 45626

SEQ ID NO: 630189 - RNA, 64 nt, hsa; identical to SEQ ID NO: 45627

SEQ ID NO: 630190 - RNA, 64 nt, hsa; identical to SEQ ID NO: 45628

SEQ ID NO: 630191 - RNA, 64 nt, hsa; identical to SEQ ID NO: 45629

SEQ ID NO: 630192 - RNA, 64 nt, hsa; identical to SEQ ID NO: 45630

SEQ ID NO: 630193 - RNA, 64 nt, hsa; identical to SEQ ID NO: 45631

SEQ ID NO: 630194 - RNA, 64 nt, hsa; identical to SEQ ID NO: 45632

SEQ ID NO: 630195 - RNA, 64 nt, hsa; identical to SEQ ID NO: 45633

SEQ ID NO: 630196 - RNA, 64 nt, hsa; identical to SEQ ID NO: 45634

SEQ ID NO: 630197 - RNA, 64 nt, hsa; identical to SEQ ID NO: 45635

SEQ ID NO: 630198 - RNA, 64 nt, hsa; identical to SEQ ID NO: 45636

SEQ ID NO: 630199 - RNA, 64 nt, hsa; identical to SEQ ID NO: 45637

SEQ ID NO: 630200 - RNA, 64 nt, hsa; identical to SEQ ID NO: 45638

SEQ ID NO: 630201 - RNA, 64 nt, hsa; identical to SEQ ID NO: 45639

SEQ ID NO: 630202 - RNA, 64 nt, hsa; identical to SEQ ID NO: 45640

SEQ ID NO: 630203 - RNA, 64 nt, hsa; identical to SEQ ID NO: 45641

SEQ ID NO: 630204 - RNA, 64 nt, hsa; identical to SEQ ID NO: 45642

SEQ ID NO: 630205 - RNA, 64 nt, hsa; identical to SEQ ID NO: 45643

SEQ ID NO: 630206 - RNA, 64 nt, hsa; identical to SEQ ID NO: 45644

SEQ ID NO: 630207 - RNA, 64 nt, hsa; identical to SEQ ID NO: 45645

SEQ ID NO: 630208 - RNA, 64 nt, hsa; identical to SEQ ID NO: 45646

SEQ ID NO: 630209 - RNA, 64 nt, hsa; identical to SEQ ID NO: 45647

SEQ ID NO: 630210 - RNA, 64 nt, hsa; identical to SEQ ID NO: 45648

SEQ ID NO: 630211 - RNA, 64 nt, hsa; identical to SEQ ID NO: 45649

SEQ ID NO: 630212 - RNA, 64 nt, hsa; identical to SEQ ID NO: 45650

SEQ ID NO: 630213 - RNA, 64 nt, hsa; identical to SEQ ID NO: 45651

SEQ ID NO: 630214 - RNA, 64 nt, hsa; identical to SEQ ID NO: 45652

SEQ ID NO: 630215 - RNA, 64 nt, hsa; identical to SEQ ID NO: 45653

SEQ ID NO: 630216 - RNA, 64 nt, hsa; identical to SEQ ID NO: 45654

SEQ ID NO: 630217 - RNA, 64 nt, hsa; identical to SEQ ID NO: 45655

SEQ ID NO: 630218 - RNA, 64 nt, hsa
aaaccuagaaaaacggguaguaaacuguggauagucaggaaaacacccagcaagggacacagcu

SEQ ID NO: 630219 - RNA, 64 nt, hsa
uagucaggaaaacacccagcaagggacacagcugucaggaaaugaaucuuccccccaaccccca

SEQ ID NO: 630220 - RNA, 64 nt, hsa
aacuaacuuaaccaugugcuucccacacaguacaucaggaaaacuuacagggcaauauuuuuaa

SEQ ID NO: 630221 - RNA, 64 nt, hsa
cacaguaccucuuacacucccuguggcuccaacuucaggaaauaaauuucccauugcgagggac

SEQ ID NO: 630222 - RNA, 64 nt, hsa
uguaguaugagaugaaauuaaaaguggauagcuuucaggaaagauaaagagaacaugcuuagaa

SEQ ID NO: 630223 - RNA, 64 nt, hsa
cccauggguggguguugagguuuuuaaaguguggucaggaaaggccccacugauaagguaacau

SEQ ID NO: 630224 - RNA, 64 nt, hsa
aauuugagaaggauuucaaggaaguguuugcuauucaggaaacaaaugggaacaguugacuggu

SEQ ID NO: 630225 - RNA, 64 nt, hsa
aacaguugacugguuuaguggaugcugaaggccuucaggaaauaugcuacugguugccacugac

SEQ ID NO: 630226 - RNA, 64 nt, hsa
gauugcacaucauucuuuaaggcauacuuuuaccucaggaaacuuacucuaguauguucucaua

SEQ ID NO: 630227 - RNA, 64 nt, hsa
guaugccuguacuugggcugcacugagcuugucuucaggaaaccagagcguugcuuuaucaucg

SEQ ID NO: 630228 - RNA, 64 nt, hsa
acuguccguaagcaguauauuaguauuaucuuguucaggaaaagguugaauaauauaugccuug

SEQ ID NO: 630229 - RNA, 64 nt, hsa
aaagauaaagaccagaaauucccuuuucaccuuuucaggaaaauaacuuagacucuaguauuua

SEQ ID NO: 630230 - RNA, 64 nt, hsa
aaaugaucauuuggguucacucaggaaaugcaugucaggaaacuuguauuauaaguuuauuagu

SEQ ID NO: 630231 - RNA, 64 nt, hsa
uuccuuguuuuaaaaaaugaucauuuggguucacucaggaaaugcaugucaggaaacuuguauu

SEQ ID NO: 630232 - RNA, 64 nt, hsa
gaaagguguuuguuuuuaacaacauugaagauaaucaggaaagauuuuuucuuaauguuucucu

SEQ ID NO: 630233 - RNA, 64 nt, hsa
ggggacugggauagaggaagggugagcuccucauucaggaaauagaggaguguuuccucuuuau

SEQ ID NO: 630234 - RNA, 64 nt, hsa
ucuaaugcuaugcuggauaugaacuuuuggggccucaggaaagaaaaaccaggaacuaguuuca

SEQ ID NO: 630235 - RNA, 64 nt, hsa
gcccacagcaaccaaagagacuuccucuuggcguucaggaaacacagauucuuuguccuuuucc

SEQ ID NO: 630236 - RNA, 64 nt, hsa
gcacugccccaaagugagaacuugcucuacguggucaggaaagagcagggagaccaagcagagu

SEQ ID NO: 630237 - RNA, 64 nt, hsa
gcuuuucucuguugccacauuuuccucagguuacucaggaaaaugcuccagcaugugcgagcac

SEQ ID NO: 630238 - RNA, 64 nt, hsa
ucagcugccaauacauucaacccuuucucuuccuucaggaaaauaccuauacccaaauguuccc

SEQ ID NO: 630239 - RNA, 64 nt, hsa
cuaauauguuuucugaaaccaggaugaugcucauucaggaaauccacuauguugaauguccacu

SEQ ID NO: 630240 - RNA, 64 nt, hsa
auuuuuuguuauuucaauauacccuccuguuuauucaggaaaaaauaauaaagucacuaucuua

SEQ ID NO: 630241 - RNA, 64 nt, hsa
accuugaaaacugaauaucaacguucaccuugauucaggaaagcugggugcugucuccaugcca

SEQ ID NO: 630242 - RNA, 64 nt, hsa
cuaauugagguacaucugcaagugagacuuuuugucaggaaaaggcaauauaucaggucuccuc

SEQ ID NO: 630243 - RNA, 64 nt, hsa
acaugcugcuguguuuauuuauuguggauucccaucaggaaagaggaaaaaauacacauguucu

SEQ ID NO: 630244 - RNA, 64 nt, hsa
auuggcuucauacaaaauagacaauucucugauuucaggaaaugugcauggucuacccgcuuua

SEQ ID NO: 630245 - RNA, 64 nt, hsa
gaugagaucagaaaacguucaugaaaaaucauauucaggaaauaaggaagaggaauauaaaugc

SEQ ID NO: 630246 - RNA, 64 nt, hsa
auagguucccaagcaacauagauuucccuaucuuucaggaaacagcaucaaggaacucugaaaa

SEQ ID NO: 630247 - RNA, 64 nt, hsa
aagauuuagguugcagaaucgacuccaaugccuuucaggaaaggacucggcacuucucugacug

SEQ ID NO: 630248 - RNA, 64 nt, hsa
ggaaccuagcucuuuaaacucuggggagucggauucaggaaacacccccaggaggccaagccug

SEQ ID NO: 630249 - RNA, 64 nt, hsa
uucucuugcuugguguaacuaaucacuguuaauuucaggaaacagaacucauuaaaacuccuua

SEQ ID NO: 630250 - RNA, 64 nt, hsa
uguaguuuaugcaguaucugacugcaaaucauauucaggaaagaagugcagaauuucuucccca

SEQ ID NO: 630251 - RNA, 64 nt, hsa
guuucuacaaaaauaaccuucaggaaaaagaaaaucaggaaaaaaauuuuuuuucaauaaucuu

SEQ ID NO: 630252 - RNA, 64 nt, hsa
ucccuuuuuaccaugguuucuacaaaaauaaccuucaggaaaaagaaaaucaggaaaaaaauuu

SEQ ID NO: 630253 - RNA, 56 nt, hsa
gcagagguuaccucaacugaacuuuuucaggaaauagagcugaugauuauaauauu

SEQ ID NO: 630254 - RNA, 64 nt, hsa
agggagugggaggcuuccaacauaguauugaaucucaggaaaaacuauucuuucaugucugauu

SEQ ID NO: 630255 - RNA, 64 nt, hsa
uaccagaagaguuauuaucuauuuguucucccuuucaggaaacuuauuguaaagggacuguuuu

SEQ ID NO: 630256 - RNA, 64 nt, hsa
uccuuuuuauggaguuaacggggaggaagaccccucaggaaaacgaaaguaaauuguuaaggcu

SEQ ID NO: 630257 - RNA, 62 nt, hsa
accccagccugagcaacaagagcgaaacuccaucucaggaaaaaaaaaaaaaaaaaaaguau

SEQ ID NO: 630258 - RNA, 64 nt, hsa
cagaucauccccagagagagcccccacaagcuccucaggaaacaggauugcugaugucugggaa

SEQ ID NO: 630259 - RNA, 64 nt, hsa
uagguccugucucaguguguggcauugacuguuuucaggaaaauagauacagauuaauaugagu

SEQ ID NO: 630260 - RNA, 64 nt, hsa
guguugaaaacuagguuacuuauaaugcaaggaaucaggaaacuuuaguuauuuauaguauaau

SEQ ID NO: 630261 - RNA, 64 nt, hsa
uuggagcacauugauuuuucaaaagccagcucugucaggaaaggaggugcuguuaugagcagcu

SEQ ID NO: 630262 - RNA, 64 nt, hsa
aggauuuuuaaauuuuuuauggguagaauuguagucaggaaaacagaaagggcuugaaauuuaa

SEQ ID NO: 630263 - RNA, 64 nt, hsa
aggucugaggugggucugaaauucauacaugaagucaggaaaagaaaagaaacuuaguucuacc

SEQ ID NO: 630264 - RNA, 64 nt, hsa
acaaauucugacuugcagaaaugcagacauacagucaggaaagaacaaacuucaauuaaaugua

SEQ ID NO: 630265 - RNA, 64 nt, hsa
uccccaaucuagcaaggcaggccaacauucagauucaggaaauacagagaacgccacaaagaua

SEQ ID NO: 630266 - RNA, 64 nt, hsa
ggauaaauagucaagacccaucagggugcuguauucaggaaacccaucucacgugcagagacac

SEQ ID NO: 630267 - RNA, 64 nt, hsa
auuuauuagaauuuggaauaugauacaaguggcaucaggaaaugaggaaauaauggaacuauuu

SEQ ID NO: 630268 - RNA, 64 nt, hsa
aauacuuagcgguucuacuuaugaguaugaaugcucaggaaauacgcacuaggauauuuacugu

SEQ ID NO: 630269 - RNA, 64 nt, hsa
gggccugagggagccccuggcuuuccccucagccucaggaaagguggucaggaaaacucuggcu

SEQ ID NO: 630270 - RNA, 64 nt, hsa
ccccuggcuuuccccucagccucaggaaagguggucaggaaaacucuggcuggacaagggucag

SEQ ID NO: 630271 - RNA, 64 nt, hsa
acagccuccuggaggaagcagccuccacuuuggaucaggaaauaguaaaggaaagcaguguugg

SEQ ID NO: 630272 - RNA, 64 nt, hsa
ggauccuugucaguuguaacauucuauuucaacuucaggaaagcagcaguuuucuuuuaauuuu

SEQ ID NO: 630273 - RNA, 64 nt, hsa
acucauugauuggguuucuacuucuuucaaggacucaggaaauuucacuuugaacugaggccaa

SEQ ID NO: 630274 - RNA, 64 nt, hsa
augagcauguacaaccucuggagcuagaagcuccucaggaaagccaguucuccaaguucuuaac

SEQ ID NO: 630275 - RNA, 64 nt, hsa
aagaaaaggagagguagauacagucagugucacuucaggaaagcuauuuaaaaaaacuugaaau

SEQ ID NO: 630276 - RNA, 64 nt, hsa
aaggaaaagagaggaggauagagucaaggucaguucaggaaagcuuaagcaucgaaaaaagaaa

SEQ ID NO: 630277 - RNA, 64 nt, hsa; identical to SEQ ID NO: 170526

SEQ ID NO: 630278 - RNA, 64 nt, hsa; identical to SEQ ID NO: 170527

SEQ ID NO: 630279 - RNA, 64 nt, hsa; identical to SEQ ID NO: 170528

SEQ ID NO: 630280 - RNA, 64 nt, hsa; identical to SEQ ID NO: 170529

SEQ ID NO: 630281 - RNA, 64 nt, hsa; identical to SEQ ID NO: 170530

SEQ ID NO: 630282 - RNA, 64 nt, hsa; identical to SEQ ID NO: 170531

SEQ ID NO: 630283 - RNA, 64 nt, hsa; identical to SEQ ID NO: 170532

SEQ ID NO: 630284 - RNA, 64 nt, hsa; identical to SEQ ID NO: 170533

SEQ ID NO: 630285 - RNA, 64 nt, hsa; identical to SEQ ID NO: 170534

SEQ ID NO: 630286 - RNA, 64 nt, hsa; identical to SEQ ID NO: 170535

SEQ ID NO: 630287 - RNA, 64 nt, hsa; identical to SEQ ID NO: 170536

SEQ ID NO: 630288 - RNA, 64 nt, hsa; identical to SEQ ID NO: 170537

SEQ ID NO: 630289 - RNA, 64 nt, hsa; identical to SEQ ID NO: 170538

SEQ ID NO: 630290 - RNA, 64 nt, hsa; identical to SEQ ID NO: 170539

SEQ ID NO: 630291 - RNA, 64 nt, hsa; identical to SEQ ID NO: 170540

SEQ ID NO: 630292 - RNA, 64 nt, hsa; identical to SEQ ID NO: 170541

SEQ ID NO: 630293 - RNA, 64 nt, hsa; identical to SEQ ID NO: 170542

SEQ ID NO: 630294 - RNA, 64 nt, hsa; identical to SEQ ID NO: 170543

SEQ ID NO: 630295 - RNA, 64 nt, hsa; identical to SEQ ID NO: 170544

SEQ ID NO: 630296 - RNA, 64 nt, hsa; identical to SEQ ID NO: 170545

SEQ ID NO: 630297 - RNA, 64 nt, hsa; identical to SEQ ID NO: 170546

SEQ ID NO: 630298 - RNA, 64 nt, hsa; identical to SEQ ID NO: 170547

SEQ ID NO: 630299 - RNA, 64 nt, hsa; identical to SEQ ID NO: 170548

SEQ ID NO: 630300 - RNA, 64 nt, hsa; identical to SEQ ID NO: 170549

SEQ ID NO: 630301 - RNA, 64 nt, hsa; identical to SEQ ID NO: 170550

SEQ ID NO: 630302 - RNA, 53 nt, hsa; identical to SEQ ID NO: 170551

SEQ ID NO: 630303 - RNA, 64 nt, hsa; identical to SEQ ID NO: 170552

SEQ ID NO: 630304 - RNA, 64 nt, hsa; identical to SEQ ID NO: 170553

SEQ ID NO: 630305 - RNA, 64 nt, hsa; identical to SEQ ID NO: 170554

SEQ ID NO: 630306 - RNA, 64 nt, hsa; identical to SEQ ID NO: 170555

SEQ ID NO: 630307 - RNA, 64 nt, hsa; identical to SEQ ID NO: 170556

SEQ ID NO: 630308 - RNA, 64 nt, hsa; identical to SEQ ID NO: 170557

SEQ ID NO: 630309 - RNA, 64 nt, hsa; identical to SEQ ID NO: 170558

SEQ ID NO: 630310 - RNA, 64 nt, hsa; identical to SEQ ID NO: 170559

SEQ ID NO: 630311 - RNA, 64 nt, hsa; identical to SEQ ID NO: 170560

SEQ ID NO: 630312 - RNA, 64 nt, hsa; identical to SEQ ID NO: 170561

SEQ ID NO: 630313 - RNA, 64 nt, hsa; identical to SEQ ID NO: 170562

SEQ ID NO: 630314 - RNA, 64 nt, hsa; identical to SEQ ID NO: 170563

SEQ ID NO: 630315 - RNA, 64 nt, hsa; identical to SEQ ID NO: 170564

SEQ ID NO: 630316 - RNA, 64 nt, hsa; identical to SEQ ID NO: 170565

SEQ ID NO: 630317 - RNA, 52 nt, hsa; identical to SEQ ID NO: 170566

SEQ ID NO: 630318 - RNA, 64 nt, hsa; identical to SEQ ID NO: 170567

SEQ ID NO: 630319 - RNA, 64 nt, hsa; identical to SEQ ID NO: 170568

SEQ ID NO: 630320 - RNA, 64 nt, hsa; identical to SEQ ID NO: 170569

SEQ ID NO: 630321 - RNA, 64 nt, hsa; identical to SEQ ID NO: 170570

SEQ ID NO: 630322 - RNA, 64 nt, hsa; identical to SEQ ID NO: 170571

SEQ ID NO: 630323 - RNA, 64 nt, hsa; identical to SEQ ID NO: 170572

SEQ ID NO: 630324 - RNA, 64 nt, hsa; identical to SEQ ID NO: 170573

SEQ ID NO: 630325 - RNA, 64 nt, hsa; identical to SEQ ID NO: 170574

SEQ ID NO: 630326 - RNA, 64 nt, hsa; identical to SEQ ID NO: 170575

SEQ ID NO: 630327 - RNA, 64 nt, hsa; identical to SEQ ID NO: 170576

SEQ ID NO: 630328 - RNA, 64 nt, hsa; identical to SEQ ID NO: 170577

SEQ ID NO: 630329 - RNA, 64 nt, hsa; identical to SEQ ID NO: 170578

SEQ ID NO: 630330 - RNA, 64 nt, hsa; identical to SEQ ID NO: 170579

SEQ ID NO: 630331 - RNA, 64 nt, hsa; identical to SEQ ID NO: 170580

SEQ ID NO: 630332 - RNA, 64 nt, hsa; identical to SEQ ID NO: 170581

SEQ ID NO: 630333 - RNA, 64 nt, hsa; identical to SEQ ID NO: 170582

SEQ ID NO: 630334 - RNA, 64 nt, hsa; identical to SEQ ID NO: 170583

SEQ ID NO: 630335 - RNA, 64 nt, hsa; identical to SEQ ID NO: 170584

SEQ ID NO: 630336 - RNA, 64 nt, hsa; identical to SEQ ID NO: 170585

SEQ ID NO: 630337 - RNA, 64 nt, hsa; identical to SEQ ID NO: 170586

SEQ ID NO: 630338 - RNA, 64 nt, hsa; identical to SEQ ID NO: 170587

SEQ ID NO: 630339 - RNA, 64 nt, hsa; identical to SEQ ID NO: 170588

SEQ ID NO: 630340 - RNA, 64 nt, hsa; identical to SEQ ID NO: 170589

SEQ ID NO: 630341 - RNA, 64 nt, hsa; identical to SEQ ID NO: 170590

SEQ ID NO: 630342 - RNA, 64 nt, hsa; identical to SEQ ID NO: 170591

SEQ ID NO: 630343 - RNA, 64 nt, hsa; identical to SEQ ID NO: 170592

SEQ ID NO: 630344 - RNA, 64 nt, hsa; identical to SEQ ID NO: 170593

SEQ ID NO: 630345 - RNA, 64 nt, hsa; identical to SEQ ID NO: 170594

SEQ ID NO: 630346 - RNA, 64 nt, hsa; identical to SEQ ID NO: 170595

SEQ ID NO: 630347 - RNA, 64 nt, hsa; identical to SEQ ID NO: 170596

SEQ ID NO: 630348 - RNA, 64 nt, hsa; identical to SEQ ID NO: 170597

SEQ ID NO: 630349 - RNA, 64 nt, hsa; identical to SEQ ID NO: 170598

SEQ ID NO: 630350 - RNA, 64 nt, hsa; identical to SEQ ID NO: 170599

SEQ ID NO: 630351 - RNA, 64 nt, hsa; identical to SEQ ID NO: 170600

SEQ ID NO: 630352 - RNA, 64 nt, hsa; identical to SEQ ID NO: 170601

SEQ ID NO: 630353 - RNA, 64 nt, hsa; identical to SEQ ID NO: 170602

SEQ ID NO: 630354 - RNA, 64 nt, hsa; identical to SEQ ID NO: 170603

SEQ ID NO: 630355 - RNA, 64 nt, hsa; identical to SEQ ID NO: 170604

SEQ ID NO: 630356 - RNA, 64 nt, hsa; identical to SEQ ID NO: 170605

SEQ ID NO: 630357 - RNA, 64 nt, hsa; identical to SEQ ID NO: 170606

SEQ ID NO: 630358 - RNA, 64 nt, hsa; identical to SEQ ID NO: 170607

SEQ ID NO: 630359 - RNA, 64 nt, hsa; identical to SEQ ID NO: 170608

SEQ ID NO: 630360 - RNA, 64 nt, hsa; identical to SEQ ID NO: 170609

SEQ ID NO: 630361 - RNA, 64 nt, hsa; identical to SEQ ID NO: 170610

SEQ ID NO: 630362 - RNA, 64 nt, hsa; identical to SEQ ID NO: 170611

SEQ ID NO: 630363 - RNA, 64 nt, hsa; identical to SEQ ID NO: 170612

SEQ ID NO: 630364 - RNA, 64 nt, hsa; identical to SEQ ID NO: 170613

SEQ ID NO: 630365 - RNA, 64 nt, hsa; identical to SEQ ID NO: 170614

SEQ ID NO: 630366 - RNA, 64 nt, hsa; identical to SEQ ID NO: 45231

SEQ ID NO: 630367 - RNA, 64 nt, hsa; identical to SEQ ID NO: 45232

SEQ ID NO: 630368 - RNA, 64 nt, hsa; identical to SEQ ID NO: 45233

SEQ ID NO: 630369 - RNA, 64 nt, hsa; identical to SEQ ID NO: 45234

SEQ ID NO: 630370 - RNA, 64 nt, hsa; identical to SEQ ID NO: 45235

SEQ ID NO: 630371 - RNA, 64 nt, hsa; identical to SEQ ID NO: 45236

SEQ ID NO: 630372 - RNA, 64 nt, hsa; identical to SEQ ID NO: 45237

SEQ ID NO: 630373 - RNA, 64 nt, hsa; identical to SEQ ID NO: 45238

SEQ ID NO: 630374 - RNA, 64 nt, hsa; identical to SEQ ID NO: 45239

SEQ ID NO: 630375 - RNA, 64 nt, hsa; identical to SEQ ID NO: 45240

SEQ ID NO: 630376 - RNA, 64 nt, hsa; identical to SEQ ID NO: 45241

SEQ ID NO: 630377 - RNA, 64 nt, hsa; identical to SEQ ID NO: 45242

SEQ ID NO: 630378 - RNA, 64 nt, hsa; identical to SEQ ID NO: 45243

SEQ ID NO: 630379 - RNA, 64 nt, hsa; identical to SEQ ID NO: 45244

SEQ ID NO: 630380 - RNA, 64 nt, hsa; identical to SEQ ID NO: 45245

SEQ ID NO: 630381 - RNA, 64 nt, hsa; identical to SEQ ID NO: 45246

SEQ ID NO: 630382 - RNA, 64 nt, hsa; identical to SEQ ID NO: 45247

SEQ ID NO: 630383 - RNA, 64 nt, hsa; identical to SEQ ID NO: 45248

SEQ ID NO: 630384 - RNA, 64 nt, hsa; identical to SEQ ID NO: 45249

SEQ ID NO: 630385 - RNA, 64 nt, hsa; identical to SEQ ID NO: 45250

SEQ ID NO: 630386 - RNA, 64 nt, hsa; identical to SEQ ID NO: 45251

SEQ ID NO: 630387 - RNA, 64 nt, hsa; identical to SEQ ID NO: 45252

SEQ ID NO: 630388 - RNA, 64 nt, hsa; identical to SEQ ID NO: 45253

SEQ ID NO: 630389 - RNA, 64 nt, hsa; identical to SEQ ID NO: 45254

SEQ ID NO: 630390 - RNA, 64 nt, hsa; identical to SEQ ID NO: 45255

SEQ ID NO: 630391 - RNA, 64 nt, hsa; identical to SEQ ID NO: 45256

SEQ ID NO: 630392 - RNA, 64 nt, hsa; identical to SEQ ID NO: 45257

SEQ ID NO: 630393 - RNA, 64 nt, hsa; identical to SEQ ID NO: 45258

SEQ ID NO: 630394 - RNA, 64 nt, hsa; identical to SEQ ID NO: 45259

SEQ ID NO: 630395 - RNA, 64 nt, hsa; identical to SEQ ID NO: 45260

SEQ ID NO: 630396 - RNA, 64 nt, hsa; identical to SEQ ID NO: 45261

SEQ ID NO: 630397 - RNA, 64 nt, hsa; identical to SEQ ID NO: 45262

SEQ ID NO: 630398 - RNA, 64 nt, hsa; identical to SEQ ID NO: 45263

SEQ ID NO: 630399 - RNA, 64 nt, hsa; identical to SEQ ID NO: 45264

SEQ ID NO: 630400 - RNA, 64 nt, hsa; identical to SEQ ID NO: 45265

SEQ ID NO: 630401 - RNA, 64 nt, hsa; identical to SEQ ID NO: 45266

SEQ ID NO: 630402 - RNA, 64 nt, hsa; identical to SEQ ID NO: 45267

SEQ ID NO: 630403 - RNA, 64 nt, hsa; identical to SEQ ID NO: 45268

SEQ ID NO: 630404 - RNA, 64 nt, hsa; identical to SEQ ID NO: 45269

SEQ ID NO: 630405 - RNA, 64 nt, hsa; identical to SEQ ID NO: 45270

SEQ ID NO: 630406 - RNA, 64 nt, hsa; identical to SEQ ID NO: 45271

SEQ ID NO: 630407 - RNA, 64 nt, hsa; identical to SEQ ID NO: 45272

SEQ ID NO: 630408 - RNA, 64 nt, hsa; identical to SEQ ID NO: 45273

SEQ ID NO: 630409 - RNA, 64 nt, hsa; identical to SEQ ID NO: 45274

SEQ ID NO: 630410 - RNA, 64 nt, hsa; identical to SEQ ID NO: 45275

SEQ ID NO: 630411 - RNA, 64 nt, hsa; identical to SEQ ID NO: 45276

SEQ ID NO: 630412 - RNA, 64 nt, hsa; identical to SEQ ID NO: 45277

SEQ ID NO: 630413 - RNA, 64 nt, hsa; identical to SEQ ID NO: 45278

SEQ ID NO: 630414 - RNA, 64 nt, hsa; identical to SEQ ID NO: 45279

SEQ ID NO: 630415 - RNA, 64 nt, hsa; identical to SEQ ID NO: 45280

SEQ ID NO: 630416 - RNA, 64 nt, hsa
guagucauuauuugugaaaaauucccaaaaagcuggggaaaacaaauguguaacuuuuccaguu

SEQ ID NO: 630417 - RNA, 64 nt, hsa
uguaacuuuuccaguuacuugacacgauucagugggggaaaaccagcauuuuuuauucuauuga

SEQ ID NO: 630418 - RNA, 64 nt, hsa
accuauccugcucuguuauuucuucaucugcuggggggaaaaaguaaauuacaaacaaacaaac

SEQ ID NO: 630419 - RNA, 64 nt, hsa
acagaaaucauacaugaaaagguuuuacugagaaggggaaaaccuuagauagagggacauguga

SEQ ID NO: 630420 - RNA, 64 nt, hsa
cuuugacaagcuuuauuaaguugagagagagagaggggaaaaaaaaaagccuuucguaguucag

SEQ ID NO: 630421 - RNA, 64 nt, hsa
gugaaaauacaaaauacccaagauuuaagaccggggggaaaaaaccacaaauugguaaauaaag

SEQ ID NO: 630422 - RNA, 64 nt, hsa
ugcagagcuugacuugaugagguuugagguacaaggggaaaagauggcgauucugucuuauaac

SEQ ID NO: 630423 - RNA, 64 nt, hsa
auuggcucaucaagaacacaguccccauguugagggggaaaaugcaguaauguuugugggagcc

SEQ ID NO: 630424 - RNA, 64 nt, hsa
ugaaucaccaauuaaaaaccuuuuugggagggauggggaaaacuacaaacguuugacaaacaca

SEQ ID NO: 630425 - RNA, 64 nt, hsa
uucuuuuauuaauacuuucuuuuauuaauauaugggggaaaauuauuuugacaugacgugguaa

SEQ ID NO: 630426 - RNA, 64 nt, hsa
aaaccuucuaaaaugcuuuugauucugaaaauugggggaaaaaacuuuuaaucacaauuuucuu

SEQ ID NO: 630427 - RNA, 64 nt, hsa
aaaaaacuuuuaaucacaauuuucuucaauacaaggggaaaauauucuugcggauucccaacgu

SEQ ID NO: 630428 - RNA, 64 nt, hsa
aacaauugucccaacaaccacacuuaaauccaguggggaaaaaaagguuaacaguaaaaauuuc

SEQ ID NO: 630429 - RNA, 64 nt, hsa
acguaauucaauuucucacaauagacagaaacagggggaaaauguuugcccuguucaaaguacu

SEQ ID NO: 630430 - RNA, 64 nt, hsa
uagcuuuugaagaaaggccagugauccagcaaagggggaaaaauaugcauuucaccccacauga

SEQ ID NO: 630431 - RNA, 64 nt, hsa
gcagccagcacaaugugacccaacuuaaaauuugggggaaaaagaaugcaggagugaaauaacc

SEQ ID NO: 630432 - RNA, 64 nt, hsa
guaggauguuguugccuuuaacuuuucuuauccaggggaaaauugccauuuuagggucagcaug

SEQ ID NO: 630433 - RNA, 64 nt, hsa
cuggaagcagcauugugugauauucucagaggcaggggaaaauagagggaaaaauagagacuau

SEQ ID NO: 630434 - RNA, 64 nt, hsa
aaaaauaaaaaaaaucaaguauuggcaaagauguggggaaaauucucauaagcuacugaugaga

SEQ ID NO: 630435 - RNA, 64 nt, hsa
gcuuguucuuguggcuucugaugauuucugacuuggggaaaaauggggaagaguugaaauacgu

SEQ ID NO: 630436 - RNA, 64 nt, hsa
uaauuuauaagaaagaaugccauugaauuuuuuaggggaaaaacuacaaauuucuaauuuagcu

SEQ ID NO: 630437 - RNA, 64 nt, hsa
aaccugggcagcagagcaagacucugucucaaaaggggaaaaaaaaaauugcugaugugaccca

SEQ ID NO: 630438 - RNA, 64 nt, hsa
cccuucaauuauuucccaucuccacaaauagucgggggaaaaaauuaaaauuuuccuuuaugau

SEQ ID NO: 630439 - RNA, 64 nt, hsa
uucuuuuagucagaaaugauucaggguuauuugaggggaaaaaaccccauagugccuugauuuu

SEQ ID NO: 630440 - RNA, 64 nt, hsa
gaaauaauagggaaaauaccuauuuuauaugaugggggaaaaaaaguaaucuuuaaacuggcug

SEQ ID NO: 630441 - RNA, 64 nt, hsa
uuuaaagaaaaauaugauacucucagauuuuaagggggaaaacuguucucuuuaaaauauuugu

SEQ ID NO: 630442 - RNA, 64 nt, hsa
guguauauuuuaaugaauauugauguuaacaagaggggaaaacaaaacacagguuuuuucaauu

SEQ ID NO: 630443 - RNA, 64 nt, hsa
aaggccagagaaaaaucacagcuuccuugucggaggggaaaaggacaggugaucuggggaaaac

SEQ ID NO: 630444 - RNA, 64 nt, hsa
cuuccuugucggaggggaaaaggacaggugaucuggggaaaacgcagcuacaccuggagcaagg

SEQ ID NO: 630445 - RNA, 64 nt, hsa
cacuacgcgcagugcucgguuguuuacaaucaguggggaaaagggcagaaccagugcccggccc

SEQ ID NO: 630446 - RNA, 64 nt, hsa
uuccaaaguacauuacaaaucucugaggccauuaggggaaaaggaaggggugugguuugucuuu

SEQ ID NO: 630447 - RNA, 64 nt, hsa
uauuugauaccaagggcuuuuuaaaugucaugggggggaaaaacccaacuuggugaacucccag

SEQ ID NO: 630448 - RNA, 64 nt, hsa
uagaugcuuauccuuuaaauucuacuuuucuugaggggaaaaagucuucuucuggaaauacaua

SEQ ID NO: 630449 - RNA, 64 nt, hsa
uugaaucacauguuaaaccucaguuuuauaagagggggaaaaaaccgucucuacauaguaaaac

SEQ ID NO: 630450 - RNA, 64 nt, hsa
uuaguuuccaggcacuugaacugugcuacaaguaggggaaaaccuacuuuaaaguaugguaaau

SEQ ID NO: 630451 - RNA, 64 nt, hsa
aggucacucgggaagggggaaaaaguuuaaaaugggggaaaaaaagccaucuuuuuaaacaaaa

SEQ ID NO: 630452 - RNA, 64 nt, hsa
aucagucuaacaagucauuaggucacucgggaagggggaaaaaguuuaaaaugggggaaaaaaa

SEQ ID NO: 630453 - RNA, 64 nt, hsa
uguguuggggaguggcaggggaugauuuguuucaggggaaaaugcccacauuuuaacuuuuaaa

SEQ ID NO: 630454 - RNA, 64 nt, hsa
auaacuugaguuuuccuaaguucaucagaaugaaggggaaaaacagccaucauccaacauuauu

SEQ ID NO: 630455 - RNA, 64 nt, hsa
agagugucacacuccuggcuaucucagggggaauggggaaaagaaucuuucaagggcaaagaac

SEQ ID NO: 630456 - RNA, 64 nt, hsa
gucgcacuuggacucugaggguuggguguggaagggggaaaaggagauggagaccugcucccca

SEQ ID NO: 630457 - RNA, 64 nt, hsa
aacauuugcuaaaugaaauuacugauugaaauuuggggaaaagugaauaagaagacuaucuagg

SEQ ID NO: 630458 - RNA, 64 nt, hsa
agcuuuuccagaagcugauucccauuuuaagaugggggaaaauuaagguuugagguuuuagaaa

SEQ ID NO: 630459 - RNA, 64 nt, hsa
ucccagugaccuggaagcaagcccacccuccccaggggaaaaucuaggagaaugcauuccucug

SEQ ID NO: 630460 - RNA, 64 nt, hsa
cagauucugcaacugacucauuuucaggagguugggggaaaagauguuuaugaguuuagccaac

SEQ ID NO: 630461 - RNA, 64 nt, hsa
uugcacuccagccugggcgacagagucuccaucuggggaaaaaaauuaaauaaauaaacucccg

SEQ ID NO: 630462 - RNA, 64 nt, hsa
uauucugagguacaggagccgcggcuuucugaugggggaaaaugccgccuuaggcuggagccaa

SEQ ID NO: 630463 - RNA, 64 nt, hsa
ggaggugggcaggauggagaacagugccuguuugggggaaaacaggaaaucuuguuaggcuuga

SEQ ID NO: 630464 - RNA, 64 nt, hsa
ccuuccucacagucuguagccaucugauauccuaggggaaaaggaaggccagggguucacauag

SEQ ID NO: 630465 - RNA, 64 nt, hsa
aaauauuaaaaguaguucugguuuauuaaucaacggggaaaacaucuucuccaaaaaacuugga

SEQ ID NO: 630466 - RNA, 64 nt, hsa
gauuaaguauucccucuugucaaacuggaagcuaggggaaaaagagggauuuuuauccuuuacu

SEQ ID NO: 630467 - RNA, 64 nt, hsa
uggggggcaauaaucaacugaauugcaaaauuugggggaaaauggcacuauccguguacgaauc

SEQ ID NO: 630468 - RNA, 64 nt, hsa
gaucuagaugucuguuuguuguauggaaauuuugggggaaaaaauccaaaacacaaacuguggg

SEQ ID NO: 630469 - RNA, 64 nt, hsa
uugaagccauaaaaauauuaguuugguguguauuggggaaaauagcuaaaagucuaauuuuuac

SEQ ID NO: 630470 - RNA, 64 nt, hsa
cuuguuuucuugcuuuauucugggcaaguuugaaggggaaaauuugugcugcuguuagugcaac

SEQ ID NO: 630471 - RNA, 64 nt, hsa
aguuacuacaucaaucugcaacuaucaaaaaugaggggaaaagguucaggcuguuaacaauucc

SEQ ID NO: 630472 - RNA, 64 nt, hsa
cuaacucccauugacauugcuucuuaccagacauggggaaaagcuaccuuuccugaaaggggag

SEQ ID NO: 630473 - RNA, 64 nt, hsa
guagaugagaauagaagaguaccuguaccuacaaggggaaaaaugaaugcaauucuuuauuuga

SEQ ID NO: 630474 - RNA, 64 nt, hsa
uagaccuugguuugguaguucuuguuuuuaauaaggggaaaaagauaaaauaaccccuauuuuu

SEQ ID NO: 630475 - RNA, 64 nt, hsa
cuuuccguuucaagaccuuuuucuuuuauugcaaggggaaaaaaaugucaucuccccccaccuc

SEQ ID NO: 630476 - RNA, 64 nt, hsa
ucuuuucaagucuccucagucaucaauaguuccuggggaaaaacagagcugguagacuugaaga

SEQ ID NO: 630477 - RNA, 64 nt, hsa
aagaaacacaagauuuaauuauuuuucuacuuggggggaaaaaaguccucauguagaagcaccc

SEQ ID NO: 630478 - RNA, 64 nt, hsa
acuccugaccccagauucaacuuugcaaacaacaggggaaaaaaauggggaaaagaaaaaccac

SEQ ID NO: 630479 - RNA, 64 nt, hsa
agauucaacuuugcaaacaacaggggaaaaaaauggggaaaagaaaaaccacgagagagggaaa

SEQ ID NO: 630480 - RNA, 64 nt, hsa
ugaugcaucaggaagcaacgugauggaggacuugggggaaaaggaucacauacucagucuaugg

SEQ ID NO: 630481 - RNA, 64 nt, hsa
cugagcugcuuccuguuuucuucugauugcuccuggggaaaacacgccuuguccugaagaacaa

SEQ ID NO: 630482 - RNA, 64 nt, hsa
guuagcaugugccucacuuuaagaaaguccuguaggggaaaaaaaaaacugucagagcgaauuc

SEQ ID NO: 630483 - RNA, 64 nt, hsa
gagaugcuucugagggaugcugaccucccacuauggggaaaaggguugcuuggaggaccugggg

SEQ ID NO: 630484 - RNA, 64 nt, hsa
ugucauaugcaacuaaaacaggguagacaggccaggggaaaaaggcacucagggcacacagcau

SEQ ID NO: 630485 - RNA, 64 nt, hsa
gaaaagaauacacuaaguuaaugucuaagauaauggggaaaauagaaaauaacauuauuaagug

SEQ ID NO: 630486 - RNA, 64 nt, hsa
uaauugugcugcuacauuauacuggaaauuaacaggggaaaagggaagagcucuuggcucccuu

SEQ ID NO: 630487 - RNA, 64 nt, hsa
caguggaaguuaagaggggugagaaaacaaagaaggggaaaaacugacaacuaacaaaaccagc

SEQ ID NO: 630488 - RNA, 64 nt, hsa
gacauauuuaacuggugcacuuuguaaauucccuggggaaaacuugcagcuaaggaggggaaaa

SEQ ID NO: 630489 - RNA, 64 nt, hsa
uguaaauucccuggggaaaacuugcagcuaaggaggggaaaaaaauguuguuuccuaauaucaa

SEQ ID NO: 630490 - RNA, 64 nt, hsa
uggugaaucuauggacagucauacacauacaucaggggaaaauguguguguacaacccaaauuu

SEQ ID NO: 630491 - RNA, 64 nt, hsa
ccacuaccucccacaauaccuagccauuuuggaaggggaaaacaugcgguggucuagcuguaua

SEQ ID NO: 630492 - RNA, 64 nt, hsa
aaagcuuaagugggaaaaaggaagaugauugucaggggaaaaacuuacaaaaugcuacaguguu

SEQ ID NO: 630493 - RNA, 64 nt, hsa
cuuccugccccuaguauuugauuacaaggaaccaggggaaaaaaacuuucuuagacacacuggc

SEQ ID NO: 630494 - RNA, 64 nt, hsa
acuaugaaaugggguauauaaccacgacucugguggggaaaaccguuuuuuaaaggacacacac

SEQ ID NO: 630495 - RNA, 64 nt, hsa
uucugaccagugugcguguaacuuuaugaucugaggggaaaaauggcuuuuggguuuuuguuua

SEQ ID NO: 630496 - RNA, 64 nt, hsa
agagacaucaaguaugguaggggagggcaggcuuggggaaaauggccaugcaggagguggagaa

SEQ ID NO: 630497 - RNA, 64 nt, hsa
gaucuauggaagucgugucuuacuccaggugaagggggaaaaaaaaagccuauacuuuggcagg

SEQ ID NO: 630498 - RNA, 64 nt, hsa
uggcgguuuuguggaauagaaaaggcggaaagguggggaaaagauugagaaauuggaugguugc

SEQ ID NO: 630499 - RNA, 64 nt, hsa
uuucuacucugucuccucaacucuguugauauuuggggaaaauucuguuuuucauagauucuuu

SEQ ID NO: 630500 - RNA, 64 nt, hsa
uuuaacuccuggguuggcuguuggguagacagguggggaaaaggcccgugagucauuguaagca

SEQ ID NO: 630501 - RNA, 64 nt, hsa
ugaacauggaccacgcaguugcgacaggaggccaggggaaaaaccccugcucacuuguuugccc

SEQ ID NO: 630502 - RNA, 64 nt, hsa
acuugagcgccguguucuucagccucagcuggaaggggaaaagucagggccuucccggcggggg

SEQ ID NO: 630503 - RNA, 64 nt, hsa
gcugccugccugugggcugggagacagggacaauggggaaaaguuaaggagcaaaauggggguu

SEQ ID NO: 630504 - RNA, 64 nt, hsa
ggaagcagaaguucaaggugaucgugccagcccgggggaaaaggcugaguccaccgcugugcag

SEQ ID NO: 630505 - RNA, 64 nt, hsa
gccucaguuuccccaucucuagaaugaggauguuggggaaaaucccggaucaggaucuagaagu

SEQ ID NO: 630506 - RNA, 64 nt, hsa
aaaagaaaucauuuggguuggguggggcgggaugggggaaaaguauauaaugcuugcaccucag

SEQ ID NO: 630507 - RNA, 62 nt, hsa
caaaugacaaaaaaacuugauucacuaauuagggggaaaaaaggugagcauauguuucaauu

SEQ ID NO: 630508 - RNA, 64 nt, hsa
aaccccuuccacuucccacuucccccaggcuuggggggaaaacagggcaugagccuucuggggc

SEQ ID NO: 630509 - RNA, 64 nt, hsa
uguucacugugcaaagccccaguagucggauuccggggaaaagaacaaguaucuaguuuugaug

SEQ ID NO: 630510 - RNA, 64 nt, hsa
ccagucaauuaugacaagguuaaagaaguaacucggggaaaagaugaaaaucccgcucuguuuc

SEQ ID NO: 630511 - RNA, 64 nt, hsa
auuuacaaauauugucauccgcuugcugugcuguggggaaaaaaaaguagaggaaaaagugugu

SEQ ID NO: 630512 - RNA, 64 nt, hsa
caagauggaggauguccacagaggcugaccugugggggaaaagaagugcucagguaagguuguc

SEQ ID NO: 630513 - RNA, 64 nt, hsa
gccugaggcagggcgggaggcaugcaagccagugggggaaaaccccucugaagcugggcagccc

SEQ ID NO: 630514 - RNA, 64 nt, hsa
aaagcaaaaugcugugauaaaccaaacagggaagggggaaaaacccuccuccuugggauuuuuu

SEQ ID NO: 630515 - RNA, 64 nt, hsa
aacccgacacggacuuauuuuugucauuagcaagggggaaaaggccaaaggacaagggccucuu

SEQ ID NO: 630516 - RNA, 64 nt, hsa
caugguauccugguuauuuuuuuuaagucaucugggggaaaaccuguuuaucacuccagugauu

SEQ ID NO: 630517 - RNA, 64 nt, hsa
gguuagaaauuggugccucagcccuaucuagacuggggaaaaauugaggaucucuguuuuuccu

SEQ ID NO: 630518 - RNA, 64 nt, hsa; identical to SEQ ID NO: 370820

SEQ ID NO: 630519 - RNA, 64 nt, hsa; identical to SEQ ID NO: 370821

SEQ ID NO: 630520 - RNA, 64 nt, hsa; identical to SEQ ID NO: 370822

SEQ ID NO: 630521 - RNA, 64 nt, hsa; identical to SEQ ID NO: 370823

SEQ ID NO: 630522 - RNA, 64 nt, hsa; identical to SEQ ID NO: 370824

SEQ ID NO: 630523 - RNA, 64 nt, hsa; identical to SEQ ID NO: 370825

SEQ ID NO: 630524 - RNA, 64 nt, hsa; identical to SEQ ID NO: 370826

SEQ ID NO: 630525 - RNA, 64 nt, hsa; identical to SEQ ID NO: 370827

SEQ ID NO: 630526 - RNA, 64 nt, hsa; identical to SEQ ID NO: 370828

SEQ ID NO: 630527 - RNA, 64 nt, hsa; identical to SEQ ID NO: 370829

SEQ ID NO: 630528 - RNA, 64 nt, hsa; identical to SEQ ID NO: 370830

SEQ ID NO: 630529 - RNA, 64 nt, hsa; identical to SEQ ID NO: 370831

SEQ ID NO: 630530 - RNA, 64 nt, hsa; identical to SEQ ID NO: 370832

SEQ ID NO: 630531 - RNA, 64 nt, hsa; identical to SEQ ID NO: 370833

SEQ ID NO: 630532 - RNA, 64 nt, hsa; identical to SEQ ID NO: 370834

SEQ ID NO: 630533 - RNA, 64 nt, hsa; identical to SEQ ID NO: 370835

SEQ ID NO: 630534 - RNA, 64 nt, hsa; identical to SEQ ID NO: 370836

SEQ ID NO: 630535 - RNA, 64 nt, hsa; identical to SEQ ID NO: 370837

SEQ ID NO: 630536 - RNA, 64 nt, hsa; identical to SEQ ID NO: 370838

SEQ ID NO: 630537 - RNA, 64 nt, hsa; identical to SEQ ID NO: 370839

SEQ ID NO: 630538 - RNA, 64 nt, hsa; identical to SEQ ID NO: 370840

SEQ ID NO: 630539 - RNA, 64 nt, hsa; identical to SEQ ID NO: 370841

SEQ ID NO: 630540 - RNA, 64 nt, hsa; identical to SEQ ID NO: 370842

SEQ ID NO: 630541 - RNA, 64 nt, hsa; identical to SEQ ID NO: 370843

SEQ ID NO: 630542 - RNA, 64 nt, hsa; identical to SEQ ID NO: 370844

SEQ ID NO: 630543 - RNA, 64 nt, hsa; identical to SEQ ID NO: 370845

SEQ ID NO: 630544 - RNA, 64 nt, hsa; identical to SEQ ID NO: 370846

SEQ ID NO: 630545 - RNA, 64 nt, hsa; identical to SEQ ID NO: 370847

SEQ ID NO: 630546 - RNA, 64 nt, hsa; identical to SEQ ID NO: 370848

SEQ ID NO: 630547 - RNA, 64 nt, hsa; identical to SEQ ID NO: 370849

SEQ ID NO: 630548 - RNA, 64 nt, hsa; identical to SEQ ID NO: 370850

SEQ ID NO: 630549 - RNA, 64 nt, hsa; identical to SEQ ID NO: 370851

SEQ ID NO: 630550 - RNA, 64 nt, hsa; identical to SEQ ID NO: 370852

SEQ ID NO: 630551 - RNA, 64 nt, hsa; identical to SEQ ID NO: 370853

SEQ ID NO: 630552 - RNA, 64 nt, hsa; identical to SEQ ID NO: 370854

SEQ ID NO: 630553 - RNA, 60 nt, hsa; identical to SEQ ID NO: 370855

SEQ ID NO: 630554 - RNA, 64 nt, hsa; identical to SEQ ID NO: 370856

SEQ ID NO: 630555 - RNA, 64 nt, hsa; identical to SEQ ID NO: 370857

SEQ ID NO: 630556 - RNA, 64 nt, hsa; identical to SEQ ID NO: 370858

SEQ ID NO: 630557 - RNA, 64 nt, hsa; identical to SEQ ID NO: 370859

SEQ ID NO: 630558 - RNA, 64 nt, hsa; identical to SEQ ID NO: 370860

SEQ ID NO: 630559 - RNA, 64 nt, hsa; identical to SEQ ID NO: 370861

SEQ ID NO: 630560 - RNA, 64 nt, hsa; identical to SEQ ID NO: 370862

SEQ ID NO: 630561 - RNA, 64 nt, hsa; identical to SEQ ID NO: 370863

SEQ ID NO: 630562 - RNA, 64 nt, hsa; identical to SEQ ID NO: 370864

SEQ ID NO: 630563 - RNA, 64 nt, hsa; identical to SEQ ID NO: 370865

SEQ ID NO: 630564 - RNA, 64 nt, hsa; identical to SEQ ID NO: 370866

SEQ ID NO: 630565 - RNA, 64 nt, hsa; identical to SEQ ID NO: 370867

SEQ ID NO: 630566 - RNA, 64 nt, hsa; identical to SEQ ID NO: 370868

SEQ ID NO: 630567 - RNA, 64 nt, hsa; identical to SEQ ID NO: 370869

SEQ ID NO: 630568 - RNA, 64 nt, hsa
uuuccacucugcacauuguagagggaacacucuguaggcccaugggucccuuacuagagagguu

SEQ ID NO: 630569 - RNA, 64 nt, hsa
uaaggguuagcccuuggccaaaucuuuugccgucuaggcccagccaggcuuuucugacuaaaua

SEQ ID NO: 630570 - RNA, 64 nt, hsa
agguccacucccugcuccacgaagccuuaagccauaggcccaggauauuucugagagugaaacc

SEQ ID NO: 630571 - RNA, 64 nt, hsa
ccuugggacagccagagcuggguggggacagugauaggcccaagguccccuccacaucccagca

SEQ ID NO: 630572 - RNA, 64 nt, hsa
gccagcugcugcaggcaggacuccagcgucaggauguugccacuuggaguaugaacaaugggca

SEQ ID NO: 630573 - RNA, 64 nt, hsa
accuugcauccaggguaugguguaaauaaaccuguguugccauggcaacagagaccggcgguac

SEQ ID NO: 630574 - RNA, 64 nt, hsa
uagaaagaaaagacccugagacuccagaaucugcuguugccauagccccauaugugugaauucu

SEQ ID NO: 630575 - RNA, 64 nt, hsa
ggguggcaccuccugagaaggcgaggagagugguuguugccaacuaagcccucgaaccaaggca

SEQ ID NO: 630576 - RNA, 64 nt, hsa
guuuuacucaauugguccccuacugaugggcauuuguugccauuauuuuacuguuauaaacaau

SEQ ID NO: 630577 - RNA, 64 nt, hsa
uagaacauucuuuguaacccgaauguucccuggauguugccagcuuuuggauacaaauaauaua

SEQ ID NO: 630578 - RNA, 64 nt, hsa
cgccaagucccuggugcuggguuugcucucccgcuguugccaggggcuggaagcuggagggguc

SEQ ID NO: 630579 - RNA, 64 nt, hsa
ugccaugcagagacguggcuggcccagaauggccuguugccauagcaacuggaggcgauggggc

SEQ ID NO: 630580 - RNA, 64 nt, hsa
cagagggggaacagccagcaccgcucuagcugguuguugccaugccggaaugugggccuagugu

SEQ ID NO: 630581 - RNA, 64 nt, hsa
agcugguuguugccaugccggaaugugggccuaguguugccagaucuucugauuuuucgaaaga

SEQ ID NO: 630582 - RNA, 64 nt, hsa
cucuguugcagggaaccaggaggaaagggaaagauguugccauauuuccuacucuuuaggcaug

SEQ ID NO: 630583 - RNA, 64 nt, hsa
ucugaagaaauggcacagggacagugaaugguaguguugccacccugugcugaggccugaggcc

SEQ ID NO: 630584 - RNA, 64 nt, hsa
auguuuguuuguuuuuugagacaggaucucacucuguugccagggcuguagugcagugguguga

SEQ ID NO: 630585 - RNA, 64 nt, hsa
uuuuuguauuuuuuguagagacgggguuuugccauguugccaaggcugguuucaaacuccugga

SEQ ID NO: 630586 - RNA, 64 nt, hsa
aaaaaaaagaaaagaaaaagacagcaucucacuauguugccaaggcucaucuugagaagcaggc

SEQ ID NO: 630587 - RNA, 64 nt, hsa
uaugugcaagguagcaugaugagcaacuugaguuuguugccacugagaagcaggcggguugggu

SEQ ID NO: 630588 - RNA, 64 nt, hsa
aguugugugcucuguugaagccccacagagcagguguugccaaugcugcgguucgugcagaagc

SEQ ID NO: 630589 - RNA, 64 nt, hsa
cagugcuggaagcaggaacccaggcuccagaagguguugccaggggcccagaugcccugacacu

SEQ ID NO: 630590 - RNA, 64 nt, hsa
uuccuuguggacaacggggcccuguucaccaagcuguugccauagagacugucaacguuguccu

SEQ ID NO: 630591 - RNA, 64 nt, hsa
augcuccacccccaggcgguuuggaccccaccacuguugccauggugaccaaacucuggagucc

SEQ ID NO: 630592 - RNA, 64 nt, hsa
gucuaaauuguugccauguggaaauggggcagaguguugccaauuuucugauuuuuugugugga

SEQ ID NO: 630593 - RNA, 64 nt, hsa
agagccauguggagagcucauggccugucuaaauuguugccauguggaaauggggcagaguguu

SEQ ID NO: 630594 - RNA, 64 nt, hsa
aauauuuauaguuaaaugauuuauauuugaaauguguugccagacuuaacccagcagacacucu

SEQ ID NO: 630595 - RNA, 64 nt, hsa
auauuucauugguauuuguggagccuauguuuaauguugccacguguuuuuauguccuuuuugu

SEQ ID NO: 630596 - RNA, 64 nt, hsa; identical to SEQ ID NO: 140724

SEQ ID NO: 630597 - RNA, 64 nt, hsa; identical to SEQ ID NO: 140725

SEQ ID NO: 630598 - RNA, 64 nt, hsa; identical to SEQ ID NO: 140726

SEQ ID NO: 630599 - RNA, 64 nt, hsa; identical to SEQ ID NO: 140727

SEQ ID NO: 630600 - RNA, 64 nt, hsa; identical to SEQ ID NO: 140728

SEQ ID NO: 630601 - RNA, 64 nt, hsa; identical to SEQ ID NO: 140729

SEQ ID NO: 630602 - RNA, 64 nt, hsa; identical to SEQ ID NO: 140730

SEQ ID NO: 630603 - RNA, 64 nt, hsa; identical to SEQ ID NO: 140731

SEQ ID NO: 630604 - RNA, 64 nt, hsa; identical to SEQ ID NO: 140732

SEQ ID NO: 630605 - RNA, 64 nt, hsa; identical to SEQ ID NO: 140733

SEQ ID NO: 630606 - RNA, 63 nt, hsa
uucagaagguggauaggucuucccacuccagcauggcuugaacucuuaggggucugcagugcu

SEQ ID NO: 630607 - RNA, 63 nt, hsa
uacacaccaggcagggcugucugccaccuuguguggcuugacccccuguggaggggagugccu

SEQ ID NO: 630608 - RNA, 63 nt, hsa
ugauuuggaggcugucuucugccagauuuuuuguggcuugagaugauauuuucgaacccuucu

SEQ ID NO: 630609 - RNA, 63 nt, hsa
uauuugcagcuggucuaaccaguuacguaugucuggcuugauuacauggccagagcaacauaa

SEQ ID NO: 630610 - RNA, 63 nt, hsa
cuguugcugggggccgauucugaucaagacacauggcuugaaaauggaagacacaaaacugag

SEQ ID NO: 630611 - RNA, 63 nt, hsa
ucaguaguuauugccaauauuguuguuggucaauggcuugaagauaaacuuucuaauaauuau

SEQ ID NO: 630612 - RNA, 63 nt, hsa
uagauaaauacuuauacuuugcaaagucaaaaauggcuugauuuuuggaaacaauauagaggu

SEQ ID NO: 630613 - RNA, 63 nt, hsa
augacuccuaagagaguuguaaaaauagaggcuuggcuugaauguacauagaugguaccuggc

SEQ ID NO: 630614 - RNA, 63 nt, hsa
aucccgacacuuugggaggccaaggcaggaggauggcuugaagccaguaguucaagaccagcc

SEQ ID NO: 630615 - RNA, 63 nt, hsa
ccuguuccccacuccacaggagggagcugacguuggcuugaaaggaguaaagucaacaucugc

SEQ ID NO: 630616 - RNA, 63 nt, hsa
aaugaccucuguccacccacuuuuuuauugcacuggcuugaauacaguagcaguguugauaga

SEQ ID NO: 630617 - RNA, 63 nt, hsa
uaucuuggaugagaaagaugggcaauccugggcuggcuugagggaaucaugggcagaggauga

SEQ ID NO: 630618 - RNA, 63 nt, hsa
aaacuucucuccuccccacccuaccugccccccuggcuugagagaauaucuucaaggaucaaa

SEQ ID NO: 630619 - RNA, 63 nt, hsa
agaaaacuugcuacuaaacuauuaggccaucaauggcuugaauaaaaaccagagaagguuuuu

SEQ ID NO: 630620 - RNA, 63 nt, hsa
cugggcgggacagagcagucaagaaccacgguguggcuugagaaacaguccugcuuccugagc

SEQ ID NO: 630621 - RNA, 63 nt, hsa
agcccuacccuacccucauuccccgacacccucuggcuugaaccauggcugagcagugccggc

SEQ ID NO: 630622 - RNA, 63 nt, hsa
gagugcaacuguggcuuagcuaauauugcaauguggcuugaauguagguagcauccuuugaug

SEQ ID NO: 630623 - RNA, 63 nt, hsa
cacaaugaaauuauauuuucuuuguaaagaaaguggcuugaaaucuuuuuuguucaaagauua

SEQ ID NO: 630624 - RNA, 63 nt, hsa
aaaaacccugagugugauucugggcagccggccuggcuugaaguccgccaugacccugggcac

SEQ ID NO: 630625 - RNA, 63 nt, hsa
augucccuuaaccaugauuauuaacuaaguuuguggcuugaguuuacaaauucuacuuguugc

SEQ ID NO: 630626 - RNA, 63 nt, hsa
gucaguuuccccucaaaguacccaaaguagccuuggcuugaguuuuuguccuugccuccuuuu

SEQ ID NO: 630627 - RNA, 63 nt, hsa
augaaccuuuugucgugggacuucaggccacauuggcuugaaggcauucguuuccuucugggg

SEQ ID NO: 630628 - RNA, 63 nt, hsa
gugcauggugccucaugccuguaaugaggcagauggcuugaguccaggaguucaagacuagcc

SEQ ID NO: 630629 - RNA, 63 nt, hsa
gagaauuguagggauugggggacccugccugccuggcuugagaacagcccugcugcccuuuug

SEQ ID NO: 630630 - RNA, 63 nt, hsa
cucucuugcucuguugcccaggcuggagugcacuggcuugaucuuggcuaacugcaacuucca

SEQ ID NO: 630631 - RNA, 63 nt, hsa
agcacuuugagaggccgaggugagacgggaagauggcuugaacucaggaguucgagacuagcc

SEQ ID NO: 630632 - RNA, 63 nt, hsa
aguaaagaaaaggugcaaugcagugcuuuuagauggcuugauauaccaaauaacaauauagaa

SEQ ID NO: 630633 - RNA, 63 nt, hsa
cuucuuaauauggugcugauguuuuugugucaauggcuugaaacuggcaagauuaacaaaauu

SEQ ID NO: 630634 - RNA, 63 nt, hsa
ucucugcccugaauccgaaaucugaaaauguacuggcuugaacaaaauuuguuuuguguguua

SEQ ID NO: 630635 - RNA, 63 nt, hsa
uaaaaauuaaaauccuugacauagaccauagcauggcuugaaaugcuaugucugcaugauaau

SEQ ID NO: 630636 - RNA, 63 nt, hsa
aucccaacuacuagggacagugaggcagaaggauggcuugagcccaagaguuugaagcugcag

SEQ ID NO: 630637 - RNA, 63 nt, hsa
uuccaccucagccucccaaagugcugagauuacuggcuugagccacugcacccaccccuccag

SEQ ID NO: 630638 - RNA, 63 nt, hsa
uagugggaggcugcaucuucccuaaccucugucuggcuugagcguugacagagaaaaggcuua

SEQ ID NO: 630639 - RNA, 63 nt, hsa
ucaacuuucggcgcccuuauuccccugccuuccuggcuugauugaaggaaagcuugaaaaggc

SEQ ID NO: 630640 - RNA, 63 nt, hsa
uaacuuagcaagaggacaaguaaagggcccucuuggcuugauuuugcuucuuucuuucugugg

SEQ ID NO: 630641 - RNA, 63 nt, hsa
gcugcuccucucugccgccuuuccuccauuccauggcuugaaaccucugccugauguggcucc

SEQ ID NO: 630642 - RNA, 63 nt, hsa
agcagagugacauggugguggcacuuauggugguggcuugagagccuuggggaaauuagggcc

SEQ ID NO: 630643 - RNA, 63 nt, hsa
accggguacugggcggagagcccccguggcauuuggcuugaugguuugguuuggcuuuugcug

SEQ ID NO: 630644 - RNA, 63 nt, hsa
gaaccuacuuaagauagaacaugguuuuggcuauggcuugacucaugggcuuucagugcuuuu

SEQ ID NO: 630645 - RNA, 63 nt, hsa
agcgucagccuguagccgaggggccaggguuccuggcuugaaucugccaccacgggccgguug

SEQ ID NO: 630646 - RNA, 63 nt, hsa
uagcaaggauaccaaggcaagcauacauguagcuggcuugaguuuguaccaaaacaguccuuc

SEQ ID NO: 630647 - RNA, 63 nt, hsa
gacccuucuaagaagauugggcaguuggguuucuggcuugagaugaauccaagcagcagaaug

SEQ ID NO: 630648 - RNA, 63 nt, hsa
uguaucuuaaaaccuauuuuugaaaaacaaacuuggcuugauaaucauuugggcagcuugggu

SEQ ID NO: 630649 - RNA, 63 nt, hsa
gcugcaguacgacugucuggcccugaauuugcauggcuugagaaggcacaccguaagacuaag

SEQ ID NO: 630650 - RNA, 63 nt, hsa
auguuagaaaagaauuuuuaaacaaucuucagauggcuugaacacgugccauuauaguaucua

SEQ ID NO: 630651 - RNA, 63 nt, hsa
cccccucgacggacuuauaauguuucagguggcuggcuugaacaugagucugcugugcuaucu

SEQ ID NO: 630652 - RNA, 63 nt, hsa
ccagacuauagcauauuagcuguuuagaagggauggcuugaaaggaaggagacugaaaaacac

SEQ ID NO: 630653 - RNA, 63 nt, hsa
aggcuccuugcuacuuaugcaaauuucugcagcuggcuugaauuucuccccagaaaauggguu

SEQ ID NO: 630654 - RNA, 63 nt, hsa
ccagugaauaaggacuccagaaucuaaagccaguggcuugaggcuacagggaguguaguaaag

SEQ ID NO: 630655 - RNA, 63 nt, hsa
caucgugaaagguacauuuaaaauauguuaaauuggcuugaaauuuucagagaauuuugucuu

SEQ ID NO: 630656 - RNA, 63 nt, hsa
cacgugcccacugaaguggcaccaacagaaguuuggcuugaacuaaaggacauuuuauuuuuu

SEQ ID NO: 630657 - RNA, 63 nt, hsa
aucacauuuguagaaauguaaugcgguucugaguggcuugaaauguacagaauguuuugaaag

SEQ ID NO: 630658 - RNA, 63 nt, hsa
guauacuucguaagaaggaaugcgaguaaggauuggcuugaauuccauggaauuucuaguaug

SEQ ID NO: 630659 - RNA, 63 nt, hsa
aucccagcuacucagggggcugaggcaggggaauggcuugaacccaggaggcagagguugcag

SEQ ID NO: 630660 - RNA, 63 nt, hsa
cuggacagaaacaggaaugugagcugggggagcuggcuugaguuucucaaaagccaucggaag

SEQ ID NO: 630661 - RNA, 63 nt, hsa
ggagauuagcauuuuaguuugugugcgcccgccuggcuugaggcaguaguuuaggaaugacaa

SEQ ID NO: 630662 - RNA, 63 nt, hsa
uugcagaacuguuguagaaagcugccuuauaguuggcuugacaaagcauaauucucucauaac

SEQ ID NO: 630663 - RNA, 63 nt, hsa
guugggauugucaggguccuggccccucagaacuggcuugaucaagggccuuauguggagcag

SEQ ID NO: 630664 - RNA, 63 nt, hsa
acaguuggcaugccaggguucgagaagagugaauggcuugacguacuugcaguuaacugugca

SEQ ID NO: 630665 - RNA, 63 nt, hsa
gacuggcaggcggggccucaagccugcagccacuggcuugauugggcccuggacguugagccc

SEQ ID NO: 630666 - RNA, 63 nt, hsa
agggcuccacugcugacaagguuugagaacugcuggcuugaggugagaaccccuuuaaccucu

SEQ ID NO: 630667 - RNA, 63 nt, hsa
gucagugaagaccgggagggaaugucagugaauuggcuugaauguucuguggcaauccacagg

SEQ ID NO: 630668 - RNA, 63 nt, hsa
agacaugaacuauacaaacaggauauauuuauauggcuugagguauguuuuguaauagcguug

SEQ ID NO: 630669 - RNA, 63 nt, hsa
acuguaaacauggcugguggaaaaucacgauuguggcuugauguggcaagccgaaaccacuug

SEQ ID NO: 630670 - RNA, 63 nt, hsa
uauguuuucuguaucgacacauuuuauuaaacuuggcuugauugcuucuuuauaguagucccu

SEQ ID NO: 630671 - RNA, 63 nt, hsa
gaaccuuacaaggcucuaaaaugagaugugauauggcuugaaaugggaggagacacuuucuga

SEQ ID NO: 630672 - RNA, 63 nt, hsa
ucccugguguuguguguuaccuacccuuuggcuuggcuugaccucuccuugugagcucaccug

SEQ ID NO: 630673 - RNA, 63 nt, hsa
acagggacuauaacagggaggcagaauucagguuggcuugacaacacaccuuaggaacaugug

SEQ ID NO: 630674 - RNA, 63 nt, hsa
agguucucauguggugaagcccuucauuuaaguuggcuugaaucucaucagcaggcagccuca

SEQ ID NO: 630675 - RNA, 63 nt, hsa
uucuggacacuagauuuuuuuguuuggggagguuggcuugaacauaaaugaaaauauccuguu

SEQ ID NO: 630676 - RNA, 63 nt, hsa
aauaacgcacgguacuguucuugaaauaccuaauggcuugaaauucuagucuguuugugaaag

SEQ ID NO: 630677 - RNA, 63 nt, hsa
aaugugcugacucccaaaagaggagaaaugcaauggcuugagcuugcaugugucacagguuug

SEQ ID NO: 630678 - RNA, 63 nt, hsa
uaaccaaauaaugaccaucgauggcucaaagaguggcuugaauauaucccauggguuaucugu

SEQ ID NO: 630679 - RNA, 63 nt, hsa
ugagccugcaauagagcccugaaaucaagagcauggcuugagugugugaauaugaugugugca

SEQ ID NO: 630680 - RNA, 63 nt, hsa
aaucuggagcacaccgaagggcaaucuaaauuguggcuugaaggacugcacuaaaacccacua

SEQ ID NO: 630681 - RNA, 63 nt, hsa
ugauuguugaaugaacaacaaaguugaaagccauggcuugaucuuguaaauauauaaauguaa

SEQ ID NO: 630682 - RNA, 63 nt, hsa
gaaagaguguggggagaaauaagaauggaaagguggcuugagcucagcuccuggagggacagu

SEQ ID NO: 630683 - RNA, 63 nt, hsa
auuucccuucuuuuguuucucuuguuugugcuauggcuugacccagcauguccccucaaauga

SEQ ID NO: 630684 - RNA, 63 nt, hsa
cagggagccuagcaauacaaguacacauuucuguggcuugauuucuugaauaugcugagaccc

SEQ ID NO: 630685 - RNA, 63 nt, hsa
acagagaugccacuggggacccccagacaccaguggcuugacuuugagcuaaggcugaaguac

SEQ ID NO: 630686 - RNA, 63 nt, hsa
uaaauuuuaccuuuauaagacaauggugaaaucuggcuugaacuugcuuauguguuuaaccua

SEQ ID NO: 630687 - RNA, 63 nt, hsa
caaaugaccaagggcgccccuucuggccgugcuuggcuugaguaacugucucucuuuccccac

SEQ ID NO: 630688 - RNA, 63 nt, hsa
ggaaugagaauuuaagccucaaauuugaacauguggcuugaauuaagaagaaaauuauggcau

SEQ ID NO: 630689 - RNA, 63 nt, hsa
cuccacugugccccacuuucugccaaugaacaguggcuugauaauaccaaguauuguuguaau

SEQ ID NO: 630690 - RNA, 63 nt, hsa
cagcaauuuuuuuaaaaaacugagauuuccuacuggcuugaaguuuuucuauuuagcaaaaua

SEQ ID NO: 630691 - RNA, 63 nt, hsa
uucacccaagagugaaaaaaggaaaaucuaccauggcuugaaguuaaagagcagaacuccuga

SEQ ID NO: 630692 - RNA, 63 nt, hsa
gugcugccauuugcuauaaaguugaacuuuguauggcuugaaaaagaaaugacaauauggaac

SEQ ID NO: 630693 - RNA, 63 nt, hsa
auuuaaaguaaaacauuguuuaauguuaccuuuuggcuugagaaugucuuucagcuccagaau

SEQ ID NO: 630694 - RNA, 63 nt, hsa
ucagacauguguaagguagacgccuauggccacuggcuugaccaccuuggaagucaaugacua

SEQ ID NO: 630695 - RNA, 63 nt, hsa
uauaagggacuuuuauuuguaaaguaauggaucuggcuugaaaaauacgguagagauacuuag

SEQ ID NO: 630696 - RNA, 63 nt, hsa
ugccagcaaucccugcuguuccuuagccuauaguggcuugacuccaaucucaguuuuguuguc

SEQ ID NO: 630697 - RNA, 63 nt, hsa
uucuuucuuuuaaauuaaauauuuauuaguaccuggcuugaagccuaguguuuucauaaugua

SEQ ID NO: 630698 - RNA, 63 nt, hsa
aaaaaaaaaaaaagaaaguaauuuuaaacucacuggcuugaaaugugugcuuucuguacaaug

SEQ ID NO: 630699 - RNA, 63 nt, hsa
uucacuugguaguacuuugcuuuagcuuuuaaauggcuugauuuuaaaggagaaauucuauuu

SEQ ID NO: 630700 - RNA, 63 nt, hsa
ucuuggugccuuuugugugaugcgccuugcugauggcuugacaugugcaauugugagggacau

SEQ ID NO: 630701 - RNA, 63 nt, hsa
gucaaacauuuacugaaaauagaauuggccccauggcuugaugugaagacagcaaggaaagaa

SEQ ID NO: 630702 - RNA, 63 nt, hsa
caggguuuugccaucguccaggcuggagugcgcuggcuugaucuuggcucacugcagccucaa

SEQ ID NO: 630703 - RNA, 63 nt, hsa
aguguuaauacaugcaagaaguaagagcauuuguggcuugaacuugccagaugcaaauaccac

SEQ ID NO: 630704 - RNA, 63 nt, hsa
cggaggacgugcccucaccccucacugguccacuggcuugagacucaccccgucugcccagua

SEQ ID NO: 630705 - RNA, 63 nt, hsa
gggugcuuccaagaggcaugagagugccuacucuggcuugagcacuucuauaugcaaggugaa

SEQ ID NO: 630706 - RNA, 63 nt, hsa
auuggcucuuucuaaaucaugugacguuuugacuggcuugagauucagaugcauaauuuuuaa

SEQ ID NO: 630707 - RNA, 63 nt, hsa
gguagugucuaaagcgacacuuuacucacagccuggcuugagucaacaggaacaccauagcac

SEQ ID NO: 630708 - RNA, 63 nt, hsa
aucuugugaggguguguuuuucccagugugaauuggcuugaagagccaugggcuaaaugggua

SEQ ID NO: 630709 - RNA, 63 nt, hsa
caugaaaagaacacuagagucugucauuugcuuuggcuugaaguaugguugguaacacaaauu

SEQ ID NO: 630710 - RNA, 63 nt, hsa
auuuaaaauagcauuagagcaaguugcuugucauggcuugaagagcuuaacuuugucuuuugg

SEQ ID NO: 630711 - RNA, 63 nt, hsa
ccuucuccuguuauuuaggauuucugacaaagcuggcuugagauuggucacuuagagccgacu

SEQ ID NO: 630712 - RNA, 63 nt, hsa
ucccugcuugcauuuuuuaaaaacuagacauuguggcuugagaauuuaucaaucaucuuuccg

SEQ ID NO: 630713 - RNA, 63 nt, hsa
ggacaucgaaaaggaggauggagccaggugccauggcuugagccuauaauccgaggcugaggu

SEQ ID NO: 630714 - RNA, 63 nt, hsa
uucccaugaauucaaggugacaaucaagcccaauggcuugaugacuucaauaguaaccaaguc

SEQ ID NO: 630715 - RNA, 63 nt, hsa
uuuguaucaccucuucacaauuuaguucguaccuggcuugaagcugcucacugcucacacgcu

SEQ ID NO: 630716 - RNA, 63 nt, hsa
ucucagugggugcagacagcccugccuugaggauggcuugaccugggauugacaaaauguguc

SEQ ID NO: 630717 - RNA, 63 nt, hsa
aaauccucaagccaucaggauuugcuauuuaaguggcuugacaacugggccaccaaagaacuu

SEQ ID NO: 630718 - RNA, 63 nt, hsa
auuuuuguagccagagaaauugaaaaacgacuguggcuugauguugauacacauuugaauuuu

SEQ ID NO: 630719 - RNA, 63 nt, hsa
gauucuucugagcaguuaaccucuaggauaauguggcuugaacacauuacagaacuauguuuu

SEQ ID NO: 630720 - RNA, 63 nt, hsa
cgagacugggacuauggcuuauucagugaugacuggcuugagaugauaagagaauucucgaac

SEQ ID NO: 630721 - RNA, 63 nt, hsa
acacaaccuauuuuguuuuauagcuucaaaguguggcuugacauucaaauggaaggaaccacc

SEQ ID NO: 630722 - RNA, 63 nt, hsa
acgccauuccuggucuaccggcucacuaacaucuggcuugagcucccgcugaugguuuucggu

SEQ ID NO: 630723 - RNA, 63 nt, hsa
ugggccaaggcugugguccccguggcuggcaucuggcuugagucuccccgaggccugugcguc

SEQ ID NO: 630724 - RNA, 63 nt, hsa
ucaaccaaacgccuauuuuuuaaugcuuaguuuuggcuugaaauucuucuucaccuggaguuu

SEQ ID NO: 630725 - RNA, 63 nt, hsa
acaggggcucuugggguucggcucagcucaacauggcuugacauggugggcacacuggcgccc

SEQ ID NO: 630726 - RNA, 63 nt, hsa
cuugcaggucagccccugccuugcagggcgggcuggcuugacucaggcccugugagauagagg

SEQ ID NO: 630727 - RNA, 63 nt, hsa
aaaaaaaggaacagaaacaacuuugcauugcauuggcuugacccauaaacuaaguuauauccg

SEQ ID NO: 630728 - RNA, 63 nt, hsa
auugugauguuucaaugugagacacaaaaacaauggcuugaaacuuguguaucauaugugauu

SEQ ID NO: 630729 - RNA, 63 nt, hsa
accugauuaauuucuuauaaagcagcauaaccuuggcuugauuaaggaauucuacuuucaaaa

SEQ ID NO: 630730 - RNA, 63 nt, hsa
cucccccuccuucuguccccucccuuucuuuccuggcuugagguaggggcucuuaagguacag

SEQ ID NO: 630731 - RNA, 63 nt, hsa
guucaacuaggaucagaauaucacagaaaagcauggcuugaauaaggaaaugacaauuuuuuc

SEQ ID NO: 630732 - RNA, 63 nt, hsa
aagauuauuaaggagaauauuccuuaacuauacuggcuugauuugaaacaggcucuuauugcc

SEQ ID NO: 630733 - RNA, 63 nt, hsa
cauguguuugguuuguuuuaaauucugugaaaguggcuugauuaaaagacuccuuuuaaaugg

SEQ ID NO: 630734 - RNA, 63 nt, hsa
agcuuugcacaguguauuaacauugggagggucuggcuugaaaauuuggccacccucagccuc

SEQ ID NO: 630735 - RNA, 63 nt, hsa
uuuuuuguuuuguuuugguuuuuuuuuuuuuuuuggcuugacucaggauuuaaaaacuggaac

SEQ ID NO: 630736 - RNA, 63 nt, hsa
cuuuguccccgcuccgggagaugagucagaugguggcuugaguugucacuugguccccuccgc

SEQ ID NO: 630737 - RNA, 63 nt, hsa
aguuugcacaaaagucaguauuuuaucuuaaaguggcuugauuuccaauagcugaacuugggc

SEQ ID NO: 630738 - RNA, 63 nt, hsa
ccaaugauacaacaguaguuuaaucacguguauuggcuugaaugugauuuucauuccuugauu

SEQ ID NO: 630739 - RNA, 63 nt, hsa
agucucacuguguugcccaggcuggagugcaaauggcuugaucuugguucacugcaaccucug

SEQ ID NO: 630740 - RNA, 63 nt, hsa
gaaaccuuuuucuacuuacuaucauuuuuauuguggcuugagcucagucaaucuggugcagau

SEQ ID NO: 630741 - RNA, 63 nt, hsa
uggcagaucuugacaggcuggaccugcaagauguggcuugaauuuuaaccauuuauuacauaa

SEQ ID NO: 630742 - RNA, 63 nt, hsa
aaggacagcccuccuugacccugaaaggaacacuggcuugaaggacugcagacaggcucugag

SEQ ID NO: 630743 - RNA, 63 nt, hsa
guucucuagcuguucuacaaaacuggagcaugcuggcuugaaaaacccuugcccaguuuugau

SEQ ID NO: 630744 - RNA, 63 nt, hsa
aagaacaacagaaauuaucugucauuugagaaguggcuugacaaucauuugagcuuugaaagc

SEQ ID NO: 630745 - RNA, 63 nt, hsa
aguaaauuucuugcuuaauguuuuuccaaguucuggcuugaauauuucuuauuaaagcuaucu

SEQ ID NO: 630746 - RNA, 63 nt, hsa
aaauauuaacaaaaaugauuuggggaaaugacauggcuugauuguucuguuuaaauuuguacu

SEQ ID NO: 630747 - RNA, 63 nt, hsa
gucccagcuacucuggaggcugaaguuggaggauggcuugagcccacgagauggaaguugcag

SEQ ID NO: 630748 - RNA, 63 nt, hsa
aacaauugaaagggaagcuuauucauggaauauuggcuugauuuaucuagaaaguuuuuccuu

SEQ ID NO: 630749 - RNA, 63 nt, hsa
auugcuggaauuacaguugugagccaccacaccuggcuugaauguagauuuuaauaauugaau

SEQ ID NO: 630750 - RNA, 63 nt, hsa
cuaauagaaaaagaagucgauguucuggaaagcuggcuugauuucacaggggaguuggagcca

SEQ ID NO: 630751 - RNA, 63 nt, hsa
aaaugugucagaauaggaaaacauugcaauaaauggcuugauuuuuuaaugucauuuuucccu

SEQ ID NO: 630752 - RNA, 63 nt, hsa
uucaguaacuaaagaaaaaggaacuucccugaguggcuugaauguguuugcccacagucuaua

SEQ ID NO: 630753 - RNA, 63 nt, hsa
agaguaagcaggggagacagguuuaaggguagcuggcuugaguaauuucaguggcucucagga

SEQ ID NO: 630754 - RNA, 63 nt, hsa
gucuuagcuacucgagaggccaaagaaggaggauggcuugagcccaggaguucaagaccagcc

SEQ ID NO: 630755 - RNA, 63 nt, hsa
guguuuauaugaaacuacuaaagacuuuuuaaauggcuugauguagcagucauagcaaguuug

SEQ ID NO: 630756 - RNA, 63 nt, hsa
gcucacuggaauguuuuuccaucccuguauucauggcuugacuuugugacugcucuacacugc

SEQ ID NO: 630757 - RNA, 63 nt, hsa
auaaaaagccauauauacugcaaaguuccuaacuggcuugacuccugacauugcauuuuuauu

SEQ ID NO: 630758 - RNA, 63 nt, hsa
ggauauauguauugagauauuacaccuagucuguggcuugacuguuuucuuuaugucuuuuga

SEQ ID NO: 630759 - RNA, 63 nt, hsa
agugaaguauuauauuuuucaauaacccuguaguggcuugaugcagggaacccugggggacuu

SEQ ID NO: 630760 - RNA, 63 nt, hsa
gguauggagugggccugcaaaaucagacagaaauggcuugagaagccgcagggggagcaugcc

SEQ ID NO: 630761 - RNA, 63 nt, hsa
uuagcauguauuauggaaaacacuaacuuauuguggcuugaucuucuuaggacaucuuuuuua

SEQ ID NO: 630762 - RNA, 63 nt, hsa
ugugaucccagcucacugcagccucgaccucccuggcuugagugauccucccgccccagccuc

SEQ ID NO: 630763 - RNA, 63 nt, hsa
gggguggcaccaggugggcagugguaggugggguggcuugaggucugggaggguggcccuggc

SEQ ID NO: 630764 - RNA, 63 nt, hsa
cugaacugugugcacuccuuagaucgcuauugauggcuugaucaucccucagcauuucuccca

SEQ ID NO: 630765 - RNA, 63 nt, hsa
aagauacaauucaaggguuagguugcagagagcuggcuugagaguaguuauuaugaaaaaggc

SEQ ID NO: 630766 - RNA, 63 nt, hsa
cccaggucuccaugguuaguugaagccaauuucuggcuugacuuuuaugggaaaaguuauuuu

SEQ ID NO: 630767 - RNA, 63 nt, hsa
gcugcugagcuugugugaaaaucagaccugagauggcuugaagcagccaagaaccacaugggc

SEQ ID NO: 630768 - RNA, 63 nt, hsa
uuuagaagguagauucgaugugaaggaugaaucuggcuugaccuucuggguggcugaugggcc

SEQ ID NO: 630769 - RNA, 63 nt, hsa
uauuuuuucccuucauguuuucucucugaaaguuggcuugagaguuguugucagaaaggugca

SEQ ID NO: 630770 - RNA, 63 nt, hsa
aaguguagcauuucaggguaaagacccaugaaauggcuugauguauucuagacuacugaaaga

SEQ ID NO: 630771 - RNA, 63 nt, hsa
gaaaguugcuuuucuuuugagaauuaaaaacuuuggcuugauuucuuuuuucccuuugcuuau

SEQ ID NO: 630772 - RNA, 63 nt, hsa
aauggguaauaguagaaaauagguuagaaucuauggcuugauuaaaaauauguuauuacauua

SEQ ID NO: 630773 - RNA, 63 nt, hsa
gggguuuggggaaggacaguguggugugacuauuggcuugaaacguuauggauaugguuggag

SEQ ID NO: 630774 - RNA, 63 nt, hsa
uuaaaagcaugaaggagagaaaaaugggggucguggcuugagaaauuccaggcccuaccgauc

SEQ ID NO: 630775 - RNA, 63 nt, hsa
cuuuccuugagcuguugugagcuuugaaguagguggcuugagcuagagauaaaacagaaucuu

SEQ ID NO: 630776 - RNA, 63 nt, hsa
ugggacccucauuucuucugacagauuucagucuggcuugaaauuuggggauguuaaugaggg

SEQ ID NO: 630777 - RNA, 63 nt, hsa
acacuuguaaucccagcacuuugaggugggcaauggcuugagcccaggaguucgacaccagcc

SEQ ID NO: 630778 - RNA, 63 nt, hsa
ugaaggcuugaaaacaaaacauauccacaacauuggcuugaugugaucaucaucucauaacug

SEQ ID NO: 630779 - RNA, 63 nt, hsa
gggccuggggcucuugcuucccgagaacgccuguggcuugaagaaccuugacugcuugguccu

SEQ ID NO: 630780 - RNA, 63 nt, hsa
cgcaaaucccuucaccacaggguuucguuuugcuggcuugaagacaaauggucuuagaauuca

SEQ ID NO: 630781 - RNA, 63 nt, hsa
aggggcugucucuguuugugggagagagacauauggcuugagaagcggagauauuggagauug

SEQ ID NO: 630782 - RNA, 63 nt, hsa
ucucuucuaacccccugaaauccugaguuuaaguggcuugauuaaauggcugaucaaaacuua

SEQ ID NO: 630783 - RNA, 63 nt, hsa
acuuuuacucauccuugagauguaugguguauuuggcuugaguuaugagagaugcuuauuuau

SEQ ID NO: 630784 - RNA, 63 nt, hsa
cagggugauaauaaucuccauaguuauuugaaguggcuugaaaaaggcaagauugacuuuuau

SEQ ID NO: 630785 - RNA, 63 nt, hsa
aaucccagcacuuugcaggccgagguagacagauggcuugagcucaggaguucgugaccagcc

SEQ ID NO: 630786 - RNA, 63 nt, hsa
aaugcaguguuuuucuuuuuuucucugcauaaauggcuugagcauacuggcauuuacacagaa

SEQ ID NO: 630787 - RNA, 63 nt, hsa
gacccuuaacacuacacuucuccuuaucuuuauuggcuugauaaacauaauuauuucuaacac

SEQ ID NO: 630788 - RNA, 63 nt, hsa
uuccuacaucuucuucccaguaaguuuccccucuggcuugacagcaugagguguugugcauuu

SEQ ID NO: 630789 - RNA, 63 nt, hsa
gucuuugcucaaauuaaccagguugugagccaguggcuugagugaauguuaggccuugggggc

SEQ ID NO: 630790 - RNA, 63 nt, hsa
cccuuacucuuucauugacugcagugugaauauuggcuugaaccuuuucccuucaguaauaac

SEQ ID NO: 630791 - RNA, 63 nt, hsa
cgaaucugugugaaacuuucauuccuucagauuuggcuugacaaaggcaggagguacaaaaga

SEQ ID NO: 630792 - RNA, 63 nt, hsa
gccaggaggaaugucugagcagagucaagcaacuggcuugaccacagucugaagcaaggugcc

SEQ ID NO: 630793 - RNA, 63 nt, hsa
gaagccuuucuaagaaagaaaugggggugcgaguggcuugaaucucccaugauguuggagggc

SEQ ID NO: 630794 - RNA, 63 nt, hsa
cuguccucugauuuagcugcugccuccagccucuggcuugagaacuuacuaaaggcacuuccu

SEQ ID NO: 630795 - RNA, 63 nt, hsa
caaauugcugccaugcuggcaucuguagcucgguggcuugacauucuccccagggacuucccg

SEQ ID NO: 630796 - RNA, 63 nt, hsa
uuagaaauuacuuuuuuuaaucuauuuaaaguuuggcuugaagaaugccaucucugacuauau

SEQ ID NO: 630797 - RNA, 63 nt, hsa
gagucucgcucugucacccaggcuggagugcacuggcuugaucucggcucacugcaagcucca

SEQ ID NO: 630798 - RNA, 63 nt, hsa
ggccacuugaguuacuguugcuuccucgccugcuggcuugaugagcaccgauggugggaucug

SEQ ID NO: 630799 - RNA, 63 nt, hsa
uuuauucaacagccauuuagagugccaucaagauggcuugaaauggaauuuugugauuuguag

SEQ ID NO: 630800 - RNA, 63 nt, hsa
ucaaaaaccaacauccaaaaugggagggagauguggcuugaggucaagcgccaugcaucccaa

SEQ ID NO: 630801 - RNA, 63 nt, hsa
gugugaaaggaggguuuugccucuucuugagcauggcuugaguugguaaggaaagcuguaacu

SEQ ID NO: 630802 - RNA, 63 nt, hsa
gcuaccccuaagaucgagcuuguuuucagugacuggcuugagucauaggaggaggagucuggu

SEQ ID NO: 630803 - RNA, 63 nt, hsa
gguguuuugguuuguuuuauuuuuucuuguuuuuggcuugauauuacuauauuuuaacugaau

SEQ ID NO: 630804 - RNA, 63 nt, hsa
aaagguccauauccaauaguauccuuugugcuguggcuugauuuuggccuauuuuacauuauu

SEQ ID NO: 630805 - RNA, 63 nt, hsa
acccacauggcgugcugucugucugcaggggccuggcuugauggggucuugaagagggggcag

SEQ ID NO: 630806 - RNA, 63 nt, hsa
guucuagcugcuugggagguugaggagggaggauggcuugaacacagguguucaaggccagcc

SEQ ID NO: 630807 - RNA, 63 nt, hsa
acaguucucagauuuacagcuuuuuuuugucauuggcuugaugucacacauuuccaaucucuu

SEQ ID NO: 630808 - RNA, 63 nt, hsa
auccuagcacuuugggaagacaaugugggagaauggcuugagcccaggaguucaagaccggcc

SEQ ID NO: 630809 - RNA, 63 nt, hsa
ugaugagcuaugaaccacuggagcagcccacacuggcuugauggaucacccccaggaggggaa

SEQ ID NO: 630810 - RNA, 63 nt, hsa
cuugcucccagcagcggaagcgccucugacccuuggcuugagucccacgugggggaggaggag

SEQ ID NO: 630811 - RNA, 63 nt, hsa
gagcacuucacuaucaaaaauacuaacaucacauggcuugaagaguaaccaucagagcugaau

SEQ ID NO: 630812 - RNA, 63 nt, hsa
aaauagggaauauaauguaugaacuuuuugcauuggcuugaagcaauauaauauauuguaaac

SEQ ID NO: 630813 - RNA, 63 nt, hsa
gggccagccuugcacugagugaaacuugcccucuggcuugauucagacuggaguggauaggau

SEQ ID NO: 630814 - RNA, 63 nt, hsa
accuguguaaugaauuagugugcugugucacuguggcuugaagucacuguggaucgagcucac

SEQ ID NO: 630815 - RNA, 50 nt, hsa
acaaaaaggccucugaauaauggcuugacuuagcacugagagcuauuuaa

SEQ ID NO: 630816 - RNA, 63 nt, hsa
aauccagcuacuugggaggcugaggcaggaaaauggcuugaacccgggagguggagguugcag

SEQ ID NO: 630817 - RNA, 63 nt, hsa
uggaguuacaacuugcauguuccuuacuccuguuggcuugauggaacaggugcauucacacua

SEQ ID NO: 630818 - RNA, 63 nt, hsa
cauagauaaguaagcaccacugaagcaccucuguggcuugauauuuugcugugggugaaauuu

SEQ ID NO: 630819 - RNA, 63 nt, hsa
uuuugaagacaacugucuuauuuuauuacaaauuggcuugacauauuuauacuguaacauugu

SEQ ID NO: 630820 - RNA, 63 nt, hsa
aacaucacaccaaagaugaggguagcgagcaacuggcuugagcagacagaacggggaagacuc

SEQ ID NO: 630821 - RNA, 63 nt, hsa
gagcauugaucugcauccaaggccuucucaggcuggcuugagugaauuguguaccugaaguac

SEQ ID NO: 630822 - RNA, 63 nt, hsa
cgucauuucauuaguauuccucauucugcauccuggcuugaaaaacagcucuguugaaucaca

SEQ ID NO: 630823 - RNA, 63 nt, hsa
acggaagucauuagaauggcuugugauaucugauggcuugaacuugcccacaguugaacacaa

SEQ ID NO: 630824 - RNA, 63 nt, hsa
augauagaaacauuugauguaauaaaacuugguuggcuugauauuuuaaggaauugaaaccua

SEQ ID NO: 630825 - RNA, 55 nt, hsa
ccaacucuggcugcugcugaacaucuggcuugaacuuuuuuuguccuuccuggaa

SEQ ID NO: 630826 - RNA, 63 nt, hsa
cauuucaugauguaaagaaacugaacagugaaguggcuugauugcuuaaacuauugacuuggu

SEQ ID NO: 630827 - RNA, 63 nt, hsa; identical to SEQ ID NO: 630826

SEQ ID NO: 630828 - RNA, 63 nt, hsa
gucccagcuacuugggaggcugaggucagaggauggcuugagcccaagaggcagagguugcag

SEQ ID NO: 630829 - RNA, 63 nt, hsa
uuuuucuuucuggaguuuaaguacagugaugguuggcuugaguaccuuuuuaaaucuagccca

SEQ ID NO: 630830 - RNA, 63 nt, hsa
uugagguaaaugaaacuuucucauuuguauauuuggcuugauauggucuuaauauuaucuuuc

SEQ ID NO: 630831 - RNA, 63 nt, hsa
auaaggacaagucaauuugucaguagcuucuucuggcuugaaacccccucccuggauuuuaua

SEQ ID NO: 630832 - RNA, 63 nt, hsa
agaauucuaguuugguuuauggggccuggauucuggcuugaagaagccauauuuggcaugggu

SEQ ID NO: 630833 - RNA, 63 nt, hsa
ggucccaucuccaaggugcgucauaugcaggaauggcuugaaacaagaggaaguccuaaauca

SEQ ID NO: 630834 - RNA, 63 nt, hsa
gaagaaacuagcgguguucuuuuaggcguuuucuggcuugacggcuucucucuuuuuuuaaau

SEQ ID NO: 630835 - RNA, 63 nt, hsa
gggauaaaguugagaagugugccuuuuuuuuaauggcuugaaguuucagaggugauaaaaauu

SEQ ID NO: 630836 - RNA, 63 nt, hsa
caccuuugauggggggugggcaauggggagcaguggcuugaacccacuugagaaggcugccuc

SEQ ID NO: 630837 - RNA, 63 nt, hsa
acucuguggccagccuggcaucaguuuaggccuuggcuugauggaagugggccaguccugguu

SEQ ID NO: 630838 - RNA, 63 nt, hsa
ugaccaaauuuaccuuugaguugauaaguccaguggcuugaguagugaaucccucagugcuga

SEQ ID NO: 630839 - RNA, 63 nt, hsa
cuaacugagcugggugaaggcuugugcaucaccuggcuugaguuccuugcugucacagaugau

SEQ ID NO: 630840 - RNA, 63 nt, hsa
cccucugccuccuccccaugcccccaguugcuguggcuugauucugcuacccugaccccacca

SEQ ID NO: 630841 - RNA, 63 nt, hsa
cuguguggagaccagcuucaaggagcggaaggcuggcuugaggccacacagcuggggcgggga

SEQ ID NO: 630842 - RNA, 63 nt, hsa
ugcacacacagacuucucucuuacguucauggcuggcuugagaugaguugaaaauaacuucgc

SEQ ID NO: 630843 - RNA, 63 nt, hsa
gggggauggaggacucaagggauguaagggauauggcuugaggagggaugggggcaggaauga

SEQ ID NO: 630844 - RNA, 63 nt, hsa
aucccagcuauugggaaggaugagaugggaggauggcuugaggccagagguuugagaccgacc

SEQ ID NO: 630845 - RNA, 63 nt, hsa
guccuaguuacuugggaggcugaggcaggagaauggcuugaacuggggaagcagagcuugcag

SEQ ID NO: 630846 - RNA, 63 nt, hsa
cauauauuguuuaccuucaaagauacaauuaaauggcuugauuuuuaagcuguguucuagucg

SEQ ID NO: 630847 - RNA, 63 nt, hsa
uggucccaggacaggaaugcgguucaaacccaguggcuugaaacuuccugagaaacuguagca

SEQ ID NO: 630848 - RNA, 63 nt, hsa
ggcuguucacuugauuaguugaaacacaaauucuggcuugaaaaaauaggggagauuaaauau

SEQ ID NO: 630849 - RNA, 63 nt, hsa
caaggccgcgcuggggcucugucuuggugcacauggcuugaccggacuuucccugcuucccac

SEQ ID NO: 630850 - RNA, 63 nt, hsa
ugggcuggccggacuccugggacaugugggugguggcuugaccccgggcccaugggcagcuug

SEQ ID NO: 630851 - RNA, 63 nt, hsa
ccuguccccaaauugaagauccuuccuugccuguggcuugaugcggggcggguaaaggguauu

SEQ ID NO: 630852 - RNA, 63 nt, hsa
gaggcucacucugucacccaggcuggagugcaguggcuugaucuuggcucacugcaaccuccg

SEQ ID NO: 630853 - RNA, 63 nt, hsa
uccccacaccucccuacuccccugggcaucuucuggcuugacuggauggaaggagacuuagga

SEQ ID NO: 630854 - RNA, 63 nt, hsa
ccacuucccaccccgucuccagccccuguacuuuggcuugaccucguggaaauauuuauuuuc

SEQ ID NO: 630855 - RNA, 63 nt, hsa
cgaggggaggguggcaggugaccuucugggaaauggcuugaagccaagucagcuuugccuucc

SEQ ID NO: 630856 - RNA, 63 nt, hsa
ucaaaucuugaagucgugagugaagcugcggguuggcuugacugggcucagccacugagcugc

SEQ ID NO: 630857 - RNA, 63 nt, hsa
ccugcccaucacccuuagaaggaucuuuucccauggcuugacuuccuucauuucccuaacuga

SEQ ID NO: 630858 - RNA, 63 nt, hsa
gggaagcauuuuuaacuggguagaaucugacuguggcuugaaauaaaaagcucucagaaaacu

SEQ ID NO: 630859 - RNA, 63 nt, hsa
cccuucuggggguggugggcaggugacacggaguggcuugagcuucuggggaugcagguccac

SEQ ID NO: 630860 - RNA, 63 nt, hsa
gaugcgagcccccaggucugacguccuuggggguggcuugaggaagaggggaaggugcguauu

SEQ ID NO: 630861 - RNA, 63 nt, hsa
gaaggaguucuacuugucuugacaccauagagguggcuugagaagauguccuuugaagagcca

SEQ ID NO: 630862 - RNA, 63 nt, hsa
aucugccgaagcagugacuugcauuuccacacuuggcuugagcacucaacccagaaggcgaag

SEQ ID NO: 630863 - RNA, 63 nt, hsa
uagaauccuuuggaaucuuauggcaaccaaauguggcuugacgaagucgugguuucaucucuu

SEQ ID NO: 630864 - RNA, 63 nt, hsa
ggaggacgugggcugcgaggagaagcuguacuuuggcuugagugaguacagcaagucucugca

SEQ ID NO: 630865 - RNA, 63 nt, hsa
accaauggguaaaaguaacaggcgggcagauuuuggcuugaggaagagcuucuagcacgacug

SEQ ID NO: 630866 - RNA, 63 nt, hsa
uaauuaacauucccugugaccuaguuggugcaguggcuugaaugccaaaauaaagcgugugca

SEQ ID NO: 630867 - RNA, 63 nt, hsa
gucacccuggguaaguucucagaguggucaggauggcuugaccugcagaagauacccaagguc

SEQ ID NO: 630868 - RNA, 63 nt, hsa
acgucuucaugcuuucuccucccuauuauuuucuggcuugaggggaaaauaaugucaggucuu

SEQ ID NO: 630869 - RNA, 63 nt, hsa
aaauauuaaugauaauuuuugaauugcuuuguuuggcuugauuaacuuugaucagaaauagaa

SEQ ID NO: 630870 - RNA, 63 nt, hsa
ucaguuuguaagauuucuuuucuggcacuuuaauggcuugagguaucauuaucaguuacaaau

SEQ ID NO: 630871 - RNA, 63 nt, hsa
auuccacggcggcaagcugaccgcacagcagucuggcuugauuuucagccgucaucauugggu

SEQ ID NO: 630872 - RNA, 63 nt, hsa
ugaaacugaggcucagauauaaaggaaagguacuggcuugaagucacaaccacgacaggagua

SEQ ID NO: 630873 - RNA, 63 nt, hsa
ccauguuuacauugcaccuucccgugcuguaauuggcuugacaaagacaagcaggcuucucug

SEQ ID NO: 630874 - RNA, 63 nt, hsa
guagaccucacccuuuccagacuuuagagcuuguggcuugaauguuaaaggugugaccaccga

SEQ ID NO: 630875 - RNA, 63 nt, hsa
augcucaggaaauacgcacuaggauauuuacuguggcuugauuuguaguagccaaaaauuaga

SEQ ID NO: 630876 - RNA, 63 nt, hsa
aucccaucacuuugggaggugcaggcaggcagauggcuugagcccaggaauucaagaccaguc

SEQ ID NO: 630877 - RNA, 63 nt, hsa
gucccagcuacucaggaggcugagguaggaugauggcuugagcccaggaguucgagaccagcc

SEQ ID NO: 630878 - RNA, 63 nt, hsa
aucccagcuacuccggaagcugaggcaggagaauggcuugaacccaggagguggagguugcug

SEQ ID NO: 630879 - RNA, 63 nt, hsa
ccuggucaguccugcgcacuauaguuuugcaaguggcuugaagaggaguuucauucgcguccc

SEQ ID NO: 630880 - RNA, 63 nt, hsa
cacugguuucucuccuuagaaaaguagguuucuuggcuugauguagacuggcuugcuuugauu

SEQ ID NO: 630881 - RNA, 63 nt, hsa
agaauuaaagaaagaggaaagaaacacaaaaaguggcuugaugguuaagacagguuuauuuua

SEQ ID NO: 630882 - RNA, 63 nt, hsa
gucucagcuacucgggaggcagaggcaggagaauggcuugaaccugggaagcgguugcaguga

SEQ ID NO: 630883 - RNA, 63 nt, hsa
cacaucugagaacuaaaugugcuuccaugagacuggcuugagaagucuucagcaccaaguucc

SEQ ID NO: 630884 - RNA, 63 nt, hsa
gguucagcuucuguggagucugcagugggaggauggcuugagccuaggaguucgaggcugcag

SEQ ID NO: 630885 - RNA, 63 nt, hsa
cucccagcaacucagggggcugaggugggagaauggcuugagccugggaggcagagguugcag

SEQ ID NO: 630886 - RNA, 63 nt, hsa
aguguugggauugcaggcgugagccacugcuccuggcuugaauuuucuuauaaucccaugaaa

SEQ ID NO: 630887 - RNA, 63 nt, hsa
uucccagcugcuugggaggcugaggcaggagaauggcuugaaccugggagguggagguugcag

SEQ ID NO: 630888 - RNA, 63 nt, hsa
cuauauuagggguaggguauuacagaagauaauuggcuugauguccuagaaguucuuugaucc

SEQ ID NO: 630889 - RNA, 63 nt, hsa
aucccagcuacucgggaaccugaggcaggagaauggcuugaacccaggagacagagguugugg

SEQ ID NO: 630890 - RNA, 63 nt, hsa
cucgccuccuggggauucucaggggcuccauuauggcuugauuuacuccacgugcagaagucu

SEQ ID NO: 630891 - RNA, 63 nt, hsa
uucgguaucuuuuaauauaagaacacugaauuuuggcuugaaauauugugacuaaauugcaca

SEQ ID NO: 630892 - RNA, 63 nt, hsa
uauaaggaauggcaucagaacaauagcuuggaauggcuugaaaucacaaaggaucugcaagau

SEQ ID NO: 630893 - RNA, 63 nt, hsa
cuuauuugaaaaauuaaggaaggauuucaggcauggcuugauccagcuacucaaaaaagguug

SEQ ID NO: 630894 - RNA, 63 nt, hsa
cagucucauucuguugcccaggcuggagugcaguggcuugaucucggcucacugcaaccucgc

SEQ ID NO: 630895 - RNA, 63 nt, hsa
gucucuccacaaaccaaacucaacagaauacuuuggcuugaagccggcacacccaggguuacu

SEQ ID NO: 630896 - RNA, 63 nt, hsa
aaauaugcgaaguucuccaaacccauuuauuacuggcuugaccaggacaaauccuuucaguga

SEQ ID NO: 630897 - RNA, 63 nt, hsa
ccuuuaucgccucaccucuucuacaagcuuuuguggcuugagggcuuuuguuuuuggcuuuug

SEQ ID NO: 630898 - RNA, 63 nt, hsa
uuccuaagggaaggagaucuuuaucuuucugguuggcuugaccagucacguugggagaagaga

SEQ ID NO: 630899 - RNA, 63 nt, hsa
gaauuucgcucugucacccagacuggagugcaauggcuugaucuuggcucacugcaaacucug

SEQ ID NO: 630900 - RNA, 63 nt, hsa
uaauuucuguauucucugcaacuuugcaauguuuggcuugaagaaggagcucaguaaacaucu

SEQ ID NO: 630901 - RNA, 63 nt, hsa
gggcacaacccuuauuugacaaaacuuggauguuggcuugacuguguuugucccuucagaugg

SEQ ID NO: 630902 - RNA, 63 nt, hsa
ucuggcuccugccaccacaaauguuacccucauuggcuugaaaagcauccaagggugcacagg

SEQ ID NO: 630903 - RNA, 63 nt, hsa
uccugggcucagcugccccugucugaagggucuuggcuugauugcagaaggacaaccuccgca

SEQ ID NO: 630904 - RNA, 63 nt, hsa
cuggacagaaagaugcccguuuggccaggcugguggcuugauggguguaccuggagagggggu

SEQ ID NO: 630905 - RNA, 63 nt, hsa
aggaaguucccuaauaaucuggaauauucuacauggcuugauuacauagcaaacaagaccaag

SEQ ID NO: 630906 - RNA, 63 nt, hsa
gacaacccaagucucugggccccaggcacccccuggcuugaaccuucaaagcuuuuguaaaau

SEQ ID NO: 630907 - RNA, 63 nt, hsa
uaaguugcauagguuuaauaauuuuuaauuauauggcuugaguuuaaauuguaauaggcguaa

SEQ ID NO: 630908 - RNA, 63 nt, hsa
uuuccuguuguuuguggaaccuacgcguuugaauggcuugaacguugcaucuuuuaaaguuau

SEQ ID NO: 630909 - RNA, 63 nt, hsa
ccuagaaguaaugauauacaguuuucuuccuaguggcuugaaaaucuggacuuccucaauuau

SEQ ID NO: 630910 - RNA, 63 nt, hsa
agugccuggcuauuacuauauaaugaagcccacuggcuugacuuguaaguucaaccuaaacca

SEQ ID NO: 630911 - RNA, 63 nt, hsa
aucccagcauuuugggaggcuaaggcagggagauggcuugagaccaggaguucaagaccagcc

SEQ ID NO: 630912 - RNA, 63 nt, hsa
cacuuuuuuccccaagacaagacaaucgaggucuggcuugagaacgaccuuucuuucuuuauu

SEQ ID NO: 630913 - RNA, 63 nt, hsa
gcaccacgauacccucugauuauuggaauccauuggcuugagacacaugacccaaacauagaa

SEQ ID NO: 630914 - RNA, 63 nt, hsa
cagcagggguguucaguuggagcaaauuagcuuuggcuugaguuguucauggggccuugaugu

SEQ ID NO: 630915 - RNA, 63 nt, hsa
uauguaaagugcucauuagauuuuuuguguguguggcuugagaaucccaucuccuaaauugag

SEQ ID NO: 630916 - RNA, 63 nt, hsa
aaugauuguuuucuaagcauuguggcuucucaguggcuugacagcaucuuccugguuguaugu

SEQ ID NO: 630917 - RNA, 63 nt, hsa
acuuaauuuaccgaaggcaaaucuuccagacuauggcuugaguaggaugaaagacaaacacau

SEQ ID NO: 630918 - RNA, 63 nt, hsa
gcaaacaaaauuaugugaauuguguuguuuucuuggcuugauguuuucuaucuacgcuugauu

SEQ ID NO: 630919 - RNA, 63 nt, hsa
acuucaaaacaaacagaugcucugagagcaaacuggcuugaauuggugacauuuagucccuca

SEQ ID NO: 630920 - RNA, 63 nt, hsa
aaacagcuaacugcaucagcaaauuggaauggcuggcuugaaguuuccauuauuuucuugaag

SEQ ID NO: 630921 - RNA, 63 nt, hsa
agucccagcuauucaggagcugugguaggaggauggcuugagcucaagagguugaggcugcag

SEQ ID NO: 630922 - RNA, 63 nt, hsa
uccaaaauaguuaagacaugauuuccuugaauguggcuugagaaauauggacacuuaauacua

SEQ ID NO: 630923 - RNA, 63 nt, hsa
ccaaaacaucagcauuucuaaaauaguccuaaagcuugaaaguaaguugcuuccaugagcaug

SEQ ID NO: 630924 - RNA, 63 nt, hsa
cuuucacuaccuuucuuacccuuaaugugccaagcuugaaacaggauuugauuuccugagcua

SEQ ID NO: 630925 - RNA, 63 nt, hsa
ugccucacucucuccaguugguuuucagcuggggcuugaaaugcauuuuuagcccuuugacgu

SEQ ID NO: 630926 - RNA, 63 nt, hsa
auaguguauuauuaucguuggggcuggcucuaugcuugaaaaccaguuuauuuauaaccuguu

SEQ ID NO: 630927 - RNA, 63 nt, hsa
uuuuuucauaguuucauuuguucuugcccacaagcuugaaauccagguuaagguauccagccu

SEQ ID NO: 630928 - RNA, 63 nt, hsa
guugcugggggccgauucugaucaagacacauggcuugaaaauggaagacacaaaacugagag

SEQ ID NO: 630929 - RNA, 63 nt, hsa
aauauauaaaugcuucagaugucaaauacccaugcuugaaagcucguguaauuuacuuuaaga

SEQ ID NO: 630930 - RNA, 63 nt, hsa
gcuaaacuuuauauaaugugugguuucaauucagcuugaaaaauaaucucacuacauguagca

SEQ ID NO: 630931 - RNA, 63 nt, hsa
uguuccccacuccacaggagggagcugacguuggcuugaaaggaguaaagucaacaucugcug

SEQ ID NO: 630932 - RNA, 63 nt, hsa
guucuauagccuucucuugcaguauuuggauuugcuugaaaccgggaaaacuguucccauuag

SEQ ID NO: 630933 - RNA, 63 nt, hsa
guaucgguuuuauucuuugcugauguccuuucugcuugaaauaacagucaccauacagcuaaa

SEQ ID NO: 630934 - RNA, 63 nt, hsa
auuacugucucuugaacaguugcaaucuuggcagcuugaaaauggugcuacacucuguuuugu

SEQ ID NO: 630935 - RNA, 63 nt, hsa
auguuuaaaucgcuaaaggaaaauacaguaagugcuugaaagaugaaggaccaaaaggccaaa

SEQ ID NO: 630936 - RNA, 63 nt, hsa
acuggcacuggaagaguuuaguguuucuuguaugcuugaaaauaaaguauguacuguuuugaa

SEQ ID NO: 630937 - RNA, 63 nt, hsa
gucccacuggcuggccucaggcugucuuauuccgcuugaaaauagccaaaaagucuacugugg

SEQ ID NO: 630938 - RNA, 63 nt, hsa
caaugaaauuauauuuucuuuguaaagaaaguggcuugaaaucuuuuuuguucaaagauuaau

SEQ ID NO: 630939 - RNA, 63 nt, hsa
uuccaaagaagagucgaguccucugaggucugugcuugaaagccguccgaaggcauucuuguu

SEQ ID NO: 630940 - RNA, 60 nt, hsa
augggcaacaguggaaguagacaaguaagggcuugaaaaugauacuggcaagauacgauu

SEQ ID NO: 630941 - RNA, 63 nt, hsa
ugugccuucagggaggaagagggagguggucaagcuugaaaaacuggcuuuaggaugguucug

SEQ ID NO: 630942 - RNA, 63 nt, hsa
guccagcagacacugaaccagaauuggaaacgugcuugaaacaaucacacaggacacuuuucu

SEQ ID NO: 630943 - RNA, 63 nt, hsa
aacacugucaagguggagacuggaggugguggggcuugaaaugagcccaggaaaccagagcag

SEQ ID NO: 630944 - RNA, 63 nt, hsa
aggcaagaugagauggcagccugcagaguaaaugcuugaaaaaagaggggugauuuucaaugg

SEQ ID NO: 630945 - RNA, 63 nt, hsa
aaacacuaguuuugugccagccgugaugcucaggcuugaaaugcauuauuuugaaugugaagu

SEQ ID NO: 630946 - RNA, 63 nt, hsa
uuuuauguuguugacucuggcuccagggccugugcuugaaaaggacagauaaguauugcccag

SEQ ID NO: 630947 - RNA, 63 nt, hsa
uguuuuauaucuuaauucuaguaucuguuuuaugcuugaaagcauuacagaucaugauaccua

SEQ ID NO: 630948 - RNA, 63 nt, hsa
ucuuaauauggugcugauguuuuugugucaauggcuugaaacuggcaagauuaacaaaauuag

SEQ ID NO: 630949 - RNA, 63 nt, hsa
aaaauuaaaauccuugacauagaccauagcauggcuugaaaugcuaugucugcaugauaauuu

SEQ ID NO: 630950 - RNA, 63 nt, hsa
agaaaaccuaaacuaaugucauuggaaacaaaagcuugaaagaaacacaucgcaucuacauuu

SEQ ID NO: 630951 - RNA, 63 nt, hsa
acucacaaaacauuuugcuaaaaagauaugacugcuugaaauagucucucucccauggagaac

SEQ ID NO: 630952 - RNA, 63 nt, hsa
ggauauucaagccuuuggauggcuauggagagggcuugaaauguguacaggugucaccaucau

SEQ ID NO: 630953 - RNA, 63 nt, hsa
aaugagcuaagcaaggcugagccuccuccuguugcuugaaauaaugaugauauaaaggcugga

SEQ ID NO: 630954 - RNA, 63 nt, hsa
uucuuugaauagucacucguaaaaacugucagugcuugaaacuguuuccuuuacucauguuga

SEQ ID NO: 630955 - RNA, 63 nt, hsa
auuccccugccuuccuggcuugauugaaggaaagcuugaaaaggcgcagagcccuauaccuca

SEQ ID NO: 630956 - RNA, 63 nt, hsa
ggaguuucaaaaacugaugagccucgauccagggcuugaaagaagccaggguguaaucuuguu

SEQ ID NO: 630957 - RNA, 63 nt, hsa
ugcuccucucugccgccuuuccuccauuccauggcuugaaaccucugccugauguggcuccuu

SEQ ID NO: 630958 - RNA, 63 nt, hsa
uaaaaugagaaacuuuuuuccuacaaagaccuugcuugaaaccacaaaaguuuugcuggcacg

SEQ ID NO: 630959 - RNA, 63 nt, hsa
ugaccauacuaauuauacccccugcaaagcccagcuugaaaccuucacuuaggaacguaaucg

SEQ ID NO: 630960 - RNA, 63 nt, hsa
uauugugugcaaaggaugggcagaaaagaaagugcuugaaagauuucaaauuuucagaaaggg

SEQ ID NO: 630961 - RNA, 63 nt, hsa
aaauuucacaagacuuauuuuaaugacaauguagcuugaaagcgaugaagaaugucucuagaa

SEQ ID NO: 630962 - RNA, 63 nt, hsa
acuuggcucugaacauacuggcuuugcuguaaugcuugaaaaggcguugguaucuucauuuua

SEQ ID NO: 630963 - RNA, 63 nt, hsa
cuaugcauccgauucuuaacaaaacugcagggagcuugaaaaaaugcagacuguacaaacgcu

SEQ ID NO: 630964 - RNA, 63 nt, hsa
cagaaaaugcaucccugauuucauucauuuccagcuugaaagccagccauauuacucuagucc

SEQ ID NO: 630965 - RNA, 63 nt, hsa
auaaauacaguaaguuuagauuauugaauuggugcuugaaauuuauugguuuuguuguaauuu

SEQ ID NO: 630966 - RNA, 63 nt, hsa
guaauagugaaaccuguacucaaaauauaagcagcuugaaacuggcuuuaccaaucuugaaau

SEQ ID NO: 630967 - RNA, 63 nt, hsa
aaucauaacuguuaauucucagccaucuuugaagcuugaaagaagagucuuugguauuuugua

SEQ ID NO: 630968 - RNA, 63 nt, hsa
uuaguguccgaagaccgaauuuuauuuuacagagcuugaaaacucacuucaaugaacaaaggg

SEQ ID NO: 630969 - RNA, 63 nt, hsa
uagcauaaagcuaggggaugcauggaaauagcagcuugaaacuaggagguaacaagaaagcuu

SEQ ID NO: 630970 - RNA, 63 nt, hsa
uaaugggucuuggaguauagauuuuuauuaguagcuugaaagagcuuaaucauaugcaguaag

SEQ ID NO: 630971 - RNA, 63 nt, hsa
gcacaucccgcugcagagggcauucccuuuaaggcuugaaaaugccuccuguagucccaaacc

SEQ ID NO: 630972 - RNA, 63 nt, hsa
aggacuugggcgggacacaggcuccaaacuggagcuugaaauagugucugaugaauguuaaau

SEQ ID NO: 630973 - RNA, 63 nt, hsa
gccagggggacuagccccuguggagacuggggggcuugaaauuguccccguggucucuuacuu

SEQ ID NO: 630974 - RNA, 63 nt, hsa
agacuauagcauauuagcuguuuagaagggauggcuugaaaggaaggagacugaaaaacacuc

SEQ ID NO: 630975 - RNA, 63 nt, hsa
cugccucagccucccaaagugcugggauuacaggcuugaaagucuaacuuuuuuuuacuuaua

SEQ ID NO: 630976 - RNA, 63 nt, hsa
uugugauuucuuauuugagguucaaaaugaccugcuugaaacuuugauacauauuggaauaca

SEQ ID NO: 630977 - RNA, 63 nt, hsa
uuuauauacuuucaauuagcuguacuaauuggggcuugaaaguauauaaaaucuuccuguccu

SEQ ID NO: 630978 - RNA, 63 nt, hsa
ucgugaaagguacauuuaaaauauguuaaauuggcuugaaauuuucagagaauuuugucuucc

SEQ ID NO: 630979 - RNA, 63 nt, hsa
gugauacauuuaagccacuggaaaaaccccugugcuugaaaauauuuccucuauaucaugccu

SEQ ID NO: 630980 - RNA, 63 nt, hsa
uuccuauuuuuuuuuccaguaguauuguuaccugcuugaaaacacugcuguguuaagcuguuc

SEQ ID NO: 630981 - RNA, 63 nt, hsa
aaaaaaauacugauguuccuagugaaagaggcagcuugaaacugagaugugaacacaucagcu

SEQ ID NO: 630982 - RNA, 63 nt, hsa
cacauuuguagaaauguaaugcgguucugaguggcuugaaauguacagaauguuuugaaagug

SEQ ID NO: 630983 - RNA, 63 nt, hsa
uuguuauaaaacauucaaauucugauauacauugcuugaaaaugagugaguaccucagagaaa

SEQ ID NO: 630984 - RNA, 63 nt, hsa
gcacuccucaauugggaguguugugacugaaaugcuugaaaccaaagcuucagauaaacuugc

SEQ ID NO: 630985 - RNA, 63 nt, hsa
cgaaaagaaugaaaacagagaaaaaauguaugugcuugaaaguaaaauacuuacaauaguagc

SEQ ID NO: 630986 - RNA, 63 nt, hsa
uugaguaucauguaauaauuauaauauaauuuagcuugaaagaugcucuacauuaugaccaau

SEQ ID NO: 630987 - RNA, 61 nt, hsa
agcgugagaagcuuaacuaggcugcauaacagcuugaaaacuggauuaucuacuacagagu

SEQ ID NO: 630988 - RNA, 63 nt, hsa
gcaaagcuaauuugccuuugccugggguguucagcuugaaagaauaaagcucauuugguuuag

SEQ ID NO: 630989 - RNA, 63 nt, hsa
aaacucucuguuguuuguaauauucucuuaaaagcuugaaaauaaaacuucuuucccuaccau

SEQ ID NO: 630990 - RNA, 63 nt, hsa
ccaccgugggacaucaaguggaagaacuuguuugcuugaaaguaucucagacccaaggcaccu

SEQ ID NO: 630991 - RNA, 63 nt, hsa
uuuaagaaccagaggcagaaguucuggcuuccugcuugaaacccaauucuuauaugaaauuuu

SEQ ID NO: 630992 - RNA, 63 nt, hsa
guuuggggcuugauagagugugaaagguguguugcuugaaagguguggccuuagacacuagga

SEQ ID NO: 630993 - RNA, 63 nt, hsa
auagaugugugggugaagccauagaacauauuugcuugaaauucuugagcagggaucuuauaa

SEQ ID NO: 630994 - RNA, 63 nt, hsa
caguuaaacacugcugcaauauuucaguguugugcuugaaaauauguacaguuuuuuuccaau

SEQ ID NO: 630995 - RNA, 63 nt, hsa
uaagaggcugauaauuccagugguccauggaaugcuugaaaaaugugcaaaacagcguuuaag

SEQ ID NO: 630996 - RNA, 63 nt, hsa
ugcauauucuuauguaugugaaaguuacaaauugcuugaaagaaaauaugcaucuaauaaaaa

SEQ ID NO: 630997 - RNA, 63 nt, hsa
augggaccgcaagugguaggcagugucccuucugcuugaaaccuauugaaaccaauuuaaaac

SEQ ID NO: 630998 - RNA, 63 nt, hsa
gaauuuugugagacaguugucaaauuguugcuagcuugaaaucugcggcaauuggaguauuua

SEQ ID NO: 630999 - RNA, 63 nt, hsa
ggcagcacauauacuaaaaauuaauaagacccagcuugaaaauugagccugauaacaagauua

SEQ ID NO: 631000 - RNA, 63 nt, hsa
uugugaaugaauaaauuacuaauccuccuugucgcuugaaaccuucccacacucccugcucca

SEQ ID NO: 631001 - RNA, 63 nt, hsa
auuucugcucaaccacacauucucuaagaaacagcuugaaagcucugucugggucauucauuu

SEQ ID NO: 631002 - RNA, 63 nt, hsa
caagaacacuuuaaggaaacauuuuacaaguaugcuugaaagaaugucacuaacugguccaga

SEQ ID NO: 631003 - RNA, 63 nt, hsa
uuuagguauaauaucaucuugucuuugacuagagcuugaaaccuuguuaucugauuguguacc

SEQ ID NO: 631004 - RNA, 63 nt, hsa
accuuacaaggcucuaaaaugagaugugauauggcuugaaaugggaggagacacuuucugaca

SEQ ID NO: 631005 - RNA, 63 nt, hsa
ugggugagucugccaacucacaggugcuuuuaggcuugaaaucuccauccuaucauuuccguu

SEQ ID NO: 631006 - RNA, 63 nt, hsa
guuuuguuugguuuacuuucaaaagaguagaaagcuugaaaagauucugaaaccacaguuuca

SEQ ID NO: 631007 - RNA, 63 nt, hsa
agugaacuugguuugaucuuacucaacuagaaagcuugaaaacaucccuggggauucugaagg

SEQ ID NO: 631008 - RNA, 63 nt, hsa
ugcuagcucaauuaguuuugaauuauauguauagcuugaaaaguuuuuuuuuaaugacugugc

SEQ ID NO: 631009 - RNA, 63 nt, hsa
uaacgcacgguacuguucuugaaauaccuaauggcuugaaauucuagucuguuugugaaagau

SEQ ID NO: 631010 - RNA, 63 nt, hsa
cuuacuguggcuuuaaacauauucagaacagaugcuugaaauaugcacuuagcacuuugguuc

SEQ ID NO: 631011 - RNA, 63 nt, hsa
caaacauucuguugaagggaaaucuagucaguugcuugaaagagcacagcccaaauaaaacaa

SEQ ID NO: 631012 - RNA, 63 nt, hsa
acacaauaaccaaaagcuuuuauuuauaaaaaggcuugaaaaauauagacaaucuuuaaugua

SEQ ID NO: 631013 - RNA, 63 nt, hsa
auguauguccucucuguaauuguuuuaaugugugcuugaaauauccagaaaaccuauggaguu

SEQ ID NO: 631014 - RNA, 63 nt, hsa
uguuguucugagcagggggacaggauugaugaggcuugaaagagcccacugagccacucucug

SEQ ID NO: 631015 - RNA, 63 nt, hsa
gaggugcaaaacauagauauagaacugaacagggcuugaaacaauauuaggauuacuacccag

SEQ ID NO: 631016 - RNA, 63 nt, hsa
ucacucaaacauagcugacuuccuauugguacagcuugaaaagcacuuuuuacuacauacaca

SEQ ID NO: 631017 - RNA, 63 nt, hsa
auggugcucuugucuucuuuguuugugacccaugcuugaaaacuugaaggaaguuagauauga

SEQ ID NO: 631018 - RNA, 63 nt, hsa
aaagccuggacaaacuauagggugcuggggacugcuugaaaagcgacacaaacgggcgugcuc

SEQ ID NO: 631019 - RNA, 63 nt, hsa
cuucaaggaagacucuacaagcuuuuguucacagcuugaaauagaugccucacaauucagaca

SEQ ID NO: 631020 - RNA, 63 nt, hsa
gcugccauuugcuauaaaguugaacuuuguauggcuugaaaaagaaaugacaauauggaacau

SEQ ID NO: 631021 - RNA, 63 nt, hsa
aacugucccauuguaaagguguaaguuauauaggcuugaaaaaaauuggcggguaaaaaucac

SEQ ID NO: 631022 - RNA, 63 nt, hsa
uuuguuuuuucuugcuuuucauuugauuacccugcuugaaauacaguuaguugauaacauaaa

SEQ ID NO: 631023 - RNA, 63 nt, hsa
uaagggacuuuuauuuguaaaguaauggaucuggcuugaaaaauacgguagagauacuuagcu

SEQ ID NO: 631024 - RNA, 63 nt, hsa
aauauauaauuuucuauacauauauauccucuagcuugaaacuuuugcucaaguuuauuuaug

SEQ ID NO: 631025 - RNA, 63 nt, hsa
uuguauuauaaugaugauucugucaaaugaaaggcuugaaauaccuagaugaaguuuagauuu

SEQ ID NO: 631026 - RNA, 63 nt, hsa
cauaucucaccucuaggauaugauggaagaagugcuugaaagagaauuuuagcagaugguacu

SEQ ID NO: 631027 - RNA, 63 nt, hsa
cccagcuacucgggaggcugagacagaagaacugcuugaaaccaggaggcagagguugcagug

SEQ ID NO: 631028 - RNA, 63 nt, hsa
aaaaaaaaaaagaaaguaauuuuaaacucacuggcuugaaaugugugcuuucuguacaaugaa

SEQ ID NO: 631029 - RNA, 63 nt, hsa
uuuuuuauuucaauauauacaguuugaugaugugcuugaaauuggugcaaauauauacacacc

SEQ ID NO: 631030 - RNA, 63 nt, hsa
uucagaauaagcuuccccaccccaguuuuuguugcuugaaaauauuguugucccggauuuuug

SEQ ID NO: 631031 - RNA, 63 nt, hsa
gagacgcagguugcaguggacauugggauuguugcuugaaaaauuaaaauuugaauauuuucu

SEQ ID NO: 631032 - RNA, 63 nt, hsa
uuugaagucuucccuugacccuaguaaaauauagcuugaaacuuguaaacaacuguguuugcc

SEQ ID NO: 631033 - RNA, 63 nt, hsa
aaaugcuuguccccuauaugaauauucuguuacgcuugaaaaauauuuucuccagcguugguu

SEQ ID NO: 631034 - RNA, 63 nt, hsa
aggaauaaagccaaggggagugagaugaggugggcuugaaaguaccuuguccgcucagaagga

SEQ ID NO: 631035 - RNA, 63 nt, hsa
ccaggguauccaccugcaccccacucccaaguagcuugaaaaagggaggacagucuuucccca

SEQ ID NO: 631036 - RNA, 63 nt, hsa
aauuaaauauuauguccuaccaacuuauuagcugcuugaaaaauauaauacacauaaauaaaa

SEQ ID NO: 631037 - RNA, 63 nt, hsa
acuguauguuuuaauugcauuuaaaaauauauagcuugaaagcaguuaaacugauuaguauuc

SEQ ID NO: 631038 - RNA, 63 nt, hsa
ugguguguauuggccaaguuuugcuuguugugugcuugaaagaaaauaucucugaccaacuuc

SEQ ID NO: 631039 - RNA, 63 nt, hsa
uuuuggucccugcuccuugcccauaguaaaacagcuugaaauaucccaugcaagagaguaguu

SEQ ID NO: 631040 - RNA, 63 nt, hsa
gagacacagaggugccagugauggacuggaucagcuugaaagaagcacaaagacuccgugauc

SEQ ID NO: 631041 - RNA, 63 nt, hsa
cugggauugcaaacacuuuuuaaaaaauuguuugcuugaaaauacuacugaauauaaauaaga

SEQ ID NO: 631042 - RNA, 63 nt, hsa
uguugcccaccuguucacaaaaaguaccuuuaugcuugaaaacauuagguucuuugguuacug

SEQ ID NO: 631043 - RNA, 63 nt, hsa
gugaauuuuuuuuaaguggcacggucuuuuucugcuugaaaucugaucacaccccccagccau

SEQ ID NO: 631044 - RNA, 63 nt, hsa
caaggggcaaguuucacccaaaugccugagacugcuugaaagauauauuuuaaguggugcacu

SEQ ID NO: 631045 - RNA, 63 nt, hsa
auucaacugcaaaaucucaaucuugaaaaucaagcuugaaauuucauagguagaaauauuagc

SEQ ID NO: 631046 - RNA, 56 nt, hsa
cugaugaccuggagaucuagauacaggcuugaaagcaucaagauuccacucaauug

SEQ ID NO: 631047 - RNA, 63 nt, hsa
agaaucuugcaagacaguuauuaaacauucauagcuugaaauugcccauggugggagaguuua

SEQ ID NO: 631048 - RNA, 63 nt, hsa
cagacaaagucaagcagcuuuaaguacaaggcagcuugaaaccucucugaugaaagugaaaaa

SEQ ID NO: 631049 - RNA, 63 nt, hsa
caugaugagauaucaagguaauuaaaauagcaugcuugaaaaaaaaauacguaaucuguuuca

SEQ ID NO: 631050 - RNA, 63 nt, hsa
ggagaaaugaagcaaaggugaaugacagccuaggcuugaaauuauaaagcucucucagguuga

SEQ ID NO: 631051 - RNA, 63 nt, hsa
uucuuauaagccagcucugacuggauuuugaacgcuugaaaucaggcucuccacaccauugac

SEQ ID NO: 631052 - RNA, 63 nt, hsa
ggaggggugccguuuuuauuuuccugaacauuugcuugaaauauuuuguuagggccucaaaga

SEQ ID NO: 631053 - RNA, 63 nt, hsa
agguaugauuccuaagcccuaaggagcuccucagcuugaaauggggcugcaucccuauaaacc

SEQ ID NO: 631054 - RNA, 63 nt, hsa
aaccaaacgccuauuuuuuaaugcuuaguuuuggcuugaaauucuucuucaccuggaguuuuc

SEQ ID NO: 631055 - RNA, 63 nt, hsa
auuuuuacacagguuuucuugucuugacaagaugcuugaaaaaccaagaggauaugaaaaucu

SEQ ID NO: 631056 - RNA, 63 nt, hsa
ugugauguuucaaugugagacacaaaaacaauggcuugaaacuuguguaucauaugugauuuu

SEQ ID NO: 631057 - RNA, 63 nt, hsa
gaagguggggacagugaccgcggaccccucugugcuugaaagauuuccuccacggccuuugcc

SEQ ID NO: 631058 - RNA, 63 nt, hsa
uauuagucagaaagaaggagagaaugagugagugcuugaaaugugucauacuguuuuaggauc

SEQ ID NO: 631059 - RNA, 63 nt, hsa
agcugucuccucaucucauccuagucuagguuugcuugaaauugggugugagagcuagaauga

SEQ ID NO: 631060 - RNA, 63 nt, hsa
caaacuucauauaugucuaucagguaauaauaggcuugaaaauugauauccuguggugcuaaa

SEQ ID NO: 631061 - RNA, 63 nt, hsa
cuuccaaaggcauaagacccuaagccuccuuuugcuugaaaccaaagauauauacacaggauc

SEQ ID NO: 631062 - RNA, 63 nt, hsa
acauugauuauagaaccacuauuacgugaaaaggcuugaaacaaccaacauauacaaauaaaa

SEQ ID NO: 631063 - RNA, 63 nt, hsa
cuuugcacaguguauuaacauugggagggucuggcuugaaaauuuggccacccucagccucug

SEQ ID NO: 631064 - RNA, 63 nt, hsa
uuagacuuuuuaaacucaaggaugagcauaagugcuugaaauaaaaugcuaauacuuaagugu

SEQ ID NO: 631065 - RNA, 63 nt, hsa
cacaguugauuuucgguguguuccuguauaacggcuugaaaggaaaggagaagaugcuguguc

SEQ ID NO: 631066 - RNA, 63 nt, hsa
uugugcaugcuaguguuguauuucuauacaguagcuugaaauugauuaacuuauacuguaggu

SEQ ID NO: 631067 - RNA, 63 nt, hsa
gaggugaguucacauaacaggaauucuggaacugcuugaaaacuaggacgauugggcaauauc

SEQ ID NO: 631068 - RNA, 63 nt, hsa
cuauuaguacuucccuuugucugugccauaagugcuugaaaacguuaagguuuucuguuuugu

SEQ ID NO: 631069 - RNA, 63 nt, hsa
ucucuagcuguucuacaaaacuggagcaugcuggcuugaaaaacccuugcccaguuuugaucc

SEQ ID NO: 631070 - RNA, 63 nt, hsa
auuccagccaaggcaaauucaguuggaucuagggcuugaaaacugcccaagauuaaagagcua

SEQ ID NO: 631071 - RNA, 63 nt, hsa
uuuuuauuugcugucuuugguaauuaucucucugcuugaaauuaaaugcacuauaaguuaaua

SEQ ID NO: 631072 - RNA, 63 nt, hsa
auugcaauuguggucaaauaaggaacguuuccugcuugaaauuauauugauuuaaaugaugug

SEQ ID NO: 631073 - RNA, 63 nt, hsa
cgcacagcagcgaugcagaaggcaagaacggcagcuugaaaaauuaaaggagguuguucacuu

SEQ ID NO: 631074 - RNA, 63 nt, hsa
gcugcucuuaugccauuuguuuauuuuuauauagcuugaaacauagagggagagagggagaga

SEQ ID NO: 631075 - RNA, 51 nt, hsa
ccuuggagccgcccuccugaagcuugaaaauggaagaauuuaguuuuguug

SEQ ID NO: 631076 - RNA, 63 nt, hsa
uuccaaagcaagggcaagguaggaacaagaugagcuugaaauaucuuguuaugccagaaagua

SEQ ID NO: 631077 - RNA, 63 nt, hsa
guaaaguuguuucaguuaaacugggcugagagagcuugaaaguccuuuucauaaaagauaacu

SEQ ID NO: 631078 - RNA, 63 nt, hsa
uuaacuuaaaggcauugguuauaaauucaaagagcuugaaaagauugaagagggccaaacacu

SEQ ID NO: 631079 - RNA, 63 nt, hsa
cuuauuagaaagccaaaguagaguucuguuuaagcuugaaagagguaugaaguaaucuguagu

SEQ ID NO: 631080 - RNA, 63 nt, hsa
cugaaauuuaaacuugauauuuuucgcccucuugcuugaaaacuucacuugcuuccccauuuc

SEQ ID NO: 631081 - RNA, 63 nt, hsa
ggcuugauuuaacauuguuuuuguguuauuuuugcuugaaacaacgcacacauuuucaacaac

SEQ ID NO: 631082 - RNA, 63 nt, hsa
guuuaagagcagaacagaucuuuuacuuuggccgcuugaaaagcuaguguaccuccucucagu

SEQ ID NO: 631083 - RNA, 63 nt, hsa
ccagcugggccaugucagucucaucgucccaaggcuugaaauccagcaggauggaggacuugg

SEQ ID NO: 631084 - RNA, 63 nt, hsa
caguguuggugaaucuuuuggccuuuccccaaugcuugaaagaagaucaccacugcuggaggc

SEQ ID NO: 631085 - RNA, 63 nt, hsa
gacaggugggugaggaucugagaaaugcuaaaggcuugaaagcaucugaagacaucuaacuua

SEQ ID NO: 631086 - RNA, 63 nt, hsa
agaaauacaagguugcuugucugaccccaaucugcuugaaaccugacucugcuucucucauuu

SEQ ID NO: 631087 - RNA, 63 nt, hsa
ggggcugacagcaggcuuacugccaucaacauugcuugaaaugccucuauguucugaauaaag

SEQ ID NO: 631088 - RNA, 63 nt, hsa
uaaaauauggaaauuuuaaaauuaugaccaagggcuugaaacauauuggauuacaugcucaca

SEQ ID NO: 631089 - RNA, 63 nt, hsa
aaacaaugaauucuucaacagggaaaacagcuagcuugaaaacuugcugaaaaacacaacuug

SEQ ID NO: 631090 - RNA, 63 nt, hsa
ccacccucagcucuuuccucugguguggcuucagcuugaaagcaaccuggagucgggggcaca

SEQ ID NO: 631091 - RNA, 63 nt, hsa
auugaaagggaguauuacaaaaacauggccuuugcuugaaagaaaauaccaaggaacaggaaa

SEQ ID NO: 631092 - RNA, 57 nt, hsa
cccggauuggugugagauaacuuuuuugcuugaaagagacugcucuauuuauucugu

SEQ ID NO: 631093 - RNA, 63 nt, hsa
gguuuggggaaggacaguguggugugacuauuggcuugaaacguuauggauaugguuggaguc

SEQ ID NO: 631094 - RNA, 63 nt, hsa
cauauaaauguggaggcuaucaacaaagaaugggcuugaaacauuauaaaaauugacaaugau

SEQ ID NO: 631095 - RNA, 63 nt, hsa
cccagcuccucaggaggcugaggcaggagaauugcuugaaaccaggaggcggagguugcagug

SEQ ID NO: 631096 - RNA, 63 nt, hsa
gaacuguuggacuggguagaaaucuuucaagaagcuugaaaauaaggccauaaaggaggggcu

SEQ ID NO: 631097 - RNA, 63 nt, hsa
ggacccucauuucuucugacagauuucagucuggcuugaaauuuggggauguuaaugaggguc

SEQ ID NO: 631098 - RNA, 63 nt, hsa
uacaugguuacauguucuacaucaugcauaguagcuugaaaucuagucuggagaaaacuggau

SEQ ID NO: 631099 - RNA, 63 nt, hsa
acaguguucuggaaaagaugccauucuuuuuaagcuugaaacugcagaagaaauucacaggaa

SEQ ID NO: 631100 - RNA, 63 nt, hsa
aguggcccaucauucauacccacuguucugaaggcuugaaaacaaaacauauccacaacauug

SEQ ID NO: 631101 - RNA, 63 nt, hsa
gucuuuuuacugcaacccacaggcccacaguaugcuugaaaagauaaauuauaucaauuuccu

SEQ ID NO: 631102 - RNA, 63 nt, hsa
gcucgggagagcugaggguuuuauuguuugcuugcuugaaaccuaaucuauagacggccccac

SEQ ID NO: 631103 - RNA, 63 nt, hsa
ccacugagcuggaggaauaucuacagcagugaugcuugaaauuuuuguaugaauuauuuuguc

SEQ ID NO: 631104 - RNA, 63 nt, hsa
cuuucuaucuucauaaccauuuaaagcgauuuagcuugaaauuaaauuuuaucaggcuaccaa

SEQ ID NO: 631105 - RNA, 63 nt, hsa
ccccucccuguccgccucuccuuacuuucucuugcuugaaacugcuuuuccuuuucuacucuu

SEQ ID NO: 631106 - RNA, 63 nt, hsa
ggcgugaguuuuaggugaauuuaugugguuccugcuugaaaaccuuccccucuccagguucgg

SEQ ID NO: 631107 - RNA, 63 nt, hsa
auaaaauaaucauuuuugaaccuguguaauaaagcuugaaagcagggaaaagaauuuccuuuu

SEQ ID NO: 631108 - RNA, 63 nt, hsa
gggugauaauaaucuccauaguuauuugaaguggcuugaaaaaggcaagauugacuuuuauga

SEQ ID NO: 631109 - RNA, 63 nt, hsa
ucauaacacucucggucacauguuuuuccuucagcuugaaagcuuuuuuuuaaaaggaaaaga

SEQ ID NO: 631110 - RNA, 63 nt, hsa
aauaccuuaauggugguagagccuuuaccuguagcuugaaaggggaaagauuggagguaagag

SEQ ID NO: 631111 - RNA, 63 nt, hsa
guaggaauccaggaugcuuaguuucuagacccugcuugaaaguucuagagccuuugaaaggga

SEQ ID NO: 631112 - RNA, 63 nt, hsa
cguaaagccauauguucuguucaagucuuguuugcuugaaaugauuauuccuacaagugaaac

SEQ ID NO: 631113 - RNA, 63 nt, hsa
ugaagacaacaccugcuucaggggaacacaggcgcuugaaaaagaaaagagagaacagcccau

SEQ ID NO: 631114 - RNA, 63 nt, hsa
ucaaaauaugagacuaugcuauaggcagugcuugcuugaaaagucucauuuuuaaaucucccu

SEQ ID NO: 631115 - RNA, 63 nt, hsa
cuuauaucuaauauauaucugggagaaaaggcugcuugaaaauaucuuuugauucagugauuu

SEQ ID NO: 631116 - RNA, 63 nt, hsa
uuuuuuaagggagggaauuuauuauuuaccguugcuugaaauuacuguguaaauauaugucug

SEQ ID NO: 631117 - RNA, 58 nt, hsa
cacaggugcccgaggacugagaaccagagcuugaaauucaaagcugcgaucccuucac

SEQ ID NO: 631118 - RNA, 63 nt, hsa
uuuggguguggugacccagaugcacagagcucugcuugaaacagguacacgggccagggaaau

SEQ ID NO: 631119 - RNA, 63 nt, hsa
ggucaccucaaauuuaagucgggaaauucugcugcuugaaacuucagcccugaaccuuugucc

SEQ ID NO: 631120 - RNA, 63 nt, hsa
ccugucucaggacacacuugccaucuagggcuagcuugaaagagccugaggacugccuuuaac

SEQ ID NO: 631121 - RNA, 63 nt, hsa
guugauuaaaccugucacuuuacacaugaaaaagcuugaaacuuagagaaagauaaaauguaa

SEQ ID NO: 631122 - RNA, 63 nt, hsa
cugugaagaguggacagucuuggagaacacagugcuugaaauggacaagcuggaccuauuccu

SEQ ID NO: 631123 - RNA, 63 nt, hsa
uauugccacccaugacauuuaacauguugugaugcuugaaaacacaggaguagagaaaaucga

SEQ ID NO: 631124 - RNA, 63 nt, hsa
augaagcacuguuuuuaaacccaaguaaagacugcuugaaaccuguugauggaaaugacuuau

SEQ ID NO: 631125 - RNA, 63 nt, hsa
uauucaacagccauuuagagugccaucaagauggcuugaaauggaauuuugugauuuguaguc

SEQ ID NO: 631126 - RNA, 63 nt, hsa
aaauagaauauauauauauugcuuaucugaaaugcuugaaaccagaauuguuuugcauuuuuu

SEQ ID NO: 631127 - RNA, 63 nt, hsa
augaagauugaaugugauguauucacguaacaugcuugaaacugccuggcauauacuaaacgc

SEQ ID NO: 631128 - RNA, 63 nt, hsa
aaaaaaaugcacauagcuaucaagugugcuuuagcuugaaaaggugaccuugcaacuucaugu

SEQ ID NO: 631129 - RNA, 63 nt, hsa
cccuuuuuauuuuaaaauuugacuccucuucaagcuugaaaacccucugaacucagucuucuu

SEQ ID NO: 631130 - RNA, 63 nt, hsa
uuaaugcagcccugcugguccccauuaacaauugcuugaaauucacauggauguaaaauuaua

SEQ ID NO: 631131 - RNA, 63 nt, hsa
uguuuagacauuuuuugucccagaaauacagaagcuugaaaugcuaugaaggcagagcuucua

SEQ ID NO: 631132 - RNA, 63 nt, hsa
ucauacgcuguacuugcuaaaaaucaacugugcgcuugaaagaccucuucauaguugaguaau

SEQ ID NO: 631133 - RNA, 63 nt, hsa
uuaaugcaggacaucaacuacauaaugaaagaugcuugaaaugcuuuuguuauuucaggcaaa

SEQ ID NO: 631134 - RNA, 63 nt, hsa
uuacaaacaagagaaaugagaacuuacaggauugcuugaaauuauuguggguauuaucuguuu

SEQ ID NO: 631135 - RNA, 63 nt, hsa
acucaaggucgcuggaugcugaucuaaucaguagcuugaaaccacaauuuuaaaaaugugacu

SEQ ID NO: 631136 - RNA, 63 nt, hsa
gcugguucccguuuuccagagggggagcccagagcuugaaaggccgcgguuggcacuucgaga

SEQ ID NO: 631137 - RNA, 63 nt, hsa
auggguagaauuguagucaggaaaacagaaagggcuugaaauuuaauaagugcugcuggaagg

SEQ ID NO: 631138 - RNA, 63 nt, hsa
cacgagugucuccccagugcagacucaaguuaugcuugaaaugaaaaagucuaucugguagug

SEQ ID NO: 631139 - RNA, 63 nt, hsa
augaaauggucauuuuucugaagagaauauuuugcuugaaaugcaaaggacugaaagagauuu

SEQ ID NO: 631140 - RNA, 63 nt, hsa
gacguccuuccauaucccugcccagccuguggugcuugaaacguuugccccaugggaaacgua

SEQ ID NO: 631141 - RNA, 63 nt, hsa
uuuauacuuggguuauauauuagacuuuuauaggcuugaaaucauccaucacauaagaaaaua

SEQ ID NO: 631142 - RNA, 63 nt, hsa
ucauuucauuaguauuccucauucugcauccuggcuugaaaaacagcucuguugaaucacagu

SEQ ID NO: 631143 - RNA, 63 nt, hsa
auucuacuuaagcuauaagucucugucauuuuugcuugaaaauuagcaugccucugucuuaaa

SEQ ID NO: 631144 - RNA, 63 nt, hsa
uucuuuuuuaaagccauucuguucuuuggaugugcuugaaagggugugugauuacaccauugu

SEQ ID NO: 631145 - RNA, 63 nt, hsa
guugcacuuugcugugcugaucccacaggaaaggcuugaaacacgagaagcagcaaagacaga

SEQ ID NO: 631146 - RNA, 63 nt, hsa
uuuccccccaaguagaacuaaugcuagcuuccagcuugaaaguaaaacuccaguguggaguga

SEQ ID NO: 631147 - RNA, 63 nt, hsa
ucaggguggccaguauuuugacuuauuuauccugcuugaaagcuacuugagauguguacugcu

SEQ ID NO: 631148 - RNA, 63 nt, hsa
ggagcaaaacacugauuugauacuagucaguuugcuugaaacuaguucaccuaaagcuagauc

SEQ ID NO: 631149 - RNA, 63 nt, hsa
acuuucauguuuuaaaaaucccuuuaauuucuugcuugaaaaucccaugaacauuaaagagcc

SEQ ID NO: 631150 - RNA, 63 nt, hsa
aagcuguuuguuauaugcugcuuaauaaaguaagcuugaaauuuaucauuuuaucaugaaaac

SEQ ID NO: 631151 - RNA, 63 nt, hsa
auuuagaugguccaagauaaucucauucaggaggcuugaaacauuaaugguuuagucuuguga

SEQ ID NO: 631152 - RNA, 63 nt, hsa
auguggcagaauuucccucuuacauaaaccaaugcuugaaaaugcugcaaaugacccucuaau

SEQ ID NO: 631153 - RNA, 63 nt, hsa
aaggacaagucaauuugucaguagcuucuucuggcuugaaacccccucccuggauuuuauagc

SEQ ID NO: 631154 - RNA, 63 nt, hsa
ucccaucuccaaggugcgucauaugcaggaauggcuugaaacaagaggaaguccuaaaucaca

SEQ ID NO: 631155 - RNA, 63 nt, hsa
uuuccccuguuuggugcuauguuuauguauuaugcuugaaauuuuaauuuuuuuuuuuuugca

SEQ ID NO: 631156 - RNA, 63 nt, hsa
gguccagcaaaagucaguagggacauugcagaagcuugaaaggccaauaccagaacacaggcu

SEQ ID NO: 631157 - RNA, 63 nt, hsa
aucccagcuauucuggaggcugaggcaggaaucgcuugaaauuggaaagcagagguugcagug

SEQ ID NO: 631158 - RNA, 63 nt, hsa
cccaguuugucuuucagaaggugacuuucaugugcuugaaaaguuuaauauuugaauauugug

SEQ ID NO: 631159 - RNA, 63 nt, hsa
uuguuuucuuuaggagucuaccuuuguguaugugcuugaaaguauuuuuguaauccaagaaug

SEQ ID NO: 631160 - RNA, 63 nt, hsa
gaauugcccuauaaacauagcaggauuuugagagcuugaaaauuuuccauuauucuggacaug

SEQ ID NO: 631161 - RNA, 63 nt, hsa
guccccucugucaccagggaagccacaaugagagcuugaaagggugcugucaagauaaauguc

SEQ ID NO: 631162 - RNA, 63 nt, hsa
aacagggagugguauuugaaguguccagcaguugcuugaaaugcuuugccgaaucugacucca

SEQ ID NO: 631163 - RNA, 63 nt, hsa
uaccucuguuuuuaauuuucuuuccaaaaggcagcuugaaauguugguccuaaucuuaauuuu

SEQ ID NO: 631164 - RNA, 63 nt, hsa
ggggugacuuuaguuuuucuucagcuuaggcgugcuugaaaccuuggccagguuccaugacca

SEQ ID NO: 631165 - RNA, 63 nt, hsa
cuaaacugcaaacauuuucacacccaccaugcugcuugaaagccacuugauccucaacauaua

SEQ ID NO: 631166 - RNA, 63 nt, hsa
accagugacuucagagccuauggucucaacugugcuugaaaaacacugucucugaaaacaacu

SEQ ID NO: 631167 - RNA, 63 nt, hsa
uuaagccagacugaccacuugcuuggagugugugcuugaaaaaaccagagcaauacuguuggg

SEQ ID NO: 631168 - RNA, 63 nt, hsa
gucccaggacaggaaugcgguucaaacccaguggcuugaaacuuccugagaaacuguagcaua

SEQ ID NO: 631169 - RNA, 63 nt, hsa
gcaacacuccugccaaguggucuucuacccauugcuugaaaaucucucuugacagggagcuca

SEQ ID NO: 631170 - RNA, 63 nt, hsa
cuguucacuugauuaguugaaacacaaauucuggcuugaaaaaauaggggagauuaaauauua

SEQ ID NO: 631171 - RNA, 63 nt, hsa
acaucuauccccuccucccccauacacaccuaggcuugaaaugcccuacaggcccagaacuuu

SEQ ID NO: 631172 - RNA, 63 nt, hsa
gaauguuugggaaugagaggaugagugagugaggcuugaaaacacaccacauugaaaauccug

SEQ ID NO: 631173 - RNA, 63 nt, hsa
aauugcgccgcuccuggagaccugauaacuuaggcuugaaauaauugacuugucuaaaaggac

SEQ ID NO: 631174 - RNA, 63 nt, hsa
gaagcauuuuuaacuggguagaaucugacuguggcuugaaauaaaaagcucucagaaaacuca

SEQ ID NO: 631175 - RNA, 63 nt, hsa
cccacccccuuuaggaaccaggcugguguucuugcuugaaagcguugugcccucugagugucu

SEQ ID NO: 631176 - RNA, 63 nt, hsa
gggaaggauagggugauguuccgaaggugaggagcuugaaacccguggcgcuuucugcaguuu

SEQ ID NO: 631177 - RNA, 63 nt, hsa
uguuaauucuaaauccuugauccucugcaaugugcuugaaaacacaaaccuuuuggguuaaaa

SEQ ID NO: 631178 - RNA, 63 nt, hsa
gucagauuagggucucugccauucagaguugaugcuugaaaacuuuaguuuuccuuauuaaug

SEQ ID NO: 631179 - RNA, 63 nt, hsa
gagcucuguuacagcccacuguguccuuuagaagcuugaaaggaacccaacucuuugcugcac

SEQ ID NO: 631180 - RNA, 63 nt, hsa
gcuuuaccuggucaccaugugaugugaucagaugcuugaaauuuaacacuuuucacuugguuc

SEQ ID NO: 631181 - RNA, 63 nt, hsa
aauuagagaaacagaaguccaaggcuggcgacagcuugaaaagucugacagcuuuucuacuuu

SEQ ID NO: 631182 - RNA, 63 nt, hsa
ucgcuuaagaucacaggcuuagugugaggacgagcuugaaaucccagucuccuggcccccagg

SEQ ID NO: 631183 - RNA, 63 nt, hsa
guacauggguacaauccgagggugugaauuucagcuugaaauuccauugcuguuccuuguuuu

SEQ ID NO: 631184 - RNA, 63 nt, hsa
guucaucucugaaacccagcauccuuuucagcugcuugaaaacauuguauuuuuuuuuuuuaa

SEQ ID NO: 631185 - RNA, 63 nt, hsa
ugacaaggaaggaguugagcccuggguaggcuugcuugaaaagugaguccuuccagaauauuc

SEQ ID NO: 631186 - RNA, 63 nt, hsa
aggaaagggucuuagucacugccucccgaaguugcuugaaagcacucggagaauugugcaggu

SEQ ID NO: 631187 - RNA, 63 nt, hsa
cugcccagugucagaacaguuauacaaacgagggcuugaaaacauuuugugaaaacuugcuua

SEQ ID NO: 631188 - RNA, 63 nt, hsa
agucaacauuagaacugaaaauggaaauaaacugcuugaaaagacgauggugccucuggguca

SEQ ID NO: 631189 - RNA, 63 nt, hsa
ugcacaguccauucuguuuuuauuacuaucuaggcuugaaauauauaguuugaaauuaugaca

SEQ ID NO: 631190 - RNA, 63 nt, hsa
cuaaauguccaaaaagaacaugagauuuauggugcuugaaauguugcuaaacguaaauuugua

SEQ ID NO: 631191 - RNA, 63 nt, hsa
agacugugacaaaguugucagucacaaaucacagcuugaaagacaggagaauucauacuggag

SEQ ID NO: 631192 - RNA, 63 nt, hsa
cugggaagccugggaguguuugucccaucgguagcuugaaauaaacgcuccccucagacaccc

SEQ ID NO: 631193 - RNA, 63 nt, hsa
ggaagccuugccuucccgcuucuacaugcuugagcuugaaaagcagucaccuccucggggacc

SEQ ID NO: 631194 - RNA, 63 nt, hsa
cuguuucaaugaccuuuauuuuaaaaacacauagcuugaaaauuuauuuuuauacugauauua

SEQ ID NO: 631195 - RNA, 63 nt, hsa
uagcugaacaaaaaugugcaguuaauacuuggcgcuugaaaaugcaguagugaauguggaacc

SEQ ID NO: 631196 - RNA, 63 nt, hsa
uaaggucuucuuguguccugaugaaaaauaugugcuugaaaugagaaacuuugaucucugcuu

SEQ ID NO: 631197 - RNA, 63 nt, hsa
uuucuaauagccuuggguuuauuugcaaaggaagcuugaaaaauaugagaaaaguugcuugaa

SEQ ID NO: 631198 - RNA, 63 nt, hsa
uuagccucccugaaaauguuuuucugccagggagcuugaaaguuuucagaaccucuuccccag

SEQ ID NO: 631199 - RNA, 63 nt, hsa
gaaaaugucguuguuguuguuuuucuggaaacugcuugaaaucuugcuguacuauagagcuca

SEQ ID NO: 631200 - RNA, 63 nt, hsa
aaaguaaagaaggaauaaucuacccugacuaaagcuugaaaugcuacauuuccaaggugaaga

SEQ ID NO: 631201 - RNA, 63 nt, hsa
cgguaucuuuuaauauaagaacacugaauuuuggcuugaaauauugugacuaaauugcacaau

SEQ ID NO: 631202 - RNA, 63 nt, hsa
uaaggaauggcaucagaacaauagcuuggaauggcuugaaaucacaaaggaucugcaagauga

SEQ ID NO: 631203 - RNA, 63 nt, hsa
gaaaacugcagcauaucagacagcaauuuaacagcuugaaacaucuacagauaguuccuacua

SEQ ID NO: 631204 - RNA, 63 nt, hsa
cuuagcuacucaggaggcugaggcaggagaaucgcuugaaaacaggagguggagguugcagug

SEQ ID NO: 631205 - RNA, 63 nt, hsa
cuaggaaucauauguuguccaucccccccucaggcuugaaaguccucaaagagacccacuauc

SEQ ID NO: 631206 - RNA, 63 nt, hsa
auaucuuaagagaugaauaccuuaucagcuguugcuugaaaccuguuaaaaauguucauaaca

SEQ ID NO: 631207 - RNA, 63 nt, hsa
uaaacaagaauaauaaagguuggagauuguuacgcuugaaauuaaguuggaggcaaauugaua

SEQ ID NO: 631208 - RNA, 63 nt, hsa
gucaccugaacaaugacccaucaucucuugcuugcuugaaaucuugcugaaauguucucauuu

SEQ ID NO: 631209 - RNA, 63 nt, hsa
auuuauuguuuugguauuucauguuacuccuaagcuugaaagcucuuuuuucuauauacagaa

SEQ ID NO: 631210 - RNA, 63 nt, hsa
gggagaagcuauagaaagaggagcccacacaaagcuugaaagccugugccagauggagccuuu

SEQ ID NO: 631211 - RNA, 63 nt, hsa
uggcuccugccaccacaaauguuacccucauuggcuugaaaagcauccaagggugcacaggga

SEQ ID NO: 631212 - RNA, 63 nt, hsa
acugaauugagaaauacuucuucaaguuaugaugcuugaaaguucucaauaaaguucacgguu

SEQ ID NO: 631213 - RNA, 63 nt, hsa
uaaauuuacacuauuuauaaauacauauuuauugcuugaaaauauuugugaauggaaugcugu

SEQ ID NO: 631214 - RNA, 63 nt, hsa
cauauagcuauagauauaggcuuuuccuugaaagcuugaaaaaaauucgccaguaaaauaauc

SEQ ID NO: 631215 - RNA, 63 nt, hsa
ugaaaccaauaugguuuucuuuaugucuuggcugcuugaaaauuaaaaaaaaaaaagguuugu

SEQ ID NO: 631216 - RNA, 63 nt, hsa
cccaaaggaucuguacuuucuuuccuuacaacagcuugaaaaucauuauuuuaaaauccuuaa

SEQ ID NO: 631217 - RNA, 63 nt, hsa
aauuuguuauguuuaaggaaauuaagauuuuaagcuugaaauuauacaagcagaaucuaauuu

SEQ ID NO: 631218 - RNA, 63 nt, hsa
gugcuaccaguuugcugguggcuaacggcuugugcuugaaagucuucugaagucugaugugaa

SEQ ID NO: 631219 - RNA, 63 nt, hsa
gcaugcauguugaaauuuuuuagcaguacuuuagcuugaaaguacucguacaaauacuguuag

SEQ ID NO: 631220 - RNA, 63 nt, hsa
uagaaguaaugauauacaguuuucuuccuaguggcuugaaaaucuggacuuccucaauuauua

SEQ ID NO: 631221 - RNA, 63 nt, hsa
caccauucuucuuuuguaauaaauuuugaaugugcuugaaagugaaaagcaaucaauuauacc

SEQ ID NO: 631222 - RNA, 63 nt, hsa
uugguacuuggaauugauauauaccuuauuaaagcuugaaaacauuuagcauuugaauaguaa

SEQ ID NO: 631223 - RNA, 63 nt, hsa
aguaaauaaaacaguguauuuugaaguuugacugcuugaaaaagauuagcauacaucuaaugu

SEQ ID NO: 631224 - RNA, 63 nt, hsa
aacugucagaauuguuaacugaaacaaauauuugcuugaaaaaaaaaguucaugaaguaccaa

SEQ ID NO: 631225 - RNA, 63 nt, hsa
uuccaggauuuggauuuugauuuuccaaauguagcuugaaauuucaauaaacuuugcucuguu

SEQ ID NO: 631226 - RNA, 63 nt, hsa
uuaaaaucauguauuuaaugugucagauauugugcuugaaagauucucaucucagaauacuuu

SEQ ID NO: 631227 - RNA, 63 nt, hsa
uaugaguuacugugggguccaagggcacucgcugcuugaaaguacuggagcacguggucaggg

SEQ ID NO: 631228 - RNA, 63 nt, hsa
cuugucgucacagcuggcaugggcuggacaguugcuugaaaugaccuaaccaaaaacauucaa

SEQ ID NO: 631229 - RNA, 63 nt, hsa
auucacugacgaauucagagauugagggcacuugcuugaaaucaaggugcuccaacuuaguuu

SEQ ID NO: 631230 - RNA, 64 nt, hsa
cccaaaacaucagcauuucuaaaauaguccuaaagcuugaaaguaaguugcuuccaugagcaug

SEQ ID NO: 631231 - RNA, 64 nt, hsa
ucuuucacuaccuuucuuacccuuaaugugccaagcuugaaacaggauuugauuuccugagcua

SEQ ID NO: 631232 - RNA, 64 nt, hsa
uugccucacucucuccaguugguuuucagcuggggcuugaaaugcauuuuuagcccuuugacgu

SEQ ID NO: 631233 - RNA, 64 nt, hsa
aauaguguauuauuaucguuggggcuggcucuaugcuugaaaaccaguuuauuuauaaccuguu

SEQ ID NO: 631234 - RNA, 64 nt, hsa
auuuuuucauaguuucauuuguucuugcccacaagcuugaaauccagguuaagguauccagccu

SEQ ID NO: 631235 - RNA, 64 nt, hsa
uguugcugggggccgauucugaucaagacacauggcuugaaaauggaagacacaaaacugagag

SEQ ID NO: 631236 - RNA, 64 nt, hsa
aaauauauaaaugcuucagaugucaaauacccaugcuugaaagcucguguaauuuacuuuaaga

SEQ ID NO: 631237 - RNA, 64 nt, hsa
ugcuaaacuuuauauaaugugugguuucaauucagcuugaaaaauaaucucacuacauguagca

SEQ ID NO: 631238 - RNA, 64 nt, hsa
cuguuccccacuccacaggagggagcugacguuggcuugaaaggaguaaagucaacaucugcug

SEQ ID NO: 631239 - RNA, 64 nt, hsa
aguucuauagccuucucuugcaguauuuggauuugcuugaaaccgggaaaacuguucccauuag

SEQ ID NO: 631240 - RNA, 64 nt, hsa
aguaucgguuuuauucuuugcugauguccuuucugcuugaaauaacagucaccauacagcuaaa

SEQ ID NO: 631241 - RNA, 64 nt, hsa
gauuacugucucuugaacaguugcaaucuuggcagcuugaaaauggugcuacacucuguuuugu

SEQ ID NO: 631242 - RNA, 64 nt, hsa; identical to SEQ ID NO: 190819

SEQ ID NO: 631243 - RNA, 64 nt, hsa; identical to SEQ ID NO: 190820

SEQ ID NO: 631244 - RNA, 64 nt, hsa
agucccacuggcuggccucaggcugucuuauuccgcuugaaaauagccaaaaagucuacugugg

SEQ ID NO: 631245 - RNA, 64 nt, hsa
acaaugaaauuauauuuucuuuguaaagaaaguggcuugaaaucuuuuuuguucaaagauuaau

SEQ ID NO: 631246 - RNA, 64 nt, hsa
uuuccaaagaagagucgaguccucugaggucugugcuugaaagccguccgaaggcauucuuguu

SEQ ID NO: 631247 - RNA, 60 nt, hsa; identical to SEQ ID NO: 630940

SEQ ID NO: 631248 - RNA, 64 nt, hsa
gugugccuucagggaggaagagggagguggucaagcuugaaaaacuggcuuuaggaugguucug

SEQ ID NO: 631249 - RNA, 64 nt, hsa
cguccagcagacacugaaccagaauuggaaacgugcuugaaacaaucacacaggacacuuuucu

SEQ ID NO: 631250 - RNA, 64 nt, hsa
caacacugucaagguggagacuggaggugguggggcuugaaaugagcccaggaaaccagagcag

SEQ ID NO: 631251 - RNA, 64 nt, hsa
gaggcaagaugagauggcagccugcagaguaaaugcuugaaaaaagaggggugauuuucaaugg

SEQ ID NO: 631252 - RNA, 64 nt, hsa
aaaacacuaguuuugugccagccgugaugcucaggcuugaaaugcauuauuuugaaugugaagu

SEQ ID NO: 631253 - RNA, 64 nt, hsa
auuuuauguuguugacucuggcuccagggccugugcuugaaaaggacagauaaguauugcccag

SEQ ID NO: 631254 - RNA, 64 nt, hsa
auguuuuauaucuuaauucuaguaucuguuuuaugcuugaaagcauuacagaucaugauaccua

SEQ ID NO: 631255 - RNA, 64 nt, hsa
uucuuaauauggugcugauguuuuugugucaauggcuugaaacuggcaagauuaacaaaauuag

SEQ ID NO: 631256 - RNA, 64 nt, hsa
aaaaauuaaaauccuugacauagaccauagcauggcuugaaaugcuaugucugcaugauaauuu

SEQ ID NO: 631257 - RNA, 64 nt, hsa
aagaaaaccuaaacuaaugucauuggaaacaaaagcuugaaagaaacacaucgcaucuacauuu

SEQ ID NO: 631258 - RNA, 64 nt, hsa
aacucacaaaacauuuugcuaaaaagauaugacugcuugaaauagucucucucccauggagaac

SEQ ID NO: 631259 - RNA, 64 nt, hsa
uggauauucaagccuuuggauggcuauggagagggcuugaaauguguacaggugucaccaucau

SEQ ID NO: 631260 - RNA, 64 nt, hsa
gaaugagcuaagcaaggcugagccuccuccuguugcuugaaauaaugaugauauaaaggcugga

SEQ ID NO: 631261 - RNA, 64 nt, hsa
auucuuugaauagucacucguaaaaacugucagugcuugaaacuguuuccuuuacucauguuga

SEQ ID NO: 631262 - RNA, 64 nt, hsa
uauuccccugccuuccuggcuugauugaaggaaagcuugaaaaggcgcagagcccuauaccuca

SEQ ID NO: 631263 - RNA, 64 nt, hsa
cggaguuucaaaaacugaugagccucgauccagggcuugaaagaagccaggguguaaucuuguu

SEQ ID NO: 631264 - RNA, 64 nt, hsa
cugcuccucucugccgccuuuccuccauuccauggcuugaaaccucugccugauguggcuccuu

SEQ ID NO: 631265 - RNA, 64 nt, hsa
auaaaaugagaaacuuuuuuccuacaaagaccuugcuugaaaccacaaaaguuuugcuggcacg

SEQ ID NO: 631266 - RNA, 64 nt, hsa
gugaccauacuaauuauacccccugcaaagcccagcuugaaaccuucacuuaggaacguaaucg

SEQ ID NO: 631267 - RNA, 64 nt, hsa
auauugugugcaaaggaugggcagaaaagaaagugcuugaaagauuucaaauuuucagaaaggg

SEQ ID NO: 631268 - RNA, 64 nt, hsa
aaaauuucacaagacuuauuuuaaugacaauguagcuugaaagcgaugaagaaugucucuagaa

SEQ ID NO: 631269 - RNA, 64 nt, hsa
cacuuggcucugaacauacuggcuuugcuguaaugcuugaaaaggcguugguaucuucauuuua

SEQ ID NO: 631270 - RNA, 64 nt, hsa
ucuaugcauccgauucuuaacaaaacugcagggagcuugaaaaaaugcagacuguacaaacgcu

SEQ ID NO: 631271 - RNA, 64 nt, hsa
ucagaaaaugcaucccugauuucauucauuuccagcuugaaagccagccauauuacucuagucc

SEQ ID NO: 631272 - RNA, 64 nt, hsa
uauaaauacaguaaguuuagauuauugaauuggugcuugaaauuuauugguuuuguuguaauuu

SEQ ID NO: 631273 - RNA, 64 nt, hsa
uguaauagugaaaccuguacucaaaauauaagcagcuugaaacuggcuuuaccaaucuugaaau

SEQ ID NO: 631274 - RNA, 64 nt, hsa
uaaucauaacuguuaauucucagccaucuuugaagcuugaaagaagagucuuugguauuuugua

SEQ ID NO: 631275 - RNA, 64 nt, hsa
guuaguguccgaagaccgaauuuuauuuuacagagcuugaaaacucacuucaaugaacaaaggg

SEQ ID NO: 631276 - RNA, 64 nt, hsa
auagcauaaagcuaggggaugcauggaaauagcagcuugaaacuaggagguaacaagaaagcuu

SEQ ID NO: 631277 - RNA, 64 nt, hsa
guaaugggucuuggaguauagauuuuuauuaguagcuugaaagagcuuaaucauaugcaguaag

SEQ ID NO: 631278 - RNA, 64 nt, hsa
agcacaucccgcugcagagggcauucccuuuaaggcuugaaaaugccuccuguagucccaaacc

SEQ ID NO: 631279 - RNA, 64 nt, hsa
gaggacuugggcgggacacaggcuccaaacuggagcuugaaauagugucugaugaauguuaaau

SEQ ID NO: 631280 - RNA, 64 nt, hsa
agccagggggacuagccccuguggagacuggggggcuugaaauuguccccguggucucuuacuu

SEQ ID NO: 631281 - RNA, 64 nt, hsa
cagacuauagcauauuagcuguuuagaagggauggcuugaaaggaaggagacugaaaaacacuc

SEQ ID NO: 631282 - RNA, 64 nt, hsa
ccugccucagccucccaaagugcugggauuacaggcuugaaagucuaacuuuuuuuuacuuaua

SEQ ID NO: 631283 - RNA, 64 nt, hsa
auugugauuucuuauuugagguucaaaaugaccugcuugaaacuuugauacauauuggaauaca

SEQ ID NO: 631284 - RNA, 64 nt, hsa
uuuuauauacuuucaauuagcuguacuaauuggggcuugaaaguauauaaaaucuuccuguccu

SEQ ID NO: 631285 - RNA, 64 nt, hsa
aucgugaaagguacauuuaaaauauguuaaauuggcuugaaauuuucagagaauuuugucuucc

SEQ ID NO: 631286 - RNA, 64 nt, hsa
ugugauacauuuaagccacuggaaaaaccccugugcuugaaaauauuuccucuauaucaugccu

SEQ ID NO: 631287 - RNA, 64 nt, hsa
cuuccuauuuuuuuuuccaguaguauuguuaccugcuugaaaacacugcuguguuaagcuguuc

SEQ ID NO: 631288 - RNA, 64 nt, hsa
aaaaaaaauacugauguuccuagugaaagaggcagcuugaaacugagaugugaacacaucagcu

SEQ ID NO: 631289 - RNA, 64 nt, hsa
ucacauuuguagaaauguaaugcgguucugaguggcuugaaauguacagaauguuuugaaagug

SEQ ID NO: 631290 - RNA, 64 nt, hsa
guuguuauaaaacauucaaauucugauauacauugcuugaaaaugagugaguaccucagagaaa

SEQ ID NO: 631291 - RNA, 64 nt, hsa
ggcacuccucaauugggaguguugugacugaaaugcuugaaaccaaagcuucagauaaacuugc

SEQ ID NO: 631292 - RNA, 64 nt, hsa
ccgaaaagaaugaaaacagagaaaaaauguaugugcuugaaaguaaaauacuuacaauaguagc

SEQ ID NO: 631293 - RNA, 64 nt, hsa
auugaguaucauguaauaauuauaauauaauuuagcuugaaagaugcucuacauuaugaccaau

SEQ ID NO: 631294 - RNA, 61 nt, hsa; identical to SEQ ID NO: 630987

SEQ ID NO: 631295 - RNA, 64 nt, hsa
agcaaagcuaauuugccuuugccugggguguucagcuugaaagaauaaagcucauuugguuuag

SEQ ID NO: 631296 - RNA, 64 nt, hsa
aaaacucucuguuguuuguaauauucucuuaaaagcuugaaaauaaaacuucuuucccuaccau

SEQ ID NO: 631297 - RNA, 64 nt, hsa
gccaccgugggacaucaaguggaagaacuuguuugcuugaaaguaucucagacccaaggcaccu

SEQ ID NO: 631298 - RNA, 64 nt, hsa
auuuaagaaccagaggcagaaguucuggcuuccugcuugaaacccaauucuuauaugaaauuuu

SEQ ID NO: 631299 - RNA, 64 nt, hsa
uguuuggggcuugauagagugugaaagguguguugcuugaaagguguggccuuagacacuagga

SEQ ID NO: 631300 - RNA, 64 nt, hsa
aauagaugugugggugaagccauagaacauauuugcuugaaauucuugagcagggaucuuauaa

SEQ ID NO: 631301 - RNA, 64 nt, hsa
ucaguuaaacacugcugcaauauuucaguguugugcuugaaaauauguacaguuuuuuuccaau

SEQ ID NO: 631302 - RNA, 64 nt, hsa
auaagaggcugauaauuccagugguccauggaaugcuugaaaaaugugcaaaacagcguuuaag

SEQ ID NO: 631303 - RNA, 64 nt, hsa
uugcauauucuuauguaugugaaaguuacaaauugcuugaaagaaaauaugcaucuaauaaaaa

SEQ ID NO: 631304 - RNA, 64 nt, hsa
aaugggaccgcaagugguaggcagugucccuucugcuugaaaccuauugaaaccaauuuaaaac

SEQ ID NO: 631305 - RNA, 64 nt, hsa
ggaauuuugugagacaguugucaaauuguugcuagcuugaaaucugcggcaauuggaguauuua

SEQ ID NO: 631306 - RNA, 64 nt, hsa
cggcagcacauauacuaaaaauuaauaagacccagcuugaaaauugagccugauaacaagauua

SEQ ID NO: 631307 - RNA, 64 nt, hsa
uuugugaaugaauaaauuacuaauccuccuugucgcuugaaaccuucccacacucccugcucca

SEQ ID NO: 631308 - RNA, 64 nt, hsa
cauuucugcucaaccacacauucucuaagaaacagcuugaaagcucugucugggucauucauuu

SEQ ID NO: 631309 - RNA, 64 nt, hsa
ccaagaacacuuuaaggaaacauuuuacaaguaugcuugaaagaaugucacuaacugguccaga

SEQ ID NO: 631310 - RNA, 64 nt, hsa
auuuagguauaauaucaucuugucuuugacuagagcuugaaaccuuguuaucugauuguguacc

SEQ ID NO: 631311 - RNA, 64 nt, hsa
aaccuuacaaggcucuaaaaugagaugugauauggcuugaaaugggaggagacacuuucugaca

SEQ ID NO: 631312 - RNA, 64 nt, hsa; identical to SEQ ID NO: 190821

SEQ ID NO: 631313 - RNA, 64 nt, hsa; identical to SEQ ID NO: 190822

SEQ ID NO: 631314 - RNA, 64 nt, hsa
aagugaacuugguuugaucuuacucaacuagaaagcuugaaaacaucccuggggauucugaagg

SEQ ID NO: 631315 - RNA, 64 nt, hsa
augcuagcucaauuaguuuugaauuauauguauagcuugaaaaguuuuuuuuuaaugacugugc

SEQ ID NO: 631316 - RNA, 64 nt, hsa
auaacgcacgguacuguucuugaaauaccuaauggcuugaaauucuagucuguuugugaaagau

SEQ ID NO: 631317 - RNA, 64 nt, hsa
acuuacuguggcuuuaaacauauucagaacagaugcuugaaauaugcacuuagcacuuugguuc

SEQ ID NO: 631318 - RNA, 64 nt, hsa
acaaacauucuguugaagggaaaucuagucaguugcuugaaagagcacagcccaaauaaaacaa

SEQ ID NO: 631319 - RNA, 64 nt, hsa
aacacaauaaccaaaagcuuuuauuuauaaaaaggcuugaaaaauauagacaaucuuuaaugua

SEQ ID NO: 631320 - RNA, 64 nt, hsa
aauguauguccucucuguaauuguuuuaaugugugcuugaaauauccagaaaaccuauggaguu

SEQ ID NO: 631321 - RNA, 64 nt, hsa
guguuguucugagcagggggacaggauugaugaggcuugaaagagcccacugagccacucucug

SEQ ID NO: 631322 - RNA, 64 nt, hsa
ugaggugcaaaacauagauauagaacugaacagggcuugaaacaauauuaggauuacuacccag

SEQ ID NO: 631323 - RNA, 64 nt, hsa
cucacucaaacauagcugacuuccuauugguacagcuugaaaagcacuuuuuacuacauacaca

SEQ ID NO: 631324 - RNA, 64 nt, hsa
uauggugcucuugucuucuuuguuugugacccaugcuugaaaacuugaaggaaguuagauauga

SEQ ID NO: 631325 - RNA, 63 nt, hsa; identical to SEQ ID NO: 631018

SEQ ID NO: 631326 - RNA, 64 nt, hsa
acuucaaggaagacucuacaagcuuuuguucacagcuugaaauagaugccucacaauucagaca

SEQ ID NO: 631327 - RNA, 64 nt, hsa
ugcugccauuugcuauaaaguugaacuuuguauggcuugaaaaagaaaugacaauauggaacau

SEQ ID NO: 631328 - RNA, 64 nt, hsa
uaacugucccauuguaaagguguaaguuauauaggcuugaaaaaaauuggcggguaaaaaucac

SEQ ID NO: 631329 - RNA, 64 nt, hsa
auuuguuuuuucuugcuuuucauuugauuacccugcuugaaauacaguuaguugauaacauaaa

SEQ ID NO: 631330 - RNA, 64 nt, hsa
auaagggacuuuuauuuguaaaguaauggaucuggcuugaaaaauacgguagagauacuuagcu

SEQ ID NO: 631331 - RNA, 64 nt, hsa
aaauauauaauuuucuauacauauauauccucuagcuugaaacuuuugcucaaguuuauuuaug

SEQ ID NO: 631332 - RNA, 64 nt, hsa
auuguauuauaaugaugauucugucaaaugaaaggcuugaaauaccuagaugaaguuuagauuu

SEQ ID NO: 631333 - RNA, 64 nt, hsa
ccauaucucaccucuaggauaugauggaagaagugcuugaaagagaauuuuagcagaugguacu

SEQ ID NO: 631334 - RNA, 64 nt, hsa
ucccagcuacucgggaggcugagacagaagaacugcuugaaaccaggaggcagagguugcagug

SEQ ID NO: 631335 - RNA, 64 nt, hsa
aaaaaaaaaaaagaaaguaauuuuaaacucacuggcuugaaaugugugcuuucuguacaaugaa

SEQ ID NO: 631336 - RNA, 64 nt, hsa
uuuuuuuauuucaauauauacaguuugaugaugugcuugaaauuggugcaaauauauacacacc

SEQ ID NO: 631337 - RNA, 64 nt, hsa
cuucagaauaagcuuccccaccccaguuuuuguugcuugaaaauauuguugucccggauuuuug

SEQ ID NO: 631338 - RNA, 64 nt, hsa
ggagacgcagguugcaguggacauugggauuguugcuugaaaaauuaaaauuugaauauuuucu

SEQ ID NO: 631339 - RNA, 64 nt, hsa
uuuugaagucuucccuugacccuaguaaaauauagcuugaaacuuguaaacaacuguguuugcc

SEQ ID NO: 631340 - RNA, 64 nt, hsa
aaaaugcuuguccccuauaugaauauucuguuacgcuugaaaaauauuuucuccagcguugguu

SEQ ID NO: 631341 - RNA, 64 nt, hsa
gaggaauaaagccaaggggagugagaugaggugggcuugaaaguaccuuguccgcucagaagga

SEQ ID NO: 631342 - RNA, 64 nt, hsa
cccaggguauccaccugcaccccacucccaaguagcuugaaaaagggaggacagucuuucccca

SEQ ID NO: 631343 - RNA, 64 nt, hsa
gaauuaaauauuauguccuaccaacuuauuagcugcuugaaaaauauaauacacauaaauaaaa

SEQ ID NO: 631344 - RNA, 64 nt, hsa
gacuguauguuuuaauugcauuuaaaaauauauagcuugaaagcaguuaaacugauuaguauuc

SEQ ID NO: 631345 - RNA, 64 nt, hsa
uugguguguauuggccaaguuuugcuuguugugugcuugaaagaaaauaucucugaccaacuuc

SEQ ID NO: 631346 - RNA, 64 nt, hsa
auuuuggucccugcuccuugcccauaguaaaacagcuugaaauaucccaugcaagagaguaguu

SEQ ID NO: 631347 - RNA, 64 nt, hsa
ugagacacagaggugccagugauggacuggaucagcuugaaagaagcacaaagacuccgugauc

SEQ ID NO: 631348 - RNA, 64 nt, hsa
gcugggauugcaaacacuuuuuaaaaaauuguuugcuugaaaauacuacugaauauaaauaaga

SEQ ID NO: 631349 - RNA, 64 nt, hsa
guguugcccaccuguucacaaaaaguaccuuuaugcuugaaaacauuagguucuuugguuacug

SEQ ID NO: 631350 - RNA, 64 nt, hsa
ggugaauuuuuuuuaaguggcacggucuuuuucugcuugaaaucugaucacaccccccagccau

SEQ ID NO: 631351 - RNA, 64 nt, hsa
gcaaggggcaaguuucacccaaaugccugagacugcuugaaagauauauuuuaaguggugcacu

SEQ ID NO: 631352 - RNA, 64 nt, hsa
uauucaacugcaaaaucucaaucuugaaaaucaagcuugaaauuucauagguagaaauauuagc

SEQ ID NO: 631353 - RNA, 56 nt, hsa; identical to SEQ ID NO: 631046

SEQ ID NO: 631354 - RNA, 64 nt, hsa
aagaaucuugcaagacaguuauuaaacauucauagcuugaaauugcccauggugggagaguuua

SEQ ID NO: 631355 - RNA, 64 nt, hsa
gcagacaaagucaagcagcuuuaaguacaaggcagcuugaaaccucucugaugaaagugaaaaa

SEQ ID NO: 631356 - RNA, 64 nt, hsa
acaugaugagauaucaagguaauuaaaauagcaugcuugaaaaaaaaauacguaaucuguuuca

SEQ ID NO: 631357 - RNA, 64 nt, hsa
uggagaaaugaagcaaaggugaaugacagccuaggcuugaaauuauaaagcucucucagguuga

SEQ ID NO: 631358 - RNA, 64 nt, hsa
cuucuuauaagccagcucugacuggauuuugaacgcuugaaaucaggcucuccacaccauugac

SEQ ID NO: 631359 - RNA, 64 nt, hsa
gggaggggugccguuuuuauuuuccugaacauuugcuugaaauauuuuguuagggccucaaaga

SEQ ID NO: 631360 - RNA, 64 nt, hsa
gagguaugauuccuaagcccuaaggagcuccucagcuugaaauggggcugcaucccuauaaacc

SEQ ID NO: 631361 - RNA, 64 nt, hsa
caaccaaacgccuauuuuuuaaugcuuaguuuuggcuugaaauucuucuucaccuggaguuuuc

SEQ ID NO: 631362 - RNA, 64 nt, hsa
uauuuuuacacagguuuucuugucuugacaagaugcuugaaaaaccaagaggauaugaaaaucu

SEQ ID NO: 631363 - RNA, 64 nt, hsa
uugugauguuucaaugugagacacaaaaacaauggcuugaaacuuguguaucauaugugauuuu

SEQ ID NO: 631364 - RNA, 64 nt, hsa
ugaagguggggacagugaccgcggaccccucugugcuugaaagauuuccuccacggccuuugcc

SEQ ID NO: 631365 - RNA, 64 nt, hsa
cuauuagucagaaagaaggagagaaugagugagugcuugaaaugugucauacuguuuuaggauc

SEQ ID NO: 631366 - RNA, 64 nt, hsa
uagcugucuccucaucucauccuagucuagguuugcuugaaauugggugugagagcuagaauga

SEQ ID NO: 631367 - RNA, 64 nt, hsa
ccaaacuucauauaugucuaucagguaauaauaggcuugaaaauugauauccuguggugcuaaa

SEQ ID NO: 631368 - RNA, 64 nt, hsa
ucuuccaaaggcauaagacccuaagccuccuuuugcuugaaaccaaagauauauacacaggauc

SEQ ID NO: 631369 - RNA, 64 nt, hsa
uacauugauuauagaaccacuauuacgugaaaaggcuugaaacaaccaacauauacaaauaaaa

SEQ ID NO: 631370 - RNA, 64 nt, hsa
gcuuugcacaguguauuaacauugggagggucuggcuugaaaauuuggccacccucagccucug

SEQ ID NO: 631371 - RNA, 64 nt, hsa
guuagacuuuuuaaacucaaggaugagcauaagugcuugaaauaaaaugcuaauacuuaagugu

SEQ ID NO: 631372 - RNA, 64 nt, hsa
gcacaguugauuuucgguguguuccuguauaacggcuugaaaggaaaggagaagaugcuguguc

SEQ ID NO: 631373 - RNA, 64 nt, hsa
auugugcaugcuaguguuguauuucuauacaguagcuugaaauugauuaacuuauacuguaggu

SEQ ID NO: 631374 - RNA, 64 nt, hsa
cgaggugaguucacauaacaggaauucuggaacugcuugaaaacuaggacgauugggcaauauc

SEQ ID NO: 631375 - RNA, 64 nt, hsa
acuauuaguacuucccuuugucugugccauaagugcuugaaaacguuaagguuuucuguuuugu

SEQ ID NO: 631376 - RNA, 64 nt, hsa
uucucuagcuguucuacaaaacuggagcaugcuggcuugaaaaacccuugcccaguuuugaucc

SEQ ID NO: 631377 - RNA, 64 nt, hsa
aauuccagccaaggcaaauucaguuggaucuagggcuugaaaacugcccaagauuaaagagcua

SEQ ID NO: 631378 - RNA, 64 nt, hsa
uuuuuuauuugcugucuuugguaauuaucucucugcuugaaauuaaaugcacuauaaguuaaua

SEQ ID NO: 631379 - RNA, 64 nt, hsa
uauugcaauuguggucaaauaaggaacguuuccugcuugaaauuauauugauuuaaaugaugug

SEQ ID NO: 631380 - RNA, 64 nt, hsa
ccgcacagcagcgaugcagaaggcaagaacggcagcuugaaaaauuaaaggagguuguucacuu

SEQ ID NO: 631381 - RNA, 64 nt, hsa
cgcugcucuuaugccauuuguuuauuuuuauauagcuugaaacauagagggagagagggagaga

SEQ ID NO: 631382 - RNA, 51 nt, hsa; identical to SEQ ID NO: 631075

SEQ ID NO: 631383 - RNA, 64 nt, hsa
auuccaaagcaagggcaagguaggaacaagaugagcuugaaauaucuuguuaugccagaaagua

SEQ ID NO: 631384 - RNA, 64 nt, hsa
uguaaaguuguuucaguuaaacugggcugagagagcuugaaaguccuuuucauaaaagauaacu

SEQ ID NO: 631385 - RNA, 64 nt, hsa
cuuaacuuaaaggcauugguuauaaauucaaagagcuugaaaagauugaagagggccaaacacu

SEQ ID NO: 631386 - RNA, 64 nt, hsa
gcuuauuagaaagccaaaguagaguucuguuuaagcuugaaagagguaugaaguaaucuguagu

SEQ ID NO: 631387 - RNA, 64 nt, hsa
ucugaaauuuaaacuugauauuuuucgcccucuugcuugaaaacuucacuugcuuccccauuuc

SEQ ID NO: 631388 - RNA, 64 nt, hsa
gggcuugauuuaacauuguuuuuguguuauuuuugcuugaaacaacgcacacauuuucaacaac

SEQ ID NO: 631389 - RNA, 64 nt, hsa
aguuuaagagcagaacagaucuuuuacuuuggccgcuugaaaagcuaguguaccuccucucagu

SEQ ID NO: 631390 - RNA, 64 nt, hsa; identical to SEQ ID NO: 190823

SEQ ID NO: 631391 - RNA, 64 nt, hsa; identical to SEQ ID NO: 190824

SEQ ID NO: 631392 - RNA, 64 nt, hsa
ggacaggugggugaggaucugagaaaugcuaaaggcuugaaagcaucugaagacaucuaacuua

SEQ ID NO: 631393 - RNA, 64 nt, hsa
gagaaauacaagguugcuugucugaccccaaucugcuugaaaccugacucugcuucucucauuu

SEQ ID NO: 631394 - RNA, 64 nt, hsa
aggggcugacagcaggcuuacugccaucaacauugcuugaaaugccucuauguucugaauaaag

SEQ ID NO: 631395 - RNA, 64 nt, hsa
uuaaaauauggaaauuuuaaaauuaugaccaagggcuugaaacauauuggauuacaugcucaca

SEQ ID NO: 631396 - RNA, 64 nt, hsa
uaaacaaugaauucuucaacagggaaaacagcuagcuugaaaacuugcugaaaaacacaacuug

SEQ ID NO: 631397 - RNA, 64 nt, hsa
gccacccucagcucuuuccucugguguggcuucagcuugaaagcaaccuggagucgggggcaca

SEQ ID NO: 631398 - RNA, 64 nt, hsa
cauugaaagggaguauuacaaaaacauggccuuugcuugaaagaaaauaccaaggaacaggaaa

SEQ ID NO: 631399 - RNA, 57 nt, hsa; identical to SEQ ID NO: 631092

SEQ ID NO: 631400 - RNA, 64 nt, hsa
ggguuuggggaaggacaguguggugugacuauuggcuugaaacguuauggauaugguuggaguc

SEQ ID NO: 631401 - RNA, 64 nt, hsa
ccauauaaauguggaggcuaucaacaaagaaugggcuugaaacauuauaaaaauugacaaugau

SEQ ID NO: 631402 - RNA, 64 nt, hsa
ucccagcuccucaggaggcugaggcaggagaauugcuugaaaccaggaggcggagguugcagug

SEQ ID NO: 631403 - RNA, 64 nt, hsa
ugaacuguuggacuggguagaaaucuuucaagaagcuugaaaauaaggccauaaaggaggggcu

SEQ ID NO: 631404 - RNA, 64 nt, hsa
gggacccucauuucuucugacagauuucagucuggcuugaaauuuggggauguuaaugaggguc

SEQ ID NO: 631405 - RNA, 64 nt, hsa
uuacaugguuacauguucuacaucaugcauaguagcuugaaaucuagucuggagaaaacuggau

SEQ ID NO: 631406 - RNA, 64 nt, hsa
uacaguguucuggaaaagaugccauucuuuuuaagcuugaaacugcagaagaaauucacaggaa

SEQ ID NO: 631407 - RNA, 64 nt, hsa
aaguggcccaucauucauacccacuguucugaaggcuugaaaacaaaacauauccacaacauug

SEQ ID NO: 631408 - RNA, 64 nt, hsa
ugucuuuuuacugcaacccacaggcccacaguaugcuugaaaagauaaauuauaucaauuuccu

SEQ ID NO: 631409 - RNA, 64 nt, hsa
ugcucgggagagcugaggguuuuauuguuugcuugcuugaaaccuaaucuauagacggccccac

SEQ ID NO: 631410 - RNA, 64 nt, hsa
cccacugagcuggaggaauaucuacagcagugaugcuugaaauuuuuguaugaauuauuuuguc

SEQ ID NO: 631411 - RNA, 64 nt, hsa
acuuucuaucuucauaaccauuuaaagcgauuuagcuugaaauuaaauuuuaucaggcuaccaa

SEQ ID NO: 631412 - RNA, 64 nt, hsa
uccccucccuguccgccucuccuuacuuucucuugcuugaaacugcuuuuccuuuucuacucuu

SEQ ID NO: 631413 - RNA, 64 nt, hsa
aggcgugaguuuuaggugaauuuaugugguuccugcuugaaaaccuuccccucuccagguucgg

SEQ ID NO: 631414 - RNA, 64 nt, hsa
cauaaaauaaucauuuuugaaccuguguaauaaagcuugaaagcagggaaaagaauuuccuuuu

SEQ ID NO: 631415 - RNA, 64 nt, hsa; identical to SEQ ID NO: 190825

SEQ ID NO: 631416 - RNA, 64 nt, hsa; identical to SEQ ID NO: 190826

SEQ ID NO: 631417 - RNA, 64 nt, hsa
caauaccuuaauggugguagagccuuuaccuguagcuugaaaggggaaagauuggagguaagag

SEQ ID NO: 631418 - RNA, 64 nt, hsa
gguaggaauccaggaugcuuaguuucuagacccugcuugaaaguucuagagccuuugaaaggga

SEQ ID NO: 631419 - RNA, 64 nt, hsa
ucguaaagccauauguucuguucaagucuuguuugcuugaaaugauuauuccuacaagugaaac

SEQ ID NO: 631420 - RNA, 64 nt, hsa
cugaagacaacaccugcuucaggggaacacaggcgcuugaaaaagaaaagagagaacagcccau

SEQ ID NO: 631421 - RNA, 64 nt, hsa
uucaaaauaugagacuaugcuauaggcagugcuugcuugaaaagucucauuuuuaaaucucccu

SEQ ID NO: 631422 - RNA, 64 nt, hsa
ccuuauaucuaauauauaucugggagaaaaggcugcuugaaaauaucuuuugauucagugauuu

SEQ ID NO: 631423 - RNA, 64 nt, hsa
guuuuuuaagggagggaauuuauuauuuaccguugcuugaaauuacuguguaaauauaugucug

SEQ ID NO: 631424 - RNA, 58 nt, hsa; identical to SEQ ID NO: 631117

SEQ ID NO: 631425 - RNA, 64 nt, hsa
cuuuggguguggugacccagaugcacagagcucugcuugaaacagguacacgggccagggaaau

SEQ ID NO: 631426 - RNA, 64 nt, hsa
uggucaccucaaauuuaagucgggaaauucugcugcuugaaacuucagcccugaaccuuugucc

SEQ ID NO: 631427 - RNA, 64 nt, hsa
accugucucaggacacacuugccaucuagggcuagcuugaaagagccugaggacugccuuuaac

SEQ ID NO: 631428 - RNA, 64 nt, hsa
uguugauuaaaccugucacuuuacacaugaaaaagcuugaaacuuagagaaagauaaaauguaa

SEQ ID NO: 631429 - RNA, 64 nt, hsa
gcugugaagaguggacagucuuggagaacacagugcuugaaauggacaagcuggaccuauuccu

SEQ ID NO: 631430 - RNA, 64 nt, hsa
guauugccacccaugacauuuaacauguugugaugcuugaaaacacaggaguagagaaaaucga

SEQ ID NO: 631431 - RNA, 64 nt, hsa
caugaagcacuguuuuuaaacccaaguaaagacugcuugaaaccuguugauggaaaugacuuau

SEQ ID NO: 631432 - RNA, 64 nt, hsa
uuauucaacagccauuuagagugccaucaagauggcuugaaauggaauuuugugauuuguaguc

SEQ ID NO: 631433 - RNA, 64 nt, hsa
aaaauagaauauauauauauugcuuaucugaaaugcuugaaaccagaauuguuuugcauuuuuu

SEQ ID NO: 631434 - RNA, 64 nt, hsa
uaugaagauugaaugugauguauucacguaacaugcuugaaacugccuggcauauacuaaacgc

SEQ ID NO: 631435 - RNA, 64 nt, hsa
aaaaaaaaugcacauagcuaucaagugugcuuuagcuugaaaaggugaccuugcaacuucaugu

SEQ ID NO: 631436 - RNA, 64 nt, hsa
ccccuuuuuauuuuaaaauuugacuccucuucaagcuugaaaacccucugaacucagucuucuu

SEQ ID NO: 631437 - RNA, 64 nt, hsa
cuuaaugcagcccugcugguccccauuaacaauugcuugaaauucacauggauguaaaauuaua

SEQ ID NO: 631438 - RNA, 64 nt, hsa
cuguuuagacauuuuuugucccagaaauacagaagcuugaaaugcuaugaaggcagagcuucua

SEQ ID NO: 631439 - RNA, 64 nt, hsa
uucauacgcuguacuugcuaaaaaucaacugugcgcuugaaagaccucuucauaguugaguaau

SEQ ID NO: 631440 - RNA, 64 nt, hsa
uuuaaugcaggacaucaacuacauaaugaaagaugcuugaaaugcuuuuguuauuucaggcaaa

SEQ ID NO: 631441 - RNA, 64 nt, hsa
auuacaaacaagagaaaugagaacuuacaggauugcuugaaauuauuguggguauuaucuguuu

SEQ ID NO: 631442 - RNA, 64 nt, hsa
cacucaaggucgcuggaugcugaucuaaucaguagcuugaaaccacaauuuuaaaaaugugacu

SEQ ID NO: 631443 - RNA, 64 nt, hsa
agcugguucccguuuuccagagggggagcccagagcuugaaaggccgcgguuggcacuucgaga

SEQ ID NO: 631444 - RNA, 64 nt, hsa
uauggguagaauuguagucaggaaaacagaaagggcuugaaauuuaauaagugcugcuggaagg

SEQ ID NO: 631445 - RNA, 64 nt, hsa
ccacgagugucuccccagugcagacucaaguuaugcuugaaaugaaaaagucuaucugguagug

SEQ ID NO: 631446 - RNA, 64 nt, hsa
uaugaaauggucauuuuucugaagagaauauuuugcuugaaaugcaaaggacugaaagagauuu

SEQ ID NO: 631447 - RNA, 64 nt, hsa
ggacguccuuccauaucccugcccagccuguggugcuugaaacguuugccccaugggaaacgua

SEQ ID NO: 631448 - RNA, 64 nt, hsa
cuuuauacuuggguuauauauuagacuuuuauaggcuugaaaucauccaucacauaagaaaaua

SEQ ID NO: 631449 - RNA, 64 nt, hsa
gucauuucauuaguauuccucauucugcauccuggcuugaaaaacagcucuguugaaucacagu

SEQ ID NO: 631450 - RNA, 64 nt, hsa
aauucuacuuaagcuauaagucucugucauuuuugcuugaaaauuagcaugccucugucuuaaa

SEQ ID NO: 631451 - RNA, 64 nt, hsa
uuucuuuuuuaaagccauucuguucuuuggaugugcuugaaagggugugugauuacaccauugu

SEQ ID NO: 631452 - RNA, 64 nt, hsa
aguugcacuuugcugugcugaucccacaggaaaggcuugaaacacgagaagcagcaaagacaga

SEQ ID NO: 631453 - RNA, 64 nt, hsa
uuuuccccccaaguagaacuaaugcuagcuuccagcuugaaaguaaaacuccaguguggaguga

SEQ ID NO: 631454 - RNA, 64 nt, hsa
cucaggguggccaguauuuugacuuauuuauccugcuugaaagcuacuugagauguguacugcu

SEQ ID NO: 631455 - RNA, 64 nt, hsa
gggagcaaaacacugauuugauacuagucaguuugcuugaaacuaguucaccuaaagcuagauc

SEQ ID NO: 631456 - RNA, 64 nt, hsa
uacuuucauguuuuaaaaaucccuuuaauuucuugcuugaaaaucccaugaacauuaaagagcc

SEQ ID NO: 631457 - RNA, 64 nt, hsa
aaagcuguuuguuauaugcugcuuaauaaaguaagcuugaaauuuaucauuuuaucaugaaaac

SEQ ID NO: 631458 - RNA, 64 nt, hsa
gauuuagaugguccaagauaaucucauucaggaggcuugaaacauuaaugguuuagucuuguga

SEQ ID NO: 631459 - RNA, 64 nt, hsa
cauguggcagaauuucccucuuacauaaaccaaugcuugaaaaugcugcaaaugacccucuaau

SEQ ID NO: 631460 - RNA, 64 nt, hsa
uaaggacaagucaauuugucaguagcuucuucuggcuugaaacccccucccuggauuuuauagc

SEQ ID NO: 631461 - RNA, 64 nt, hsa
gucccaucuccaaggugcgucauaugcaggaauggcuugaaacaagaggaaguccuaaaucaca

SEQ ID NO: 631462 - RNA, 64 nt, hsa
uuuuccccuguuuggugcuauguuuauguauuaugcuugaaauuuuaauuuuuuuuuuuuugca

SEQ ID NO: 631463 - RNA, 64 nt, hsa
agguccagcaaaagucaguagggacauugcagaagcuugaaaggccaauaccagaacacaggcu

SEQ ID NO: 631464 - RNA, 64 nt, hsa
aaucccagcuauucuggaggcugaggcaggaaucgcuugaaauuggaaagcagagguugcagug

SEQ ID NO: 631465 - RNA, 64 nt, hsa; identical to SEQ ID NO: 190827

SEQ ID NO: 631466 - RNA, 64 nt, hsa; identical to SEQ ID NO: 190828

SEQ ID NO: 631467 - RNA, 64 nt, hsa
agaauugcccuauaaacauagcaggauuuugagagcuugaaaauuuuccauuauucuggacaug

SEQ ID NO: 631468 - RNA, 64 nt, hsa
uguccccucugucaccagggaagccacaaugagagcuugaaagggugcugucaagauaaauguc

SEQ ID NO: 631469 - RNA, 64 nt, hsa
uaacagggagugguauuugaaguguccagcaguugcuugaaaugcuuugccgaaucugacucca

SEQ ID NO: 631470 - RNA, 64 nt, hsa
cuaccucuguuuuuaauuuucuuuccaaaaggcagcuugaaauguugguccuaaucuuaauuuu

SEQ ID NO: 631471 - RNA, 64 nt, hsa
gggggugacuuuaguuuuucuucagcuuaggcgugcuugaaaccuuggccagguuccaugacca

SEQ ID NO: 631472 - RNA, 64 nt, hsa
ucuaaacugcaaacauuuucacacccaccaugcugcuugaaagccacuugauccucaacauaua

SEQ ID NO: 631473 - RNA, 64 nt, hsa
aaccagugacuucagagccuauggucucaacugugcuugaaaaacacugucucugaaaacaacu

SEQ ID NO: 631474 - RNA, 64 nt, hsa
auuaagccagacugaccacuugcuuggagugugugcuugaaaaaaccagagcaauacuguuggg

SEQ ID NO: 631475 - RNA, 64 nt, hsa
ggucccaggacaggaaugcgguucaaacccaguggcuugaaacuuccugagaaacuguagcaua

SEQ ID NO: 631476 - RNA, 64 nt, hsa
ugcaacacuccugccaaguggucuucuacccauugcuugaaaaucucucuugacagggagcuca

SEQ ID NO: 631477 - RNA, 64 nt, hsa
gcuguucacuugauuaguugaaacacaaauucuggcuugaaaaaauaggggagauuaaauauua

SEQ ID NO: 631478 - RNA, 64 nt, hsa
aacaucuauccccuccucccccauacacaccuaggcuugaaaugcccuacaggcccagaacuuu

SEQ ID NO: 631479 - RNA, 64 nt, hsa
ugaauguuugggaaugagaggaugagugagugaggcuugaaaacacaccacauugaaaauccug

SEQ ID NO: 631480 - RNA, 64 nt, hsa
aaauugcgccgcuccuggagaccugauaacuuaggcuugaaauaauugacuugucuaaaaggac

SEQ ID NO: 631481 - RNA, 64 nt, hsa
ggaagcauuuuuaacuggguagaaucugacuguggcuugaaauaaaaagcucucagaaaacuca

SEQ ID NO: 631482 - RNA, 64 nt, hsa
acccacccccuuuaggaaccaggcugguguucuugcuugaaagcguugugcccucugagugucu

SEQ ID NO: 631483 - RNA, 64 nt, hsa
ggggaaggauagggugauguuccgaaggugaggagcuugaaacccguggcgcuuucugcaguuu

SEQ ID NO: 631484 - RNA, 64 nt, hsa
guguuaauucuaaauccuugauccucugcaaugugcuugaaaacacaaaccuuuuggguuaaaa

SEQ ID NO: 631485 - RNA, 64 nt, hsa
agucagauuagggucucugccauucagaguugaugcuugaaaacuuuaguuuuccuuauuaaug

SEQ ID NO: 631486 - RNA, 64 nt, hsa
agagcucuguuacagcccacuguguccuuuagaagcuugaaaggaacccaacucuuugcugcac

SEQ ID NO: 631487 - RNA, 64 nt, hsa
agcuuuaccuggucaccaugugaugugaucagaugcuugaaauuuaacacuuuucacuugguuc

SEQ ID NO: 631488 - RNA, 64 nt, hsa
caauuagagaaacagaaguccaaggcuggcgacagcuugaaaagucugacagcuuuucuacuuu

SEQ ID NO: 631489 - RNA, 64 nt, hsa
cucgcuuaagaucacaggcuuagugugaggacgagcuugaaaucccagucuccuggcccccagg

SEQ ID NO: 631490 - RNA, 64 nt, hsa
aguacauggguacaauccgagggugugaauuucagcuugaaauuccauugcuguuccuuguuuu

SEQ ID NO: 631491 - RNA, 64 nt, hsa
cguucaucucugaaacccagcauccuuuucagcugcuugaaaacauuguauuuuuuuuuuuuaa

SEQ ID NO: 631492 - RNA, 64 nt, hsa
cugacaaggaaggaguugagcccuggguaggcuugcuugaaaagugaguccuuccagaauauuc

SEQ ID NO: 631493 - RNA, 64 nt, hsa
aaggaaagggucuuagucacugccucccgaaguugcuugaaagcacucggagaauugugcaggu

SEQ ID NO: 631494 - RNA, 64 nt, hsa
gcugcccagugucagaacaguuauacaaacgagggcuugaaaacauuuugugaaaacuugcuua

SEQ ID NO: 631495 - RNA, 64 nt, hsa
aagucaacauuagaacugaaaauggaaauaaacugcuugaaaagacgauggugccucuggguca

SEQ ID NO: 631496 - RNA, 64 nt, hsa
cugcacaguccauucuguuuuuauuacuaucuaggcuugaaauauauaguuugaaauuaugaca

SEQ ID NO: 631497 - RNA, 64 nt, hsa
ccuaaauguccaaaaagaacaugagauuuauggugcuugaaauguugcuaaacguaaauuugua

SEQ ID NO: 631498 - RNA, 64 nt, hsa
aagacugugacaaaguugucagucacaaaucacagcuugaaagacaggagaauucauacuggag

SEQ ID NO: 631499 - RNA, 64 nt, hsa
ccugggaagccugggaguguuugucccaucgguagcuugaaauaaacgcuccccucagacaccc

SEQ ID NO: 631500 - RNA, 64 nt, hsa
uggaagccuugccuucccgcuucuacaugcuugagcuugaaaagcagucaccuccucggggacc

SEQ ID NO: 631501 - RNA, 64 nt, hsa
acuguuucaaugaccuuuauuuuaaaaacacauagcuugaaaauuuauuuuuauacugauauua

SEQ ID NO: 631502 - RNA, 64 nt, hsa
cuagcugaacaaaaaugugcaguuaauacuuggcgcuugaaaaugcaguagugaauguggaacc

SEQ ID NO: 631503 - RNA, 64 nt, hsa
guaaggucuucuuguguccugaugaaaaauaugugcuugaaaugagaaacuuugaucucugcuu

SEQ ID NO: 631504 - RNA, 64 nt, hsa
auuucuaauagccuuggguuuauuugcaaaggaagcuugaaaaauaugagaaaaguugcuugaa

SEQ ID NO: 631505 - RNA, 64 nt, hsa
cuuagccucccugaaaauguuuuucugccagggagcuugaaaguuuucagaaccucuuccccag

SEQ ID NO: 631506 - RNA, 64 nt, hsa
agaaaaugucguuguuguuguuuuucuggaaacugcuugaaaucuugcuguacuauagagcuca

SEQ ID NO: 631507 - RNA, 64 nt, hsa
gaaaguaaagaaggaauaaucuacccugacuaaagcuugaaaugcuacauuuccaaggugaaga

SEQ ID NO: 631508 - RNA, 64 nt, hsa
ucgguaucuuuuaauauaagaacacugaauuuuggcuugaaauauugugacuaaauugcacaau

SEQ ID NO: 631509 - RNA, 64 nt, hsa
auaaggaauggcaucagaacaauagcuuggaauggcuugaaaucacaaaggaucugcaagauga

SEQ ID NO: 631510 - RNA, 64 nt, hsa
ugaaaacugcagcauaucagacagcaauuuaacagcuugaaacaucuacagauaguuccuacua

SEQ ID NO: 631511 - RNA, 64 nt, hsa
ucuuagcuacucaggaggcugaggcaggagaaucgcuugaaaacaggagguggagguugcagug

SEQ ID NO: 631512 - RNA, 64 nt, hsa
ucuaggaaucauauguuguccaucccccccucaggcuugaaaguccucaaagagacccacuauc

SEQ ID NO: 631513 - RNA, 64 nt, hsa
aauaucuuaagagaugaauaccuuaucagcuguugcuugaaaccuguuaaaaauguucauaaca

SEQ ID NO: 631514 - RNA, 64 nt, hsa
uuaaacaagaauaauaaagguuggagauuguuacgcuugaaauuaaguuggaggcaaauugaua

SEQ ID NO: 631515 - RNA, 64 nt, hsa
agucaccugaacaaugacccaucaucucuugcuugcuugaaaucuugcugaaauguucucauuu

SEQ ID NO: 631516 - RNA, 64 nt, hsa
uauuuauuguuuugguauuucauguuacuccuaagcuugaaagcucuuuuuucuauauacagaa

SEQ ID NO: 631517 - RNA, 64 nt, hsa
ggggagaagcuauagaaagaggagcccacacaaagcuugaaagccugugccagauggagccuuu

SEQ ID NO: 631518 - RNA, 64 nt, hsa
cuggcuccugccaccacaaauguuacccucauuggcuugaaaagcauccaagggugcacaggga

SEQ ID NO: 631519 - RNA, 64 nt, hsa
aacugaauugagaaauacuucuucaaguuaugaugcuugaaaguucucaauaaaguucacgguu

SEQ ID NO: 631520 - RNA, 64 nt, hsa
guaaauuuacacuauuuauaaauacauauuuauugcuugaaaauauuugugaauggaaugcugu

SEQ ID NO: 631521 - RNA, 64 nt, hsa
gcauauagcuauagauauaggcuuuuccuugaaagcuugaaaaaaauucgccaguaaaauaauc

SEQ ID NO: 631522 - RNA, 64 nt, hsa
gugaaaccaauaugguuuucuuuaugucuuggcugcuugaaaauuaaaaaaaaaaaagguuugu

SEQ ID NO: 631523 - RNA, 64 nt, hsa
ucccaaaggaucuguacuuucuuuccuuacaacagcuugaaaaucauuauuuuaaaauccuuaa

SEQ ID NO: 631524 - RNA, 64 nt, hsa
aaauuuguuauguuuaaggaaauuaagauuuuaagcuugaaauuauacaagcagaaucuaauuu

SEQ ID NO: 631525 - RNA, 64 nt, hsa; identical to SEQ ID NO: 190829

SEQ ID NO: 631526 - RNA, 64 nt, hsa; identical to SEQ ID NO: 190830

SEQ ID NO: 631527 - RNA, 64 nt, hsa
cuagaaguaaugauauacaguuuucuuccuaguggcuugaaaaucuggacuuccucaauuauua

SEQ ID NO: 631528 - RNA, 64 nt, hsa
ucaccauucuucuuuuguaauaaauuuugaaugugcuugaaagugaaaagcaaucaauuauacc

SEQ ID NO: 631529 - RNA, 64 nt, hsa
cuugguacuuggaauugauauauaccuuauuaaagcuugaaaacauuuagcauuugaauaguaa

SEQ ID NO: 631530 - RNA, 64 nt, hsa; identical to SEQ ID NO: 190831

SEQ ID NO: 631531 - RNA, 64 nt, hsa; identical to SEQ ID NO: 190832

SEQ ID NO: 631532 - RNA, 64 nt, hsa
guuccaggauuuggauuuugauuuuccaaauguagcuugaaauuucaauaaacuuugcucuguu

SEQ ID NO: 631533 - RNA, 64 nt, hsa
uuuaaaaucauguauuuaaugugucagauauugugcuugaaagauucucaucucagaauacuuu

SEQ ID NO: 631534 - RNA, 64 nt, hsa
cuaugaguuacugugggguccaagggcacucgcugcuugaaaguacuggagcacguggucaggg

SEQ ID NO: 631535 - RNA, 64 nt, hsa
acuugucgucacagcuggcaugggcuggacaguugcuugaaaugaccuaaccaaaaacauucaa

SEQ ID NO: 631536 - RNA, 64 nt, hsa
aauucacugacgaauucagagauugagggcacuugcuugaaaucaaggugcuccaacuuaguuu

SEQ ID NO: 631537 - RNA, 65 nt, hsa
ccccaaaacaucagcauuucuaaaauaguccuaaagcuugaaaguaaguugcuuccaugagcaug

SEQ ID NO: 631538 - RNA, 65 nt, hsa
uucuuucacuaccuuucuuacccuuaaugugccaagcuugaaacaggauuugauuuccugagcua

SEQ ID NO: 631539 - RNA, 65 nt, hsa
uuugccucacucucuccaguugguuuucagcuggggcuugaaaugcauuuuuagcccuuugacgu

SEQ ID NO: 631540 - RNA, 65 nt, hsa
aaauaguguauuauuaucguuggggcuggcucuaugcuugaaaaccaguuuauuuauaaccuguu

SEQ ID NO: 631541 - RNA, 65 nt, hsa
cauuuuuucauaguuucauuuguucuugcccacaagcuugaaauccagguuaagguauccagccu

SEQ ID NO: 631542 - RNA, 65 nt, hsa
cuguugcugggggccgauucugaucaagacacauggcuugaaaauggaagacacaaaacugagag

SEQ ID NO: 631543 - RNA, 65 nt, hsa
aaaauauauaaaugcuucagaugucaaauacccaugcuugaaagcucguguaauuuacuuuaaga

SEQ ID NO: 631544 - RNA, 65 nt, hsa
uugcuaaacuuuauauaaugugugguuucaauucagcuugaaaaauaaucucacuacauguagca

SEQ ID NO: 631545 - RNA, 65 nt, hsa
ccuguuccccacuccacaggagggagcugacguuggcuugaaaggaguaaagucaacaucugcug

SEQ ID NO: 631546 - RNA, 65 nt, hsa
aaguucuauagccuucucuugcaguauuuggauuugcuugaaaccgggaaaacuguucccauuag

SEQ ID NO: 631547 - RNA, 65 nt, hsa
aaguaucgguuuuauucuuugcugauguccuuucugcuugaaauaacagucaccauacagcuaaa

SEQ ID NO: 631548 - RNA, 65 nt, hsa
agauuacugucucuugaacaguugcaaucuuggcagcuugaaaauggugcuacacucuguuuugu

SEQ ID NO: 631549 - RNA, 65 nt, hsa
aaauguuuaaaucgcuaaaggaaaauacaguaagugcuugaaagaugaaggaccaaaaggccaaa

SEQ ID NO: 631550 - RNA, 65 nt, hsa
guacuggcacuggaagaguuuaguguuucuuguaugcuugaaaauaaaguauguacuguuuugaa

SEQ ID NO: 631551 - RNA, 65 nt, hsa
aagucccacuggcuggccucaggcugucuuauuccgcuugaaaauagccaaaaagucuacugugg

SEQ ID NO: 631552 - RNA, 65 nt, hsa
cacaaugaaauuauauuuucuuuguaaagaaaguggcuugaaaucuuuuuuguucaaagauuaau

SEQ ID NO: 631553 - RNA, 65 nt, hsa
uuuuccaaagaagagucgaguccucugaggucugugcuugaaagccguccgaaggcauucuuguu

SEQ ID NO: 631554 - RNA, 60 nt, hsa; identical to SEQ ID NO: 630940

SEQ ID NO: 631555 - RNA, 65 nt, hsa
ggugugccuucagggaggaagagggagguggucaagcuugaaaaacuggcuuuaggaugguucug

SEQ ID NO: 631556 - RNA, 65 nt, hsa
gcguccagcagacacugaaccagaauuggaaacgugcuugaaacaaucacacaggacacuuuucu

SEQ ID NO: 631557 - RNA, 65 nt, hsa
ccaacacugucaagguggagacuggaggugguggggcuugaaaugagcccaggaaaccagagcag

SEQ ID NO: 631558 - RNA, 65 nt, hsa
agaggcaagaugagauggcagccugcagaguaaaugcuugaaaaaagaggggugauuuucaaugg

SEQ ID NO: 631559 - RNA, 65 nt, hsa
aaaaacacuaguuuugugccagccgugaugcucaggcuugaaaugcauuauuuugaaugugaagu

SEQ ID NO: 631560 - RNA, 65 nt, hsa
uauuuuauguuguugacucuggcuccagggccugugcuugaaaaggacagauaaguauugcccag

SEQ ID NO: 631561 - RNA, 65 nt, hsa
aauguuuuauaucuuaauucuaguaucuguuuuaugcuugaaagcauuacagaucaugauaccua

SEQ ID NO: 631562 - RNA, 65 nt, hsa
cuucuuaauauggugcugauguuuuugugucaauggcuugaaacuggcaagauuaacaaaauuag

SEQ ID NO: 631563 - RNA, 65 nt, hsa
uaaaaauuaaaauccuugacauagaccauagcauggcuugaaaugcuaugucugcaugauaauuu

SEQ ID NO: 631564 - RNA, 65 nt, hsa
aaagaaaaccuaaacuaaugucauuggaaacaaaagcuugaaagaaacacaucgcaucuacauuu

SEQ ID NO: 631565 - RNA, 65 nt, hsa
aaacucacaaaacauuuugcuaaaaagauaugacugcuugaaauagucucucucccauggagaac

SEQ ID NO: 631566 - RNA, 65 nt, hsa
uuggauauucaagccuuuggauggcuauggagagggcuugaaauguguacaggugucaccaucau

SEQ ID NO: 631567 - RNA, 65 nt, hsa
ggaaugagcuaagcaaggcugagccuccuccuguugcuugaaauaaugaugauauaaaggcugga

SEQ ID NO: 631568 - RNA, 65 nt, hsa
cauucuuugaauagucacucguaaaaacugucagugcuugaaacuguuuccuuuacucauguuga

SEQ ID NO: 631569 - RNA, 65 nt, hsa
uuauuccccugccuuccuggcuugauugaaggaaagcuugaaaaggcgcagagcccuauaccuca

SEQ ID NO: 631570 - RNA, 65 nt, hsa
acggaguuucaaaaacugaugagccucgauccagggcuugaaagaagccaggguguaaucuuguu

SEQ ID NO: 631571 - RNA, 65 nt, hsa
gcugcuccucucugccgccuuuccuccauuccauggcuugaaaccucugccugauguggcuccuu

SEQ ID NO: 631572 - RNA, 65 nt, hsa
aauaaaaugagaaacuuuuuuccuacaaagaccuugcuugaaaccacaaaaguuuugcuggcacg

SEQ ID NO: 631573 - RNA, 65 nt, hsa
agugaccauacuaauuauacccccugcaaagcccagcuugaaaccuucacuuaggaacguaaucg

SEQ ID NO: 631574 - RNA, 65 nt, hsa
cauauugugugcaaaggaugggcagaaaagaaagugcuugaaagauuucaaauuuucagaaaggg

SEQ ID NO: 631575 - RNA, 65 nt, hsa
aaaaauuucacaagacuuauuuuaaugacaauguagcuugaaagcgaugaagaaugucucuagaa

SEQ ID NO: 631576 - RNA, 65 nt, hsa
ucacuuggcucugaacauacuggcuuugcuguaaugcuugaaaaggcguugguaucuucauuuua

SEQ ID NO: 631577 - RNA, 65 nt, hsa
uucuaugcauccgauucuuaacaaaacugcagggagcuugaaaaaaugcagacuguacaaacgcu

SEQ ID NO: 631578 - RNA, 65 nt, hsa
uucagaaaaugcaucccugauuucauucauuuccagcuugaaagccagccauauuacucuagucc

SEQ ID NO: 631579 - RNA, 65 nt, hsa
auauaaauacaguaaguuuagauuauugaauuggugcuugaaauuuauugguuuuguuguaauuu

SEQ ID NO: 631580 - RNA, 65 nt, hsa
uuguaauagugaaaccuguacucaaaauauaagcagcuugaaacuggcuuuaccaaucuugaaau

SEQ ID NO: 631581 - RNA, 65 nt, hsa
cuaaucauaacuguuaauucucagccaucuuugaagcuugaaagaagagucuuugguauuuugua

SEQ ID NO: 631582 - RNA, 65 nt, hsa
aguuaguguccgaagaccgaauuuuauuuuacagagcuugaaaacucacuucaaugaacaaaggg

SEQ ID NO: 631583 - RNA, 65 nt, hsa
cauagcauaaagcuaggggaugcauggaaauagcagcuugaaacuaggagguaacaagaaagcuu

SEQ ID NO: 631584 - RNA, 65 nt, hsa
aguaaugggucuuggaguauagauuuuuauuaguagcuugaaagagcuuaaucauaugcaguaag

SEQ ID NO: 631585 - RNA, 65 nt, hsa
cagcacaucccgcugcagagggcauucccuuuaaggcuugaaaaugccuccuguagucccaaacc

SEQ ID NO: 631586 - RNA, 65 nt, hsa
ugaggacuugggcgggacacaggcuccaaacuggagcuugaaauagugucugaugaauguuaaau

SEQ ID NO: 631587 - RNA, 65 nt, hsa
uagccagggggacuagccccuguggagacuggggggcuugaaauuguccccguggucucuuacuu

SEQ ID NO: 631588 - RNA, 65 nt, hsa
ccagacuauagcauauuagcuguuuagaagggauggcuugaaaggaaggagacugaaaaacacuc

SEQ ID NO: 631589 - RNA, 65 nt, hsa
accugccucagccucccaaagugcugggauuacaggcuugaaagucuaacuuuuuuuuacuuaua

SEQ ID NO: 631590 - RNA, 65 nt, hsa
uauugugauuucuuauuugagguucaaaaugaccugcuugaaacuuugauacauauuggaauaca

SEQ ID NO: 631591 - RNA, 65 nt, hsa
uuuuuauauacuuucaauuagcuguacuaauuggggcuugaaaguauauaaaaucuuccuguccu

SEQ ID NO: 631592 - RNA, 65 nt, hsa
caucgugaaagguacauuuaaaauauguuaaauuggcuugaaauuuucagagaauuuugucuucc

SEQ ID NO: 631593 - RNA, 65 nt, hsa
augugauacauuuaagccacuggaaaaaccccugugcuugaaaauauuuccucuauaucaugccu

SEQ ID NO: 631594 - RNA, 65 nt, hsa
gcuuccuauuuuuuuuuccaguaguauuguuaccugcuugaaaacacugcuguguuaagcuguuc

SEQ ID NO: 631595 - RNA, 65 nt, hsa
aaaaaaaaauacugauguuccuagugaaagaggcagcuugaaacugagaugugaacacaucagcu

SEQ ID NO: 631596 - RNA, 65 nt, hsa
aucacauuuguagaaauguaaugcgguucugaguggcuugaaauguacagaauguuuugaaagug

SEQ ID NO: 631597 - RNA, 65 nt, hsa
uguuguuauaaaacauucaaauucugauauacauugcuugaaaaugagugaguaccucagagaaa

SEQ ID NO: 631598 - RNA, 65 nt, hsa
uggcacuccucaauugggaguguugugacugaaaugcuugaaaccaaagcuucagauaaacuugc

SEQ ID NO: 631599 - RNA, 65 nt, hsa
gccgaaaagaaugaaaacagagaaaaaauguaugugcuugaaaguaaaauacuuacaauaguagc

SEQ ID NO: 631600 - RNA, 65 nt, hsa
gauugaguaucauguaauaauuauaauauaauuuagcuugaaagaugcucuacauuaugaccaau

SEQ ID NO: 631601 - RNA, 61 nt, hsa; identical to SEQ ID NO: 630987

SEQ ID NO: 631602 - RNA, 65 nt, hsa
cagcaaagcuaauuugccuuugccugggguguucagcuugaaagaauaaagcucauuugguuuag

SEQ ID NO: 631603 - RNA, 65 nt, hsa
uaaaacucucuguuguuuguaauauucucuuaaaagcuugaaaauaaaacuucuuucccuaccau

SEQ ID NO: 631604 - RNA, 65 nt, hsa
agccaccgugggacaucaaguggaagaacuuguuugcuugaaaguaucucagacccaaggcaccu

SEQ ID NO: 631605 - RNA, 65 nt, hsa
aauuuaagaaccagaggcagaaguucuggcuuccugcuugaaacccaauucuuauaugaaauuuu

SEQ ID NO: 631606 - RNA, 65 nt, hsa
guguuuggggcuugauagagugugaaagguguguugcuugaaagguguggccuuagacacuagga

SEQ ID NO: 631607 - RNA, 65 nt, hsa
gaauagaugugugggugaagccauagaacauauuugcuugaaauucuugagcagggaucuuauaa

SEQ ID NO: 631608 - RNA, 65 nt, hsa
uucaguuaaacacugcugcaauauuucaguguugugcuugaaaauauguacaguuuuuuuccaau

SEQ ID NO: 631609 - RNA, 65 nt, hsa
uauaagaggcugauaauuccagugguccauggaaugcuugaaaaaugugcaaaacagcguuuaag

SEQ ID NO: 631610 - RNA, 65 nt, hsa
uuugcauauucuuauguaugugaaaguuacaaauugcuugaaagaaaauaugcaucuaauaaaaa

SEQ ID NO: 631611 - RNA, 65 nt, hsa
aaaugggaccgcaagugguaggcagugucccuucugcuugaaaccuauugaaaccaauuuaaaac

SEQ ID NO: 631612 - RNA, 65 nt, hsa
aggaauuuugugagacaguugucaaauuguugcuagcuugaaaucugcggcaauuggaguauuua

SEQ ID NO: 631613 - RNA, 65 nt, hsa
ucggcagcacauauacuaaaaauuaauaagacccagcuugaaaauugagccugauaacaagauua

SEQ ID NO: 631614 - RNA, 65 nt, hsa
guuugugaaugaauaaauuacuaauccuccuugucgcuugaaaccuucccacacucccugcucca

SEQ ID NO: 631615 - RNA, 65 nt, hsa
ccauuucugcucaaccacacauucucuaagaaacagcuugaaagcucugucugggucauucauuu

SEQ ID NO: 631616 - RNA, 65 nt, hsa
cccaagaacacuuuaaggaaacauuuuacaaguaugcuugaaagaaugucacuaacugguccaga

SEQ ID NO: 631617 - RNA, 65 nt, hsa
uauuuagguauaauaucaucuugucuuugacuagagcuugaaaccuuguuaucugauuguguacc

SEQ ID NO: 631618 - RNA, 65 nt, hsa
gaaccuuacaaggcucuaaaaugagaugugauauggcuugaaaugggaggagacacuuucugaca

SEQ ID NO: 631619 - RNA, 65 nt, hsa
ccugggugagucugccaacucacaggugcuuuuaggcuugaaaucuccauccuaucauuuccguu

SEQ ID NO: 631620 - RNA, 65 nt, hsa
caguuuuguuugguuuacuuucaaaagaguagaaagcuugaaaagauucugaaaccacaguuuca

SEQ ID NO: 631621 - RNA, 65 nt, hsa
gaagugaacuugguuugaucuuacucaacuagaaagcuugaaaacaucccuggggauucugaagg

SEQ ID NO: 631622 - RNA, 65 nt, hsa
caugcuagcucaauuaguuuugaauuauauguauagcuugaaaaguuuuuuuuuaaugacugugc

SEQ ID NO: 631623 - RNA, 65 nt, hsa
aauaacgcacgguacuguucuugaaauaccuaauggcuugaaauucuagucuguuugugaaagau

SEQ ID NO: 631624 - RNA, 65 nt, hsa
aacuuacuguggcuuuaaacauauucagaacagaugcuugaaauaugcacuuagcacuuugguuc

SEQ ID NO: 631625 - RNA, 65 nt, hsa
cacaaacauucuguugaagggaaaucuagucaguugcuugaaagagcacagcccaaauaaaacaa

SEQ ID NO: 631626 - RNA, 65 nt, hsa
uaacacaauaaccaaaagcuuuuauuuauaaaaaggcuugaaaaauauagacaaucuuuaaugua

SEQ ID NO: 631627 - RNA, 65 nt, hsa
aaauguauguccucucuguaauuguuuuaaugugugcuugaaauauccagaaaaccuauggaguu

SEQ ID NO: 631628 - RNA, 65 nt, hsa
aguguuguucugagcagggggacaggauugaugaggcuugaaagagcccacugagccacucucug

SEQ ID NO: 631629 - RNA, 65 nt, hsa
cugaggugcaaaacauagauauagaacugaacagggcuugaaacaauauuaggauuacuacccag

SEQ ID NO: 631630 - RNA, 65 nt, hsa
ccucacucaaacauagcugacuuccuauugguacagcuugaaaagcacuuuuuacuacauacaca

SEQ ID NO: 631631 - RNA, 65 nt, hsa
guauggugcucuugucuucuuuguuugugacccaugcuugaaaacuugaaggaaguuagauauga

SEQ ID NO: 631632 - RNA, 63 nt, hsa; identical to SEQ ID NO: 631018

SEQ ID NO: 631633 - RNA, 65 nt, hsa
uacuucaaggaagacucuacaagcuuuuguucacagcuugaaauagaugccucacaauucagaca

SEQ ID NO: 631634 - RNA, 65 nt, hsa
gugcugccauuugcuauaaaguugaacuuuguauggcuugaaaaagaaaugacaauauggaacau

SEQ ID NO: 631635 - RNA, 65 nt, hsa
uuaacugucccauuguaaagguguaaguuauauaggcuugaaaaaaauuggcggguaaaaaucac

SEQ ID NO: 631636 - RNA, 65 nt, hsa
aauuuguuuuuucuugcuuuucauuugauuacccugcuugaaauacaguuaguugauaacauaaa

SEQ ID NO: 631637 - RNA, 65 nt, hsa
uauaagggacuuuuauuuguaaaguaauggaucuggcuugaaaaauacgguagagauacuuagcu

SEQ ID NO: 631638 - RNA, 65 nt, hsa
caaauauauaauuuucuauacauauauauccucuagcuugaaacuuuugcucaaguuuauuuaug

SEQ ID NO: 631639 - RNA, 65 nt, hsa
uauuguauuauaaugaugauucugucaaaugaaaggcuugaaauaccuagaugaaguuuagauuu

SEQ ID NO: 631640 - RNA, 65 nt, hsa
cccauaucucaccucuaggauaugauggaagaagugcuugaaagagaauuuuagcagaugguacu

SEQ ID NO: 631641 - RNA, 65 nt, hsa
gucccagcuacucgggaggcugagacagaagaacugcuugaaaccaggaggcagagguugcagug

SEQ ID NO: 631642 - RNA, 65 nt, hsa
aaaaaaaaaaaaagaaaguaauuuuaaacucacuggcuugaaaugugugcuuucuguacaaugaa

SEQ ID NO: 631643 - RNA, 65 nt, hsa
uuuuuuuuauuucaauauauacaguuugaugaugugcuugaaauuggugcaaauauauacacacc

SEQ ID NO: 631644 - RNA, 65 nt, hsa
ccuucagaauaagcuuccccaccccaguuuuuguugcuugaaaauauuguugucccggauuuuug

SEQ ID NO: 631645 - RNA, 65 nt, hsa
cggagacgcagguugcaguggacauugggauuguugcuugaaaaauuaaaauuugaauauuuucu

SEQ ID NO: 631646 - RNA, 65 nt, hsa
uuuuugaagucuucccuugacccuaguaaaauauagcuugaaacuuguaaacaacuguguuugcc

SEQ ID NO: 631647 - RNA, 65 nt, hsa
aaaaaugcuuguccccuauaugaauauucuguuacgcuugaaaaauauuuucuccagcguugguu

SEQ ID NO: 631648 - RNA, 65 nt, hsa
ugaggaauaaagccaaggggagugagaugaggugggcuugaaaguaccuuguccgcucagaagga

SEQ ID NO: 631649 - RNA, 65 nt, hsa
ucccaggguauccaccugcaccccacucccaaguagcuugaaaaagggaggacagucuuucccca

SEQ ID NO: 631650 - RNA, 65 nt, hsa
cgaauuaaauauuauguccuaccaacuuauuagcugcuugaaaaauauaauacacauaaauaaaa

SEQ ID NO: 631651 - RNA, 65 nt, hsa
agacuguauguuuuaauugcauuuaaaaauauauagcuugaaagcaguuaaacugauuaguauuc

SEQ ID NO: 631652 - RNA, 65 nt, hsa
auugguguguauuggccaaguuuugcuuguugugugcuugaaagaaaauaucucugaccaacuuc

SEQ ID NO: 631653 - RNA, 65 nt, hsa
cauuuuggucccugcuccuugcccauaguaaaacagcuugaaauaucccaugcaagagaguaguu

SEQ ID NO: 631654 - RNA, 65 nt, hsa
cugagacacagaggugccagugauggacuggaucagcuugaaagaagcacaaagacuccgugauc

SEQ ID NO: 631655 - RNA, 65 nt, hsa
ugcugggauugcaaacacuuuuuaaaaaauuguuugcuugaaaauacuacugaauauaaauaaga

SEQ ID NO: 631656 - RNA, 65 nt, hsa
uguguugcccaccuguucacaaaaaguaccuuuaugcuugaaaacauuagguucuuugguuacug

SEQ ID NO: 631657 - RNA, 65 nt, hsa
uggugaauuuuuuuuaaguggcacggucuuuuucugcuugaaaucugaucacaccccccagccau

SEQ ID NO: 631658 - RNA, 65 nt, hsa
ugcaaggggcaaguuucacccaaaugccugagacugcuugaaagauauauuuuaaguggugcacu

SEQ ID NO: 631659 - RNA, 65 nt, hsa
uuauucaacugcaaaaucucaaucuugaaaaucaagcuugaaauuucauagguagaaauauuagc

SEQ ID NO: 631660 - RNA, 56 nt, hsa; identical to SEQ ID NO: 631046

SEQ ID NO: 631661 - RNA, 65 nt, hsa
caagaaucuugcaagacaguuauuaaacauucauagcuugaaauugcccauggugggagaguuua

SEQ ID NO: 631662 - RNA, 65 nt, hsa
agcagacaaagucaagcagcuuuaaguacaaggcagcuugaaaccucucugaugaaagugaaaaa

SEQ ID NO: 631663 - RNA, 65 nt, hsa
cacaugaugagauaucaagguaauuaaaauagcaugcuugaaaaaaaaauacguaaucuguuuca

SEQ ID NO: 631664 - RNA, 65 nt, hsa
uuggagaaaugaagcaaaggugaaugacagccuaggcuugaaauuauaaagcucucucagguuga

SEQ ID NO: 631665 - RNA, 65 nt, hsa
ucuucuuauaagccagcucugacuggauuuugaacgcuugaaaucaggcucuccacaccauugac

SEQ ID NO: 631666 - RNA, 65 nt, hsa
ugggaggggugccguuuuuauuuuccugaacauuugcuugaaauauuuuguuagggccucaaaga

SEQ ID NO: 631667 - RNA, 65 nt, hsa
agagguaugauuccuaagcccuaaggagcuccucagcuugaaauggggcugcaucccuauaaacc

SEQ ID NO: 631668 - RNA, 65 nt, hsa
ucaaccaaacgccuauuuuuuaaugcuuaguuuuggcuugaaauucuucuucaccuggaguuuuc

SEQ ID NO: 631669 - RNA, 65 nt, hsa
cuauuuuuacacagguuuucuugucuugacaagaugcuugaaaaaccaagaggauaugaaaaucu

SEQ ID NO: 631670 - RNA, 65 nt, hsa
auugugauguuucaaugugagacacaaaaacaauggcuugaaacuuguguaucauaugugauuuu

SEQ ID NO: 631671 - RNA, 65 nt, hsa
cugaagguggggacagugaccgcggaccccucugugcuugaaagauuuccuccacggccuuugcc

SEQ ID NO: 631672 - RNA, 65 nt, hsa
ccuauuagucagaaagaaggagagaaugagugagugcuugaaaugugucauacuguuuuaggauc

SEQ ID NO: 631673 - RNA, 65 nt, hsa
cuagcugucuccucaucucauccuagucuagguuugcuugaaauugggugugagagcuagaauga

SEQ ID NO: 631674 - RNA, 65 nt, hsa
uccaaacuucauauaugucuaucagguaauaauaggcuugaaaauugauauccuguggugcuaaa

SEQ ID NO: 631675 - RNA, 65 nt, hsa
cucuuccaaaggcauaagacccuaagccuccuuuugcuugaaaccaaagauauauacacaggauc

SEQ ID NO: 631676 - RNA, 65 nt, hsa
cuacauugauuauagaaccacuauuacgugaaaaggcuugaaacaaccaacauauacaaauaaaa

SEQ ID NO: 631677 - RNA, 65 nt, hsa
agcuuugcacaguguauuaacauugggagggucuggcuugaaaauuuggccacccucagccucug

SEQ ID NO: 631678 - RNA, 65 nt, hsa
uguuagacuuuuuaaacucaaggaugagcauaagugcuugaaauaaaaugcuaauacuuaagugu

SEQ ID NO: 631679 - RNA, 65 nt, hsa
cgcacaguugauuuucgguguguuccuguauaacggcuugaaaggaaaggagaagaugcuguguc

SEQ ID NO: 631680 - RNA, 65 nt, hsa
uauugugcaugcuaguguuguauuucuauacaguagcuugaaauugauuaacuuauacuguaggu

SEQ ID NO: 631681 - RNA, 65 nt, hsa
acgaggugaguucacauaacaggaauucuggaacugcuugaaaacuaggacgauugggcaauauc

SEQ ID NO: 631682 - RNA, 65 nt, hsa
cacuauuaguacuucccuuugucugugccauaagugcuugaaaacguuaagguuuucuguuuugu

SEQ ID NO: 631683 - RNA, 65 nt, hsa
guucucuagcuguucuacaaaacuggagcaugcuggcuugaaaaacccuugcccaguuuugaucc

SEQ ID NO: 631684 - RNA, 65 nt, hsa
gaauuccagccaaggcaaauucaguuggaucuagggcuugaaaacugcccaagauuaaagagcua

SEQ ID NO: 631685 - RNA, 65 nt, hsa
auuuuuuauuugcugucuuugguaauuaucucucugcuugaaauuaaaugcacuauaaguuaaua

SEQ ID NO: 631686 - RNA, 65 nt, hsa
uuauugcaauuguggucaaauaaggaacguuuccugcuugaaauuauauugauuuaaaugaugug

SEQ ID NO: 631687 - RNA, 65 nt, hsa
accgcacagcagcgaugcagaaggcaagaacggcagcuugaaaaauuaaaggagguuguucacuu

SEQ ID NO: 631688 - RNA, 65 nt, hsa
gcgcugcucuuaugccauuuguuuauuuuuauauagcuugaaacauagagggagagagggagaga

SEQ ID NO: 631689 - RNA, 51 nt, hsa; identical to SEQ ID NO: 631075

SEQ ID NO: 631690 - RNA, 65 nt, hsa
gauuccaaagcaagggcaagguaggaacaagaugagcuugaaauaucuuguuaugccagaaagua

SEQ ID NO: 631691 - RNA, 65 nt, hsa
cuguaaaguuguuucaguuaaacugggcugagagagcuugaaaguccuuuucauaaaagauaacu

SEQ ID NO: 631692 - RNA, 65 nt, hsa
ucuuaacuuaaaggcauugguuauaaauucaaagagcuugaaaagauugaagagggccaaacacu

SEQ ID NO: 631693 - RNA, 65 nt, hsa
agcuuauuagaaagccaaaguagaguucuguuuaagcuugaaagagguaugaaguaaucuguagu

SEQ ID NO: 631694 - RNA, 65 nt, hsa
uucugaaauuuaaacuugauauuuuucgcccucuugcuugaaaacuucacuugcuuccccauuuc

SEQ ID NO: 631695 - RNA, 65 nt, hsa
ugggcuugauuuaacauuguuuuuguguuauuuuugcuugaaacaacgcacacauuuucaacaac

SEQ ID NO: 631696 - RNA, 65 nt, hsa
caguuuaagagcagaacagaucuuuuacuuuggccgcuugaaaagcuaguguaccuccucucagu

SEQ ID NO: 631697 - RNA, 65 nt, hsa
cuccagcugggccaugucagucucaucgucccaaggcuugaaauccagcaggauggaggacuugg

SEQ ID NO: 631698 - RNA, 65 nt, hsa
accaguguuggugaaucuuuuggccuuuccccaaugcuugaaagaagaucaccacugcuggaggc

SEQ ID NO: 631699 - RNA, 65 nt, hsa
aggacaggugggugaggaucugagaaaugcuaaaggcuugaaagcaucugaagacaucuaacuua

SEQ ID NO: 631700 - RNA, 65 nt, hsa
ugagaaauacaagguugcuugucugaccccaaucugcuugaaaccugacucugcuucucucauuu

SEQ ID NO: 631701 - RNA, 65 nt, hsa
caggggcugacagcaggcuuacugccaucaacauugcuugaaaugccucuauguucugaauaaag

SEQ ID NO: 631702 - RNA, 65 nt, hsa
auuaaaauauggaaauuuuaaaauuaugaccaagggcuugaaacauauuggauuacaugcucaca

SEQ ID NO: 631703 - RNA, 65 nt, hsa
cuaaacaaugaauucuucaacagggaaaacagcuagcuugaaaacuugcugaaaaacacaacuug

SEQ ID NO: 631704 - RNA, 65 nt, hsa
ugccacccucagcucuuuccucugguguggcuucagcuugaaagcaaccuggagucgggggcaca

SEQ ID NO: 631705 - RNA, 65 nt, hsa
ccauugaaagggaguauuacaaaaacauggccuuugcuugaaagaaaauaccaaggaacaggaaa

SEQ ID NO: 631706 - RNA, 57 nt, hsa; identical to SEQ ID NO: 631092

SEQ ID NO: 631707 - RNA, 65 nt, hsa
gggguuuggggaaggacaguguggugugacuauuggcuugaaacguuauggauaugguuggaguc

SEQ ID NO: 631708 - RNA, 65 nt, hsa
accauauaaauguggaggcuaucaacaaagaaugggcuugaaacauuauaaaaauugacaaugau

SEQ ID NO: 631709 - RNA, 65 nt, hsa
aucccagcuccucaggaggcugaggcaggagaauugcuugaaaccaggaggcggagguugcagug

SEQ ID NO: 631710 - RNA, 65 nt, hsa
gugaacuguuggacuggguagaaaucuuucaagaagcuugaaaauaaggccauaaaggaggggcu

SEQ ID NO: 631711 - RNA, 65 nt, hsa
ugggacccucauuucuucugacagauuucagucuggcuugaaauuuggggauguuaaugaggguc

SEQ ID NO: 631712 - RNA, 65 nt, hsa
guuacaugguuacauguucuacaucaugcauaguagcuugaaaucuagucuggagaaaacuggau

SEQ ID NO: 631713 - RNA, 65 nt, hsa
auacaguguucuggaaaagaugccauucuuuuuaagcuugaaacugcagaagaaauucacaggaa

SEQ ID NO: 631714 - RNA, 65 nt, hsa
aaaguggcccaucauucauacccacuguucugaaggcuugaaaacaaaacauauccacaacauug

SEQ ID NO: 631715 - RNA, 65 nt, hsa
uugucuuuuuacugcaacccacaggcccacaguaugcuugaaaagauaaauuauaucaauuuccu

SEQ ID NO: 631716 - RNA, 65 nt, hsa
cugcucgggagagcugaggguuuuauuguuugcuugcuugaaaccuaaucuauagacggccccac

SEQ ID NO: 631717 - RNA, 65 nt, hsa
ccccacugagcuggaggaauaucuacagcagugaugcuugaaauuuuuguaugaauuauuuuguc

SEQ ID NO: 631718 - RNA, 65 nt, hsa
uacuuucuaucuucauaaccauuuaaagcgauuuagcuugaaauuaaauuuuaucaggcuaccaa

SEQ ID NO: 631719 - RNA, 65 nt, hsa
uuccccucccuguccgccucuccuuacuuucucuugcuugaaacugcuuuuccuuuucuacucuu

SEQ ID NO: 631720 - RNA, 65 nt, hsa
uaggcgugaguuuuaggugaauuuaugugguuccugcuugaaaaccuuccccucuccagguucgg

SEQ ID NO: 631721 - RNA, 65 nt, hsa
gcauaaaauaaucauuuuugaaccuguguaauaaagcuugaaagcagggaaaagaauuuccuuuu

SEQ ID NO: 631722 - RNA, 65 nt, hsa
cagggugauaauaaucuccauaguuauuugaaguggcuugaaaaaggcaagauugacuuuuauga

SEQ ID NO: 631723 - RNA, 65 nt, hsa
aaucauaacacucucggucacauguuuuuccuucagcuugaaagcuuuuuuuuaaaaggaaaaga

SEQ ID NO: 631724 - RNA, 65 nt, hsa
ucaauaccuuaauggugguagagccuuuaccuguagcuugaaaggggaaagauuggagguaagag

SEQ ID NO: 631725 - RNA, 65 nt, hsa
ggguaggaauccaggaugcuuaguuucuagacccugcuugaaaguucuagagccuuugaaaggga

SEQ ID NO: 631726 - RNA, 65 nt, hsa
aucguaaagccauauguucuguucaagucuuguuugcuugaaaugauuauuccuacaagugaaac

SEQ ID NO: 631727 - RNA, 65 nt, hsa
gcugaagacaacaccugcuucaggggaacacaggcgcuugaaaaagaaaagagagaacagcccau

SEQ ID NO: 631728 - RNA, 65 nt, hsa
uuucaaaauaugagacuaugcuauaggcagugcuugcuugaaaagucucauuuuuaaaucucccu

SEQ ID NO: 631729 - RNA, 65 nt, hsa
uccuuauaucuaauauauaucugggagaaaaggcugcuugaaaauaucuuuugauucagugauuu

SEQ ID NO: 631730 - RNA, 65 nt, hsa
uguuuuuuaagggagggaauuuauuauuuaccguugcuugaaauuacuguguaaauauaugucug

SEQ ID NO: 631731 - RNA, 58 nt, hsa; identical to SEQ ID NO: 631117

SEQ ID NO: 631732 - RNA, 65 nt, hsa
acuuuggguguggugacccagaugcacagagcucugcuugaaacagguacacgggccagggaaau

SEQ ID NO: 631733 - RNA, 65 nt, hsa
uuggucaccucaaauuuaagucgggaaauucugcugcuugaaacuucagcccugaaccuuugucc

SEQ ID NO: 631734 - RNA, 65 nt, hsa
aaccugucucaggacacacuugccaucuagggcuagcuugaaagagccugaggacugccuuuaac

SEQ ID NO: 631735 - RNA, 65 nt, hsa
cuguugauuaaaccugucacuuuacacaugaaaaagcuugaaacuuagagaaagauaaaauguaa

SEQ ID NO: 631736 - RNA, 65 nt, hsa
ggcugugaagaguggacagucuuggagaacacagugcuugaaauggacaagcuggaccuauuccu

SEQ ID NO: 631737 - RNA, 65 nt, hsa
gguauugccacccaugacauuuaacauguugugaugcuugaaaacacaggaguagagaaaaucga

SEQ ID NO: 631738 - RNA, 65 nt, hsa
gcaugaagcacuguuuuuaaacccaaguaaagacugcuugaaaccuguugauggaaaugacuuau

SEQ ID NO: 631739 - RNA, 65 nt, hsa
uuuauucaacagccauuuagagugccaucaagauggcuugaaauggaauuuugugauuuguaguc

SEQ ID NO: 631740 - RNA, 65 nt, hsa
caaaauagaauauauauauauugcuuaucugaaaugcuugaaaccagaauuguuuugcauuuuuu

SEQ ID NO: 631741 - RNA, 65 nt, hsa
guaugaagauugaaugugauguauucacguaacaugcuugaaacugccuggcauauacuaaacgc

SEQ ID NO: 631742 - RNA, 65 nt, hsa
aaaaaaaaaugcacauagcuaucaagugugcuuuagcuugaaaaggugaccuugcaacuucaugu

SEQ ID NO: 631743 - RNA, 65 nt, hsa
uccccuuuuuauuuuaaaauuugacuccucuucaagcuugaaaacccucugaacucagucuucuu

SEQ ID NO: 631744 - RNA, 65 nt, hsa
ucuuaaugcagcccugcugguccccauuaacaauugcuugaaauucacauggauguaaaauuaua

SEQ ID NO: 631745 - RNA, 65 nt, hsa
ucuguuuagacauuuuuugucccagaaauacagaagcuugaaaugcuaugaaggcagagcuucua

SEQ ID NO: 631746 - RNA, 65 nt, hsa
cuucauacgcuguacuugcuaaaaaucaacugugcgcuugaaagaccucuucauaguugaguaau

SEQ ID NO: 631747 - RNA, 65 nt, hsa
guuuaaugcaggacaucaacuacauaaugaaagaugcuugaaaugcuuuuguuauuucaggcaaa

SEQ ID NO: 631748 - RNA, 65 nt, hsa
aauuacaaacaagagaaaugagaacuuacaggauugcuugaaauuauuguggguauuaucuguuu

SEQ ID NO: 631749 - RNA, 65 nt, hsa
gcacucaaggucgcuggaugcugaucuaaucaguagcuugaaaccacaauuuuaaaaaugugacu

SEQ ID NO: 631750 - RNA, 65 nt, hsa
aagcugguucccguuuuccagagggggagcccagagcuugaaaggccgcgguuggcacuucgaga

SEQ ID NO: 631751 - RNA, 65 nt, hsa
uuauggguagaauuguagucaggaaaacagaaagggcuugaaauuuaauaagugcugcuggaagg

SEQ ID NO: 631752 - RNA, 65 nt, hsa
accacgagugucuccccagugcagacucaaguuaugcuugaaaugaaaaagucuaucugguagug

SEQ ID NO: 631753 - RNA, 65 nt, hsa
uuaugaaauggucauuuuucugaagagaauauuuugcuugaaaugcaaaggacugaaagagauuu

SEQ ID NO: 631754 - RNA, 65 nt, hsa
aggacguccuuccauaucccugcccagccuguggugcuugaaacguuugccccaugggaaacgua

SEQ ID NO: 631755 - RNA, 65 nt, hsa
acuuuauacuuggguuauauauuagacuuuuauaggcuugaaaucauccaucacauaagaaaaua

SEQ ID NO: 631756 - RNA, 65 nt, hsa
cgucauuucauuaguauuccucauucugcauccuggcuugaaaaacagcucuguugaaucacagu

SEQ ID NO: 631757 - RNA, 65 nt, hsa
gaauucuacuuaagcuauaagucucugucauuuuugcuugaaaauuagcaugccucugucuuaaa

SEQ ID NO: 631758 - RNA, 65 nt, hsa
uuuucuuuuuuaaagccauucuguucuuuggaugugcuugaaagggugugugauuacaccauugu

SEQ ID NO: 631759 - RNA, 65 nt, hsa
aaguugcacuuugcugugcugaucccacaggaaaggcuugaaacacgagaagcagcaaagacaga

SEQ ID NO: 631760 - RNA, 65 nt, hsa
uuuuuccccccaaguagaacuaaugcuagcuuccagcuugaaaguaaaacuccaguguggaguga

SEQ ID NO: 631761 - RNA, 65 nt, hsa
ucucaggguggccaguauuuugacuuauuuauccugcuugaaagcuacuugagauguguacugcu

SEQ ID NO: 631762 - RNA, 65 nt, hsa
agggagcaaaacacugauuugauacuagucaguuugcuugaaacuaguucaccuaaagcuagauc

SEQ ID NO: 631763 - RNA, 65 nt, hsa
uuacuuucauguuuuaaaaaucccuuuaauuucuugcuugaaaaucccaugaacauuaaagagcc

SEQ ID NO: 631764 - RNA, 65 nt, hsa
aaaagcuguuuguuauaugcugcuuaauaaaguaagcuugaaauuuaucauuuuaucaugaaaac

SEQ ID NO: 631765 - RNA, 65 nt, hsa
ugauuuagaugguccaagauaaucucauucaggaggcuugaaacauuaaugguuuagucuuguga

SEQ ID NO: 631766 - RNA, 65 nt, hsa
ucauguggcagaauuucccucuuacauaaaccaaugcuugaaaaugcugcaaaugacccucuaau

SEQ ID NO: 631767 - RNA, 65 nt, hsa
auaaggacaagucaauuugucaguagcuucuucuggcuugaaacccccucccuggauuuuauagc

SEQ ID NO: 631768 - RNA, 65 nt, hsa
ggucccaucuccaaggugcgucauaugcaggaauggcuugaaacaagaggaaguccuaaaucaca

SEQ ID NO: 631769 - RNA, 65 nt, hsa
uuuuuccccuguuuggugcuauguuuauguauuaugcuugaaauuuuaauuuuuuuuuuuuugca

SEQ ID NO: 631770 - RNA, 65 nt, hsa
cagguccagcaaaagucaguagggacauugcagaagcuugaaaggccaauaccagaacacaggcu

SEQ ID NO: 631771 - RNA, 65 nt, hsa
uaaucccagcuauucuggaggcugaggcaggaaucgcuugaaauuggaaagcagagguugcagug

SEQ ID NO: 631772 - RNA, 65 nt, hsa
agcccaguuugucuuucagaaggugacuuucaugugcuugaaaaguuuaauauuugaauauugug

SEQ ID NO: 631773 - RNA, 65 nt, hsa
aguuguuuucuuuaggagucuaccuuuguguaugugcuugaaaguauuuuuguaauccaagaaug

SEQ ID NO: 631774 - RNA, 65 nt, hsa
aagaauugcccuauaaacauagcaggauuuugagagcuugaaaauuuuccauuauucuggacaug

SEQ ID NO: 631775 - RNA, 65 nt, hsa
cuguccccucugucaccagggaagccacaaugagagcuugaaagggugcugucaagauaaauguc

SEQ ID NO: 631776 - RNA, 65 nt, hsa
uuaacagggagugguauuugaaguguccagcaguugcuugaaaugcuuugccgaaucugacucca

SEQ ID NO: 631777 - RNA, 65 nt, hsa
ucuaccucuguuuuuaauuuucuuuccaaaaggcagcuugaaauguugguccuaaucuuaauuuu

SEQ ID NO: 631778 - RNA, 65 nt, hsa
ugggggugacuuuaguuuuucuucagcuuaggcgugcuugaaaccuuggccagguuccaugacca

SEQ ID NO: 631779 - RNA, 65 nt, hsa
aucuaaacugcaaacauuuucacacccaccaugcugcuugaaagccacuugauccucaacauaua

SEQ ID NO: 631780 - RNA, 65 nt, hsa
aaaccagugacuucagagccuauggucucaacugugcuugaaaaacacugucucugaaaacaacu

SEQ ID NO: 631781 - RNA, 65 nt, hsa
aauuaagccagacugaccacuugcuuggagugugugcuugaaaaaaccagagcaauacuguuggg

SEQ ID NO: 631782 - RNA, 65 nt, hsa
uggucccaggacaggaaugcgguucaaacccaguggcuugaaacuuccugagaaacuguagcaua

SEQ ID NO: 631783 - RNA, 65 nt, hsa
uugcaacacuccugccaaguggucuucuacccauugcuugaaaaucucucuugacagggagcuca

SEQ ID NO: 631784 - RNA, 65 nt, hsa
ggcuguucacuugauuaguugaaacacaaauucuggcuugaaaaaauaggggagauuaaauauua

SEQ ID NO: 631785 - RNA, 65 nt, hsa
gaacaucuauccccuccucccccauacacaccuaggcuugaaaugcccuacaggcccagaacuuu

SEQ ID NO: 631786 - RNA, 65 nt, hsa
cugaauguuugggaaugagaggaugagugagugaggcuugaaaacacaccacauugaaaauccug

SEQ ID NO: 631787 - RNA, 65 nt, hsa
aaaauugcgccgcuccuggagaccugauaacuuaggcuugaaauaauugacuugucuaaaaggac

SEQ ID NO: 631788 - RNA, 65 nt, hsa
gggaagcauuuuuaacuggguagaaucugacuguggcuugaaauaaaaagcucucagaaaacuca

SEQ ID NO: 631789 - RNA, 65 nt, hsa
cacccacccccuuuaggaaccaggcugguguucuugcuugaaagcguugugcccucugagugucu

SEQ ID NO: 631790 - RNA, 65 nt, hsa
aggggaaggauagggugauguuccgaaggugaggagcuugaaacccguggcgcuuucugcaguuu

SEQ ID NO: 631791 - RNA, 65 nt, hsa
aguguuaauucuaaauccuugauccucugcaaugugcuugaaaacacaaaccuuuuggguuaaaa

SEQ ID NO: 631792 - RNA, 65 nt, hsa
cagucagauuagggucucugccauucagaguugaugcuugaaaacuuuaguuuuccuuauuaaug

SEQ ID NO: 631793 - RNA, 65 nt, hsa
gagagcucuguuacagcccacuguguccuuuagaagcuugaaaggaacccaacucuuugcugcac

SEQ ID NO: 631794 - RNA, 65 nt, hsa
aagcuuuaccuggucaccaugugaugugaucagaugcuugaaauuuaacacuuuucacuugguuc

SEQ ID NO: 631795 - RNA, 65 nt, hsa
acaauuagagaaacagaaguccaaggcuggcgacagcuugaaaagucugacagcuuuucuacuuu

SEQ ID NO: 631796 - RNA, 65 nt, hsa
acucgcuuaagaucacaggcuuagugugaggacgagcuugaaaucccagucuccuggcccccagg

SEQ ID NO: 631797 - RNA, 65 nt, hsa
caguacauggguacaauccgagggugugaauuucagcuugaaauuccauugcuguuccuuguuuu

SEQ ID NO: 631798 - RNA, 65 nt, hsa
ccguucaucucugaaacccagcauccuuuucagcugcuugaaaacauuguauuuuuuuuuuuuaa

SEQ ID NO: 631799 - RNA, 65 nt, hsa
ccugacaaggaaggaguugagcccuggguaggcuugcuugaaaagugaguccuuccagaauauuc

SEQ ID NO: 631800 - RNA, 65 nt, hsa
caaggaaagggucuuagucacugccucccgaaguugcuugaaagcacucggagaauugugcaggu

SEQ ID NO: 631801 - RNA, 65 nt, hsa
ugcugcccagugucagaacaguuauacaaacgagggcuugaaaacauuuugugaaaacuugcuua

SEQ ID NO: 631802 - RNA, 65 nt, hsa
aaagucaacauuagaacugaaaauggaaauaaacugcuugaaaagacgauggugccucuggguca

SEQ ID NO: 631803 - RNA, 65 nt, hsa
ucugcacaguccauucuguuuuuauuacuaucuaggcuugaaauauauaguuugaaauuaugaca

SEQ ID NO: 631804 - RNA, 65 nt, hsa
uccuaaauguccaaaaagaacaugagauuuauggugcuugaaauguugcuaaacguaaauuugua

SEQ ID NO: 631805 - RNA, 65 nt, hsa
gaagacugugacaaaguugucagucacaaaucacagcuugaaagacaggagaauucauacuggag

SEQ ID NO: 631806 - RNA, 65 nt, hsa
accugggaagccugggaguguuugucccaucgguagcuugaaauaaacgcuccccucagacaccc

SEQ ID NO: 631807 - RNA, 65 nt, hsa
cuggaagccuugccuucccgcuucuacaugcuugagcuugaaaagcagucaccuccucggggacc

SEQ ID NO: 631808 - RNA, 65 nt, hsa
uacuguuucaaugaccuuuauuuuaaaaacacauagcuugaaaauuuauuuuuauacugauauua

SEQ ID NO: 631809 - RNA, 65 nt, hsa
ucuagcugaacaaaaaugugcaguuaauacuuggcgcuugaaaaugcaguagugaauguggaacc

SEQ ID NO: 631810 - RNA, 65 nt, hsa
uguaaggucuucuuguguccugaugaaaaauaugugcuugaaaugagaaacuuugaucucugcuu

SEQ ID NO: 631811 - RNA, 65 nt, hsa
cauuucuaauagccuuggguuuauuugcaaaggaagcuugaaaaauaugagaaaaguugcuugaa

SEQ ID NO: 631812 - RNA, 65 nt, hsa
ccuuagccucccugaaaauguuuuucugccagggagcuugaaaguuuucagaaccucuuccccag

SEQ ID NO: 631813 - RNA, 65 nt, hsa
aagaaaaugucguuguuguuguuuuucuggaaacugcuugaaaucuugcuguacuauagagcuca

SEQ ID NO: 631814 - RNA, 65 nt, hsa
ugaaaguaaagaaggaauaaucuacccugacuaaagcuugaaaugcuacauuuccaaggugaaga

SEQ ID NO: 631815 - RNA, 65 nt, hsa
uucgguaucuuuuaauauaagaacacugaauuuuggcuugaaauauugugacuaaauugcacaau

SEQ ID NO: 631816 - RNA, 65 nt, hsa
uauaaggaauggcaucagaacaauagcuuggaauggcuugaaaucacaaaggaucugcaagauga

SEQ ID NO: 631817 - RNA, 65 nt, hsa
augaaaacugcagcauaucagacagcaauuuaacagcuugaaacaucuacagauaguuccuacua

SEQ ID NO: 631818 - RNA, 65 nt, hsa
gucuuagcuacucaggaggcugaggcaggagaaucgcuugaaaacaggagguggagguugcagug

SEQ ID NO: 631819 - RNA, 65 nt, hsa
uucuaggaaucauauguuguccaucccccccucaggcuugaaaguccucaaagagacccacuauc

SEQ ID NO: 631820 - RNA, 65 nt, hsa
aaauaucuuaagagaugaauaccuuaucagcuguugcuugaaaccuguuaaaaauguucauaaca

SEQ ID NO: 631821 - RNA, 65 nt, hsa
uuuaaacaagaauaauaaagguuggagauuguuacgcuugaaauuaaguuggaggcaaauugaua

SEQ ID NO: 631822 - RNA, 65 nt, hsa
cagucaccugaacaaugacccaucaucucuugcuugcuugaaaucuugcugaaauguucucauuu

SEQ ID NO: 631823 - RNA, 65 nt, hsa
cuauuuauuguuuugguauuucauguuacuccuaagcuugaaagcucuuuuuucuauauacagaa

SEQ ID NO: 631824 - RNA, 65 nt, hsa
uggggagaagcuauagaaagaggagcccacacaaagcuugaaagccugugccagauggagccuuu

SEQ ID NO: 631825 - RNA, 65 nt, hsa
ucuggcuccugccaccacaaauguuacccucauuggcuugaaaagcauccaagggugcacaggga

SEQ ID NO: 631826 - RNA, 65 nt, hsa
aaacugaauugagaaauacuucuucaaguuaugaugcuugaaaguucucaauaaaguucacgguu

SEQ ID NO: 631827 - RNA, 65 nt, hsa
uguaaauuuacacuauuuauaaauacauauuuauugcuugaaaauauuugugaauggaaugcugu

SEQ ID NO: 631828 - RNA, 65 nt, hsa
agcauauagcuauagauauaggcuuuuccuugaaagcuugaaaaaaauucgccaguaaaauaauc

SEQ ID NO: 631829 - RNA, 65 nt, hsa
ugugaaaccaauaugguuuucuuuaugucuuggcugcuugaaaauuaaaaaaaaaaaagguuugu

SEQ ID NO: 631830 - RNA, 65 nt, hsa
cucccaaaggaucuguacuuucuuuccuuacaacagcuugaaaaucauuauuuuaaaauccuuaa

SEQ ID NO: 631831 - RNA, 65 nt, hsa
gaaauuuguuauguuuaaggaaauuaagauuuuaagcuugaaauuauacaagcagaaucuaauuu

SEQ ID NO: 631832 - RNA, 65 nt, hsa
uugugcuaccaguuugcugguggcuaacggcuugugcuugaaagucuucugaagucugaugugaa

SEQ ID NO: 631833 - RNA, 65 nt, hsa
uugcaugcauguugaaauuuuuuagcaguacuuuagcuugaaaguacucguacaaauacuguuag

SEQ ID NO: 631834 - RNA, 65 nt, hsa
ccuagaaguaaugauauacaguuuucuuccuaguggcuugaaaaucuggacuuccucaauuauua

SEQ ID NO: 631835 - RNA, 65 nt, hsa
uucaccauucuucuuuuguaauaaauuuugaaugugcuugaaagugaaaagcaaucaauuauacc

SEQ ID NO: 631836 - RNA, 65 nt, hsa
gcuugguacuuggaauugauauauaccuuauuaaagcuugaaaacauuuagcauuugaauaguaa

SEQ ID NO: 631837 - RNA, 65 nt, hsa
auaguaaauaaaacaguguauuuugaaguuugacugcuugaaaaagauuagcauacaucuaaugu

SEQ ID NO: 631838 - RNA, 65 nt, hsa
gaaacugucagaauuguuaacugaaacaaauauuugcuugaaaaaaaaaguucaugaaguaccaa

SEQ ID NO: 631839 - RNA, 65 nt, hsa
gguuccaggauuuggauuuugauuuuccaaauguagcuugaaauuucaauaaacuuugcucuguu

SEQ ID NO: 631840 - RNA, 65 nt, hsa
uuuuaaaaucauguauuuaaugugucagauauugugcuugaaagauucucaucucagaauacuuu

SEQ ID NO: 631841 - RNA, 65 nt, hsa
gcuaugaguuacugugggguccaagggcacucgcugcuugaaaguacuggagcacguggucaggg

SEQ ID NO: 631842 - RNA, 65 nt, hsa
aacuugucgucacagcuggcaugggcuggacaguugcuugaaaugaccuaaccaaaaacauucaa

SEQ ID NO: 631843 - RNA, 65 nt, hsa
aaauucacugacgaauucagagauugagggcacuugcuugaaaucaaggugcuccaacuuaguuu

SEQ ID NO: 631844 - RNA, 64 nt, hsa; identical to SEQ ID NO: 235993

SEQ ID NO: 631845 - RNA, 64 nt, hsa; identical to SEQ ID NO: 235994

SEQ ID NO: 631846 - RNA, 64 nt, hsa; identical to SEQ ID NO: 235995

SEQ ID NO: 631847 - RNA, 64 nt, hsa; identical to SEQ ID NO: 235996

SEQ ID NO: 631848 - RNA, 64 nt, hsa; identical to SEQ ID NO: 235997

SEQ ID NO: 631849 - RNA, 64 nt, hsa; identical to SEQ ID NO: 235998

SEQ ID NO: 631850 - RNA, 64 nt, hsa; identical to SEQ ID NO: 284063

SEQ ID NO: 631851 - RNA, 64 nt, hsa; identical to SEQ ID NO: 284064

SEQ ID NO: 631852 - RNA, 64 nt, hsa; identical to SEQ ID NO: 284065

SEQ ID NO: 631853 - RNA, 64 nt, hsa; identical to SEQ ID NO: 284066

SEQ ID NO: 631854 - RNA, 64 nt, hsa; identical to SEQ ID NO: 284067

SEQ ID NO: 631855 - RNA, 64 nt, hsa; identical to SEQ ID NO: 284068

SEQ ID NO: 631856 - RNA, 64 nt, hsa; identical to SEQ ID NO: 284069

SEQ ID NO: 631857 - RNA, 64 nt, hsa; identical to SEQ ID NO: 284070

SEQ ID NO: 631858 - RNA, 64 nt, hsa; identical to SEQ ID NO: 284071

SEQ ID NO: 631859 - RNA, 64 nt, hsa; identical to SEQ ID NO: 284072

SEQ ID NO: 631860 - RNA, 57 nt, hsa; identical to SEQ ID NO: 284073

SEQ ID NO: 631861 - RNA, 64 nt, hsa; identical to SEQ ID NO: 284074

SEQ ID NO: 631862 - RNA, 64 nt, hsa; identical to SEQ ID NO: 284075

SEQ ID NO: 631863 - RNA, 64 nt, hsa; identical to SEQ ID NO: 284076

SEQ ID NO: 631864 - RNA, 64 nt, hsa; identical to SEQ ID NO: 284077

SEQ ID NO: 631865 - RNA, 64 nt, hsa; identical to SEQ ID NO: 284078

SEQ ID NO: 631866 - RNA, 64 nt, hsa; identical to SEQ ID NO: 284079

SEQ ID NO: 631867 - RNA, 64 nt, hsa; identical to SEQ ID NO: 284080

SEQ ID NO: 631868 - RNA, 64 nt, hsa; identical to SEQ ID NO: 284081

SEQ ID NO: 631869 - RNA, 64 nt, hsa; identical to SEQ ID NO: 284082

SEQ ID NO: 631870 - RNA, 64 nt, hsa; identical to SEQ ID NO: 284083

SEQ ID NO: 631871 - RNA, 64 nt, hsa; identical to SEQ ID NO: 284084

SEQ ID NO: 631872 - RNA, 64 nt, hsa; identical to SEQ ID NO: 284085

SEQ ID NO: 631873 - RNA, 64 nt, hsa; identical to SEQ ID NO: 284086

SEQ ID NO: 631874 - RNA, 64 nt, hsa; identical to SEQ ID NO: 284087

SEQ ID NO: 631875 - RNA, 64 nt, hsa; identical to SEQ ID NO: 284088

SEQ ID NO: 631876 - RNA, 64 nt, hsa; identical to SEQ ID NO: 284089

SEQ ID NO: 631877 - RNA, 64 nt, hsa; identical to SEQ ID NO: 284090

SEQ ID NO: 631878 - RNA, 55 nt, hsa; identical to SEQ ID NO: 284091

SEQ ID NO: 631879 - RNA, 64 nt, hsa; identical to SEQ ID NO: 284092

SEQ ID NO: 631880 - RNA, 64 nt, hsa; identical to SEQ ID NO: 284093

SEQ ID NO: 631881 - RNA, 64 nt, hsa; identical to SEQ ID NO: 284094

SEQ ID NO: 631882 - RNA, 64 nt, hsa; identical to SEQ ID NO: 284095

SEQ ID NO: 631883 - RNA, 64 nt, hsa; identical to SEQ ID NO: 284096

SEQ ID NO: 631884 - RNA, 64 nt, hsa; identical to SEQ ID NO: 284097

SEQ ID NO: 631885 - RNA, 64 nt, hsa; identical to SEQ ID NO: 284098

SEQ ID NO: 631886 - RNA, 64 nt, hsa; identical to SEQ ID NO: 284099

SEQ ID NO: 631887 - RNA, 64 nt, hsa; identical to SEQ ID NO: 284100

SEQ ID NO: 631888 - RNA, 64 nt, hsa; identical to SEQ ID NO: 284101

SEQ ID NO: 631889 - RNA, 64 nt, hsa; identical to SEQ ID NO: 284102

SEQ ID NO: 631890 - RNA, 64 nt, hsa; identical to SEQ ID NO: 284103

SEQ ID NO: 631891 - RNA, 64 nt, hsa; identical to SEQ ID NO: 284104

SEQ ID NO: 631892 - RNA, 64 nt, hsa; identical to SEQ ID NO: 284105

SEQ ID NO: 631893 - RNA, 64 nt, hsa; identical to SEQ ID NO: 284106

SEQ ID NO: 631894 - RNA, 64 nt, hsa; identical to SEQ ID NO: 284107

SEQ ID NO: 631895 - RNA, 64 nt, hsa; identical to SEQ ID NO: 284108

SEQ ID NO: 631896 - RNA, 64 nt, hsa; identical to SEQ ID NO: 284109

SEQ ID NO: 631897 - RNA, 64 nt, hsa; identical to SEQ ID NO: 284110

SEQ ID NO: 631898 - RNA, 64 nt, hsa; identical to SEQ ID NO: 284111

SEQ ID NO: 631899 - RNA, 64 nt, hsa; identical to SEQ ID NO: 284112

SEQ ID NO: 631900 - RNA, 64 nt, hsa; identical to SEQ ID NO: 284113

SEQ ID NO: 631901 - RNA, 64 nt, hsa; identical to SEQ ID NO: 284114

SEQ ID NO: 631902 - RNA, 64 nt, hsa; identical to SEQ ID NO: 284115

SEQ ID NO: 631903 - RNA, 64 nt, hsa; identical to SEQ ID NO: 284116

SEQ ID NO: 631904 - RNA, 64 nt, hsa; identical to SEQ ID NO: 284117

SEQ ID NO: 631905 - RNA, 64 nt, hsa; identical to SEQ ID NO: 284118

SEQ ID NO: 631906 - RNA, 64 nt, hsa; identical to SEQ ID NO: 284119

SEQ ID NO: 631907 - RNA, 64 nt, hsa; identical to SEQ ID NO: 284120

SEQ ID NO: 631908 - RNA, 64 nt, hsa; identical to SEQ ID NO: 284121

SEQ ID NO: 631909 - RNA, 64 nt, hsa; identical to SEQ ID NO: 284122

SEQ ID NO: 631910 - RNA, 64 nt, hsa; identical to SEQ ID NO: 284123

SEQ ID NO: 631911 - RNA, 64 nt, hsa; identical to SEQ ID NO: 284124

SEQ ID NO: 631912 - RNA, 64 nt, hsa; identical to SEQ ID NO: 284125

SEQ ID NO: 631913 - RNA, 64 nt, hsa; identical to SEQ ID NO: 284126

SEQ ID NO: 631914 - RNA, 64 nt, hsa; identical to SEQ ID NO: 284127

SEQ ID NO: 631915 - RNA, 64 nt, hsa; identical to SEQ ID NO: 284128

SEQ ID NO: 631916 - RNA, 64 nt, hsa; identical to SEQ ID NO: 284129

SEQ ID NO: 631917 - RNA, 64 nt, hsa; identical to SEQ ID NO: 284130

SEQ ID NO: 631918 - RNA, 64 nt, hsa; identical to SEQ ID NO: 175619

SEQ ID NO: 631919 - RNA, 64 nt, hsa; identical to SEQ ID NO: 175620

SEQ ID NO: 631920 - RNA, 64 nt, hsa; identical to SEQ ID NO: 175621

SEQ ID NO: 631921 - RNA, 64 nt, hsa; identical to SEQ ID NO: 175622

SEQ ID NO: 631922 - RNA, 64 nt, hsa; identical to SEQ ID NO: 175623

SEQ ID NO: 631923 - RNA, 64 nt, hsa; identical to SEQ ID NO: 175624

SEQ ID NO: 631924 - RNA, 64 nt, hsa; identical to SEQ ID NO: 175625

SEQ ID NO: 631925 - RNA, 64 nt, hsa; identical to SEQ ID NO: 175626

SEQ ID NO: 631926 - RNA, 64 nt, hsa; identical to SEQ ID NO: 175627

SEQ ID NO: 631927 - RNA, 64 nt, hsa; identical to SEQ ID NO: 175628

SEQ ID NO: 631928 - RNA, 64 nt, hsa; identical to SEQ ID NO: 175629

SEQ ID NO: 631929 - RNA, 64 nt, hsa; identical to SEQ ID NO: 175630

SEQ ID NO: 631930 - RNA, 64 nt, hsa; identical to SEQ ID NO: 175631

SEQ ID NO: 631931 - RNA, 64 nt, hsa; identical to SEQ ID NO: 175632

SEQ ID NO: 631932 - RNA, 64 nt, hsa; identical to SEQ ID NO: 61495

SEQ ID NO: 631933 - RNA, 64 nt, hsa; identical to SEQ ID NO: 61496

SEQ ID NO: 631934 - RNA, 64 nt, hsa; identical to SEQ ID NO: 61497

SEQ ID NO: 631935 - RNA, 64 nt, hsa; identical to SEQ ID NO: 61498

SEQ ID NO: 631936 - RNA, 64 nt, hsa; identical to SEQ ID NO: 61499

SEQ ID NO: 631937 - RNA, 64 nt, hsa; identical to SEQ ID NO: 61500

SEQ ID NO: 631938 - RNA, 64 nt, hsa; identical to SEQ ID NO: 61501

SEQ ID NO: 631939 - RNA, 64 nt, hsa; identical to SEQ ID NO: 61502

SEQ ID NO: 631940 - RNA, 64 nt, hsa; identical to SEQ ID NO: 61503

SEQ ID NO: 631941 - RNA, 64 nt, hsa; identical to SEQ ID NO: 61504

SEQ ID NO: 631942 - RNA, 64 nt, hsa; identical to SEQ ID NO: 61505

SEQ ID NO: 631943 - RNA, 64 nt, hsa; identical to SEQ ID NO: 61506

SEQ ID NO: 631944 - RNA, 64 nt, hsa; identical to SEQ ID NO: 61507

SEQ ID NO: 631945 - RNA, 64 nt, hsa; identical to SEQ ID NO: 61508

SEQ ID NO: 631946 - RNA, 64 nt, hsa; identical to SEQ ID NO: 61509

SEQ ID NO: 631947 - RNA, 64 nt, hsa; identical to SEQ ID NO: 61510

SEQ ID NO: 631948 - RNA, 64 nt, hsa; identical to SEQ ID NO: 61511

SEQ ID NO: 631949 - RNA, 64 nt, hsa; identical to SEQ ID NO: 61512

SEQ ID NO: 631950 - RNA, 64 nt, hsa; identical to SEQ ID NO: 61513

SEQ ID NO: 631951 - RNA, 64 nt, hsa; identical to SEQ ID NO: 61514

SEQ ID NO: 631952 - RNA, 64 nt, hsa; identical to SEQ ID NO: 61515

SEQ ID NO: 631953 - RNA, 64 nt, hsa; identical to SEQ ID NO: 61516

SEQ ID NO: 631954 - RNA, 64 nt, hsa; identical to SEQ ID NO: 61517

SEQ ID NO: 631955 - RNA, 64 nt, hsa; identical to SEQ ID NO: 175619

SEQ ID NO: 631956 - RNA, 64 nt, hsa; identical to SEQ ID NO: 175620

SEQ ID NO: 631957 - RNA, 64 nt, hsa; identical to SEQ ID NO: 175621

SEQ ID NO: 631958 - RNA, 64 nt, hsa; identical to SEQ ID NO: 175622

SEQ ID NO: 631959 - RNA, 64 nt, hsa; identical to SEQ ID NO: 175623

SEQ ID NO: 631960 - RNA, 64 nt, hsa; identical to SEQ ID NO: 175624

SEQ ID NO: 631961 - RNA, 64 nt, hsa; identical to SEQ ID NO: 175625

SEQ ID NO: 631962 - RNA, 64 nt, hsa; identical to SEQ ID NO: 175626

SEQ ID NO: 631963 - RNA, 64 nt, hsa; identical to SEQ ID NO: 175627

SEQ ID NO: 631964 - RNA, 64 nt, hsa; identical to SEQ ID NO: 175628

SEQ ID NO: 631965 - RNA, 64 nt, hsa; identical to SEQ ID NO: 175629

SEQ ID NO: 631966 - RNA, 64 nt, hsa; identical to SEQ ID NO: 175630

SEQ ID NO: 631967 - RNA, 64 nt, hsa; identical to SEQ ID NO: 175631

SEQ ID NO: 631968 - RNA, 64 nt, hsa; identical to SEQ ID NO: 175632

SEQ ID NO: 631969 - RNA, 64 nt, hsa; identical to SEQ ID NO: 61495

SEQ ID NO: 631970 - RNA, 64 nt, hsa; identical to SEQ ID NO: 61496

SEQ ID NO: 631971 - RNA, 64 nt, hsa; identical to SEQ ID NO: 61497

SEQ ID NO: 631972 - RNA, 64 nt, hsa; identical to SEQ ID NO: 61498

SEQ ID NO: 631973 - RNA, 64 nt, hsa; identical to SEQ ID NO: 61499

SEQ ID NO: 631974 - RNA, 64 nt, hsa; identical to SEQ ID NO: 61500

SEQ ID NO: 631975 - RNA, 64 nt, hsa; identical to SEQ ID NO: 61501

SEQ ID NO: 631976 - RNA, 64 nt, hsa; identical to SEQ ID NO: 61502

SEQ ID NO: 631977 - RNA, 64 nt, hsa; identical to SEQ ID NO: 61503

SEQ ID NO: 631978 - RNA, 64 nt, hsa; identical to SEQ ID NO: 61504

SEQ ID NO: 631979 - RNA, 64 nt, hsa; identical to SEQ ID NO: 61505

SEQ ID NO: 631980 - RNA, 64 nt, hsa; identical to SEQ ID NO: 61506

SEQ ID NO: 631981 - RNA, 64 nt, hsa; identical to SEQ ID NO: 61507

SEQ ID NO: 631982 - RNA, 64 nt, hsa; identical to SEQ ID NO: 61508

SEQ ID NO: 631983 - RNA, 64 nt, hsa; identical to SEQ ID NO: 61509

SEQ ID NO: 631984 - RNA, 64 nt, hsa; identical to SEQ ID NO: 61510

SEQ ID NO: 631985 - RNA, 64 nt, hsa; identical to SEQ ID NO: 61511

SEQ ID NO: 631986 - RNA, 64 nt, hsa; identical to SEQ ID NO: 61512

SEQ ID NO: 631987 - RNA, 64 nt, hsa; identical to SEQ ID NO: 61513

SEQ ID NO: 631988 - RNA, 64 nt, hsa; identical to SEQ ID NO: 61514

SEQ ID NO: 631989 - RNA, 64 nt, hsa; identical to SEQ ID NO: 61515

SEQ ID NO: 631990 - RNA, 64 nt, hsa; identical to SEQ ID NO: 61516

SEQ ID NO: 631991 - RNA, 64 nt, hsa; identical to SEQ ID NO: 61517

SEQ ID NO: 631992 - RNA, 63 nt, hsa; identical to SEQ ID NO: 118067

SEQ ID NO: 631993 - RNA, 64 nt, hsa; identical to SEQ ID NO: 118068

SEQ ID NO: 631994 - RNA, 64 nt, hsa; identical to SEQ ID NO: 118069

SEQ ID NO: 631995 - RNA, 64 nt, hsa; identical to SEQ ID NO: 118070

SEQ ID NO: 631996 - RNA, 64 nt, hsa; identical to SEQ ID NO: 118071

SEQ ID NO: 631997 - RNA, 64 nt, hsa; identical to SEQ ID NO: 118072

SEQ ID NO: 631998 - RNA, 64 nt, hsa; identical to SEQ ID NO: 118073

SEQ ID NO: 631999 - RNA, 64 nt, hsa; identical to SEQ ID NO: 118074

SEQ ID NO: 632000 - RNA, 64 nt, hsa; identical to SEQ ID NO: 118075

SEQ ID NO: 632001 - RNA, 64 nt, hsa; identical to SEQ ID NO: 118076

SEQ ID NO: 632002 - RNA, 64 nt, hsa; identical to SEQ ID NO: 118077

SEQ ID NO: 632003 - RNA, 64 nt, hsa; identical to SEQ ID NO: 118078

SEQ ID NO: 632004 - RNA, 64 nt, hsa; identical to SEQ ID NO: 118079

SEQ ID NO: 632005 - RNA, 64 nt, hsa; identical to SEQ ID NO: 118080

SEQ ID NO: 632006 - RNA, 64 nt, hsa; identical to SEQ ID NO: 118081

SEQ ID NO: 632007 - RNA, 64 nt, hsa; identical to SEQ ID NO: 118082

SEQ ID NO: 632008 - RNA, 64 nt, hsa; identical to SEQ ID NO: 118083

SEQ ID NO: 632009 - RNA, 64 nt, hsa; identical to SEQ ID NO: 118084

SEQ ID NO: 632010 - RNA, 64 nt, hsa; identical to SEQ ID NO: 118085

SEQ ID NO: 632011 - RNA, 64 nt, hsa; identical to SEQ ID NO: 118086

SEQ ID NO: 632012 - RNA, 64 nt, hsa; identical to SEQ ID NO: 118087

SEQ ID NO: 632013 - RNA, 64 nt, hsa; identical to SEQ ID NO: 118088

SEQ ID NO: 632014 - RNA, 64 nt, hsa; identical to SEQ ID NO: 118089

SEQ ID NO: 632015 - RNA, 64 nt, hsa; identical to SEQ ID NO: 118090

SEQ ID NO: 632016 - RNA, 64 nt, hsa; identical to SEQ ID NO: 118091

SEQ ID NO: 632017 - RNA, 64 nt, hsa; identical to SEQ ID NO: 118092

SEQ ID NO: 632018 - RNA, 64 nt, hsa; identical to SEQ ID NO: 118093

SEQ ID NO: 632019 - RNA, 64 nt, hsa; identical to SEQ ID NO: 118094

SEQ ID NO: 632020 - RNA, 64 nt, hsa; identical to SEQ ID NO: 118095

SEQ ID NO: 632021 - RNA, 64 nt, hsa; identical to SEQ ID NO: 118096

SEQ ID NO: 632022 - RNA, 64 nt, hsa; identical to SEQ ID NO: 118097

SEQ ID NO: 632023 - RNA, 64 nt, hsa; identical to SEQ ID NO: 118098

SEQ ID NO: 632024 - RNA, 64 nt, hsa; identical to SEQ ID NO: 118099

SEQ ID NO: 632025 - RNA, 64 nt, hsa; identical to SEQ ID NO: 118100

SEQ ID NO: 632026 - RNA, 64 nt, hsa; identical to SEQ ID NO: 118101

SEQ ID NO: 632027 - RNA, 64 nt, hsa; identical to SEQ ID NO: 118102

SEQ ID NO: 632028 - RNA, 64 nt, hsa; identical to SEQ ID NO: 118103

SEQ ID NO: 632029 - RNA, 64 nt, hsa; identical to SEQ ID NO: 118104

SEQ ID NO: 632030 - RNA, 64 nt, hsa; identical to SEQ ID NO: 118105

SEQ ID NO: 632031 - RNA, 64 nt, hsa; identical to SEQ ID NO: 118106

SEQ ID NO: 632032 - RNA, 64 nt, hsa; identical to SEQ ID NO: 118107

SEQ ID NO: 632033 - RNA, 64 nt, hsa; identical to SEQ ID NO: 118108

SEQ ID NO: 632034 - RNA, 64 nt, hsa; identical to SEQ ID NO: 118109

SEQ ID NO: 632035 - RNA, 64 nt, hsa; identical to SEQ ID NO: 118110

SEQ ID NO: 632036 - RNA, 64 nt, hsa; identical to SEQ ID NO: 118111

SEQ ID NO: 632037 - RNA, 64 nt, hsa; identical to SEQ ID NO: 118112

SEQ ID NO: 632038 - RNA, 64 nt, hsa; identical to SEQ ID NO: 118113

SEQ ID NO: 632039 - RNA, 64 nt, hsa; identical to SEQ ID NO: 118114

SEQ ID NO: 632040 - RNA, 64 nt, hsa; identical to SEQ ID NO: 118115

SEQ ID NO: 632041 - RNA, 64 nt, hsa; identical to SEQ ID NO: 118116

SEQ ID NO: 632042 - RNA, 64 nt, hsa; identical to SEQ ID NO: 118117

SEQ ID NO: 632043 - RNA, 64 nt, hsa; identical to SEQ ID NO: 118118

SEQ ID NO: 632044 - RNA, 64 nt, hsa; identical to SEQ ID NO: 118119

SEQ ID NO: 632045 - RNA, 64 nt, hsa; identical to SEQ ID NO: 118120

SEQ ID NO: 632046 - RNA, 64 nt, hsa; identical to SEQ ID NO: 118121

SEQ ID NO: 632047 - RNA, 64 nt, hsa
acacacacacacacacacacacacacacacacacacacacaagaccugggcccuuaaguuuaca

SEQ ID NO: 632048 - RNA, 64 nt, hsa
ugugugugugugugugugugucucccucucucacacacacaagagcaguuugcuguugcuguuu

SEQ ID NO: 632049 - RNA, 64 nt, hsa
uauccauagguuucucucccuccuucuccuucucacacacaacuguccauacuaacaaguuugg

SEQ ID NO: 632050 - RNA, 64 nt, hsa
cuguaauggguacaaugaagaaguuucuaaaaacacacacaaagcacauugggccaacuauuua

SEQ ID NO: 632051 - RNA, 64 nt, hsa
ggccaccaacacacaaccacacacacacaaccacacacacaaaugggggcaaccacauccagua

SEQ ID NO: 632052 - RNA, 64 nt, hsa
aggcucagcuguggccaccaacacacaaccacacacacacaaccacacacacaaaugggggcaa

SEQ ID NO: 632053 - RNA, 64 nt, hsa
uucucuggugacagaggcucagcuguggccaccaacacacaaccacacacacacaaccacacac

SEQ ID NO: 632054 - RNA, 64 nt, hsa
ucgaaaaugcaaacuuggggagggcggaaacaucacacacaagguuuccacuucacacuuggag

SEQ ID NO: 632055 - RNA, 64 nt, hsa
uuucuaaggauaccagaaaggaaauggcaugcacacacacaaaaaauaccuaaauuuuggauga

SEQ ID NO: 632056 - RNA, 64 nt, hsa
guucaaguccugccucuuaaauaaaccuuuuuggacacacaaauuaucuuaaaacuccuguuuc

SEQ ID NO: 632057 - RNA, 64 nt, hsa
ucaaccucuguauuugaaucagccuacaggccucacacacaaugugucugagagauucaugcug

SEQ ID NO: 632058 - RNA, 64 nt, hsa
acacacgcagacacacacacacacacaaaugcagacacacaacaucaagaaaacagcaagggag

SEQ ID NO: 632059 - RNA, 64 nt, hsa
gugauggaacacacacacacgcagacacacacacacacacaaaugcagacacacaacaucaaga

SEQ ID NO: 632060 - RNA, 64 nt, hsa
ucauuuggagauguaugguguaaaacacacaaacacacacaaaaaagcacaagcccgcugcaug

SEQ ID NO: 632061 - RNA, 64 nt, hsa
aauaaauacuucauuuggagauguaugguguaaaacacacaaacacacacaaaaaagcacaagc

SEQ ID NO: 632062 - RNA, 64 nt, hsa
cacacacacacacacacacacacacaaaauaaagacacacaaggacgucugcgcagcaagaaaa

SEQ ID NO: 632063 - RNA, 64 nt, hsa
ccuaucccagcaaaacacacacacacacacacacacacacaaaauaaagacacacaaggacguc

SEQ ID NO: 632064 - RNA, 64 nt, hsa
auacacacacacccacacacacaaacacacacacacacacaauuuucacgauguauggucagga

SEQ ID NO: 632065 - RNA, 64 nt, hsa
accagcauauacauggacauacacacacacccacacacacaaacacacacacacacacaauuuu

SEQ ID NO: 632066 - RNA, 64 nt, hsa
aaauacguaauaaagaauacauauauauauaucuacacacaaauuauauaucuaucuaucuaua

SEQ ID NO: 632067 - RNA, 64 nt, hsa
uuuuaagggggggaaagguuucaaauggggaaaaacacacaaaaaaaaaaaucacuaaaaauuc

SEQ ID NO: 632068 - RNA, 64 nt, hsa
cuucuccaucucacccucccucucucacacauacacacacaaacacauacacacaacacuaagu

SEQ ID NO: 632069 - RNA, 64 nt, hsa
ccucccucucucacacauacacacacaaacacauacacacaacacuaagugccuagacuuuaaa

SEQ ID NO: 632070 - RNA, 64 nt, hsa
cagcacaugcacacaggugcacagaccacacagcacacacaagugcacagagcacacugcacac

SEQ ID NO: 632071 - RNA, 64 nt, hsa
aagugcacagaccacacacagcacuaacacaugcacacacaaagugcauaggccacacagcaca

SEQ ID NO: 632072 - RNA, 64 nt, hsa
gaguugagcuuuaacagccauggcaauuacacacacacacaaacauacacucacacacacaauu

SEQ ID NO: 632073 - RNA, 64 nt, hsa
uggcaauuacacacacacacaaacauacacucacacacacaauuacuauguauaacauauauga

SEQ ID NO: 632074 - RNA, 64 nt, hsa
aggaacuacaagagagucggagaugaugcagcacacacacaauuccccagcccagugaugcuug

SEQ ID NO: 632075 - RNA, 64 nt, hsa
aaagcagcagacaacacacuguagagucuugcacacacacaagugcccaggcaaggugcuuggc

SEQ ID NO: 632076 - RNA, 64 nt, hsa; identical to SEQ ID NO: 91262

SEQ ID NO: 632077 - RNA, 64 nt, hsa; identical to SEQ ID NO: 91263

SEQ ID NO: 632078 - RNA, 64 nt, hsa; identical to SEQ ID NO: 91264

SEQ ID NO: 632079 - RNA, 64 nt, hsa; identical to SEQ ID NO: 91265

SEQ ID NO: 632080 - RNA, 64 nt, hsa; identical to SEQ ID NO: 91266

SEQ ID NO: 632081 - RNA, 64 nt, hsa; identical to SEQ ID NO: 91267

SEQ ID NO: 632082 - RNA, 64 nt, hsa; identical to SEQ ID NO: 91268

SEQ ID NO: 632083 - RNA, 64 nt, hsa; identical to SEQ ID NO: 91269

SEQ ID NO: 632084 - RNA, 64 nt, hsa; identical to SEQ ID NO: 91270

SEQ ID NO: 632085 - RNA, 64 nt, hsa; identical to SEQ ID NO: 91271

SEQ ID NO: 632086 - RNA, 64 nt, hsa; identical to SEQ ID NO: 91272

SEQ ID NO: 632087 - RNA, 64 nt, hsa; identical to SEQ ID NO: 91273

SEQ ID NO: 632088 - RNA, 64 nt, hsa; identical to SEQ ID NO: 91274

SEQ ID NO: 632089 - RNA, 64 nt, hsa; identical to SEQ ID NO: 91275

SEQ ID NO: 632090 - RNA, 64 nt, hsa; identical to SEQ ID NO: 91276

SEQ ID NO: 632091 - RNA, 64 nt, hsa; identical to SEQ ID NO: 91277

SEQ ID NO: 632092 - RNA, 64 nt, hsa; identical to SEQ ID NO: 91278

SEQ ID NO: 632093 - RNA, 64 nt, hsa; identical to SEQ ID NO: 91279

SEQ ID NO: 632094 - RNA, 64 nt, hsa; identical to SEQ ID NO: 91280

SEQ ID NO: 632095 - RNA, 64 nt, hsa; identical to SEQ ID NO: 91281

SEQ ID NO: 632096 - RNA, 64 nt, hsa; identical to SEQ ID NO: 91282

SEQ ID NO: 632097 - RNA, 64 nt, hsa; identical to SEQ ID NO: 91283

SEQ ID NO: 632098 - RNA, 64 nt, hsa; identical to SEQ ID NO: 91284

SEQ ID NO: 632099 - RNA, 64 nt, hsa; identical to SEQ ID NO: 91285

SEQ ID NO: 632100 - RNA, 64 nt, hsa; identical to SEQ ID NO: 91286

SEQ ID NO: 632101 - RNA, 64 nt, hsa; identical to SEQ ID NO: 91287

SEQ ID NO: 632102 - RNA, 64 nt, hsa; identical to SEQ ID NO: 91288

SEQ ID NO: 632103 - RNA, 64 nt, hsa; identical to SEQ ID NO: 91289

SEQ ID NO: 632104 - RNA, 64 nt, hsa; identical to SEQ ID NO: 91290

SEQ ID NO: 632105 - RNA, 64 nt, hsa; identical to SEQ ID NO: 91291

SEQ ID NO: 632106 - RNA, 64 nt, hsa; identical to SEQ ID NO: 91292

SEQ ID NO: 632107 - RNA, 64 nt, hsa; identical to SEQ ID NO: 91293

SEQ ID NO: 632108 - RNA, 64 nt, hsa; identical to SEQ ID NO: 91294

SEQ ID NO: 632109 - RNA, 64 nt, hsa; identical to SEQ ID NO: 91295

SEQ ID NO: 632110 - RNA, 64 nt, hsa; identical to SEQ ID NO: 91296

SEQ ID NO: 632111 - RNA, 64 nt, hsa; identical to SEQ ID NO: 91297

SEQ ID NO: 632112 - RNA, 64 nt, hsa; identical to SEQ ID NO: 91298

SEQ ID NO: 632113 - RNA, 64 nt, hsa; identical to SEQ ID NO: 91299

SEQ ID NO: 632114 - RNA, 64 nt, hsa; identical to SEQ ID NO: 91300

SEQ ID NO: 632115 - RNA, 64 nt, hsa; identical to SEQ ID NO: 91301

SEQ ID NO: 632116 - RNA, 64 nt, hsa; identical to SEQ ID NO: 91302

SEQ ID NO: 632117 - RNA, 64 nt, hsa; identical to SEQ ID NO: 91303

SEQ ID NO: 632118 - RNA, 64 nt, hsa; identical to SEQ ID NO: 91304

SEQ ID NO: 632119 - RNA, 64 nt, hsa; identical to SEQ ID NO: 91305

SEQ ID NO: 632120 - RNA, 64 nt, hsa; identical to SEQ ID NO: 91306

SEQ ID NO: 632121 - RNA, 64 nt, hsa; identical to SEQ ID NO: 91307

SEQ ID NO: 632122 - RNA, 64 nt, hsa; identical to SEQ ID NO: 91308

SEQ ID NO: 632123 - RNA, 64 nt, hsa; identical to SEQ ID NO: 91309

SEQ ID NO: 632124 - RNA, 64 nt, hsa; identical to SEQ ID NO: 91310

SEQ ID NO: 632125 - RNA, 64 nt, hsa; identical to SEQ ID NO: 91311

SEQ ID NO: 632126 - RNA, 64 nt, hsa; identical to SEQ ID NO: 91312

SEQ ID NO: 632127 - RNA, 64 nt, hsa; identical to SEQ ID NO: 91313

SEQ ID NO: 632128 - RNA, 64 nt, hsa; identical to SEQ ID NO: 91314

SEQ ID NO: 632129 - RNA, 64 nt, hsa; identical to SEQ ID NO: 91315

SEQ ID NO: 632130 - RNA, 64 nt, hsa; identical to SEQ ID NO: 91316

SEQ ID NO: 632131 - RNA, 64 nt, hsa; identical to SEQ ID NO: 91317

SEQ ID NO: 632132 - RNA, 64 nt, hsa; identical to SEQ ID NO: 91318

SEQ ID NO: 632133 - RNA, 64 nt, hsa; identical to SEQ ID NO: 91319

SEQ ID NO: 632134 - RNA, 64 nt, hsa; identical to SEQ ID NO: 91320

SEQ ID NO: 632135 - RNA, 64 nt, hsa; identical to SEQ ID NO: 91321

SEQ ID NO: 632136 - RNA, 64 nt, hsa; identical to SEQ ID NO: 91322

SEQ ID NO: 632137 - RNA, 64 nt, hsa; identical to SEQ ID NO: 91323

SEQ ID NO: 632138 - RNA, 64 nt, hsa; identical to SEQ ID NO: 91324

SEQ ID NO: 632139 - RNA, 64 nt, hsa; identical to SEQ ID NO: 91325

SEQ ID NO: 632140 - RNA, 64 nt, hsa; identical to SEQ ID NO: 91326

SEQ ID NO: 632141 - RNA, 64 nt, hsa; identical to SEQ ID NO: 91327

SEQ ID NO: 632142 - RNA, 64 nt, hsa; identical to SEQ ID NO: 91328

SEQ ID NO: 632143 - RNA, 64 nt, hsa; identical to SEQ ID NO: 91329

SEQ ID NO: 632144 - RNA, 64 nt, hsa; identical to SEQ ID NO: 91330

SEQ ID NO: 632145 - RNA, 64 nt, hsa; identical to SEQ ID NO: 91331

SEQ ID NO: 632146 - RNA, 64 nt, hsa; identical to SEQ ID NO: 91332

SEQ ID NO: 632147 - RNA, 64 nt, hsa; identical to SEQ ID NO: 91333

SEQ ID NO: 632148 - RNA, 64 nt, hsa; identical to SEQ ID NO: 91334

SEQ ID NO: 632149 - RNA, 64 nt, hsa; identical to SEQ ID NO: 91335

SEQ ID NO: 632150 - RNA, 64 nt, hsa; identical to SEQ ID NO: 91336

SEQ ID NO: 632151 - RNA, 64 nt, hsa; identical to SEQ ID NO: 91337

SEQ ID NO: 632152 - RNA, 64 nt, hsa; identical to SEQ ID NO: 91338

SEQ ID NO: 632153 - RNA, 64 nt, hsa; identical to SEQ ID NO: 91339

SEQ ID NO: 632154 - RNA, 64 nt, hsa; identical to SEQ ID NO: 91340

SEQ ID NO: 632155 - RNA, 64 nt, hsa; identical to SEQ ID NO: 91341

SEQ ID NO: 632156 - RNA, 64 nt, hsa; identical to SEQ ID NO: 91342

SEQ ID NO: 632157 - RNA, 64 nt, hsa; identical to SEQ ID NO: 91343

SEQ ID NO: 632158 - RNA, 64 nt, hsa; identical to SEQ ID NO: 91344

SEQ ID NO: 632159 - RNA, 64 nt, hsa; identical to SEQ ID NO: 91345

SEQ ID NO: 632160 - RNA, 64 nt, hsa; identical to SEQ ID NO: 91346

SEQ ID NO: 632161 - RNA, 64 nt, hsa; identical to SEQ ID NO: 91347

SEQ ID NO: 632162 - RNA, 64 nt, hsa; identical to SEQ ID NO: 91348

SEQ ID NO: 632163 - RNA, 64 nt, hsa; identical to SEQ ID NO: 91349

SEQ ID NO: 632164 - RNA, 64 nt, hsa; identical to SEQ ID NO: 91350

SEQ ID NO: 632165 - RNA, 64 nt, hsa; identical to SEQ ID NO: 91351

SEQ ID NO: 632166 - RNA, 64 nt, hsa; identical to SEQ ID NO: 91352

SEQ ID NO: 632167 - RNA, 64 nt, hsa; identical to SEQ ID NO: 91353

SEQ ID NO: 632168 - RNA, 54 nt, hsa; identical to SEQ ID NO: 91354

SEQ ID NO: 632169 - RNA, 64 nt, hsa; identical to SEQ ID NO: 91355

SEQ ID NO: 632170 - RNA, 64 nt, hsa; identical to SEQ ID NO: 91356

SEQ ID NO: 632171 - RNA, 64 nt, hsa; identical to SEQ ID NO: 91357

SEQ ID NO: 632172 - RNA, 64 nt, hsa; identical to SEQ ID NO: 91358

SEQ ID NO: 632173 - RNA, 64 nt, hsa; identical to SEQ ID NO: 91359

SEQ ID NO: 632174 - RNA, 64 nt, hsa; identical to SEQ ID NO: 91360

SEQ ID NO: 632175 - RNA, 64 nt, hsa; identical to SEQ ID NO: 91361

SEQ ID NO: 632176 - RNA, 64 nt, hsa; identical to SEQ ID NO: 91362

SEQ ID NO: 632177 - RNA, 64 nt, hsa; identical to SEQ ID NO: 91363

SEQ ID NO: 632178 - RNA, 64 nt, hsa; identical to SEQ ID NO: 91364

SEQ ID NO: 632179 - RNA, 64 nt, hsa; identical to SEQ ID NO: 91365

SEQ ID NO: 632180 - RNA, 64 nt, hsa; identical to SEQ ID NO: 91366

SEQ ID NO: 632181 - RNA, 64 nt, hsa; identical to SEQ ID NO: 91367

SEQ ID NO: 632182 - RNA, 64 nt, hsa; identical to SEQ ID NO: 91368

SEQ ID NO: 632183 - RNA, 64 nt, hsa; identical to SEQ ID NO: 91369

SEQ ID NO: 632184 - RNA, 64 nt, hsa; identical to SEQ ID NO: 91370

SEQ ID NO: 632185 - RNA, 64 nt, hsa; identical to SEQ ID NO: 91371

SEQ ID NO: 632186 - RNA, 64 nt, hsa; identical to SEQ ID NO: 91372

SEQ ID NO: 632187 - RNA, 64 nt, hsa; identical to SEQ ID NO: 91373

SEQ ID NO: 632188 - RNA, 64 nt, hsa; identical to SEQ ID NO: 91374

SEQ ID NO: 632189 - RNA, 64 nt, hsa; identical to SEQ ID NO: 91375

SEQ ID NO: 632190 - RNA, 64 nt, hsa; identical to SEQ ID NO: 91376

SEQ ID NO: 632191 - RNA, 64 nt, hsa; identical to SEQ ID NO: 91377

SEQ ID NO: 632192 - RNA, 64 nt, hsa; identical to SEQ ID NO: 91378

SEQ ID NO: 632193 - RNA, 64 nt, hsa; identical to SEQ ID NO: 91379

SEQ ID NO: 632194 - RNA, 64 nt, hsa; identical to SEQ ID NO: 91380

SEQ ID NO: 632195 - RNA, 64 nt, hsa; identical to SEQ ID NO: 133550

SEQ ID NO: 632196 - RNA, 64 nt, hsa; identical to SEQ ID NO: 133551

SEQ ID NO: 632197 - RNA, 64 nt, hsa; identical to SEQ ID NO: 133552

SEQ ID NO: 632198 - RNA, 64 nt, hsa; identical to SEQ ID NO: 133553

SEQ ID NO: 632199 - RNA, 64 nt, hsa; identical to SEQ ID NO: 133554

SEQ ID NO: 632200 - RNA, 64 nt, hsa; identical to SEQ ID NO: 133555

SEQ ID NO: 632201 - RNA, 64 nt, hsa; identical to SEQ ID NO: 133556

SEQ ID NO: 632202 - RNA, 64 nt, hsa; identical to SEQ ID NO: 133557

SEQ ID NO: 632203 - RNA, 64 nt, hsa; identical to SEQ ID NO: 133558

SEQ ID NO: 632204 - RNA, 64 nt, hsa; identical to SEQ ID NO: 133559

SEQ ID NO: 632205 - RNA, 64 nt, hsa; identical to SEQ ID NO: 133560

SEQ ID NO: 632206 - RNA, 64 nt, hsa; identical to SEQ ID NO: 133561

SEQ ID NO: 632207 - RNA, 64 nt, hsa; identical to SEQ ID NO: 133562

SEQ ID NO: 632208 - RNA, 64 nt, hsa; identical to SEQ ID NO: 133563

SEQ ID NO: 632209 - RNA, 64 nt, hsa; identical to SEQ ID NO: 133564

SEQ ID NO: 632210 - RNA, 64 nt, hsa; identical to SEQ ID NO: 133565

SEQ ID NO: 632211 - RNA, 64 nt, hsa; identical to SEQ ID NO: 133566

SEQ ID NO: 632212 - RNA, 64 nt, hsa; identical to SEQ ID NO: 133567

SEQ ID NO: 632213 - RNA, 64 nt, hsa; identical to SEQ ID NO: 133568

SEQ ID NO: 632214 - RNA, 64 nt, hsa; identical to SEQ ID NO: 133569

SEQ ID NO: 632215 - RNA, 64 nt, hsa; identical to SEQ ID NO: 133570

SEQ ID NO: 632216 - RNA, 64 nt, hsa; identical to SEQ ID NO: 133571

SEQ ID NO: 632217 - RNA, 64 nt, hsa; identical to SEQ ID NO: 133572

SEQ ID NO: 632218 - RNA, 64 nt, hsa; identical to SEQ ID NO: 133573

SEQ ID NO: 632219 - RNA, 64 nt, hsa; identical to SEQ ID NO: 133574

SEQ ID NO: 632220 - RNA, 64 nt, hsa; identical to SEQ ID NO: 133575

SEQ ID NO: 632221 - RNA, 64 nt, hsa; identical to SEQ ID NO: 133576

SEQ ID NO: 632222 - RNA, 64 nt, hsa; identical to SEQ ID NO: 133577

SEQ ID NO: 632223 - RNA, 64 nt, hsa; identical to SEQ ID NO: 133578

SEQ ID NO: 632224 - RNA, 64 nt, hsa; identical to SEQ ID NO: 133579

SEQ ID NO: 632225 - RNA, 64 nt, hsa; identical to SEQ ID NO: 133580

SEQ ID NO: 632226 - RNA, 64 nt, hsa; identical to SEQ ID NO: 133581

SEQ ID NO: 632227 - RNA, 64 nt, hsa; identical to SEQ ID NO: 133582

SEQ ID NO: 632228 - RNA, 64 nt, hsa; identical to SEQ ID NO: 133583

SEQ ID NO: 632229 - RNA, 64 nt, hsa; identical to SEQ ID NO: 133584

SEQ ID NO: 632230 - RNA, 64 nt, hsa; identical to SEQ ID NO: 133585

SEQ ID NO: 632231 - RNA, 64 nt, hsa; identical to SEQ ID NO: 133586

SEQ ID NO: 632232 - RNA, 64 nt, hsa; identical to SEQ ID NO: 133587

SEQ ID NO: 632233 - RNA, 64 nt, hsa; identical to SEQ ID NO: 133588

SEQ ID NO: 632234 - RNA, 64 nt, hsa; identical to SEQ ID NO: 133589

SEQ ID NO: 632235 - RNA, 64 nt, hsa; identical to SEQ ID NO: 133590

SEQ ID NO: 632236 - RNA, 64 nt, hsa; identical to SEQ ID NO: 133591

SEQ ID NO: 632237 - RNA, 64 nt, hsa; identical to SEQ ID NO: 133592

SEQ ID NO: 632238 - RNA, 64 nt, hsa; identical to SEQ ID NO: 133593

SEQ ID NO: 632239 - RNA, 64 nt, hsa; identical to SEQ ID NO: 133594

SEQ ID NO: 632240 - RNA, 64 nt, hsa; identical to SEQ ID NO: 133595

SEQ ID NO: 632241 - RNA, 64 nt, hsa; identical to SEQ ID NO: 133596

SEQ ID NO: 632242 - RNA, 64 nt, hsa; identical to SEQ ID NO: 133597

SEQ ID NO: 632243 - RNA, 64 nt, hsa; identical to SEQ ID NO: 133598

SEQ ID NO: 632244 - RNA, 64 nt, hsa; identical to SEQ ID NO: 133599

SEQ ID NO: 632245 - RNA, 64 nt, hsa; identical to SEQ ID NO: 133600

SEQ ID NO: 632246 - RNA, 64 nt, hsa; identical to SEQ ID NO: 133601

SEQ ID NO: 632247 - RNA, 64 nt, hsa; identical to SEQ ID NO: 133602

SEQ ID NO: 632248 - RNA, 64 nt, hsa; identical to SEQ ID NO: 133603

SEQ ID NO: 632249 - RNA, 64 nt, hsa; identical to SEQ ID NO: 133604

SEQ ID NO: 632250 - RNA, 64 nt, hsa; identical to SEQ ID NO: 133605

SEQ ID NO: 632251 - RNA, 64 nt, hsa; identical to SEQ ID NO: 133606

SEQ ID NO: 632252 - RNA, 64 nt, hsa; identical to SEQ ID NO: 133607

SEQ ID NO: 632253 - RNA, 64 nt, hsa; identical to SEQ ID NO: 133608

SEQ ID NO: 632254 - RNA, 64 nt, hsa; identical to SEQ ID NO: 133609

SEQ ID NO: 632255 - RNA, 64 nt, hsa; identical to SEQ ID NO: 133610

SEQ ID NO: 632256 - RNA, 52 nt, hsa; identical to SEQ ID NO: 133611

SEQ ID NO: 632257 - RNA, 55 nt, hsa; identical to SEQ ID NO: 133612

SEQ ID NO: 632258 - RNA, 64 nt, hsa; identical to SEQ ID NO: 133613

SEQ ID NO: 632259 - RNA, 64 nt, hsa; identical to SEQ ID NO: 133614

SEQ ID NO: 632260 - RNA, 64 nt, hsa; identical to SEQ ID NO: 133615

SEQ ID NO: 632261 - RNA, 64 nt, hsa; identical to SEQ ID NO: 133616

SEQ ID NO: 632262 - RNA, 64 nt, hsa; identical to SEQ ID NO: 133617

SEQ ID NO: 632263 - RNA, 64 nt, hsa; identical to SEQ ID NO: 133618

SEQ ID NO: 632264 - RNA, 64 nt, hsa; identical to SEQ ID NO: 133619

SEQ ID NO: 632265 - RNA, 64 nt, hsa; identical to SEQ ID NO: 133620

SEQ ID NO: 632266 - RNA, 64 nt, hsa; identical to SEQ ID NO: 133621

SEQ ID NO: 632267 - RNA, 64 nt, hsa; identical to SEQ ID NO: 133622

SEQ ID NO: 632268 - RNA, 64 nt, hsa; identical to SEQ ID NO: 133623

SEQ ID NO: 632269 - RNA, 64 nt, hsa; identical to SEQ ID NO: 133624

SEQ ID NO: 632270 - RNA, 64 nt, hsa; identical to SEQ ID NO: 133625

SEQ ID NO: 632271 - RNA, 64 nt, hsa; identical to SEQ ID NO: 133626

SEQ ID NO: 632272 - RNA, 64 nt, hsa; identical to SEQ ID NO: 133627

SEQ ID NO: 632273 - RNA, 64 nt, hsa; identical to SEQ ID NO: 133628

SEQ ID NO: 632274 - RNA, 64 nt, hsa; identical to SEQ ID NO: 133629

SEQ ID NO: 632275 - RNA, 64 nt, hsa; identical to SEQ ID NO: 133630

SEQ ID NO: 632276 - RNA, 64 nt, hsa; identical to SEQ ID NO: 133631

SEQ ID NO: 632277 - RNA, 64 nt, hsa; identical to SEQ ID NO: 133632

SEQ ID NO: 632278 - RNA, 64 nt, hsa; identical to SEQ ID NO: 133633

SEQ ID NO: 632279 - RNA, 64 nt, hsa; identical to SEQ ID NO: 133634

SEQ ID NO: 632280 - RNA, 64 nt, hsa; identical to SEQ ID NO: 133635

SEQ ID NO: 632281 - RNA, 64 nt, hsa; identical to SEQ ID NO: 133636

SEQ ID NO: 632282 - RNA, 64 nt, hsa; identical to SEQ ID NO: 133637

SEQ ID NO: 632283 - RNA, 64 nt, hsa; identical to SEQ ID NO: 133638

SEQ ID NO: 632284 - RNA, 63 nt, hsa; identical to SEQ ID NO: 133639

SEQ ID NO: 632285 - RNA, 51 nt, hsa; identical to SEQ ID NO: 133640

SEQ ID NO: 632286 - RNA, 64 nt, hsa; identical to SEQ ID NO: 133641

SEQ ID NO: 632287 - RNA, 64 nt, hsa; identical to SEQ ID NO: 133642

SEQ ID NO: 632288 - RNA, 64 nt, hsa; identical to SEQ ID NO: 133643

SEQ ID NO: 632289 - RNA, 64 nt, hsa; identical to SEQ ID NO: 133644

SEQ ID NO: 632290 - RNA, 64 nt, hsa; identical to SEQ ID NO: 133645

SEQ ID NO: 632291 - RNA, 64 nt, hsa; identical to SEQ ID NO: 133646

SEQ ID NO: 632292 - RNA, 64 nt, hsa; identical to SEQ ID NO: 133647

SEQ ID NO: 632293 - RNA, 64 nt, hsa; identical to SEQ ID NO: 133648

SEQ ID NO: 632294 - RNA, 64 nt, hsa; identical to SEQ ID NO: 133649

SEQ ID NO: 632295 - RNA, 64 nt, hsa; identical to SEQ ID NO: 133650

SEQ ID NO: 632296 - RNA, 64 nt, hsa; identical to SEQ ID NO: 133651

SEQ ID NO: 632297 - RNA, 64 nt, hsa; identical to SEQ ID NO: 133652

SEQ ID NO: 632298 - RNA, 64 nt, hsa; identical to SEQ ID NO: 133653

SEQ ID NO: 632299 - RNA, 64 nt, hsa; identical to SEQ ID NO: 133654

SEQ ID NO: 632300 - RNA, 64 nt, hsa; identical to SEQ ID NO: 133655

SEQ ID NO: 632301 - RNA, 64 nt, hsa; identical to SEQ ID NO: 133656

SEQ ID NO: 632302 - RNA, 64 nt, hsa; identical to SEQ ID NO: 133657

SEQ ID NO: 632303 - RNA, 64 nt, hsa; identical to SEQ ID NO: 133658

SEQ ID NO: 632304 - RNA, 64 nt, hsa; identical to SEQ ID NO: 133659

SEQ ID NO: 632305 - RNA, 64 nt, hsa; identical to SEQ ID NO: 133660

SEQ ID NO: 632306 - RNA, 64 nt, hsa; identical to SEQ ID NO: 133661

SEQ ID NO: 632307 - RNA, 64 nt, hsa; identical to SEQ ID NO: 133662

SEQ ID NO: 632308 - RNA, 64 nt, hsa; identical to SEQ ID NO: 133663

SEQ ID NO: 632309 - RNA, 64 nt, hsa; identical to SEQ ID NO: 133664

SEQ ID NO: 632310 - RNA, 64 nt, hsa; identical to SEQ ID NO: 133665

SEQ ID NO: 632311 - RNA, 64 nt, hsa; identical to SEQ ID NO: 133666

SEQ ID NO: 632312 - RNA, 64 nt, hsa; identical to SEQ ID NO: 133667

SEQ ID NO: 632313 - RNA, 64 nt, hsa; identical to SEQ ID NO: 133668

SEQ ID NO: 632314 - RNA, 64 nt, hsa; identical to SEQ ID NO: 133669

SEQ ID NO: 632315 - RNA, 64 nt, hsa; identical to SEQ ID NO: 133670

SEQ ID NO: 632316 - RNA, 64 nt, hsa; identical to SEQ ID NO: 133671

SEQ ID NO: 632317 - RNA, 64 nt, hsa; identical to SEQ ID NO: 133672

SEQ ID NO: 632318 - RNA, 64 nt, hsa; identical to SEQ ID NO: 133673

SEQ ID NO: 632319 - RNA, 64 nt, hsa; identical to SEQ ID NO: 133674

SEQ ID NO: 632320 - RNA, 64 nt, hsa; identical to SEQ ID NO: 133675

SEQ ID NO: 632321 - RNA, 64 nt, hsa; identical to SEQ ID NO: 133676

SEQ ID NO: 632322 - RNA, 50 nt, hsa; identical to SEQ ID NO: 133677

SEQ ID NO: 632323 - RNA, 64 nt, hsa; identical to SEQ ID NO: 133678

SEQ ID NO: 632324 - RNA, 64 nt, hsa; identical to SEQ ID NO: 133679

SEQ ID NO: 632325 - RNA, 64 nt, hsa; identical to SEQ ID NO: 133680

SEQ ID NO: 632326 - RNA, 64 nt, hsa; identical to SEQ ID NO: 133681

SEQ ID NO: 632327 - RNA, 64 nt, hsa; identical to SEQ ID NO: 133682

SEQ ID NO: 632328 - RNA, 64 nt, hsa; identical to SEQ ID NO: 133683

SEQ ID NO: 632329 - RNA, 64 nt, hsa; identical to SEQ ID NO: 133684

SEQ ID NO: 632330 - RNA, 64 nt, hsa; identical to SEQ ID NO: 133685

SEQ ID NO: 632331 - RNA, 64 nt, hsa; identical to SEQ ID NO: 133686

SEQ ID NO: 632332 - RNA, 64 nt, hsa; identical to SEQ ID NO: 133687

SEQ ID NO: 632333 - RNA, 64 nt, hsa; identical to SEQ ID NO: 133688

SEQ ID NO: 632334 - RNA, 64 nt, hsa; identical to SEQ ID NO: 133689

SEQ ID NO: 632335 - RNA, 64 nt, hsa; identical to SEQ ID NO: 133690

SEQ ID NO: 632336 - RNA, 64 nt, hsa; identical to SEQ ID NO: 133691

SEQ ID NO: 632337 - RNA, 64 nt, hsa; identical to SEQ ID NO: 133692

SEQ ID NO: 632338 - RNA, 64 nt, hsa; identical to SEQ ID NO: 133693

SEQ ID NO: 632339 - RNA, 64 nt, hsa; identical to SEQ ID NO: 133694

SEQ ID NO: 632340 - RNA, 64 nt, hsa; identical to SEQ ID NO: 133695

SEQ ID NO: 632341 - RNA, 64 nt, hsa; identical to SEQ ID NO: 133696

SEQ ID NO: 632342 - RNA, 64 nt, hsa; identical to SEQ ID NO: 133697

SEQ ID NO: 632343 - RNA, 64 nt, hsa; identical to SEQ ID NO: 133698

SEQ ID NO: 632344 - RNA, 64 nt, hsa; identical to SEQ ID NO: 133699

SEQ ID NO: 632345 - RNA, 64 nt, hsa; identical to SEQ ID NO: 133700

SEQ ID NO: 632346 - RNA, 64 nt, hsa; identical to SEQ ID NO: 133701

SEQ ID NO: 632347 - RNA, 64 nt, hsa; identical to SEQ ID NO: 133702

SEQ ID NO: 632348 - RNA, 64 nt, hsa; identical to SEQ ID NO: 133703

SEQ ID NO: 632349 - RNA, 64 nt, hsa; identical to SEQ ID NO: 133704

SEQ ID NO: 632350 - RNA, 64 nt, hsa; identical to SEQ ID NO: 133705

SEQ ID NO: 632351 - RNA, 64 nt, hsa; identical to SEQ ID NO: 133706

SEQ ID NO: 632352 - RNA, 64 nt, hsa; identical to SEQ ID NO: 133707

SEQ ID NO: 632353 - RNA, 64 nt, hsa; identical to SEQ ID NO: 133708

SEQ ID NO: 632354 - RNA, 64 nt, hsa; identical to SEQ ID NO: 133709

SEQ ID NO: 632355 - RNA, 64 nt, hsa; identical to SEQ ID NO: 133710

SEQ ID NO: 632356 - RNA, 64 nt, hsa; identical to SEQ ID NO: 133711

SEQ ID NO: 632357 - RNA, 64 nt, hsa; identical to SEQ ID NO: 133712

SEQ ID NO: 632358 - RNA, 64 nt, hsa; identical to SEQ ID NO: 133713

SEQ ID NO: 632359 - RNA, 64 nt, hsa; identical to SEQ ID NO: 133714

SEQ ID NO: 632360 - RNA, 64 nt, hsa; identical to SEQ ID NO: 133715

SEQ ID NO: 632361 - RNA, 64 nt, hsa; identical to SEQ ID NO: 133716

SEQ ID NO: 632362 - RNA, 64 nt, hsa; identical to SEQ ID NO: 133717

SEQ ID NO: 632363 - RNA, 64 nt, hsa; identical to SEQ ID NO: 133718

SEQ ID NO: 632364 - RNA, 64 nt, hsa; identical to SEQ ID NO: 133719

SEQ ID NO: 632365 - RNA, 64 nt, hsa; identical to SEQ ID NO: 133720

SEQ ID NO: 632366 - RNA, 64 nt, hsa; identical to SEQ ID NO: 133721

SEQ ID NO: 632367 - RNA, 64 nt, hsa; identical to SEQ ID NO: 133722

SEQ ID NO: 632368 - RNA, 64 nt, hsa; identical to SEQ ID NO: 133723

SEQ ID NO: 632369 - RNA, 64 nt, hsa; identical to SEQ ID NO: 133724

SEQ ID NO: 632370 - RNA, 64 nt, hsa; identical to SEQ ID NO: 133725

SEQ ID NO: 632371 - RNA, 64 nt, hsa; identical to SEQ ID NO: 133726

SEQ ID NO: 632372 - RNA, 64 nt, hsa; identical to SEQ ID NO: 133727

SEQ ID NO: 632373 - RNA, 64 nt, hsa; identical to SEQ ID NO: 133728

SEQ ID NO: 632374 - RNA, 64 nt, hsa; identical to SEQ ID NO: 133729

SEQ ID NO: 632375 - RNA, 64 nt, hsa; identical to SEQ ID NO: 133730

SEQ ID NO: 632376 - RNA, 64 nt, hsa; identical to SEQ ID NO: 133731

SEQ ID NO: 632377 - RNA, 64 nt, hsa; identical to SEQ ID NO: 133732

SEQ ID NO: 632378 - RNA, 64 nt, hsa; identical to SEQ ID NO: 133733

SEQ ID NO: 632379 - RNA, 64 nt, hsa; identical to SEQ ID NO: 133734

SEQ ID NO: 632380 - RNA, 64 nt, hsa; identical to SEQ ID NO: 133735

SEQ ID NO: 632381 - RNA, 64 nt, hsa; identical to SEQ ID NO: 133736

SEQ ID NO: 632382 - RNA, 64 nt, hsa; identical to SEQ ID NO: 133737

SEQ ID NO: 632383 - RNA, 64 nt, hsa; identical to SEQ ID NO: 133738

SEQ ID NO: 632384 - RNA, 64 nt, hsa; identical to SEQ ID NO: 133739

SEQ ID NO: 632385 - RNA, 64 nt, hsa; identical to SEQ ID NO: 133740

SEQ ID NO: 632386 - RNA, 64 nt, hsa; identical to SEQ ID NO: 133741

SEQ ID NO: 632387 - RNA, 64 nt, hsa; identical to SEQ ID NO: 133742

SEQ ID NO: 632388 - RNA, 64 nt, hsa; identical to SEQ ID NO: 133743

SEQ ID NO: 632389 - RNA, 64 nt, hsa; identical to SEQ ID NO: 133744

SEQ ID NO: 632390 - RNA, 64 nt, hsa; identical to SEQ ID NO: 133745

SEQ ID NO: 632391 - RNA, 64 nt, hsa; identical to SEQ ID NO: 133746

SEQ ID NO: 632392 - RNA, 64 nt, hsa; identical to SEQ ID NO: 133747

SEQ ID NO: 632393 - RNA, 64 nt, hsa; identical to SEQ ID NO: 133748

SEQ ID NO: 632394 - RNA, 64 nt, hsa; identical to SEQ ID NO: 133749

SEQ ID NO: 632395 - RNA, 64 nt, hsa; identical to SEQ ID NO: 133750

SEQ ID NO: 632396 - RNA, 64 nt, hsa; identical to SEQ ID NO: 133751

SEQ ID NO: 632397 - RNA, 64 nt, hsa; identical to SEQ ID NO: 133752

SEQ ID NO: 632398 - RNA, 64 nt, hsa; identical to SEQ ID NO: 133753

SEQ ID NO: 632399 - RNA, 64 nt, hsa; identical to SEQ ID NO: 133754

SEQ ID NO: 632400 - RNA, 64 nt, hsa; identical to SEQ ID NO: 133755

SEQ ID NO: 632401 - RNA, 64 nt, hsa; identical to SEQ ID NO: 133756

SEQ ID NO: 632402 - RNA, 64 nt, hsa; identical to SEQ ID NO: 133757

SEQ ID NO: 632403 - RNA, 64 nt, hsa; identical to SEQ ID NO: 133758

SEQ ID NO: 632404 - RNA, 64 nt, hsa; identical to SEQ ID NO: 133759

SEQ ID NO: 632405 - RNA, 64 nt, hsa; identical to SEQ ID NO: 133760

SEQ ID NO: 632406 - RNA, 64 nt, hsa; identical to SEQ ID NO: 133761

SEQ ID NO: 632407 - RNA, 64 nt, hsa; identical to SEQ ID NO: 133762

SEQ ID NO: 632408 - RNA, 64 nt, hsa; identical to SEQ ID NO: 133763

SEQ ID NO: 632409 - RNA, 64 nt, hsa; identical to SEQ ID NO: 133764

SEQ ID NO: 632410 - RNA, 64 nt, hsa; identical to SEQ ID NO: 133765

SEQ ID NO: 632411 - RNA, 60 nt, hsa; identical to SEQ ID NO: 133766

SEQ ID NO: 632412 - RNA, 57 nt, hsa; identical to SEQ ID NO: 133767

SEQ ID NO: 632413 - RNA, 64 nt, hsa; identical to SEQ ID NO: 133768

SEQ ID NO: 632414 - RNA, 64 nt, hsa; identical to SEQ ID NO: 133769

SEQ ID NO: 632415 - RNA, 64 nt, hsa; identical to SEQ ID NO: 133770

SEQ ID NO: 632416 - RNA, 64 nt, hsa; identical to SEQ ID NO: 133771

SEQ ID NO: 632417 - RNA, 64 nt, hsa; identical to SEQ ID NO: 133772

SEQ ID NO: 632418 - RNA, 64 nt, hsa; identical to SEQ ID NO: 133773

SEQ ID NO: 632419 - RNA, 64 nt, hsa; identical to SEQ ID NO: 133774

SEQ ID NO: 632420 - RNA, 64 nt, hsa; identical to SEQ ID NO: 133775

SEQ ID NO: 632421 - RNA, 64 nt, hsa; identical to SEQ ID NO: 133776

SEQ ID NO: 632422 - RNA, 64 nt, hsa; identical to SEQ ID NO: 133777

SEQ ID NO: 632423 - RNA, 64 nt, hsa; identical to SEQ ID NO: 133778

SEQ ID NO: 632424 - RNA, 64 nt, hsa; identical to SEQ ID NO: 133779

SEQ ID NO: 632425 - RNA, 64 nt, hsa; identical to SEQ ID NO: 133780

SEQ ID NO: 632426 - RNA, 64 nt, hsa; identical to SEQ ID NO: 133781

SEQ ID NO: 632427 - RNA, 64 nt, hsa; identical to SEQ ID NO: 133782

SEQ ID NO: 632428 - RNA, 64 nt, hsa; identical to SEQ ID NO: 133783

SEQ ID NO: 632429 - RNA, 64 nt, hsa; identical to SEQ ID NO: 133784

SEQ ID NO: 632430 - RNA, 64 nt, hsa; identical to SEQ ID NO: 133785

SEQ ID NO: 632431 - RNA, 64 nt, hsa; identical to SEQ ID NO: 133786

SEQ ID NO: 632432 - RNA, 64 nt, hsa; identical to SEQ ID NO: 133787

SEQ ID NO: 632433 - RNA, 64 nt, hsa; identical to SEQ ID NO: 133788

SEQ ID NO: 632434 - RNA, 64 nt, hsa; identical to SEQ ID NO: 133789

SEQ ID NO: 632435 - RNA, 64 nt, hsa; identical to SEQ ID NO: 133790

SEQ ID NO: 632436 - RNA, 64 nt, hsa; identical to SEQ ID NO: 133791

SEQ ID NO: 632437 - RNA, 64 nt, hsa; identical to SEQ ID NO: 133792

SEQ ID NO: 632438 - RNA, 64 nt, hsa; identical to SEQ ID NO: 133793

SEQ ID NO: 632439 - RNA, 64 nt, hsa; identical to SEQ ID NO: 133794

SEQ ID NO: 632440 - RNA, 64 nt, hsa; identical to SEQ ID NO: 133795

SEQ ID NO: 632441 - RNA, 64 nt, hsa; identical to SEQ ID NO: 133796

SEQ ID NO: 632442 - RNA, 64 nt, hsa; identical to SEQ ID NO: 133797

SEQ ID NO: 632443 - RNA, 64 nt, hsa; identical to SEQ ID NO: 133798

SEQ ID NO: 632444 - RNA, 64 nt, hsa; identical to SEQ ID NO: 133799

SEQ ID NO: 632445 - RNA, 64 nt, hsa; identical to SEQ ID NO: 133800

SEQ ID NO: 632446 - RNA, 64 nt, hsa; identical to SEQ ID NO: 133801

SEQ ID NO: 632447 - RNA, 64 nt, hsa; identical to SEQ ID NO: 133802

SEQ ID NO: 632448 - RNA, 64 nt, hsa; identical to SEQ ID NO: 133803

SEQ ID NO: 632449 - RNA, 64 nt, hsa; identical to SEQ ID NO: 133804

SEQ ID NO: 632450 - RNA, 64 nt, hsa; identical to SEQ ID NO: 133805

SEQ ID NO: 632451 - RNA, 64 nt, hsa; identical to SEQ ID NO: 133806

SEQ ID NO: 632452 - RNA, 64 nt, hsa; identical to SEQ ID NO: 133807

SEQ ID NO: 632453 - RNA, 64 nt, hsa; identical to SEQ ID NO: 133808

SEQ ID NO: 632454 - RNA, 64 nt, hsa; identical to SEQ ID NO: 133809

SEQ ID NO: 632455 - RNA, 64 nt, hsa; identical to SEQ ID NO: 133810

SEQ ID NO: 632456 - RNA, 64 nt, hsa; identical to SEQ ID NO: 133811

SEQ ID NO: 632457 - RNA, 64 nt, hsa; identical to SEQ ID NO: 133812

SEQ ID NO: 632458 - RNA, 64 nt, hsa; identical to SEQ ID NO: 133813

SEQ ID NO: 632459 - RNA, 64 nt, hsa; identical to SEQ ID NO: 133814

SEQ ID NO: 632460 - RNA, 64 nt, hsa; identical to SEQ ID NO: 133815

SEQ ID NO: 632461 - RNA, 64 nt, hsa; identical to SEQ ID NO: 133816

SEQ ID NO: 632462 - RNA, 64 nt, hsa; identical to SEQ ID NO: 133817

SEQ ID NO: 632463 - RNA, 64 nt, hsa; identical to SEQ ID NO: 133818

SEQ ID NO: 632464 - RNA, 64 nt, hsa; identical to SEQ ID NO: 133819

SEQ ID NO: 632465 - RNA, 64 nt, hsa; identical to SEQ ID NO: 133820

SEQ ID NO: 632466 - RNA, 64 nt, hsa; identical to SEQ ID NO: 133821

SEQ ID NO: 632467 - RNA, 64 nt, hsa; identical to SEQ ID NO: 133822

SEQ ID NO: 632468 - RNA, 64 nt, hsa; identical to SEQ ID NO: 133823

SEQ ID NO: 632469 - RNA, 64 nt, hsa; identical to SEQ ID NO: 133824

SEQ ID NO: 632470 - RNA, 64 nt, hsa; identical to SEQ ID NO: 133825

SEQ ID NO: 632471 - RNA, 64 nt, hsa; identical to SEQ ID NO: 133826

SEQ ID NO: 632472 - RNA, 64 nt, hsa; identical to SEQ ID NO: 133827

SEQ ID NO: 632473 - RNA, 64 nt, hsa; identical to SEQ ID NO: 133828

SEQ ID NO: 632474 - RNA, 64 nt, hsa; identical to SEQ ID NO: 133829

SEQ ID NO: 632475 - RNA, 64 nt, hsa; identical to SEQ ID NO: 573978

SEQ ID NO: 632476 - RNA, 64 nt, hsa; identical to SEQ ID NO: 573979

SEQ ID NO: 632477 - RNA, 64 nt, hsa; identical to SEQ ID NO: 573980

SEQ ID NO: 632478 - RNA, 64 nt, hsa; identical to SEQ ID NO: 573981

SEQ ID NO: 632479 - RNA, 64 nt, hsa; identical to SEQ ID NO: 573982

SEQ ID NO: 632480 - RNA, 64 nt, hsa; identical to SEQ ID NO: 573983

SEQ ID NO: 632481 - RNA, 64 nt, hsa; identical to SEQ ID NO: 573984

SEQ ID NO: 632482 - RNA, 64 nt, hsa; identical to SEQ ID NO: 573985

SEQ ID NO: 632483 - RNA, 64 nt, hsa; identical to SEQ ID NO: 573986

SEQ ID NO: 632484 - RNA, 64 nt, hsa; identical to SEQ ID NO: 573987

SEQ ID NO: 632485 - RNA, 64 nt, hsa; identical to SEQ ID NO: 573988

SEQ ID NO: 632486 - RNA, 64 nt, hsa; identical to SEQ ID NO: 573989

SEQ ID NO: 632487 - RNA, 64 nt, hsa; identical to SEQ ID NO: 573990

SEQ ID NO: 632488 - RNA, 64 nt, hsa; identical to SEQ ID NO: 573991

SEQ ID NO: 632489 - RNA, 64 nt, hsa; identical to SEQ ID NO: 573992

SEQ ID NO: 632490 - RNA, 64 nt, hsa; identical to SEQ ID NO: 573993

SEQ ID NO: 632491 - RNA, 64 nt, hsa; identical to SEQ ID NO: 573994

SEQ ID NO: 632492 - RNA, 64 nt, hsa; identical to SEQ ID NO: 573995

SEQ ID NO: 632493 - RNA, 64 nt, hsa; identical to SEQ ID NO: 573996

SEQ ID NO: 632494 - RNA, 62 nt, hsa; identical to SEQ ID NO: 573997

SEQ ID NO: 632495 - RNA, 64 nt, hsa; identical to SEQ ID NO: 274983

SEQ ID NO: 632496 - RNA, 64 nt, hsa; identical to SEQ ID NO: 274984

SEQ ID NO: 632497 - RNA, 64 nt, hsa; identical to SEQ ID NO: 274985

SEQ ID NO: 632498 - RNA, 64 nt, hsa; identical to SEQ ID NO: 274986

SEQ ID NO: 632499 - RNA, 64 nt, hsa; identical to SEQ ID NO: 274987

SEQ ID NO: 632500 - RNA, 64 nt, hsa; identical to SEQ ID NO: 274988

SEQ ID NO: 632501 - RNA, 64 nt, hsa; identical to SEQ ID NO: 274989

SEQ ID NO: 632502 - RNA, 64 nt, hsa; identical to SEQ ID NO: 274990

SEQ ID NO: 632503 - RNA, 64 nt, hsa; identical to SEQ ID NO: 274991

SEQ ID NO: 632504 - RNA, 64 nt, hsa; identical to SEQ ID NO: 274992

SEQ ID NO: 632505 - RNA, 64 nt, hsa; identical to SEQ ID NO: 274993

SEQ ID NO: 632506 - RNA, 64 nt, hsa; identical to SEQ ID NO: 274994

SEQ ID NO: 632507 - RNA, 64 nt, hsa; identical to SEQ ID NO: 274995

SEQ ID NO: 632508 - RNA, 64 nt, hsa; identical to SEQ ID NO: 274996

SEQ ID NO: 632509 - RNA, 64 nt, hsa
acuagccaucacuacaaucaccagcuuuuaaaacaacagcuaccagaaauacaaagagugccau

SEQ ID NO: 632510 - RNA, 64 nt, hsa
uuaccaggacuagcagaaaucaaaaugcuuuaugaacagcuacagucuaauucucuuuucaaca

SEQ ID NO: 632511 - RNA, 64 nt, hsa
ugcugaaaauacacauucuccugggaagacgauaaacagcuagcuaagaagccgagguucagug

SEQ ID NO: 632512 - RNA, 64 nt, hsa
uaccauuaggcauacuuucagaagcaaccuggagaacagcuaucaaucauauucaaaaccagua

SEQ ID NO: 632513 - RNA, 64 nt, hsa
auauucucuagaaugagcacaaaacaaaucgaauaacagcuaaacaaaucgaauaacagcuaaa

SEQ ID NO: 632514 - RNA, 64 nt, hsa
aaaacaaaucgaauaacagcuaaacaaaucgaauaacagcuaaacgaaucgaauaacagcuuuu

SEQ ID NO: 632515 - RNA, 64 nt, hsa
ugggcuacugaacuacaugcauaaacuaaaaacuaacagcuacaaacuuuuaagauuucucuaa

SEQ ID NO: 632516 - RNA, 64 nt, hsa
uaucuauuugaauaaauuaugagcuauccuuucaaacagcuauuggcaaguuuuaaacccaaaa

SEQ ID NO: 632517 - RNA, 64 nt, hsa
agacacugaacuugaacuuccauugugauaugaaaacagcuauagacaaucauaaaugaaugau

SEQ ID NO: 632518 - RNA, 64 nt, hsa
uuacagcaacucaauucuaccacugugguaugaaaacagcuauagacaaucauaaaugaaugau

SEQ ID NO: 632519 - RNA, 64 nt, hsa
cuuuaaaaugagcuacuucuuauucacuuuuguaaacagcuaauagcaugguuccaauuuuuuu

SEQ ID NO: 632520 - RNA, 64 nt, hsa
uuguuuuuuuuuguuuuguuuuguuuuuuugagaaacagcuacagcuuugggucauuuuuaacu

SEQ ID NO: 632521 - RNA, 64 nt, hsa
cauacuauagaaaacaccugcuacucaaaacacaacuucucagugucauccauugcugucguga

SEQ ID NO: 632522 - RNA, 64 nt, hsa
uaauauuuucauuuuuggggaaaaaucuuuuuucacuucucaugauagcuguuauauauauaug

SEQ ID NO: 632523 - RNA, 64 nt, hsa
cucaauguagaggcauaaaccugugcugaacauaacuucucauguauauuacccaauggaaaau

SEQ ID NO: 632524 - RNA, 64 nt, hsa
gugagccuugcaugacaucaugaggccggaugaaacuucucaguccagcaguuuccaguccuaa

SEQ ID NO: 632525 - RNA, 64 nt, hsa
cgccuucugcugucagaauuugcaaucaagggugacuucucagcuaauccuacagccugagugg

SEQ ID NO: 632526 - RNA, 64 nt, hsa
ccuucucuucuguacagcagaaguaauuacaagcacuucucacgaaggcagaagacugaugcaa

SEQ ID NO: 632527 - RNA, 64 nt, hsa
uuagggucauuuggcacuucucagcaaguaggauacuucucauguuuugaaauuauaugaauau

SEQ ID NO: 632528 - RNA, 64 nt, hsa
uucuaagauauuuugaauauuagggucauuuggcacuucucagcaaguaggauacuucucaugu

SEQ ID NO: 632529 - RNA, 64 nt, hsa
auuuaaaaggaaaaagguauuaaacuugaagcaaacuucucaugaucucauuugaauucuuucc

SEQ ID NO: 632530 - RNA, 64 nt, hsa
gaucaugauacagaacacuuucuuuacccugaaaacuucucauuuuuccuuuugcagucaaucc

SEQ ID NO: 632531 - RNA, 64 nt, hsa
agucuagcuagcauuucagcaugauauugcaagcacuucucauugcuaaaaauaaauaaaccaa

SEQ ID NO: 632532 - RNA, 64 nt, hsa
ucuaucucuugcuacaauaauuccaacuaagugaacuucucaauuaucaucauacuuacuuacc

SEQ ID NO: 632533 - RNA, 64 nt, hsa
ggcuucugcccagggcuccaggaucagggauauuacuucucaacccgcacuucuccucuacuga

SEQ ID NO: 632534 - RNA, 64 nt, hsa
augcaggccucccuucaguguaccucuuuuuccaacuucucacuccuccuuacuaggcuuggcc

SEQ ID NO: 632535 - RNA, 64 nt, hsa; identical to SEQ ID NO: 159813

SEQ ID NO: 632536 - RNA, 64 nt, hsa; identical to SEQ ID NO: 159814

SEQ ID NO: 632537 - RNA, 64 nt, hsa; identical to SEQ ID NO: 159815

SEQ ID NO: 632538 - RNA, 64 nt, hsa; identical to SEQ ID NO: 159816

SEQ ID NO: 632539 - RNA, 64 nt, hsa; identical to SEQ ID NO: 417312

SEQ ID NO: 632540 - RNA, 64 nt, hsa; identical to SEQ ID NO: 417313

SEQ ID NO: 632541 - RNA, 64 nt, hsa; identical to SEQ ID NO: 417314

SEQ ID NO: 632542 - RNA, 64 nt, hsa; identical to SEQ ID NO: 417315

SEQ ID NO: 632543 - RNA, 64 nt, hsa; identical to SEQ ID NO: 417316

SEQ ID NO: 632544 - RNA, 64 nt, hsa; identical to SEQ ID NO: 417317

SEQ ID NO: 632545 - RNA, 64 nt, hsa; identical to SEQ ID NO: 417318

SEQ ID NO: 632546 - RNA, 64 nt, hsa; identical to SEQ ID NO: 417319

SEQ ID NO: 632547 - RNA, 64 nt, hsa; identical to SEQ ID NO: 417320

SEQ ID NO: 632548 - RNA, 64 nt, hsa; identical to SEQ ID NO: 417321

SEQ ID NO: 632549 - RNA, 64 nt, hsa; identical to SEQ ID NO: 417322

SEQ ID NO: 632550 - RNA, 64 nt, hsa; identical to SEQ ID NO: 417323

SEQ ID NO: 632551 - RNA, 64 nt, hsa; identical to SEQ ID NO: 417324

SEQ ID NO: 632552 - RNA, 64 nt, hsa; identical to SEQ ID NO: 417325

SEQ ID NO: 632553 - RNA, 64 nt, hsa; identical to SEQ ID NO: 417326

SEQ ID NO: 632554 - RNA, 64 nt, hsa; identical to SEQ ID NO: 417327

SEQ ID NO: 632555 - RNA, 64 nt, hsa; identical to SEQ ID NO: 417328

SEQ ID NO: 632556 - RNA, 64 nt, hsa; identical to SEQ ID NO: 417329

SEQ ID NO: 632557 - RNA, 64 nt, hsa; identical to SEQ ID NO: 417330

SEQ ID NO: 632558 - RNA, 64 nt, hsa; identical to SEQ ID NO: 417331

SEQ ID NO: 632559 - RNA, 64 nt, hsa; identical to SEQ ID NO: 417332

SEQ ID NO: 632560 - RNA, 64 nt, hsa; identical to SEQ ID NO: 417333

SEQ ID NO: 632561 - RNA, 64 nt, hsa; identical to SEQ ID NO: 417334

SEQ ID NO: 632562 - RNA, 64 nt, hsa; identical to SEQ ID NO: 417335

SEQ ID NO: 632563 - RNA, 64 nt, hsa; identical to SEQ ID NO: 417336

SEQ ID NO: 632564 - RNA, 64 nt, hsa; identical to SEQ ID NO: 417337

SEQ ID NO: 632565 - RNA, 64 nt, hsa; identical to SEQ ID NO: 417338

SEQ ID NO: 632566 - RNA, 64 nt, hsa; identical to SEQ ID NO: 417339

SEQ ID NO: 632567 - RNA, 64 nt, hsa; identical to SEQ ID NO: 417340

SEQ ID NO: 632568 - RNA, 64 nt, hsa; identical to SEQ ID NO: 417341

SEQ ID NO: 632569 - RNA, 64 nt, hsa; identical to SEQ ID NO: 417342

SEQ ID NO: 632570 - RNA, 64 nt, hsa; identical to SEQ ID NO: 417343

SEQ ID NO: 632571 - RNA, 64 nt, hsa; identical to SEQ ID NO: 417344

SEQ ID NO: 632572 - RNA, 64 nt, hsa; identical to SEQ ID NO: 417345

SEQ ID NO: 632573 - RNA, 64 nt, hsa; identical to SEQ ID NO: 417346

SEQ ID NO: 632574 - RNA, 64 nt, hsa; identical to SEQ ID NO: 417347

SEQ ID NO: 632575 - RNA, 64 nt, hsa; identical to SEQ ID NO: 417348

SEQ ID NO: 632576 - RNA, 64 nt, hsa; identical to SEQ ID NO: 417349

SEQ ID NO: 632577 - RNA, 64 nt, hsa; identical to SEQ ID NO: 417350

SEQ ID NO: 632578 - RNA, 64 nt, hsa; identical to SEQ ID NO: 417351

SEQ ID NO: 632579 - RNA, 64 nt, hsa; identical to SEQ ID NO: 417352

SEQ ID NO: 632580 - RNA, 64 nt, hsa; identical to SEQ ID NO: 417353

SEQ ID NO: 632581 - RNA, 64 nt, hsa; identical to SEQ ID NO: 417354

SEQ ID NO: 632582 - RNA, 64 nt, hsa; identical to SEQ ID NO: 417355

SEQ ID NO: 632583 - RNA, 64 nt, hsa; identical to SEQ ID NO: 417356

SEQ ID NO: 632584 - RNA, 50 nt, hsa; identical to SEQ ID NO: 417357

SEQ ID NO: 632585 - RNA, 64 nt, hsa; identical to SEQ ID NO: 417358

SEQ ID NO: 632586 - RNA, 56 nt, hsa; identical to SEQ ID NO: 417359

SEQ ID NO: 632587 - RNA, 64 nt, hsa; identical to SEQ ID NO: 417360

SEQ ID NO: 632588 - RNA, 64 nt, hsa; identical to SEQ ID NO: 417361

SEQ ID NO: 632589 - RNA, 64 nt, hsa; identical to SEQ ID NO: 417362

SEQ ID NO: 632590 - RNA, 64 nt, hsa; identical to SEQ ID NO: 417363

SEQ ID NO: 632591 - RNA, 64 nt, hsa; identical to SEQ ID NO: 417364

SEQ ID NO: 632592 - RNA, 64 nt, hsa; identical to SEQ ID NO: 417365

SEQ ID NO: 632593 - RNA, 64 nt, hsa; identical to SEQ ID NO: 417366

SEQ ID NO: 632594 - RNA, 64 nt, hsa; identical to SEQ ID NO: 417367

SEQ ID NO: 632595 - RNA, 64 nt, hsa; identical to SEQ ID NO: 417368

SEQ ID NO: 632596 - RNA, 64 nt, hsa; identical to SEQ ID NO: 417369

SEQ ID NO: 632597 - RNA, 64 nt, hsa; identical to SEQ ID NO: 417370

SEQ ID NO: 632598 - RNA, 64 nt, hsa; identical to SEQ ID NO: 417371

SEQ ID NO: 632599 - RNA, 64 nt, hsa; identical to SEQ ID NO: 417372

SEQ ID NO: 632600 - RNA, 63 nt, hsa; identical to SEQ ID NO: 417373

SEQ ID NO: 632601 - RNA, 64 nt, hsa; identical to SEQ ID NO: 417374

SEQ ID NO: 632602 - RNA, 64 nt, hsa; identical to SEQ ID NO: 417375

SEQ ID NO: 632603 - RNA, 64 nt, hsa; identical to SEQ ID NO: 417376

SEQ ID NO: 632604 - RNA, 64 nt, hsa; identical to SEQ ID NO: 417377

SEQ ID NO: 632605 - RNA, 64 nt, hsa; identical to SEQ ID NO: 417378

SEQ ID NO: 632606 - RNA, 64 nt, hsa; identical to SEQ ID NO: 417379

SEQ ID NO: 632607 - RNA, 64 nt, hsa; identical to SEQ ID NO: 417380

SEQ ID NO: 632608 - RNA, 64 nt, hsa; identical to SEQ ID NO: 417381

SEQ ID NO: 632609 - RNA, 64 nt, hsa; identical to SEQ ID NO: 417382

SEQ ID NO: 632610 - RNA, 64 nt, hsa; identical to SEQ ID NO: 417383

SEQ ID NO: 632611 - RNA, 64 nt, hsa; identical to SEQ ID NO: 417384

SEQ ID NO: 632612 - RNA, 64 nt, hsa; identical to SEQ ID NO: 417385

SEQ ID NO: 632613 - RNA, 64 nt, hsa; identical to SEQ ID NO: 417386

SEQ ID NO: 632614 - RNA, 64 nt, hsa; identical to SEQ ID NO: 417387

SEQ ID NO: 632615 - RNA, 64 nt, hsa; identical to SEQ ID NO: 417388

SEQ ID NO: 632616 - RNA, 64 nt, hsa; identical to SEQ ID NO: 417389

SEQ ID NO: 632617 - RNA, 64 nt, hsa; identical to SEQ ID NO: 417390

SEQ ID NO: 632618 - RNA, 64 nt, hsa; identical to SEQ ID NO: 417391

SEQ ID NO: 632619 - RNA, 64 nt, hsa; identical to SEQ ID NO: 417392

SEQ ID NO: 632620 - RNA, 64 nt, hsa; identical to SEQ ID NO: 417393

SEQ ID NO: 632621 - RNA, 64 nt, hsa; identical to SEQ ID NO: 417394

SEQ ID NO: 632622 - RNA, 64 nt, hsa; identical to SEQ ID NO: 417395

SEQ ID NO: 632623 - RNA, 64 nt, hsa; identical to SEQ ID NO: 417396

SEQ ID NO: 632624 - RNA, 64 nt, hsa; identical to SEQ ID NO: 417397

SEQ ID NO: 632625 - RNA, 64 nt, hsa; identical to SEQ ID NO: 417398

SEQ ID NO: 632626 - RNA, 64 nt, hsa; identical to SEQ ID NO: 417399

SEQ ID NO: 632627 - RNA, 64 nt, hsa; identical to SEQ ID NO: 417400

SEQ ID NO: 632628 - RNA, 64 nt, hsa; identical to SEQ ID NO: 417401

SEQ ID NO: 632629 - RNA, 64 nt, hsa; identical to SEQ ID NO: 417402

SEQ ID NO: 632630 - RNA, 64 nt, hsa; identical to SEQ ID NO: 417403

SEQ ID NO: 632631 - RNA, 64 nt, hsa; identical to SEQ ID NO: 417404

SEQ ID NO: 632632 - RNA, 64 nt, hsa; identical to SEQ ID NO: 417405

SEQ ID NO: 632633 - RNA, 64 nt, hsa; identical to SEQ ID NO: 417406

SEQ ID NO: 632634 - RNA, 64 nt, hsa; identical to SEQ ID NO: 417407

SEQ ID NO: 632635 - RNA, 64 nt, hsa; identical to SEQ ID NO: 417408

SEQ ID NO: 632636 - RNA, 64 nt, hsa; identical to SEQ ID NO: 417409

SEQ ID NO: 632637 - RNA, 64 nt, hsa; identical to SEQ ID NO: 417410

SEQ ID NO: 632638 - RNA, 64 nt, hsa; identical to SEQ ID NO: 417411

SEQ ID NO: 632639 - RNA, 64 nt, hsa; identical to SEQ ID NO: 417412

SEQ ID NO: 632640 - RNA, 64 nt, hsa; identical to SEQ ID NO: 417413

SEQ ID NO: 632641 - RNA, 63 nt, hsa; identical to SEQ ID NO: 417414

SEQ ID NO: 632642 - RNA, 51 nt, hsa; identical to SEQ ID NO: 417415

SEQ ID NO: 632643 - RNA, 64 nt, hsa; identical to SEQ ID NO: 417416

SEQ ID NO: 632644 - RNA, 64 nt, hsa; identical to SEQ ID NO: 417417

SEQ ID NO: 632645 - RNA, 64 nt, hsa; identical to SEQ ID NO: 417418

SEQ ID NO: 632646 - RNA, 64 nt, hsa; identical to SEQ ID NO: 417419

SEQ ID NO: 632647 - RNA, 64 nt, hsa; identical to SEQ ID NO: 417420

SEQ ID NO: 632648 - RNA, 64 nt, hsa; identical to SEQ ID NO: 417421

SEQ ID NO: 632649 - RNA, 64 nt, hsa; identical to SEQ ID NO: 417422

SEQ ID NO: 632650 - RNA, 64 nt, hsa; identical to SEQ ID NO: 417423

SEQ ID NO: 632651 - RNA, 64 nt, hsa; identical to SEQ ID NO: 417424

SEQ ID NO: 632652 - RNA, 64 nt, hsa; identical to SEQ ID NO: 417425

SEQ ID NO: 632653 - RNA, 64 nt, hsa; identical to SEQ ID NO: 417426

SEQ ID NO: 632654 - RNA, 64 nt, hsa; identical to SEQ ID NO: 417427

SEQ ID NO: 632655 - RNA, 64 nt, hsa; identical to SEQ ID NO: 417428

SEQ ID NO: 632656 - RNA, 64 nt, hsa; identical to SEQ ID NO: 417429

SEQ ID NO: 632657 - RNA, 64 nt, hsa; identical to SEQ ID NO: 417430

SEQ ID NO: 632658 - RNA, 64 nt, hsa; identical to SEQ ID NO: 417431

SEQ ID NO: 632659 - RNA, 64 nt, hsa; identical to SEQ ID NO: 417432

SEQ ID NO: 632660 - RNA, 64 nt, hsa; identical to SEQ ID NO: 417433

SEQ ID NO: 632661 - RNA, 64 nt, hsa; identical to SEQ ID NO: 417434

SEQ ID NO: 632662 - RNA, 64 nt, hsa; identical to SEQ ID NO: 417435

SEQ ID NO: 632663 - RNA, 64 nt, hsa; identical to SEQ ID NO: 417436

SEQ ID NO: 632664 - RNA, 64 nt, hsa; identical to SEQ ID NO: 417437

SEQ ID NO: 632665 - RNA, 64 nt, hsa; identical to SEQ ID NO: 417438

SEQ ID NO: 632666 - RNA, 64 nt, hsa; identical to SEQ ID NO: 417439

SEQ ID NO: 632667 - RNA, 64 nt, hsa; identical to SEQ ID NO: 417440

SEQ ID NO: 632668 - RNA, 64 nt, hsa; identical to SEQ ID NO: 417441

SEQ ID NO: 632669 - RNA, 64 nt, hsa; identical to SEQ ID NO: 417442

SEQ ID NO: 632670 - RNA, 64 nt, hsa; identical to SEQ ID NO: 417443

SEQ ID NO: 632671 - RNA, 64 nt, hsa; identical to SEQ ID NO: 417444

SEQ ID NO: 632672 - RNA, 64 nt, hsa; identical to SEQ ID NO: 417445

SEQ ID NO: 632673 - RNA, 64 nt, hsa; identical to SEQ ID NO: 417446

SEQ ID NO: 632674 - RNA, 64 nt, hsa; identical to SEQ ID NO: 417447

SEQ ID NO: 632675 - RNA, 64 nt, hsa; identical to SEQ ID NO: 417448

SEQ ID NO: 632676 - RNA, 64 nt, hsa; identical to SEQ ID NO: 417449

SEQ ID NO: 632677 - RNA, 64 nt, hsa; identical to SEQ ID NO: 417450

SEQ ID NO: 632678 - RNA, 64 nt, hsa; identical to SEQ ID NO: 417451

SEQ ID NO: 632679 - RNA, 64 nt, hsa; identical to SEQ ID NO: 417452

SEQ ID NO: 632680 - RNA, 64 nt, hsa; identical to SEQ ID NO: 417453

SEQ ID NO: 632681 - RNA, 64 nt, hsa; identical to SEQ ID NO: 417454

SEQ ID NO: 632682 - RNA, 64 nt, hsa; identical to SEQ ID NO: 417455

SEQ ID NO: 632683 - RNA, 64 nt, hsa; identical to SEQ ID NO: 417456

SEQ ID NO: 632684 - RNA, 64 nt, hsa; identical to SEQ ID NO: 417457

SEQ ID NO: 632685 - RNA, 63 nt, hsa; identical to SEQ ID NO: 417458

SEQ ID NO: 632686 - RNA, 64 nt, hsa; identical to SEQ ID NO: 417459

SEQ ID NO: 632687 - RNA, 64 nt, hsa; identical to SEQ ID NO: 417460

SEQ ID NO: 632688 - RNA, 64 nt, hsa; identical to SEQ ID NO: 417461

SEQ ID NO: 632689 - RNA, 64 nt, hsa; identical to SEQ ID NO: 417462

SEQ ID NO: 632690 - RNA, 64 nt, hsa; identical to SEQ ID NO: 417463

SEQ ID NO: 632691 - RNA, 64 nt, hsa; identical to SEQ ID NO: 417464

SEQ ID NO: 632692 - RNA, 64 nt, hsa; identical to SEQ ID NO: 417465

SEQ ID NO: 632693 - RNA, 64 nt, hsa; identical to SEQ ID NO: 417466

SEQ ID NO: 632694 - RNA, 64 nt, hsa; identical to SEQ ID NO: 159813

SEQ ID NO: 632695 - RNA, 64 nt, hsa; identical to SEQ ID NO: 159814

SEQ ID NO: 632696 - RNA, 64 nt, hsa; identical to SEQ ID NO: 159815

SEQ ID NO: 632697 - RNA, 64 nt, hsa; identical to SEQ ID NO: 159816

SEQ ID NO: 632698 - RNA, 64 nt, hsa; identical to SEQ ID NO: 417312

SEQ ID NO: 632699 - RNA, 64 nt, hsa; identical to SEQ ID NO: 417313

SEQ ID NO: 632700 - RNA, 64 nt, hsa; identical to SEQ ID NO: 417314

SEQ ID NO: 632701 - RNA, 64 nt, hsa; identical to SEQ ID NO: 417315

SEQ ID NO: 632702 - RNA, 64 nt, hsa; identical to SEQ ID NO: 417316

SEQ ID NO: 632703 - RNA, 64 nt, hsa; identical to SEQ ID NO: 417317

SEQ ID NO: 632704 - RNA, 64 nt, hsa; identical to SEQ ID NO: 417318

SEQ ID NO: 632705 - RNA, 64 nt, hsa; identical to SEQ ID NO: 417319

SEQ ID NO: 632706 - RNA, 64 nt, hsa; identical to SEQ ID NO: 417320

SEQ ID NO: 632707 - RNA, 64 nt, hsa; identical to SEQ ID NO: 417321

SEQ ID NO: 632708 - RNA, 64 nt, hsa; identical to SEQ ID NO: 417322

SEQ ID NO: 632709 - RNA, 64 nt, hsa; identical to SEQ ID NO: 417323

SEQ ID NO: 632710 - RNA, 64 nt, hsa; identical to SEQ ID NO: 417324

SEQ ID NO: 632711 - RNA, 64 nt, hsa; identical to SEQ ID NO: 417325

SEQ ID NO: 632712 - RNA, 64 nt, hsa; identical to SEQ ID NO: 417326

SEQ ID NO: 632713 - RNA, 64 nt, hsa; identical to SEQ ID NO: 417327

SEQ ID NO: 632714 - RNA, 64 nt, hsa; identical to SEQ ID NO: 417328

SEQ ID NO: 632715 - RNA, 64 nt, hsa; identical to SEQ ID NO: 417329

SEQ ID NO: 632716 - RNA, 64 nt, hsa; identical to SEQ ID NO: 417330

SEQ ID NO: 632717 - RNA, 64 nt, hsa; identical to SEQ ID NO: 417331

SEQ ID NO: 632718 - RNA, 64 nt, hsa; identical to SEQ ID NO: 417332

SEQ ID NO: 632719 - RNA, 64 nt, hsa; identical to SEQ ID NO: 417333

SEQ ID NO: 632720 - RNA, 64 nt, hsa; identical to SEQ ID NO: 417334

SEQ ID NO: 632721 - RNA, 64 nt, hsa; identical to SEQ ID NO: 417335

SEQ ID NO: 632722 - RNA, 64 nt, hsa; identical to SEQ ID NO: 417336

SEQ ID NO: 632723 - RNA, 64 nt, hsa; identical to SEQ ID NO: 417337

SEQ ID NO: 632724 - RNA, 64 nt, hsa; identical to SEQ ID NO: 417338

SEQ ID NO: 632725 - RNA, 64 nt, hsa; identical to SEQ ID NO: 417339

SEQ ID NO: 632726 - RNA, 64 nt, hsa; identical to SEQ ID NO: 417340

SEQ ID NO: 632727 - RNA, 64 nt, hsa; identical to SEQ ID NO: 417341

SEQ ID NO: 632728 - RNA, 64 nt, hsa; identical to SEQ ID NO: 417342

SEQ ID NO: 632729 - RNA, 64 nt, hsa; identical to SEQ ID NO: 417343

SEQ ID NO: 632730 - RNA, 64 nt, hsa; identical to SEQ ID NO: 417344

SEQ ID NO: 632731 - RNA, 64 nt, hsa; identical to SEQ ID NO: 417345

SEQ ID NO: 632732 - RNA, 64 nt, hsa; identical to SEQ ID NO: 417346

SEQ ID NO: 632733 - RNA, 64 nt, hsa; identical to SEQ ID NO: 417347

SEQ ID NO: 632734 - RNA, 64 nt, hsa; identical to SEQ ID NO: 417348

SEQ ID NO: 632735 - RNA, 64 nt, hsa; identical to SEQ ID NO: 417349

SEQ ID NO: 632736 - RNA, 64 nt, hsa; identical to SEQ ID NO: 417350

SEQ ID NO: 632737 - RNA, 64 nt, hsa; identical to SEQ ID NO: 417351

SEQ ID NO: 632738 - RNA, 64 nt, hsa; identical to SEQ ID NO: 417352

SEQ ID NO: 632739 - RNA, 64 nt, hsa; identical to SEQ ID NO: 417353

SEQ ID NO: 632740 - RNA, 64 nt, hsa; identical to SEQ ID NO: 417354

SEQ ID NO: 632741 - RNA, 64 nt, hsa; identical to SEQ ID NO: 417355

SEQ ID NO: 632742 - RNA, 64 nt, hsa; identical to SEQ ID NO: 417356

SEQ ID NO: 632743 - RNA, 50 nt, hsa; identical to SEQ ID NO: 417357

SEQ ID NO: 632744 - RNA, 64 nt, hsa; identical to SEQ ID NO: 417358

SEQ ID NO: 632745 - RNA, 56 nt, hsa; identical to SEQ ID NO: 417359

SEQ ID NO: 632746 - RNA, 64 nt, hsa; identical to SEQ ID NO: 417360

SEQ ID NO: 632747 - RNA, 64 nt, hsa; identical to SEQ ID NO: 417361

SEQ ID NO: 632748 - RNA, 64 nt, hsa; identical to SEQ ID NO: 417362

SEQ ID NO: 632749 - RNA, 64 nt, hsa; identical to SEQ ID NO: 417363

SEQ ID NO: 632750 - RNA, 64 nt, hsa; identical to SEQ ID NO: 417364

SEQ ID NO: 632751 - RNA, 64 nt, hsa; identical to SEQ ID NO: 417365

SEQ ID NO: 632752 - RNA, 64 nt, hsa; identical to SEQ ID NO: 417366

SEQ ID NO: 632753 - RNA, 64 nt, hsa; identical to SEQ ID NO: 417367

SEQ ID NO: 632754 - RNA, 64 nt, hsa; identical to SEQ ID NO: 417368

SEQ ID NO: 632755 - RNA, 64 nt, hsa; identical to SEQ ID NO: 417369

SEQ ID NO: 632756 - RNA, 64 nt, hsa; identical to SEQ ID NO: 417370

SEQ ID NO: 632757 - RNA, 64 nt, hsa; identical to SEQ ID NO: 417371

SEQ ID NO: 632758 - RNA, 64 nt, hsa; identical to SEQ ID NO: 417372

SEQ ID NO: 632759 - RNA, 63 nt, hsa; identical to SEQ ID NO: 417373

SEQ ID NO: 632760 - RNA, 64 nt, hsa; identical to SEQ ID NO: 417374

SEQ ID NO: 632761 - RNA, 64 nt, hsa; identical to SEQ ID NO: 417375

SEQ ID NO: 632762 - RNA, 64 nt, hsa; identical to SEQ ID NO: 417376

SEQ ID NO: 632763 - RNA, 64 nt, hsa; identical to SEQ ID NO: 417377

SEQ ID NO: 632764 - RNA, 64 nt, hsa; identical to SEQ ID NO: 417378

SEQ ID NO: 632765 - RNA, 64 nt, hsa; identical to SEQ ID NO: 417379

SEQ ID NO: 632766 - RNA, 64 nt, hsa; identical to SEQ ID NO: 417380

SEQ ID NO: 632767 - RNA, 64 nt, hsa; identical to SEQ ID NO: 417381

SEQ ID NO: 632768 - RNA, 64 nt, hsa; identical to SEQ ID NO: 417382

SEQ ID NO: 632769 - RNA, 64 nt, hsa; identical to SEQ ID NO: 417383

SEQ ID NO: 632770 - RNA, 64 nt, hsa; identical to SEQ ID NO: 417384

SEQ ID NO: 632771 - RNA, 64 nt, hsa; identical to SEQ ID NO: 417385

SEQ ID NO: 632772 - RNA, 64 nt, hsa; identical to SEQ ID NO: 417386

SEQ ID NO: 632773 - RNA, 64 nt, hsa; identical to SEQ ID NO: 417387

SEQ ID NO: 632774 - RNA, 64 nt, hsa; identical to SEQ ID NO: 417388

SEQ ID NO: 632775 - RNA, 64 nt, hsa; identical to SEQ ID NO: 417389

SEQ ID NO: 632776 - RNA, 64 nt, hsa; identical to SEQ ID NO: 417390

SEQ ID NO: 632777 - RNA, 64 nt, hsa; identical to SEQ ID NO: 417391

SEQ ID NO: 632778 - RNA, 64 nt, hsa; identical to SEQ ID NO: 417392

SEQ ID NO: 632779 - RNA, 64 nt, hsa; identical to SEQ ID NO: 417393

SEQ ID NO: 632780 - RNA, 64 nt, hsa; identical to SEQ ID NO: 417394

SEQ ID NO: 632781 - RNA, 64 nt, hsa; identical to SEQ ID NO: 417395

SEQ ID NO: 632782 - RNA, 64 nt, hsa; identical to SEQ ID NO: 417396

SEQ ID NO: 632783 - RNA, 64 nt, hsa; identical to SEQ ID NO: 417397

SEQ ID NO: 632784 - RNA, 64 nt, hsa; identical to SEQ ID NO: 417398

SEQ ID NO: 632785 - RNA, 64 nt, hsa; identical to SEQ ID NO: 417399

SEQ ID NO: 632786 - RNA, 64 nt, hsa; identical to SEQ ID NO: 417400

SEQ ID NO: 632787 - RNA, 64 nt, hsa; identical to SEQ ID NO: 417401

SEQ ID NO: 632788 - RNA, 64 nt, hsa; identical to SEQ ID NO: 417402

SEQ ID NO: 632789 - RNA, 64 nt, hsa; identical to SEQ ID NO: 417403

SEQ ID NO: 632790 - RNA, 64 nt, hsa; identical to SEQ ID NO: 417404

SEQ ID NO: 632791 - RNA, 64 nt, hsa; identical to SEQ ID NO: 417405

SEQ ID NO: 632792 - RNA, 64 nt, hsa; identical to SEQ ID NO: 417406

SEQ ID NO: 632793 - RNA, 64 nt, hsa; identical to SEQ ID NO: 417407

SEQ ID NO: 632794 - RNA, 64 nt, hsa; identical to SEQ ID NO: 417408

SEQ ID NO: 632795 - RNA, 64 nt, hsa; identical to SEQ ID NO: 417409

SEQ ID NO: 632796 - RNA, 64 nt, hsa; identical to SEQ ID NO: 417410

SEQ ID NO: 632797 - RNA, 64 nt, hsa; identical to SEQ ID NO: 417411

SEQ ID NO: 632798 - RNA, 64 nt, hsa; identical to SEQ ID NO: 417412

SEQ ID NO: 632799 - RNA, 64 nt, hsa; identical to SEQ ID NO: 417413

SEQ ID NO: 632800 - RNA, 63 nt, hsa; identical to SEQ ID NO: 417414

SEQ ID NO: 632801 - RNA, 51 nt, hsa; identical to SEQ ID NO: 417415

SEQ ID NO: 632802 - RNA, 64 nt, hsa; identical to SEQ ID NO: 417416

SEQ ID NO: 632803 - RNA, 64 nt, hsa; identical to SEQ ID NO: 417417

SEQ ID NO: 632804 - RNA, 64 nt, hsa; identical to SEQ ID NO: 417418

SEQ ID NO: 632805 - RNA, 64 nt, hsa; identical to SEQ ID NO: 417419

SEQ ID NO: 632806 - RNA, 64 nt, hsa; identical to SEQ ID NO: 417420

SEQ ID NO: 632807 - RNA, 64 nt, hsa; identical to SEQ ID NO: 417421

SEQ ID NO: 632808 - RNA, 64 nt, hsa; identical to SEQ ID NO: 417422

SEQ ID NO: 632809 - RNA, 64 nt, hsa; identical to SEQ ID NO: 417423

SEQ ID NO: 632810 - RNA, 64 nt, hsa; identical to SEQ ID NO: 417424

SEQ ID NO: 632811 - RNA, 64 nt, hsa; identical to SEQ ID NO: 417425

SEQ ID NO: 632812 - RNA, 64 nt, hsa; identical to SEQ ID NO: 417426

SEQ ID NO: 632813 - RNA, 64 nt, hsa; identical to SEQ ID NO: 417427

SEQ ID NO: 632814 - RNA, 64 nt, hsa; identical to SEQ ID NO: 417428

SEQ ID NO: 632815 - RNA, 64 nt, hsa; identical to SEQ ID NO: 417429

SEQ ID NO: 632816 - RNA, 64 nt, hsa; identical to SEQ ID NO: 417430

SEQ ID NO: 632817 - RNA, 64 nt, hsa; identical to SEQ ID NO: 417431

SEQ ID NO: 632818 - RNA, 64 nt, hsa; identical to SEQ ID NO: 417432

SEQ ID NO: 632819 - RNA, 64 nt, hsa; identical to SEQ ID NO: 417433

SEQ ID NO: 632820 - RNA, 64 nt, hsa; identical to SEQ ID NO: 417434

SEQ ID NO: 632821 - RNA, 64 nt, hsa; identical to SEQ ID NO: 417435

SEQ ID NO: 632822 - RNA, 64 nt, hsa; identical to SEQ ID NO: 417436

SEQ ID NO: 632823 - RNA, 64 nt, hsa; identical to SEQ ID NO: 417437

SEQ ID NO: 632824 - RNA, 64 nt, hsa; identical to SEQ ID NO: 417438

SEQ ID NO: 632825 - RNA, 64 nt, hsa; identical to SEQ ID NO: 417439

SEQ ID NO: 632826 - RNA, 64 nt, hsa; identical to SEQ ID NO: 417440

SEQ ID NO: 632827 - RNA, 64 nt, hsa; identical to SEQ ID NO: 417441

SEQ ID NO: 632828 - RNA, 64 nt, hsa; identical to SEQ ID NO: 417442

SEQ ID NO: 632829 - RNA, 64 nt, hsa; identical to SEQ ID NO: 417443

SEQ ID NO: 632830 - RNA, 64 nt, hsa; identical to SEQ ID NO: 417444

SEQ ID NO: 632831 - RNA, 64 nt, hsa; identical to SEQ ID NO: 417445

SEQ ID NO: 632832 - RNA, 64 nt, hsa; identical to SEQ ID NO: 417446

SEQ ID NO: 632833 - RNA, 64 nt, hsa; identical to SEQ ID NO: 417447

SEQ ID NO: 632834 - RNA, 64 nt, hsa; identical to SEQ ID NO: 417448

SEQ ID NO: 632835 - RNA, 64 nt, hsa; identical to SEQ ID NO: 417449

SEQ ID NO: 632836 - RNA, 64 nt, hsa; identical to SEQ ID NO: 417450

SEQ ID NO: 632837 - RNA, 64 nt, hsa; identical to SEQ ID NO: 417451

SEQ ID NO: 632838 - RNA, 64 nt, hsa; identical to SEQ ID NO: 417452

SEQ ID NO: 632839 - RNA, 64 nt, hsa; identical to SEQ ID NO: 417453

SEQ ID NO: 632840 - RNA, 64 nt, hsa; identical to SEQ ID NO: 417454

SEQ ID NO: 632841 - RNA, 64 nt, hsa; identical to SEQ ID NO: 417455

SEQ ID NO: 632842 - RNA, 64 nt, hsa; identical to SEQ ID NO: 417456

SEQ ID NO: 632843 - RNA, 64 nt, hsa; identical to SEQ ID NO: 417457

SEQ ID NO: 632844 - RNA, 63 nt, hsa; identical to SEQ ID NO: 417458

SEQ ID NO: 632845 - RNA, 64 nt, hsa; identical to SEQ ID NO: 417459

SEQ ID NO: 632846 - RNA, 64 nt, hsa; identical to SEQ ID NO: 417460

SEQ ID NO: 632847 - RNA, 64 nt, hsa; identical to SEQ ID NO: 417461

SEQ ID NO: 632848 - RNA, 64 nt, hsa; identical to SEQ ID NO: 417462

SEQ ID NO: 632849 - RNA, 64 nt, hsa; identical to SEQ ID NO: 417463

SEQ ID NO: 632850 - RNA, 64 nt, hsa; identical to SEQ ID NO: 417464

SEQ ID NO: 632851 - RNA, 64 nt, hsa; identical to SEQ ID NO: 417465

SEQ ID NO: 632852 - RNA, 64 nt, hsa; identical to SEQ ID NO: 417466

SEQ ID NO: 632853 - RNA, 64 nt, hsa; identical to SEQ ID NO: 259893

SEQ ID NO: 632854 - RNA, 64 nt, hsa; identical to SEQ ID NO: 259894

SEQ ID NO: 632855 - RNA, 64 nt, hsa; identical to SEQ ID NO: 259895

SEQ ID NO: 632856 - RNA, 64 nt, hsa; identical to SEQ ID NO: 259896

SEQ ID NO: 632857 - RNA, 63 nt, hsa; identical to SEQ ID NO: 483635

SEQ ID NO: 632858 - RNA, 63 nt, hsa; identical to SEQ ID NO: 483636

SEQ ID NO: 632859 - RNA, 63 nt, hsa; identical to SEQ ID NO: 483637

SEQ ID NO: 632860 - RNA, 63 nt, hsa; identical to SEQ ID NO: 483638

SEQ ID NO: 632861 - RNA, 63 nt, hsa; identical to SEQ ID NO: 483639

SEQ ID NO: 632862 - RNA, 63 nt, hsa; identical to SEQ ID NO: 483635

SEQ ID NO: 632863 - RNA, 63 nt, hsa; identical to SEQ ID NO: 483641

SEQ ID NO: 632864 - RNA, 63 nt, hsa; identical to SEQ ID NO: 483642

SEQ ID NO: 632865 - RNA, 63 nt, hsa; identical to SEQ ID NO: 483643

SEQ ID NO: 632866 - RNA, 63 nt, hsa; identical to SEQ ID NO: 483644

SEQ ID NO: 632867 - RNA, 63 nt, hsa; identical to SEQ ID NO: 483645

SEQ ID NO: 632868 - RNA, 63 nt, hsa; identical to SEQ ID NO: 483646

SEQ ID NO: 632869 - RNA, 63 nt, hsa; identical to SEQ ID NO: 483647

SEQ ID NO: 632870 - RNA, 63 nt, hsa; identical to SEQ ID NO: 483648

SEQ ID NO: 632871 - RNA, 63 nt, hsa; identical to SEQ ID NO: 483649

SEQ ID NO: 632872 - RNA, 63 nt, hsa; identical to SEQ ID NO: 483650

SEQ ID NO: 632873 - RNA, 63 nt, hsa; identical to SEQ ID NO: 483651

SEQ ID NO: 632874 - RNA, 61 nt, hsa; identical to SEQ ID NO: 379771

SEQ ID NO: 632875 - RNA, 63 nt, hsa; identical to SEQ ID NO: 483653

SEQ ID NO: 632876 - RNA, 63 nt, hsa; identical to SEQ ID NO: 483654

SEQ ID NO: 632877 - RNA, 63 nt, hsa; identical to SEQ ID NO: 483655

SEQ ID NO: 632878 - RNA, 63 nt, hsa; identical to SEQ ID NO: 483656

SEQ ID NO: 632879 - RNA, 63 nt, hsa; identical to SEQ ID NO: 483657

SEQ ID NO: 632880 - RNA, 63 nt, hsa; identical to SEQ ID NO: 483658

SEQ ID NO: 632881 - RNA, 63 nt, hsa; identical to SEQ ID NO: 483659

SEQ ID NO: 632882 - RNA, 63 nt, hsa; identical to SEQ ID NO: 483660

SEQ ID NO: 632883 - RNA, 63 nt, hsa; identical to SEQ ID NO: 483661

SEQ ID NO: 632884 - RNA, 63 nt, hsa; identical to SEQ ID NO: 483662

SEQ ID NO: 632885 - RNA, 63 nt, hsa; identical to SEQ ID NO: 483663

SEQ ID NO: 632886 - RNA, 63 nt, hsa; identical to SEQ ID NO: 483664

SEQ ID NO: 632887 - RNA, 63 nt, hsa; identical to SEQ ID NO: 483665

SEQ ID NO: 632888 - RNA, 63 nt, hsa; identical to SEQ ID NO: 483666

SEQ ID NO: 632889 - RNA, 63 nt, hsa; identical to SEQ ID NO: 483667

SEQ ID NO: 632890 - RNA, 63 nt, hsa; identical to SEQ ID NO: 483668

SEQ ID NO: 632891 - RNA, 63 nt, hsa; identical to SEQ ID NO: 483669

SEQ ID NO: 632892 - RNA, 63 nt, hsa; identical to SEQ ID NO: 483670

SEQ ID NO: 632893 - RNA, 63 nt, hsa; identical to SEQ ID NO: 483671

SEQ ID NO: 632894 - RNA, 63 nt, hsa; identical to SEQ ID NO: 483672

SEQ ID NO: 632895 - RNA, 64 nt, hsa; identical to SEQ ID NO: 266775

SEQ ID NO: 632896 - RNA, 64 nt, hsa; identical to SEQ ID NO: 266776

SEQ ID NO: 632897 - RNA, 64 nt, hsa; identical to SEQ ID NO: 266777

SEQ ID NO: 632898 - RNA, 64 nt, hsa; identical to SEQ ID NO: 266778

SEQ ID NO: 632899 - RNA, 62 nt, hsa; identical to SEQ ID NO: 266779

SEQ ID NO: 632900 - RNA, 64 nt, hsa; identical to SEQ ID NO: 266780

SEQ ID NO: 632901 - RNA, 64 nt, hsa; identical to SEQ ID NO: 266781

SEQ ID NO: 632902 - RNA, 64 nt, hsa; identical to SEQ ID NO: 266782

SEQ ID NO: 632903 - RNA, 64 nt, hsa; identical to SEQ ID NO: 266783

SEQ ID NO: 632904 - RNA, 64 nt, hsa; identical to SEQ ID NO: 266784

SEQ ID NO: 632905 - RNA, 64 nt, hsa; identical to SEQ ID NO: 266785

SEQ ID NO: 632906 - RNA, 64 nt, hsa; identical to SEQ ID NO: 266786

SEQ ID NO: 632907 - RNA, 64 nt, hsa; identical to SEQ ID NO: 266787

SEQ ID NO: 632908 - RNA, 64 nt, hsa; identical to SEQ ID NO: 266788

SEQ ID NO: 632909 - RNA, 64 nt, hsa; identical to SEQ ID NO: 266789

SEQ ID NO: 632910 - RNA, 64 nt, hsa; identical to SEQ ID NO: 266790

SEQ ID NO: 632911 - RNA, 64 nt, hsa; identical to SEQ ID NO: 266791

SEQ ID NO: 632912 - RNA, 64 nt, hsa; identical to SEQ ID NO: 266792

SEQ ID NO: 632913 - RNA, 64 nt, hsa; identical to SEQ ID NO: 266793

SEQ ID NO: 632914 - RNA, 64 nt, hsa; identical to SEQ ID NO: 266794

SEQ ID NO: 632915 - RNA, 64 nt, hsa; identical to SEQ ID NO: 266795

SEQ ID NO: 632916 - RNA, 64 nt, hsa; identical to SEQ ID NO: 266796

SEQ ID NO: 632917 - RNA, 64 nt, hsa; identical to SEQ ID NO: 266797

SEQ ID NO: 632918 - RNA, 64 nt, hsa; identical to SEQ ID NO: 266798

SEQ ID NO: 632919 - RNA, 64 nt, hsa; identical to SEQ ID NO: 266799

SEQ ID NO: 632920 - RNA, 64 nt, hsa; identical to SEQ ID NO: 266800

SEQ ID NO: 632921 - RNA, 64 nt, hsa
ugcuuuaccuugagccauuauuugugucagagaacaaaagaaacagaaucaauauauaaaauuc

SEQ ID NO: 632922 - RNA, 64 nt, hsa
gagacuuuuucuuugcuuguuuguguaauucaaccaaaagaauuucaauacccauucaaauugu

SEQ ID NO: 632923 - RNA, 64 nt, hsa
auuguguaaacuuagauccuucucccuuuuggcccaaaagaacccuugauuuaguuccagaauc

SEQ ID NO: 632924 - RNA, 64 nt, hsa
aagccugagcuuucucuuauuccuaaagugguggcaaaagaaugaacuggguaugacccugccc

SEQ ID NO: 632925 - RNA, 64 nt, hsa
acacagauuauuuuuuggcuccaaaacuggauugcaaaagaaagaggagaagaauauuuugugu

SEQ ID NO: 632926 - RNA, 64 nt, hsa
aaaaacuuuuuauacucuaaagugauacucagaacaaaagaaagucauaaaacuccugaauuua

SEQ ID NO: 632927 - RNA, 64 nt, hsa
uugauuauuguguuuauauguauaaaaauaggagcaaaagaaaauacucugggaauagucauac

SEQ ID NO: 632928 - RNA, 64 nt, hsa
uacagcaacauucgccauacuagcggagguaaaacaaaagaaauauugaaaacugaggcaguua

SEQ ID NO: 632929 - RNA, 64 nt, hsa
uuuuccagaguuucacaggcauuuuuggauccuucaaaagaagagguauauaacaguucuuuua

SEQ ID NO: 632930 - RNA, 64 nt, hsa
ugggaucuaauuaaacuaaagagcuucugcacagcaaaagaaacuaccaucagagugaacaggc

SEQ ID NO: 632931 - RNA, 64 nt, hsa
aaaaagugggugaaggacaugaacagacacuucucaaaagaagacauuuaugcagccaaaaaac

SEQ ID NO: 632932 - RNA, 64 nt, hsa
cuacccuucccuucaaggaguaugucauauaucacaaaagaaauugccuuacacugguucaugu

SEQ ID NO: 632933 - RNA, 64 nt, hsa
aucugaucuuagcaauuuuggagcaguuccccaacaaaagaagcuacaggaggaacuuucugac

SEQ ID NO: 632934 - RNA, 64 nt, hsa
ugaaauaguuuuuauugaaagucaagugacauuucaaaagaaguucuauaacaauuauguuuca

SEQ ID NO: 632935 - RNA, 64 nt, hsa
uuuugccacaucugcaaugauuauuguuuaauuucaaaagaauccucaggcucuacaaucuagg

SEQ ID NO: 632936 - RNA, 64 nt, hsa
acuuuuaauguuuucucucucacacacaaagauucaaaagaaaugugcauauauuuauucugua

SEQ ID NO: 632937 - RNA, 64 nt, hsa
gagagaagaaaauauauuagugcuuuuuuuuuuucaaaagaaaaggaaaauaaaagaaauauau

SEQ ID NO: 632938 - RNA, 64 nt, hsa
uaguauugcugacauuuuaaaaaaauacaaaauacaaaagaaaccauuagaaauuaauaacugu

SEQ ID NO: 632939 - RNA, 64 nt, hsa
acagcagcuuuagaauagcuucuuacugaauaugcaaaagaauaauuccuuguuauuuccuaau

SEQ ID NO: 632940 - RNA, 64 nt, hsa
aaacaaccaaagaaaauugguacuuacccuucuacaaaagaagugugacuagauaucaaucagu

SEQ ID NO: 632941 - RNA, 64 nt, hsa
ggagaggacaaguguaauaaaucaaaauugaccucaaaagaaaauguguaacagaguugagguu

SEQ ID NO: 632942 - RNA, 64 nt, hsa
uuaaagcguuugcacagaucaacuuaccaggcaccaaaagaaguaaaagcaaaaaagaaaaccu

SEQ ID NO: 632943 - RNA, 64 nt, hsa
ucacuaaaucuuuuauaggauuuauuuaaaauagcaaaagaagaaguuucaucauuuuuuacuu

SEQ ID NO: 632944 - RNA, 64 nt, hsa
uaaaaauagaauuuggaaacuuauuuuuucuccccaaaagaaucagcagcacaggggaacuaug

SEQ ID NO: 632945 - RNA, 64 nt, hsa
uucuugucuccauauauucauguaagaugcacaacaaaagaaacaucagaaguuuauaaaaaua

SEQ ID NO: 632946 - RNA, 64 nt, hsa
gugccucacccacucccuucuccuggucucuccucaaaagaauuuuacaugauuuuaaaauaau

SEQ ID NO: 632947 - RNA, 64 nt, hsa
uaauaaauggacacaacacaaaacucaaaagguacaaaagaauaaaacaguuaaaaacuaugcc

SEQ ID NO: 632948 - RNA, 64 nt, hsa
gacaagacaagcacuuauuuuuauuuucagaagacaaaagaaccaagaugccaacuggcugcga

SEQ ID NO: 632949 - RNA, 64 nt, hsa
gaguaauggugaaaauuguugucuuuggaaagcacaaaagaaaccuggaaaggcaguucggcuc

SEQ ID NO: 632950 - RNA, 64 nt, hsa
uuaaaauugggcaaaggcaugaacagacacuuuucaaaagaagaccuacaauuggccaacaaac

SEQ ID NO: 632951 - RNA, 64 nt, hsa
ucacaaagucagagaugguggugaggcugcagagcaaaagaaacagacacuguuggugggaaag

SEQ ID NO: 632952 - RNA, 64 nt, hsa
cacuauauuuuucuauuuuacuugcagagcaucacaaaagaacagguauuuucagugcuacaua

SEQ ID NO: 632953 - RNA, 64 nt, hsa
cuacacuggguaccuuugaaagaaucucaaauuucaaaagaaauagcaugauugaagauacauc

SEQ ID NO: 632954 - RNA, 64 nt, hsa
ugcucacgugcagcuccagaauauggaaacagagcaaaagaacaacccuaguaccuuuuuuuag

SEQ ID NO: 632955 - RNA, 64 nt, hsa
uaaaaaacaaaaaaaaaaaacaaaaaaaaaaaaacaaaagaaaaaaauaaaaauacgguggcaa

SEQ ID NO: 632956 - RNA, 64 nt, hsa
ccauuauaugacauuggacacuuuuuuauuauuccaaaagaagaaaaaauuaaaacaacuugcu

SEQ ID NO: 632957 - RNA, 64 nt, hsa
ccacaguucugaaacauguggcuaccuugucuuucaaaagaacucagaauccuccaggaucuag

SEQ ID NO: 632958 - RNA, 64 nt, hsa
agugaagaucugguuccagaaccgccgaaugaagcaaaagaaacgugagaaggagggucucuug

SEQ ID NO: 632959 - RNA, 62 nt, hsa
ucuccagcgcagacuuuugacuggaugaaagucaaaagaaacccucccaaaacaggucaguc

SEQ ID NO: 632960 - RNA, 64 nt, hsa
aaaaagugggcaaaggacaugaacagacacuuuucaaaagaagacaucuguggccaacaauccu

SEQ ID NO: 632961 - RNA, 64 nt, hsa
aaaugggaucuaauuaaacuaaagagcugcacagcaaaagaaacuaucaagagaguaaacagac

SEQ ID NO: 632962 - RNA, 64 nt, hsa
uuugcuagcuuuuaaauauauuuauuugacagagcaaaagaacccucuucugguugauugugac

SEQ ID NO: 632963 - RNA, 64 nt, hsa
gggcauacacacucaaaaagcaggauccaauacccaaaagaaauggaacuuaauguugugccaa

SEQ ID NO: 632964 - RNA, 64 nt, hsa
aauaaucauugaugaaguaugucaguuacaagcacaaaagaauauaacugcuuuuauaaaucuu

SEQ ID NO: 632965 - RNA, 64 nt, hsa
ucagcuuuuuaauguagguuaccacuuauaagcacaaaagaaacauguauaagaaaccagauuu

SEQ ID NO: 632966 - RNA, 64 nt, hsa
cuuugcucuuucccccuuccaucucugacuuaagcaaaagaaaaagauuacccaaaaacugucu

SEQ ID NO: 632967 - RNA, 64 nt, hsa
cugugugccccggucaccuagcaagcugccgaaccaaaagaauuugcaccccgcugcgggccca

SEQ ID NO: 632968 - RNA, 64 nt, hsa
uauacauauagauagauaauguucuccacugacacaaaagaagaaauaaauaaucuacaucaag

SEQ ID NO: 632969 - RNA, 64 nt, hsa
uaugacaaauuuagccaauaaagaaauuaacacccaaaagaauuaaauugauuauuuugugcaa

SEQ ID NO: 632970 - RNA, 64 nt, hsa
agagaaacaaguauuuugcuauauauaaagacaacaaaagaaaucuccuaacaaaagaacuaag

SEQ ID NO: 632971 - RNA, 64 nt, hsa
gcuauauauaaagacaacaaaagaaaucuccuaacaaaagaacuaagaggcccagcccucagaa

SEQ ID NO: 632972 - RNA, 64 nt, hsa
aacacuuggaggcaauuaaugaguauaucuuagucaaaagaauuguuggagcuuuuuauuaaag

SEQ ID NO: 632973 - RNA, 64 nt, hsa
cagucauuuauuaaggauucaacucgugauacaccaaaagaagaguugacuucagagauguguu

SEQ ID NO: 632974 - RNA, 64 nt, hsa
cauccccaggaucacugggcaaugcuggaaagagcaaaagaauaucauuggcccugaucacaua

SEQ ID NO: 632975 - RNA, 64 nt, hsa
uuuagcucagaaauucuaucuucgggagucaccacaaaagaaaaaaaucaaaaugcagaaaaug

SEQ ID NO: 632976 - RNA, 64 nt, hsa
uuuugcuacuaauuccuaucccauacauuugacacaaaagaaguguugguaauggauaaauaac

SEQ ID NO: 632977 - RNA, 64 nt, hsa
ugguuuggucacaguugccuaugaguguggguuucaaaagaaacauaaagccuuaacuuagaau

SEQ ID NO: 632978 - RNA, 64 nt, hsa
aauugcaauaagaagcagugaacauuuggaaccccaaaagaaaguuacagguauugcacugggu

SEQ ID NO: 632979 - RNA, 64 nt, hsa
uacugacugggacuucauauucuaauggauguggcaaaagaauugcaauaagaagcagugaaca

SEQ ID NO: 632980 - RNA, 64 nt, hsa
auaaauucauaaaaaagacucauaucuuugcaaacaaaagaagggcagauacugggcuucuaca

SEQ ID NO: 632981 - RNA, 64 nt, hsa
uccuagaguugauucauuguuuuccuccauccugcaaaagaagaucccuuuguuaagcagcuca

SEQ ID NO: 632982 - RNA, 64 nt, hsa
ugggaucuaauuaaacuaaagaccuucugcacagcaaaagaaacuaccaucagagucaacaggc

SEQ ID NO: 632983 - RNA, 64 nt, hsa
aaaaagucggcaaaggacaugaacagacacuucucaaaagaagacauuuaugcagccaaaaaac

SEQ ID NO: 632984 - RNA, 64 nt, hsa
ugggaccuaauuaaacuaaauaacuucugcacagcaaaagaagcuauuugcagacuacagaaug

SEQ ID NO: 632985 - RNA, 64 nt, hsa
aaaaacugggcaaaggccaugaauagaccuuucucaaaagaauacauacauguggcaauaagca

SEQ ID NO: 632986 - RNA, 64 nt, hsa
cauuuaguuacugggcauaacuuacugcuuuuuacaaaagaaacaaacauugucuguacagguu

SEQ ID NO: 632987 - RNA, 64 nt, hsa
uuuuuucuccccucccaaauuuaguuccucaucacaaaagaacaaagauaaaccagccucaauc

SEQ ID NO: 632988 - RNA, 64 nt, hsa
cuagugaagaguuuuuucuggaauugauuuuucccaaaagaauauauuaauugagguuaagaag

SEQ ID NO: 632989 - RNA, 64 nt, hsa
auaguaagaugaguggaaguguuuaucgagcaugcaaaagaaacccucacggcuaagggcucug

SEQ ID NO: 632990 - RNA, 64 nt, hsa
cagguccgagggggcgggggcagggccaagaguucaaaagaagccaauggagggagagggagcg

SEQ ID NO: 632991 - RNA, 64 nt, hsa
ugucaccccugagcagaagcagucaaaucuugggcaaaagaauuucgguuagaaaagaaaaucc

SEQ ID NO: 632992 - RNA, 64 nt, hsa
uacucaggcagugcaguacucaguaagacagugcagugcucaguaaggcagugcaauacucagu

SEQ ID NO: 632993 - RNA, 64 nt, hsa
caguaaagcaaugcaaugcucaguaacacagugcagugcucaauaaggcagugcagugcucagu

SEQ ID NO: 632994 - RNA, 64 nt, hsa
caguaacacagugcagugcucaauaaggcagugcagugcucaguaaggcagugaauugcuuagu

SEQ ID NO: 632995 - RNA, 64 nt, hsa
caguaaggcagugaauugcuuaguaacacaguguagugcucaguaggacagcauaguacucagu

SEQ ID NO: 632996 - RNA, 64 nt, hsa
ugcuaacacugucucuuuugugaaaaucuggaaaagugcucauauucacagguggcuggugcua

SEQ ID NO: 632997 - RNA, 64 nt, hsa
uauguaaagcaguuuaaaauggaauucaauguucagugcucagguauguaguaaguacuguagu

SEQ ID NO: 632998 - RNA, 64 nt, hsa
ccaacccuuaggaaaagcccucuuccaucguuacagugcucagugaauauuaauuuaguucugc

SEQ ID NO: 632999 - RNA, 64 nt, hsa
cuacaaaaaccuacuuugguauuuauuacagaaaagugcucaguuaaauguaaguguuauuccu

SEQ ID NO: 633000 - RNA, 64 nt, hsa
guuggaaguaagaaguuuuauuuuaaguacuuucagugcucaaaaaaaugcaaucacuguguug

SEQ ID NO: 633001 - RNA, 64 nt, hsa
aacacuuuucuagcguugguacaucugagaaaugagugcucagguggauuuuauccucgcaagc

SEQ ID NO: 633002 - RNA, 64 nt, hsa
uguaacccaccuugaccauaaauuggcuuuucauagugcucagauguuucauaauucuuccccc

SEQ ID NO: 633003 - RNA, 64 nt, hsa
cacguguggaauuuuccacuucuggcaucacgucagugcucagaaauuuucugaucucagagca

SEQ ID NO: 633004 - RNA, 64 nt, hsa
agagaaucacccuuaccccagaccuucaugagacagugcucaugaagccagugcguuucccaga

SEQ ID NO: 633005 - RNA, 64 nt, hsa
aaagaauucaaauaaagagacuuggcacagaguaagugcucaguaaaugguuacugguauuauc

SEQ ID NO: 633006 - RNA, 64 nt, hsa
cuuuugacccaaucauauaguggggcucagggccagugcucacucuuauugguaagcuauagga

SEQ ID NO: 633007 - RNA, 64 nt, hsa
agcucaguuucucaguugcgcuaaucacauuucaagugcucagcagccacccgugucuacuacu

SEQ ID NO: 633008 - RNA, 64 nt, hsa
accucugauccccuucagugggaaccguagugucagugcucauuuauguggcauuugcuuagga

SEQ ID NO: 633009 - RNA, 64 nt, hsa
ugccgaugaaaagagaggguggauaagcuccccgagugcucaccugccccagccuggcucuacc

SEQ ID NO: 633010 - RNA, 64 nt, hsa
cagauaacuggcuuaugacaccuugaaaaguucaagugcucauauaacacaccacacugaaccc

SEQ ID NO: 633011 - RNA, 64 nt, hsa
gucaccaggucucccaagugcacucauccaggucagugcucagauguguuuaaggagacccuau

SEQ ID NO: 633012 - RNA, 64 nt, hsa; identical to SEQ ID NO: 223145

SEQ ID NO: 633013 - RNA, 64 nt, hsa; identical to SEQ ID NO: 223146

SEQ ID NO: 633014 - RNA, 64 nt, hsa; identical to SEQ ID NO: 223147

SEQ ID NO: 633015 - RNA, 64 nt, hsa; identical to SEQ ID NO: 223148

SEQ ID NO: 633016 - RNA, 64 nt, hsa; identical to SEQ ID NO: 223149

SEQ ID NO: 633017 - RNA, 64 nt, hsa; identical to SEQ ID NO: 223150

SEQ ID NO: 633018 - RNA, 64 nt, hsa; identical to SEQ ID NO: 223151

SEQ ID NO: 633019 - RNA, 64 nt, hsa; identical to SEQ ID NO: 223152

SEQ ID NO: 633020 - RNA, 64 nt, hsa; identical to SEQ ID NO: 223153

SEQ ID NO: 633021 - RNA, 64 nt, hsa; identical to SEQ ID NO: 223154

SEQ ID NO: 633022 - RNA, 64 nt, hsa; identical to SEQ ID NO: 223155

SEQ ID NO: 633023 - RNA, 64 nt, hsa; identical to SEQ ID NO: 223156

SEQ ID NO: 633024 - RNA, 64 nt, hsa; identical to SEQ ID NO: 223157

SEQ ID NO: 633025 - RNA, 64 nt, hsa; identical to SEQ ID NO: 223158

SEQ ID NO: 633026 - RNA, 64 nt, hsa; identical to SEQ ID NO: 223159

SEQ ID NO: 633027 - RNA, 64 nt, hsa; identical to SEQ ID NO: 223160

SEQ ID NO: 633028 - RNA, 64 nt, hsa; identical to SEQ ID NO: 223161

SEQ ID NO: 633029 - RNA, 64 nt, hsa; identical to SEQ ID NO: 223162

SEQ ID NO: 633030 - RNA, 64 nt, hsa; identical to SEQ ID NO: 223163

SEQ ID NO: 633031 - RNA, 64 nt, hsa; identical to SEQ ID NO: 223164

SEQ ID NO: 633032 - RNA, 64 nt, hsa; identical to SEQ ID NO: 223165

SEQ ID NO: 633033 - RNA, 64 nt, hsa; identical to SEQ ID NO: 223166

SEQ ID NO: 633034 - RNA, 64 nt, hsa; identical to SEQ ID NO: 223167

SEQ ID NO: 633035 - RNA, 64 nt, hsa; identical to SEQ ID NO: 223168

SEQ ID NO: 633036 - RNA, 64 nt, hsa; identical to SEQ ID NO: 223169

SEQ ID NO: 633037 - RNA, 64 nt, hsa; identical to SEQ ID NO: 223170

SEQ ID NO: 633038 - RNA, 64 nt, hsa; identical to SEQ ID NO: 223171

SEQ ID NO: 633039 - RNA, 64 nt, hsa; identical to SEQ ID NO: 223172

SEQ ID NO: 633040 - RNA, 64 nt, hsa; identical to SEQ ID NO: 223173

SEQ ID NO: 633041 - RNA, 64 nt, hsa; identical to SEQ ID NO: 223174

SEQ ID NO: 633042 - RNA, 64 nt, hsa; identical to SEQ ID NO: 223175

SEQ ID NO: 633043 - RNA, 64 nt, hsa; identical to SEQ ID NO: 223176

SEQ ID NO: 633044 - RNA, 64 nt, hsa; identical to SEQ ID NO: 223177

SEQ ID NO: 633045 - RNA, 64 nt, hsa; identical to SEQ ID NO: 223178

SEQ ID NO: 633046 - RNA, 64 nt, hsa; identical to SEQ ID NO: 223179

SEQ ID NO: 633047 - RNA, 64 nt, hsa; identical to SEQ ID NO: 223180

SEQ ID NO: 633048 - RNA, 64 nt, hsa; identical to SEQ ID NO: 223181

SEQ ID NO: 633049 - RNA, 64 nt, hsa; identical to SEQ ID NO: 223182

SEQ ID NO: 633050 - RNA, 64 nt, hsa; identical to SEQ ID NO: 223183

SEQ ID NO: 633051 - RNA, 64 nt, hsa; identical to SEQ ID NO: 223184

SEQ ID NO: 633052 - RNA, 64 nt, hsa; identical to SEQ ID NO: 223185

SEQ ID NO: 633053 - RNA, 64 nt, hsa; identical to SEQ ID NO: 223186

SEQ ID NO: 633054 - RNA, 64 nt, hsa; identical to SEQ ID NO: 223187

SEQ ID NO: 633055 - RNA, 64 nt, hsa; identical to SEQ ID NO: 223188

SEQ ID NO: 633056 - RNA, 64 nt, hsa; identical to SEQ ID NO: 223189

SEQ ID NO: 633057 - RNA, 64 nt, hsa; identical to SEQ ID NO: 223190

SEQ ID NO: 633058 - RNA, 64 nt, hsa; identical to SEQ ID NO: 223191

SEQ ID NO: 633059 - RNA, 64 nt, hsa; identical to SEQ ID NO: 223192

SEQ ID NO: 633060 - RNA, 64 nt, hsa; identical to SEQ ID NO: 223193

SEQ ID NO: 633061 - RNA, 64 nt, hsa; identical to SEQ ID NO: 223194

SEQ ID NO: 633062 - RNA, 64 nt, hsa; identical to SEQ ID NO: 223195

SEQ ID NO: 633063 - RNA, 57 nt, hsa; identical to SEQ ID NO: 223196

SEQ ID NO: 633064 - RNA, 64 nt, hsa; identical to SEQ ID NO: 223197

SEQ ID NO: 633065 - RNA, 54 nt, hsa; identical to SEQ ID NO: 223198

SEQ ID NO: 633066 - RNA, 64 nt, hsa
aguuaaucuuuugcaggcccgcuucucaaugaaugagauacaccaggauaugcacgugcaucug

SEQ ID NO: 633067 - RNA, 64 nt, hsa
aguaucuguccucaugcagcuuacauucuagcaggagauacaauuuacaaauauacaagcaaau

SEQ ID NO: 633068 - RNA, 64 nt, hsa
uuaagaccuugcauaugucuguccauuuugauuugagauacaacuuuuuguguggguugaauga

SEQ ID NO: 633069 - RNA, 64 nt, hsa
agccuugaccucacuuagcagggauuacagaaaugagauacauuuugaaggagaguugucuguu

SEQ ID NO: 633070 - RNA, 64 nt, hsa
ccaucuuccuguccugccugacaguucgcucauuccaacuaaucaucaucuucaaguuuuccac

SEQ ID NO: 633071 - RNA, 64 nt, hsa
uuuuuuuuaacuuaagaggauucaggguuaagcaccaacuaaauuaaaucaugcuauuuaauuu

SEQ ID NO: 633072 - RNA, 64 nt, hsa
ugcagguucuagggcuucucccagccuucagaagccaacuaacucugcagauggggcuaggacu

SEQ ID NO: 633073 - RNA, 64 nt, hsa
cgugcugacggcaaggggcaauggagugaguuucccaacuaagaaaccacuauuauauauuuuu

SEQ ID NO: 633074 - RNA, 64 nt, hsa
cggauuguguuaguaguagccaucaggagggucuccaacuaaaacacuuguuccugcuugcucc

SEQ ID NO: 633075 - RNA, 64 nt, hsa
uguggcagcccauggguaugacauaggccaaggcccaacuaacagucaagaaacagcuccucgu

SEQ ID NO: 633076 - RNA, 64 nt, hsa
aucuuuuuaaucauaaucaacaucaguuuuugacccaacuaaccuugacuguauucaaacuuau

SEQ ID NO: 633077 - RNA, 64 nt, hsa
auccguuuacccuaugcaaaguugcuguaugaugccaacuaaacuacucuuuaggcagccuucu

SEQ ID NO: 633078 - RNA, 53 nt, hsa
gucuauuagugcgauggugacaaccaacuaauaaaauuuaaagaccacacugc

SEQ ID NO: 633079 - RNA, 64 nt, hsa
cauucauaaggcaggcacuaucagaaaguguacgccaacuaagggacccacaaagcaggcagag

SEQ ID NO: 633080 - RNA, 64 nt, hsa
guaagaaaccccuguccccagucagagauaacauccaacuaacuccagaagcggaagaggauau

SEQ ID NO: 633081 - RNA, 64 nt, hsa
cucucaaaaauaaucuuaaauacugcaaauagucccaacuaagauucagucaguauguuuguuu

SEQ ID NO: 633082 - RNA, 64 nt, hsa
gcaccuccugagaaggcgaggagagugguuguugccaacuaagcccucgaaccaaggcagccuc

SEQ ID NO: 633083 - RNA, 64 nt, hsa
ugguggauuucuuacuaccuaacgcccaagaaaaccaacuaaggacucucaaaccauaccuggu

SEQ ID NO: 633084 - RNA, 64 nt, hsa
gugccuucauacaauaauauuuuucucuuugucuccaacuaauauaaaauguuuugcuaaaucu

SEQ ID NO: 633085 - RNA, 64 nt, hsa
caagcaauucuaagaucuuccacaaaacaucuagccaacuaaaauggagagaugaaucauucug

SEQ ID NO: 633086 - RNA, 64 nt, hsa
cuaaacucaugcuuauugcuaaauguggucuuugccaacuaaauuuaagaugcagcauuuuaga

SEQ ID NO: 633087 - RNA, 64 nt, hsa
cuccagggcucaaggauccuccugccucagucucccaacuaagugggacuacaggcacgugcca

SEQ ID NO: 633088 - RNA, 64 nt, hsa
acccuccagauguauccuugggaaaagcaguaaaccaacuaauauuuauugaagaccuacuuug

SEQ ID NO: 633089 - RNA, 64 nt, hsa
gauuacaggcgugagccaccgugccuggccacgcccaacuaauuuuuguauuuuuaguagagac

SEQ ID NO: 633090 - RNA, 64 nt, hsa
gcauuauuucauaaaaugcuaucuuauacauaauccaacuaauugacauguagcucauguaugg

SEQ ID NO: 633091 - RNA, 64 nt, hsa
augaaaccagaaauccaugugaacuacagagccaccaacuaaauguacaucacaguuuucaaga

SEQ ID NO: 633092 - RNA, 56 nt, hsa
uuacaggaagugaagaaugagauggcccaacuaaaccaauuuggaaucauuaacua

SEQ ID NO: 633093 - RNA, 64 nt, hsa
acccugggagcagacaauaagaggaagaaugaagccaacuaaaauucugaaugcuuuuuguugg

SEQ ID NO: 633094 - RNA, 64 nt, hsa
uuaaguguuauuuauuuuacucaagaacuggaaaccaacuaaaugccuucuauagaaguaauuu

SEQ ID NO: 633095 - RNA, 64 nt, hsa
cugaguagcuggauuacaggcaugugccacccacccaacuaauuuuuguguuuuuaauaaagac

SEQ ID NO: 633096 - RNA, 64 nt, hsa
ugaagccacauuuuccaacaugagccucaugaagccaacuaaguguuauugaacuguaauucuc

SEQ ID NO: 633097 - RNA, 64 nt, hsa
uaucuaaugucucccuaauaagucuucuuuccuuccaacuaaaugaccuacacggacuuuuauu

SEQ ID NO: 633098 - RNA, 64 nt, hsa
uccuuuucuuucuguuguuguuucccagcuacaaccaacuaaagacacaaauggcguucugcaa

SEQ ID NO: 633099 - RNA, 64 nt, hsa
agugagacaucugccauucccaacucugggaaaaccaacuaauauacaaccauauaaaugaagg

SEQ ID NO: 633100 - RNA, 64 nt, hsa
aaauauucuaugguacauucucagaaauuggcuuccaacuaaaauacguuugacccauuuugaa

SEQ ID NO: 633101 - RNA, 64 nt, hsa
ugggccuuugauuuaccaacacuggaaaugccugccaacuaaucuuggauagauucuuuaaggc

SEQ ID NO: 633102 - RNA, 64 nt, hsa
ccacccgccagcuccaggacugccccuuccugggccaacuaaccagacaacugggaagagcccc

SEQ ID NO: 633103 - RNA, 64 nt, hsa
augaaguguguuuuucuuugguuucuucuguuuuccaacuaaauauuuuuuucuaaauaaauau

SEQ ID NO: 633104 - RNA, 64 nt, hsa
guaaugcaagaaccaaaugcacugugauguggcaccaacuaauuagcaagcaugaauuuuucac

SEQ ID NO: 633105 - RNA, 64 nt, hsa
aggguaucgcauacucaaaugguagacaaugaccccaacuaaaucuuccugauguuacacugcu

SEQ ID NO: 633106 - RNA, 64 nt, hsa
uuguaacuuaccaaaaacaaaccaucauaucauaccaacuaaaaugauauauggaugaagcaac

SEQ ID NO: 633107 - RNA, 64 nt, hsa
acuccaggugugugguauuauggaaagcaaauugccaacuaauggcacguccuuucuuucuuug

SEQ ID NO: 633108 - RNA, 64 nt, hsa
agggaauaauaaaggccugauuuuuugucuuauuccaacuaaguagaucauuaucucuuuccuu

SEQ ID NO: 633109 - RNA, 64 nt, hsa
agagagcaugauggagcagagucccagucacugaccaacuaacuggucguuugauuaggaaaca

SEQ ID NO: 633110 - RNA, 64 nt, hsa
auccagugaccucucucucugggacuugguuuccccaacuaaaauuugaaguaguugaaugggg

SEQ ID NO: 633111 - RNA, 64 nt, hsa
gugucuuuugugcuuuuuuguuguuauuaaaacaccaacuaaaccuuauagucaagacaaggcu

SEQ ID NO: 633112 - RNA, 64 nt, hsa
agaagacauugcguuaucuuauuuccaaaacguuccaacuaaaaaacauuuuccuauuaaaaua

SEQ ID NO: 633113 - RNA, 64 nt, hsa
uuauuuuuauauggaaaaguuuuaaggacuugggccaacuaagucuacccacacgaaaaaagaa

SEQ ID NO: 633114 - RNA, 64 nt, hsa
aaguaacuaagacuacaggcaugcaccaccauacccaacuaauuuuauuuuuuauuuuuugcag

SEQ ID NO: 633115 - RNA, 64 nt, hsa
gauauugucucccauuuuauuacacauuuuaaagccaacuaacgaaggcagcugagucccucag

SEQ ID NO: 633116 - RNA, 64 nt, hsa
uucagaggaaaguaccagucaguaaagaaaaaugccaacuaaacaugaaacuauugaucaauac

SEQ ID NO: 633117 - RNA, 64 nt, hsa
aauagccaggggcuacaggcauauaccaccaugcccaacuaauuuuuuaauuuuuuguagagau

SEQ ID NO: 633118 - RNA, 64 nt, hsa
auauuuaugaagcaagaauagguacagucauuuuccaacuaacaucuagugagacugggauuca

SEQ ID NO: 633119 - RNA, 64 nt, hsa
gcauuuaguugaaugaagucuucuuggauuucacccaacuaaaaggauuuuuaaaaauaaauaa

SEQ ID NO: 633120 - RNA, 64 nt, hsa
aaauuuuugauagaauuaaauuuaaauuuauccuccaacuaaauuuuugauagaauuaaauuua

SEQ ID NO: 633121 - RNA, 64 nt, hsa
auuauuucaacacaauggaagagcacaguuaaggccaacuaacguaaaaugcacugaagccuua

SEQ ID NO: 633122 - RNA, 64 nt, hsa
aauuuaaguuuuaaauauuguguuuauaaaauaaccaacuaauaaccauuugucuuucccauuu

SEQ ID NO: 633123 - RNA, 64 nt, hsa
aaguaaacaacauauuugggguuugcuuguaaaaccaacuaaauaaaaaauucaaaccaauuca

SEQ ID NO: 633124 - RNA, 64 nt, hsa
ggguuuuguucccccuccaucucgauucucguacccaacuaaaaaaaaaaaaauaaagaaaaaa

SEQ ID NO: 633125 - RNA, 64 nt, hsa
aguuagaaaacauaaucuucugccuucucaugauccaacuaaugccuuacucuucuugaaauuu

SEQ ID NO: 633126 - RNA, 64 nt, hsa
augauaucaaaagaauaaucaauuuaguuaccucccaacuaaaaaguaaaaaugaaaaagacga

SEQ ID NO: 633127 - RNA, 64 nt, hsa
uucugcuccaugcucuuccucgggucaaagcggaccaacuaacgccuaaaccucgguauuagcc

SEQ ID NO: 633128 - RNA, 64 nt, hsa
aacacuucacagagggucacaguccaugaucugaccaacuaagcuuuuaaaaaucaacuauuac

SEQ ID NO: 633129 - RNA, 64 nt, hsa
uuccaaauguauuucauuacuauagucacaauauccaacuaaaaauuacgcuaucuagaauugu

SEQ ID NO: 633130 - RNA, 64 nt, hsa
uaauuuauuuuugauucuuuguuuucuuuuucguccaacuaaaacaacuguaauguacuugaua

SEQ ID NO: 633131 - RNA, 64 nt, hsa
gagaauuuaaagcagauuaccuuuuaaaacuggaccaacuaaguaauugguauuuaaucaaaga

SEQ ID NO: 633132 - RNA, 64 nt, hsa
ucugcacacucacauuaucuugcuaucacuguaaccaacuaaugccaaaagaacgguuuuguaa

SEQ ID NO: 633133 - RNA, 64 nt, hsa
aagcacaggaaacagaccuuaaaauuguaaccuaccaacuaacuuacaugcuuauaaaaguaaa

SEQ ID NO: 633134 - RNA, 64 nt, hsa
auuaaaguuuguguguuguguccauuuugcaaacccaacuaagccaggaccccaaugcgacaag

SEQ ID NO: 633135 - RNA, 64 nt, hsa
cuugcuuucaggaagagagauguguuucaacaagccaacuaaaauauauugcugcaaauggaag

SEQ ID NO: 633136 - RNA, 64 nt, hsa
cuguuaucagggcccaaauaacaguggcaagcuaccaacuaaguuguauuuuaauaaagauucc

SEQ ID NO: 633137 - RNA, 64 nt, hsa
gucucugaagacaaauaauuaaaccuuuuuuuucccaacuaaagaauggauuuaauuaaacuau

SEQ ID NO: 633138 - RNA, 64 nt, hsa
gccaggauugauggcagcugagggaaauucuugcccaacuaaacccagaacucaaacuuaacau

SEQ ID NO: 633139 - RNA, 64 nt, hsa
acucaucauggucacauccagcccccacccccggccaacuaaccacugcaggcuccucuuccag

SEQ ID NO: 633140 - RNA, 64 nt, hsa
gaccccugcuaacacaugcaggucuucucuucugccaacuaacgugcucgcgcccucccagcac

SEQ ID NO: 633141 - RNA, 64 nt, hsa
cacuaucagagccacaaaucugggaccugucuuuccaacuaaauuggaggcuuuggaagggcag

SEQ ID NO: 633142 - RNA, 64 nt, hsa
ccagggccugccggcgcggggaggaaagcaaaauccaacuaaugguauauauuguaggguacag

SEQ ID NO: 633143 - RNA, 64 nt, hsa
gcaaugaaucuagaugcaauuaauuuuauuccuuccaacuaaaauuacaauauuuuuagguuaa

SEQ ID NO: 633144 - RNA, 64 nt, hsa
uugucuccuccuuuaacugagucaucaucuuaguccaacuaaugcagucgauacaaugcguaga

SEQ ID NO: 633145 - RNA, 64 nt, hsa
agccaugguucuuucugguggaaaacagaauucuccaacuaaaaauauuuuaauggcagacuga

SEQ ID NO: 633146 - RNA, 64 nt, hsa
aaaaacccuacaucuagcaucauccuugauguuuccaacuaaaugcuuuccuacuaagaucagg

SEQ ID NO: 633147 - RNA, 64 nt, hsa
gcuuuucuacaauuggcagaucagguuugucuggccaacuaaggacaccaggaggguugugggc

SEQ ID NO: 633148 - RNA, 64 nt, hsa
ugcagcuugcuugcugcauuuugaauugucaaagccaacuaauaccgugacccgacugauaccu

SEQ ID NO: 633149 - RNA, 64 nt, hsa
aaguagcugggauuacaggcacccaccaccaugcccaacuaauuuuuguauuuuuauagagaua

SEQ ID NO: 633150 - RNA, 64 nt, hsa
uacaaacaaugcaaccaacuauccaaguguuauaccaacuaaaacccccaauaaaccuugaaca

SEQ ID NO: 633151 - RNA, 64 nt, hsa
uugagaaagaugucaugcaaaaggacgacgguggccaacuaaagcaagucuuccuuccacccug

SEQ ID NO: 633152 - RNA, 64 nt, hsa
gugcauuagguauauauuuuuugaaguauuuuugccaacuaaaaugaagucuguaaauucuguu

SEQ ID NO: 633153 - RNA, 64 nt, hsa
guuuuuuaggaaucagaaucauuucaggagaaaaccaacuaaguagacuuuaauucuucucuuu

SEQ ID NO: 633154 - RNA, 64 nt, hsa
ccucauccggggcuuuggauagagugagaauuccccaacuaaauuggacuucucugcuuuaucc

SEQ ID NO: 633155 - RNA, 64 nt, hsa
ccuagauauuuaugugaaaccucccaguguauugccaacuaaaucaaauuuuuaaagaugcuua

SEQ ID NO: 633156 - RNA, 64 nt, hsa
ucagauauacaugucuagauguuacagcaaagccccaacuaaucuuuagaagcauauuggaacu

SEQ ID NO: 633157 - RNA, 64 nt, hsa
cuuagcaaggaaacagugcaggaaauguagguuaccaacuaagcagcuuuugcucuuaguacug

SEQ ID NO: 633158 - RNA, 64 nt, hsa
auagcuuacauuuccucuuuuugccuuuaucuccccaacuaaaauacaauggggaagaagucug

SEQ ID NO: 633159 - RNA, 64 nt, hsa
aaguccuucauacaccuucuggguagggaaacaaccaacuaauugacuaacaccaccaacaaca

SEQ ID NO: 633160 - RNA, 64 nt, hsa
agaaaaaaacgaaaacagucaaccaaccccaucgccaacuaagcgaggcaugccugagagacau

SEQ ID NO: 633161 - RNA, 64 nt, hsa
aacauuucauuaugaggucagacuaggauaauguccaacuaaaaacaaacccuuuucauccugg

SEQ ID NO: 633162 - RNA, 64 nt, hsa
aaaugcagagaugaggcuaaggcaagaauaugccccaacuaaagcauagauuccccaaagugag

SEQ ID NO: 633163 - RNA, 64 nt, hsa
aaaaucaguaguuaggcagcccagcugagguggaccaacuaauuggaaacacucuuccccuucu

SEQ ID NO: 633164 - RNA, 64 nt, hsa
aauagcuagaauucaaauugauuauugcuaguggccaacuaaaccuguacaaaauagcugacag

SEQ ID NO: 633165 - RNA, 64 nt, hsa
acuuccaaaggucaauaugucguccuuuggcaucccaacuaacaauaaagaauaggcuauaagg

SEQ ID NO: 633166 - RNA, 64 nt, hsa
acuucuaaaggucaauauaucauccuuuggcaucccaacuaacaauaaagaguaggcuauaagg

SEQ ID NO: 633167 - RNA, 64 nt, hsa
gcuccccuguccucuucaaucccuugagauauagccaacuaacgacgcuacuggaagccccaga

SEQ ID NO: 633168 - RNA, 64 nt, hsa
auuuuuucuuucuuuuuuuaauacacauaugcaaccaacuaaacaguuauaaucuuggcacugu

SEQ ID NO: 633169 - RNA, 64 nt, hsa
uguaguuuccgcuuugcuugcuuguuuaacaaacccaacuaaagugcuugaggcuaccucuacc

SEQ ID NO: 633170 - RNA, 64 nt, hsa
ggaaccauuccuuuauguugccccuuacugaugcccaacuaauguguuucugguuacuaacaga

SEQ ID NO: 633171 - RNA, 64 nt, hsa
aacauaaccaaaaauuaaauugaaacaaaaugucccaacuaagaaaauauauagagcauuuuau

SEQ ID NO: 633172 - RNA, 64 nt, hsa
ugucugcuuacucacccacucuguccuuuccucaccaacuaacaugugccagccaggcagaguc

SEQ ID NO: 633173 - RNA, 64 nt, hsa
cuaauuugcuuuggugggguccuuaaaacauuucccaacuaaagaauagaauuguaaaggaaaa

SEQ ID NO: 633174 - RNA, 64 nt, hsa
aucuauuugguuuaaaaaguauucuaucuuaaggccaacuaauauaaaauaccauuguuaaaga

SEQ ID NO: 633175 - RNA, 64 nt, hsa
uauuuggcuauaaaaagucagcauaaaauaugauccaacuaaaagggauuaauuuuuggcauuu

SEQ ID NO: 633176 - RNA, 64 nt, hsa
uuugucaaugguagugacuuacugaacaugggcaccaacuaauuuuguuguuguucuaccagaa

SEQ ID NO: 633177 - RNA, 64 nt, hsa
uuuguuucgccugaucucaaguuuuagcaacucaccaacuaaggcguaaccucauuuuauguuc

SEQ ID NO: 633178 - RNA, 64 nt, hsa
cuuuuuuuucuuucucuuuuuuuuucuuaaaaugccaacuaaaauaauuagaaaguagcuuauu

SEQ ID NO: 633179 - RNA, 64 nt, hsa
aacuuuuaacccgcuucuaccugcccaacugugaccaacuaaaugacagaugugugagaacaag

SEQ ID NO: 633180 - RNA, 64 nt, hsa
aaaacuuuggaaaguguguuaccuauauuucuagccaacuaacucacagaaaaacuguuuacuu

SEQ ID NO: 633181 - RNA, 64 nt, hsa
ggaucuucaaaaaauaaaauaaugugaagcaaaaccaacuaaaaagugauucuugcacaugaac

SEQ ID NO: 633182 - RNA, 64 nt, hsa
uaagacuuggauucucuucugcccuuguuaaucuccaacuaauuacuacagauugacacguuuu

SEQ ID NO: 633183 - RNA, 64 nt, hsa
uuauugcuuuaaacaaguuugugcuuaaucugucccaacuaaaauggagcuuauaaacuuacuu

SEQ ID NO: 633184 - RNA, 64 nt, hsa
gucacccucccucugcugggaugagguccaggagccaacuaaaacaauggcagaggagacaucu

SEQ ID NO: 633185 - RNA, 64 nt, hsa
aaguagcugggacuacaggcacacgccaccacacccaacuaauuuuuguauuuuuaguagagau

SEQ ID NO: 633186 - RNA, 64 nt, hsa
ggcaguggggagcccccaucccuucacaccgccaccaacuaaccaagcuuggccucugacuccc

SEQ ID NO: 633187 - RNA, 64 nt, hsa
auucaugucugccuggggcccuuccgaaccugugccaacuaagggcccccacuguaagcccccg

SEQ ID NO: 633188 - RNA, 64 nt, hsa
gacuccgucacaacaacaacaacaaaaagcuuccccaacuaaagccuagaagagcuucugaggc

SEQ ID NO: 633189 - RNA, 64 nt, hsa
cugccagacggcacccacccagcacccagcaacuccaacuaacaagaaacucacccccaagggg

SEQ ID NO: 633190 - RNA, 64 nt, hsa
caggcccuggcucuguaaccauuaaccucuucccccaacuaacaccaaugaaaacaccauucca

SEQ ID NO: 633191 - RNA, 64 nt, hsa
uauguugacuaaauuuacaaauaaacuuguuuauccaacuaaguguccaaaaccuaaauugaau

SEQ ID NO: 633192 - RNA, 64 nt, hsa
ggguguggcuuuuuuucucuccuuuuuaccaaccccaacuaaacugggaguaagacuuagucag

SEQ ID NO: 633193 - RNA, 64 nt, hsa
gauguuaacaguauuaaaaauuaaaccccauaaaccaacuaagccuuauggaauucacagucac

SEQ ID NO: 633194 - RNA, 64 nt, hsa
auaaugucaggucuuucacucauauaaaaaagcaccaacuaaugacacuuuaauuguuuuucuu

SEQ ID NO: 633195 - RNA, 64 nt, hsa
ugugugaaaugaaggaacugucaauaauugacagccaacuaauacaguaaacuguuauacuagu

SEQ ID NO: 633196 - RNA, 64 nt, hsa
ucccuuuguaaagacuuggggaguaaggacauuaccaacuaaauugcuucuucgaaacugaagu

SEQ ID NO: 633197 - RNA, 64 nt, hsa
gcacugaaacuguguauuaccaagcucacucuagccaacuaaauaaaaaucucuggcaguaaaa

SEQ ID NO: 633198 - RNA, 64 nt, hsa
cuuuacuggacugauuuuaacccgcugcacaacaccaacuaaaaguaguaauaccagcauacuu

SEQ ID NO: 633199 - RNA, 64 nt, hsa
uaguagcuggcauuacaggcacaugccaccacgcccaacuaauuuuuauauuuuuaguagagac

SEQ ID NO: 633200 - RNA, 64 nt, hsa
gcuuucuacuuuauaucauauacaaaaauaaaauccaacuaaagaccagaauauaaaaagcaaa

SEQ ID NO: 633201 - RNA, 64 nt, hsa
uacuugggagauaggccaagcgagaggucaugggccaacuaaguguuauccaguagaaaagaca

SEQ ID NO: 633202 - RNA, 64 nt, hsa
gauaaacacaaaauccauuccagguagcucggcaccaacuaagaaaaaaagcacaaaguucuca

SEQ ID NO: 633203 - RNA, 64 nt, hsa
gaguagcugggauuacaggcaugcgccaccacgcccaacuaauuuuguauuuuuaguagagacg

SEQ ID NO: 633204 - RNA, 64 nt, hsa
aacggauggccucuacgcuguuccaucacagucuccaacuaaggcuuaugguauuucauuaaac

SEQ ID NO: 633205 - RNA, 64 nt, hsa
ugaucaccaccaacaucauaggucuauaaaucacccaacuaagaucagggguguuucaugggaa

SEQ ID NO: 633206 - RNA, 64 nt, hsa
gacuugauguauuuuuucauuuuguccaguguuaccaacuaaauugugcaguuuggggcuuuuc

SEQ ID NO: 633207 - RNA, 64 nt, hsa
aaguuaauauucagauguuggucuuggucauuugccaacuaauuuuaaaguaaaaggcacugca

SEQ ID NO: 633208 - RNA, 64 nt, hsa
cucauaugaaggaugaaaaagaggcccugauaaaccaacuaacuuugguggaauccuuguggac

SEQ ID NO: 633209 - RNA, 64 nt, hsa
caguagcugggaccacaggugcccgccaccacacccaacuaauuuuuguauuuuuaguagagac

SEQ ID NO: 633210 - RNA, 64 nt, hsa
caaucuggaacaaugucccuccucuuagaaugucccaacuaaagaccaguuaaaauauuagggu

SEQ ID NO: 633211 - RNA, 64 nt, hsa
gagaguguuucuccaagguuuucuaucuucaaaaccaacuaaguuaugaaaguagagagaucug

SEQ ID NO: 633212 - RNA, 64 nt, hsa
ucuucuugcccuuaagggucuuuuaccucccucaccaacuaagauuuggucauguugcguauaa

SEQ ID NO: 633213 - RNA, 64 nt, hsa
uuuggauaaaauuggguuuuaacauaccucgaguccaacuaaucucauuaaacaaauauucucc

SEQ ID NO: 633214 - RNA, 64 nt, hsa
uguguauauauuucuaucucuugcuacaauaauuccaacuaagugaacuucucaauuaucauca

SEQ ID NO: 633215 - RNA, 64 nt, hsa
cagcaggcucaaaggcauaagucauuccaaucagccaacuaaguuguccuuuucugguuucgug

SEQ ID NO: 633216 - RNA, 64 nt, hsa
agucuuguuggagaagcccagagagaaugggacuccaacuaagggaaccugaaaucaacucaau

SEQ ID NO: 633217 - RNA, 64 nt, hsa
uccuuuuuuuuuuuugaucgauugaaaucuuuugccaacuaaguggacaucagucuccauuuuu

SEQ ID NO: 633218 - RNA, 64 nt, hsa
ugaaaccuaaauagaauucuuaaaauguuauuuaccaacuaaguauucauguucaaauuacuua

SEQ ID NO: 633219 - RNA, 64 nt, hsa
cuguuguuuuuaggauggagcugguuguuauucaccaacuaagggaacaguuagagcagagaug

SEQ ID NO: 633220 - RNA, 64 nt, hsa
uguuugacaauaaauugugcuguacauguccuuaccaacuaaaugauguaaaacuuucuuaaag

SEQ ID NO: 633221 - RNA, 64 nt, hsa
cugucucuuccugcuuuagacagccauuaagaucccaacuaauuuuaccgaaccuaaaacccac

SEQ ID NO: 633222 - RNA, 64 nt, hsa
gaguguuaauagcagcaguccucccccuaccccgccccgagaccccaccccgagaccccacccc

SEQ ID NO: 633223 - RNA, 64 nt, hsa
agcaguccucccccuaccccgccccgagaccccaccccgagaccccaccccggaccaguuacau

SEQ ID NO: 633224 - RNA, 64 nt, hsa
gcaccucuucaaugacugucugcugcugucucggccccgagaggguagccgauuccugguauuu

SEQ ID NO: 633225 - RNA, 64 nt, hsa
cuccccccagguacagugccuucgagccuacaagccccgagagaaugaugaauuggcacuggag

SEQ ID NO: 633226 - RNA, 56 nt, hsa
aaugcugcuccaucaugugagccggcccccgagaccccggcccccaccccacacca

SEQ ID NO: 633227 - RNA, 64 nt, hsa
gcuuggaccaggguccugggucuucccaaccauaccccgagaucaggccccaccugccagcucu

SEQ ID NO: 633228 - RNA, 58 nt, hsa
ugcuugaagcuguuuccuuuacucacauugaagggacuucguugguuuuuuggagucu

SEQ ID NO: 633229 - RNA, 58 nt, hsa
ugcuugaaacuguuuccuuuacucauguugaagggacuuuguuggcuuuuagaguguu

SEQ ID NO: 633230 - RNA, 58 nt, hsa
ccugaugaguguuccccaggaugcacauugaagggagggcucaggcagcugagggcug

SEQ ID NO: 633231 - RNA, 58 nt, hsa
ggccaguuggccaccagggggagugggcugaagggagaguagauggugcaaagcaagc

SEQ ID NO: 633232 - RNA, 58 nt, hsa
auuacauucuauaguuaccaaaaaugguugaagggagggauuucucauugcagagggu

SEQ ID NO: 633233 - RNA, 58 nt, hsa
augccuuguccugauguugaaggauuugugaagggaaaaaaaauucuggacucuuuga

SEQ ID NO: 633234 - RNA, 58 nt, hsa
gacugcugagugagagggcaggggcaguugaagggaacaugaauugcuggaacagcua

SEQ ID NO: 633235 - RNA, 58 nt, hsa
guuggggguuuuuuuuguuuuuuuaaaaugaagggacaaagucaacuggacugcugag

SEQ ID NO: 633236 - RNA, 58 nt, hsa
agaauauauuccuugccuguguuagacaugaagggaaaaagaggucacauauugugau

SEQ ID NO: 633237 - RNA, 58 nt, hsa
gaguccaggauggaauuucacaggaaagugaagggauacugcaggccuguguuugcag

SEQ ID NO: 633238 - RNA, 58 nt, hsa
ugauaauaagaaacauuguuacagauggugaagggagaaagugguauuuauuaauaua

SEQ ID NO: 633239 - RNA, 58 nt, hsa
auaagaaggaccaacucuaggcucaauaugaagggauuuaguucuguaagcagcaaaa

SEQ ID NO: 633240 - RNA, 58 nt, hsa
uguccucaccacaugcggagaacaaaugugaagggaguaggauauugggucagugucc

SEQ ID NO: 633241 - RNA, 58 nt, hsa
cacaauaguaaccuggguaaaugcagcgugaagggauuuuagucacacguggucuuuc

SEQ ID NO: 633242 - RNA, 58 nt, hsa
uuacaaucaaacaccaauuccugguuaaugaagggagagugugggcuuagcagaguua

SEQ ID NO: 633243 - RNA, 58 nt, hsa
guacuacauguaucuauccacacacugcugaagggaacuugacccuacgcauuccaaa

SEQ ID NO: 633244 - RNA, 58 nt, hsa
agaacagccccucuccccagucacagccugaagggaggccccgagagcuuccuccuuc

SEQ ID NO: 633245 - RNA, 58 nt, hsa
uggggugcuuuuccugaaucuuugcgggugaagggaguguugcucccaguccagaggc

SEQ ID NO: 633246 - RNA, 58 nt, hsa
auguagacuggcuugcuuugauuuuuagugaagggaauguacguaaaacaaaauaggg

SEQ ID NO: 633247 - RNA, 58 nt, hsa
aaacucagucuuuucacccucauucagaugaagggacucaggacaggcucugugacuu

SEQ ID NO: 633248 - RNA, 64 nt, hsa
ggaaaugaagaagcaucuuccuuaggucugcccugcuugcaaauccacuagcaccgaccccacc

SEQ ID NO: 633249 - RNA, 64 nt, hsa
ugccucucgagacauacaaauccuugcuuugucagcuugcaaaggaggagaguuuaggauuagg

SEQ ID NO: 633250 - RNA, 64 nt, hsa
agcaucagcaauugcuacucaauugucaaacacagcuugcaauauacauagaaacgucugugcu

SEQ ID NO: 633251 - RNA, 64 nt, hsa
guuugauuuaauagguaucuuaaucaagaauuaagcuugcaacauuggcuuugcucagaugcag

SEQ ID NO: 633252 - RNA, 64 nt, hsa
ccacuuuuccacuucucacucuuauggucucaaagcuugcaaagauagcuucugauauuguugu

SEQ ID NO: 633253 - RNA, 64 nt, hsa
uccaacuuccacuucucacucuuauggucucaaagcuugcaaagauagcuucugauauuguugu

SEQ ID NO: 633254 - RNA, 64 nt, hsa
ccucacucaacuucagccaggaggacuggguggugcuugcaauguuggaaugaccggcucaaag

SEQ ID NO: 633255 - RNA, 64 nt, hsa
cugggaacacaaaggcagcugauaagcagguucugcuugcaaagaggccucaguccagugggag

SEQ ID NO: 633256 - RNA, 64 nt, hsa
aauuagacaaggauuuacuaccuggccccugguggcuugcaaaauuguuggaagagcuggagaa

SEQ ID NO: 633257 - RNA, 64 nt, hsa
gccccuccugagugugucacuaacagcccacugugcuugcaaagcauuuuguucccuuuugccu

SEQ ID NO: 633258 - RNA, 64 nt, hsa
guuuccuucaugcccaagccugagcucagauccagcuugcaacuaauccuucuaucaucuaaca

SEQ ID NO: 633259 - RNA, 64 nt, hsa
auuaugcauucuucaugaauacuuuuguauugcugcuugcaaauaugcauuuccaaacuugaaa

SEQ ID NO: 633260 - RNA, 64 nt, hsa
guuaauuuuuaaauguuuacauaauggccagaaggcuugcaaaucuguauuuaauugcauuuua

SEQ ID NO: 633261 - RNA, 64 nt, hsa
ugccgaaagaggguauuauggguggguggugugggcuugcaaauacaagcuuggaggugagaca

SEQ ID NO: 633262 - RNA, 64 nt, hsa
gagaaacacaggcuugucgugccguuuaagcuuugcuugcaagaguggaugccccgcaaucguu

SEQ ID NO: 633263 - RNA, 64 nt, hsa
cauuccauauuauuauaguuaaugucuuaauccagcuugcaagugaauggaaaaaaaaauaagc

SEQ ID NO: 633264 - RNA, 64 nt, hsa
cagugaggagacugcccagugccuuuggggcugugcuugcaauaaagaauuuccuggaaaggca

SEQ ID NO: 633265 - RNA, 50 nt, hsa
cauuuauaagugguaaaugagcuugcaauguguuaaagaagauuaaccau

SEQ ID NO: 633266 - RNA, 64 nt, hsa
ucaagaguaaagauuauacugcucuguacaggaagcuugcaaauuuucuguacaaugugcugug

SEQ ID NO: 633267 - RNA, 64 nt, hsa
auauauacaguauguauauuuuuuaaaaagauuugcuugcaaugaccuuauaagugacauuuaa

SEQ ID NO: 633268 - RNA, 64 nt, hsa
uccaaucagucaaaagaggucaaugaauuaaaaggcuugcaacuuuuucaaaaaccuguuagaa

SEQ ID NO: 633269 - RNA, 64 nt, hsa
cacguuuggaaaauaaucugcagaaacgagcugugcuugcaaagacuucauaguucccaagaau

SEQ ID NO: 633270 - RNA, 64 nt, hsa
aaaaacaggccagaauggguaaagacuugucaaagcuugcaacauagcuacauggugcacccgg

SEQ ID NO: 633271 - RNA, 64 nt, hsa
auugauagaguguuaucagucauaacuaaauaaagcuugcaacaaaauucucugacacauaguu

SEQ ID NO: 633272 - RNA, 64 nt, hsa
cucaugcuccuggaauagggaauagggaucucaugcuugcaaacuacacaaugcugcaggugcu

SEQ ID NO: 633273 - RNA, 64 nt, hsa
gacuucugagcuauaacuugugggaguaauaccagcuugcaaugggucagcacuuuaccuuuuu

SEQ ID NO: 633274 - RNA, 64 nt, hsa
aauugugacuuuauucuacuguaagcaauaauuugcuugcaauuuuucauguaauuuuuaaauu

SEQ ID NO: 633275 - RNA, 64 nt, hsa
gccaaaacauaaaaaaaaaaaaauccucaguauagcuugcaauuaagaccuagaucacaguauu

SEQ ID NO: 633276 - RNA, 64 nt, hsa
uuaaggcuaauacaaugacagacugagcaaaauugcuugcaaaaguggcacagaguuagcacuc

SEQ ID NO: 633277 - RNA, 64 nt, hsa
uguacucuaguccugacuuggggugcagagggcugcuugcaauccuguuuguaaggcugugccu

SEQ ID NO: 633278 - RNA, 64 nt, hsa
agguuauaggucuuucucucucuagauuucaggugcuugcaacuggacugcagacucuaccaau

SEQ ID NO: 633279 - RNA, 64 nt, hsa
uaucugacaaaauucccuugaauuuuuauccuuugcuugcaacauuuaagacucaaagucacug

SEQ ID NO: 633280 - RNA, 64 nt, hsa
uggagagauucuggcaaccuuugaacagcccagagcuugcaaccuagccucacccaagaagacu

SEQ ID NO: 633281 - RNA, 64 nt, hsa
uuuauuggguguuaacuuugacagcugagagugggcuugcaagaacacaaucuaaaaguguguu

SEQ ID NO: 633282 - RNA, 64 nt, hsa
gaagagaaacugcaaacguggaaagugugacaaagcuugcaaccacacucaaucuauucuaaau

SEQ ID NO: 633283 - RNA, 64 nt, hsa
uuacaagcuuuaauggacucguaagccagcaugggcuugcaaaaauuucuuguuuaccagagca

SEQ ID NO: 633284 - RNA, 64 nt, hsa
uuucacuacacuucuauucucaguaaccaagauugcuugcaacuuuuuuugccuuggugacuuu

SEQ ID NO: 633285 - RNA, 64 nt, hsa
uuugauuugaugucaucuguuugcccuucaucuugcuugcaagugugcaugguucaaucccuca

SEQ ID NO: 633286 - RNA, 64 nt, hsa
guuaagggcauuguaaauacuguaguuuuauguagcuugcaacuucuacugaaaugaguuuaau

SEQ ID NO: 633287 - RNA, 64 nt, hsa
cuguuaugcuccugauagccaauagcagauagaagcuugcaaucaagaggguaggacauguguu

SEQ ID NO: 633288 - RNA, 64 nt, hsa
cugaagcuaccugauuuauucuauuaaauuguaagcuugcaaacucaaaauaaauuggcagauu

SEQ ID NO: 633289 - RNA, 64 nt, hsa
uugaugguggcguuuuugaaauguagaacagagugcuugcaaaauguaauaaauacacuugugu

SEQ ID NO: 633290 - RNA, 64 nt, hsa
ugccaugagguaaauguaauguuucaggcauucugcuugcaaaaaaaucuaucaugugcuuuuc

SEQ ID NO: 633291 - RNA, 64 nt, hsa
cacuuuacuuucagguuaaaaauguuucuaacacgcuugcaacuucccuuauggcauuaaucuu

SEQ ID NO: 633292 - RNA, 64 nt, hsa
aaaaaauucucaagugcaauguguuuuaaaauaagcuugcaaaugacagcagagacauuuacuu

SEQ ID NO: 633293 - RNA, 64 nt, hsa
ggaccagaggaagccccuuacuaugaucucaggagcuugcaagaagcaggaaggggaauggaau

SEQ ID NO: 633294 - RNA, 64 nt, hsa
agugguaacacacuuaguuaauaaaauaagccaggcuugcaacuaaguaucuaacuuuacaggc

SEQ ID NO: 633295 - RNA, 64 nt, hsa
gucccaagggcccaauggccugacuuuuagaauugcuugcaauugguguuuucucuugaauuug

SEQ ID NO: 633296 - RNA, 64 nt, hsa
uuggccaccugucugcaagagaggcggccccugugcuugcaacgcuuacguguugaucccagug

SEQ ID NO: 633297 - RNA, 64 nt, hsa
uugccuuaagaguuacuagcgaggucaguguuaggcuugcaauagggauuuuaaaauacacuaa

SEQ ID NO: 633298 - RNA, 64 nt, hsa
aauguccaaguuuguguaaaaccagugcauuucagcuugcaaguuacugaacacaauaaugcug

SEQ ID NO: 633299 - RNA, 64 nt, hsa
guccacccagucacauccgugcagcccucucuuggcuugcaagauaacgcuuuuauuuuuauuu

SEQ ID NO: 633300 - RNA, 64 nt, hsa
uuguccaugguucugacuuucugugaaggcaccagcuugcaauaugccaucccauuucaccuug

SEQ ID NO: 633301 - RNA, 64 nt, hsa
gacuccagaugccuauuauuaguuaggcuucugagcuugcaaucauauugaauguaugaagagc

SEQ ID NO: 633302 - RNA, 64 nt, hsa
aacucaaggucaacggcuuauuagugaaacuggggcuugcaagaggaggugguucugaaagugg

SEQ ID NO: 633303 - RNA, 64 nt, hsa
gggccacguuuuaccuucagugagguuuuguuuggcuugcaaugaguacauggguuuuagguug

SEQ ID NO: 633304 - RNA, 64 nt, hsa
cauaugaagaaaucauugaaugugcugaccaaaggcuugcaauaucccacucccagauugcaca

SEQ ID NO: 633305 - RNA, 64 nt, hsa
cccggggacaguggcugugcuuuuaaaaagagaugcuugcaaagcaauggggaacguguucucg

SEQ ID NO: 633306 - RNA, 64 nt, hsa
agucuguagacauuuuugccuuugcccuugaaaugcuugcaaaauacuuuguuaacaaaagcug

SEQ ID NO: 633307 - RNA, 64 nt, hsa
ugauaauuuucucuucuugcugcaaaacugguuggcuugcaacccagagagagcagcuucccuu

SEQ ID NO: 633308 - RNA, 64 nt, hsa
cuccuauucagcaguuuuuguggaaagcaguaaugcuugcaaaacgugugugucauucagcauu

SEQ ID NO: 633309 - RNA, 64 nt, hsa
uagaguagaacacagccccggaaugcuuccaguugcuugcaagggaccaugccggcccgggugg

SEQ ID NO: 633310 - RNA, 64 nt, hsa
guccccauauuagcugcauugccaucuucugggagcuugcaagaaauguacauucucaggaucc

SEQ ID NO: 633311 - RNA, 64 nt, hsa
aacuguauccaaauuuucagaaaagacagcuucagcuugcaaauucuauccucuaaacuuaucu

SEQ ID NO: 633312 - RNA, 64 nt, hsa
agagugacuagaaaguuucuaggagcaccuccaggcuugcaaagaaagugaggccucuugguau

SEQ ID NO: 633313 - RNA, 64 nt, hsa
cagugcaaaguguaauugggucauggucaaaaacgcuugcaacaucuaauuggcguucaagaua

SEQ ID NO: 633314 - RNA, 64 nt, hsa
aaagaggcuccagcauggggugggucagagaugugcuugcaagguccagggacugcguggucug

SEQ ID NO: 633315 - RNA, 64 nt, hsa
acaguaguuauuugacuguuaauaggugcuacuugcuugcaaggauuuggagauguaaacauga

SEQ ID NO: 633316 - RNA, 64 nt, hsa
ugggaaggugaccacauccaccuuuaaacacggggcuugcaacuuagcucacaccugaccaauc

SEQ ID NO: 633317 - RNA, 59 nt, hsa
cacggaucacuuuugucugauuccagccugcuugcaacccugggguccucuuguucccu

SEQ ID NO: 633318 - RNA, 64 nt, hsa
uguuuuuaaaugauuguuucuucuucaugcuuuugcuugcaauguagucaauaaaaccucaugu

SEQ ID NO: 633319 - RNA, 64 nt, hsa
uaugaaucgacaauuuggauuguugaacuugaaggcuugcaaaauaugguacaugcuggauagu

SEQ ID NO: 633320 - RNA, 64 nt, hsa
gcccauguagaaagagagagaccucaucuuucaugcuugcaagugaaauauguuacagaacaug

SEQ ID NO: 633321 - RNA, 64 nt, hsa
agaggaugacgacaacgugcaacagcagaaagaugcuugcaagcagagucagggucaccaguga

SEQ ID NO: 633322 - RNA, 64 nt, hsa
uguauuuaaagaaaauauuacuguuacauauacugcuugcaauuucuguauuuauuguucucug

SEQ ID NO: 633323 - RNA, 64 nt, hsa
gauuuuuaguuugguuuuuacagucaagccuacugcuugcaauuaagauaucaaucugaaaugc

SEQ ID NO: 633324 - RNA, 64 nt, hsa
aaggagaggauuauuguugauuccauuuacucaugcuugcaaaacuagagaccccuaaggcaga

SEQ ID NO: 633325 - RNA, 64 nt, hsa
cuuuucuguuugaauuaagaugggcuaagauggggcuugcaacauuaaacaugagcugagcauc

SEQ ID NO: 633326 - RNA, 64 nt, hsa
ggagcagaucuggggucagaaccggaccuggugggcuugcaagccugugccuuuuccacuaacu

SEQ ID NO: 633327 - RNA, 64 nt, hsa
gaggcaggagaauggcgugaacccgggagguggagcuugcaaugagccaagauugcgccacugc

SEQ ID NO: 633328 - RNA, 64 nt, hsa
guggauggcagauuuaaagggaagaaccacaaaggcuugcaaagauaggagaggcuccaucucu

SEQ ID NO: 633329 - RNA, 64 nt, hsa
aggcguccuaaagaccucuaggcuggaagcuugggcuugcaaguggauccgggaccgagggugg

SEQ ID NO: 633330 - RNA, 64 nt, hsa
uuacauuauugauaguuaagcucuuaauuguguagcuugcaaaagacagcacuuuuuaguuaca

SEQ ID NO: 633331 - RNA, 64 nt, hsa
augcugccccagugagauagugaguggucaccaggcuugcaaaugaacuucagacggaccucag

SEQ ID NO: 633332 - RNA, 64 nt, hsa
gccuugggguuggccguuccucuaaucuggacuugcuugcaaaggugccaggcugucuucuguc

SEQ ID NO: 633333 - RNA, 64 nt, hsa
aagguuuccauaagcuuggugacaaaauucauuugcuugcaaucuaaucugaacugaccuugaa

SEQ ID NO: 633334 - RNA, 64 nt, hsa
guucaacuuauuaacaauuaggcagacucuuuaugcuugcaaaaacuacaaccaauggaaugug

SEQ ID NO: 633335 - RNA, 64 nt, hsa
agucugacuugguucguuaguggauuacuucugagcuugcaacauagcucacugaagagcuguu

SEQ ID NO: 633336 - RNA, 64 nt, hsa
gaagcugcugggcuuggcucaggauguguucugggcuugcaagccccccgcccaaucauguguu

SEQ ID NO: 633337 - RNA, 64 nt, hsa
cuucacaugaagagccucugcagcccuucccacagcuugcaaggaccaagggaggccagcaggu

SEQ ID NO: 633338 - RNA, 64 nt, hsa
guggcacucaggucacccugaaaagcccccaggggcuugcaauucuggaaaauauuuugacuag

SEQ ID NO: 633339 - RNA, 64 nt, hsa
ccacuacuaggacagccaauuggaagaugccagggcuugcaagaaguaaguuucuucaaagaag

SEQ ID NO: 633340 - RNA, 64 nt, hsa
ggccaggagggcagguucccucucuggugcugcugcuugcaagucuuagaggaaauaaaaaggg

SEQ ID NO: 633341 - RNA, 64 nt, hsa
uauuucucauuuaaauuuugucaaaucuuucuuugcuugcaagcauuucuuguuacccaaaucu

SEQ ID NO: 633342 - RNA, 64 nt, hsa
augcucuaacuucaauauaccaauaaaauaaucagcuugcaauuucugauuauagcaucuccuu

SEQ ID NO: 633343 - RNA, 64 nt, hsa
guuuugaguucccucauucuuauuaccagaaagagcuugcaaauaguuuuacuuucuuggcacu

SEQ ID NO: 633344 - RNA, 64 nt, hsa
cuucuuucguuuccucgucaaacaucugauugacgcuugcaaacugucugaauuugccaugcaa

SEQ ID NO: 633345 - RNA, 64 nt, hsa
ugcaggccugagacugcuaucccuagaaaggucugcuugcaaaguuggcccuuggcuggcaucu

SEQ ID NO: 633346 - RNA, 64 nt, hsa
aaguuuaugugaagacagaauuuggauuuggaaggcuugcaaugugguugacuaccuuuugaua

SEQ ID NO: 633347 - RNA, 64 nt, hsa
augcucuaacuucaguauaccaauaaaacaaucagcuugcaauuucugcugguggugucucuuu

SEQ ID NO: 633348 - RNA, 64 nt, hsa
ggcucacagaaucaaagccuaugcuugguuuaaugcuugcaaucugagcucuugaacaaauaaa

SEQ ID NO: 633349 - RNA, 64 nt, hsa
aggacacaucgaaguuguuaaauuccugaucgaggcuugcaaagugaauccuuuugccaaggac

SEQ ID NO: 633350 - RNA, 64 nt, hsa
cagagcagcccggacccgaaaccuuucaggccccgcuugcaagagcuggaaaaaaacgcguauc

SEQ ID NO: 633351 - RNA, 64 nt, hsa
ccucugagcgaucaggcgaggccagcgagggugugcuugcaaauucaagcaauaagaggggggu

SEQ ID NO: 633352 - RNA, 64 nt, hsa
auacaaaaaaaauuagcuggguauguuggugcaggcuugcaaucccagcuacuugggacgcuga

SEQ ID NO: 633353 - RNA, 64 nt, hsa
agcacuuaacauuuuaggaauucuuuuuaaagcugcuugcaaaguguuggugauuuuacugaaa

SEQ ID NO: 633354 - RNA, 64 nt, hsa
uuguuucuuuauauaguuugcguuugauauuagugcuugcaauuguauuaaagucaaaagcuga

SEQ ID NO: 633355 - RNA, 64 nt, hsa
aacuuaaaauugaauugguuugauuaaaaauaaagcuugcaauuuuaaaaguagcucacauuua

SEQ ID NO: 633356 - RNA, 64 nt, hsa
caaaacagaagaaacaaacaaacaaacaaaaaaagcuugcaaaauauuuuaugguuuccaagcu

SEQ ID NO: 633357 - RNA, 64 nt, hsa
uuaguaaaauauugaaggcaauauuuuacugcuagcuugcaaaguuaugagaguuuaaaaaaua

SEQ ID NO: 633358 - RNA, 64 nt, hsa
aaggaaauaaaaacacagaguuguaaauacacaugcuugcaaaaacauuagucgugaaaucccu

SEQ ID NO: 633359 - RNA, 64 nt, hsa
cagucucuggccucugcccaacgagccuggcugggcuugcaacgcagcugauucugagacaggc

SEQ ID NO: 633360 - RNA, 64 nt, hsa
ugaauugacaaucugaaagagucuucaaugauaugcuugcaaaaauauauuuuuaugagcuggu

SEQ ID NO: 633361 - RNA, 64 nt, hsa
auguccuuaagguguuuaaccugccucugaccuggcuugcaaugcauaggugaggagaagcaga

SEQ ID NO: 633362 - RNA, 64 nt, hsa
ggguagugagugggauccuauccaguugaggaaugcuugcaaugcucauugaagggauuugcuu

SEQ ID NO: 633363 - RNA, 64 nt, hsa
cuacuucuaccacuuguguaucucuagccaaugugcuugcaaguguacagaucuguguagagga

SEQ ID NO: 633364 - RNA, 64 nt, hsa
aaacugauccaucagucauguagcuagcuguagagcuugcaacuuaauagcagcagcugcccaa

SEQ ID NO: 633365 - RNA, 64 nt, hsa
uuuccuccccagcagguggggaggggguuugggggcuugcaaguauguuuuagcauguguuugg

SEQ ID NO: 633366 - RNA, 64 nt, hsa
cugcuuacgugcuaagcagaucaguuuauuuaaugcuugcaacgacucucugagguagaaaaua

SEQ ID NO: 633367 - RNA, 64 nt, hsa
ugugugcuggucacaggaaguguugaauggauuggcuugcaaaggggguagguggggagagaua

SEQ ID NO: 633368 - RNA, 64 nt, hsa
ccugccauuuuggguuuugggucuuugaacccuugcuugcaauaggugugcgucagaagcaccc

SEQ ID NO: 633369 - RNA, 64 nt, hsa
uaacaaucuucugaacuccaguaccuauaacugggcuugcaaccucucaucacacagccacaua

SEQ ID NO: 633370 - RNA, 64 nt, hsa
gcuggcauagaaggcucuuagauuauauugggcagcuugcaaucugccgaagcagugacuugca

SEQ ID NO: 633371 - RNA, 64 nt, hsa
ggccuucagcuuuaaauguacaggcuuaaagugcgcuugcaaacguuugcucuccuuuuuuucu

SEQ ID NO: 633372 - RNA, 64 nt, hsa
uuucuuccuaccgggauuaccuauguuuuuccuugcuugcaaucucaucugauuuugcuagaaa

SEQ ID NO: 633373 - RNA, 64 nt, hsa
cacgucugcgccgccgccggaguccacucccagugcuugcaagauuccaaguucucaccucuua

SEQ ID NO: 633374 - RNA, 64 nt, hsa
cgucccucgccaacggccgagcuugugauucugagcuugcaaugccgccaagcgccccccgcca

SEQ ID NO: 633375 - RNA, 64 nt, hsa
auguuaagucauaguaaacccuguagaugauguugcuugcaagcguaauauccaacaguuuaag

SEQ ID NO: 633376 - RNA, 64 nt, hsa
aauaaaaauaaacuggccaggugcgguggcucacgcuugcaaucccagugcuuugggagacuga

SEQ ID NO: 633377 - RNA, 64 nt, hsa
uauuuuugcauauuaacccuuuaucagguauacagcuugcaacuauuuucucccauuucugagu

SEQ ID NO: 633378 - RNA, 64 nt, hsa
uaaaaaauuccaaagccuuuauuugggagucuuagcuugcaagcuuguggaaggauuuagcuua

SEQ ID NO: 633379 - RNA, 64 nt, hsa
ggacaaaggccucucaucaccacaggaagcgggggcuugcaaggaaagugaaugggccuguggc

SEQ ID NO: 633380 - RNA, 64 nt, hsa
uuagaacagauccaauagacaacucuuaauaucagcuugcaacuguugaucucccuggauccag

SEQ ID NO: 633381 - RNA, 64 nt, hsa
ccauuuuguauauaguugcaacuuaaacuuuuuggcuugcaaaauauuuuuguaauaaagauuu

SEQ ID NO: 633382 - RNA, 64 nt, hsa
ugucccagaguuaguaagccucggcuugucaccugcuugcaaaggguauagacaucauucuggg

SEQ ID NO: 633383 - RNA, 64 nt, hsa
ggacuagaucaccuuaguuugauucuauuuuuuagcuugcaaaaagugacuuauauuccaaaga

SEQ ID NO: 633384 - RNA, 64 nt, hsa
ccuucagccaugcuggccccgagcuuagggaugugcuugcaaacccuucucaagggucucacaa

SEQ ID NO: 633385 - RNA, 64 nt, hsa
uuugugugagaagacaucucuuucugcucacugugcuugcaauaaaaacuuuucuuggcaucuc

SEQ ID NO: 633386 - RNA, 64 nt, hsa
ugugaugucuggucugaaugcacaagcuaagagagcuugcaaaaaaaaaaagaaaaaagaaaaa

SEQ ID NO: 633387 - RNA, 64 nt, hsa
cucuggaacugggugcucauguugguuuuaaugagcuugcaacccuuccccguuugcuuuguuu

SEQ ID NO: 633388 - RNA, 64 nt, hsa
gcuuucaacuuuuguugcaucaugcacugaugcugcuugcaaaaaaugaagacaaaauacucag

SEQ ID NO: 633389 - RNA, 64 nt, hsa
ugcauauauaucuuacccuaauugaacaugugaagcuugcaacuuuaugucuugcuuuggacau

SEQ ID NO: 633390 - RNA, 64 nt, hsa
uaggcagcuagacccugcguucuaaaaaaggauugcuugcaauguugguuuggcuauucauuug

SEQ ID NO: 633391 - RNA, 64 nt, hsa
uuggcuguguuuucaaugcacaaggggaaauuuggcuugcaauucaucacuuugaaaagguuag

SEQ ID NO: 633392 - RNA, 64 nt, hsa
gugcugggauuacaggcgugagccaccgcacccggcuugcaauuuagaaagggcacuuggcaac

SEQ ID NO: 633393 - RNA, 64 nt, hsa
gguauauuauuuuaaucauuccaugccuuaauaugcuugcaauacaagaauaucuucagauggg

SEQ ID NO: 633394 - RNA, 64 nt, hsa
uaacacccucccuucaggccucccaaaggcauaggcuugcaaagagcagaaggugugaaaucac

SEQ ID NO: 633395 - RNA, 64 nt, hsa
ucuucacaucugcccauucugugguuagucaauggcuugcaauaaaugugcaaacugcaucuau

SEQ ID NO: 633396 - RNA, 64 nt, hsa
cagauuuuaugcguguugacaaaaucauuuuucagcuugcaaaaugggacugcaauauuacauu

SEQ ID NO: 633397 - RNA, 64 nt, hsa
aaucuuaagacuaacaaauccuugaaaucacacagcuugcaaauacguacuaaacugcacaagg

SEQ ID NO: 633398 - RNA, 64 nt, hsa
guugccauguuaggaaggucagcugcacagccaagaguguaagaguguaaagaaaugccuuuuu

SEQ ID NO: 633399 - RNA, 64 nt, hsa
guuaggaaggucagcugcacagccaagaguguaagaguguaaagaaaugccuuuuuuuuuuuuu

SEQ ID NO: 633400 - RNA, 64 nt, hsa
acaauuuagaauggauauuuugacgaaucggcaugaguguaacagugauaaccugaucuguuug

SEQ ID NO: 633401 - RNA, 64 nt, hsa
uuaaagugccacauuuggcaguacaaaugagucugaguguaauagcccagagauuuauauauag

SEQ ID NO: 633402 - RNA, 64 nt, hsa
uuucucucagaccccuuuuguuguagugcuuguagaguguaaagugaaacaguuuugcauuuuc

SEQ ID NO: 633403 - RNA, 64 nt, hsa
agugaccuuugucaguguccuuuuuaagacaagugaguguaagggucaaugugcuugcuuggag

SEQ ID NO: 633404 - RNA, 64 nt, hsa
acaugaaaaaucuuacacuggagagaaacccuaugaguguaagcaaugugggaaagccuuuguu

SEQ ID NO: 633405 - RNA, 64 nt, hsa
ucaugaaaggacucacacuggagagaaccccuaugaguguaagcaauuugggaaagccuucaga

SEQ ID NO: 633406 - RNA, 64 nt, hsa
ucaugaaaggacucacacuggagagaaacccuaugaguguaagcaaugugggaaagccuucaga

SEQ ID NO: 633407 - RNA, 64 nt, hsa
aggcaugguaggacucacuggagagaaacccuaugaguguaaggaaugugggaaagccuucaga

SEQ ID NO: 633408 - RNA, 64 nt, hsa
ccaugaaaggacucacacuggagagaaacccuaugaguguaagcaaugugggaaagccuucaga

SEQ ID NO: 633409 - RNA, 64 nt, hsa
gcaugcugggacucacccugaagagaagcccuacgaguguaagcaaugugggaaagccuucaga

SEQ ID NO: 633410 - RNA, 64 nt, hsa
ccaugguagaacucacacuggagagaaacccuaugaguguaaggaaugugggaaagccuucaga

SEQ ID NO: 633411 - RNA, 64 nt, hsa
accugaaaaaucuuacacuggagagaaacccuaugaguguaagcaaugugggaaagccuuuauu

SEQ ID NO: 633412 - RNA, 64 nt, hsa
acaugaaaggacucacacuggagagaaacccuaugaguguaagcaauguggaaaaaccuucaga

SEQ ID NO: 633413 - RNA, 64 nt, hsa
cagacccaccaggaggaaagaggcccagcucucagcugacgauggaggcagaaccggagucggg

SEQ ID NO: 633414 - RNA, 64 nt, hsa
cacagucauccacaccauugcucuggggccgucugcugacgaagaacuggagacccugucaaau

SEQ ID NO: 633415 - RNA, 64 nt, hsa
gugguuuuuaaaggagcgcccacgaaguguaguggcugacgauuucaaccucacacagcaguuu

SEQ ID NO: 633416 - RNA, 64 nt, hsa
cugcugcuuugcucuuucaaaacagaaccuccaggcugacgaggcaagacaaagccucccacca

SEQ ID NO: 633417 - RNA, 64 nt, hsa
ccuguccuggagggggcagaggccaggccccagugcugacgaggagcccagauuugggccuaau

SEQ ID NO: 633418 - RNA, 64 nt, hsa
aguccucucucccuccagucugauuuuauaaagugcugacgagauugggaauaaagaggcauaa

SEQ ID NO: 633419 - RNA, 64 nt, hsa
uguguguccgugaagugagucccgucugccaggagcugacgaaccacgaaugcuucugccugug

SEQ ID NO: 633420 - RNA, 64 nt, hsa
gcagcagacuaugggcagcccagugcugccaccugcugacgacccuugagaagcugccauaucu

SEQ ID NO: 633421 - RNA, 64 nt, hsa
aggacccuguggcagcuuugaugugcgcaagacagcugacgacugagcccugcuucugcugggg

SEQ ID NO: 633422 - RNA, 64 nt, hsa
auuucaggcacuuguggccccucaaggaccucacgcugacgagcaaucaggugagagggaggcc

SEQ ID NO: 633423 - RNA, 64 nt, hsa
aucagauuuuugccuagcacucgguuuugguggagcugacgauuuugagggcugaggcugguua

SEQ ID NO: 633424 - RNA, 64 nt, hsa
cacucagaaagaggucuccccauccccauucggggcugacgauggggggcugauggcugccccu

SEQ ID NO: 633425 - RNA, 64 nt, hsa
accuuggcaacuccagggcgcuccguucaagaaugcugacgaaaagcaauauccaaagucuugu

SEQ ID NO: 633426 - RNA, 64 nt, hsa
gaagcacggguccacagaguuccagagaaugaaugcugacgacuaagcaccagccuccacuccc

SEQ ID NO: 633427 - RNA, 64 nt, hsa
cccaacaagccagccuuugguaagcucggugccugcugacgaacucugagaucccaauggugug

SEQ ID NO: 633428 - RNA, 64 nt, hsa
aaccgcccaggaucagauugcaugugacucugaagcugacgaacuuccauggcccucauuaaug

SEQ ID NO: 633429 - RNA, 64 nt, hsa
ggugccaggacaaugaaauacuccagcaccuguggcugacgaauuuguuucuacagaaauaaca

SEQ ID NO: 633430 - RNA, 64 nt, hsa
uuugggucugugagguucuguaaacugugcuagugcugacgauguucuguacaacuuaacucac

SEQ ID NO: 633431 - RNA, 64 nt, hsa
agcaugugcucugaggccaggccccagcucugcugcugacgagcugugugguccugggcagagu

SEQ ID NO: 633432 - RNA, 64 nt, hsa
caggacaagcacuuucucagaagcccguggcccugcugacgagagacagcccacccccagccug

SEQ ID NO: 633433 - RNA, 64 nt, hsa
caccaucaacuuguaggcggccaaggccgccugugcugacgaggcccggagcugcuccugcugc

SEQ ID NO: 633434 - RNA, 64 nt, hsa
gacuuuccuccgcagaaagcaaaguuuggggagggcugacgauuuuguagaacacaacagugac

SEQ ID NO: 633435 - RNA, 64 nt, hsa
agauaaauaauggagcaugcagugagcacaucuagcugacgauaaucacaccuuuucccccguc

SEQ ID NO: 633436 - RNA, 64 nt, hsa
uaaaggaaauaauugccaaauaccuaggcccauugcugacgauuaguucuaaaaucuuauuccu

SEQ ID NO: 633437 - RNA, 61 nt, hsa
auggcuaaagccucucuugauuuaggcuugggcugacgacaaaguuguacauccugaaccc

SEQ ID NO: 633438 - RNA, 64 nt, hsa
ggccuuucccuuccgcgccugccccaucgggcucgcugacgaggaagcgcugucccugugauga

SEQ ID NO: 633439 - RNA, 64 nt, hsa
ucuaggagccccaguagcccaggagcuugggugugcugacgagcaggguggugaguagagcccu

SEQ ID NO: 633440 - RNA, 64 nt, hsa
ggauccuggaaccaaaccccugcagauacuaagggcugacgaucuagguaagacuggauuuaac

SEQ ID NO: 633441 - RNA, 63 nt, hsa
ccauggagguguccuguugaagcccuugaucccgcugacgacgcccacgucgaggccccaccg

SEQ ID NO: 633442 - RNA, 64 nt, hsa
uuacggagcacagucauaaguggagguucagggugcugacgaaauccaagcugcucugguugaa

SEQ ID NO: 633443 - RNA, 64 nt, hsa
ggcagggaggcaccauucaggaaccuggaccaaagcugacgaggcugggccaagccagggaugg

SEQ ID NO: 633444 - RNA, 64 nt, hsa
ggccgucucugauucucccuuuaugaagcugcaggcugacgagagauggucccuucccauuggc

SEQ ID NO: 633445 - RNA, 64 nt, hsa
uccuuuauuaugugguuagcauagguuauacuuugcugacgauucacauuuuauuaguuugguu

SEQ ID NO: 633446 - RNA, 64 nt, hsa
agggccuggaggggccuggggcccgggaccggaggcugacgaggcuggacuuccucgaguggcc

SEQ ID NO: 633447 - RNA, 64 nt, hsa
cacccccauuuuccagggggguuguaauuuauaagcugacgaagguagccagacuuccggagga

SEQ ID NO: 633448 - RNA, 64 nt, hsa
uaaguaccugccccuucaccucucagacgaggcagcugacgaggcagcuggcccagucuuggga

SEQ ID NO: 633449 - RNA, 64 nt, hsa
aaggagcaggugggucgauccugcuugaguaaucgcugacgagcuucgugcugcugcuuuccug

SEQ ID NO: 633450 - RNA, 64 nt, hsa
ccccuuggccucacaggcaaagaauaacuuaaaagcugacgauuugaauaaauuauguuacagu

SEQ ID NO: 633451 - RNA, 64 nt, hsa; identical to SEQ ID NO: 583943

SEQ ID NO: 633452 - RNA, 64 nt, hsa; identical to SEQ ID NO: 583944

SEQ ID NO: 633453 - RNA, 64 nt, hsa; identical to SEQ ID NO: 583945

SEQ ID NO: 633454 - RNA, 64 nt, hsa; identical to SEQ ID NO: 583946

SEQ ID NO: 633455 - RNA, 64 nt, hsa; identical to SEQ ID NO: 583947

SEQ ID NO: 633456 - RNA, 64 nt, hsa; identical to SEQ ID NO: 583948

SEQ ID NO: 633457 - RNA, 64 nt, hsa; identical to SEQ ID NO: 583949

SEQ ID NO: 633458 - RNA, 64 nt, hsa; identical to SEQ ID NO: 583950

SEQ ID NO: 633459 - RNA, 64 nt, hsa; identical to SEQ ID NO: 583951

SEQ ID NO: 633460 - RNA, 64 nt, hsa; identical to SEQ ID NO: 583952

SEQ ID NO: 633461 - RNA, 64 nt, hsa; identical to SEQ ID NO: 583953

SEQ ID NO: 633462 - RNA, 64 nt, hsa; identical to SEQ ID NO: 583954

SEQ ID NO: 633463 - RNA, 64 nt, hsa; identical to SEQ ID NO: 583955

SEQ ID NO: 633464 - RNA, 64 nt, hsa; identical to SEQ ID NO: 583956

SEQ ID NO: 633465 - RNA, 64 nt, hsa; identical to SEQ ID NO: 583957

SEQ ID NO: 633466 - RNA, 64 nt, hsa; identical to SEQ ID NO: 583958

SEQ ID NO: 633467 - RNA, 64 nt, hsa; identical to SEQ ID NO: 583959

SEQ ID NO: 633468 - RNA, 64 nt, hsa; identical to SEQ ID NO: 583960

SEQ ID NO: 633469 - RNA, 64 nt, hsa; identical to SEQ ID NO: 583961

SEQ ID NO: 633470 - RNA, 64 nt, hsa; identical to SEQ ID NO: 583962

SEQ ID NO: 633471 - RNA, 64 nt, hsa; identical to SEQ ID NO: 583963

SEQ ID NO: 633472 - RNA, 64 nt, hsa; identical to SEQ ID NO: 583964

SEQ ID NO: 633473 - RNA, 64 nt, hsa; identical to SEQ ID NO: 583965

SEQ ID NO: 633474 - RNA, 64 nt, hsa; identical to SEQ ID NO: 583966

SEQ ID NO: 633475 - RNA, 64 nt, hsa; identical to SEQ ID NO: 583967

SEQ ID NO: 633476 - RNA, 64 nt, hsa; identical to SEQ ID NO: 583968

SEQ ID NO: 633477 - RNA, 64 nt, hsa; identical to SEQ ID NO: 583969

SEQ ID NO: 633478 - RNA, 64 nt, hsa; identical to SEQ ID NO: 583970

SEQ ID NO: 633479 - RNA, 64 nt, hsa; identical to SEQ ID NO: 583971

SEQ ID NO: 633480 - RNA, 64 nt, hsa; identical to SEQ ID NO: 583972

SEQ ID NO: 633481 - RNA, 64 nt, hsa; identical to SEQ ID NO: 583973

SEQ ID NO: 633482 - RNA, 64 nt, hsa; identical to SEQ ID NO: 583974

SEQ ID NO: 633483 - RNA, 64 nt, hsa; identical to SEQ ID NO: 583975

SEQ ID NO: 633484 - RNA, 64 nt, hsa; identical to SEQ ID NO: 583976

SEQ ID NO: 633485 - RNA, 64 nt, hsa; identical to SEQ ID NO: 583977

SEQ ID NO: 633486 - RNA, 64 nt, hsa; identical to SEQ ID NO: 583978

SEQ ID NO: 633487 - RNA, 64 nt, hsa; identical to SEQ ID NO: 583979

SEQ ID NO: 633488 - RNA, 64 nt, hsa; identical to SEQ ID NO: 583980

SEQ ID NO: 633489 - RNA, 64 nt, hsa; identical to SEQ ID NO: 583981

SEQ ID NO: 633490 - RNA, 64 nt, hsa; identical to SEQ ID NO: 583982

SEQ ID NO: 633491 - RNA, 64 nt, hsa; identical to SEQ ID NO: 583983

SEQ ID NO: 633492 - RNA, 64 nt, hsa; identical to SEQ ID NO: 583984

SEQ ID NO: 633493 - RNA, 64 nt, hsa; identical to SEQ ID NO: 583985

SEQ ID NO: 633494 - RNA, 64 nt, hsa; identical to SEQ ID NO: 583986

SEQ ID NO: 633495 - RNA, 64 nt, hsa; identical to SEQ ID NO: 583987

SEQ ID NO: 633496 - RNA, 64 nt, hsa; identical to SEQ ID NO: 583988

SEQ ID NO: 633497 - RNA, 64 nt, hsa; identical to SEQ ID NO: 583989

SEQ ID NO: 633498 - RNA, 64 nt, hsa; identical to SEQ ID NO: 583990

SEQ ID NO: 633499 - RNA, 64 nt, hsa; identical to SEQ ID NO: 583991

SEQ ID NO: 633500 - RNA, 64 nt, hsa; identical to SEQ ID NO: 583992

SEQ ID NO: 633501 - RNA, 64 nt, hsa; identical to SEQ ID NO: 583993

SEQ ID NO: 633502 - RNA, 64 nt, hsa; identical to SEQ ID NO: 583994

SEQ ID NO: 633503 - RNA, 64 nt, hsa; identical to SEQ ID NO: 583995

SEQ ID NO: 633504 - RNA, 64 nt, hsa; identical to SEQ ID NO: 583996

SEQ ID NO: 633505 - RNA, 64 nt, hsa; identical to SEQ ID NO: 583997

SEQ ID NO: 633506 - RNA, 64 nt, hsa
gaguugacauggaggcagugcuugcauugcuuuguucgccuaucaucuggccacaugaggcugu

SEQ ID NO: 633507 - RNA, 64 nt, hsa
uaguuuauggauugacucuguauccugucaucuuuucgccuaccugaucuuucuuggaauaaaa

SEQ ID NO: 633508 - RNA, 64 nt, hsa
ugcccuggagcaaacaaacaguaugugauuuugcuucgccuauuuuuuuuuucuuuuuuggggg

SEQ ID NO: 633509 - RNA, 64 nt, hsa
cacauaccucuguccagcuuuuuaggaaauacauuucgccuauugcgacuuuuuccauuuaccc

SEQ ID NO: 633510 - RNA, 64 nt, hsa
ucacacaauuuuccaguucaaaaauggagaauacuucgccuaaaauacuguuaaguggguuaau

SEQ ID NO: 633511 - RNA, 64 nt, hsa
auuuccauuuuccuccguguaaauguuuuauguguucgccuacugaucccauucguugcuucua

SEQ ID NO: 633512 - RNA, 64 nt, hsa
aagcugcucuaaaaucucacugagugauuucaccuucgccuacuaugaaaugucucaucagacc

SEQ ID NO: 633513 - RNA, 64 nt, hsa
aggacuucucagccuccauaagugugugggccaguucgccuaauaaauccccucuccuggccgg

SEQ ID NO: 633514 - RNA, 64 nt, hsa
caggacuucugaucucaguccucugggagggagguucgccuaggaggugccccccacauuggug

SEQ ID NO: 633515 - RNA, 64 nt, hsa
ggcucccccucgguacugcgguugcacagaguauuucgccuaaaccaagaaauuuuuuauuacc

SEQ ID NO: 633516 - RNA, 64 nt, hsa
agaggggagggauggguaggugcuuuccaaauacuucgccuaugaaugcauaauuuucagauuu

SEQ ID NO: 633517 - RNA, 64 nt, hsa
cgugaccagcugcuccagacccccgcuccugggauucgccuaccucaagccuccauucuccauc

SEQ ID NO: 633518 - RNA, 64 nt, hsa
gaaguuguaguguauauaggaagucucugccucuuucgccuaguaucucugccuuuguuucaau

SEQ ID NO: 633519 - RNA, 64 nt, hsa
cuaaugaaauuaaaaaggauucuucaucauggauuucgccuaagugauauuacagccaccucau

SEQ ID NO: 633520 - RNA, 64 nt, hsa
ccuuuaccacuuggcaggugcccacaguacaucauucgccuaacucaucaugauccagaaguaa

SEQ ID NO: 633521 - RNA, 64 nt, hsa
cucccaaagugcuuggauugcaggcaugagccacuucgccuagccaagccugcauuuuuuugag

SEQ ID NO: 633522 - RNA, 64 nt, hsa
augaaggcccuggugaggagaaagcacucuguucuucgccuacucuguaaucguuuugucauaa

SEQ ID NO: 633523 - RNA, 64 nt, hsa
augucaagggaaauguaaucagauuuggccagaguucgccuacagauaagaaggcacugggcca

SEQ ID NO: 633524 - RNA, 64 nt, hsa; identical to SEQ ID NO: 279762

SEQ ID NO: 633525 - RNA, 64 nt, hsa; identical to SEQ ID NO: 279763

SEQ ID NO: 633526 - RNA, 64 nt, hsa; identical to SEQ ID NO: 279764

SEQ ID NO: 633527 - RNA, 64 nt, hsa; identical to SEQ ID NO: 279765

SEQ ID NO: 633528 - RNA, 64 nt, hsa; identical to SEQ ID NO: 279766

SEQ ID NO: 633529 - RNA, 64 nt, hsa; identical to SEQ ID NO: 279767

SEQ ID NO: 633530 - RNA, 64 nt, hsa; identical to SEQ ID NO: 279768

SEQ ID NO: 633531 - RNA, 64 nt, hsa; identical to SEQ ID NO: 279769

SEQ ID NO: 633532 - RNA, 64 nt, hsa; identical to SEQ ID NO: 279770

SEQ ID NO: 633533 - RNA, 64 nt, hsa; identical to SEQ ID NO: 279771

SEQ ID NO: 633534 - RNA, 64 nt, hsa; identical to SEQ ID NO: 279772

SEQ ID NO: 633535 - RNA, 64 nt, hsa; identical to SEQ ID NO: 279773

SEQ ID NO: 633536 - RNA, 64 nt, hsa; identical to SEQ ID NO: 279774

SEQ ID NO: 633537 - RNA, 64 nt, hsa; identical to SEQ ID NO: 279775

SEQ ID NO: 633538 - RNA, 64 nt, hsa; identical to SEQ ID NO: 238026

SEQ ID NO: 633539 - RNA, 64 nt, hsa; identical to SEQ ID NO: 238027

SEQ ID NO: 633540 - RNA, 64 nt, hsa; identical to SEQ ID NO: 238028

SEQ ID NO: 633541 - RNA, 64 nt, hsa; identical to SEQ ID NO: 238029

SEQ ID NO: 633542 - RNA, 64 nt, hsa; identical to SEQ ID NO: 238030

SEQ ID NO: 633543 - RNA, 64 nt, hsa; identical to SEQ ID NO: 238031

SEQ ID NO: 633544 - RNA, 64 nt, hsa; identical to SEQ ID NO: 238032

SEQ ID NO: 633545 - RNA, 64 nt, hsa; identical to SEQ ID NO: 238033

SEQ ID NO: 633546 - RNA, 64 nt, hsa; identical to SEQ ID NO: 238034

SEQ ID NO: 633547 - RNA, 64 nt, hsa; identical to SEQ ID NO: 238035

SEQ ID NO: 633548 - RNA, 64 nt, hsa; identical to SEQ ID NO: 238036

SEQ ID NO: 633549 - RNA, 64 nt, hsa; identical to SEQ ID NO: 238037

SEQ ID NO: 633550 - RNA, 64 nt, hsa; identical to SEQ ID NO: 238038

SEQ ID NO: 633551 - RNA, 64 nt, hsa; identical to SEQ ID NO: 238039

SEQ ID NO: 633552 - RNA, 64 nt, hsa; identical to SEQ ID NO: 238040

SEQ ID NO: 633553 - RNA, 64 nt, hsa; identical to SEQ ID NO: 238041

SEQ ID NO: 633554 - RNA, 64 nt, hsa; identical to SEQ ID NO: 238042

SEQ ID NO: 633555 - RNA, 64 nt, hsa; identical to SEQ ID NO: 238043

SEQ ID NO: 633556 - RNA, 64 nt, hsa; identical to SEQ ID NO: 238044

SEQ ID NO: 633557 - RNA, 64 nt, hsa; identical to SEQ ID NO: 238045

SEQ ID NO: 633558 - RNA, 64 nt, hsa; identical to SEQ ID NO: 238046

SEQ ID NO: 633559 - RNA, 64 nt, hsa; identical to SEQ ID NO: 238047

SEQ ID NO: 633560 - RNA, 64 nt, hsa; identical to SEQ ID NO: 238048

SEQ ID NO: 633561 - RNA, 64 nt, hsa; identical to SEQ ID NO: 238049

SEQ ID NO: 633562 - RNA, 64 nt, hsa; identical to SEQ ID NO: 238050

SEQ ID NO: 633563 - RNA, 64 nt, hsa; identical to SEQ ID NO: 238051

SEQ ID NO: 633564 - RNA, 64 nt, hsa; identical to SEQ ID NO: 238052

SEQ ID NO: 633565 - RNA, 64 nt, hsa; identical to SEQ ID NO: 238053

SEQ ID NO: 633566 - RNA, 64 nt, hsa; identical to SEQ ID NO: 238054

SEQ ID NO: 633567 - RNA, 64 nt, hsa; identical to SEQ ID NO: 238055

SEQ ID NO: 633568 - RNA, 64 nt, hsa; identical to SEQ ID NO: 238056

SEQ ID NO: 633569 - RNA, 64 nt, hsa; identical to SEQ ID NO: 238057

SEQ ID NO: 633570 - RNA, 64 nt, hsa; identical to SEQ ID NO: 238058

SEQ ID NO: 633571 - RNA, 64 nt, hsa; identical to SEQ ID NO: 238059

SEQ ID NO: 633572 - RNA, 64 nt, hsa; identical to SEQ ID NO: 238060

SEQ ID NO: 633573 - RNA, 64 nt, hsa; identical to SEQ ID NO: 238061

SEQ ID NO: 633574 - RNA, 64 nt, hsa; identical to SEQ ID NO: 238062

SEQ ID NO: 633575 - RNA, 64 nt, hsa; identical to SEQ ID NO: 238063

SEQ ID NO: 633576 - RNA, 64 nt, hsa; identical to SEQ ID NO: 238064

SEQ ID NO: 633577 - RNA, 64 nt, hsa; identical to SEQ ID NO: 238065

SEQ ID NO: 633578 - RNA, 64 nt, hsa; identical to SEQ ID NO: 238066

SEQ ID NO: 633579 - RNA, 64 nt, hsa; identical to SEQ ID NO: 238067

SEQ ID NO: 633580 - RNA, 64 nt, hsa; identical to SEQ ID NO: 238068

SEQ ID NO: 633581 - RNA, 64 nt, hsa; identical to SEQ ID NO: 238069

SEQ ID NO: 633582 - RNA, 64 nt, hsa; identical to SEQ ID NO: 238070

SEQ ID NO: 633583 - RNA, 64 nt, hsa; identical to SEQ ID NO: 238071

SEQ ID NO: 633584 - RNA, 64 nt, hsa; identical to SEQ ID NO: 238072

SEQ ID NO: 633585 - RNA, 64 nt, hsa; identical to SEQ ID NO: 238073

SEQ ID NO: 633586 - RNA, 64 nt, hsa; identical to SEQ ID NO: 238074

SEQ ID NO: 633587 - RNA, 64 nt, hsa; identical to SEQ ID NO: 238075

SEQ ID NO: 633588 - RNA, 64 nt, hsa; identical to SEQ ID NO: 238076

SEQ ID NO: 633589 - RNA, 60 nt, hsa
uucugccccugaaugauucugucuagaaaagcucuggaguauugaucacuacuggaaaaa

SEQ ID NO: 633590 - RNA, 60 nt, hsa
aucuccagggccccaccucagaucaaagcagcucuggaugagaugggaccugcagcucuc

SEQ ID NO: 633591 - RNA, 60 nt, hsa
agauuagcucuggaccagccuguuggacccgcucuggaccaacccuguuuccugaguuug

SEQ ID NO: 633592 - RNA, 60 nt, hsa
gaaucaaagacauggaauuaccuuagauuagcucuggaccagccuguuggacccgcucug

SEQ ID NO: 633593 - RNA, 60 nt, hsa
auacuuuuguagaaguggaccaacuucaaagcucuggacaggagacaccugcuccaggcc

SEQ ID NO: 633594 - RNA, 60 nt, hsa
uggcccuaaugagaaacccuuuguaagugggcucuggauuuuugguuuuguuuucuuuuu

SEQ ID NO: 633595 - RNA, 60 nt, hsa
gacgagccacguaugaggugccugcccugggcucuggaccccgggcacacgagggacggu

SEQ ID NO: 633596 - RNA, 60 nt, hsa
ccucuggguacaaaagugccucaacgacaugcucuggaaaucccaaaugccacagucuga

SEQ ID NO: 633597 - RNA, 60 nt, hsa
caccucugugaccucaggcacuagccuuuggcucuggagacagccccagagcaggguguu

SEQ ID NO: 633598 - RNA, 60 nt, hsa
ccccacgcccuccccuccccugcugcaggggcucuggagagaaacaauaaagagauucac

SEQ ID NO: 633599 - RNA, 60 nt, hsa
cuucagccugugaggggaggguugagggaggcucuggaaagcccagccacaccugagucc

SEQ ID NO: 633600 - RNA, 60 nt, hsa
uagggagaggguggauuugugcagggugcagcucuggagaagaagcuggaucacucuugg

SEQ ID NO: 633601 - RNA, 60 nt, hsa
ugugugggauagcgauugcauuuuccuuuugcucuggaguuucacuccccuucugggucc

SEQ ID NO: 633602 - RNA, 60 nt, hsa
acuccaguugccucagguugguucugcugugcucuggaaaguaacugcagccaccaggua

SEQ ID NO: 633603 - RNA, 60 nt, hsa
uuguuacuuccaauuuauaaucaagaaggggcucuggauccccuuuuaaauuacacacac

SEQ ID NO: 633604 - RNA, 60 nt, hsa
accuacccaaaccuuuuguucuguaaaacugcucuggaaauaccgggaagcccaguuuuc

SEQ ID NO: 633605 - RNA, 60 nt, hsa
agaugcugacaggcccugggaggcugcugugcucuggagaagcuggagcagcucauuucu

SEQ ID NO: 633606 - RNA, 60 nt, hsa
aauuccugugcucugaaaugccacuugguagcucuggacaaugaaggacaauugacucaa

SEQ ID NO: 633607 - RNA, 60 nt, hsa
gagggguuaaagacaggaucucacucuggcgcucuggagugcaguggugugauuagggau

SEQ ID NO: 633608 - RNA, 60 nt, hsa
uuauaauaaacagaaauguauuggcucagagcucuggaggcugggaaguccauaguggag

SEQ ID NO: 633609 - RNA, 60 nt, hsa
ggcaggggcagaguuuuggaaacagugcaggcucuggagccagacuggcgagauucaaau

SEQ ID NO: 633610 - RNA, 60 nt, hsa
cagaucgggggcuugaacccagguggucaggcucuggagcccacaauugucuuacccacu

SEQ ID NO: 633611 - RNA, 60 nt, hsa
cauugcugugcauggcucccucaggaagaagcucuggaguggggccgaggccccagaugc

SEQ ID NO: 633612 - RNA, 60 nt, hsa
acccugccccuggcugggagcuccccuggggcucuggaaccugaagcccugagaaggaga

SEQ ID NO: 633613 - RNA, 60 nt, hsa
agugggcgcaggcacgccaggccuucuuuagcucuggaaagaauaaggcugccuuggagg

SEQ ID NO: 633614 - RNA, 60 nt, hsa
ucuccuaacccaagauggaagagccagagggcucuggagugagcagaaccucaccccauu

SEQ ID NO: 633615 - RNA, 66 nt, hsa
ccucguguaugacagguagcuagggagcucuuggagauguagcaguugggauugugggagauuacu

SEQ ID NO: 633616 - RNA, 66 nt, hsa
uaauuaagugaaaaaaguuuaaucccagaagaguaaauguagcaugaugcccuuucuaaaugaaag

SEQ ID NO: 633617 - RNA, 66 nt, hsa
aauaaagaccuccaaggguacuucuuuggaaaugaaauguagcacaaucuuagccuacguuaccag

SEQ ID NO: 633618 - RNA, 66 nt, hsa
uguuagugacccacaggacaguauagauguuuguggauguagcacugaguggugauacccagacca

SEQ ID NO: 633619 - RNA, 66 nt, hsa
cggcagcucuuccugccacugaaugcguucugcagcauguagcaugcccaccuagcucccuggcca

SEQ ID NO: 633620 - RNA, 66 nt, hsa
cuugacucucccggcucugccacuguuuucugagaaauguagcauccgcugcagcuggccacacug

SEQ ID NO: 633621 - RNA, 66 nt, hsa
agaaugaaaauuguugagguuaucucccauucaaucauguagcaagaacuuaaagaaauucacuac

SEQ ID NO: 633622 - RNA, 66 nt, hsa
aagaaaauagagaauuuaauauauggugauugggauauguagcauucaaaaaaagugaauugccaa

SEQ ID NO: 633623 - RNA, 66 nt, hsa
gcuuggcucucuacacauggcauuucaggguauaagauguagcauuucaauguguaagauauaugu

SEQ ID NO: 633624 - RNA, 66 nt, hsa
aauucagcuuucuuuaacuuaauuguggucguguuaauguagcacaaaaaauauauuuuaaugaag

SEQ ID NO: 633625 - RNA, 66 nt, hsa
ccaaugcuaugguuuccauguggacauacagugccuauguagcaggcacuuagaguaaauggacuu

SEQ ID NO: 633626 - RNA, 66 nt, hsa
aaauaaaagcaugcccucagcuuuuaaugaacuuaaauguagcacauauggcuuaaucucuuagac

SEQ ID NO: 633627 - RNA, 66 nt, hsa
uauuuuaaaaaggcuuuggcuuaugcugaauuauacauguagcaccaaaauguuacaacucuacua

SEQ ID NO: 633628 - RNA, 66 nt, hsa
uuuggcaauuuauaauuuauuacuacuuuaaaucaaauguagcauuaucacacuguauuuaaauug

SEQ ID NO: 633629 - RNA, 66 nt, hsa
gcccagaggggaacuugauucaaaaauuugggauucauguagcagagacagagcuagacuguaaag

SEQ ID NO: 633630 - RNA, 66 nt, hsa
uuuuugaguuaaaaauggcacuuuugauaugagacaauguagcagaauaccaggcagacagaaccu

SEQ ID NO: 633631 - RNA, 66 nt, hsa
aggcacucuuaaaugaucugccucuaaaagcguuggauguagcauuaugcaauuagguuuuuccuu

SEQ ID NO: 633632 - RNA, 66 nt, hsa
ucauuguacuaccuguguauauaguuuuuaccuuuuauguagcacauaaacuuuggggaagggagg

SEQ ID NO: 633633 - RNA, 66 nt, hsa
cuuucaugagggagucaauauguaguggaaagaagcauguagcaaaaaagacaaccuugaucuuua

SEQ ID NO: 633634 - RNA, 66 nt, hsa
aaaaaaagcagaacccacuggaguagaaaaggaagcauguagcauauacucaguagugaaauuuaa

SEQ ID NO: 633635 - RNA, 66 nt, hsa
uuauugucuugguugccaguaguaccuuguuuugccauguagcagacaacacacaaaauaaugcag

SEQ ID NO: 633636 - RNA, 66 nt, hsa
aagccucagcucauagugaacacagcagaccuagaaauguagcagcagccuacugaguagcuuuca

SEQ ID NO: 633637 - RNA, 64 nt, hsa; identical to SEQ ID NO: 266194

SEQ ID NO: 633638 - RNA, 64 nt, hsa; identical to SEQ ID NO: 266195

SEQ ID NO: 633639 - RNA, 64 nt, hsa; identical to SEQ ID NO: 266196

SEQ ID NO: 633640 - RNA, 64 nt, hsa; identical to SEQ ID NO: 266197

SEQ ID NO: 633641 - RNA, 64 nt, hsa; identical to SEQ ID NO: 266198

SEQ ID NO: 633642 - RNA, 64 nt, hsa; identical to SEQ ID NO: 266199

SEQ ID NO: 633643 - RNA, 64 nt, hsa; identical to SEQ ID NO: 266200

SEQ ID NO: 633644 - RNA, 64 nt, hsa; identical to SEQ ID NO: 266201

SEQ ID NO: 633645 - RNA, 64 nt, hsa; identical to SEQ ID NO: 266202

SEQ ID NO: 633646 - RNA, 64 nt, hsa; identical to SEQ ID NO: 266203

SEQ ID NO: 633647 - RNA, 64 nt, hsa; identical to SEQ ID NO: 266204

SEQ ID NO: 633648 - RNA, 64 nt, hsa; identical to SEQ ID NO: 266205

SEQ ID NO: 633649 - RNA, 64 nt, hsa; identical to SEQ ID NO: 266206

SEQ ID NO: 633650 - RNA, 64 nt, hsa; identical to SEQ ID NO: 266207

SEQ ID NO: 633651 - RNA, 64 nt, hsa; identical to SEQ ID NO: 266208

SEQ ID NO: 633652 - RNA, 64 nt, hsa; identical to SEQ ID NO: 266209

SEQ ID NO: 633653 - RNA, 64 nt, hsa; identical to SEQ ID NO: 266210

SEQ ID NO: 633654 - RNA, 64 nt, hsa; identical to SEQ ID NO: 266211

SEQ ID NO: 633655 - RNA, 64 nt, hsa; identical to SEQ ID NO: 266212

SEQ ID NO: 633656 - RNA, 64 nt, hsa; identical to SEQ ID NO: 266213

SEQ ID NO: 633657 - RNA, 64 nt, hsa; identical to SEQ ID NO: 266214

SEQ ID NO: 633658 - RNA, 64 nt, hsa; identical to SEQ ID NO: 266215

SEQ ID NO: 633659 - RNA, 64 nt, hsa; identical to SEQ ID NO: 266216

SEQ ID NO: 633660 - RNA, 64 nt, hsa; identical to SEQ ID NO: 266217

SEQ ID NO: 633661 - RNA, 64 nt, hsa; identical to SEQ ID NO: 266218

SEQ ID NO: 633662 - RNA, 64 nt, hsa; identical to SEQ ID NO: 266219

SEQ ID NO: 633663 - RNA, 64 nt, hsa; identical to SEQ ID NO: 266220

SEQ ID NO: 633664 - RNA, 64 nt, hsa; identical to SEQ ID NO: 266221

SEQ ID NO: 633665 - RNA, 64 nt, hsa; identical to SEQ ID NO: 266222

SEQ ID NO: 633666 - RNA, 64 nt, hsa; identical to SEQ ID NO: 266223

SEQ ID NO: 633667 - RNA, 64 nt, hsa; identical to SEQ ID NO: 266224

SEQ ID NO: 633668 - RNA, 64 nt, hsa; identical to SEQ ID NO: 266225

SEQ ID NO: 633669 - RNA, 64 nt, hsa; identical to SEQ ID NO: 266226

SEQ ID NO: 633670 - RNA, 64 nt, hsa; identical to SEQ ID NO: 266227

SEQ ID NO: 633671 - RNA, 64 nt, hsa; identical to SEQ ID NO: 266228

SEQ ID NO: 633672 - RNA, 64 nt, hsa; identical to SEQ ID NO: 266229

SEQ ID NO: 633673 - RNA, 64 nt, hsa; identical to SEQ ID NO: 266230

SEQ ID NO: 633674 - RNA, 64 nt, hsa; identical to SEQ ID NO: 266231

SEQ ID NO: 633675 - RNA, 64 nt, hsa; identical to SEQ ID NO: 266232

SEQ ID NO: 633676 - RNA, 64 nt, hsa; identical to SEQ ID NO: 266233

SEQ ID NO: 633677 - RNA, 64 nt, hsa; identical to SEQ ID NO: 266234

SEQ ID NO: 633678 - RNA, 64 nt, hsa; identical to SEQ ID NO: 266235

SEQ ID NO: 633679 - RNA, 64 nt, hsa; identical to SEQ ID NO: 266236

SEQ ID NO: 633680 - RNA, 64 nt, hsa; identical to SEQ ID NO: 266237

SEQ ID NO: 633681 - RNA, 64 nt, hsa; identical to SEQ ID NO: 266238

SEQ ID NO: 633682 - RNA, 64 nt, hsa; identical to SEQ ID NO: 266239

SEQ ID NO: 633683 - RNA, 64 nt, hsa; identical to SEQ ID NO: 266240

SEQ ID NO: 633684 - RNA, 64 nt, hsa; identical to SEQ ID NO: 266241

SEQ ID NO: 633685 - RNA, 64 nt, hsa; identical to SEQ ID NO: 266242

SEQ ID NO: 633686 - RNA, 64 nt, hsa; identical to SEQ ID NO: 266243

SEQ ID NO: 633687 - RNA, 64 nt, hsa; identical to SEQ ID NO: 266244

SEQ ID NO: 633688 - RNA, 64 nt, hsa; identical to SEQ ID NO: 266245

SEQ ID NO: 633689 - RNA, 64 nt, hsa; identical to SEQ ID NO: 266246

SEQ ID NO: 633690 - RNA, 64 nt, hsa; identical to SEQ ID NO: 266247

SEQ ID NO: 633691 - RNA, 64 nt, hsa; identical to SEQ ID NO: 266248

SEQ ID NO: 633692 - RNA, 64 nt, hsa; identical to SEQ ID NO: 266249

SEQ ID NO: 633693 - RNA, 64 nt, hsa; identical to SEQ ID NO: 266250

SEQ ID NO: 633694 - RNA, 64 nt, hsa; identical to SEQ ID NO: 266251

SEQ ID NO: 633695 - RNA, 64 nt, hsa; identical to SEQ ID NO: 266252

SEQ ID NO: 633696 - RNA, 64 nt, hsa; identical to SEQ ID NO: 468387

SEQ ID NO: 633697 - RNA, 64 nt, hsa; identical to SEQ ID NO: 468388

SEQ ID NO: 633698 - RNA, 64 nt, hsa; identical to SEQ ID NO: 468389

SEQ ID NO: 633699 - RNA, 64 nt, hsa; identical to SEQ ID NO: 468390

SEQ ID NO: 633700 - RNA, 64 nt, hsa; identical to SEQ ID NO: 468391

SEQ ID NO: 633701 - RNA, 64 nt, hsa; identical to SEQ ID NO: 468392

SEQ ID NO: 633702 - RNA, 64 nt, hsa; identical to SEQ ID NO: 468393

SEQ ID NO: 633703 - RNA, 64 nt, hsa; identical to SEQ ID NO: 468394

SEQ ID NO: 633704 - RNA, 64 nt, hsa; identical to SEQ ID NO: 468395

SEQ ID NO: 633705 - RNA, 64 nt, hsa; identical to SEQ ID NO: 468396

SEQ ID NO: 633706 - RNA, 64 nt, hsa; identical to SEQ ID NO: 468397

SEQ ID NO: 633707 - RNA, 64 nt, hsa; identical to SEQ ID NO: 468398

SEQ ID NO: 633708 - RNA, 64 nt, hsa; identical to SEQ ID NO: 468399

SEQ ID NO: 633709 - RNA, 64 nt, hsa; identical to SEQ ID NO: 468400

SEQ ID NO: 633710 - RNA, 64 nt, hsa; identical to SEQ ID NO: 468401

SEQ ID NO: 633711 - RNA, 64 nt, hsa; identical to SEQ ID NO: 468402

SEQ ID NO: 633712 - RNA, 64 nt, hsa; identical to SEQ ID NO: 466453

SEQ ID NO: 633713 - RNA, 64 nt, hsa; identical to SEQ ID NO: 466454

SEQ ID NO: 633714 - RNA, 64 nt, hsa; identical to SEQ ID NO: 466455

SEQ ID NO: 633715 - RNA, 64 nt, hsa; identical to SEQ ID NO: 466456

SEQ ID NO: 633716 - RNA, 64 nt, hsa; identical to SEQ ID NO: 466457

SEQ ID NO: 633717 - RNA, 64 nt, hsa; identical to SEQ ID NO: 466458

SEQ ID NO: 633718 - RNA, 64 nt, hsa; identical to SEQ ID NO: 466459

SEQ ID NO: 633719 - RNA, 64 nt, hsa; identical to SEQ ID NO: 466460

SEQ ID NO: 633720 - RNA, 64 nt, hsa; identical to SEQ ID NO: 466461

SEQ ID NO: 633721 - RNA, 64 nt, hsa; identical to SEQ ID NO: 466462

SEQ ID NO: 633722 - RNA, 64 nt, hsa; identical to SEQ ID NO: 466463

SEQ ID NO: 633723 - RNA, 64 nt, hsa; identical to SEQ ID NO: 466464

SEQ ID NO: 633724 - RNA, 64 nt, hsa; identical to SEQ ID NO: 466465

SEQ ID NO: 633725 - RNA, 64 nt, hsa; identical to SEQ ID NO: 466466

SEQ ID NO: 633726 - RNA, 64 nt, hsa; identical to SEQ ID NO: 466467

SEQ ID NO: 633727 - RNA, 64 nt, hsa; identical to SEQ ID NO: 466468

SEQ ID NO: 633728 - RNA, 64 nt, hsa; identical to SEQ ID NO: 466469

SEQ ID NO: 633729 - RNA, 64 nt, hsa; identical to SEQ ID NO: 466470

SEQ ID NO: 633730 - RNA, 64 nt, hsa; identical to SEQ ID NO: 466471

SEQ ID NO: 633731 - RNA, 64 nt, hsa; identical to SEQ ID NO: 466472

SEQ ID NO: 633732 - RNA, 64 nt, hsa; identical to SEQ ID NO: 466473

SEQ ID NO: 633733 - RNA, 64 nt, hsa; identical to SEQ ID NO: 466474

SEQ ID NO: 633734 - RNA, 64 nt, hsa; identical to SEQ ID NO: 466475

SEQ ID NO: 633735 - RNA, 64 nt, hsa; identical to SEQ ID NO: 466476

SEQ ID NO: 633736 - RNA, 64 nt, hsa; identical to SEQ ID NO: 466477

SEQ ID NO: 633737 - RNA, 64 nt, hsa; identical to SEQ ID NO: 466478

SEQ ID NO: 633738 - RNA, 64 nt, hsa; identical to SEQ ID NO: 466479

SEQ ID NO: 633739 - RNA, 64 nt, hsa; identical to SEQ ID NO: 466480

SEQ ID NO: 633740 - RNA, 64 nt, hsa; identical to SEQ ID NO: 466481

SEQ ID NO: 633741 - RNA, 64 nt, hsa; identical to SEQ ID NO: 466482

SEQ ID NO: 633742 - RNA, 64 nt, hsa; identical to SEQ ID NO: 466483

SEQ ID NO: 633743 - RNA, 64 nt, hsa; identical to SEQ ID NO: 466484

SEQ ID NO: 633744 - RNA, 64 nt, hsa; identical to SEQ ID NO: 466485

SEQ ID NO: 633745 - RNA, 64 nt, hsa; identical to SEQ ID NO: 466486

SEQ ID NO: 633746 - RNA, 64 nt, hsa; identical to SEQ ID NO: 466487

SEQ ID NO: 633747 - RNA, 64 nt, hsa; identical to SEQ ID NO: 466488

SEQ ID NO: 633748 - RNA, 64 nt, hsa; identical to SEQ ID NO: 466489

SEQ ID NO: 633749 - RNA, 64 nt, hsa; identical to SEQ ID NO: 466490

SEQ ID NO: 633750 - RNA, 64 nt, hsa; identical to SEQ ID NO: 466491

SEQ ID NO: 633751 - RNA, 64 nt, hsa; identical to SEQ ID NO: 466492

SEQ ID NO: 633752 - RNA, 64 nt, hsa; identical to SEQ ID NO: 466493

SEQ ID NO: 633753 - RNA, 64 nt, hsa; identical to SEQ ID NO: 466494

SEQ ID NO: 633754 - RNA, 64 nt, hsa; identical to SEQ ID NO: 466495

SEQ ID NO: 633755 - RNA, 64 nt, hsa; identical to SEQ ID NO: 466496

SEQ ID NO: 633756 - RNA, 64 nt, hsa; identical to SEQ ID NO: 466497

SEQ ID NO: 633757 - RNA, 64 nt, hsa; identical to SEQ ID NO: 466498

SEQ ID NO: 633758 - RNA, 64 nt, hsa; identical to SEQ ID NO: 466499

SEQ ID NO: 633759 - RNA, 64 nt, hsa; identical to SEQ ID NO: 466500

SEQ ID NO: 633760 - RNA, 64 nt, hsa; identical to SEQ ID NO: 466501

SEQ ID NO: 633761 - RNA, 64 nt, hsa; identical to SEQ ID NO: 466502

SEQ ID NO: 633762 - RNA, 64 nt, hsa; identical to SEQ ID NO: 466503

SEQ ID NO: 633763 - RNA, 64 nt, hsa; identical to SEQ ID NO: 466504

SEQ ID NO: 633764 - RNA, 64 nt, hsa; identical to SEQ ID NO: 466505

SEQ ID NO: 633765 - RNA, 64 nt, hsa; identical to SEQ ID NO: 466506

SEQ ID NO: 633766 - RNA, 64 nt, hsa; identical to SEQ ID NO: 466507

SEQ ID NO: 633767 - RNA, 64 nt, hsa; identical to SEQ ID NO: 466508

SEQ ID NO: 633768 - RNA, 64 nt, hsa; identical to SEQ ID NO: 466509

SEQ ID NO: 633769 - RNA, 64 nt, hsa; identical to SEQ ID NO: 466510

SEQ ID NO: 633770 - RNA, 64 nt, hsa; identical to SEQ ID NO: 234645

SEQ ID NO: 633771 - RNA, 64 nt, hsa; identical to SEQ ID NO: 234646

SEQ ID NO: 633772 - RNA, 64 nt, hsa; identical to SEQ ID NO: 234647

SEQ ID NO: 633773 - RNA, 64 nt, hsa; identical to SEQ ID NO: 234648

SEQ ID NO: 633774 - RNA, 64 nt, hsa; identical to SEQ ID NO: 234649

SEQ ID NO: 633775 - RNA, 64 nt, hsa; identical to SEQ ID NO: 234650

SEQ ID NO: 633776 - RNA, 64 nt, hsa; identical to SEQ ID NO: 234651

SEQ ID NO: 633777 - RNA, 64 nt, hsa; identical to SEQ ID NO: 234652

SEQ ID NO: 633778 - RNA, 64 nt, hsa; identical to SEQ ID NO: 234653

SEQ ID NO: 633779 - RNA, 64 nt, hsa; identical to SEQ ID NO: 234654

SEQ ID NO: 633780 - RNA, 64 nt, hsa; identical to SEQ ID NO: 234655

SEQ ID NO: 633781 - RNA, 64 nt, hsa; identical to SEQ ID NO: 234656

SEQ ID NO: 633782 - RNA, 64 nt, hsa; identical to SEQ ID NO: 234657

SEQ ID NO: 633783 - RNA, 64 nt, hsa; identical to SEQ ID NO: 234658

SEQ ID NO: 633784 - RNA, 64 nt, hsa; identical to SEQ ID NO: 234659

SEQ ID NO: 633785 - RNA, 64 nt, hsa; identical to SEQ ID NO: 234660

SEQ ID NO: 633786 - RNA, 64 nt, hsa; identical to SEQ ID NO: 234661

SEQ ID NO: 633787 - RNA, 64 nt, hsa; identical to SEQ ID NO: 234662

SEQ ID NO: 633788 - RNA, 64 nt, hsa; identical to SEQ ID NO: 234663

SEQ ID NO: 633789 - RNA, 64 nt, hsa; identical to SEQ ID NO: 234664

SEQ ID NO: 633790 - RNA, 64 nt, hsa; identical to SEQ ID NO: 234665

SEQ ID NO: 633791 - RNA, 63 nt, hsa; identical to SEQ ID NO: 234666

SEQ ID NO: 633792 - RNA, 64 nt, hsa; identical to SEQ ID NO: 234667

SEQ ID NO: 633793 - RNA, 64 nt, hsa; identical to SEQ ID NO: 234668

SEQ ID NO: 633794 - RNA, 64 nt, hsa; identical to SEQ ID NO: 234669

SEQ ID NO: 633795 - RNA, 64 nt, hsa; identical to SEQ ID NO: 234670

SEQ ID NO: 633796 - RNA, 64 nt, hsa; identical to SEQ ID NO: 234671

SEQ ID NO: 633797 - RNA, 64 nt, hsa; identical to SEQ ID NO: 234672

SEQ ID NO: 633798 - RNA, 64 nt, hsa; identical to SEQ ID NO: 234673

SEQ ID NO: 633799 - RNA, 64 nt, hsa; identical to SEQ ID NO: 234674

SEQ ID NO: 633800 - RNA, 64 nt, hsa; identical to SEQ ID NO: 234675

SEQ ID NO: 633801 - RNA, 64 nt, hsa; identical to SEQ ID NO: 234676

SEQ ID NO: 633802 - RNA, 64 nt, hsa; identical to SEQ ID NO: 234677

SEQ ID NO: 633803 - RNA, 64 nt, hsa; identical to SEQ ID NO: 234678

SEQ ID NO: 633804 - RNA, 64 nt, hsa; identical to SEQ ID NO: 234679

SEQ ID NO: 633805 - RNA, 64 nt, hsa; identical to SEQ ID NO: 234680

SEQ ID NO: 633806 - RNA, 64 nt, hsa; identical to SEQ ID NO: 234681

SEQ ID NO: 633807 - RNA, 64 nt, hsa; identical to SEQ ID NO: 234682

SEQ ID NO: 633808 - RNA, 64 nt, hsa; identical to SEQ ID NO: 234683

SEQ ID NO: 633809 - RNA, 64 nt, hsa; identical to SEQ ID NO: 234684

SEQ ID NO: 633810 - RNA, 64 nt, hsa; identical to SEQ ID NO: 234685

SEQ ID NO: 633811 - RNA, 64 nt, hsa; identical to SEQ ID NO: 234686

SEQ ID NO: 633812 - RNA, 64 nt, hsa; identical to SEQ ID NO: 234687

SEQ ID NO: 633813 - RNA, 64 nt, hsa; identical to SEQ ID NO: 234688

SEQ ID NO: 633814 - RNA, 64 nt, hsa; identical to SEQ ID NO: 234689

SEQ ID NO: 633815 - RNA, 64 nt, hsa; identical to SEQ ID NO: 234690

SEQ ID NO: 633816 - RNA, 64 nt, hsa; identical to SEQ ID NO: 234691

SEQ ID NO: 633817 - RNA, 64 nt, hsa; identical to SEQ ID NO: 234692

SEQ ID NO: 633818 - RNA, 64 nt, hsa; identical to SEQ ID NO: 234693

SEQ ID NO: 633819 - RNA, 64 nt, hsa; identical to SEQ ID NO: 234694

SEQ ID NO: 633820 - RNA, 64 nt, hsa; identical to SEQ ID NO: 234695

SEQ ID NO: 633821 - RNA, 64 nt, hsa; identical to SEQ ID NO: 234696

SEQ ID NO: 633822 - RNA, 61 nt, hsa
gcagaauggcccuagaguucuuuucccugagaaaggagaaaaagaugggauugccacucac

SEQ ID NO: 633823 - RNA, 61 nt, hsa
guugcuugguugguuuguugcuuuauuuuuaaaaggagaaguuuaacuuugcuauuuauuu

SEQ ID NO: 633824 - RNA, 61 nt, hsa
agcaauugcuccaccuuacaaauuuggauagaaaggagauguaguuuauuucauaugggca

SEQ ID NO: 633825 - RNA, 61 nt, hsa
agggcaggcacgaagaacagugagauugucaaaaggagacaaccacagauccuacaggacu

SEQ ID NO: 633826 - RNA, 61 nt, hsa
auguguauguguagugcgauuuucuucaaggaaaggagacaaguccaaagcucguuugugg

SEQ ID NO: 633827 - RNA, 61 nt, hsa
aguucaugcugauacucaaauuucuuuuuaaaaaggagaaacaggaagguuucuuuuggag

SEQ ID NO: 633828 - RNA, 61 nt, hsa
gugacuccaacuauggauagcuuauuuugaaaaaggagaauugcaaauuuuaccaaaagau

SEQ ID NO: 633829 - RNA, 61 nt, hsa
aguaaauuauagaauguauaagaaaaaauauaaaggagaaaaucaauuaucaggaaagcua

SEQ ID NO: 633830 - RNA, 61 nt, hsa
ccaucuagcaaaugaggcacuguucucaaccaaaggagauggggaucugguuuagggcaau

SEQ ID NO: 633831 - RNA, 61 nt, hsa
acaggaacauuguuuucuagagcaagauaauaaaggagaugggccauacaaauguuuucua

SEQ ID NO: 633832 - RNA, 61 nt, hsa
aguaaaagaugaaguuuuauacacacagcaaaaaggagaaaaaauucuaguauauuuuaag

SEQ ID NO: 633833 - RNA, 61 nt, hsa
aggaaagagggcacccuuuucaguugggaagaaaggagagggguggcgccauggacguggc

SEQ ID NO: 633834 - RNA, 61 nt, hsa
aagccauuggaugaggaggggacugccauggaaaggagaguuuguuacuuacgguucugag

SEQ ID NO: 633835 - RNA, 61 nt, hsa
agcagcaaccucugcagggcugacaggauuuaaaggagagaauguucuuauuuggaagcag

SEQ ID NO: 633836 - RNA, 61 nt, hsa
gacaucagaguauuugaccugcaguauugaaaaaggagaauucagaaugauacaguauuuu

SEQ ID NO: 633837 - RNA, 61 nt, hsa
ugaggggagauuugcaccuagacacuucuugaaaggagacacucaguuucacaagugagcc

SEQ ID NO: 633838 - RNA, 61 nt, hsa
ucccuuaccuccuuucguugauggccaaagcaaaggagaguccugggagcccacaagaucc

SEQ ID NO: 633839 - RNA, 61 nt, hsa
ugcaucuuuuuaaaacaaggaaaagggaaaaaaaggagaaaaaacgaugcaucaagcuugu

SEQ ID NO: 633840 - RNA, 61 nt, hsa
aaagaugaguuaaccaaaggaaaauaacauuaaaggagacuuauguguuaacgcuuuguuu

SEQ ID NO: 633841 - RNA, 61 nt, hsa
gcaggaaguuguaaaucacuggcuaaugagaaaaggagacagcuaacucuaggaugaagcu

SEQ ID NO: 633842 - RNA, 61 nt, hsa
gggacaggguauagcuuagaugguggaaagcaaaggagagcaggaaguuguaaaucacugg

SEQ ID NO: 633843 - RNA, 61 nt, hsa
uggaguuugagaggagggaggugcuggggccaaaggagacacuagaaaagugguagauggg

SEQ ID NO: 633844 - RNA, 61 nt, hsa
aauguaaaagggcaguaauuaggggugagggaaaggagauaggggacccuaggagguagag

SEQ ID NO: 633845 - RNA, 61 nt, hsa
gacaggcgagaaguacgaggggagcgagacgaaaggagaacggugauuauucaugacaggc

SEQ ID NO: 633846 - RNA, 61 nt, hsa
uuuuucuacagauucauggaagaaguaaggaaaaggagagagcuagucuagauaaaaaaag

SEQ ID NO: 633847 - RNA, 61 nt, hsa
uccaggacauaugguaauacuagaccaaacuaaaggagaucauuguagaccaucaagaaga

SEQ ID NO: 633848 - RNA, 61 nt, hsa
uguuccaguuugauauggguuagguuaaggaaaaggagauggucucgaugucauggauuua

SEQ ID NO: 633849 - RNA, 61 nt, hsa
ccugucccgcuagccuguguguucacacaccaaaggagaaggguaggcgagggguucggag

SEQ ID NO: 633850 - RNA, 61 nt, hsa
aaguucugcuguuuuuagcaaaagcguccagaaaggagagcuuagcaggaguccuagcccu

SEQ ID NO: 633851 - RNA, 61 nt, hsa
gagcguccccucacaaauaaauuaaagcguaaaaggagaccuacaucaggccuucauccug

SEQ ID NO: 633852 - RNA, 61 nt, hsa
cccacagagguauuugauguauuuaauugugaaaggagacuuugcagauaaaugaggccag

SEQ ID NO: 633853 - RNA, 61 nt, hsa
aguaacauccacagaacuaguccaacucuuaaaaggagagaggaaaaacacaggcaccagu

SEQ ID NO: 633854 - RNA, 61 nt, hsa
uguucugcauguagccuucuguggucaugugaaaggagacaggcucuucuaaguugaguug

SEQ ID NO: 633855 - RNA, 61 nt, hsa
uucucuggaauuccugucucuccuuuaaaagaaaggagagaacauuuuagaacaauaguuc

SEQ ID NO: 633856 - RNA, 61 nt, hsa
uguucucggugcugggaguacagcagugagcaaaggagacaauauucccugcucacagaga

SEQ ID NO: 633857 - RNA, 61 nt, hsa
ccaugaguauguauguuuaccugugccuaauaaaggagaauuaugaaauaauuuuauuuuu

SEQ ID NO: 633858 - RNA, 61 nt, hsa
acgcugcaauaaagguugggagaaggcgcggaaaggagaggagcuggggccuuggggaccc

SEQ ID NO: 633859 - RNA, 61 nt, hsa
uauugaucuuguguucuuugugccaauaugaaaaggagaggguugguucuuuccuuuauug

SEQ ID NO: 633860 - RNA, 61 nt, hsa
ucaaagcuuuagaugugucccauguggcaagaaaggagacagugaauuuugucaaacaaua

SEQ ID NO: 633861 - RNA, 61 nt, hsa
agcauaugagaaucucugagagguccucuagaaaggagagaaaaagcaccucuuuuggcuc

SEQ ID NO: 633862 - RNA, 61 nt, hsa
uuuagacaaaagcaagaggaucagaugaagaaaaggagagguagauacagucagugucacu

SEQ ID NO: 633863 - RNA, 61 nt, hsa
uggauuuagaaaaaggaacaccugaugaagaaaaggagagguagauacagucagugucacu

SEQ ID NO: 633864 - RNA, 64 nt, hsa; identical to SEQ ID NO: 486536

SEQ ID NO: 633865 - RNA, 64 nt, hsa; identical to SEQ ID NO: 486537

SEQ ID NO: 633866 - RNA, 64 nt, hsa; identical to SEQ ID NO: 486538

SEQ ID NO: 633867 - RNA, 64 nt, hsa; identical to SEQ ID NO: 486539

SEQ ID NO: 633868 - RNA, 64 nt, hsa; identical to SEQ ID NO: 486540

SEQ ID NO: 633869 - RNA, 64 nt, hsa; identical to SEQ ID NO: 486541

SEQ ID NO: 633870 - RNA, 64 nt, hsa; identical to SEQ ID NO: 486542

SEQ ID NO: 633871 - RNA, 64 nt, hsa; identical to SEQ ID NO: 486543

SEQ ID NO: 633872 - RNA, 64 nt, hsa; identical to SEQ ID NO: 486544

SEQ ID NO: 633873 - RNA, 64 nt, hsa; identical to SEQ ID NO: 486545

SEQ ID NO: 633874 - RNA, 64 nt, hsa; identical to SEQ ID NO: 486546

SEQ ID NO: 633875 - RNA, 64 nt, hsa; identical to SEQ ID NO: 486547

SEQ ID NO: 633876 - RNA, 64 nt, hsa; identical to SEQ ID NO: 486548

SEQ ID NO: 633877 - RNA, 64 nt, hsa; identical to SEQ ID NO: 486549

SEQ ID NO: 633878 - RNA, 63 nt, hsa
acccagaccucagaugaggacuuaaugucuucuuccucucaagccaaauucgccuccacccac

SEQ ID NO: 633879 - RNA, 63 nt, hsa
ucacagacauuaaagugacgauucccacuccccuccucucagccucccugaugaagaguugac

SEQ ID NO: 633880 - RNA, 63 nt, hsa
ugggcuguaacaauucaggguuuucccuuguuuuccucucauugcauguuucccuccaauauu

SEQ ID NO: 633881 - RNA, 63 nt, hsa
auuuucagaaagggaacaacgaaggcccucucuuccucucauaccacguuuugcucaagaagc

SEQ ID NO: 633882 - RNA, 63 nt, hsa
acaugucauugaucuugcccccaauccugcuccuccucucauguuuccucuuugacuaaaugg

SEQ ID NO: 633883 - RNA, 63 nt, hsa
aauuauaaacaggacccaauuuauauucauagauccucucaaguauuauacaauuuaaaaacu

SEQ ID NO: 633884 - RNA, 63 nt, hsa
uuggccugagcuugugggucuguucagacugucuccucucaugguuugaaacugcaucugaau

SEQ ID NO: 633885 - RNA, 63 nt, hsa
augauuaguucacauuuacuggugcauccuugauccucucacagauagaggucuuaaagguug

SEQ ID NO: 633886 - RNA, 63 nt, hsa
ggcugucuuuacuuguggaaaccaggaaauugcuccucucagccaaccaagguugaccacaca

SEQ ID NO: 633887 - RNA, 63 nt, hsa
cccccccgccacgccuuagagcagagcagccccuccucucauuuggugcagaaacagucaaga

SEQ ID NO: 633888 - RNA, 63 nt, hsa
caccugagaagaaaguguacgaagagaguguccuccucucacaugagccagaucagccagaaa

SEQ ID NO: 633889 - RNA, 63 nt, hsa
uguagaguguggaaaggaguugcugauugcauuuccucucauuaacaauuggguguguaauaa

SEQ ID NO: 633890 - RNA, 63 nt, hsa
gucuuggaugccauccugcucaucuccagcauuuccucucaccuccguguucucggggagugc

SEQ ID NO: 633891 - RNA, 63 nt, hsa
gugucagaucccauccugcucaucuccagcauuuccucucaccucuguguucucggggagugc

SEQ ID NO: 633892 - RNA, 63 nt, hsa
gugucagaucccauccugcuccucuccagcauuuccucucaccuccguguucucggggagugc

SEQ ID NO: 633893 - RNA, 63 nt, hsa
gugucagaucccauccugcuccucuccagaguuuccucucaccuccguguucucggggagugc

SEQ ID NO: 633894 - RNA, 63 nt, hsa
augcaggugacauuuguucauucucuaaucccauccucucacccauccauuuccucacucagu

SEQ ID NO: 633895 - RNA, 63 nt, hsa
gccucugccuugggccucgccucuguccucagguccucucagaggcagauaccuaggggagcu

SEQ ID NO: 633896 - RNA, 63 nt, hsa
ccaaaucuccuccuuccacaccugcugccagucuccucucaagcaagccuccugaaccacugg

SEQ ID NO: 633897 - RNA, 63 nt, hsa
gaggaaggcaggggauuuaggaucgcccucccauccucucacccacuggaccccguaggaguc

SEQ ID NO: 633898 - RNA, 63 nt, hsa
uaggcaccccucuuccuuaaugaaauguggcaguccucucagggguaccccaccuacuuaggg

SEQ ID NO: 633899 - RNA, 63 nt, hsa
gagggacucuaagaaccuaagguggaaacacuguccucucaucuugggaccgagggggugggg

SEQ ID NO: 633900 - RNA, 63 nt, hsa
uuuaugaaagcaauugguuaggaccucuuuuuuuccucucagggaacuaaugcucugaaaagg

SEQ ID NO: 633901 - RNA, 63 nt, hsa
gagagaggaguuuuauuuccuccuucgauguuuuccucucaguuguaaaagaugaacucuuug

SEQ ID NO: 633902 - RNA, 63 nt, hsa
gcaaaugaaacgguauauuauuucuuugcagucuccucucagucauucaucaauguggccagc

SEQ ID NO: 633903 - RNA, 63 nt, hsa
ucugucugcagaacuuucaggaugacuauuaauuccucucagaugucauuuuugaguggucca

SEQ ID NO: 633904 - RNA, 63 nt, hsa
ccccuagagcaggaaagagggaagguacagggguccucucagccuugaaggagcccacugcuc

SEQ ID NO: 633905 - RNA, 63 nt, hsa
uucucaucugcagguuggcuagaagugguggcauccucucacucuguaauuguaaucucagcu

SEQ ID NO: 633906 - RNA, 63 nt, hsa
ucucucuuguuuccucucacucugaauuauucuuccucucaugacugaccaaacacauggaac

SEQ ID NO: 633907 - RNA, 63 nt, hsa
cuucccugagggcugccuagaaucucucuuguuuccucucacucugaauuauucuuccucuca

SEQ ID NO: 633908 - RNA, 63 nt, hsa
acacaucccaaauaccaccaccaaccaccuucuuccucucaacucugucccacaggccugucu

SEQ ID NO: 633909 - RNA, 63 nt, hsa
gaaggccauuucaagcgcugcuucucacuccauuccucucagcuguuauugcugcagggccaa

SEQ ID NO: 633910 - RNA, 63 nt, hsa
cuaaggacuucagacaccauguccgaaaccuguuccucucaagugcccuguuguguggaacac

SEQ ID NO: 633911 - RNA, 63 nt, hsa
uaaggaaugcauuaugggucaaaaaucaaacauuccucucauguuauguauauuuuguuccug

SEQ ID NO: 633912 - RNA, 63 nt, hsa
aauauuuuuccccacaauugucugauguaugaguccucucagaagcacaagugcauacuagga

SEQ ID NO: 633913 - RNA, 63 nt, hsa
gcuuccaaaccucacugagcauguucagagaauuccucucauuaaggaaauauuuuuccccac

SEQ ID NO: 633914 - RNA, 64 nt, hsa; identical to SEQ ID NO: 91381

SEQ ID NO: 633915 - RNA, 64 nt, hsa; identical to SEQ ID NO: 91382

SEQ ID NO: 633916 - RNA, 64 nt, hsa; identical to SEQ ID NO: 91383

SEQ ID NO: 633917 - RNA, 64 nt, hsa; identical to SEQ ID NO: 91384

SEQ ID NO: 633918 - RNA, 64 nt, hsa; identical to SEQ ID NO: 91385

SEQ ID NO: 633919 - RNA, 64 nt, hsa; identical to SEQ ID NO: 91386

SEQ ID NO: 633920 - RNA, 64 nt, hsa; identical to SEQ ID NO: 245291

SEQ ID NO: 633921 - RNA, 64 nt, hsa; identical to SEQ ID NO: 245292

SEQ ID NO: 633922 - RNA, 64 nt, hsa; identical to SEQ ID NO: 245293

SEQ ID NO: 633923 - RNA, 64 nt, hsa; identical to SEQ ID NO: 245294

SEQ ID NO: 633924 - RNA, 64 nt, hsa
gggucuccccagaggggccggcgggggcuggggaggggguaaguuuauccaugcagacaccaag

SEQ ID NO: 633925 - RNA, 64 nt, hsa
agagcgucuccagccccaucuccuaacgggggcuggggguaagagaaaucuaacugcgcucccc

SEQ ID NO: 633926 - RNA, 64 nt, hsa
auucaguagauuuuuguuuggcaucauguugaagcaccgaaagauaaaugauuuuuaaaaggcu

SEQ ID NO: 633927 - RNA, 64 nt, hsa
ccauacugcaccguacaugccagcguacccauugcaccgaaagcaggcccuuagggcaggaagg

SEQ ID NO: 633928 - RNA, 64 nt, hsa
caacuggaauugagguugcacacugugauuuuuacaccgaaaagccaaaaggagcuggccaucc

SEQ ID NO: 633929 - RNA, 64 nt, hsa
uuaugaugacagcccacuugucaaauauguaauucaccgaaaccacaccaaguccugcuacugu

SEQ ID NO: 633930 - RNA, 64 nt, hsa
uuccuuuugauaauuuuuuaaguuuccagcucuucaccgaaauguuguauucuuauuucagugu

SEQ ID NO: 633931 - RNA, 64 nt, hsa
cuuggaauugcaucccaaggcaaagcuuuuggcucaccgaaagcucacagauugcagaaauuag

SEQ ID NO: 633932 - RNA, 64 nt, hsa
cucgcuucaggaagaaaaguaccucauccucggccaccgaaaccacgugagugagaugagccaa

SEQ ID NO: 633933 - RNA, 64 nt, hsa
uagaucaaaguccagaucuaguuccaagucugggcaccgaaagagagcaucaaaaucaccaaga

SEQ ID NO: 633934 - RNA, 64 nt, hsa
aacacugucucaucgcugaaauaagaggccauagcaccgaaaagcagcgugggcgccggcugag

SEQ ID NO: 633935 - RNA, 64 nt, hsa
gggaaucuggaguacaggccucuccgccccugaccaccgaaacgugcaggcauucucacucaca

SEQ ID NO: 633936 - RNA, 64 nt, hsa
uaagauuccaaagaacuuagauucauuucuucaacaccgaaaugcuggagguguuugaucaguu

SEQ ID NO: 633937 - RNA, 64 nt, hsa
uugcaguguauaagguggaagccuaaagaaaucucaccgaaacuuacugcugaaugauuacauu

SEQ ID NO: 633938 - RNA, 64 nt, hsa
ucucugagcuaauguuuauauuuuuccauucaggcaccgaaauaguuaauauuugaaauaaguc

SEQ ID NO: 633939 - RNA, 64 nt, hsa
ggccuugauaucaccucugggacugugccuugcucaccgaaacccgcgcccaggaguauggcug

SEQ ID NO: 633940 - RNA, 64 nt, hsa
aguaauggguuugcagugauaagucauacuuuuccaccgaaagggagggcuugggaaucccuga

SEQ ID NO: 633941 - RNA, 64 nt, hsa
aaaaaguuuacggaaaacaccaguucacuaaaagcaccgaaaucugcaaagccugucuuccgcu

SEQ ID NO: 633942 - RNA, 62 nt, hsa
caggaguuggcaaauaagaauuaaaugucugcuacaccgaaaaccucacgccucucauucgu

SEQ ID NO: 633943 - RNA, 64 nt, hsa
aucauccuccaaagcaagaggcuuaagagagaaacaccgaaauucagauagcucagggacugcu

SEQ ID NO: 633944 - RNA, 64 nt, hsa
ugcccuuccgccccccacacuuugccugcaggugcaccgaaaggaccugggagauaaaauucaa

SEQ ID NO: 633945 - RNA, 64 nt, hsa
augaccauaaacaguaucaauguaucacugaggccaccgaaaaggacauuucuaccuaggcaau

SEQ ID NO: 633946 - RNA, 64 nt, hsa
cauauaggccauuuuagaaggccaaggagagccacaccgaaaaaggagacaguuccugugaucu

SEQ ID NO: 633947 - RNA, 64 nt, hsa
uuucacucuugguuuucaggauauaacagcacuucaccgaaauauucuuucagccauaccacug

SEQ ID NO: 633948 - RNA, 64 nt, hsa
caaauggaaaaaaagaggaaagauuaacuauuugcaccgaaaugucuuguuuuguugcgacaua

SEQ ID NO: 633949 - RNA, 64 nt, hsa
uggcaauucuguuuacaugaaauggggagaaagucaccgaaaugggugccgccggcccccacuc

SEQ ID NO: 633950 - RNA, 64 nt, hsa
ugacagccccuuuacagguuacaucauugcaguccaccgaaaaaugguuaguuaaauguuaggc

SEQ ID NO: 633951 - RNA, 51 nt, hsa
gaguguuuuguuguuucagaacaccgaaaagcuuuggaggauuucacucuu

SEQ ID NO: 633952 - RNA, 64 nt, hsa
gaauggcuuaaacuaauuugcuaugauccucuaacaccgaaauuucccauaaacuuaagugccu

SEQ ID NO: 633953 - RNA, 64 nt, hsa
gcucugcuagucaggauugauaaacagcugggcacaccgaaacaguguaccaacgaauucacca

SEQ ID NO: 633954 - RNA, 64 nt, hsa
gggagggcuuuagcaaugagacugcagccugugacaccgaaagagacuuuagcugaagaggagg

SEQ ID NO: 633955 - RNA, 64 nt, hsa
augaagaccuuucccuccaccacugaugcagucccaccgaaagccuccaucugcuccaggggga

SEQ ID NO: 633956 - RNA, 64 nt, hsa
guaugugggcuuugcaacccuccccaaccaaguccaccgaaaguccgugaagaaaggcuuugac

SEQ ID NO: 633957 - RNA, 64 nt, hsa
uccugguaccccacauccucuccuccgggacagucaccgaaaacacagguuccaaagucuaccu

SEQ ID NO: 633958 - RNA, 64 nt, hsa
ccucugagauggaauugauaacauggucuuaacucaccgaaauaaacaagcacguggugagagg

SEQ ID NO: 633959 - RNA, 64 nt, hsa
gagaauggaaaaaucccccagcccagcccagccccaccgaaaagcaaaaauuacacgucgucag

SEQ ID NO: 633960 - RNA, 64 nt, hsa
cagucccugugcugguuagacacggagcgcugcacaccgaaagcccaaauugggagcucugccu

SEQ ID NO: 633961 - RNA, 64 nt, hsa
gucagccaauccgauugccuuaggugaaagaaaccaccgaaaucccucaggucccuuggucagg

SEQ ID NO: 633962 - RNA, 64 nt, hsa
ucccugucgggcuccuccgacuccucgggcuggacaccgaaaccucccuucuuaaagcguguga

SEQ ID NO: 633963 - RNA, 64 nt, hsa
ggcucaaaaauaaacguauguguucauauucgaucaccgaaaugagaguucuuaauugcuaauu

SEQ ID NO: 633964 - RNA, 64 nt, hsa
ugugaaauggcuugucuccucccccaucagggcccaccgaaagcucaggggagcacagaagccc

SEQ ID NO: 633965 - RNA, 64 nt, hsa
caaggacaccacuggaacucacaaaggucuccuucaccgaaaacccauauaccuuuuaaguuug

SEQ ID NO: 633966 - RNA, 64 nt, hsa
acacaaccuccuccuccucuuccagcaaggaacgcaccgaaaagucacaugaugagaaauaugg

SEQ ID NO: 633967 - RNA, 64 nt, hsa
ugauaauuguauuauuuucuccgaaaacuucacucaccgaaaggucgauagauugaggcuacuc

SEQ ID NO: 633968 - RNA, 64 nt, hsa
ucauaagagccacaggucuuuauguugagucgcgcaccgaaaaacuaaaaauaaugggcgcuuu

SEQ ID NO: 633969 - RNA, 64 nt, hsa
auuaugucaguggugaaaugucacuccauugacccaccgaaaaaagaaaagaaaucuguuucua

SEQ ID NO: 633970 - RNA, 64 nt, hsa; identical to SEQ ID NO: 265328

SEQ ID NO: 633971 - RNA, 64 nt, hsa; identical to SEQ ID NO: 265329

SEQ ID NO: 633972 - RNA, 64 nt, hsa; identical to SEQ ID NO: 265330

SEQ ID NO: 633973 - RNA, 64 nt, hsa; identical to SEQ ID NO: 265331

SEQ ID NO: 633974 - RNA, 64 nt, hsa; identical to SEQ ID NO: 265332

SEQ ID NO: 633975 - RNA, 64 nt, hsa; identical to SEQ ID NO: 265333

SEQ ID NO: 633976 - RNA, 64 nt, hsa; identical to SEQ ID NO: 265334

SEQ ID NO: 633977 - RNA, 64 nt, hsa; identical to SEQ ID NO: 265335

SEQ ID NO: 633978 - RNA, 64 nt, hsa; identical to SEQ ID NO: 265336

SEQ ID NO: 633979 - RNA, 64 nt, hsa; identical to SEQ ID NO: 265337

SEQ ID NO: 633980 - RNA, 64 nt, hsa; identical to SEQ ID NO: 265338

SEQ ID NO: 633981 - RNA, 64 nt, hsa; identical to SEQ ID NO: 265339

SEQ ID NO: 633982 - RNA, 64 nt, hsa; identical to SEQ ID NO: 265340

SEQ ID NO: 633983 - RNA, 64 nt, hsa; identical to SEQ ID NO: 265341

SEQ ID NO: 633984 - RNA, 64 nt, hsa; identical to SEQ ID NO: 265342

SEQ ID NO: 633985 - RNA, 64 nt, hsa; identical to SEQ ID NO: 265343

SEQ ID NO: 633986 - RNA, 64 nt, hsa; identical to SEQ ID NO: 265344

SEQ ID NO: 633987 - RNA, 64 nt, hsa; identical to SEQ ID NO: 265345

SEQ ID NO: 633988 - RNA, 64 nt, hsa; identical to SEQ ID NO: 265346

SEQ ID NO: 633989 - RNA, 64 nt, hsa; identical to SEQ ID NO: 265347

SEQ ID NO: 633990 - RNA, 64 nt, hsa; identical to SEQ ID NO: 265348

SEQ ID NO: 633991 - RNA, 64 nt, hsa; identical to SEQ ID NO: 265349

SEQ ID NO: 633992 - RNA, 64 nt, hsa; identical to SEQ ID NO: 265350

SEQ ID NO: 633993 - RNA, 64 nt, hsa; identical to SEQ ID NO: 265351

SEQ ID NO: 633994 - RNA, 64 nt, hsa; identical to SEQ ID NO: 265352

SEQ ID NO: 633995 - RNA, 64 nt, hsa; identical to SEQ ID NO: 265353

SEQ ID NO: 633996 - RNA, 64 nt, hsa; identical to SEQ ID NO: 265354

SEQ ID NO: 633997 - RNA, 64 nt, hsa; identical to SEQ ID NO: 265355

SEQ ID NO: 633998 - RNA, 64 nt, hsa; identical to SEQ ID NO: 265356

SEQ ID NO: 633999 - RNA, 64 nt, hsa; identical to SEQ ID NO: 265357

SEQ ID NO: 634000 - RNA, 64 nt, hsa; identical to SEQ ID NO: 265358

SEQ ID NO: 634001 - RNA, 64 nt, hsa; identical to SEQ ID NO: 265359

SEQ ID NO: 634002 - RNA, 64 nt, hsa; identical to SEQ ID NO: 265360

SEQ ID NO: 634003 - RNA, 64 nt, hsa; identical to SEQ ID NO: 265361

SEQ ID NO: 634004 - RNA, 64 nt, hsa; identical to SEQ ID NO: 265362

SEQ ID NO: 634005 - RNA, 64 nt, hsa; identical to SEQ ID NO: 265363

SEQ ID NO: 634006 - RNA, 64 nt, hsa; identical to SEQ ID NO: 265364

SEQ ID NO: 634007 - RNA, 64 nt, hsa; identical to SEQ ID NO: 265365

SEQ ID NO: 634008 - RNA, 64 nt, hsa; identical to SEQ ID NO: 265366

SEQ ID NO: 634009 - RNA, 64 nt, hsa; identical to SEQ ID NO: 265367

SEQ ID NO: 634010 - RNA, 64 nt, hsa; identical to SEQ ID NO: 265368

SEQ ID NO: 634011 - RNA, 64 nt, hsa; identical to SEQ ID NO: 265369

SEQ ID NO: 634012 - RNA, 64 nt, hsa; identical to SEQ ID NO: 265370

SEQ ID NO: 634013 - RNA, 64 nt, hsa; identical to SEQ ID NO: 265371

SEQ ID NO: 634014 - RNA, 64 nt, hsa; identical to SEQ ID NO: 265372

SEQ ID NO: 634015 - RNA, 64 nt, hsa; identical to SEQ ID NO: 265373

SEQ ID NO: 634016 - RNA, 64 nt, hsa; identical to SEQ ID NO: 265374

SEQ ID NO: 634017 - RNA, 64 nt, hsa; identical to SEQ ID NO: 265375

SEQ ID NO: 634018 - RNA, 64 nt, hsa; identical to SEQ ID NO: 265376

SEQ ID NO: 634019 - RNA, 64 nt, hsa; identical to SEQ ID NO: 265377

SEQ ID NO: 634020 - RNA, 64 nt, hsa; identical to SEQ ID NO: 265378

SEQ ID NO: 634021 - RNA, 64 nt, hsa; identical to SEQ ID NO: 265379

SEQ ID NO: 634022 - RNA, 64 nt, hsa; identical to SEQ ID NO: 265380

SEQ ID NO: 634023 - RNA, 64 nt, hsa; identical to SEQ ID NO: 265381

SEQ ID NO: 634024 - RNA, 64 nt, hsa; identical to SEQ ID NO: 265382

SEQ ID NO: 634025 - RNA, 64 nt, hsa; identical to SEQ ID NO: 265383

SEQ ID NO: 634026 - RNA, 64 nt, hsa; identical to SEQ ID NO: 265384

SEQ ID NO: 634027 - RNA, 64 nt, hsa; identical to SEQ ID NO: 265385

SEQ ID NO: 634028 - RNA, 64 nt, hsa; identical to SEQ ID NO: 265386

SEQ ID NO: 634029 - RNA, 64 nt, hsa; identical to SEQ ID NO: 265387

SEQ ID NO: 634030 - RNA, 64 nt, hsa; identical to SEQ ID NO: 265388

SEQ ID NO: 634031 - RNA, 64 nt, hsa; identical to SEQ ID NO: 265389

SEQ ID NO: 634032 - RNA, 64 nt, hsa; identical to SEQ ID NO: 265390

SEQ ID NO: 634033 - RNA, 64 nt, hsa; identical to SEQ ID NO: 265391

SEQ ID NO: 634034 - RNA, 64 nt, hsa; identical to SEQ ID NO: 265392

SEQ ID NO: 634035 - RNA, 64 nt, hsa; identical to SEQ ID NO: 265393

SEQ ID NO: 634036 - RNA, 64 nt, hsa; identical to SEQ ID NO: 265394

SEQ ID NO: 634037 - RNA, 64 nt, hsa; identical to SEQ ID NO: 265395

SEQ ID NO: 634038 - RNA, 64 nt, hsa; identical to SEQ ID NO: 265396

SEQ ID NO: 634039 - RNA, 64 nt, hsa; identical to SEQ ID NO: 265397

SEQ ID NO: 634040 - RNA, 64 nt, hsa; identical to SEQ ID NO: 265398

SEQ ID NO: 634041 - RNA, 64 nt, hsa; identical to SEQ ID NO: 265399

SEQ ID NO: 634042 - RNA, 64 nt, hsa; identical to SEQ ID NO: 265400

SEQ ID NO: 634043 - RNA, 64 nt, hsa; identical to SEQ ID NO: 265401

SEQ ID NO: 634044 - RNA, 64 nt, hsa; identical to SEQ ID NO: 265402

SEQ ID NO: 634045 - RNA, 64 nt, hsa; identical to SEQ ID NO: 265403

SEQ ID NO: 634046 - RNA, 64 nt, hsa; identical to SEQ ID NO: 265404

SEQ ID NO: 634047 - RNA, 64 nt, hsa; identical to SEQ ID NO: 265405

SEQ ID NO: 634048 - RNA, 64 nt, hsa; identical to SEQ ID NO: 265406

SEQ ID NO: 634049 - RNA, 64 nt, hsa; identical to SEQ ID NO: 265407

SEQ ID NO: 634050 - RNA, 64 nt, hsa; identical to SEQ ID NO: 265408

SEQ ID NO: 634051 - RNA, 64 nt, hsa; identical to SEQ ID NO: 265409

SEQ ID NO: 634052 - RNA, 64 nt, hsa; identical to SEQ ID NO: 265410

SEQ ID NO: 634053 - RNA, 64 nt, hsa; identical to SEQ ID NO: 265411

SEQ ID NO: 634054 - RNA, 64 nt, hsa; identical to SEQ ID NO: 265412

SEQ ID NO: 634055 - RNA, 64 nt, hsa; identical to SEQ ID NO: 265413

SEQ ID NO: 634056 - RNA, 64 nt, hsa; identical to SEQ ID NO: 265414

SEQ ID NO: 634057 - RNA, 64 nt, hsa; identical to SEQ ID NO: 265415

SEQ ID NO: 634058 - RNA, 64 nt, hsa; identical to SEQ ID NO: 265416

SEQ ID NO: 634059 - RNA, 64 nt, hsa; identical to SEQ ID NO: 265417

SEQ ID NO: 634060 - RNA, 64 nt, hsa; identical to SEQ ID NO: 265418

SEQ ID NO: 634061 - RNA, 64 nt, hsa; identical to SEQ ID NO: 265419

SEQ ID NO: 634062 - RNA, 63 nt, hsa; identical to SEQ ID NO: 265420

SEQ ID NO: 634063 - RNA, 64 nt, hsa; identical to SEQ ID NO: 265421

SEQ ID NO: 634064 - RNA, 64 nt, hsa; identical to SEQ ID NO: 265422

SEQ ID NO: 634065 - RNA, 64 nt, hsa; identical to SEQ ID NO: 265423

SEQ ID NO: 634066 - RNA, 64 nt, hsa; identical to SEQ ID NO: 265424

SEQ ID NO: 634067 - RNA, 64 nt, hsa; identical to SEQ ID NO: 265425

SEQ ID NO: 634068 - RNA, 64 nt, hsa; identical to SEQ ID NO: 265426

SEQ ID NO: 634069 - RNA, 64 nt, hsa; identical to SEQ ID NO: 265427

SEQ ID NO: 634070 - RNA, 64 nt, hsa; identical to SEQ ID NO: 265428

SEQ ID NO: 634071 - RNA, 64 nt, hsa; identical to SEQ ID NO: 265429

SEQ ID NO: 634072 - RNA, 64 nt, hsa; identical to SEQ ID NO: 265430

SEQ ID NO: 634073 - RNA, 64 nt, hsa; identical to SEQ ID NO: 265431

SEQ ID NO: 634074 - RNA, 64 nt, hsa; identical to SEQ ID NO: 265432

SEQ ID NO: 634075 - RNA, 64 nt, hsa; identical to SEQ ID NO: 265433

SEQ ID NO: 634076 - RNA, 64 nt, hsa; identical to SEQ ID NO: 265434

SEQ ID NO: 634077 - RNA, 64 nt, hsa; identical to SEQ ID NO: 265435

SEQ ID NO: 634078 - RNA, 64 nt, hsa; identical to SEQ ID NO: 265436

SEQ ID NO: 634079 - RNA, 64 nt, hsa; identical to SEQ ID NO: 265437

SEQ ID NO: 634080 - RNA, 64 nt, hsa; identical to SEQ ID NO: 265438

SEQ ID NO: 634081 - RNA, 64 nt, hsa; identical to SEQ ID NO: 265439

SEQ ID NO: 634082 - RNA, 64 nt, hsa; identical to SEQ ID NO: 265440

SEQ ID NO: 634083 - RNA, 64 nt, hsa; identical to SEQ ID NO: 265441

SEQ ID NO: 634084 - RNA, 64 nt, hsa; identical to SEQ ID NO: 265442

SEQ ID NO: 634085 - RNA, 64 nt, hsa; identical to SEQ ID NO: 265443

SEQ ID NO: 634086 - RNA, 64 nt, hsa; identical to SEQ ID NO: 265444

SEQ ID NO: 634087 - RNA, 64 nt, hsa; identical to SEQ ID NO: 265445

SEQ ID NO: 634088 - RNA, 64 nt, hsa; identical to SEQ ID NO: 265446

SEQ ID NO: 634089 - RNA, 64 nt, hsa; identical to SEQ ID NO: 265447

SEQ ID NO: 634090 - RNA, 64 nt, hsa; identical to SEQ ID NO: 265448

SEQ ID NO: 634091 - RNA, 64 nt, hsa; identical to SEQ ID NO: 265449

SEQ ID NO: 634092 - RNA, 64 nt, hsa; identical to SEQ ID NO: 265450

SEQ ID NO: 634093 - RNA, 50 nt, hsa; identical to SEQ ID NO: 265451

SEQ ID NO: 634094 - RNA, 64 nt, hsa; identical to SEQ ID NO: 265452

SEQ ID NO: 634095 - RNA, 64 nt, hsa; identical to SEQ ID NO: 265453

SEQ ID NO: 634096 - RNA, 64 nt, hsa; identical to SEQ ID NO: 265454

SEQ ID NO: 634097 - RNA, 64 nt, hsa; identical to SEQ ID NO: 265455

SEQ ID NO: 634098 - RNA, 64 nt, hsa; identical to SEQ ID NO: 265456

SEQ ID NO: 634099 - RNA, 64 nt, hsa; identical to SEQ ID NO: 265457

SEQ ID NO: 634100 - RNA, 64 nt, hsa; identical to SEQ ID NO: 265458

SEQ ID NO: 634101 - RNA, 64 nt, hsa; identical to SEQ ID NO: 265459

SEQ ID NO: 634102 - RNA, 64 nt, hsa; identical to SEQ ID NO: 265460

SEQ ID NO: 634103 - RNA, 64 nt, hsa; identical to SEQ ID NO: 265461

SEQ ID NO: 634104 - RNA, 64 nt, hsa; identical to SEQ ID NO: 265462

SEQ ID NO: 634105 - RNA, 64 nt, hsa; identical to SEQ ID NO: 265463

SEQ ID NO: 634106 - RNA, 64 nt, hsa; identical to SEQ ID NO: 265464

SEQ ID NO: 634107 - RNA, 64 nt, hsa; identical to SEQ ID NO: 113285

SEQ ID NO: 634108 - RNA, 64 nt, hsa; identical to SEQ ID NO: 113286

SEQ ID NO: 634109 - RNA, 64 nt, hsa; identical to SEQ ID NO: 113287

SEQ ID NO: 634110 - RNA, 64 nt, hsa; identical to SEQ ID NO: 113288

SEQ ID NO: 634111 - RNA, 64 nt, hsa; identical to SEQ ID NO: 113289

SEQ ID NO: 634112 - RNA, 64 nt, hsa; identical to SEQ ID NO: 113290

SEQ ID NO: 634113 - RNA, 64 nt, hsa; identical to SEQ ID NO: 113291

SEQ ID NO: 634114 - RNA, 64 nt, hsa; identical to SEQ ID NO: 113292

SEQ ID NO: 634115 - RNA, 64 nt, hsa; identical to SEQ ID NO: 113293

SEQ ID NO: 634116 - RNA, 64 nt, hsa; identical to SEQ ID NO: 113294

SEQ ID NO: 634117 - RNA, 64 nt, hsa; identical to SEQ ID NO: 113295

SEQ ID NO: 634118 - RNA, 64 nt, hsa; identical to SEQ ID NO: 113296

SEQ ID NO: 634119 - RNA, 64 nt, hsa; identical to SEQ ID NO: 113297

SEQ ID NO: 634120 - RNA, 64 nt, hsa; identical to SEQ ID NO: 113298

SEQ ID NO: 634121 - RNA, 64 nt, hsa; identical to SEQ ID NO: 113299

SEQ ID NO: 634122 - RNA, 64 nt, hsa; identical to SEQ ID NO: 113300

SEQ ID NO: 634123 - RNA, 64 nt, hsa; identical to SEQ ID NO: 113301

SEQ ID NO: 634124 - RNA, 64 nt, hsa; identical to SEQ ID NO: 113302

SEQ ID NO: 634125 - RNA, 64 nt, hsa; identical to SEQ ID NO: 113303

SEQ ID NO: 634126 - RNA, 64 nt, hsa; identical to SEQ ID NO: 113304

SEQ ID NO: 634127 - RNA, 64 nt, hsa; identical to SEQ ID NO: 113305

SEQ ID NO: 634128 - RNA, 64 nt, hsa; identical to SEQ ID NO: 113306

SEQ ID NO: 634129 - RNA, 64 nt, hsa; identical to SEQ ID NO: 113307

SEQ ID NO: 634130 - RNA, 64 nt, hsa; identical to SEQ ID NO: 113308

SEQ ID NO: 634131 - RNA, 64 nt, hsa; identical to SEQ ID NO: 113309

SEQ ID NO: 634132 - RNA, 64 nt, hsa; identical to SEQ ID NO: 113310

SEQ ID NO: 634133 - RNA, 64 nt, hsa; identical to SEQ ID NO: 113311

SEQ ID NO: 634134 - RNA, 64 nt, hsa; identical to SEQ ID NO: 113312

SEQ ID NO: 634135 - RNA, 64 nt, hsa; identical to SEQ ID NO: 113313

SEQ ID NO: 634136 - RNA, 64 nt, hsa; identical to SEQ ID NO: 113314

SEQ ID NO: 634137 - RNA, 64 nt, hsa; identical to SEQ ID NO: 113315

SEQ ID NO: 634138 - RNA, 64 nt, hsa; identical to SEQ ID NO: 113316

SEQ ID NO: 634139 - RNA, 64 nt, hsa; identical to SEQ ID NO: 113317

SEQ ID NO: 634140 - RNA, 64 nt, hsa; identical to SEQ ID NO: 113318

SEQ ID NO: 634141 - RNA, 64 nt, hsa; identical to SEQ ID NO: 113319

SEQ ID NO: 634142 - RNA, 64 nt, hsa; identical to SEQ ID NO: 113320

SEQ ID NO: 634143 - RNA, 64 nt, hsa; identical to SEQ ID NO: 113321

SEQ ID NO: 634144 - RNA, 64 nt, hsa; identical to SEQ ID NO: 113322

SEQ ID NO: 634145 - RNA, 64 nt, hsa; identical to SEQ ID NO: 113323

SEQ ID NO: 634146 - RNA, 64 nt, hsa; identical to SEQ ID NO: 113324

SEQ ID NO: 634147 - RNA, 64 nt, hsa
cagcccuauacuuuggggaucauuugccuaccauggcauauauuugaaauugcuuuggacaagu

SEQ ID NO: 634148 - RNA, 64 nt, hsa
aacacauuuucuaugcaugugucucuguguauauggcauauaccuaguaaguauguuucuguaa

SEQ ID NO: 634149 - RNA, 64 nt, hsa
uggcccuggcccacauugcacauggaaacccaaaggcauauaucugcguaugugugguacuuag

SEQ ID NO: 634150 - RNA, 64 nt, hsa
aggaaaaaaaaagucauguauauauacacauaaaggcauauagcuauauauaaagagauaaggg

SEQ ID NO: 634151 - RNA, 64 nt, hsa
gcacuccugaauuuuaucaaacacacuuccagcuggcauauagguugcagucucggccucgugg

SEQ ID NO: 634152 - RNA, 64 nt, hsa
ugaaguuguaaacacagugugguuauggggagagggcauauaaauuccccauauuuguguucag

SEQ ID NO: 634153 - RNA, 64 nt, hsa
accaaaaacccaaacacccuauguaacuaucggaggcauauacgugguauaaaugacuguagcu

SEQ ID NO: 634154 - RNA, 64 nt, hsa
uuagcugaauagaaagaauguggaaguggucugaggcauauagaguauaugccaagaacacuac

SEQ ID NO: 634155 - RNA, 64 nt, hsa
ucccaguugagcucccaagaccaggacccacuggggcauauaaaaaagucaaaaaucaaaauca

SEQ ID NO: 634156 - RNA, 64 nt, hsa
ucccaguugagcucccaagaccaggacccacuggggcauauaaaaucucugcuguauccuuucg

SEQ ID NO: 634157 - RNA, 64 nt, hsa
uggaagaaacagcgauuuaaauuguauugaacagggcauauaaaaugcauucuguacccugauc

SEQ ID NO: 634158 - RNA, 64 nt, hsa
cagggcauauaaaaugcauucuguacccugaucuggcauauagcuucaaaacugcaguggcgag

SEQ ID NO: 634159 - RNA, 64 nt, hsa
aagcuuagugaucaggcaagauaaagauaugaaaggcauauauaaauaggaagaggggaaguca

SEQ ID NO: 634160 - RNA, 64 nt, hsa
aucaauggaauagguaagagaacccagaaauaaaggcauauaccuacaaccaugugauccucaa

SEQ ID NO: 634161 - RNA, 64 nt, hsa; identical to SEQ ID NO: 199403

SEQ ID NO: 634162 - RNA, 64 nt, hsa; identical to SEQ ID NO: 199404

SEQ ID NO: 634163 - RNA, 64 nt, hsa; identical to SEQ ID NO: 199405

SEQ ID NO: 634164 - RNA, 64 nt, hsa; identical to SEQ ID NO: 199406

SEQ ID NO: 634165 - RNA, 64 nt, hsa; identical to SEQ ID NO: 199407

SEQ ID NO: 634166 - RNA, 64 nt, hsa; identical to SEQ ID NO: 199408

SEQ ID NO: 634167 - RNA, 64 nt, hsa; identical to SEQ ID NO: 199409

SEQ ID NO: 634168 - RNA, 64 nt, hsa; identical to SEQ ID NO: 199410

SEQ ID NO: 634169 - RNA, 64 nt, hsa; identical to SEQ ID NO: 199411

SEQ ID NO: 634170 - RNA, 64 nt, hsa; identical to SEQ ID NO: 199412

SEQ ID NO: 634171 - RNA, 64 nt, hsa; identical to SEQ ID NO: 199413

SEQ ID NO: 634172 - RNA, 64 nt, hsa; identical to SEQ ID NO: 199414

SEQ ID NO: 634173 - RNA, 64 nt, hsa; identical to SEQ ID NO: 199415

SEQ ID NO: 634174 - RNA, 64 nt, hsa; identical to SEQ ID NO: 199416

SEQ ID NO: 634175 - RNA, 64 nt, hsa; identical to SEQ ID NO: 199417

SEQ ID NO: 634176 - RNA, 64 nt, hsa; identical to SEQ ID NO: 199418

SEQ ID NO: 634177 - RNA, 64 nt, hsa; identical to SEQ ID NO: 199419

SEQ ID NO: 634178 - RNA, 64 nt, hsa; identical to SEQ ID NO: 199420

SEQ ID NO: 634179 - RNA, 64 nt, hsa; identical to SEQ ID NO: 199421

SEQ ID NO: 634180 - RNA, 64 nt, hsa; identical to SEQ ID NO: 199422

SEQ ID NO: 634181 - RNA, 64 nt, hsa; identical to SEQ ID NO: 199423

SEQ ID NO: 634182 - RNA, 64 nt, hsa; identical to SEQ ID NO: 199424

SEQ ID NO: 634183 - RNA, 64 nt, hsa; identical to SEQ ID NO: 199425

SEQ ID NO: 634184 - RNA, 64 nt, hsa; identical to SEQ ID NO: 199426

SEQ ID NO: 634185 - RNA, 64 nt, hsa; identical to SEQ ID NO: 199427

SEQ ID NO: 634186 - RNA, 64 nt, hsa; identical to SEQ ID NO: 199428

SEQ ID NO: 634187 - RNA, 64 nt, hsa; identical to SEQ ID NO: 85324

SEQ ID NO: 634188 - RNA, 64 nt, hsa; identical to SEQ ID NO: 85325

SEQ ID NO: 634189 - RNA, 64 nt, hsa; identical to SEQ ID NO: 85326

SEQ ID NO: 634190 - RNA, 64 nt, hsa; identical to SEQ ID NO: 85327

SEQ ID NO: 634191 - RNA, 64 nt, hsa; identical to SEQ ID NO: 85328

SEQ ID NO: 634192 - RNA, 64 nt, hsa; identical to SEQ ID NO: 85329

SEQ ID NO: 634193 - RNA, 64 nt, hsa; identical to SEQ ID NO: 85330

SEQ ID NO: 634194 - RNA, 64 nt, hsa; identical to SEQ ID NO: 85331

SEQ ID NO: 634195 - RNA, 64 nt, hsa; identical to SEQ ID NO: 85332

SEQ ID NO: 634196 - RNA, 64 nt, hsa; identical to SEQ ID NO: 85333

SEQ ID NO: 634197 - RNA, 64 nt, hsa; identical to SEQ ID NO: 85334

SEQ ID NO: 634198 - RNA, 64 nt, hsa; identical to SEQ ID NO: 85335

SEQ ID NO: 634199 - RNA, 64 nt, hsa; identical to SEQ ID NO: 85336

SEQ ID NO: 634200 - RNA, 64 nt, hsa; identical to SEQ ID NO: 85337

SEQ ID NO: 634201 - RNA, 64 nt, hsa; identical to SEQ ID NO: 85338

SEQ ID NO: 634202 - RNA, 64 nt, hsa; identical to SEQ ID NO: 85339

SEQ ID NO: 634203 - RNA, 64 nt, hsa; identical to SEQ ID NO: 85340

SEQ ID NO: 634204 - RNA, 64 nt, hsa; identical to SEQ ID NO: 85341

SEQ ID NO: 634205 - RNA, 64 nt, hsa; identical to SEQ ID NO: 85342

SEQ ID NO: 634206 - RNA, 64 nt, hsa; identical to SEQ ID NO: 85343

SEQ ID NO: 634207 - RNA, 64 nt, hsa; identical to SEQ ID NO: 85344

SEQ ID NO: 634208 - RNA, 64 nt, hsa; identical to SEQ ID NO: 85345

SEQ ID NO: 634209 - RNA, 64 nt, hsa; identical to SEQ ID NO: 85346

SEQ ID NO: 634210 - RNA, 64 nt, hsa; identical to SEQ ID NO: 85347

SEQ ID NO: 634211 - RNA, 64 nt, hsa; identical to SEQ ID NO: 85348

SEQ ID NO: 634212 - RNA, 64 nt, hsa; identical to SEQ ID NO: 85349

SEQ ID NO: 634213 - RNA, 64 nt, hsa; identical to SEQ ID NO: 85350

SEQ ID NO: 634214 - RNA, 64 nt, hsa; identical to SEQ ID NO: 85351

SEQ ID NO: 634215 - RNA, 64 nt, hsa; identical to SEQ ID NO: 85352

SEQ ID NO: 634216 - RNA, 64 nt, hsa; identical to SEQ ID NO: 85353

SEQ ID NO: 634217 - RNA, 64 nt, hsa; identical to SEQ ID NO: 85354

SEQ ID NO: 634218 - RNA, 64 nt, hsa; identical to SEQ ID NO: 85355

SEQ ID NO: 634219 - RNA, 64 nt, hsa; identical to SEQ ID NO: 85356

SEQ ID NO: 634220 - RNA, 64 nt, hsa; identical to SEQ ID NO: 85357

SEQ ID NO: 634221 - RNA, 64 nt, hsa; identical to SEQ ID NO: 85358

SEQ ID NO: 634222 - RNA, 64 nt, hsa; identical to SEQ ID NO: 85359

SEQ ID NO: 634223 - RNA, 64 nt, hsa; identical to SEQ ID NO: 85360

SEQ ID NO: 634224 - RNA, 64 nt, hsa; identical to SEQ ID NO: 85361

SEQ ID NO: 634225 - RNA, 64 nt, hsa; identical to SEQ ID NO: 85362

SEQ ID NO: 634226 - RNA, 64 nt, hsa; identical to SEQ ID NO: 85363

SEQ ID NO: 634227 - RNA, 64 nt, hsa; identical to SEQ ID NO: 85364

SEQ ID NO: 634228 - RNA, 64 nt, hsa; identical to SEQ ID NO: 85365

SEQ ID NO: 634229 - RNA, 64 nt, hsa; identical to SEQ ID NO: 85366

SEQ ID NO: 634230 - RNA, 64 nt, hsa; identical to SEQ ID NO: 85367

SEQ ID NO: 634231 - RNA, 64 nt, hsa; identical to SEQ ID NO: 85368

SEQ ID NO: 634232 - RNA, 64 nt, hsa; identical to SEQ ID NO: 85369

SEQ ID NO: 634233 - RNA, 64 nt, hsa; identical to SEQ ID NO: 237127

SEQ ID NO: 634234 - RNA, 64 nt, hsa; identical to SEQ ID NO: 237128

SEQ ID NO: 634235 - RNA, 64 nt, hsa; identical to SEQ ID NO: 237129

SEQ ID NO: 634236 - RNA, 64 nt, hsa; identical to SEQ ID NO: 237130

SEQ ID NO: 634237 - RNA, 64 nt, hsa; identical to SEQ ID NO: 237131

SEQ ID NO: 634238 - RNA, 64 nt, hsa; identical to SEQ ID NO: 237132

SEQ ID NO: 634239 - RNA, 64 nt, hsa; identical to SEQ ID NO: 237133

SEQ ID NO: 634240 - RNA, 64 nt, hsa; identical to SEQ ID NO: 237134

SEQ ID NO: 634241 - RNA, 64 nt, hsa; identical to SEQ ID NO: 147779

SEQ ID NO: 634242 - RNA, 64 nt, hsa; identical to SEQ ID NO: 147780

SEQ ID NO: 634243 - RNA, 64 nt, hsa; identical to SEQ ID NO: 147781

SEQ ID NO: 634244 - RNA, 64 nt, hsa; identical to SEQ ID NO: 147782

SEQ ID NO: 634245 - RNA, 64 nt, hsa; identical to SEQ ID NO: 147783

SEQ ID NO: 634246 - RNA, 64 nt, hsa; identical to SEQ ID NO: 147784

SEQ ID NO: 634247 - RNA, 64 nt, hsa; identical to SEQ ID NO: 147785

SEQ ID NO: 634248 - RNA, 64 nt, hsa; identical to SEQ ID NO: 147786

SEQ ID NO: 634249 - RNA, 64 nt, hsa; identical to SEQ ID NO: 147787

SEQ ID NO: 634250 - RNA, 64 nt, hsa; identical to SEQ ID NO: 147788

SEQ ID NO: 634251 - RNA, 64 nt, hsa; identical to SEQ ID NO: 147789

SEQ ID NO: 634252 - RNA, 64 nt, hsa; identical to SEQ ID NO: 147790

SEQ ID NO: 634253 - RNA, 64 nt, hsa; identical to SEQ ID NO: 147791

SEQ ID NO: 634254 - RNA, 64 nt, hsa; identical to SEQ ID NO: 147792

SEQ ID NO: 634255 - RNA, 64 nt, hsa; identical to SEQ ID NO: 147793

SEQ ID NO: 634256 - RNA, 64 nt, hsa; identical to SEQ ID NO: 147794

SEQ ID NO: 634257 - RNA, 64 nt, hsa; identical to SEQ ID NO: 147795

SEQ ID NO: 634258 - RNA, 64 nt, hsa; identical to SEQ ID NO: 147796

SEQ ID NO: 634259 - RNA, 64 nt, hsa; identical to SEQ ID NO: 147797

SEQ ID NO: 634260 - RNA, 64 nt, hsa; identical to SEQ ID NO: 147798

SEQ ID NO: 634261 - RNA, 64 nt, hsa; identical to SEQ ID NO: 147799

SEQ ID NO: 634262 - RNA, 64 nt, hsa; identical to SEQ ID NO: 147800

SEQ ID NO: 634263 - RNA, 64 nt, hsa; identical to SEQ ID NO: 147801

SEQ ID NO: 634264 - RNA, 64 nt, hsa; identical to SEQ ID NO: 147802

SEQ ID NO: 634265 - RNA, 64 nt, hsa; identical to SEQ ID NO: 147803

SEQ ID NO: 634266 - RNA, 64 nt, hsa; identical to SEQ ID NO: 147804

SEQ ID NO: 634267 - RNA, 64 nt, hsa; identical to SEQ ID NO: 147805

SEQ ID NO: 634268 - RNA, 54 nt, hsa; identical to SEQ ID NO: 147806

SEQ ID NO: 634269 - RNA, 64 nt, hsa; identical to SEQ ID NO: 147807

SEQ ID NO: 634270 - RNA, 64 nt, hsa; identical to SEQ ID NO: 147808

SEQ ID NO: 634271 - RNA, 64 nt, hsa; identical to SEQ ID NO: 147809

SEQ ID NO: 634272 - RNA, 64 nt, hsa; identical to SEQ ID NO: 147810

SEQ ID NO: 634273 - RNA, 64 nt, hsa; identical to SEQ ID NO: 147811

SEQ ID NO: 634274 - RNA, 64 nt, hsa; identical to SEQ ID NO: 147812

SEQ ID NO: 634275 - RNA, 64 nt, hsa; identical to SEQ ID NO: 147813

SEQ ID NO: 634276 - RNA, 64 nt, hsa; identical to SEQ ID NO: 147814

SEQ ID NO: 634277 - RNA, 64 nt, hsa; identical to SEQ ID NO: 147815

SEQ ID NO: 634278 - RNA, 64 nt, hsa; identical to SEQ ID NO: 147816

SEQ ID NO: 634279 - RNA, 64 nt, hsa; identical to SEQ ID NO: 147817

SEQ ID NO: 634280 - RNA, 64 nt, hsa; identical to SEQ ID NO: 147818

SEQ ID NO: 634281 - RNA, 64 nt, hsa; identical to SEQ ID NO: 147819

SEQ ID NO: 634282 - RNA, 64 nt, hsa; identical to SEQ ID NO: 147820

SEQ ID NO: 634283 - RNA, 64 nt, hsa; identical to SEQ ID NO: 147821

SEQ ID NO: 634284 - RNA, 64 nt, hsa; identical to SEQ ID NO: 147822

SEQ ID NO: 634285 - RNA, 64 nt, hsa; identical to SEQ ID NO: 147823

SEQ ID NO: 634286 - RNA, 64 nt, hsa; identical to SEQ ID NO: 147824

SEQ ID NO: 634287 - RNA, 64 nt, hsa; identical to SEQ ID NO: 147825

SEQ ID NO: 634288 - RNA, 64 nt, hsa; identical to SEQ ID NO: 147826

SEQ ID NO: 634289 - RNA, 64 nt, hsa; identical to SEQ ID NO: 147827

SEQ ID NO: 634290 - RNA, 64 nt, hsa; identical to SEQ ID NO: 147828

SEQ ID NO: 634291 - RNA, 64 nt, hsa; identical to SEQ ID NO: 147829

SEQ ID NO: 634292 - RNA, 64 nt, hsa; identical to SEQ ID NO: 147830

SEQ ID NO: 634293 - RNA, 64 nt, hsa; identical to SEQ ID NO: 147831

SEQ ID NO: 634294 - RNA, 64 nt, hsa; identical to SEQ ID NO: 147832

SEQ ID NO: 634295 - RNA, 64 nt, hsa; identical to SEQ ID NO: 147833

SEQ ID NO: 634296 - RNA, 64 nt, hsa; identical to SEQ ID NO: 147834

SEQ ID NO: 634297 - RNA, 64 nt, hsa; identical to SEQ ID NO: 147835

SEQ ID NO: 634298 - RNA, 64 nt, hsa; identical to SEQ ID NO: 147836

SEQ ID NO: 634299 - RNA, 64 nt, hsa; identical to SEQ ID NO: 147837

SEQ ID NO: 634300 - RNA, 64 nt, hsa; identical to SEQ ID NO: 147838

SEQ ID NO: 634301 - RNA, 64 nt, hsa; identical to SEQ ID NO: 147839

SEQ ID NO: 634302 - RNA, 64 nt, hsa; identical to SEQ ID NO: 147840

SEQ ID NO: 634303 - RNA, 64 nt, hsa; identical to SEQ ID NO: 147841

SEQ ID NO: 634304 - RNA, 64 nt, hsa; identical to SEQ ID NO: 147842

SEQ ID NO: 634305 - RNA, 64 nt, hsa; identical to SEQ ID NO: 147843

SEQ ID NO: 634306 - RNA, 58 nt, hsa; identical to SEQ ID NO: 147844

SEQ ID NO: 634307 - RNA, 64 nt, hsa; identical to SEQ ID NO: 147845

SEQ ID NO: 634308 - RNA, 64 nt, hsa; identical to SEQ ID NO: 147846

SEQ ID NO: 634309 - RNA, 64 nt, hsa; identical to SEQ ID NO: 147847

SEQ ID NO: 634310 - RNA, 64 nt, hsa; identical to SEQ ID NO: 147848

SEQ ID NO: 634311 - RNA, 64 nt, hsa; identical to SEQ ID NO: 147849

SEQ ID NO: 634312 - RNA, 64 nt, hsa; identical to SEQ ID NO: 147850

SEQ ID NO: 634313 - RNA, 64 nt, hsa; identical to SEQ ID NO: 147851

SEQ ID NO: 634314 - RNA, 64 nt, hsa; identical to SEQ ID NO: 147852

SEQ ID NO: 634315 - RNA, 64 nt, hsa; identical to SEQ ID NO: 147853

SEQ ID NO: 634316 - RNA, 64 nt, hsa; identical to SEQ ID NO: 147854

SEQ ID NO: 634317 - RNA, 64 nt, hsa; identical to SEQ ID NO: 147855

SEQ ID NO: 634318 - RNA, 64 nt, hsa; identical to SEQ ID NO: 147856

SEQ ID NO: 634319 - RNA, 64 nt, hsa; identical to SEQ ID NO: 147857

SEQ ID NO: 634320 - RNA, 64 nt, hsa; identical to SEQ ID NO: 147858

SEQ ID NO: 634321 - RNA, 64 nt, hsa; identical to SEQ ID NO: 147859

SEQ ID NO: 634322 - RNA, 64 nt, hsa; identical to SEQ ID NO: 147860

SEQ ID NO: 634323 - RNA, 64 nt, hsa; identical to SEQ ID NO: 147861

SEQ ID NO: 634324 - RNA, 64 nt, hsa; identical to SEQ ID NO: 147862

SEQ ID NO: 634325 - RNA, 64 nt, hsa; identical to SEQ ID NO: 147863

SEQ ID NO: 634326 - RNA, 64 nt, hsa; identical to SEQ ID NO: 147864

SEQ ID NO: 634327 - RNA, 64 nt, hsa; identical to SEQ ID NO: 147865

SEQ ID NO: 634328 - RNA, 64 nt, hsa; identical to SEQ ID NO: 147866

SEQ ID NO: 634329 - RNA, 64 nt, hsa; identical to SEQ ID NO: 147867

SEQ ID NO: 634330 - RNA, 64 nt, hsa; identical to SEQ ID NO: 147868

SEQ ID NO: 634331 - RNA, 64 nt, hsa; identical to SEQ ID NO: 147869

SEQ ID NO: 634332 - RNA, 64 nt, hsa; identical to SEQ ID NO: 147870

SEQ ID NO: 634333 - RNA, 64 nt, hsa; identical to SEQ ID NO: 147871

SEQ ID NO: 634334 - RNA, 64 nt, hsa; identical to SEQ ID NO: 147872

SEQ ID NO: 634335 - RNA, 64 nt, hsa; identical to SEQ ID NO: 147873

SEQ ID NO: 634336 - RNA, 64 nt, hsa; identical to SEQ ID NO: 147874

SEQ ID NO: 634337 - RNA, 64 nt, hsa; identical to SEQ ID NO: 147875

SEQ ID NO: 634338 - RNA, 64 nt, hsa; identical to SEQ ID NO: 147876

SEQ ID NO: 634339 - RNA, 64 nt, hsa; identical to SEQ ID NO: 147877

SEQ ID NO: 634340 - RNA, 64 nt, hsa; identical to SEQ ID NO: 147878

SEQ ID NO: 634341 - RNA, 64 nt, hsa; identical to SEQ ID NO: 147879

SEQ ID NO: 634342 - RNA, 64 nt, hsa; identical to SEQ ID NO: 147880

SEQ ID NO: 634343 - RNA, 64 nt, hsa; identical to SEQ ID NO: 147881

SEQ ID NO: 634344 - RNA, 64 nt, hsa; identical to SEQ ID NO: 147882

SEQ ID NO: 634345 - RNA, 64 nt, hsa; identical to SEQ ID NO: 147883

SEQ ID NO: 634346 - RNA, 64 nt, hsa; identical to SEQ ID NO: 147884

SEQ ID NO: 634347 - RNA, 64 nt, hsa; identical to SEQ ID NO: 147885

SEQ ID NO: 634348 - RNA, 64 nt, hsa; identical to SEQ ID NO: 147886

SEQ ID NO: 634349 - RNA, 64 nt, hsa; identical to SEQ ID NO: 147887

SEQ ID NO: 634350 - RNA, 64 nt, hsa; identical to SEQ ID NO: 147888

SEQ ID NO: 634351 - RNA, 64 nt, hsa; identical to SEQ ID NO: 147889

SEQ ID NO: 634352 - RNA, 64 nt, hsa; identical to SEQ ID NO: 147890

SEQ ID NO: 634353 - RNA, 64 nt, hsa; identical to SEQ ID NO: 147891

SEQ ID NO: 634354 - RNA, 64 nt, hsa; identical to SEQ ID NO: 147892

SEQ ID NO: 634355 - RNA, 64 nt, hsa; identical to SEQ ID NO: 147893

SEQ ID NO: 634356 - RNA, 64 nt, hsa; identical to SEQ ID NO: 147894

SEQ ID NO: 634357 - RNA, 64 nt, hsa; identical to SEQ ID NO: 147895

SEQ ID NO: 634358 - RNA, 64 nt, hsa; identical to SEQ ID NO: 147896

SEQ ID NO: 634359 - RNA, 64 nt, hsa; identical to SEQ ID NO: 147897

SEQ ID NO: 634360 - RNA, 64 nt, hsa; identical to SEQ ID NO: 147898

SEQ ID NO: 634361 - RNA, 64 nt, hsa; identical to SEQ ID NO: 147899

SEQ ID NO: 634362 - RNA, 64 nt, hsa; identical to SEQ ID NO: 147900

SEQ ID NO: 634363 - RNA, 64 nt, hsa; identical to SEQ ID NO: 147901

SEQ ID NO: 634364 - RNA, 64 nt, hsa; identical to SEQ ID NO: 147902

SEQ ID NO: 634365 - RNA, 64 nt, hsa; identical to SEQ ID NO: 147903

SEQ ID NO: 634366 - RNA, 64 nt, hsa; identical to SEQ ID NO: 147904

SEQ ID NO: 634367 - RNA, 64 nt, hsa; identical to SEQ ID NO: 147905

SEQ ID NO: 634368 - RNA, 64 nt, hsa; identical to SEQ ID NO: 147906

SEQ ID NO: 634369 - RNA, 64 nt, hsa; identical to SEQ ID NO: 147907

SEQ ID NO: 634370 - RNA, 64 nt, hsa; identical to SEQ ID NO: 147908

SEQ ID NO: 634371 - RNA, 64 nt, hsa; identical to SEQ ID NO: 147909

SEQ ID NO: 634372 - RNA, 64 nt, hsa; identical to SEQ ID NO: 147910

SEQ ID NO: 634373 - RNA, 64 nt, hsa; identical to SEQ ID NO: 147911

SEQ ID NO: 634374 - RNA, 64 nt, hsa; identical to SEQ ID NO: 147912

SEQ ID NO: 634375 - RNA, 64 nt, hsa; identical to SEQ ID NO: 147913

SEQ ID NO: 634376 - RNA, 64 nt, hsa; identical to SEQ ID NO: 147914

SEQ ID NO: 634377 - RNA, 64 nt, hsa; identical to SEQ ID NO: 147915

SEQ ID NO: 634378 - RNA, 64 nt, hsa; identical to SEQ ID NO: 147916

SEQ ID NO: 634379 - RNA, 64 nt, hsa; identical to SEQ ID NO: 147917

SEQ ID NO: 634380 - RNA, 64 nt, hsa; identical to SEQ ID NO: 147918

SEQ ID NO: 634381 - RNA, 64 nt, hsa; identical to SEQ ID NO: 147919

SEQ ID NO: 634382 - RNA, 64 nt, hsa; identical to SEQ ID NO: 147920

SEQ ID NO: 634383 - RNA, 64 nt, hsa; identical to SEQ ID NO: 147921

SEQ ID NO: 634384 - RNA, 64 nt, hsa; identical to SEQ ID NO: 147922

SEQ ID NO: 634385 - RNA, 64 nt, hsa; identical to SEQ ID NO: 147923

SEQ ID NO: 634386 - RNA, 64 nt, hsa; identical to SEQ ID NO: 147924

SEQ ID NO: 634387 - RNA, 64 nt, hsa; identical to SEQ ID NO: 147925

SEQ ID NO: 634388 - RNA, 64 nt, hsa; identical to SEQ ID NO: 147926

SEQ ID NO: 634389 - RNA, 64 nt, hsa; identical to SEQ ID NO: 147927

SEQ ID NO: 634390 - RNA, 64 nt, hsa; identical to SEQ ID NO: 147928

SEQ ID NO: 634391 - RNA, 64 nt, hsa; identical to SEQ ID NO: 147929

SEQ ID NO: 634392 - RNA, 64 nt, hsa; identical to SEQ ID NO: 147930

SEQ ID NO: 634393 - RNA, 64 nt, hsa; identical to SEQ ID NO: 147931

SEQ ID NO: 634394 - RNA, 64 nt, hsa; identical to SEQ ID NO: 147932

SEQ ID NO: 634395 - RNA, 64 nt, hsa; identical to SEQ ID NO: 147933

SEQ ID NO: 634396 - RNA, 64 nt, hsa; identical to SEQ ID NO: 147934

SEQ ID NO: 634397 - RNA, 64 nt, hsa; identical to SEQ ID NO: 147935

SEQ ID NO: 634398 - RNA, 64 nt, hsa; identical to SEQ ID NO: 363385

SEQ ID NO: 634399 - RNA, 64 nt, hsa; identical to SEQ ID NO: 363386

SEQ ID NO: 634400 - RNA, 64 nt, hsa; identical to SEQ ID NO: 363387

SEQ ID NO: 634401 - RNA, 64 nt, hsa; identical to SEQ ID NO: 363388

SEQ ID NO: 634402 - RNA, 64 nt, hsa; identical to SEQ ID NO: 363389

SEQ ID NO: 634403 - RNA, 64 nt, hsa; identical to SEQ ID NO: 363390

SEQ ID NO: 634404 - RNA, 64 nt, hsa; identical to SEQ ID NO: 363391

SEQ ID NO: 634405 - RNA, 64 nt, hsa; identical to SEQ ID NO: 363392

SEQ ID NO: 634406 - RNA, 64 nt, hsa; identical to SEQ ID NO: 363393

SEQ ID NO: 634407 - RNA, 64 nt, hsa; identical to SEQ ID NO: 363394

SEQ ID NO: 634408 - RNA, 64 nt, hsa; identical to SEQ ID NO: 363395

SEQ ID NO: 634409 - RNA, 64 nt, hsa; identical to SEQ ID NO: 363396

SEQ ID NO: 634410 - RNA, 64 nt, hsa; identical to SEQ ID NO: 363397

SEQ ID NO: 634411 - RNA, 64 nt, hsa; identical to SEQ ID NO: 363398

SEQ ID NO: 634412 - RNA, 64 nt, hsa; identical to SEQ ID NO: 363399

SEQ ID NO: 634413 - RNA, 64 nt, hsa; identical to SEQ ID NO: 363400

SEQ ID NO: 634414 - RNA, 64 nt, hsa; identical to SEQ ID NO: 363401

SEQ ID NO: 634415 - RNA, 64 nt, hsa; identical to SEQ ID NO: 363402

SEQ ID NO: 634416 - RNA, 64 nt, hsa; identical to SEQ ID NO: 363403

SEQ ID NO: 634417 - RNA, 64 nt, hsa; identical to SEQ ID NO: 363404

SEQ ID NO: 634418 - RNA, 64 nt, hsa; identical to SEQ ID NO: 363405

SEQ ID NO: 634419 - RNA, 64 nt, hsa; identical to SEQ ID NO: 363406

SEQ ID NO: 634420 - RNA, 64 nt, hsa; identical to SEQ ID NO: 363407

SEQ ID NO: 634421 - RNA, 64 nt, hsa; identical to SEQ ID NO: 363408

SEQ ID NO: 634422 - RNA, 64 nt, hsa; identical to SEQ ID NO: 363409

SEQ ID NO: 634423 - RNA, 64 nt, hsa; identical to SEQ ID NO: 363410

SEQ ID NO: 634424 - RNA, 64 nt, hsa; identical to SEQ ID NO: 363411

SEQ ID NO: 634425 - RNA, 64 nt, hsa; identical to SEQ ID NO: 363412

SEQ ID NO: 634426 - RNA, 64 nt, hsa; identical to SEQ ID NO: 363413

SEQ ID NO: 634427 - RNA, 64 nt, hsa; identical to SEQ ID NO: 363414

SEQ ID NO: 634428 - RNA, 64 nt, hsa; identical to SEQ ID NO: 363415

SEQ ID NO: 634429 - RNA, 64 nt, hsa; identical to SEQ ID NO: 363416

SEQ ID NO: 634430 - RNA, 64 nt, hsa; identical to SEQ ID NO: 363417

SEQ ID NO: 634431 - RNA, 64 nt, hsa; identical to SEQ ID NO: 363418

SEQ ID NO: 634432 - RNA, 64 nt, hsa; identical to SEQ ID NO: 363419

SEQ ID NO: 634433 - RNA, 64 nt, hsa; identical to SEQ ID NO: 363420

SEQ ID NO: 634434 - RNA, 64 nt, hsa; identical to SEQ ID NO: 363421

SEQ ID NO: 634435 - RNA, 64 nt, hsa; identical to SEQ ID NO: 363422

SEQ ID NO: 634436 - RNA, 64 nt, hsa; identical to SEQ ID NO: 363423

SEQ ID NO: 634437 - RNA, 64 nt, hsa; identical to SEQ ID NO: 363424

SEQ ID NO: 634438 - RNA, 64 nt, hsa; identical to SEQ ID NO: 363425

SEQ ID NO: 634439 - RNA, 64 nt, hsa; identical to SEQ ID NO: 363426

SEQ ID NO: 634440 - RNA, 64 nt, hsa; identical to SEQ ID NO: 363427

SEQ ID NO: 634441 - RNA, 64 nt, hsa; identical to SEQ ID NO: 363428

SEQ ID NO: 634442 - RNA, 64 nt, hsa; identical to SEQ ID NO: 363429

SEQ ID NO: 634443 - RNA, 64 nt, hsa; identical to SEQ ID NO: 210956

SEQ ID NO: 634444 - RNA, 64 nt, hsa; identical to SEQ ID NO: 210957

SEQ ID NO: 634445 - RNA, 64 nt, hsa; identical to SEQ ID NO: 210958

SEQ ID NO: 634446 - RNA, 64 nt, hsa; identical to SEQ ID NO: 210959

SEQ ID NO: 634447 - RNA, 64 nt, hsa
uuacacuucucagagggcagaguggcagccgggcacccuacagaaacucagagggcagaguggc

SEQ ID NO: 634448 - RNA, 64 nt, hsa
uaguaucuggggcgaguguuggggguaaaagcccacccuacagaaaguggaacagcccggagcc

SEQ ID NO: 634449 - RNA, 64 nt, hsa
uaacuguagauaagaaaauucauacuggaaagaaacccuacaaaugugaagucuguggcaaagc

SEQ ID NO: 634450 - RNA, 64 nt, hsa
uuacuacauguaagaguauuuauacuggaaagaaacccuacaaauguaaaaaacguggcaaugc

SEQ ID NO: 634451 - RNA, 64 nt, hsa
ucacugaacauaaguuaauucauacuggagaaaaacccuacaaauguaaagaauguggaaaagc

SEQ ID NO: 634452 - RNA, 64 nt, hsa
uuauuacacauaagauaauucacaguggagaaaaacccuacaaaugugaagaauguggcaaagc

SEQ ID NO: 634453 - RNA, 64 nt, hsa
uuaugagacauaagaaaauucauaguaaagagaaacccuacaaaugugaacaguguggcaaggu

SEQ ID NO: 634454 - RNA, 64 nt, hsa
uuacuaaacacaagaagauucauacuagagagaaacccuacaaaugugaagaauguggcauauc

SEQ ID NO: 634455 - RNA, 64 nt, hsa
uugcuauacauaagaugauucacacuugaaugaaacccuacaaaugugaacgauguggcaguug

SEQ ID NO: 634456 - RNA, 64 nt, hsa
gcugcauugacucuauuaaucacauuucaaauucacccuacauuccucuccucuucacuagccu

SEQ ID NO: 634457 - RNA, 64 nt, hsa
cucccgggcacauccaggaaggaccuugcuuuggacccuacacacuucggcucucuggacacuu

SEQ ID NO: 634458 - RNA, 64 nt, hsa
uuaauacacauaagauaauuaaugcuggagagaaacccuacaaaugugaagaauguggcaaaga

SEQ ID NO: 634459 - RNA, 64 nt, hsa
ugccuacacguaagauaauucauacuggaaggaaacccuacaaauaugaggaaugucucaaagc

SEQ ID NO: 634460 - RNA, 64 nt, hsa
uuacuacacauuagauaauucaugcuggagagaaacccuacaaaugugaaaaauguggcaaagc

SEQ ID NO: 634461 - RNA, 64 nt, hsa
cuuuauugaacaaaauaauucauacaggagagaaacccuacaaaugugaagaaugugacaaagc

SEQ ID NO: 634462 - RNA, 59 nt, hsa
uuacuaaacauaauucauaauggagaaaaacccuacaaaugugaagaaugugucaaagc

SEQ ID NO: 634463 - RNA, 64 nt, hsa
ccuuacuaaacauaagggaauucauaauagagaaacccuacaaaugugaagaacguggccuggc

SEQ ID NO: 634464 - RNA, 64 nt, hsa
cucaaagacaugaaaggacucauacuggagagaaacccuacaaauguaaggaaugugggaaagc

SEQ ID NO: 634465 - RNA, 64 nt, hsa
cucaaagacaugaaaagacucauacuggagagaaacccuacaaaugcaaggaaugugggaaagc

SEQ ID NO: 634466 - RNA, 64 nt, hsa
cucaaaaacaugaaaaggcucauacuggagagaaacccuacaaauguaaggaaugugggaaacc

SEQ ID NO: 634467 - RNA, 64 nt, hsa
uuacugaacauaagggaauuuauacaggagggaaacccuacaaaugugaagaauguggcaagcc

SEQ ID NO: 634468 - RNA, 64 nt, hsa
uuguggaacauaagagaauucauacuggagagaaacccuacaaaugcgaagaaugugauaaaga

SEQ ID NO: 634469 - RNA, 64 nt, hsa; identical to SEQ ID NO: 175895

SEQ ID NO: 634470 - RNA, 64 nt, hsa; identical to SEQ ID NO: 175896

SEQ ID NO: 634471 - RNA, 64 nt, hsa; identical to SEQ ID NO: 175897

SEQ ID NO: 634472 - RNA, 64 nt, hsa; identical to SEQ ID NO: 175898

SEQ ID NO: 634473 - RNA, 64 nt, hsa; identical to SEQ ID NO: 175899

SEQ ID NO: 634474 - RNA, 64 nt, hsa; identical to SEQ ID NO: 175900

SEQ ID NO: 634475 - RNA, 64 nt, hsa; identical to SEQ ID NO: 175901

SEQ ID NO: 634476 - RNA, 64 nt, hsa; identical to SEQ ID NO: 175902

SEQ ID NO: 634477 - RNA, 64 nt, hsa; identical to SEQ ID NO: 175903

SEQ ID NO: 634478 - RNA, 64 nt, hsa; identical to SEQ ID NO: 175904

SEQ ID NO: 634479 - RNA, 64 nt, hsa; identical to SEQ ID NO: 175905

SEQ ID NO: 634480 - RNA, 64 nt, hsa; identical to SEQ ID NO: 175906

SEQ ID NO: 634481 - RNA, 64 nt, hsa; identical to SEQ ID NO: 175907

SEQ ID NO: 634482 - RNA, 64 nt, hsa; identical to SEQ ID NO: 175908

SEQ ID NO: 634483 - RNA, 64 nt, hsa; identical to SEQ ID NO: 175909

SEQ ID NO: 634484 - RNA, 64 nt, hsa; identical to SEQ ID NO: 175910

SEQ ID NO: 634485 - RNA, 64 nt, hsa; identical to SEQ ID NO: 175911

SEQ ID NO: 634486 - RNA, 64 nt, hsa; identical to SEQ ID NO: 175912

SEQ ID NO: 634487 - RNA, 64 nt, hsa; identical to SEQ ID NO: 175913

SEQ ID NO: 634488 - RNA, 64 nt, hsa; identical to SEQ ID NO: 175914

SEQ ID NO: 634489 - RNA, 64 nt, hsa; identical to SEQ ID NO: 175915

SEQ ID NO: 634490 - RNA, 64 nt, hsa; identical to SEQ ID NO: 175916

SEQ ID NO: 634491 - RNA, 64 nt, hsa; identical to SEQ ID NO: 175917

SEQ ID NO: 634492 - RNA, 64 nt, hsa; identical to SEQ ID NO: 175918

SEQ ID NO: 634493 - RNA, 64 nt, hsa; identical to SEQ ID NO: 175919

SEQ ID NO: 634494 - RNA, 64 nt, hsa; identical to SEQ ID NO: 175920

SEQ ID NO: 634495 - RNA, 64 nt, hsa; identical to SEQ ID NO: 175921

SEQ ID NO: 634496 - RNA, 64 nt, hsa; identical to SEQ ID NO: 175922

SEQ ID NO: 634497 - RNA, 64 nt, hsa; identical to SEQ ID NO: 175923

SEQ ID NO: 634498 - RNA, 64 nt, hsa; identical to SEQ ID NO: 175924

SEQ ID NO: 634499 - RNA, 64 nt, hsa; identical to SEQ ID NO: 175925

SEQ ID NO: 634500 - RNA, 64 nt, hsa; identical to SEQ ID NO: 175926

SEQ ID NO: 634501 - RNA, 64 nt, hsa; identical to SEQ ID NO: 175927

SEQ ID NO: 634502 - RNA, 64 nt, hsa; identical to SEQ ID NO: 175928

SEQ ID NO: 634503 - RNA, 64 nt, hsa; identical to SEQ ID NO: 175929

SEQ ID NO: 634504 - RNA, 64 nt, hsa; identical to SEQ ID NO: 175930

SEQ ID NO: 634505 - RNA, 64 nt, hsa; identical to SEQ ID NO: 175931

SEQ ID NO: 634506 - RNA, 64 nt, hsa; identical to SEQ ID NO: 175932

SEQ ID NO: 634507 - RNA, 64 nt, hsa; identical to SEQ ID NO: 175933

SEQ ID NO: 634508 - RNA, 64 nt, hsa; identical to SEQ ID NO: 175934

SEQ ID NO: 634509 - RNA, 64 nt, hsa; identical to SEQ ID NO: 175935

SEQ ID NO: 634510 - RNA, 64 nt, hsa; identical to SEQ ID NO: 175936

SEQ ID NO: 634511 - RNA, 64 nt, hsa; identical to SEQ ID NO: 175937

SEQ ID NO: 634512 - RNA, 64 nt, hsa; identical to SEQ ID NO: 175938

SEQ ID NO: 634513 - RNA, 64 nt, hsa; identical to SEQ ID NO: 175939

SEQ ID NO: 634514 - RNA, 64 nt, hsa; identical to SEQ ID NO: 175940

SEQ ID NO: 634515 - RNA, 64 nt, hsa; identical to SEQ ID NO: 175941

SEQ ID NO: 634516 - RNA, 64 nt, hsa; identical to SEQ ID NO: 175942

SEQ ID NO: 634517 - RNA, 64 nt, hsa; identical to SEQ ID NO: 175943

SEQ ID NO: 634518 - RNA, 64 nt, hsa; identical to SEQ ID NO: 175944

SEQ ID NO: 634519 - RNA, 64 nt, hsa; identical to SEQ ID NO: 175945

SEQ ID NO: 634520 - RNA, 64 nt, hsa; identical to SEQ ID NO: 175946

SEQ ID NO: 634521 - RNA, 64 nt, hsa; identical to SEQ ID NO: 175947

SEQ ID NO: 634522 - RNA, 64 nt, hsa; identical to SEQ ID NO: 175948

SEQ ID NO: 634523 - RNA, 64 nt, hsa; identical to SEQ ID NO: 175949

SEQ ID NO: 634524 - RNA, 64 nt, hsa; identical to SEQ ID NO: 175950

SEQ ID NO: 634525 - RNA, 64 nt, hsa; identical to SEQ ID NO: 175951

SEQ ID NO: 634526 - RNA, 64 nt, hsa; identical to SEQ ID NO: 175952

SEQ ID NO: 634527 - RNA, 64 nt, hsa; identical to SEQ ID NO: 175953

SEQ ID NO: 634528 - RNA, 62 nt, hsa; identical to SEQ ID NO: 175954

SEQ ID NO: 634529 - RNA, 64 nt, hsa; identical to SEQ ID NO: 175955

SEQ ID NO: 634530 - RNA, 64 nt, hsa; identical to SEQ ID NO: 175956

SEQ ID NO: 634531 - RNA, 64 nt, hsa; identical to SEQ ID NO: 175957

SEQ ID NO: 634532 - RNA, 64 nt, hsa; identical to SEQ ID NO: 175958

SEQ ID NO: 634533 - RNA, 64 nt, hsa; identical to SEQ ID NO: 175959

SEQ ID NO: 634534 - RNA, 64 nt, hsa; identical to SEQ ID NO: 175960

SEQ ID NO: 634535 - RNA, 64 nt, hsa; identical to SEQ ID NO: 175961

SEQ ID NO: 634536 - RNA, 64 nt, hsa; identical to SEQ ID NO: 175962

SEQ ID NO: 634537 - RNA, 64 nt, hsa; identical to SEQ ID NO: 175963

SEQ ID NO: 634538 - RNA, 64 nt, hsa; identical to SEQ ID NO: 175964

SEQ ID NO: 634539 - RNA, 64 nt, hsa; identical to SEQ ID NO: 175965

SEQ ID NO: 634540 - RNA, 64 nt, hsa; identical to SEQ ID NO: 175966

SEQ ID NO: 634541 - RNA, 64 nt, hsa; identical to SEQ ID NO: 175967

SEQ ID NO: 634542 - RNA, 64 nt, hsa; identical to SEQ ID NO: 175968

SEQ ID NO: 634543 - RNA, 64 nt, hsa; identical to SEQ ID NO: 175969

SEQ ID NO: 634544 - RNA, 64 nt, hsa; identical to SEQ ID NO: 175970

SEQ ID NO: 634545 - RNA, 64 nt, hsa; identical to SEQ ID NO: 175971

SEQ ID NO: 634546 - RNA, 64 nt, hsa; identical to SEQ ID NO: 175972

SEQ ID NO: 634547 - RNA, 64 nt, hsa; identical to SEQ ID NO: 175973

SEQ ID NO: 634548 - RNA, 64 nt, hsa; identical to SEQ ID NO: 175974

SEQ ID NO: 634549 - RNA, 64 nt, hsa; identical to SEQ ID NO: 175975

SEQ ID NO: 634550 - RNA, 64 nt, hsa; identical to SEQ ID NO: 175976

SEQ ID NO: 634551 - RNA, 64 nt, hsa; identical to SEQ ID NO: 175977

SEQ ID NO: 634552 - RNA, 64 nt, hsa; identical to SEQ ID NO: 175978

SEQ ID NO: 634553 - RNA, 64 nt, hsa; identical to SEQ ID NO: 175979

SEQ ID NO: 634554 - RNA, 64 nt, hsa; identical to SEQ ID NO: 175980

SEQ ID NO: 634555 - RNA, 64 nt, hsa; identical to SEQ ID NO: 175981

SEQ ID NO: 634556 - RNA, 64 nt, hsa; identical to SEQ ID NO: 175982

SEQ ID NO: 634557 - RNA, 64 nt, hsa; identical to SEQ ID NO: 175983

SEQ ID NO: 634558 - RNA, 64 nt, hsa; identical to SEQ ID NO: 175984

SEQ ID NO: 634559 - RNA, 64 nt, hsa; identical to SEQ ID NO: 175985

SEQ ID NO: 634560 - RNA, 64 nt, hsa; identical to SEQ ID NO: 175986

SEQ ID NO: 634561 - RNA, 64 nt, hsa; identical to SEQ ID NO: 175987

SEQ ID NO: 634562 - RNA, 64 nt, hsa; identical to SEQ ID NO: 175988

SEQ ID NO: 634563 - RNA, 64 nt, hsa; identical to SEQ ID NO: 175989

SEQ ID NO: 634564 - RNA, 64 nt, hsa; identical to SEQ ID NO: 175990

SEQ ID NO: 634565 - RNA, 64 nt, hsa; identical to SEQ ID NO: 175991

SEQ ID NO: 634566 - RNA, 64 nt, hsa; identical to SEQ ID NO: 175992

SEQ ID NO: 634567 - RNA, 64 nt, hsa; identical to SEQ ID NO: 175993

SEQ ID NO: 634568 - RNA, 64 nt, hsa; identical to SEQ ID NO: 175994

SEQ ID NO: 634569 - RNA, 64 nt, hsa; identical to SEQ ID NO: 175995

SEQ ID NO: 634570 - RNA, 64 nt, hsa; identical to SEQ ID NO: 175996

SEQ ID NO: 634571 - RNA, 64 nt, hsa; identical to SEQ ID NO: 175997

SEQ ID NO: 634572 - RNA, 62 nt, hsa; identical to SEQ ID NO: 175998

SEQ ID NO: 634573 - RNA, 64 nt, hsa; identical to SEQ ID NO: 175999

SEQ ID NO: 634574 - RNA, 64 nt, hsa; identical to SEQ ID NO: 176000

SEQ ID NO: 634575 - RNA, 64 nt, hsa; identical to SEQ ID NO: 176001

SEQ ID NO: 634576 - RNA, 64 nt, hsa; identical to SEQ ID NO: 176002

SEQ ID NO: 634577 - RNA, 64 nt, hsa; identical to SEQ ID NO: 176003

SEQ ID NO: 634578 - RNA, 64 nt, hsa; identical to SEQ ID NO: 176004

SEQ ID NO: 634579 - RNA, 64 nt, hsa; identical to SEQ ID NO: 176005

SEQ ID NO: 634580 - RNA, 64 nt, hsa; identical to SEQ ID NO: 176006

SEQ ID NO: 634581 - RNA, 64 nt, hsa; identical to SEQ ID NO: 176007

SEQ ID NO: 634582 - RNA, 64 nt, hsa; identical to SEQ ID NO: 176008

SEQ ID NO: 634583 - RNA, 64 nt, hsa; identical to SEQ ID NO: 176009

SEQ ID NO: 634584 - RNA, 64 nt, hsa; identical to SEQ ID NO: 176010

SEQ ID NO: 634585 - RNA, 64 nt, hsa; identical to SEQ ID NO: 176011

SEQ ID NO: 634586 - RNA, 64 nt, hsa; identical to SEQ ID NO: 176012

SEQ ID NO: 634587 - RNA, 64 nt, hsa; identical to SEQ ID NO: 176013

SEQ ID NO: 634588 - RNA, 64 nt, hsa; identical to SEQ ID NO: 176014

SEQ ID NO: 634589 - RNA, 64 nt, hsa; identical to SEQ ID NO: 176015

SEQ ID NO: 634590 - RNA, 64 nt, hsa; identical to SEQ ID NO: 176016

SEQ ID NO: 634591 - RNA, 64 nt, hsa; identical to SEQ ID NO: 176017

SEQ ID NO: 634592 - RNA, 64 nt, hsa; identical to SEQ ID NO: 176018

SEQ ID NO: 634593 - RNA, 64 nt, hsa; identical to SEQ ID NO: 176019

SEQ ID NO: 634594 - RNA, 64 nt, hsa; identical to SEQ ID NO: 176020

SEQ ID NO: 634595 - RNA, 64 nt, hsa; identical to SEQ ID NO: 176021

SEQ ID NO: 634596 - RNA, 64 nt, hsa; identical to SEQ ID NO: 176022

SEQ ID NO: 634597 - RNA, 64 nt, hsa; identical to SEQ ID NO: 176023

SEQ ID NO: 634598 - RNA, 64 nt, hsa; identical to SEQ ID NO: 176024

SEQ ID NO: 634599 - RNA, 64 nt, hsa; identical to SEQ ID NO: 176025

SEQ ID NO: 634600 - RNA, 64 nt, hsa; identical to SEQ ID NO: 176026

SEQ ID NO: 634601 - RNA, 64 nt, hsa; identical to SEQ ID NO: 176027

SEQ ID NO: 634602 - RNA, 64 nt, hsa; identical to SEQ ID NO: 176028

SEQ ID NO: 634603 - RNA, 64 nt, hsa; identical to SEQ ID NO: 176029

SEQ ID NO: 634604 - RNA, 59 nt, hsa; identical to SEQ ID NO: 176030

SEQ ID NO: 634605 - RNA, 56 nt, hsa; identical to SEQ ID NO: 176031

SEQ ID NO: 634606 - RNA, 64 nt, hsa; identical to SEQ ID NO: 176032

SEQ ID NO: 634607 - RNA, 64 nt, hsa; identical to SEQ ID NO: 176033

SEQ ID NO: 634608 - RNA, 64 nt, hsa; identical to SEQ ID NO: 176034

SEQ ID NO: 634609 - RNA, 64 nt, hsa; identical to SEQ ID NO: 176035

SEQ ID NO: 634610 - RNA, 64 nt, hsa; identical to SEQ ID NO: 176036

SEQ ID NO: 634611 - RNA, 64 nt, hsa; identical to SEQ ID NO: 176037

SEQ ID NO: 634612 - RNA, 64 nt, hsa; identical to SEQ ID NO: 176038

SEQ ID NO: 634613 - RNA, 64 nt, hsa; identical to SEQ ID NO: 176039

SEQ ID NO: 634614 - RNA, 64 nt, hsa; identical to SEQ ID NO: 176040

SEQ ID NO: 634615 - RNA, 64 nt, hsa; identical to SEQ ID NO: 176041

SEQ ID NO: 634616 - RNA, 64 nt, hsa; identical to SEQ ID NO: 176042

SEQ ID NO: 634617 - RNA, 64 nt, hsa; identical to SEQ ID NO: 176043

SEQ ID NO: 634618 - RNA, 64 nt, hsa; identical to SEQ ID NO: 176044

SEQ ID NO: 634619 - RNA, 64 nt, hsa; identical to SEQ ID NO: 176045

SEQ ID NO: 634620 - RNA, 64 nt, hsa; identical to SEQ ID NO: 176046

SEQ ID NO: 634621 - RNA, 64 nt, hsa; identical to SEQ ID NO: 176047

SEQ ID NO: 634622 - RNA, 64 nt, hsa; identical to SEQ ID NO: 176048

SEQ ID NO: 634623 - RNA, 64 nt, hsa; identical to SEQ ID NO: 176049

SEQ ID NO: 634624 - RNA, 64 nt, hsa; identical to SEQ ID NO: 176050

SEQ ID NO: 634625 - RNA, 64 nt, hsa; identical to SEQ ID NO: 176051

SEQ ID NO: 634626 - RNA, 64 nt, hsa; identical to SEQ ID NO: 176052

SEQ ID NO: 634627 - RNA, 64 nt, hsa; identical to SEQ ID NO: 176053

SEQ ID NO: 634628 - RNA, 64 nt, hsa; identical to SEQ ID NO: 176054

SEQ ID NO: 634629 - RNA, 64 nt, hsa; identical to SEQ ID NO: 176055

SEQ ID NO: 634630 - RNA, 64 nt, hsa; identical to SEQ ID NO: 176056

SEQ ID NO: 634631 - RNA, 64 nt, hsa; identical to SEQ ID NO: 176057

SEQ ID NO: 634632 - RNA, 64 nt, hsa; identical to SEQ ID NO: 176058

SEQ ID NO: 634633 - RNA, 64 nt, hsa; identical to SEQ ID NO: 176059

SEQ ID NO: 634634 - RNA, 64 nt, hsa; identical to SEQ ID NO: 176060

SEQ ID NO: 634635 - RNA, 64 nt, hsa; identical to SEQ ID NO: 176061

SEQ ID NO: 634636 - RNA, 64 nt, hsa; identical to SEQ ID NO: 176062

SEQ ID NO: 634637 - RNA, 64 nt, hsa; identical to SEQ ID NO: 176063

SEQ ID NO: 634638 - RNA, 64 nt, hsa; identical to SEQ ID NO: 176064

SEQ ID NO: 634639 - RNA, 64 nt, hsa; identical to SEQ ID NO: 176065

SEQ ID NO: 634640 - RNA, 64 nt, hsa; identical to SEQ ID NO: 176066

SEQ ID NO: 634641 - RNA, 64 nt, hsa; identical to SEQ ID NO: 176067

SEQ ID NO: 634642 - RNA, 64 nt, hsa; identical to SEQ ID NO: 176068

SEQ ID NO: 634643 - RNA, 64 nt, hsa; identical to SEQ ID NO: 176069

SEQ ID NO: 634644 - RNA, 64 nt, hsa; identical to SEQ ID NO: 176070

SEQ ID NO: 634645 - RNA, 64 nt, hsa; identical to SEQ ID NO: 176071

SEQ ID NO: 634646 - RNA, 64 nt, hsa; identical to SEQ ID NO: 176072

SEQ ID NO: 634647 - RNA, 64 nt, hsa; identical to SEQ ID NO: 176073

SEQ ID NO: 634648 - RNA, 64 nt, hsa; identical to SEQ ID NO: 176074

SEQ ID NO: 634649 - RNA, 64 nt, hsa; identical to SEQ ID NO: 176075

SEQ ID NO: 634650 - RNA, 64 nt, hsa
uauguaguuauucuaaaguuuaaggagcguuguugaccauaauauugcuuaguuuucuuacugc

SEQ ID NO: 634651 - RNA, 64 nt, hsa
uaugcuugaaguauuuggugaaaagauguugguugaccauaauuugcaacauugucucauuaaa

SEQ ID NO: 634652 - RNA, 64 nt, hsa
cuagacuauauccaaccccagucaggcugacacagaccauaagaauuguacagauaauccacag

SEQ ID NO: 634653 - RNA, 64 nt, hsa
ugccaaacaagauuuuguagaauauugcaaaaaugaccauaaauuccucgugauaaugugacuu

SEQ ID NO: 634654 - RNA, 64 nt, hsa
ggauaggcuuauauucaaaacaucuuagucauacgaccauaaauuaaaaguggagucacuaaau

SEQ ID NO: 634655 - RNA, 64 nt, hsa
uuaaagaaaaauuccuacagauuuucaaugcagagaccauaaucaaaaaguaaacuuucuuuag

SEQ ID NO: 634656 - RNA, 64 nt, hsa
acaucaguuaucuugaacauucugacguguaaaggaccauaagguacaucauuuaucuugaaca

SEQ ID NO: 634657 - RNA, 64 nt, hsa
uugacuccuggaaguauugagucuuccuuucaaggaccauaagguacaucaguuaucuugaaca

SEQ ID NO: 634658 - RNA, 64 nt, hsa; identical to SEQ ID NO: 76114

SEQ ID NO: 634659 - RNA, 64 nt, hsa; identical to SEQ ID NO: 76115

SEQ ID NO: 634660 - RNA, 64 nt, hsa; identical to SEQ ID NO: 76116

SEQ ID NO: 634661 - RNA, 64 nt, hsa; identical to SEQ ID NO: 76117

SEQ ID NO: 634662 - RNA, 64 nt, hsa; identical to SEQ ID NO: 76118

SEQ ID NO: 634663 - RNA, 64 nt, hsa; identical to SEQ ID NO: 76119

SEQ ID NO: 634664 - RNA, 64 nt, hsa; identical to SEQ ID NO: 76120

SEQ ID NO: 634665 - RNA, 64 nt, hsa; identical to SEQ ID NO: 76121

SEQ ID NO: 634666 - RNA, 64 nt, hsa; identical to SEQ ID NO: 76122

SEQ ID NO: 634667 - RNA, 64 nt, hsa; identical to SEQ ID NO: 76123

SEQ ID NO: 634668 - RNA, 64 nt, hsa; identical to SEQ ID NO: 76124

SEQ ID NO: 634669 - RNA, 64 nt, hsa; identical to SEQ ID NO: 76125

SEQ ID NO: 634670 - RNA, 64 nt, hsa; identical to SEQ ID NO: 76126

SEQ ID NO: 634671 - RNA, 64 nt, hsa; identical to SEQ ID NO: 76127

SEQ ID NO: 634672 - RNA, 64 nt, hsa; identical to SEQ ID NO: 76128

SEQ ID NO: 634673 - RNA, 64 nt, hsa; identical to SEQ ID NO: 76129

SEQ ID NO: 634674 - RNA, 64 nt, hsa; identical to SEQ ID NO: 76130

SEQ ID NO: 634675 - RNA, 64 nt, hsa; identical to SEQ ID NO: 76131

SEQ ID NO: 634676 - RNA, 64 nt, hsa; identical to SEQ ID NO: 76132

SEQ ID NO: 634677 - RNA, 64 nt, hsa; identical to SEQ ID NO: 76133

SEQ ID NO: 634678 - RNA, 64 nt, hsa; identical to SEQ ID NO: 76134

SEQ ID NO: 634679 - RNA, 64 nt, hsa; identical to SEQ ID NO: 76135

SEQ ID NO: 634680 - RNA, 64 nt, hsa; identical to SEQ ID NO: 76136

SEQ ID NO: 634681 - RNA, 64 nt, hsa; identical to SEQ ID NO: 76137

SEQ ID NO: 634682 - RNA, 64 nt, hsa; identical to SEQ ID NO: 76138

SEQ ID NO: 634683 - RNA, 64 nt, hsa; identical to SEQ ID NO: 76139

SEQ ID NO: 634684 - RNA, 64 nt, hsa; identical to SEQ ID NO: 76140

SEQ ID NO: 634685 - RNA, 64 nt, hsa; identical to SEQ ID NO: 76141

SEQ ID NO: 634686 - RNA, 64 nt, hsa; identical to SEQ ID NO: 76142

SEQ ID NO: 634687 - RNA, 64 nt, hsa; identical to SEQ ID NO: 76143

SEQ ID NO: 634688 - RNA, 64 nt, hsa; identical to SEQ ID NO: 76144

SEQ ID NO: 634689 - RNA, 64 nt, hsa; identical to SEQ ID NO: 76145

SEQ ID NO: 634690 - RNA, 64 nt, hsa; identical to SEQ ID NO: 76146

SEQ ID NO: 634691 - RNA, 64 nt, hsa; identical to SEQ ID NO: 76147

SEQ ID NO: 634692 - RNA, 64 nt, hsa; identical to SEQ ID NO: 76148

SEQ ID NO: 634693 - RNA, 64 nt, hsa; identical to SEQ ID NO: 76149

SEQ ID NO: 634694 - RNA, 64 nt, hsa; identical to SEQ ID NO: 76150

SEQ ID NO: 634695 - RNA, 64 nt, hsa; identical to SEQ ID NO: 76151

SEQ ID NO: 634696 - RNA, 64 nt, hsa; identical to SEQ ID NO: 76152

SEQ ID NO: 634697 - RNA, 64 nt, hsa; identical to SEQ ID NO: 76153

SEQ ID NO: 634698 - RNA, 64 nt, hsa; identical to SEQ ID NO: 76154

SEQ ID NO: 634699 - RNA, 64 nt, hsa; identical to SEQ ID NO: 103925

SEQ ID NO: 634700 - RNA, 64 nt, hsa; identical to SEQ ID NO: 103926

SEQ ID NO: 634701 - RNA, 64 nt, hsa; identical to SEQ ID NO: 103927

SEQ ID NO: 634702 - RNA, 64 nt, hsa; identical to SEQ ID NO: 103928

SEQ ID NO: 634703 - RNA, 64 nt, hsa; identical to SEQ ID NO: 103929

SEQ ID NO: 634704 - RNA, 64 nt, hsa; identical to SEQ ID NO: 103930

SEQ ID NO: 634705 - RNA, 64 nt, hsa; identical to SEQ ID NO: 103931

SEQ ID NO: 634706 - RNA, 64 nt, hsa; identical to SEQ ID NO: 103932

SEQ ID NO: 634707 - RNA, 64 nt, hsa; identical to SEQ ID NO: 103933

SEQ ID NO: 634708 - RNA, 64 nt, hsa; identical to SEQ ID NO: 103934

SEQ ID NO: 634709 - RNA, 64 nt, hsa; identical to SEQ ID NO: 103935

SEQ ID NO: 634710 - RNA, 64 nt, hsa; identical to SEQ ID NO: 103936

SEQ ID NO: 634711 - RNA, 64 nt, hsa; identical to SEQ ID NO: 103937

SEQ ID NO: 634712 - RNA, 64 nt, hsa; identical to SEQ ID NO: 103938

SEQ ID NO: 634713 - RNA, 64 nt, hsa; identical to SEQ ID NO: 103939

SEQ ID NO: 634714 - RNA, 64 nt, hsa; identical to SEQ ID NO: 125091

SEQ ID NO: 634715 - RNA, 64 nt, hsa; identical to SEQ ID NO: 125092

SEQ ID NO: 634716 - RNA, 64 nt, hsa; identical to SEQ ID NO: 125093

SEQ ID NO: 634717 - RNA, 64 nt, hsa; identical to SEQ ID NO: 125094

SEQ ID NO: 634718 - RNA, 64 nt, hsa; identical to SEQ ID NO: 125095

SEQ ID NO: 634719 - RNA, 64 nt, hsa; identical to SEQ ID NO: 125096

SEQ ID NO: 634720 - RNA, 64 nt, hsa; identical to SEQ ID NO: 125097

SEQ ID NO: 634721 - RNA, 64 nt, hsa; identical to SEQ ID NO: 125098

SEQ ID NO: 634722 - RNA, 64 nt, hsa; identical to SEQ ID NO: 125099

SEQ ID NO: 634723 - RNA, 64 nt, hsa; identical to SEQ ID NO: 125100

SEQ ID NO: 634724 - RNA, 64 nt, hsa; identical to SEQ ID NO: 125101

SEQ ID NO: 634725 - RNA, 64 nt, hsa; identical to SEQ ID NO: 125102

SEQ ID NO: 634726 - RNA, 64 nt, hsa; identical to SEQ ID NO: 125103

SEQ ID NO: 634727 - RNA, 64 nt, hsa; identical to SEQ ID NO: 125104

SEQ ID NO: 634728 - RNA, 64 nt, hsa; identical to SEQ ID NO: 125105

SEQ ID NO: 634729 - RNA, 64 nt, hsa; identical to SEQ ID NO: 125106

SEQ ID NO: 634730 - RNA, 64 nt, hsa; identical to SEQ ID NO: 125107

SEQ ID NO: 634731 - RNA, 64 nt, hsa; identical to SEQ ID NO: 125108

SEQ ID NO: 634732 - RNA, 64 nt, hsa; identical to SEQ ID NO: 125109

SEQ ID NO: 634733 - RNA, 64 nt, hsa; identical to SEQ ID NO: 125110

SEQ ID NO: 634734 - RNA, 64 nt, hsa; identical to SEQ ID NO: 125111

SEQ ID NO: 634735 - RNA, 64 nt, hsa; identical to SEQ ID NO: 125112

SEQ ID NO: 634736 - RNA, 64 nt, hsa; identical to SEQ ID NO: 125113

SEQ ID NO: 634737 - RNA, 64 nt, hsa; identical to SEQ ID NO: 125114

SEQ ID NO: 634738 - RNA, 64 nt, hsa; identical to SEQ ID NO: 125115

SEQ ID NO: 634739 - RNA, 64 nt, hsa; identical to SEQ ID NO: 125116

SEQ ID NO: 634740 - RNA, 64 nt, hsa; identical to SEQ ID NO: 125117

SEQ ID NO: 634741 - RNA, 64 nt, hsa; identical to SEQ ID NO: 125118

SEQ ID NO: 634742 - RNA, 64 nt, hsa; identical to SEQ ID NO: 125119

SEQ ID NO: 634743 - RNA, 64 nt, hsa; identical to SEQ ID NO: 125120

SEQ ID NO: 634744 - RNA, 64 nt, hsa; identical to SEQ ID NO: 125121

SEQ ID NO: 634745 - RNA, 64 nt, hsa; identical to SEQ ID NO: 125122

SEQ ID NO: 634746 - RNA, 64 nt, hsa; identical to SEQ ID NO: 125123

SEQ ID NO: 634747 - RNA, 64 nt, hsa; identical to SEQ ID NO: 125124

SEQ ID NO: 634748 - RNA, 64 nt, hsa; identical to SEQ ID NO: 125125

SEQ ID NO: 634749 - RNA, 64 nt, hsa; identical to SEQ ID NO: 125126

SEQ ID NO: 634750 - RNA, 64 nt, hsa; identical to SEQ ID NO: 125127

SEQ ID NO: 634751 - RNA, 64 nt, hsa; identical to SEQ ID NO: 125128

SEQ ID NO: 634752 - RNA, 64 nt, hsa; identical to SEQ ID NO: 125129

SEQ ID NO: 634753 - RNA, 64 nt, hsa; identical to SEQ ID NO: 125130

SEQ ID NO: 634754 - RNA, 64 nt, hsa; identical to SEQ ID NO: 125131

SEQ ID NO: 634755 - RNA, 64 nt, hsa; identical to SEQ ID NO: 125132

SEQ ID NO: 634756 - RNA, 64 nt, hsa; identical to SEQ ID NO: 125133

SEQ ID NO: 634757 - RNA, 64 nt, hsa; identical to SEQ ID NO: 125134

SEQ ID NO: 634758 - RNA, 64 nt, hsa; identical to SEQ ID NO: 125135

SEQ ID NO: 634759 - RNA, 64 nt, hsa; identical to SEQ ID NO: 125136

SEQ ID NO: 634760 - RNA, 64 nt, hsa; identical to SEQ ID NO: 125137

SEQ ID NO: 634761 - RNA, 64 nt, hsa; identical to SEQ ID NO: 125138

SEQ ID NO: 634762 - RNA, 64 nt, hsa; identical to SEQ ID NO: 125139

SEQ ID NO: 634763 - RNA, 64 nt, hsa; identical to SEQ ID NO: 125140

SEQ ID NO: 634764 - RNA, 64 nt, hsa; identical to SEQ ID NO: 125141

SEQ ID NO: 634765 - RNA, 64 nt, hsa; identical to SEQ ID NO: 125142

SEQ ID NO: 634766 - RNA, 64 nt, hsa; identical to SEQ ID NO: 125143

SEQ ID NO: 634767 - RNA, 64 nt, hsa; identical to SEQ ID NO: 125144

SEQ ID NO: 634768 - RNA, 64 nt, hsa; identical to SEQ ID NO: 125145

SEQ ID NO: 634769 - RNA, 64 nt, hsa; identical to SEQ ID NO: 125146

SEQ ID NO: 634770 - RNA, 64 nt, hsa; identical to SEQ ID NO: 125147

SEQ ID NO: 634771 - RNA, 64 nt, hsa; identical to SEQ ID NO: 125148

SEQ ID NO: 634772 - RNA, 64 nt, hsa; identical to SEQ ID NO: 125149

SEQ ID NO: 634773 - RNA, 64 nt, hsa; identical to SEQ ID NO: 125150

SEQ ID NO: 634774 - RNA, 64 nt, hsa; identical to SEQ ID NO: 125151

SEQ ID NO: 634775 - RNA, 64 nt, hsa; identical to SEQ ID NO: 125152

SEQ ID NO: 634776 - RNA, 64 nt, hsa; identical to SEQ ID NO: 125153

SEQ ID NO: 634777 - RNA, 64 nt, hsa; identical to SEQ ID NO: 125154

SEQ ID NO: 634778 - RNA, 64 nt, hsa; identical to SEQ ID NO: 125155

SEQ ID NO: 634779 - RNA, 64 nt, hsa; identical to SEQ ID NO: 125156

SEQ ID NO: 634780 - RNA, 64 nt, hsa; identical to SEQ ID NO: 125157

SEQ ID NO: 634781 - RNA, 64 nt, hsa; identical to SEQ ID NO: 125158

SEQ ID NO: 634782 - RNA, 64 nt, hsa; identical to SEQ ID NO: 125159

SEQ ID NO: 634783 - RNA, 64 nt, hsa; identical to SEQ ID NO: 125160

SEQ ID NO: 634784 - RNA, 64 nt, hsa; identical to SEQ ID NO: 125161

SEQ ID NO: 634785 - RNA, 64 nt, hsa; identical to SEQ ID NO: 125162

SEQ ID NO: 634786 - RNA, 64 nt, hsa; identical to SEQ ID NO: 125163

SEQ ID NO: 634787 - RNA, 64 nt, hsa; identical to SEQ ID NO: 125164

SEQ ID NO: 634788 - RNA, 64 nt, hsa; identical to SEQ ID NO: 125165

SEQ ID NO: 634789 - RNA, 64 nt, hsa; identical to SEQ ID NO: 125166

SEQ ID NO: 634790 - RNA, 64 nt, hsa; identical to SEQ ID NO: 125167

SEQ ID NO: 634791 - RNA, 64 nt, hsa; identical to SEQ ID NO: 125168

SEQ ID NO: 634792 - RNA, 64 nt, hsa; identical to SEQ ID NO: 125169

SEQ ID NO: 634793 - RNA, 64 nt, hsa; identical to SEQ ID NO: 125170

SEQ ID NO: 634794 - RNA, 64 nt, hsa; identical to SEQ ID NO: 125171

SEQ ID NO: 634795 - RNA, 64 nt, hsa; identical to SEQ ID NO: 125172

SEQ ID NO: 634796 - RNA, 64 nt, hsa; identical to SEQ ID NO: 125173

SEQ ID NO: 634797 - RNA, 64 nt, hsa; identical to SEQ ID NO: 125174

SEQ ID NO: 634798 - RNA, 64 nt, hsa; identical to SEQ ID NO: 125175

SEQ ID NO: 634799 - RNA, 64 nt, hsa; identical to SEQ ID NO: 125176

SEQ ID NO: 634800 - RNA, 64 nt, hsa; identical to SEQ ID NO: 125177

SEQ ID NO: 634801 - RNA, 64 nt, hsa; identical to SEQ ID NO: 125178

SEQ ID NO: 634802 - RNA, 64 nt, hsa; identical to SEQ ID NO: 125179

SEQ ID NO: 634803 - RNA, 64 nt, hsa; identical to SEQ ID NO: 125180

SEQ ID NO: 634804 - RNA, 64 nt, hsa; identical to SEQ ID NO: 125181

SEQ ID NO: 634805 - RNA, 64 nt, hsa; identical to SEQ ID NO: 125182

SEQ ID NO: 634806 - RNA, 64 nt, hsa; identical to SEQ ID NO: 125183

SEQ ID NO: 634807 - RNA, 64 nt, hsa; identical to SEQ ID NO: 125184

SEQ ID NO: 634808 - RNA, 64 nt, hsa; identical to SEQ ID NO: 125185

SEQ ID NO: 634809 - RNA, 64 nt, hsa; identical to SEQ ID NO: 125186

SEQ ID NO: 634810 - RNA, 64 nt, hsa; identical to SEQ ID NO: 125187

SEQ ID NO: 634811 - RNA, 64 nt, hsa; identical to SEQ ID NO: 125188

SEQ ID NO: 634812 - RNA, 64 nt, hsa; identical to SEQ ID NO: 125189

SEQ ID NO: 634813 - RNA, 58 nt, hsa; identical to SEQ ID NO: 125190

SEQ ID NO: 634814 - RNA, 64 nt, hsa; identical to SEQ ID NO: 125191

SEQ ID NO: 634815 - RNA, 64 nt, hsa; identical to SEQ ID NO: 125192

SEQ ID NO: 634816 - RNA, 64 nt, hsa; identical to SEQ ID NO: 125193

SEQ ID NO: 634817 - RNA, 64 nt, hsa; identical to SEQ ID NO: 125194

SEQ ID NO: 634818 - RNA, 64 nt, hsa; identical to SEQ ID NO: 125195

SEQ ID NO: 634819 - RNA, 64 nt, hsa; identical to SEQ ID NO: 125196

SEQ ID NO: 634820 - RNA, 64 nt, hsa; identical to SEQ ID NO: 125197

SEQ ID NO: 634821 - RNA, 64 nt, hsa; identical to SEQ ID NO: 125198

SEQ ID NO: 634822 - RNA, 64 nt, hsa; identical to SEQ ID NO: 125199

SEQ ID NO: 634823 - RNA, 64 nt, hsa; identical to SEQ ID NO: 125200

SEQ ID NO: 634824 - RNA, 64 nt, hsa; identical to SEQ ID NO: 125201

SEQ ID NO: 634825 - RNA, 64 nt, hsa; identical to SEQ ID NO: 125202

SEQ ID NO: 634826 - RNA, 64 nt, hsa; identical to SEQ ID NO: 125203

SEQ ID NO: 634827 - RNA, 64 nt, hsa; identical to SEQ ID NO: 125204

SEQ ID NO: 634828 - RNA, 64 nt, hsa; identical to SEQ ID NO: 125205

SEQ ID NO: 634829 - RNA, 64 nt, hsa; identical to SEQ ID NO: 125206

SEQ ID NO: 634830 - RNA, 64 nt, hsa; identical to SEQ ID NO: 125207

SEQ ID NO: 634831 - RNA, 64 nt, hsa; identical to SEQ ID NO: 125208

SEQ ID NO: 634832 - RNA, 64 nt, hsa; identical to SEQ ID NO: 125209

SEQ ID NO: 634833 - RNA, 64 nt, hsa; identical to SEQ ID NO: 125210

SEQ ID NO: 634834 - RNA, 64 nt, hsa; identical to SEQ ID NO: 125211

SEQ ID NO: 634835 - RNA, 64 nt, hsa; identical to SEQ ID NO: 125212

SEQ ID NO: 634836 - RNA, 64 nt, hsa; identical to SEQ ID NO: 125213

SEQ ID NO: 634837 - RNA, 64 nt, hsa; identical to SEQ ID NO: 125214

SEQ ID NO: 634838 - RNA, 64 nt, hsa; identical to SEQ ID NO: 125215

SEQ ID NO: 634839 - RNA, 64 nt, hsa; identical to SEQ ID NO: 125216

SEQ ID NO: 634840 - RNA, 64 nt, hsa; identical to SEQ ID NO: 125217

SEQ ID NO: 634841 - RNA, 64 nt, hsa; identical to SEQ ID NO: 125218

SEQ ID NO: 634842 - RNA, 64 nt, hsa; identical to SEQ ID NO: 125219

SEQ ID NO: 634843 - RNA, 64 nt, hsa; identical to SEQ ID NO: 125220

SEQ ID NO: 634844 - RNA, 64 nt, hsa; identical to SEQ ID NO: 125221

SEQ ID NO: 634845 - RNA, 64 nt, hsa; identical to SEQ ID NO: 125222

SEQ ID NO: 634846 - RNA, 64 nt, hsa; identical to SEQ ID NO: 125223

SEQ ID NO: 634847 - RNA, 64 nt, hsa; identical to SEQ ID NO: 125224

SEQ ID NO: 634848 - RNA, 64 nt, hsa; identical to SEQ ID NO: 125225

SEQ ID NO: 634849 - RNA, 64 nt, hsa; identical to SEQ ID NO: 125226

SEQ ID NO: 634850 - RNA, 64 nt, hsa; identical to SEQ ID NO: 125227

SEQ ID NO: 634851 - RNA, 64 nt, hsa; identical to SEQ ID NO: 125228

SEQ ID NO: 634852 - RNA, 64 nt, hsa; identical to SEQ ID NO: 125229

SEQ ID NO: 634853 - RNA, 64 nt, hsa; identical to SEQ ID NO: 125230

SEQ ID NO: 634854 - RNA, 64 nt, hsa; identical to SEQ ID NO: 125231

SEQ ID NO: 634855 - RNA, 64 nt, hsa; identical to SEQ ID NO: 125232

SEQ ID NO: 634856 - RNA, 64 nt, hsa; identical to SEQ ID NO: 125233

SEQ ID NO: 634857 - RNA, 64 nt, hsa; identical to SEQ ID NO: 125234

SEQ ID NO: 634858 - RNA, 64 nt, hsa; identical to SEQ ID NO: 125235

SEQ ID NO: 634859 - RNA, 64 nt, hsa; identical to SEQ ID NO: 125236

SEQ ID NO: 634860 - RNA, 64 nt, hsa; identical to SEQ ID NO: 125237

SEQ ID NO: 634861 - RNA, 64 nt, hsa; identical to SEQ ID NO: 125238

SEQ ID NO: 634862 - RNA, 64 nt, hsa; identical to SEQ ID NO: 125239

SEQ ID NO: 634863 - RNA, 64 nt, hsa; identical to SEQ ID NO: 125240

SEQ ID NO: 634864 - RNA, 64 nt, hsa; identical to SEQ ID NO: 125241

SEQ ID NO: 634865 - RNA, 64 nt, hsa; identical to SEQ ID NO: 125242

SEQ ID NO: 634866 - RNA, 64 nt, hsa; identical to SEQ ID NO: 125243

SEQ ID NO: 634867 - RNA, 64 nt, hsa; identical to SEQ ID NO: 125244

SEQ ID NO: 634868 - RNA, 64 nt, hsa; identical to SEQ ID NO: 125245

SEQ ID NO: 634869 - RNA, 64 nt, hsa; identical to SEQ ID NO: 125246

SEQ ID NO: 634870 - RNA, 64 nt, hsa; identical to SEQ ID NO: 125247

SEQ ID NO: 634871 - RNA, 64 nt, hsa; identical to SEQ ID NO: 125248

SEQ ID NO: 634872 - RNA, 64 nt, hsa; identical to SEQ ID NO: 125249

SEQ ID NO: 634873 - RNA, 64 nt, hsa; identical to SEQ ID NO: 125250

SEQ ID NO: 634874 - RNA, 64 nt, hsa; identical to SEQ ID NO: 125251

SEQ ID NO: 634875 - RNA, 64 nt, hsa; identical to SEQ ID NO: 125252

SEQ ID NO: 634876 - RNA, 64 nt, hsa; identical to SEQ ID NO: 125253

SEQ ID NO: 634877 - RNA, 64 nt, hsa; identical to SEQ ID NO: 125254

SEQ ID NO: 634878 - RNA, 64 nt, hsa; identical to SEQ ID NO: 125255

SEQ ID NO: 634879 - RNA, 64 nt, hsa; identical to SEQ ID NO: 125256

SEQ ID NO: 634880 - RNA, 64 nt, hsa; identical to SEQ ID NO: 125257

SEQ ID NO: 634881 - RNA, 64 nt, hsa; identical to SEQ ID NO: 125258

SEQ ID NO: 634882 - RNA, 64 nt, hsa; identical to SEQ ID NO: 125259

SEQ ID NO: 634883 - RNA, 64 nt, hsa; identical to SEQ ID NO: 125260

SEQ ID NO: 634884 - RNA, 64 nt, hsa; identical to SEQ ID NO: 125261

SEQ ID NO: 634885 - RNA, 64 nt, hsa; identical to SEQ ID NO: 125262

SEQ ID NO: 634886 - RNA, 64 nt, hsa; identical to SEQ ID NO: 125263

SEQ ID NO: 634887 - RNA, 64 nt, hsa; identical to SEQ ID NO: 125264

SEQ ID NO: 634888 - RNA, 64 nt, hsa; identical to SEQ ID NO: 125265

SEQ ID NO: 634889 - RNA, 64 nt, hsa; identical to SEQ ID NO: 125266

SEQ ID NO: 634890 - RNA, 64 nt, hsa; identical to SEQ ID NO: 125267

SEQ ID NO: 634891 - RNA, 64 nt, hsa; identical to SEQ ID NO: 125268

SEQ ID NO: 634892 - RNA, 64 nt, hsa; identical to SEQ ID NO: 125269

SEQ ID NO: 634893 - RNA, 64 nt, hsa; identical to SEQ ID NO: 125270

SEQ ID NO: 634894 - RNA, 64 nt, hsa; identical to SEQ ID NO: 125271

SEQ ID NO: 634895 - RNA, 64 nt, hsa; identical to SEQ ID NO: 125272

SEQ ID NO: 634896 - RNA, 64 nt, hsa; identical to SEQ ID NO: 125273

SEQ ID NO: 634897 - RNA, 64 nt, hsa; identical to SEQ ID NO: 125274

SEQ ID NO: 634898 - RNA, 64 nt, hsa; identical to SEQ ID NO: 125275

SEQ ID NO: 634899 - RNA, 64 nt, hsa; identical to SEQ ID NO: 125276

SEQ ID NO: 634900 - RNA, 64 nt, hsa; identical to SEQ ID NO: 125277

SEQ ID NO: 634901 - RNA, 64 nt, hsa; identical to SEQ ID NO: 125278

SEQ ID NO: 634902 - RNA, 64 nt, hsa; identical to SEQ ID NO: 125279

SEQ ID NO: 634903 - RNA, 63 nt, hsa; identical to SEQ ID NO: 125280

SEQ ID NO: 634904 - RNA, 64 nt, hsa; identical to SEQ ID NO: 125281

SEQ ID NO: 634905 - RNA, 64 nt, hsa; identical to SEQ ID NO: 125282

SEQ ID NO: 634906 - RNA, 64 nt, hsa; identical to SEQ ID NO: 125283

SEQ ID NO: 634907 - RNA, 64 nt, hsa; identical to SEQ ID NO: 125284

SEQ ID NO: 634908 - RNA, 64 nt, hsa; identical to SEQ ID NO: 125285

SEQ ID NO: 634909 - RNA, 64 nt, hsa; identical to SEQ ID NO: 125286

SEQ ID NO: 634910 - RNA, 64 nt, hsa; identical to SEQ ID NO: 125287

SEQ ID NO: 634911 - RNA, 64 nt, hsa; identical to SEQ ID NO: 125288

SEQ ID NO: 634912 - RNA, 64 nt, hsa; identical to SEQ ID NO: 125289

SEQ ID NO: 634913 - RNA, 64 nt, hsa; identical to SEQ ID NO: 125290

SEQ ID NO: 634914 - RNA, 64 nt, hsa; identical to SEQ ID NO: 125291

SEQ ID NO: 634915 - RNA, 64 nt, hsa; identical to SEQ ID NO: 125292

SEQ ID NO: 634916 - RNA, 64 nt, hsa; identical to SEQ ID NO: 125293

SEQ ID NO: 634917 - RNA, 64 nt, hsa; identical to SEQ ID NO: 125294

SEQ ID NO: 634918 - RNA, 64 nt, hsa; identical to SEQ ID NO: 125295

SEQ ID NO: 634919 - RNA, 64 nt, hsa; identical to SEQ ID NO: 125296

SEQ ID NO: 634920 - RNA, 64 nt, hsa; identical to SEQ ID NO: 125297

SEQ ID NO: 634921 - RNA, 64 nt, hsa; identical to SEQ ID NO: 74579

SEQ ID NO: 634922 - RNA, 64 nt, hsa; identical to SEQ ID NO: 74580

SEQ ID NO: 634923 - RNA, 64 nt, hsa; identical to SEQ ID NO: 110383

SEQ ID NO: 634924 - RNA, 64 nt, hsa; identical to SEQ ID NO: 110384

SEQ ID NO: 634925 - RNA, 64 nt, hsa; identical to SEQ ID NO: 110385

SEQ ID NO: 634926 - RNA, 64 nt, hsa; identical to SEQ ID NO: 110386

SEQ ID NO: 634927 - RNA, 64 nt, hsa; identical to SEQ ID NO: 110387

SEQ ID NO: 634928 - RNA, 64 nt, hsa; identical to SEQ ID NO: 110388

SEQ ID NO: 634929 - RNA, 64 nt, hsa
guaagcucauaaaaauaauugaugauaacacuuaccaaaagaucacugcaaaccugccucaaga

SEQ ID NO: 634930 - RNA, 64 nt, hsa
gacgauacaaaagccagcaauaauucuucaagauccaaaagaaaaaaauauacuaccucagauu

SEQ ID NO: 634931 - RNA, 64 nt, hsa
uuaaaagcuguucuguucucacuucugacuuuaaccaaaagauuucaacccacaaugaucaggu

SEQ ID NO: 634932 - RNA, 64 nt, hsa
gucaaucaaaaucccuaagagcagaacuccuaccccaaaagaagccuggaagucuaauuaagag

SEQ ID NO: 634933 - RNA, 64 nt, hsa
caacugcuauuauaauucucaaaguccuacucugccaaaagaagauuaaaagucauacauuaca

SEQ ID NO: 634934 - RNA, 64 nt, hsa
ucugcauuugugagugguucagucaugagguuuuccaaaagauguuuuuagaguuguaaaaacc

SEQ ID NO: 634935 - RNA, 64 nt, hsa
guauuuuuuuaugagcaauaucaauuuggagugaccaaaagauacuuaaaaauggguuuauuuu

SEQ ID NO: 634936 - RNA, 64 nt, hsa
caggggauauuuuuugagaugauuuaaauguaaaccaaaagauggaagacaaaaagacaaacac

SEQ ID NO: 634937 - RNA, 64 nt, hsa
acaugaaguaugguguaauaggaauaauauuuauccaaaagauuuuuaaaaauagggcuguguu

SEQ ID NO: 634938 - RNA, 64 nt, hsa
ggaaguaaaucuauaucuguuagaaauaauguagccaaaagaauguaaauuugaggauuuuuuu

SEQ ID NO: 634939 - RNA, 64 nt, hsa
agaaaauguaaaaugcucaugaagguuuugaaugccaaaagauauuuuagaaucaauuuauaaa

SEQ ID NO: 634940 - RNA, 64 nt, hsa
caguacugaauuaugccuuggcagaggggagacuccaaaagagucaucgcaggaagaaguuaag

SEQ ID NO: 634941 - RNA, 64 nt, hsa
ugcagcucuguggcuuggaauuucauuugagcaauuucuauaggauauguauuuauuauugauu

SEQ ID NO: 634942 - RNA, 64 nt, hsa
uaauguaaauugugauuuuuguuuuacauguggguuucuauaguuuuaauuuuuucagcuuuua

SEQ ID NO: 634943 - RNA, 64 nt, hsa
ugacuaauguuugaaauuauuuuuucuaagaguuuuucuauaaccuuccaaaagucgugauguu

SEQ ID NO: 634944 - RNA, 64 nt, hsa
uuugggguuuuuaaauaagcauuaacuaacaaccuuucuauaguuaaugcagaguuaaugaaca

SEQ ID NO: 634945 - RNA, 64 nt, hsa
aauguaguuauaaugcuuuugaaaaauuuuccuuuuucuauauccccuuaguccagccucucuu

SEQ ID NO: 634946 - RNA, 64 nt, hsa
gugugacuugaagauuaccaaugauuuugaggcuuuucuauaauaaaaagagguucuaaccauu

SEQ ID NO: 634947 - RNA, 64 nt, hsa
ucuugcagagaacaagucugcccagauuccaugcuuucuauaacuggaggaccuggcaaaccug

SEQ ID NO: 634948 - RNA, 64 nt, hsa
aagcuguaaauugcaugugcauauuugucuauuuuuucuauaaguuuuauugcaagagguaaag

SEQ ID NO: 634949 - RNA, 64 nt, hsa
cuauuguaacacauaaagacagcaagaauucuuauuucuauaauaaauuaacaagauucaccua

SEQ ID NO: 634950 - RNA, 64 nt, hsa
aacucaaauuccuguuuccaacuucaaauaguuuuuucuauaaacacaaaaucaguguuuauuc

SEQ ID NO: 634951 - RNA, 64 nt, hsa
ccuuucuccugguuucaugacaguguuauuccuuuuucuauaaauauauuuuuaggaaaaaaag

SEQ ID NO: 634952 - RNA, 64 nt, hsa
ugaaauguucuauacacuaucaaauauauaaagcuuucuauauugaauguacauuauacagauc

SEQ ID NO: 634953 - RNA, 64 nt, hsa
uggcccgguaccaccuuuuuuuuuuuuuuuuuuuuuucuauacaaauuuguuacaugucaguga

SEQ ID NO: 634954 - RNA, 64 nt, hsa
uaaaauauuuuuguauuuuguaauaucaaaggaauuucuauaucguaggacucaguggggacuu

SEQ ID NO: 634955 - RNA, 64 nt, hsa
uaugcaaaagguuuauuccggaaacuaguguacauuucuauaaauagaugcuguguauauggua

SEQ ID NO: 634956 - RNA, 64 nt, hsa
uuuauuuccuuuguccuuuuucaggagaauuagauuucuauaggauuuuucuuuaggagauuua

SEQ ID NO: 634957 - RNA, 64 nt, hsa
ugauguaugccauuaaaaaaauuguuuuuuuaauuuucuauauuauaaacauaaaauaaguaau

SEQ ID NO: 634958 - RNA, 64 nt, hsa
uauuaaaugcugaggccaauaccaagaaguuuauuuucuauauuauacaauuaugaauuacaug

SEQ ID NO: 634959 - RNA, 64 nt, hsa
uuucaaauauguacucuugaagucaagcaauaaauuucuauacauaaaauaggauccugauuua

SEQ ID NO: 634960 - RNA, 64 nt, hsa
agucuuuuaucauauuuauacugcuguccaaucuuuucuauauuuagaaauaauaauguacaua

SEQ ID NO: 634961 - RNA, 64 nt, hsa
ugaccaauaaguugauauuuguccauaggucuccuuucuauaaaucaucuugauguuuaacaac

SEQ ID NO: 634962 - RNA, 64 nt, hsa
cucaguauccuaaaacuuagaaccuuauugauauuuucuauacaguaguuuugugauuagaauu

SEQ ID NO: 634963 - RNA, 64 nt, hsa
auguaaaugauauauuuuuggugaaaugcaaccuuuucuauaaaaugugggcaacauuuuaaag

SEQ ID NO: 634964 - RNA, 64 nt, hsa
acuuccccgguaugaugauuguugguaacaacuuuuucuauagucauugauggaguagaucaug

SEQ ID NO: 634965 - RNA, 64 nt, hsa
aauguuuuuaaacaaaguuuucuccugcagugcuuuucuauaugaaauaguugagucaagcuug

SEQ ID NO: 634966 - RNA, 64 nt, hsa
cugaauuacccgguagacugaauaucugacgggauuucuauauggacauagcacagaugaacca

SEQ ID NO: 634967 - RNA, 64 nt, hsa
uaaaguauucuucguuucuuuagucaaaucuccuuuucuauaaaauggagacggcuuucauaug

SEQ ID NO: 634968 - RNA, 64 nt, hsa
cacaguauaauuacauaagaauuuguuauauauguuucuauagaauaauaacauacccacacaa

SEQ ID NO: 634969 - RNA, 64 nt, hsa
aagaagaaugaaacgccuguauauccugguuaaguuucuauaaaauaagaacauacacgauuca

SEQ ID NO: 634970 - RNA, 64 nt, hsa
uuuguuuuugaguuuucuauaggaaauaaauagcuuucuauauaugaguugcuggggaccuuca

SEQ ID NO: 634971 - RNA, 64 nt, hsa
cuuuauuuuucuuucuuuuucuuuguuuuugaguuuucuauaggaaauaaauagcuuucuauau

SEQ ID NO: 634972 - RNA, 64 nt, hsa
uugaaauaauuaaguggugguguucuuuaaggaauuucuauaaccaaauugaucuuauuuuuga

SEQ ID NO: 634973 - RNA, 64 nt, hsa
uaauaccugagagucuuaaaauuugugaacaacguuucuauaguccuuuauuuucaaaugcaca

SEQ ID NO: 634974 - RNA, 64 nt, hsa
uuaacuuaauauuuaauuauuugauuuauuuaauuuucuauauucuuacaauguauguaugaug

SEQ ID NO: 634975 - RNA, 64 nt, hsa
ucccgguaaaaaugaauugaaccauuucaacuauuuucuauauuuggagaaaguuugugcccug

SEQ ID NO: 634976 - RNA, 64 nt, hsa
uaaagucugugagaauaucaaccauagauaguucuuucuauauuauguuuucgcuuuuguauuu

SEQ ID NO: 634977 - RNA, 64 nt, hsa
augaaaagaugguaauaugucauuucuauaaauguuucuauauaugaaacauaaaguggcaggg

SEQ ID NO: 634978 - RNA, 64 nt, hsa
ccugcuuagcuuaugaaaagaugguaauaugucauuucuauaaauguuucuauauaugaaacau

SEQ ID NO: 634979 - RNA, 64 nt, hsa
uucucucaaaugaaaauuuaauuuuagggauucauuucuauauuuucacauauguaguauuauu

SEQ ID NO: 634980 - RNA, 64 nt, hsa
caaaauguguugaagugcccuaugaaguagcaauuuucuauaggaauauaguuggaaauaaaug

SEQ ID NO: 634981 - RNA, 64 nt, hsa
agcugggacuacaggcaugugccaccacaccuaauuucuauauuuuuuguagagacuagguuuc

SEQ ID NO: 634982 - RNA, 64 nt, hsa
ucuaugcugagcuuacauagaauuucuuccauguuuucuauagcuauaguguauuuuuaccuuu

SEQ ID NO: 634983 - RNA, 64 nt, hsa
ugguucacaucauaaagaacuugauuugaaauguuuucuauagaaacaagugcuaaguguaccg

SEQ ID NO: 634984 - RNA, 64 nt, hsa
gugcuaccagccacggaaggagccucucuuguuuuuucuauaaaauggguaggcaggagaaaag

SEQ ID NO: 634985 - RNA, 64 nt, hsa
uuuaaaaacuucgugcauuuguuacagcucauguuuucuauaugaacuuagucauuaauguucu

SEQ ID NO: 634986 - RNA, 64 nt, hsa
ccacuacauuuuggugcuauuuaaggugugcaauuuucuauaggugacuuuugcaauucaggga

SEQ ID NO: 634987 - RNA, 64 nt, hsa
ggcaacuuaaauaacuccugagcaguuggcacuagaacagaauacuuggaaugacaccaaaguu

SEQ ID NO: 634988 - RNA, 64 nt, hsa
gcaaagaucaugauuaacugucaagacacugguagaacagaacaagcaaaagauuaagaguuca

SEQ ID NO: 634989 - RNA, 64 nt, hsa
ggcuuucaaugaguuccuauguggauuuuuaaaagaacagaacaguaaugaaauauuugaagua

SEQ ID NO: 634990 - RNA, 64 nt, hsa
aaaagcuauaugcagaguuuuguauaaaacaauagaacagaaauuugggacauuuuucuaggaa

SEQ ID NO: 634991 - RNA, 64 nt, hsa
ccugaagacaaugauuauuucuggaggagcaagggaacagaaacuacauuguaaccuguuuguc

SEQ ID NO: 634992 - RNA, 64 nt, hsa
agggaaguuuuuaaaaaugucauuacuuucaaaggaacagaaguaguuaaccaaacuaacaagc

SEQ ID NO: 634993 - RNA, 64 nt, hsa
ucuuuuaagaaucaaaauauggauuugauacuaggaacagaaucugcucuuuauuucauuccuu

SEQ ID NO: 634994 - RNA, 64 nt, hsa
acgugacuacaauggauaaauaauuuguuugcuggaacagaagccgucuuugaauucuccaaca

SEQ ID NO: 634995 - RNA, 64 nt, hsa
aaaacaggauucuugcuucuguagucaucaaggugaacagaagcauccuacacaaccacuaagg

SEQ ID NO: 634996 - RNA, 64 nt, hsa
gagauauuccaaaguuuuauuuuacuuuuuuaaagaacagaaaaagaugaaugaaagaaccaag

SEQ ID NO: 634997 - RNA, 64 nt, hsa
uuguauccaucaaguauuacaggagaaggauugggaacagaauggaaaaacaguguaugaaagu

SEQ ID NO: 634998 - RNA, 64 nt, hsa
cgauggaguagccagugguaauacaaagcagggagaacagaaagguagaguuacuaaggccuuc

SEQ ID NO: 634999 - RNA, 64 nt, hsa
agaacagaaagguagaguuacuaaggccuucagugaacagaaaggagcagagagcaagauuaga

SEQ ID NO: 635000 - RNA, 64 nt, hsa
caugucuagcuuucaccuccaggaucuauugagugaacagaauugcaaauagucucuauuugua

SEQ ID NO: 635001 - RNA, 64 nt, hsa
gguaugaagccagaccuccccggcgggccucagggaacagaaugaucagaccuuugaaugauuc

SEQ ID NO: 635002 - RNA, 64 nt, hsa
aagugggggauggcuaagaaagcugggagauagggaacagaagaggguagugggugggcuaggg

SEQ ID NO: 635003 - RNA, 64 nt, hsa
ggcagaaggaaggagggaagaaaagaaagcaaaggaacagaaggaaggaaagaaagaugggagg

SEQ ID NO: 635004 - RNA, 64 nt, hsa; identical to SEQ ID NO: 169330

SEQ ID NO: 635005 - RNA, 64 nt, hsa; identical to SEQ ID NO: 169331

SEQ ID NO: 635006 - RNA, 64 nt, hsa; identical to SEQ ID NO: 169332

SEQ ID NO: 635007 - RNA, 64 nt, hsa; identical to SEQ ID NO: 169333

SEQ ID NO: 635008 - RNA, 64 nt, hsa; identical to SEQ ID NO: 169334

SEQ ID NO: 635009 - RNA, 64 nt, hsa; identical to SEQ ID NO: 169335

SEQ ID NO: 635010 - RNA, 64 nt, hsa; identical to SEQ ID NO: 169336

SEQ ID NO: 635011 - RNA, 64 nt, hsa; identical to SEQ ID NO: 169337

SEQ ID NO: 635012 - RNA, 64 nt, hsa; identical to SEQ ID NO: 169338

SEQ ID NO: 635013 - RNA, 64 nt, hsa; identical to SEQ ID NO: 169339

SEQ ID NO: 635014 - RNA, 64 nt, hsa; identical to SEQ ID NO: 169340

SEQ ID NO: 635015 - RNA, 64 nt, hsa; identical to SEQ ID NO: 169341

SEQ ID NO: 635016 - RNA, 64 nt, hsa; identical to SEQ ID NO: 169342

SEQ ID NO: 635017 - RNA, 64 nt, hsa; identical to SEQ ID NO: 169343

SEQ ID NO: 635018 - RNA, 64 nt, hsa; identical to SEQ ID NO: 169344

SEQ ID NO: 635019 - RNA, 64 nt, hsa; identical to SEQ ID NO: 169345

SEQ ID NO: 635020 - RNA, 64 nt, hsa; identical to SEQ ID NO: 169346

SEQ ID NO: 635021 - RNA, 64 nt, hsa; identical to SEQ ID NO: 169347

SEQ ID NO: 635022 - RNA, 64 nt, hsa; identical to SEQ ID NO: 169348

SEQ ID NO: 635023 - RNA, 64 nt, hsa; identical to SEQ ID NO: 169349

SEQ ID NO: 635024 - RNA, 64 nt, hsa; identical to SEQ ID NO: 169350

SEQ ID NO: 635025 - RNA, 64 nt, hsa; identical to SEQ ID NO: 169351

SEQ ID NO: 635026 - RNA, 64 nt, hsa; identical to SEQ ID NO: 169352

SEQ ID NO: 635027 - RNA, 64 nt, hsa; identical to SEQ ID NO: 169353

SEQ ID NO: 635028 - RNA, 64 nt, hsa; identical to SEQ ID NO: 169354

SEQ ID NO: 635029 - RNA, 64 nt, hsa; identical to SEQ ID NO: 169355

SEQ ID NO: 635030 - RNA, 64 nt, hsa; identical to SEQ ID NO: 169356

SEQ ID NO: 635031 - RNA, 64 nt, hsa; identical to SEQ ID NO: 169357

SEQ ID NO: 635032 - RNA, 64 nt, hsa; identical to SEQ ID NO: 169358

SEQ ID NO: 635033 - RNA, 64 nt, hsa; identical to SEQ ID NO: 169359

SEQ ID NO: 635034 - RNA, 64 nt, hsa; identical to SEQ ID NO: 169360

SEQ ID NO: 635035 - RNA, 64 nt, hsa; identical to SEQ ID NO: 169361

SEQ ID NO: 635036 - RNA, 64 nt, hsa; identical to SEQ ID NO: 169362

SEQ ID NO: 635037 - RNA, 64 nt, hsa; identical to SEQ ID NO: 169363

SEQ ID NO: 635038 - RNA, 64 nt, hsa; identical to SEQ ID NO: 169364

SEQ ID NO: 635039 - RNA, 64 nt, hsa; identical to SEQ ID NO: 169365

SEQ ID NO: 635040 - RNA, 64 nt, hsa; identical to SEQ ID NO: 169366

SEQ ID NO: 635041 - RNA, 64 nt, hsa; identical to SEQ ID NO: 169367

SEQ ID NO: 635042 - RNA, 64 nt, hsa; identical to SEQ ID NO: 169368

SEQ ID NO: 635043 - RNA, 64 nt, hsa; identical to SEQ ID NO: 169369

SEQ ID NO: 635044 - RNA, 64 nt, hsa; identical to SEQ ID NO: 169370

SEQ ID NO: 635045 - RNA, 64 nt, hsa; identical to SEQ ID NO: 169371

SEQ ID NO: 635046 - RNA, 64 nt, hsa; identical to SEQ ID NO: 169372

SEQ ID NO: 635047 - RNA, 64 nt, hsa; identical to SEQ ID NO: 169373

SEQ ID NO: 635048 - RNA, 64 nt, hsa; identical to SEQ ID NO: 169374

SEQ ID NO: 635049 - RNA, 64 nt, hsa; identical to SEQ ID NO: 169375

SEQ ID NO: 635050 - RNA, 64 nt, hsa; identical to SEQ ID NO: 169376

SEQ ID NO: 635051 - RNA, 64 nt, hsa
uuagacuggaaguucauaccuaaguacuguaauaauaccucaauguuugaggagcauguuuugu

SEQ ID NO: 635052 - RNA, 64 nt, hsa
auauauuuagugcugcaucuuauagcacuuugaaauaccucauguuuaugaaaauaaauagcuu

SEQ ID NO: 635053 - RNA, 64 nt, hsa
uuuuuuugcucuccauuuugacuugcaagaaauaauaccucaagauaaucugauuuauuagcua

SEQ ID NO: 635054 - RNA, 64 nt, hsa
cacacuuuuuuugacugaugacaucuccuuugcuauaccucaauuuuuggaauuuagagaagaa

SEQ ID NO: 635055 - RNA, 64 nt, hsa
agccugcauugauaacagccuuaacccucgaggaauaccucaauaccucagacaaggcccuucc

SEQ ID NO: 635056 - RNA, 64 nt, hsa
uugauaacagccuuaacccucgaggaauaccucaauaccucagacaaggcccuuccaauauguu

SEQ ID NO: 635057 - RNA, 64 nt, hsa
auuuugacguuaaaaaacaacaacagaucuagagauaccucaaggauaucauuuuugauuuugu

SEQ ID NO: 635058 - RNA, 64 nt, hsa
cacacuuuucacugacgggauaucucuuuaugcaauaccucaauuuuucauauugcaaagagua

SEQ ID NO: 635059 - RNA, 64 nt, hsa
aaggcaugcuuucugacugacaugaucuuuugcaauaccucaauuuugaaauauaggaaagaaa

SEQ ID NO: 635060 - RNA, 64 nt, hsa
agccuuuaguugcucucuauuuugacuuguaaggauaccucauaagcuggaucuuuuauuuuuc

SEQ ID NO: 635061 - RNA, 64 nt, hsa
guguucucauggcacacuucauggcagcacagauauaccucauuuuaaccaauagauauucucu

SEQ ID NO: 635062 - RNA, 64 nt, hsa
uuguacuuacacugugggcauguggucaagaugcauaccucaugaauucaacuauuuuuucaua

SEQ ID NO: 635063 - RNA, 64 nt, hsa
agucuguuuugcucuaauccuccauuaagcgagcauaccucaagugggucuauuagcauuuaau

SEQ ID NO: 635064 - RNA, 64 nt, hsa
caaauccuaaguguauaauuaugugcaauguucaauaccucauauaauacuugcucaacaguau

SEQ ID NO: 635065 - RNA, 64 nt, hsa
cagcacaccucaccacaccacaccgcacugcaccauaccucaccacaucucaccacaccacagc

SEQ ID NO: 635066 - RNA, 64 nt, hsa
uugccuuuguuguuguauuacaaaucugcauaaaauaccucauuucaaaucaaaucuuacaaau

SEQ ID NO: 635067 - RNA, 64 nt, hsa
cauccccacacgugccgaugucagguucauugaaauaccucagauuuguaauuguugauguuug

SEQ ID NO: 635068 - RNA, 64 nt, hsa
gaggaaagggaaucaaaagcuugagcacaaacagauaccucagcccgguaagcugcagcucugc

SEQ ID NO: 635069 - RNA, 64 nt, hsa
gugauagcacauggguagccuaggcagugaguaaauaccucagauguccuccugcagcaagugu

SEQ ID NO: 635070 - RNA, 64 nt, hsa
uugacuugucuaaaaggacaaagagaaaaaaaaaauaccucaugacugcauucucucugacuag

SEQ ID NO: 635071 - RNA, 64 nt, hsa
aggggacgugagaaaggaaaaggcaugaaguucuauaccucagccagcagcugccuucguuugg

SEQ ID NO: 635072 - RNA, 62 nt, hsa
cuucauugaaaguagugcuguaaauauucugccauaggaauacugucuacaugcuuucucau

SEQ ID NO: 635073 - RNA, 62 nt, hsa
ggccucacccaggcaucugcuuuacucuggaccauaggaaacaagaccguuuggagguuuca

SEQ ID NO: 635074 - RNA, 62 nt, hsa
ccuucaagugggcugaagcccuuggaaagugacauaggaaguccccagaucuugcccuucuc

SEQ ID NO: 635075 - RNA, 62 nt, hsa
aauuguauuuagaucuuguuauugcuccaguacauaggaauuguguaaaguguuaacagcag

SEQ ID NO: 635076 - RNA, 62 nt, hsa
accauagauuucuuucagaaaaaaaaaacaggcauaggaacaguuuucucuucauauauuau

SEQ ID NO: 635077 - RNA, 62 nt, hsa
auaucuuuaaaauuuuccuuuauguuccauuccauaggaaaacacacauaugcacacaaaac

SEQ ID NO: 635078 - RNA, 62 nt, hsa
ggugguuauuugguauuaaacuccaaaugagccauaggaaggcacuacaugaaauaaugcac

SEQ ID NO: 635079 - RNA, 62 nt, hsa
uuguaauuuugaugauacaaagauugaaagaucauaggaaagcauugcccuucaucacagaa

SEQ ID NO: 635080 - RNA, 62 nt, hsa
gaagcagacacaacccaaacauuugcuacuaacauaggaaacacacacauacagacaccccc

SEQ ID NO: 635081 - RNA, 62 nt, hsa
ugagaguuggugcaaauucuuguguguguuugcauaggaaggugagaugaccaucuacuaaa

SEQ ID NO: 635082 - RNA, 62 nt, hsa
ccccccggaaaugaacaaagccgggcccuuuccauaggaacugcccuuggagauagcagagu

SEQ ID NO: 635083 - RNA, 62 nt, hsa
cucaccaucaugauaccagauacaggugaauacauaggaacuaucugccuguguccucaauc

SEQ ID NO: 635084 - RNA, 62 nt, hsa
gauuuuuauuuguuacagguuuccaauggccccauaggaauaagcaauaauguagacugaua

SEQ ID NO: 635085 - RNA, 62 nt, hsa
cuuuugugaaggccgaacucgagcuguauccucauaggaaacagugaucaccccggacgggc

SEQ ID NO: 635086 - RNA, 62 nt, hsa
cuccagagcccacgaggcuugcagaucgggggcauaggaauuuggaauccaagagcuauaau

SEQ ID NO: 635087 - RNA, 62 nt, hsa
ccacgucuuccagcugggggaugggggggagucauaggaaaagcccccaucucccaucuggg

SEQ ID NO: 635088 - RNA, 62 nt, hsa
ucugagauguggugacucaugugaaguggugucauaggaaugaaggacugugggcgcugggu

SEQ ID NO: 635089 - RNA, 62 nt, hsa
ggguucuccucaaagccucacaaccauaggaucauaggaaaggggcccuauuuuccugcugc

SEQ ID NO: 635090 - RNA, 62 nt, hsa
acagucgaggaaaauugauaccugcaguaacccauaggaaauaaacuguagaguuccauauu

SEQ ID NO: 635091 - RNA, 62 nt, hsa
ucuuauacagagaucuagaaucuuauauuuuccauaggaagguaaagaaaucauuagcaaga

SEQ ID NO: 635092 - RNA, 62 nt, hsa
uugaugcucauaucuguucuucagcagccugucauaggaacuggauccuaccuauguuaauu

SEQ ID NO: 635093 - RNA, 62 nt, hsa
gagccuucuugcuuucauuuuccuugaauguacauaggaacaagggggaaagucucuuacug

SEQ ID NO: 635094 - RNA, 62 nt, hsa
ggggcaacuuugugaacacguaggcacuuagucauaggaaacauauuaugugcagguccuag

SEQ ID NO: 635095 - RNA, 62 nt, hsa
cauucacuauuguauagaagaugcuguuaaaacauaggaaggguauuuuucuugauccaaag

SEQ ID NO: 635096 - RNA, 62 nt, hsa
agccguguuuacuuguauuaacuuacaguuaacauaggaaaaauacaaguaaggaugugaga

SEQ ID NO: 635097 - RNA, 62 nt, hsa
acacauuuuguaaauaacuuuuuguuaaaauucauaggaaauguuauuuuguggggggggga

SEQ ID NO: 635098 - RNA, 62 nt, hsa
cggccaccaggacaugcuucaaugccuggugccauaggaagcccaggggacagucacaacuu

SEQ ID NO: 635099 - RNA, 62 nt, hsa
aucauuguuuaauaaaaguaaucccugcuggucauaggaaaacacacgguucuaauuaagug

SEQ ID NO: 635100 - RNA, 62 nt, hsa
cauauuacucauaaaucauuaauuaauauaagcauaggaaauggucuuaaaagauacugcau

SEQ ID NO: 635101 - RNA, 62 nt, hsa
cuugacacaacuuugaaacugcauaaaguagacauaggaacuagaggaaagcucaggcugca

SEQ ID NO: 635102 - RNA, 57 nt, hsa
cuggggaaagugaagcaugaagggaaucauaggaaaaauguacugaucauauaauua

SEQ ID NO: 635103 - RNA, 62 nt, hsa
cauuuccugcuuuuguguaaggaaggugcucacauaggaaguuuuuauuugguuagagacag

SEQ ID NO: 635104 - RNA, 62 nt, hsa
ggucaagaacaaauggccccuaugcacagagccauaggaacugggggccuucccuggacagu

SEQ ID NO: 635105 - RNA, 62 nt, hsa
guacuaagcacagaaacucacuauauaagucacauaggaaacuugaaaggucugaggaugau

SEQ ID NO: 635106 - RNA, 62 nt, hsa
ugcauauaggguauggaauugcacauccaucucauaggaauuguaaaugguuugaauaagag

SEQ ID NO: 635107 - RNA, 62 nt, hsa
cucaggcacuucaaaacuaaaaccaaauuuagcauaggaaaaaguuguuuaaugcucagggc

SEQ ID NO: 635108 - RNA, 62 nt, hsa
caguguccggagcggcucuagacaacuuuggucauaggaacucuggagguggguucugguca

SEQ ID NO: 635109 - RNA, 62 nt, hsa
aaacaugggcugaaaaugaaggccccauagugcauaggaacaguaaagccagggugcugacg

SEQ ID NO: 635110 - RNA, 62 nt, hsa
cagggucugugauuuuacauguauguaaaacacauaggaagcugacuuaggaaaaagagaaa

SEQ ID NO: 635111 - RNA, 62 nt, hsa
cuguauguauaacccguaaauauccauuuugacauaggaagaacuuugguuaagaguaaguu

SEQ ID NO: 635112 - RNA, 62 nt, hsa
auuggaauuagaccauuuggccuuugaacuuucauaggaaaaaugacccaacauuucuuagc

SEQ ID NO: 635113 - RNA, 62 nt, hsa
auaggagucuucugccucuuaacuuaaaagaacauaggaauuuuguuuuugguuucuuuauc

SEQ ID NO: 635114 - RNA, 62 nt, hsa
cuuugguuugaggagguagagauauguguauccauaggaagagaucugucagaacaggcagc

SEQ ID NO: 635115 - RNA, 62 nt, hsa
agccauaccugguaagcaaaaacuaguaaagacauaggaacauguaguuuuacuugguguuu

SEQ ID NO: 635116 - RNA, 62 nt, hsa
cucuguucuccaagaggacccggaaguaaucacauaggaaaugauaaggaagaccaggagga

SEQ ID NO: 635117 - RNA, 62 nt, hsa
gacuacccagccagugaagugcagaggauagacauaggaaaacauuccaggcauuuggagac

SEQ ID NO: 635118 - RNA, 62 nt, hsa
uacauucuacagggagaaagagauagccaauacauaggaauaaauauauacaagguaucaug

SEQ ID NO: 635119 - RNA, 62 nt, hsa
cagaggagauauuaucuguccucuguguggcacauaggaaaaugugagaccuagaauuauag

SEQ ID NO: 635120 - RNA, 62 nt, hsa
cauacaauccaaaauuuaaaaaaauauuuuugcauaggaaaaauugagaaggaaguaaacca

SEQ ID NO: 635121 - RNA, 62 nt, hsa
uaaacaauaaagcaauaagaacaaauacaauacauaggaaguuaaaagcacaaaggaaugaa

SEQ ID NO: 635122 - RNA, 62 nt, hsa
ugauagcaguccugccaccuucuaguucaucccauaggaauguuuuuccaaguccuuccagu

SEQ ID NO: 635123 - RNA, 62 nt, hsa
acuuauauacauauuuuuuaaaaguagcuuuacauaggaaggaaguggcauaguuuuaucaa

SEQ ID NO: 635124 - RNA, 62 nt, hsa
gccaucuucccaaaguuauccaggcaaugaaucauaggaacaaugccauuccuaagagugcc

SEQ ID NO: 635125 - RNA, 62 nt, hsa
auguagucacaaccuguuuuguuuuuguaaaacauaggaagucucuuuaaugcaaugauuug

SEQ ID NO: 635126 - RNA, 62 nt, hsa
guuaauaacucucagcaggcaaagaccgauugcauaggaauugcacaauccaugaacagcau

SEQ ID NO: 635127 - RNA, 62 nt, hsa
cuggaagaggucuggguggggaggccaguucccauaggaaggagucugccucuucugucccc

SEQ ID NO: 635128 - RNA, 62 nt, hsa
gugaugguaugcugaaguucagccguugaacacauaggaaugucuguggggugacucuacug

SEQ ID NO: 635129 - RNA, 62 nt, hsa
aagcaggcugcucccagagguggggaacccuucauaggaaauccccacccccguccacccca

SEQ ID NO: 635130 - RNA, 62 nt, hsa
cacuagaaguggcugggcaggggggccagagucauaggaagggucuuggagucaucagaucu

SEQ ID NO: 635131 - RNA, 62 nt, hsa
augucauguauaaaauaugaauaaaauguccacauaggaaauuaacacauauauaccuucuc

SEQ ID NO: 635132 - RNA, 62 nt, hsa
uaugcugcuguuuacaaaagcccaauguaaugcauaggaaguauggcaugaacaucuuuagg

SEQ ID NO: 635133 - RNA, 62 nt, hsa
cacugauggcccugaagaagcggauccagucacauaggaaaggaggcuguguuagugaaagc

SEQ ID NO: 635134 - RNA, 62 nt, hsa
ucucuuuugguggggugggggugggcuaaagccauaggaagaaaaaugugauguaugugucc

SEQ ID NO: 635135 - RNA, 62 nt, hsa
uaucuuaauugcuacugguuggcauuguaacucauaggaauuccagaaaauuauuaauccgu

SEQ ID NO: 635136 - RNA, 62 nt, hsa
guugguguuuuauuguacauacuucagaugcacauaggaauagaaguguguuauaaaucuag

SEQ ID NO: 635137 - RNA, 62 nt, hsa
auuucauuaugauugaaaaacauaaaaacuaacauaggaaagugaaugaucaguuacuuaug

SEQ ID NO: 635138 - RNA, 62 nt, hsa
agucuaucugcaauuacucaacgaggcauuuucauaggaaacagacuaugauuaauccauuu

SEQ ID NO: 635139 - RNA, 62 nt, hsa
ccacucaguuuugcuuuugcgaggcgauuugacauaggaacuuugagacuccaugagaaagu

SEQ ID NO: 635140 - RNA, 62 nt, hsa
aauaacauuugcuguuuuauagguuugaagaacauaggaaaaacuaagagguuuuguuuuua

SEQ ID NO: 635141 - RNA, 62 nt, hsa
cugacugauuuuguuacgggguugauucugaccauaggaaguaugcaaugugaaucacuauu

SEQ ID NO: 635142 - RNA, 62 nt, hsa
uugagaagaaagggucucuugaccuguauuaacauaggaaaguaaaguucuuuuuguuuuuc

SEQ ID NO: 635143 - RNA, 62 nt, hsa
uagaauuugaucagaaucacagaaucaucagacauaggaacugagcacaggcuuuuucaggu

SEQ ID NO: 635144 - RNA, 62 nt, hsa
uauuuaaauagaagauuuuuguagguguaccacauaggaagagcaaaugaaauaaacucuuu

SEQ ID NO: 635145 - RNA, 62 nt, hsa
cuaaccuuaauuauucuguaagaacaugcuuccauaggaaauaguggauaauuuucagcuau

SEQ ID NO: 635146 - RNA, 62 nt, hsa
gacuaaucaaaggcaaacaaaggcuauuaacacauaggaaaaaauguauuuacuaaguguca

SEQ ID NO: 635147 - RNA, 62 nt, hsa
aauauauacuuuauuaaaucauccaaccaaagcauaggaaacauugacccagaaccugacuu

SEQ ID NO: 635148 - RNA, 62 nt, hsa
uuuuuaaaacaucaaaauuuaugauuuacauucauaggaauaaaauaaaauauuauuagaac

SEQ ID NO: 635149 - RNA, 62 nt, hsa
ucguguuugacuuguccauucgggguucuucucauaggaaugcuagaggaaagagaacacug

SEQ ID NO: 635150 - RNA, 62 nt, hsa
cuguguuaauaaaugacagaaccugaagaagucauaggaaagaaacuugagcgguauacuca

SEQ ID NO: 635151 - RNA, 62 nt, hsa
cagaaggaagcuuggcugagcuggccuuuuaacauaggaauguauuucguuggaaacauucu

SEQ ID NO: 635152 - RNA, 62 nt, hsa
cauuucauuuguauuuuuguccagaaauuucccauaggaagacuucaccuccuacaacuccg

SEQ ID NO: 635153 - RNA, 62 nt, hsa
aacucauuuuaguugauuuucaguacuauuuacauaggaauugauuuuuauggauauaguag

SEQ ID NO: 635154 - RNA, 62 nt, hsa
aaauggaaaauaagagaucaaaaugaauauagcauaggaauaaagauuucacuagaaauugc

SEQ ID NO: 635155 - RNA, 62 nt, hsa
aagacuuucuuuuucaucuuuuauagcguuaccauaggaaacuguuccaaacugaguuagcu

SEQ ID NO: 635156 - RNA, 62 nt, hsa
augucaauauauauuuaaaauaauaauggaaacauaggaaaucagcuauuuaaaccagauca

SEQ ID NO: 635157 - RNA, 62 nt, hsa
uuccucaccaggagcccggcuuccacuccccacauaggaauaguccauccccagauucgcca

SEQ ID NO: 635158 - RNA, 62 nt, hsa
cuccugcaaauuuaguuuguuaaagccuguuccauaggaaggcugugauaaccaguaaggaa

SEQ ID NO: 635159 - RNA, 62 nt, hsa
gaugggauugggucacuuuugaauguggcuuucauaggaaagcagcuuaaacauaaauauca

SEQ ID NO: 635160 - RNA, 62 nt, hsa
accauagaaagaugacaaaagaaaauuuuccacauaggaaaaugccaugaaaauugcuuuug

SEQ ID NO: 635161 - RNA, 62 nt, hsa
ggguuaccuguaucugaaggacgguucuggggcauaggaaacacauacacuuccauaaauag

SEQ ID NO: 635162 - RNA, 62 nt, hsa
agaaaucacucacuuugauuauguauagauuacauaggaagaacaaucacaucaguaaguua

SEQ ID NO: 635163 - RNA, 62 nt, hsa
ccaguguucuccaccuuguccuccacagaucucauaggaaauguucaacaauucugugaaag

SEQ ID NO: 635164 - RNA, 62 nt, hsa
uguucaguuuuauggaggaaaaauaaaucuaccauaggaauguuaguuaauauugauauauc

SEQ ID NO: 635165 - RNA, 62 nt, hsa
aaauaacccugagguuuuguacuuacuuuccccauaggaagacagaccauaggcaaacucug

SEQ ID NO: 635166 - RNA, 62 nt, hsa
ugguucuaaaaauugcauucaaacauaauuuacauaggaaauguacugugggaacuauucua

SEQ ID NO: 635167 - RNA, 62 nt, hsa
aagaaccuaggagggaaaggaagauugagcaacauaggaaaaggggaagagaggcugagugu

SEQ ID NO: 635168 - RNA, 62 nt, hsa
auggccguucuuuuccacccuguuucuucccccauaggaagaacccaccuguagcccugagg

SEQ ID NO: 635169 - RNA, 62 nt, hsa
ggaguuaauaaagaaguucauuuugguuuaaacauaggaaagaagagaaccaugaaaauggg

SEQ ID NO: 635170 - RNA, 62 nt, hsa
ccuccagauuuggguggagccucugugggaaccauaggaagugugugggcugccuuccuggg

SEQ ID NO: 635171 - RNA, 62 nt, hsa
aaacgaucauagucuuaggaguucauuuaaaccauaggaacuuuucacuuaucucauguuag

SEQ ID NO: 635172 - RNA, 62 nt, hsa
aaguggccaccuuuugauugauugggcuuccucauaggaagcacugagggugugucuuugua

SEQ ID NO: 635173 - RNA, 62 nt, hsa
caugaaggucagcaccaucccuggccuccucacauaggaaucuagcagaaaugauagacaca

SEQ ID NO: 635174 - RNA, 62 nt, hsa
ucauacuuaaaaauuuauuagcccugcauuuucauaggaagacacauuaucuucuggacuau

SEQ ID NO: 635175 - RNA, 62 nt, hsa
agaaccagaccuugguaaagaauugucucuugcauaggaagugucaccuucaggauacaaau

SEQ ID NO: 635176 - RNA, 62 nt, hsa
gcccuuaaacuggauucaaaaaaugcucuaaacauaggaaugguugaagaggucuugcaguc

SEQ ID NO: 635177 - RNA, 62 nt, hsa
aaaugaagagacaggcuaucugguuaauguuacauaggaauuuaauaguaaugcuugaacuu

SEQ ID NO: 635178 - RNA, 62 nt, hsa
uucccuuacuaaucaccaugaauauuucucaccauaggaauaaccacaacccaccaaguacc

SEQ ID NO: 635179 - RNA, 62 nt, hsa
ucuccacgccgugauggcagcgcugccgaggacauaggaaccacgacuggaaagauaauuua

SEQ ID NO: 635180 - RNA, 62 nt, hsa
uuucucccccacgaguggaaaauagacuucuacauaggaaagcuaaaauauguuaauauuuu

SEQ ID NO: 635181 - RNA, 62 nt, hsa
ugacuaucaggaaugugugcugugucaggauacauaggaaguugaccucgggguaucaugga

SEQ ID NO: 635182 - RNA, 62 nt, hsa
guaaguguuaaguuuuuaaucugggagcagggcauaggaagaaaaugucaguagugcuaaug

SEQ ID NO: 635183 - RNA, 62 nt, hsa
caaaacuuaauugauccuacaagcuuacuacacauaggaaaauucauacuggagagaaacua

SEQ ID NO: 635184 - RNA, 62 nt, hsa
uuucccguaacgcacaggacacgugugcaauucauaggaacggcccagaucgcccucaugag

SEQ ID NO: 635185 - RNA, 62 nt, hsa
auacugggguagauuauugccugccccuuauacauaggaauaugcugcauaauugcgcauaa

SEQ ID NO: 635186 - RNA, 62 nt, hsa
aaaccucaugccuuauucagcaucacaaaaugcauaggaaagagaaaucguaugaauguaau

SEQ ID NO: 635187 - RNA, 62 nt, hsa
aacacuuuuuuucuaauucucccuaguauaugcauaggaauuuaauauacuuuauaaauaag

SEQ ID NO: 635188 - RNA, 62 nt, hsa
guggugguuucuguuugcauuuuugcaggagccauaggaaacuacugaaaugauugugcugg

SEQ ID NO: 635189 - RNA, 62 nt, hsa
ucuguggcagacauugccgagugacuuucuaacauaggaauucacuguguuuucauuugaug

SEQ ID NO: 635190 - RNA, 62 nt, hsa
uacauaacagugcagagcacaaugcuguguaacauaggaauucacuguguuuucauuugaug

SEQ ID NO: 635191 - RNA, 62 nt, hsa
gcugaaaagaaaaucguaaaaacagaaaaugucauaggaauaaaaaaauuaucuuuucauau

SEQ ID NO: 635192 - RNA, 62 nt, hsa
agaaugcuuauucucuuagaugauaccgcacccauaggaauugagaauugggagugggaaga

SEQ ID NO: 635193 - RNA, 62 nt, hsa
ucgagauaguuuuuucuuuuuaaugaaaaaagcauaggaauuggagauuggcuugucucacg

SEQ ID NO: 635194 - RNA, 62 nt, hsa
aaucugaggaaacauaaauucuucugaagaaucauaggaagaguagacauuuuauuuauaac

SEQ ID NO: 635195 - RNA, 62 nt, hsa
cuugcuuuuucaauucuccuguugcaaugacacauaggaaaaucuuaaaauucuugggagug

SEQ ID NO: 635196 - RNA, 62 nt, hsa
ccagaggaggccucuuugguugguucuuuuuucauaggaaauuccuucauaaaacauguaac

SEQ ID NO: 635197 - RNA, 62 nt, hsa
acaauauaacuuuacauucuuugccaauauuccauaggaaaaauuuugacaauguggaguuu

SEQ ID NO: 635198 - RNA, 62 nt, hsa
aaccacuaauuuugaaaauuaccagugugauacauaggaaucauuauucagaauguagucug

SEQ ID NO: 635199 - RNA, 62 nt, hsa
aacuaguauauaaaguacuaauuaaaugcuaacauaggaaguuagaaaauacuaauaacuuu

SEQ ID NO: 635200 - RNA, 62 nt, hsa
cagccaggaaggacaggcuuuccccuguauaucauaggaaacucagggacauuucaaguugc

SEQ ID NO: 635201 - RNA, 62 nt, hsa
gccugcaucccucccuuccuuucucuuacugccauaggaaauuauuuuagggguuggaggug

SEQ ID NO: 635202 - RNA, 62 nt, hsa
acagucaaagagacaucucccucaauaaucgucauaggaaagacgugccaguuguggaggaa

SEQ ID NO: 635203 - RNA, 62 nt, hsa
ugcagcuuugggcucccccauagugacugugccauaggaaagcagccccuccucacacauac

SEQ ID NO: 635204 - RNA, 62 nt, hsa
guugauggaaaccaucugugcuuagucucugacauaggaagcuugcuucaggcaauggcuuu

SEQ ID NO: 635205 - RNA, 62 nt, hsa
cacaauuguugacuaaaaugcugcuuuuaaaacauaggaaaguagaaugguugagugcaaau

SEQ ID NO: 635206 - RNA, 62 nt, hsa
accugagaaaugcuaauggagauuugcugguacauaggaaucuagcaaauucaggaaccaag

SEQ ID NO: 635207 - RNA, 62 nt, hsa
uuugcacagucuuacuucuguagaacacuggccauaggaaaugcuguuuuuuuguacuggac

SEQ ID NO: 635208 - RNA, 56 nt, hsa
guaggaagaugauuuuguaaagugcgcauaggaacccauuacuuaauagaagucag

SEQ ID NO: 635209 - RNA, 62 nt, hsa
cuugaaucuucucccuuguccugcuugggguucauaggaauugguaaggccucuggacuggc

SEQ ID NO: 635210 - RNA, 62 nt, hsa
uuagccuaguuuucucauacagucaucacaagcauaggaagauacuucaaaaccaaaaaaac

SEQ ID NO: 635211 - RNA, 62 nt, hsa
gcuggcgccaucgcuccggauuaguugguuuccauaggaaaggcaugcuuucagccagaugc

SEQ ID NO: 635212 - RNA, 62 nt, hsa
uuuguuacuuacgguucugagaggaggggccacauaggaaagccccacggugggucagaagg

SEQ ID NO: 635213 - RNA, 62 nt, hsa
uaaguauaguugauguaacauuguagaagcagcauaggaacaauaagaacaauagguaaagc

SEQ ID NO: 635214 - RNA, 62 nt, hsa
ugcuuuguaauagagucuguaauaggauuucccauaggaagagaucugccagacgcgaacuc

SEQ ID NO: 635215 - RNA, 62 nt, hsa
cuucaaacacuggcaccuugggucucacccaccauaggaaacaagacaacauucaauuugau

SEQ ID NO: 635216 - RNA, 62 nt, hsa
uugaguucucucuaacccagcuuacugugggacauaggaaaacucaguagaaauaccuuugg

SEQ ID NO: 635217 - RNA, 62 nt, hsa
uacuuuucauuuuggcucaccguggauuuucucauaggaaguuuggucagagugaauugaau

SEQ ID NO: 635218 - RNA, 62 nt, hsa
uugaacugcagaccuguaugagaacccaaugucauaggaaauaugguuugcuaaaaucuaua

SEQ ID NO: 635219 - RNA, 62 nt, hsa
ccauuucaaaacuguuucuucuauuccugguucauaggaaagaaaaaaguuauucaaaguau

SEQ ID NO: 635220 - RNA, 62 nt, hsa
ugagcccagaaguucgagacuagccugggaaacauaggaagcccucgucucuacaaaaaaaa

SEQ ID NO: 635221 - RNA, 62 nt, hsa
ucgcuacucuuaagaauauacauguauguauucauaggaacauuuuuucucaauauuuguau

SEQ ID NO: 635222 - RNA, 62 nt, hsa
uaugagaacacauuuucacaguuauguuucuucauaggaaaacuauauuuagugggcaacaa

SEQ ID NO: 635223 - RNA, 62 nt, hsa
uuuugauaacuagcuuuccagguggacuuagccauaggaaaauauuacuaauguaauuuaac

SEQ ID NO: 635224 - RNA, 62 nt, hsa
agaagcauauauggguuggaauuaugccaaagcauaggaagcugggaauaagcaaacaaaug

SEQ ID NO: 635225 - RNA, 62 nt, hsa
cacuuaucagggccuggagcccugauggaagccauaggaacuccagaguugccaagccauag

SEQ ID NO: 635226 - RNA, 62 nt, hsa
caguggcuuuaugaaguaaaguuaaaaacaaacauaggaaaugugaaaauauuuguguuugu

SEQ ID NO: 635227 - RNA, 62 nt, hsa
cauaugaugugaaugccuacaaagccagugcgcauaggaacagugggccuggguaaagaguc

SEQ ID NO: 635228 - RNA, 62 nt, hsa
aaguaaacccucacugugaaucagagaauucacauaggaaagaaaccagaugaagaugaaug

SEQ ID NO: 635229 - RNA, 62 nt, hsa
acuuuaaacuucuauagaaaagauaucguguacauaggaacugguguagauaagcaugcaau

SEQ ID NO: 635230 - RNA, 62 nt, hsa
uuuaaacuaccauaauuccauuuuuucccuuacauaggaaaacuguaaguuggaauuaucuu

SEQ ID NO: 635231 - RNA, 62 nt, hsa
uuguaaaaauaacauaauaaauagaucuuaaacauaggaaaaccauacuguucugauaauaa

SEQ ID NO: 635232 - RNA, 62 nt, hsa
aaaacagcaugauacuggcauaacaacagacacauaggaacaguauagacaacccagaaaca

SEQ ID NO: 635233 - RNA, 62 nt, hsa
aaaaccuaauggugcuucucccuuggaaaugccauaggaagcccacaaccgcuaacacuuac

SEQ ID NO: 635234 - RNA, 62 nt, hsa
agccucugcccccaggcugggccugucacuggcauaggaaggccagccccgcaucucccacu

SEQ ID NO: 635235 - RNA, 62 nt, hsa
gggauccaagaucuuugcaguucaaucgaccacauaggaauuuccaggcaccaaaaugauau

SEQ ID NO: 635236 - RNA, 62 nt, hsa
gaucuauaggcagcuucuaagagcgaacuucacauaggaagggaucugagaacacguugcca

SEQ ID NO: 635237 - RNA, 62 nt, hsa
ugacuuuagagagaguaaaaugugccaggagccauaggaauaucuguauguuggaugacuuu

SEQ ID NO: 635238 - RNA, 62 nt, hsa
cauuuuaaaauagaacuauccuuguucgauagcauaggaaaauguucuggugauugucaggg

SEQ ID NO: 635239 - RNA, 62 nt, hsa
uuaaauauuaaaaauuguguaaauacaauugacauaggaauuacauuaaaauauuaggaaga

SEQ ID NO: 635240 - RNA, 62 nt, hsa
caauguauaauacauucacaucuagucaagggcauaggaacggugucauggaguccaaauaa

SEQ ID NO: 635241 - RNA, 62 nt, hsa
cucuggucaccacaaugcuugaugccagcugccauaggaagagggugcuggcuggccauggu

SEQ ID NO: 635242 - RNA, 62 nt, hsa
aauugauccccaaccugccaggcuuccuaucucauaggaaacauccucauugauccucuuca

SEQ ID NO: 635243 - RNA, 62 nt, hsa
cuccuaaaugccccauauuaaaagaacucauucauaggaagguguuucauuuuggugugcaa

SEQ ID NO: 635244 - RNA, 62 nt, hsa
uguuagccaccauccaugcuaccuagguaguccauaggaaccacccccaugaccaccaccaa

SEQ ID NO: 635245 - RNA, 62 nt, hsa
uccacaccagggcugugguccucccagacaugcauaggaauggccacagguuuacacugccu

SEQ ID NO: 635246 - RNA, 62 nt, hsa
cuacucagaaauuuuuauuuuucuaagguucucauaggaaaaguacauuuaauacagcagug

SEQ ID NO: 635247 - RNA, 62 nt, hsa
auauauuuaaaaaaccuuuuuuuauuguggagcauaggaauugccccccuccaggcuucacc

SEQ ID NO: 635248 - RNA, 62 nt, hsa
aaagguuauggaagaaugguuuaugaacuucccauaggaagcaccugagagauaguaaacug

SEQ ID NO: 635249 - RNA, 62 nt, hsa
aagccugucuccucacccacccccagcccuagcauaggaaaagcuuccuugaugugagcucu

SEQ ID NO: 635250 - RNA, 62 nt, hsa
gacuagaugcauaccguuuugugaaaaccagccauaggaaaacaugugagcaacaaccccca

SEQ ID NO: 635251 - RNA, 62 nt, hsa
gacaugguuacuuuauuuuccccuuguuaagacauaggaagacuuaauuuuuaaacggucag

SEQ ID NO: 635252 - RNA, 62 nt, hsa
ccccaaacucaggccgaaugaucaaggggacccauaggaaaucuuguccagagacaagacuu

SEQ ID NO: 635253 - RNA, 62 nt, hsa
ccagcuuucuucuguugaugccguucccugaacauaggaaaauagaaacuugcuuaucaaaa

SEQ ID NO: 635254 - RNA, 62 nt, hsa
aaacaguuuagcccaucucuccagagagcaaacauaggaauaugacucaggagccuccuagg

SEQ ID NO: 635255 - RNA, 62 nt, hsa
aagguuagguguuuuagguacauuccagcugucauaggaagaucacagaaaugaggaggcug

SEQ ID NO: 635256 - RNA, 62 nt, hsa
guggauuccaugacauauauuguaauucuuuucauaggaaaugucauuacaguaugaauuau

SEQ ID NO: 635257 - RNA, 62 nt, hsa
agaaggccuuuucugaagggauaucuaaaaagcauaggaaauccuugguucagagggaagug

SEQ ID NO: 635258 - RNA, 62 nt, hsa
uacugggcagguccaaaaggauaguuccaggccauaggaauggcuuggugcaguuaacgggu

SEQ ID NO: 635259 - RNA, 62 nt, hsa
cacuuccccaggcuucucccuccccccacccccauaggaacaggauuuggccuuagcuucug

SEQ ID NO: 635260 - RNA, 62 nt, hsa
guccaggcuccaguaggagagaaagaacuccucauaggaauacugaagaagugggaaggaac

SEQ ID NO: 635261 - RNA, 62 nt, hsa
ccauuuugucuuccauaggaaacugggaaucucauaggaagagccaggacaugaagaaaagg

SEQ ID NO: 635262 - RNA, 62 nt, hsa
guccauuaagacucugauaauugucuccccuccauaggaauuucucccaggaaagaaauaua

SEQ ID NO: 635263 - RNA, 62 nt, hsa
uguauaauauguaauuguagggaaacugcucucauaggaaaguuuucugcuuuuuaaauaca

SEQ ID NO: 635264 - RNA, 62 nt, hsa
cauucuaggcucuauuuaacugagucacacugcauaggaauuuagaaccuaacuuuuauagg

SEQ ID NO: 635265 - RNA, 62 nt, hsa
uugaaaagauuuuaacaaguauaaaaaauucucauaggaauuaaauguagucucccuguguc

SEQ ID NO: 635266 - RNA, 62 nt, hsa
guuguauauaauauuuaagaugcugaguauuucauaggaaagcugaaugcugcuguaaagug

SEQ ID NO: 635267 - RNA, 62 nt, hsa
gauauuugaauuaucuugauuggaauguuauucauaggaaauaacaggaagauuccaaagac

SEQ ID NO: 635268 - RNA, 62 nt, hsa
aaggccacccuagaaagaaguccgcuggcacccauaggaaggggccucaggagcaggaaggg

SEQ ID NO: 635269 - RNA, 62 nt, hsa
auagaguaauauuugagcuguguucaaaaauacauaggaaaagacugauaaaaugaaauaug

SEQ ID NO: 635270 - RNA, 62 nt, hsa
ccagcaaaccaggacucugccccuucuguuuccauaggaaucauguuggauagucagcugua

SEQ ID NO: 635271 - RNA, 62 nt, hsa
aagguaacguguuccuagaaaagaaaaugcugcauaggaaaacugagaugccuuuuauucca

SEQ ID NO: 635272 - RNA, 62 nt, hsa
ucaguuauaaauauggugaauuuuuucuggaccauaggaauauuauuucaaagaaauauuac

SEQ ID NO: 635273 - RNA, 62 nt, hsa
accuauacuuugauacugaagacugccaaauacauaggaauuuucuuucuuaaaaaacagua

SEQ ID NO: 635274 - RNA, 62 nt, hsa
ugucucacuggcaucuuguugagggccuugcacauaggaaacuuuugauaaguaucugcgga

SEQ ID NO: 635275 - RNA, 62 nt, hsa
cuccuuaaugugaaaaaucaagggcuuacugacauaggaacaacagaaaugcuccuggaacu

SEQ ID NO: 635276 - RNA, 62 nt, hsa
ucuguuuccaacagaaaagaaacauuuguuugcauaggaauucaugaaggcgacccaaccug

SEQ ID NO: 635277 - RNA, 62 nt, hsa
acccuaggaaguagggagaaaugaaggaagggcauaggaaaauuuucccaguaaauccccug

SEQ ID NO: 635278 - RNA, 62 nt, hsa
ugaauagaucaugaagucauaggcuuccaaggcauaggaagagaucuugcaggucuaguauu

SEQ ID NO: 635279 - RNA, 62 nt, hsa
auaguguuccuaagauaucucuuaaauccucccauaggaaauagaauuacagguaagguaca

SEQ ID NO: 635280 - RNA, 62 nt, hsa
aauuuuggguauacuugugguuaguuuugugccauaggaaaaaauuaucuuaaaacuuuggc

SEQ ID NO: 635281 - RNA, 62 nt, hsa
ucacgcgucugacagagcuggugcugcaggcccauaggaaggagcuggaaggccuccggaug

SEQ ID NO: 635282 - RNA, 62 nt, hsa
uauuugcaccgaaaugucuuguuuuguugcgacauaggaaaauaaccaagcacaaaguuaua

SEQ ID NO: 635283 - RNA, 62 nt, hsa
ugccuauucuucaaccaccuugguuacuuugacauaggaauugacuucuuuuccuugaaugg

SEQ ID NO: 635284 - RNA, 62 nt, hsa
aaggagauuuucuagcuccacaucugucugcacauaggaaggaaaagauaggacucuaaacc

SEQ ID NO: 635285 - RNA, 62 nt, hsa
agagcccugggguccuguccugcaggaugcugcauaggaaugggcagagauguccuggaugg

SEQ ID NO: 635286 - RNA, 62 nt, hsa
uaauaaccaagacuuuucaagcuucuagaucucauaggaaagcuuguaauagcaaaauugua

SEQ ID NO: 635287 - RNA, 62 nt, hsa
gcuguguaacaugaccuuaaauagucuuccugcauaggaagagcaaaaggguauucaucaau

SEQ ID NO: 635288 - RNA, 62 nt, hsa
cagcucuggugagucuuggcggcagcagccaucauaggaagggaccaaggcaaggcaggugc

SEQ ID NO: 635289 - RNA, 62 nt, hsa
ugcaagaauuaaaacugaguccaugaaaauaccauaggaagacauaaaacuuuaaaaggcaa

SEQ ID NO: 635290 - RNA, 62 nt, hsa
guaacacaguggugaguauuuguguuuacaaacauaggaaagguacaguaaaacuaugguau

SEQ ID NO: 635291 - RNA, 62 nt, hsa
cugaugccaccuccucuguucuuggaacaacgcauaggaaaagaaucuccuuuggaagguga

SEQ ID NO: 635292 - RNA, 62 nt, hsa
aauacguauguuuaaaaacccuuccugcuauacauaggaaaagacacacauccaccuaaaau

SEQ ID NO: 635293 - RNA, 62 nt, hsa; identical to SEQ ID NO: 635283

SEQ ID NO: 635294 - RNA, 62 nt, hsa
uaccuauucuucaaccaccucgguuacucugacauaggaauuuacuucuuuuccuugagugg

SEQ ID NO: 635295 - RNA, 62 nt, hsa
acuccauaagugauccuaaaagguagccucuucauaggaacccaggaggacaaaaccaccau

SEQ ID NO: 635296 - RNA, 62 nt, hsa
gagggggcuggaggcgaagggugggagcauagcauaggaacgcugcauagaccauggaggcc

SEQ ID NO: 635297 - RNA, 62 nt, hsa
ggggccuagauguagccucuguuccuccuggacauaggaaggucccaagcuuaguaucccac

SEQ ID NO: 635298 - RNA, 62 nt, hsa
cuggauuugccaacuagaauucgauuuccugucauaggaagcuccuuggaagaagggauggg

SEQ ID NO: 635299 - RNA, 62 nt, hsa
uccacugggaagagacaggaauucuaccuacacauaggaaggccaagguugauccacuuaac

SEQ ID NO: 635300 - RNA, 62 nt, hsa
uggaguggagagaguauuccugcugaaacgcgcauaggaagcuuuugucccugcuguuaaug

SEQ ID NO: 635301 - RNA, 62 nt, hsa
aggaaacuauuaaaauuggcucgaucaguagucauaggaauugguauaagaagagacucauu

SEQ ID NO: 635302 - RNA, 62 nt, hsa
ugugauacagcggucacuauuuucucuuaacacauaggaaaaaaguucagacaucgcuacaa

SEQ ID NO: 635303 - RNA, 62 nt, hsa
cuggaagauaaccuaggcaauaccauucuggacauaggaacggaaaaagauuucaugacaaa

SEQ ID NO: 635304 - RNA, 62 nt, hsa
ugucuggaaccagugaaugcauuagaaccuuccauaggaaaagaaaaggggcugaguuccau

SEQ ID NO: 635305 - RNA, 62 nt, hsa
cugcccccagguauuuacuguggagaacauugcauaggaaugucuggaaaaagccucuacaa

SEQ ID NO: 635306 - RNA, 62 nt, hsa
cauuauuagccaugaagggaauaucuuugucacauaggaauuguucagcaacagaaagauac

SEQ ID NO: 635307 - RNA, 62 nt, hsa
uuguaaauuuaugugauggcaaagaaggagagcauaggaaaccacacagacuugggcagggu

SEQ ID NO: 635308 - RNA, 62 nt, hsa
ccucucaagggcauucugggcuuguaaacagacauaggaagccucuguuuacccugaagcac

SEQ ID NO: 635309 - RNA, 62 nt, hsa
gcaccugccaauagcuuugucaaucacagccccauaggaacgucuggaauugcuugggaguu

SEQ ID NO: 635310 - RNA, 62 nt, hsa
auuauauuuuuuuuugguaaaaaagaaauguccauaggaaacaaauucccgugucuuaaaac

SEQ ID NO: 635311 - RNA, 62 nt, hsa
aaggggccuugcucugagcacaggugacagaucauaggaaguggcuggucuggagucccacc

SEQ ID NO: 635312 - RNA, 62 nt, hsa
acugaccucagggccgaaggggaggugguguacauaggaacgcguugcggaguccgccccgu

SEQ ID NO: 635313 - RNA, 62 nt, hsa
cugagaagacagacugagcagggcagcaccuccauaggaagccuuccuuucuggccaaggug

SEQ ID NO: 635314 - RNA, 62 nt, hsa
agauguucuagaauguagauaccuuguccagccauaggaaucaaaauaaaaaacuaaaaaag

SEQ ID NO: 635315 - RNA, 62 nt, hsa
aauuauucuuucauuuuauaaugcaacuuuuucauaggaaguccggaugggaauauucacau

SEQ ID NO: 635316 - RNA, 62 nt, hsa
ggguuuuauaaauaaauauauauauauauguacauaggaaaaaccaaauauacauacuuauu

SEQ ID NO: 635317 - RNA, 62 nt, hsa
ccuccacccuugguggggaggggacccaggaccauaggaagguccugaguccaccuccuggu

SEQ ID NO: 635318 - RNA, 62 nt, hsa
auuuuaggaggguuuaaauaggguucagagaucauaggaauauuaggaguuaccucucugug

SEQ ID NO: 635319 - RNA, 62 nt, hsa
uccuucugauuuugccugucuuauauaaugagcauaggaaaauuuuggaaugaggcagaaaa

SEQ ID NO: 635320 - RNA, 62 nt, hsa
guauggauuuuuuuguuaucuucacuuuacugcauaggaaacaaucuaccucaucauuuaaa

SEQ ID NO: 635321 - RNA, 62 nt, hsa
gaagguggggucuuggauaucaccuaaguuuacauaggaaugaaauauguaacccagaacaa

SEQ ID NO: 635322 - RNA, 62 nt, hsa
aaaugcucccugucccauggagagggacccagcauaggaaagccacauacucagccuggaug

SEQ ID NO: 635323 - RNA, 62 nt, hsa
cuauuccccaacagauauuguggcaaaucacacauaggaaagagaauuugggaauacaguag

SEQ ID NO: 635324 - RNA, 62 nt, hsa
auuaucuaaagaaucauugucuuucagagacucauaggaaaaaaaaacuaggaaaaguguca

SEQ ID NO: 635325 - RNA, 62 nt, hsa
aaguagaaagugcuugguauuucugucuuauacauaggaaaacauuuaaaauaaauaguuuu

SEQ ID NO: 635326 - RNA, 62 nt, hsa
ggcaugaaauagugauuauaucuguggaaaagcauaggaaggcauucuccuuuuucauuuuu

SEQ ID NO: 635327 - RNA, 62 nt, hsa
gaaggacagcgaugggaaaaaugcccuuaaaucauaggaaaguauuuuuuuaagcuaccaau

SEQ ID NO: 635328 - RNA, 62 nt, hsa
aucaggguccccagccucugggcuccuguuuccauaggaaggggcgacaccuuccucccagg

SEQ ID NO: 635329 - RNA, 62 nt, hsa
caaauagauuaaacacaaaaauaaaacuaaagcauaggaauuauguuuuugagauaccuuug

SEQ ID NO: 635330 - RNA, 62 nt, hsa
gguagggggacuguucuagccagcuguggacacauaggaaugcuggaccaggguaccagauu

SEQ ID NO: 635331 - RNA, 62 nt, hsa
gcuccucccccacucaagcaauagggccccgccauaggaagacccccagagagagggucagc

SEQ ID NO: 635332 - RNA, 62 nt, hsa
cagcaguccaggugccacaggcagcccugggacauaggaagcugggagcaaggaaagggucu

SEQ ID NO: 635333 - RNA, 62 nt, hsa
acuggauaaacccacuccacaugugcuggggacauaggaagaccuuaagccauagcucaucc

SEQ ID NO: 635334 - RNA, 62 nt, hsa
ugacaggauugagagauuaaaguaaagacaggcauaggaaaucacaaggguauugacugggg

SEQ ID NO: 635335 - RNA, 62 nt, hsa
gauacaacauauuccccccaaaaaaacacauacauaggaacugguuauauuccaccauaaca

SEQ ID NO: 635336 - RNA, 62 nt, hsa
ggaaucccuuuugcuucaugcucacaacuaagcauaggaaguuuuauuuaaaggaaagaaua

SEQ ID NO: 635337 - RNA, 62 nt, hsa
uagaacucuuccuuugcgaauuuuauguugagcauaggaaguacauucuagaggaaagguuu

SEQ ID NO: 635338 - RNA, 62 nt, hsa
gagaaacugaugauuuuacauuuucuagucugcauaggaagggaacaccuggacgugugaua

SEQ ID NO: 635339 - RNA, 62 nt, hsa
uauccaucugagagccaacacaggagaaaaaccauaggaaagugacauguaggagggcuaua

SEQ ID NO: 635340 - RNA, 62 nt, hsa
uuacuccuggaccacaacuguaggugaggauucauaggaagaguagaacucagucucuaguu

SEQ ID NO: 635341 - RNA, 62 nt, hsa
uccguguuccagcaucuaaccuuuuacuuuugcauaggaaauacuugauuuaauuacagguc

SEQ ID NO: 635342 - RNA, 62 nt, hsa
gggcagcaggcaucauuuuccuuuucuagcuucauaggaauauugugagcucaccaugcugu

SEQ ID NO: 635343 - RNA, 62 nt, hsa
gugguuuuuguguuuuuuuuuuuuucuuuuuccauaggaaagaauauauaaauuuguaaauc

SEQ ID NO: 635344 - RNA, 62 nt, hsa
aauuaaaaauaacacagucuuuuuaaaacuaacauaggaaagccuuuccuauuauuucucuu

SEQ ID NO: 635345 - RNA, 62 nt, hsa
ccaaaguaaacuguguaggggagccacauuuacauaggaaccaaaucaaugaauuuaggggu

SEQ ID NO: 635346 - RNA, 62 nt, hsa
caccccuacucguuccuauagaacacagaggacauaggaaacccuuaaaacacacaugggau

SEQ ID NO: 635347 - RNA, 62 nt, hsa
caacagccagcccuucauccuccagcgucugccauaggaaugugagagggguguuugcugag

SEQ ID NO: 635348 - RNA, 62 nt, hsa
gucuucuuuugaggaugaucagagaacuugggcauaggaacaaucuggcagaaguuuccaga

SEQ ID NO: 635349 - RNA, 62 nt, hsa
augugucagggaauagaugugaaacaagggaucauaggaaaaggggaaagagaaaugaucug

SEQ ID NO: 635350 - RNA, 62 nt, hsa
uauagcaaguguugcuguaaaguguuuuucuccauaggaagugugaacuguguauugucuau

SEQ ID NO: 635351 - RNA, 62 nt, hsa
ggugaucaaaacgcuccaucuuuuuacaguggcauaggaagacggcaaaaauuuccuaaagu

SEQ ID NO: 635352 - RNA, 62 nt, hsa
aacucuuuaacuuguaauaaacccuuaacuggcauaggaaaugguauccagaauggaauuuu

SEQ ID NO: 635353 - RNA, 62 nt, hsa
uccaugccaaguaacagcagagggaguuaagccauaggaauuuggcuguggaguaagaggga

SEQ ID NO: 635354 - RNA, 62 nt, hsa
aaauguaacuguuaccauuggaaauuucacgucauaggaaguuagccuuuaucuaccaacuu

SEQ ID NO: 635355 - RNA, 62 nt, hsa
cauauaugccaucuguccucaaguguuaucuacauaggaaauaaaauggaauugauguaaag

SEQ ID NO: 635356 - RNA, 62 nt, hsa
cauauaaacaugaaauaaacagugccaguauucauaggaaagugagaaacuguaauauuugg

SEQ ID NO: 635357 - RNA, 62 nt, hsa
cugcaucaccacaguguauaugcaauucuaugcauaggaagagccuuuagagaaagcauuug

SEQ ID NO: 635358 - RNA, 62 nt, hsa
aaugucaaugaguaauucauuauuauccaaagcauaggaaggcucuauguuuguauauuucu

SEQ ID NO: 635359 - RNA, 62 nt, hsa
agcaggaaccuaaaauaucugccaucaucugccauaggaaagauacccagagacccaucaug

SEQ ID NO: 635360 - RNA, 62 nt, hsa
ucugcuucuaaaaacuucuaugucuagucuuccauaggaaauccucacuguuuaaccaugug

SEQ ID NO: 635361 - RNA, 62 nt, hsa
ccgcuucugcguuuuguuauuccuacugccgccauaggaauuauuucguuggcugaacguua

SEQ ID NO: 635362 - RNA, 63 nt, hsa
acuucauugaaaguagugcuguaaauauucugccauaggaauacugucuacaugcuuucucau

SEQ ID NO: 635363 - RNA, 63 nt, hsa
cggccucacccaggcaucugcuuuacucuggaccauaggaaacaagaccguuuggagguuuca

SEQ ID NO: 635364 - RNA, 63 nt, hsa
cccuucaagugggcugaagcccuuggaaagugacauaggaaguccccagaucuugcccuucuc

SEQ ID NO: 635365 - RNA, 63 nt, hsa
uaauuguauuuagaucuuguuauugcuccaguacauaggaauuguguaaaguguuaacagcag

SEQ ID NO: 635366 - RNA, 63 nt, hsa
aaccauagauuucuuucagaaaaaaaaaacaggcauaggaacaguuuucucuucauauauuau

SEQ ID NO: 635367 - RNA, 63 nt, hsa
uauaucuuuaaaauuuuccuuuauguuccauuccauaggaaaacacacauaugcacacaaaac

SEQ ID NO: 635368 - RNA, 63 nt, hsa
uggugguuauuugguauuaaacuccaaaugagccauaggaaggcacuacaugaaauaaugcac

SEQ ID NO: 635369 - RNA, 63 nt, hsa
auuguaauuuugaugauacaaagauugaaagaucauaggaaagcauugcccuucaucacagaa

SEQ ID NO: 635370 - RNA, 63 nt, hsa
ggaagcagacacaacccaaacauuugcuacuaacauaggaaacacacacauacagacaccccc

SEQ ID NO: 635371 - RNA, 63 nt, hsa
gugagaguuggugcaaauucuuguguguguuugcauaggaaggugagaugaccaucuacuaaa

SEQ ID NO: 635372 - RNA, 63 nt, hsa
uccccccggaaaugaacaaagccgggcccuuuccauaggaacugcccuuggagauagcagagu

SEQ ID NO: 635373 - RNA, 63 nt, hsa
ccucaccaucaugauaccagauacaggugaauacauaggaacuaucugccuguguccucaauc

SEQ ID NO: 635374 - RNA, 63 nt, hsa
ugauuuuuauuuguuacagguuuccaauggccccauaggaauaagcaauaauguagacugaua

SEQ ID NO: 635375 - RNA, 63 nt, hsa
ccuuuugugaaggccgaacucgagcuguauccucauaggaaacagugaucaccccggacgggc

SEQ ID NO: 635376 - RNA, 63 nt, hsa
gcuccagagcccacgaggcuugcagaucgggggcauaggaauuuggaauccaagagcuauaau

SEQ ID NO: 635377 - RNA, 63 nt, hsa
cccacgucuuccagcugggggaugggggggagucauaggaaaagcccccaucucccaucuggg

SEQ ID NO: 635378 - RNA, 63 nt, hsa
uucugagauguggugacucaugugaaguggugucauaggaaugaaggacugugggcgcugggu

SEQ ID NO: 635379 - RNA, 63 nt, hsa
aggguucuccucaaagccucacaaccauaggaucauaggaaaggggcccuauuuuccugcugc

SEQ ID NO: 635380 - RNA, 63 nt, hsa
cacagucgaggaaaauugauaccugcaguaacccauaggaaauaaacuguagaguuccauauu

SEQ ID NO: 635381 - RNA, 63 nt, hsa
aucuuauacagagaucuagaaucuuauauuuuccauaggaagguaaagaaaucauuagcaaga

SEQ ID NO: 635382 - RNA, 63 nt, hsa
cuugaugcucauaucuguucuucagcagccugucauaggaacuggauccuaccuauguuaauu

SEQ ID NO: 635383 - RNA, 63 nt, hsa
agagccuucuugcuuucauuuuccuugaauguacauaggaacaagggggaaagucucuuacug

SEQ ID NO: 635384 - RNA, 63 nt, hsa
uggggcaacuuugugaacacguaggcacuuagucauaggaaacauauuaugugcagguccuag

SEQ ID NO: 635385 - RNA, 63 nt, hsa
ucauucacuauuguauagaagaugcuguuaaaacauaggaaggguauuuuucuugauccaaag

SEQ ID NO: 635386 - RNA, 63 nt, hsa
uagccguguuuacuuguauuaacuuacaguuaacauaggaaaaauacaaguaaggaugugaga

SEQ ID NO: 635387 - RNA, 63 nt, hsa
gacacauuuuguaaauaacuuuuuguuaaaauucauaggaaauguuauuuuguggggggggga

SEQ ID NO: 635388 - RNA, 63 nt, hsa
ccggccaccaggacaugcuucaaugccuggugccauaggaagcccaggggacagucacaacuu

SEQ ID NO: 635389 - RNA, 63 nt, hsa
uaucauuguuuaauaaaaguaaucccugcuggucauaggaaaacacacgguucuaauuaagug

SEQ ID NO: 635390 - RNA, 63 nt, hsa
gcauauuacucauaaaucauuaauuaauauaagcauaggaaauggucuuaaaagauacugcau

SEQ ID NO: 635391 - RNA, 63 nt, hsa
acuugacacaacuuugaaacugcauaaaguagacauaggaacuagaggaaagcucaggcugca

SEQ ID NO: 635392 - RNA, 57 nt, hsa; identical to SEQ ID NO: 635102

SEQ ID NO: 635393 - RNA, 63 nt, hsa
ccauuuccugcuuuuguguaaggaaggugcucacauaggaaguuuuuauuugguuagagacag

SEQ ID NO: 635394 - RNA, 63 nt, hsa
cggucaagaacaaauggccccuaugcacagagccauaggaacugggggccuucccuggacagu

SEQ ID NO: 635395 - RNA, 63 nt, hsa
gguacuaagcacagaaacucacuauauaagucacauaggaaacuugaaaggucugaggaugau

SEQ ID NO: 635396 - RNA, 63 nt, hsa
cugcauauaggguauggaauugcacauccaucucauaggaauuguaaaugguuugaauaagag

SEQ ID NO: 635397 - RNA, 63 nt, hsa
ucucaggcacuucaaaacuaaaaccaaauuuagcauaggaaaaaguuguuuaaugcucagggc

SEQ ID NO: 635398 - RNA, 63 nt, hsa
gcaguguccggagcggcucuagacaacuuuggucauaggaacucuggagguggguucugguca

SEQ ID NO: 635399 - RNA, 63 nt, hsa
gaaacaugggcugaaaaugaaggccccauagugcauaggaacaguaaagccagggugcugacg

SEQ ID NO: 635400 - RNA, 63 nt, hsa
gcagggucugugauuuuacauguauguaaaacacauaggaagcugacuuaggaaaaagagaaa

SEQ ID NO: 635401 - RNA, 63 nt, hsa
ucuguauguauaacccguaaauauccauuuugacauaggaagaacuuugguuaagaguaaguu

SEQ ID NO: 635402 - RNA, 63 nt, hsa
gauuggaauuagaccauuuggccuuugaacuuucauaggaaaaaugacccaacauuucuuagc

SEQ ID NO: 635403 - RNA, 63 nt, hsa
aauaggagucuucugccucuuaacuuaaaagaacauaggaauuuuguuuuugguuucuuuauc

SEQ ID NO: 635404 - RNA, 63 nt, hsa
gcuuugguuugaggagguagagauauguguauccauaggaagagaucugucagaacaggcagc

SEQ ID NO: 635405 - RNA, 63 nt, hsa
uagccauaccugguaagcaaaaacuaguaaagacauaggaacauguaguuuuacuugguguuu

SEQ ID NO: 635406 - RNA, 63 nt, hsa
gcucuguucuccaagaggacccggaaguaaucacauaggaaaugauaaggaagaccaggagga

SEQ ID NO: 635407 - RNA, 63 nt, hsa
agacuacccagccagugaagugcagaggauagacauaggaaaacauuccaggcauuuggagac

SEQ ID NO: 635408 - RNA, 63 nt, hsa
uuacauucuacagggagaaagagauagccaauacauaggaauaaauauauacaagguaucaug

SEQ ID NO: 635409 - RNA, 63 nt, hsa
ccagaggagauauuaucuguccucuguguggcacauaggaaaaugugagaccuagaauuauag

SEQ ID NO: 635410 - RNA, 63 nt, hsa
acauacaauccaaaauuuaaaaaaauauuuuugcauaggaaaaauugagaaggaaguaaacca

SEQ ID NO: 635411 - RNA, 63 nt, hsa
uuaaacaauaaagcaauaagaacaaauacaauacauaggaaguuaaaagcacaaaggaaugaa

SEQ ID NO: 635412 - RNA, 63 nt, hsa
augauagcaguccugccaccuucuaguucaucccauaggaauguuuuuccaaguccuuccagu

SEQ ID NO: 635413 - RNA, 63 nt, hsa
uacuuauauacauauuuuuuaaaaguagcuuuacauaggaaggaaguggcauaguuuuaucaa

SEQ ID NO: 635414 - RNA, 63 nt, hsa
ggccaucuucccaaaguuauccaggcaaugaaucauaggaacaaugccauuccuaagagugcc

SEQ ID NO: 635415 - RNA, 63 nt, hsa
cauguagucacaaccuguuuuguuuuuguaaaacauaggaagucucuuuaaugcaaugauuug

SEQ ID NO: 635416 - RNA, 63 nt, hsa
uguuaauaacucucagcaggcaaagaccgauugcauaggaauugcacaauccaugaacagcau

SEQ ID NO: 635417 - RNA, 63 nt, hsa
ccuggaagaggucuggguggggaggccaguucccauaggaaggagucugccucuucugucccc

SEQ ID NO: 635418 - RNA, 63 nt, hsa
ggugaugguaugcugaaguucagccguugaacacauaggaaugucuguggggugacucuacug

SEQ ID NO: 635419 - RNA, 63 nt, hsa
caagcaggcugcucccagagguggggaacccuucauaggaaauccccacccccguccacccca

SEQ ID NO: 635420 - RNA, 63 nt, hsa
gcacuagaaguggcugggcaggggggccagagucauaggaagggucuuggagucaucagaucu

SEQ ID NO: 635421 - RNA, 63 nt, hsa
aaugucauguauaaaauaugaauaaaauguccacauaggaaauuaacacauauauaccuucuc

SEQ ID NO: 635422 - RNA, 63 nt, hsa
uuaugcugcuguuuacaaaagcccaauguaaugcauaggaaguauggcaugaacaucuuuagg

SEQ ID NO: 635423 - RNA, 63 nt, hsa
gcacugauggcccugaagaagcggauccagucacauaggaaaggaggcuguguuagugaaagc

SEQ ID NO: 635424 - RNA, 63 nt, hsa
gucucuuuugguggggugggggugggcuaaagccauaggaagaaaaaugugauguaugugucc

SEQ ID NO: 635425 - RNA, 63 nt, hsa
guaucuuaauugcuacugguuggcauuguaacucauaggaauuccagaaaauuauuaauccgu

SEQ ID NO: 635426 - RNA, 63 nt, hsa
uguugguguuuuauuguacauacuucagaugcacauaggaauagaaguguguuauaaaucuag

SEQ ID NO: 635427 - RNA, 63 nt, hsa
uauuucauuaugauugaaaaacauaaaaacuaacauaggaaagugaaugaucaguuacuuaug

SEQ ID NO: 635428 - RNA, 63 nt, hsa
uagucuaucugcaauuacucaacgaggcauuuucauaggaaacagacuaugauuaauccauuu

SEQ ID NO: 635429 - RNA, 63 nt, hsa
accacucaguuuugcuuuugcgaggcgauuugacauaggaacuuugagacuccaugagaaagu

SEQ ID NO: 635430 - RNA, 63 nt, hsa
aaauaacauuugcuguuuuauagguuugaagaacauaggaaaaacuaagagguuuuguuuuua

SEQ ID NO: 635431 - RNA, 63 nt, hsa
ucugacugauuuuguuacgggguugauucugaccauaggaaguaugcaaugugaaucacuauu

SEQ ID NO: 635432 - RNA, 63 nt, hsa
uuugagaagaaagggucucuugaccuguauuaacauaggaaaguaaaguucuuuuuguuuuuc

SEQ ID NO: 635433 - RNA, 63 nt, hsa
guagaauuugaucagaaucacagaaucaucagacauaggaacugagcacaggcuuuuucaggu

SEQ ID NO: 635434 - RNA, 63 nt, hsa
uuauuuaaauagaagauuuuuguagguguaccacauaggaagagcaaaugaaauaaacucuuu

SEQ ID NO: 635435 - RNA, 63 nt, hsa
ccuaaccuuaauuauucuguaagaacaugcuuccauaggaaauaguggauaauuuucagcuau

SEQ ID NO: 635436 - RNA, 63 nt, hsa
agacuaaucaaaggcaaacaaaggcuauuaacacauaggaaaaaauguauuuacuaaguguca

SEQ ID NO: 635437 - RNA, 63 nt, hsa
aaauauauacuuuauuaaaucauccaaccaaagcauaggaaacauugacccagaaccugacuu

SEQ ID NO: 635438 - RNA, 63 nt, hsa
auuuuuaaaacaucaaaauuuaugauuuacauucauaggaauaaaauaaaauauuauuagaac

SEQ ID NO: 635439 - RNA, 63 nt, hsa
uucguguuugacuuguccauucgggguucuucucauaggaaugcuagaggaaagagaacacug

SEQ ID NO: 635440 - RNA, 63 nt, hsa
acuguguuaauaaaugacagaaccugaagaagucauaggaaagaaacuugagcgguauacuca

SEQ ID NO: 635441 - RNA, 63 nt, hsa
ccagaaggaagcuuggcugagcuggccuuuuaacauaggaauguauuucguuggaaacauucu

SEQ ID NO: 635442 - RNA, 63 nt, hsa
ucauuucauuuguauuuuuguccagaaauuucccauaggaagacuucaccuccuacaacuccg

SEQ ID NO: 635443 - RNA, 63 nt, hsa
uaacucauuuuaguugauuuucaguacuauuuacauaggaauugauuuuuauggauauaguag

SEQ ID NO: 635444 - RNA, 63 nt, hsa
aaaauggaaaauaagagaucaaaaugaauauagcauaggaauaaagauuucacuagaaauugc

SEQ ID NO: 635445 - RNA, 63 nt, hsa
uaagacuuucuuuuucaucuuuuauagcguuaccauaggaaacuguuccaaacugaguuagcu

SEQ ID NO: 635446 - RNA, 63 nt, hsa
aaugucaauauauauuuaaaauaauaauggaaacauaggaaaucagcuauuuaaaccagauca

SEQ ID NO: 635447 - RNA, 63 nt, hsa
uuuccucaccaggagcccggcuuccacuccccacauaggaauaguccauccccagauucgcca

SEQ ID NO: 635448 - RNA, 63 nt, hsa
ucuccugcaaauuuaguuuguuaaagccuguuccauaggaaggcugugauaaccaguaaggaa

SEQ ID NO: 635449 - RNA, 63 nt, hsa
ugaugggauugggucacuuuugaauguggcuuucauaggaaagcagcuuaaacauaaauauca

SEQ ID NO: 635450 - RNA, 63 nt, hsa
uaccauagaaagaugacaaaagaaaauuuuccacauaggaaaaugccaugaaaauugcuuuug

SEQ ID NO: 635451 - RNA, 63 nt, hsa
cggguuaccuguaucugaaggacgguucuggggcauaggaaacacauacacuuccauaaauag

SEQ ID NO: 635452 - RNA, 63 nt, hsa
gagaaaucacucacuuugauuauguauagauuacauaggaagaacaaucacaucaguaaguua

SEQ ID NO: 635453 - RNA, 63 nt, hsa
accaguguucuccaccuuguccuccacagaucucauaggaaauguucaacaauucugugaaag

SEQ ID NO: 635454 - RNA, 63 nt, hsa
cuguucaguuuuauggaggaaaaauaaaucuaccauaggaauguuaguuaauauugauauauc

SEQ ID NO: 635455 - RNA, 63 nt, hsa
uaaauaacccugagguuuuguacuuacuuuccccauaggaagacagaccauaggcaaacucug

SEQ ID NO: 635456 - RNA, 63 nt, hsa
augguucuaaaaauugcauucaaacauaauuuacauaggaaauguacugugggaacuauucua

SEQ ID NO: 635457 - RNA, 63 nt, hsa
uaagaaccuaggagggaaaggaagauugagcaacauaggaaaaggggaagagaggcugagugu

SEQ ID NO: 635458 - RNA, 63 nt, hsa
uauggccguucuuuuccacccuguuucuucccccauaggaagaacccaccuguagcccugagg

SEQ ID NO: 635459 - RNA, 63 nt, hsa
aggaguuaauaaagaaguucauuuugguuuaaacauaggaaagaagagaaccaugaaaauggg

SEQ ID NO: 635460 - RNA, 63 nt, hsa
gccuccagauuuggguggagccucugugggaaccauaggaagugugugggcugccuuccuggg

SEQ ID NO: 635461 - RNA, 63 nt, hsa
aaaacgaucauagucuuaggaguucauuuaaaccauaggaacuuuucacuuaucucauguuag

SEQ ID NO: 635462 - RNA, 63 nt, hsa
aaaguggccaccuuuugauugauugggcuuccucauaggaagcacugagggugugucuuugua

SEQ ID NO: 635463 - RNA, 63 nt, hsa
ucaugaaggucagcaccaucccuggccuccucacauaggaaucuagcagaaaugauagacaca

SEQ ID NO: 635464 - RNA, 63 nt, hsa
uucauacuuaaaaauuuauuagcccugcauuuucauaggaagacacauuaucuucuggacuau

SEQ ID NO: 635465 - RNA, 63 nt, hsa
gagaaccagaccuugguaaagaauugucucuugcauaggaagugucaccuucaggauacaaau

SEQ ID NO: 635466 - RNA, 63 nt, hsa
ggcccuuaaacuggauucaaaaaaugcucuaaacauaggaaugguugaagaggucuugcaguc

SEQ ID NO: 635467 - RNA, 63 nt, hsa
aaaaugaagagacaggcuaucugguuaauguuacauaggaauuuaauaguaaugcuugaacuu

SEQ ID NO: 635468 - RNA, 63 nt, hsa
cuucccuuacuaaucaccaugaauauuucucaccauaggaauaaccacaacccaccaaguacc

SEQ ID NO: 635469 - RNA, 63 nt, hsa
gucuccacgccgugauggcagcgcugccgaggacauaggaaccacgacuggaaagauaauuua

SEQ ID NO: 635470 - RNA, 63 nt, hsa
uuuucucccccacgaguggaaaauagacuucuacauaggaaagcuaaaauauguuaauauuuu

SEQ ID NO: 635471 - RNA, 63 nt, hsa
uugacuaucaggaaugugugcugugucaggauacauaggaaguugaccucgggguaucaugga

SEQ ID NO: 635472 - RNA, 63 nt, hsa
uguaaguguuaaguuuuuaaucugggagcagggcauaggaagaaaaugucaguagugcuaaug

SEQ ID NO: 635473 - RNA, 63 nt, hsa
gcaaaacuuaauugauccuacaagcuuacuacacauaggaaaauucauacuggagagaaacua

SEQ ID NO: 635474 - RNA, 63 nt, hsa
cuuucccguaacgcacaggacacgugugcaauucauaggaacggcccagaucgcccucaugag

SEQ ID NO: 635475 - RNA, 63 nt, hsa
uauacugggguagauuauugccugccccuuauacauaggaauaugcugcauaauugcgcauaa

SEQ ID NO: 635476 - RNA, 63 nt, hsa
caaaccucaugccuuauucagcaucacaaaaugcauaggaaagagaaaucguaugaauguaau

SEQ ID NO: 635477 - RNA, 63 nt, hsa
aaacacuuuuuuucuaauucucccuaguauaugcauaggaauuuaauauacuuuauaaauaag

SEQ ID NO: 635478 - RNA, 63 nt, hsa
uguggugguuucuguuugcauuuuugcaggagccauaggaaacuacugaaaugauugugcugg

SEQ ID NO: 635479 - RNA, 63 nt, hsa
gucuguggcagacauugccgagugacuuucuaacauaggaauucacuguguuuucauuugaug

SEQ ID NO: 635480 - RNA, 63 nt, hsa
uuacauaacagugcagagcacaaugcuguguaacauaggaauucacuguguuuucauuugaug

SEQ ID NO: 635481 - RNA, 63 nt, hsa
ugcugaaaagaaaaucguaaaaacagaaaaugucauaggaauaaaaaaauuaucuuuucauau

SEQ ID NO: 635482 - RNA, 63 nt, hsa
aagaaugcuuauucucuuagaugauaccgcacccauaggaauugagaauugggagugggaaga

SEQ ID NO: 635483 - RNA, 63 nt, hsa
cucgagauaguuuuuucuuuuuaaugaaaaaagcauaggaauuggagauuggcuugucucacg

SEQ ID NO: 635484 - RNA, 63 nt, hsa
aaaucugaggaaacauaaauucuucugaagaaucauaggaagaguagacauuuuauuuauaac

SEQ ID NO: 635485 - RNA, 63 nt, hsa
ucuugcuuuuucaauucuccuguugcaaugacacauaggaaaaucuuaaaauucuugggagug

SEQ ID NO: 635486 - RNA, 63 nt, hsa
cccagaggaggccucuuugguugguucuuuuuucauaggaaauuccuucauaaaacauguaac

SEQ ID NO: 635487 - RNA, 63 nt, hsa
cacaauauaacuuuacauucuuugccaauauuccauaggaaaaauuuugacaauguggaguuu

SEQ ID NO: 635488 - RNA, 63 nt, hsa
uaaccacuaauuuugaaaauuaccagugugauacauaggaaucauuauucagaauguagucug

SEQ ID NO: 635489 - RNA, 63 nt, hsa
caacuaguauauaaaguacuaauuaaaugcuaacauaggaaguuagaaaauacuaauaacuuu

SEQ ID NO: 635490 - RNA, 63 nt, hsa
gcagccaggaaggacaggcuuuccccuguauaucauaggaaacucagggacauuucaaguugc

SEQ ID NO: 635491 - RNA, 63 nt, hsa
agccugcaucccucccuuccuuucucuuacugccauaggaaauuauuuuagggguuggaggug

SEQ ID NO: 635492 - RNA, 63 nt, hsa
gacagucaaagagacaucucccucaauaaucgucauaggaaagacgugccaguuguggaggaa

SEQ ID NO: 635493 - RNA, 63 nt, hsa
cugcagcuuugggcucccccauagugacugugccauaggaaagcagccccuccucacacauac

SEQ ID NO: 635494 - RNA, 63 nt, hsa
uguugauggaaaccaucugugcuuagucucugacauaggaagcuugcuucaggcaauggcuuu

SEQ ID NO: 635495 - RNA, 63 nt, hsa
ucacaauuguugacuaaaaugcugcuuuuaaaacauaggaaaguagaaugguugagugcaaau

SEQ ID NO: 635496 - RNA, 63 nt, hsa
aaccugagaaaugcuaauggagauuugcugguacauaggaaucuagcaaauucaggaaccaag

SEQ ID NO: 635497 - RNA, 63 nt, hsa
guuugcacagucuuacuucuguagaacacuggccauaggaaaugcuguuuuuuuguacuggac

SEQ ID NO: 635498 - RNA, 56 nt, hsa; identical to SEQ ID NO: 635208

SEQ ID NO: 635499 - RNA, 63 nt, hsa
ccuugaaucuucucccuuguccugcuugggguucauaggaauugguaaggccucuggacuggc

SEQ ID NO: 635500 - RNA, 63 nt, hsa
auuagccuaguuuucucauacagucaucacaagcauaggaagauacuucaaaaccaaaaaaac

SEQ ID NO: 635501 - RNA, 63 nt, hsa
agcuggcgccaucgcuccggauuaguugguuuccauaggaaaggcaugcuuucagccagaugc

SEQ ID NO: 635502 - RNA, 63 nt, hsa
guuuguuacuuacgguucugagaggaggggccacauaggaaagccccacggugggucagaagg

SEQ ID NO: 635503 - RNA, 63 nt, hsa
cuaaguauaguugauguaacauuguagaagcagcauaggaacaauaagaacaauagguaaagc

SEQ ID NO: 635504 - RNA, 63 nt, hsa
uugcuuuguaauagagucuguaauaggauuucccauaggaagagaucugccagacgcgaacuc

SEQ ID NO: 635505 - RNA, 63 nt, hsa
acuucaaacacuggcaccuugggucucacccaccauaggaaacaagacaacauucaauuugau

SEQ ID NO: 635506 - RNA, 63 nt, hsa
uuugaguucucucuaacccagcuuacugugggacauaggaaaacucaguagaaauaccuuugg

SEQ ID NO: 635507 - RNA, 63 nt, hsa
guacuuuucauuuuggcucaccguggauuuucucauaggaaguuuggucagagugaauugaau

SEQ ID NO: 635508 - RNA, 63 nt, hsa
uuugaacugcagaccuguaugagaacccaaugucauaggaaauaugguuugcuaaaaucuaua

SEQ ID NO: 635509 - RNA, 63 nt, hsa
accauuucaaaacuguuucuucuauuccugguucauaggaaagaaaaaaguuauucaaaguau

SEQ ID NO: 635510 - RNA, 63 nt, hsa
uugagcccagaaguucgagacuagccugggaaacauaggaagcccucgucucuacaaaaaaaa

SEQ ID NO: 635511 - RNA, 63 nt, hsa
aucgcuacucuuaagaauauacauguauguauucauaggaacauuuuuucucaauauuuguau

SEQ ID NO: 635512 - RNA, 63 nt, hsa
uuaugagaacacauuuucacaguuauguuucuucauaggaaaacuauauuuagugggcaacaa

SEQ ID NO: 635513 - RNA, 63 nt, hsa
auuuugauaacuagcuuuccagguggacuuagccauaggaaaauauuacuaauguaauuuaac

SEQ ID NO: 635514 - RNA, 63 nt, hsa
aagaagcauauauggguuggaauuaugccaaagcauaggaagcugggaauaagcaaacaaaug

SEQ ID NO: 635515 - RNA, 63 nt, hsa
ccacuuaucagggccuggagcccugauggaagccauaggaacuccagaguugccaagccauag

SEQ ID NO: 635516 - RNA, 63 nt, hsa
ucaguggcuuuaugaaguaaaguuaaaaacaaacauaggaaaugugaaaauauuuguguuugu

SEQ ID NO: 635517 - RNA, 63 nt, hsa
acauaugaugugaaugccuacaaagccagugcgcauaggaacagugggccuggguaaagaguc

SEQ ID NO: 635518 - RNA, 63 nt, hsa
gaaguaaacccucacugugaaucagagaauucacauaggaaagaaaccagaugaagaugaaug

SEQ ID NO: 635519 - RNA, 63 nt, hsa
cacuuuaaacuucuauagaaaagauaucguguacauaggaacugguguagauaagcaugcaau

SEQ ID NO: 635520 - RNA, 63 nt, hsa
uuuuaaacuaccauaauuccauuuuuucccuuacauaggaaaacuguaaguuggaauuaucuu

SEQ ID NO: 635521 - RNA, 63 nt, hsa
cuuguaaaaauaacauaauaaauagaucuuaaacauaggaaaaccauacuguucugauaauaa

SEQ ID NO: 635522 - RNA, 63 nt, hsa
caaaacagcaugauacuggcauaacaacagacacauaggaacaguauagacaacccagaaaca

SEQ ID NO: 635523 - RNA, 63 nt, hsa
gaaaaccuaauggugcuucucccuuggaaaugccauaggaagcccacaaccgcuaacacuuac

SEQ ID NO: 635524 - RNA, 63 nt, hsa
gagccucugcccccaggcugggccugucacuggcauaggaaggccagccccgcaucucccacu

SEQ ID NO: 635525 - RNA, 63 nt, hsa
agggauccaagaucuuugcaguucaaucgaccacauaggaauuuccaggcaccaaaaugauau

SEQ ID NO: 635526 - RNA, 63 nt, hsa
ggaucuauaggcagcuucuaagagcgaacuucacauaggaagggaucugagaacacguugcca

SEQ ID NO: 635527 - RNA, 63 nt, hsa
cugacuuuagagagaguaaaaugugccaggagccauaggaauaucuguauguuggaugacuuu

SEQ ID NO: 635528 - RNA, 63 nt, hsa
acauuuuaaaauagaacuauccuuguucgauagcauaggaaaauguucuggugauugucaggg

SEQ ID NO: 635529 - RNA, 63 nt, hsa
guuaaauauuaaaaauuguguaaauacaauugacauaggaauuacauuaaaauauuaggaaga

SEQ ID NO: 635530 - RNA, 63 nt, hsa
acaauguauaauacauucacaucuagucaagggcauaggaacggugucauggaguccaaauaa

SEQ ID NO: 635531 - RNA, 63 nt, hsa
ccucuggucaccacaaugcuugaugccagcugccauaggaagagggugcuggcuggccauggu

SEQ ID NO: 635532 - RNA, 63 nt, hsa
caauugauccccaaccugccaggcuuccuaucucauaggaaacauccucauugauccucuuca

SEQ ID NO: 635533 - RNA, 63 nt, hsa
ccuccuaaaugccccauauuaaaagaacucauucauaggaagguguuucauuuuggugugcaa

SEQ ID NO: 635534 - RNA, 63 nt, hsa
cuguuagccaccauccaugcuaccuagguaguccauaggaaccacccccaugaccaccaccaa

SEQ ID NO: 635535 - RNA, 63 nt, hsa
cuccacaccagggcugugguccucccagacaugcauaggaauggccacagguuuacacugccu

SEQ ID NO: 635536 - RNA, 63 nt, hsa
ucuacucagaaauuuuuauuuuucuaagguucucauaggaaaaguacauuuaauacagcagug

SEQ ID NO: 635537 - RNA, 63 nt, hsa
aauauauuuaaaaaaccuuuuuuuauuguggagcauaggaauugccccccuccaggcuucacc

SEQ ID NO: 635538 - RNA, 63 nt, hsa
aaaagguuauggaagaaugguuuaugaacuucccauaggaagcaccugagagauaguaaacug

SEQ ID NO: 635539 - RNA, 63 nt, hsa
aaagccugucuccucacccacccccagcccuagcauaggaaaagcuuccuugaugugagcucu

SEQ ID NO: 635540 - RNA, 63 nt, hsa
ggacuagaugcauaccguuuugugaaaaccagccauaggaaaacaugugagcaacaaccccca

SEQ ID NO: 635541 - RNA, 63 nt, hsa
agacaugguuacuuuauuuuccccuuguuaagacauaggaagacuuaauuuuuaaacggucag

SEQ ID NO: 635542 - RNA, 63 nt, hsa
accccaaacucaggccgaaugaucaaggggacccauaggaaaucuuguccagagacaagacuu

SEQ ID NO: 635543 - RNA, 63 nt, hsa
gccagcuuucuucuguugaugccguucccugaacauaggaaaauagaaacuugcuuaucaaaa

SEQ ID NO: 635544 - RNA, 63 nt, hsa
uaaacaguuuagcccaucucuccagagagcaaacauaggaauaugacucaggagccuccuagg

SEQ ID NO: 635545 - RNA, 63 nt, hsa
gaagguuagguguuuuagguacauuccagcugucauaggaagaucacagaaaugaggaggcug

SEQ ID NO: 635546 - RNA, 63 nt, hsa
gguggauuccaugacauauauuguaauucuuuucauaggaaaugucauuacaguaugaauuau

SEQ ID NO: 635547 - RNA, 63 nt, hsa
gagaaggccuuuucugaagggauaucuaaaaagcauaggaaauccuugguucagagggaagug

SEQ ID NO: 635548 - RNA, 63 nt, hsa
auacugggcagguccaaaaggauaguuccaggccauaggaauggcuuggugcaguuaacgggu

SEQ ID NO: 635549 - RNA, 63 nt, hsa
ccacuuccccaggcuucucccuccccccacccccauaggaacaggauuuggccuuagcuucug

SEQ ID NO: 635550 - RNA, 63 nt, hsa
gguccaggcuccaguaggagagaaagaacuccucauaggaauacugaagaagugggaaggaac

SEQ ID NO: 635551 - RNA, 63 nt, hsa
gccauuuugucuuccauaggaaacugggaaucucauaggaagagccaggacaugaagaaaagg

SEQ ID NO: 635552 - RNA, 63 nt, hsa
uguccauuaagacucugauaauugucuccccuccauaggaauuucucccaggaaagaaauaua

SEQ ID NO: 635553 - RNA, 63 nt, hsa
uuguauaauauguaauuguagggaaacugcucucauaggaaaguuuucugcuuuuuaaauaca

SEQ ID NO: 635554 - RNA, 63 nt, hsa
gcauucuaggcucuauuuaacugagucacacugcauaggaauuuagaaccuaacuuuuauagg

SEQ ID NO: 635555 - RNA, 63 nt, hsa
auugaaaagauuuuaacaaguauaaaaaauucucauaggaauuaaauguagucucccuguguc

SEQ ID NO: 635556 - RNA, 63 nt, hsa
aguuguauauaauauuuaagaugcugaguauuucauaggaaagcugaaugcugcuguaaagug

SEQ ID NO: 635557 - RNA, 63 nt, hsa
agauauuugaauuaucuugauuggaauguuauucauaggaaauaacaggaagauuccaaagac

SEQ ID NO: 635558 - RNA, 63 nt, hsa
aaaggccacccuagaaagaaguccgcuggcacccauaggaaggggccucaggagcaggaaggg

SEQ ID NO: 635559 - RNA, 63 nt, hsa
uauagaguaauauuugagcuguguucaaaaauacauaggaaaagacugauaaaaugaaauaug

SEQ ID NO: 635560 - RNA, 63 nt, hsa
gccagcaaaccaggacucugccccuucuguuuccauaggaaucauguuggauagucagcugua

SEQ ID NO: 635561 - RNA, 63 nt, hsa
gaagguaacguguuccuagaaaagaaaaugcugcauaggaaaacugagaugccuuuuauucca

SEQ ID NO: 635562 - RNA, 63 nt, hsa
aucaguuauaaauauggugaauuuuuucuggaccauaggaauauuauuucaaagaaauauuac

SEQ ID NO: 635563 - RNA, 63 nt, hsa
uaccuauacuuugauacugaagacugccaaauacauaggaauuuucuuucuuaaaaaacagua

SEQ ID NO: 635564 - RNA, 63 nt, hsa
cugucucacuggcaucuuguugagggccuugcacauaggaaacuuuugauaaguaucugcgga

SEQ ID NO: 635565 - RNA, 63 nt, hsa
ccuccuuaaugugaaaaaucaagggcuuacugacauaggaacaacagaaaugcuccuggaacu

SEQ ID NO: 635566 - RNA, 63 nt, hsa
uucuguuuccaacagaaaagaaacauuuguuugcauaggaauucaugaaggcgacccaaccug

SEQ ID NO: 635567 - RNA, 63 nt, hsa
aacccuaggaaguagggagaaaugaaggaagggcauaggaaaauuuucccaguaaauccccug

SEQ ID NO: 635568 - RNA, 63 nt, hsa
augaauagaucaugaagucauaggcuuccaaggcauaggaagagaucuugcaggucuaguauu

SEQ ID NO: 635569 - RNA, 63 nt, hsa
aauaguguuccuaagauaucucuuaaauccucccauaggaaauagaauuacagguaagguaca

SEQ ID NO: 635570 - RNA, 63 nt, hsa
uaauuuuggguauacuugugguuaguuuugugccauaggaaaaaauuaucuuaaaacuuuggc

SEQ ID NO: 635571 - RNA, 63 nt, hsa
uucacgcgucugacagagcuggugcugcaggcccauaggaaggagcuggaaggccuccggaug

SEQ ID NO: 635572 - RNA, 63 nt, hsa
cuauuugcaccgaaaugucuuguuuuguugcgacauaggaaaauaaccaagcacaaaguuaua

SEQ ID NO: 635573 - RNA, 63 nt, hsa
cugccuauucuucaaccaccuugguuacuuugacauaggaauugacuucuuuuccuugaaugg

SEQ ID NO: 635574 - RNA, 63 nt, hsa
gaaggagauuuucuagcuccacaucugucugcacauaggaaggaaaagauaggacucuaaacc

SEQ ID NO: 635575 - RNA, 63 nt, hsa
aagagcccugggguccuguccugcaggaugcugcauaggaaugggcagagauguccuggaugg

SEQ ID NO: 635576 - RNA, 63 nt, hsa
auaauaaccaagacuuuucaagcuucuagaucucauaggaaagcuuguaauagcaaaauugua

SEQ ID NO: 635577 - RNA, 63 nt, hsa
ugcuguguaacaugaccuuaaauagucuuccugcauaggaagagcaaaaggguauucaucaau

SEQ ID NO: 635578 - RNA, 63 nt, hsa
ccagcucuggugagucuuggcggcagcagccaucauaggaagggaccaaggcaaggcaggugc

SEQ ID NO: 635579 - RNA, 63 nt, hsa
cugcaagaauuaaaacugaguccaugaaaauaccauaggaagacauaaaacuuuaaaaggcaa

SEQ ID NO: 635580 - RNA, 63 nt, hsa
uguaacacaguggugaguauuuguguuuacaaacauaggaaagguacaguaaaacuaugguau

SEQ ID NO: 635581 - RNA, 63 nt, hsa
ccugaugccaccuccucuguucuuggaacaacgcauaggaaaagaaucuccuuuggaagguga

SEQ ID NO: 635582 - RNA, 63 nt, hsa
aaauacguauguuuaaaaacccuuccugcuauacauaggaaaagacacacauccaccuaaaau

SEQ ID NO: 635583 - RNA, 63 nt, hsa; identical to SEQ ID NO: 635573

SEQ ID NO: 635584 - RNA, 63 nt, hsa
auaccuauucuucaaccaccucgguuacucugacauaggaauuuacuucuuuuccuugagugg

SEQ ID NO: 635585 - RNA, 63 nt, hsa
cacuccauaagugauccuaaaagguagccucuucauaggaacccaggaggacaaaaccaccau

SEQ ID NO: 635586 - RNA, 63 nt, hsa
ugagggggcuggaggcgaagggugggagcauagcauaggaacgcugcauagaccauggaggcc

SEQ ID NO: 635587 - RNA, 63 nt, hsa
aggggccuagauguagccucuguuccuccuggacauaggaaggucccaagcuuaguaucccac

SEQ ID NO: 635588 - RNA, 63 nt, hsa
acuggauuugccaacuagaauucgauuuccugucauaggaagcuccuuggaagaagggauggg

SEQ ID NO: 635589 - RNA, 63 nt, hsa
uuccacugggaagagacaggaauucuaccuacacauaggaaggccaagguugauccacuuaac

SEQ ID NO: 635590 - RNA, 63 nt, hsa
cuggaguggagagaguauuccugcugaaacgcgcauaggaagcuuuugucccugcuguuaaug

SEQ ID NO: 635591 - RNA, 63 nt, hsa
caggaaacuauuaaaauuggcucgaucaguagucauaggaauugguauaagaagagacucauu

SEQ ID NO: 635592 - RNA, 63 nt, hsa
uugugauacagcggucacuauuuucucuuaacacauaggaaaaaaguucagacaucgcuacaa

SEQ ID NO: 635593 - RNA, 63 nt, hsa
ucuggaagauaaccuaggcaauaccauucuggacauaggaacggaaaaagauuucaugacaaa

SEQ ID NO: 635594 - RNA, 63 nt, hsa
cugucuggaaccagugaaugcauuagaaccuuccauaggaaaagaaaaggggcugaguuccau

SEQ ID NO: 635595 - RNA, 63 nt, hsa
gcugcccccagguauuuacuguggagaacauugcauaggaaugucuggaaaaagccucuacaa

SEQ ID NO: 635596 - RNA, 63 nt, hsa
ccauuauuagccaugaagggaauaucuuugucacauaggaauuguucagcaacagaaagauac

SEQ ID NO: 635597 - RNA, 63 nt, hsa
uuuguaaauuuaugugauggcaaagaaggagagcauaggaaaccacacagacuugggcagggu

SEQ ID NO: 635598 - RNA, 63 nt, hsa
uccucucaagggcauucugggcuuguaaacagacauaggaagccucuguuuacccugaagcac

SEQ ID NO: 635599 - RNA, 63 nt, hsa
ggcaccugccaauagcuuugucaaucacagccccauaggaacgucuggaauugcuugggaguu

SEQ ID NO: 635600 - RNA, 63 nt, hsa
uauuauauuuuuuuuugguaaaaaagaaauguccauaggaaacaaauucccgugucuuaaaac

SEQ ID NO: 635601 - RNA, 63 nt, hsa
uaaggggccuugcucugagcacaggugacagaucauaggaaguggcuggucuggagucccacc

SEQ ID NO: 635602 - RNA, 63 nt, hsa
cacugaccucagggccgaaggggaggugguguacauaggaacgcguugcggaguccgccccgu

SEQ ID NO: 635603 - RNA, 63 nt, hsa
ccugagaagacagacugagcagggcagcaccuccauaggaagccuuccuuucuggccaaggug

SEQ ID NO: 635604 - RNA, 63 nt, hsa
aagauguucuagaauguagauaccuuguccagccauaggaaucaaaauaaaaaacuaaaaaag

SEQ ID NO: 635605 - RNA, 63 nt, hsa
caauuauucuuucauuuuauaaugcaacuuuuucauaggaaguccggaugggaauauucacau

SEQ ID NO: 635606 - RNA, 63 nt, hsa
cggguuuuauaaauaaauauauauauauauguacauaggaaaaaccaaauauacauacuuauu

SEQ ID NO: 635607 - RNA, 63 nt, hsa
cccuccacccuugguggggaggggacccaggaccauaggaagguccugaguccaccuccuggu

SEQ ID NO: 635608 - RNA, 63 nt, hsa
uauuuuaggaggguuuaaauaggguucagagaucauaggaauauuaggaguuaccucucugug

SEQ ID NO: 635609 - RNA, 63 nt, hsa
cuccuucugauuuugccugucuuauauaaugagcauaggaaaauuuuggaaugaggcagaaaa

SEQ ID NO: 635610 - RNA, 63 nt, hsa
uguauggauuuuuuuguuaucuucacuuuacugcauaggaaacaaucuaccucaucauuuaaa

SEQ ID NO: 635611 - RNA, 63 nt, hsa
agaagguggggucuuggauaucaccuaaguuuacauaggaaugaaauauguaacccagaacaa

SEQ ID NO: 635612 - RNA, 63 nt, hsa
uaaaugcucccugucccauggagagggacccagcauaggaaagccacauacucagccuggaug

SEQ ID NO: 635613 - RNA, 63 nt, hsa
acuauuccccaacagauauuguggcaaaucacacauaggaaagagaauuugggaauacaguag

SEQ ID NO: 635614 - RNA, 63 nt, hsa
aauuaucuaaagaaucauugucuuucagagacucauaggaaaaaaaaacuaggaaaaguguca

SEQ ID NO: 635615 - RNA, 63 nt, hsa
aaaguagaaagugcuugguauuucugucuuauacauaggaaaacauuuaaaauaaauaguuuu

SEQ ID NO: 635616 - RNA, 63 nt, hsa
aggcaugaaauagugauuauaucuguggaaaagcauaggaaggcauucuccuuuuucauuuuu

SEQ ID NO: 635617 - RNA, 63 nt, hsa
cgaaggacagcgaugggaaaaaugcccuuaaaucauaggaaaguauuuuuuuaagcuaccaau

SEQ ID NO: 635618 - RNA, 63 nt, hsa
caucaggguccccagccucugggcuccuguuuccauaggaaggggcgacaccuuccucccagg

SEQ ID NO: 635619 - RNA, 63 nt, hsa
gcaaauagauuaaacacaaaaauaaaacuaaagcauaggaauuauguuuuugagauaccuuug

SEQ ID NO: 635620 - RNA, 63 nt, hsa
agguagggggacuguucuagccagcuguggacacauaggaaugcuggaccaggguaccagauu

SEQ ID NO: 635621 - RNA, 63 nt, hsa
ggcuccucccccacucaagcaauagggccccgccauaggaagacccccagagagagggucagc

SEQ ID NO: 635622 - RNA, 63 nt, hsa
gcagcaguccaggugccacaggcagcccugggacauaggaagcugggagcaaggaaagggucu

SEQ ID NO: 635623 - RNA, 63 nt, hsa
cacuggauaaacccacuccacaugugcuggggacauaggaagaccuuaagccauagcucaucc

SEQ ID NO: 635624 - RNA, 63 nt, hsa
cugacaggauugagagauuaaaguaaagacaggcauaggaaaucacaaggguauugacugggg

SEQ ID NO: 635625 - RNA, 63 nt, hsa
ugauacaacauauuccccccaaaaaaacacauacauaggaacugguuauauuccaccauaaca

SEQ ID NO: 635626 - RNA, 63 nt, hsa
gggaaucccuuuugcuucaugcucacaacuaagcauaggaaguuuuauuuaaaggaaagaaua

SEQ ID NO: 635627 - RNA, 63 nt, hsa
uuagaacucuuccuuugcgaauuuuauguugagcauaggaaguacauucuagaggaaagguuu

SEQ ID NO: 635628 - RNA, 63 nt, hsa
ggagaaacugaugauuuuacauuuucuagucugcauaggaagggaacaccuggacgugugaua

SEQ ID NO: 635629 - RNA, 63 nt, hsa
cuauccaucugagagccaacacaggagaaaaaccauaggaaagugacauguaggagggcuaua

SEQ ID NO: 635630 - RNA, 63 nt, hsa
auuacuccuggaccacaacuguaggugaggauucauaggaagaguagaacucagucucuaguu

SEQ ID NO: 635631 - RNA, 63 nt, hsa
auccguguuccagcaucuaaccuuuuacuuuugcauaggaaauacuugauuuaauuacagguc

SEQ ID NO: 635632 - RNA, 63 nt, hsa
ugggcagcaggcaucauuuuccuuuucuagcuucauaggaauauugugagcucaccaugcugu

SEQ ID NO: 635633 - RNA, 63 nt, hsa
ugugguuuuuguguuuuuuuuuuuuucuuuuuccauaggaaagaauauauaaauuuguaaauc

SEQ ID NO: 635634 - RNA, 63 nt, hsa
gaauuaaaaauaacacagucuuuuuaaaacuaacauaggaaagccuuuccuauuauuucucuu

SEQ ID NO: 635635 - RNA, 63 nt, hsa
gccaaaguaaacuguguaggggagccacauuuacauaggaaccaaaucaaugaauuuaggggu

SEQ ID NO: 635636 - RNA, 63 nt, hsa
gcaccccuacucguuccuauagaacacagaggacauaggaaacccuuaaaacacacaugggau

SEQ ID NO: 635637 - RNA, 63 nt, hsa
ccaacagccagcccuucauccuccagcgucugccauaggaaugugagagggguguuugcugag

SEQ ID NO: 635638 - RNA, 63 nt, hsa
ugucuucuuuugaggaugaucagagaacuugggcauaggaacaaucuggcagaaguuuccaga

SEQ ID NO: 635639 - RNA, 63 nt, hsa
aaugugucagggaauagaugugaaacaagggaucauaggaaaaggggaaagagaaaugaucug

SEQ ID NO: 635640 - RNA, 63 nt, hsa
cuauagcaaguguugcuguaaaguguuuuucuccauaggaagugugaacuguguauugucuau

SEQ ID NO: 635641 - RNA, 63 nt, hsa
cggugaucaaaacgcuccaucuuuuuacaguggcauaggaagacggcaaaaauuuccuaaagu

SEQ ID NO: 635642 - RNA, 63 nt, hsa
aaacucuuuaacuuguaauaaacccuuaacuggcauaggaaaugguauccagaauggaauuuu

SEQ ID NO: 635643 - RNA, 63 nt, hsa
cuccaugccaaguaacagcagagggaguuaagccauaggaauuuggcuguggaguaagaggga

SEQ ID NO: 635644 - RNA, 63 nt, hsa
aaaauguaacuguuaccauuggaaauuucacgucauaggaaguuagccuuuaucuaccaacuu

SEQ ID NO: 635645 - RNA, 63 nt, hsa
acauauaugccaucuguccucaaguguuaucuacauaggaaauaaaauggaauugauguaaag

SEQ ID NO: 635646 - RNA, 63 nt, hsa
acauauaaacaugaaauaaacagugccaguauucauaggaaagugagaaacuguaauauuugg

SEQ ID NO: 635647 - RNA, 63 nt, hsa
ccugcaucaccacaguguauaugcaauucuaugcauaggaagagccuuuagagaaagcauuug

SEQ ID NO: 635648 - RNA, 63 nt, hsa
gaaugucaaugaguaauucauuauuauccaaagcauaggaaggcucuauguuuguauauuucu

SEQ ID NO: 635649 - RNA, 63 nt, hsa
cagcaggaaccuaaaauaucugccaucaucugccauaggaaagauacccagagacccaucaug

SEQ ID NO: 635650 - RNA, 63 nt, hsa
cucugcuucuaaaaacuucuaugucuagucuuccauaggaaauccucacuguuuaaccaugug

SEQ ID NO: 635651 - RNA, 63 nt, hsa
cccgcuucugcguuuuguuauuccuacugccgccauaggaauuauuucguuggcugaacguua

SEQ ID NO: 635652 - RNA, 64 nt, hsa
accugaccugcugaauuguuuauaauggcaagaaauaggaaaccccccaaugucuguugaacag

SEQ ID NO: 635653 - RNA, 64 nt, hsa
cggccucacccaggcaucugcuuuacucuggaccauaggaaacaagaccguuuggagguuucau

SEQ ID NO: 635654 - RNA, 64 nt, hsa
aucuuuagugucugagcuucucaaauuagcugcaauaggaaaaaaacaaauugggaaaugaaaa

SEQ ID NO: 635655 - RNA, 64 nt, hsa
uuuuuguuuuuuuaaaggaaacuauuugugggcuauaggaaacuuucugaugccuccggauugu

SEQ ID NO: 635656 - RNA, 64 nt, hsa
uucuauaggcaaagaaagcucuagacagauuggaauaggaaauggauauuugccuuuuagcuac

SEQ ID NO: 635657 - RNA, 64 nt, hsa
uugcagcaucuuuucuaguugaaauggugaacugauaggaaaacaaaugaguagaaagaguuca

SEQ ID NO: 635658 - RNA, 64 nt, hsa
acaguuuucucuucauauauuaugauuaugaauaauaggaaaguuguauuaauucaguauuugu

SEQ ID NO: 635659 - RNA, 64 nt, hsa
uauaucuuuaaaauuuuccuuuauguuccauuccauaggaaaacacacauaugcacacaaaacu

SEQ ID NO: 635660 - RNA, 64 nt, hsa
uaucagaaauuagggaagguaguccugcuuuauaauaggaaaauguauuucuguauaagaguuc

SEQ ID NO: 635661 - RNA, 64 nt, hsa
auuguaauuuugaugauacaaagauugaaagaucauaggaaagcauugcccuucaucacagaag

SEQ ID NO: 635662 - RNA, 64 nt, hsa
ggaagcagacacaacccaaacauuugcuacuaacauaggaaacacacacauacagacaccccca

SEQ ID NO: 635663 - RNA, 64 nt, hsa
agugcgagcacacacccacuauacaagaguggcuauaggaaaaaagaaaguguaucuauccuuu

SEQ ID NO: 635664 - RNA, 64 nt, hsa
auugugcauaaugcuuuggaaaaaugggucuuuuauaggaaaaaaacugggauaacugauuucu

SEQ ID NO: 635665 - RNA, 64 nt, hsa
caaaaauucacuaguugagaugguuuguuuuaggauaggaaaugaaauugccucucagugacag

SEQ ID NO: 635666 - RNA, 64 nt, hsa
uugugguggugguaguggaaggggauaauuguaaauaggaaacaugaauguucauuuuuuucuu

SEQ ID NO: 635667 - RNA, 64 nt, hsa
uugagugucugugucuuagaccugcaaacagcuaauaggaaauucuauuaauauguuagcuugc

SEQ ID NO: 635668 - RNA, 64 nt, hsa
auccccaugacuacauaauccaucaucguaggaaauaggaaagcaaauuugauuuugguuuugu

SEQ ID NO: 635669 - RNA, 64 nt, hsa
uauggagcaccaaagcauuuggauaaagaccguuauaggaaaugggggggaaauggcuaaaaga

SEQ ID NO: 635670 - RNA, 64 nt, hsa
uacuggcuagaaguuuggauggauuauuuacaauauaggaaagaaagccaagauuuagguaaug

SEQ ID NO: 635671 - RNA, 64 nt, hsa
cugcugggcuauuuucagcugaggaggggugaauauaggaaaaaugcauuuuugaaacguuugc

SEQ ID NO: 635672 - RNA, 64 nt, hsa
uuucuuugauuaaacagaacaaauuacuugaguaauaggaaauuaggaggaucuagggacagaa

SEQ ID NO: 635673 - RNA, 64 nt, hsa
ccuuuugugaaggccgaacucgagcuguauccucauaggaaacagugaucaccccggacgggcg

SEQ ID NO: 635674 - RNA, 64 nt, hsa
gugcauaguaaugacacagcaccauuccugagaaauaggaaauauaugugugugguaugaaaag

SEQ ID NO: 635675 - RNA, 64 nt, hsa
cccacgucuuccagcugggggaugggggggagucauaggaaaagcccccaucucccaucuggga

SEQ ID NO: 635676 - RNA, 55 nt, hsa
cuuucagagugaaaaaguaaauuuuauaggaaaaaaggguaucaugaugaaauuc

SEQ ID NO: 635677 - RNA, 64 nt, hsa
aggguucuccucaaagccucacaaccauaggaucauaggaaaggggcccuauuuuccugcugcu

SEQ ID NO: 635678 - RNA, 64 nt, hsa
ggaugucuuuggggguuuugcuaaguguaucuugauaggaaacaacaaaagcagguugagaugg

SEQ ID NO: 635679 - RNA, 64 nt, hsa
cacagucgaggaaaauugauaccugcaguaacccauaggaaauaaacuguagaguuccauauuc

SEQ ID NO: 635680 - RNA, 64 nt, hsa
auaacugaaaaacucuuaaauauuuagcaaucaaauaggaaaugaauguggacuuacuaaaugg

SEQ ID NO: 635681 - RNA, 64 nt, hsa
uuacaaucuuauauuaaacugguauuuucaaacaauaggaaacuuuuuuuuuuuuuuuuuuuuu

SEQ ID NO: 635682 - RNA, 64 nt, hsa
cggcaagacagugccuauacugccucuacaguuaauaggaaaaacggaagaaguuacccuuaag

SEQ ID NO: 635683 - RNA, 64 nt, hsa
aaauaaaugauccuggggaaaaagcaucugucaaauaggaaacaucacaaaacugagcacucuu

SEQ ID NO: 635684 - RNA, 64 nt, hsa
agcuaucccuacagaagauaauguguaacuuuuuauaggaaaagugugguuuuacuauuuuugc

SEQ ID NO: 635685 - RNA, 64 nt, hsa
cacacacucccuguaguccagguagggcccagaaauaggaaaggcuaggauuggauaaugcugc

SEQ ID NO: 635686 - RNA, 64 nt, hsa
gguaucucuuaggcaaauagagauauaaauuguaauaggaaacagucucuaaaugugaggcuga

SEQ ID NO: 635687 - RNA, 64 nt, hsa
auaaaugcaauuuacucaaguagcaauuuaagaaauaggaaagucaucuaugaauucaucauga

SEQ ID NO: 635688 - RNA, 64 nt, hsa
cggccuccgauugguggcgcauaggguguaaccaauaggaaaccccuaaaggguacuuaaaccc

SEQ ID NO: 635689 - RNA, 64 nt, hsa
aacaguaacaacaaaaaaauauauagcgacuugaauaggaaaccauaguauuucauuguuuuaa

SEQ ID NO: 635690 - RNA, 64 nt, hsa
uggggcaacuuugugaacacguaggcacuuagucauaggaaacauauuaugugcagguccuagc

SEQ ID NO: 635691 - RNA, 64 nt, hsa
gcuguguccaccuucugugagcuacuuaagguauauaggaaaggaguggucacaaacuugcauc

SEQ ID NO: 635692 - RNA, 64 nt, hsa
cucucagcauuacaaaagaguaaguaucucacaaauaggaaauaaaacuaaaacguggauuuaa

SEQ ID NO: 635693 - RNA, 64 nt, hsa
gaaagagugcauuagucugaagaguauacauuggauaggaaagaauuuccuucuuuuguuucuc

SEQ ID NO: 635694 - RNA, 64 nt, hsa
uagccguguuuacuuguauuaacuuacaguuaacauaggaaaaauacaaguaaggaugugagaa

SEQ ID NO: 635695 - RNA, 64 nt, hsa
guugcaaaagaugguauagccgaauauaauggaaauaggaaaaauuagucgaaaauaaagguug

SEQ ID NO: 635696 - RNA, 64 nt, hsa
uuucaaacuauuuagauaaccacuugaugcacaaauaggaaaaagcagauuguggcagugucgc

SEQ ID NO: 635697 - RNA, 64 nt, hsa
gacacauuuuguaaauaacuuuuuguuaaaauucauaggaaauguuauuuugugggggggggau

SEQ ID NO: 635698 - RNA, 64 nt, hsa
ggacaacauacuuuacgcaaugaacaguaguuaaauaggaaauaaacuaguuccauauaaguau

SEQ ID NO: 635699 - RNA, 64 nt, hsa
gugccaaaugaaacuuuuuuccuaaguaacuguaauaggaaaaaguuuauuuugagaguuucuu

SEQ ID NO: 635700 - RNA, 64 nt, hsa
cuucacgaagacugcugauaacuaucugugauugauaggaaauuuuuuuucuugauuucucugu

SEQ ID NO: 635701 - RNA, 64 nt, hsa
uaucauuguuuaauaaaaguaaucccugcuggucauaggaaaacacacgguucuaauuaagugu

SEQ ID NO: 635702 - RNA, 64 nt, hsa
gaacucacagcucuguguguguguguucaggcugauaggaaauucaaagagucuccugccagca

SEQ ID NO: 635703 - RNA, 64 nt, hsa
gauuauguauuggcauuuauuuaugugcaaggugauaggaaaacugaauccaucuuuguagaag

SEQ ID NO: 635704 - RNA, 64 nt, hsa
aaaacaaacucuacuaauuuuuagauauucauuaauaggaaagauuuaauguuacagcaucuac

SEQ ID NO: 635705 - RNA, 64 nt, hsa
caaaacuuggugaauagucccagugcuaggucauauaggaaacagaaagcaugacaguggccuu

SEQ ID NO: 635706 - RNA, 64 nt, hsa
auacagaaucucauugcuuuugcacauggagcauauaggaaacuccaaacagaucacaaugagg

SEQ ID NO: 635707 - RNA, 64 nt, hsa
ucccaaaagcuuagcuauguauaaagugccacagauaggaaacagcuguuaauuacaaagagaa

SEQ ID NO: 635708 - RNA, 64 nt, hsa
aauuuauaaaaaauaauuacacagaaaaaauggaauaggaaaaauuaugcaucuagcacauuua

SEQ ID NO: 635709 - RNA, 64 nt, hsa
aaagcaauacauaauuuagggaaaauuggaaaauauaggaaacuuuaaacgagaaaaugaaacc

SEQ ID NO: 635710 - RNA, 64 nt, hsa
aauacuugauuguaaacuaaauucaagaucauuuauaggaaaaucuaguuucacagcuauuuga

SEQ ID NO: 635711 - RNA, 64 nt, hsa
aguuucgggggaccacccuggucuggccuuguauauaggaaaugcugcugaacugaauagaaag

SEQ ID NO: 635712 - RNA, 64 nt, hsa
uagacuucagaaguguggaaaucuucggguuucuauaggaaacuaguuuuuuuuuuuuaagaaa

SEQ ID NO: 635713 - RNA, 64 nt, hsa
uuuuucacuccuguccagucuauuuauuauucaaauaggaaaaauuacuuuacagguuguuuua

SEQ ID NO: 635714 - RNA, 64 nt, hsa
uuuuguuuuguuuuuggugaggaaaaggugguaaauaggaaaccaugaaugggaaggauggcaa

SEQ ID NO: 635715 - RNA, 64 nt, hsa
gcauauuacucauaaaucauuaauuaauauaagcauaggaaauggucuuaaaagauacugcauu

SEQ ID NO: 635716 - RNA, 58 nt, hsa
cuggggaaagugaagcaugaagggaaucauaggaaaaauguacugaucauauaauuaa

SEQ ID NO: 635717 - RNA, 64 nt, hsa
uaagguauuuuaugcacagaauacacuuagauugauaggaaagaacucguaauggaguuugagu

SEQ ID NO: 635718 - RNA, 64 nt, hsa
ggcagcccccaucugcucaauaucacugcucuggauaggaaaugaccgccaucuccagccggcc

SEQ ID NO: 635719 - RNA, 64 nt, hsa
cuggcaucaguuugcuacagugagcucagaucaaauaggaaaauacuugaaaugcaugucucaa

SEQ ID NO: 635720 - RNA, 64 nt, hsa
aacuuuuuaaaaguuuggauguauagagggauaaauaggaaauauaagaauugguuauuugggg

SEQ ID NO: 635721 - RNA, 64 nt, hsa
gguacuaagcacagaaacucacuauauaagucacauaggaaacuugaaaggucugaggaugaug

SEQ ID NO: 635722 - RNA, 64 nt, hsa
uggggaaagguuuaagauuauauaguacuuaaauauaggaaaaugcacacucauguugauuccu

SEQ ID NO: 635723 - RNA, 64 nt, hsa
uuugagugguuccucagagaccuacuacccugguauaggaaagaauccauuugaagacaauguu

SEQ ID NO: 635724 - RNA, 64 nt, hsa
ucucaggcacuucaaaacuaaaaccaaauuuagcauaggaaaaaguuguuuaaugcucagggca

SEQ ID NO: 635725 - RNA, 64 nt, hsa
ccucugaaggugauuuuguaauuugcaaaaggguauaggaaaauauaccuaaaagcgaauuugu

SEQ ID NO: 635726 - RNA, 64 nt, hsa
guaggguucaggugagcaaaaagaaaguggagcuauaggaaaugccaggccuuugaggugcucu

SEQ ID NO: 635727 - RNA, 64 nt, hsa
uguagaccagcacuacaaagaucgcauagaucaaauaggaaaaaaaaugucgauuuuuauucag

SEQ ID NO: 635728 - RNA, 64 nt, hsa
uguauguauguauauaaauacauagauuaaggaaauaggaaacugaaacucuguggaauauaaa

SEQ ID NO: 635729 - RNA, 64 nt, hsa
uguauauaauuaguuuauauuuacacacuagcauauaggaaauauuucugcacuugacccuauu

SEQ ID NO: 635730 - RNA, 64 nt, hsa
gauuggaauuagaccauuuggccuuugaacuuucauaggaaaaaugacccaacauuucuuagca

SEQ ID NO: 635731 - RNA, 64 nt, hsa
acgauaaaaauuguauguguacuuucaugccaguauaggaaaccucaaucuuuuuuuuuuuucg

SEQ ID NO: 635732 - RNA, 64 nt, hsa
agaaaagauuuaagcaccuugucaagcuggguaaauaggaaaaauacauaaucaugcucagaua

SEQ ID NO: 635733 - RNA, 64 nt, hsa
aaaugaagugauucuaagauuugguuugggaucaauaggaaagcauaugcagccaaccaagaug

SEQ ID NO: 635734 - RNA, 64 nt, hsa
auaauuggaaauuuucuauaaugguaagauguuuauaggaaaguaaugguaguucauguuugag

SEQ ID NO: 635735 - RNA, 64 nt, hsa
acucuauaauacagugggcuucuggauggauuuuauaggaaaaaauaaacaggucaaugaauga

SEQ ID NO: 635736 - RNA, 64 nt, hsa
uguucagccuauaagacgaagucucacaagaccuauaggaaaguuuaccaucugccuuaaauau

SEQ ID NO: 635737 - RNA, 64 nt, hsa
gcucuguucuccaagaggacccggaaguaaucacauaggaaaugauaaggaagaccaggaggag

SEQ ID NO: 635738 - RNA, 64 nt, hsa
ugguuuuuggcauguugggucaagacguguuucuauaggaaaugcuugcacguggcacuggcuu

SEQ ID NO: 635739 - RNA, 64 nt, hsa
agacuacccagccagugaagugcagaggauagacauaggaaaacauuccaggcauuuggagaca

SEQ ID NO: 635740 - RNA, 64 nt, hsa
uugaaaacacaugagauugaaucaacaugcuuuaauaggaaaagauguauggucuauauaugua

SEQ ID NO: 635741 - RNA, 64 nt, hsa
gacccaauugcuugcccccaugaggcuagcacuaauaggaaacccuuuuuuguugucauuuaau

SEQ ID NO: 635742 - RNA, 64 nt, hsa
ccagaggagauauuaucuguccucuguguggcacauaggaaaaugugagaccuagaauuauagc

SEQ ID NO: 635743 - RNA, 64 nt, hsa
acauacaauccaaaauuuaaaaaaauauuuuugcauaggaaaaauugagaaggaaguaaaccaa

SEQ ID NO: 635744 - RNA, 64 nt, hsa
gucaaaacaaaaacuuuacugaaaauggacagaaauaggaaauggacuuuuuccuuacugucua

SEQ ID NO: 635745 - RNA, 64 nt, hsa
caaguaguuugaugagacagucugugacuucaugauaggaaagaggaggaugaggucugggguu

SEQ ID NO: 635746 - RNA, 64 nt, hsa
guuucuccagucuccccagucuguuggugucuuuauaggaaacuauaaagcagagcaguggugu

SEQ ID NO: 635747 - RNA, 64 nt, hsa
aguauguuuguaacuauggcaaugaagucaguagauaggaaaccaguuauuccuucuaccuuua

SEQ ID NO: 635748 - RNA, 64 nt, hsa
acacauugaaaacuggacuggguauaacuauguuauaggaaaguagaaauuguauucuuuauuu

SEQ ID NO: 635749 - RNA, 64 nt, hsa
auuacggcuuuuacagcaacaauacgauuaucuuauaggaaaaaaaaaaucauuguaaaguauc

SEQ ID NO: 635750 - RNA, 64 nt, hsa
gcccauaauugaaauaaauuucugauugaaagguauaggaaacauuaaaaugcauuacuaagag

SEQ ID NO: 635751 - RNA, 64 nt, hsa
ccaggaggauucuuccugauucaaagacugucaaauaggaaaaaagaaaacaguaaaugaacaa

SEQ ID NO: 635752 - RNA, 64 nt, hsa
aaauguacaaaacaugaaaauuaaaaugaacaauauaggaaaauaauuguaacaggcauaagug

SEQ ID NO: 635753 - RNA, 64 nt, hsa
uguuugcaaacauuugccauguugaagaguguguauaggaaaggucuagaaauaaauaggcuug

SEQ ID NO: 635754 - RNA, 64 nt, hsa
uaguauauguaacauuaaaaaaaaguugcuggcuauaggaaauguuauuuuguuuucaaaauau

SEQ ID NO: 635755 - RNA, 64 nt, hsa
uauauucaggguauccgguauuuuguaauagggaauaggaaaccuuguuggcuguggaauaucc

SEQ ID NO: 635756 - RNA, 64 nt, hsa
cauuugggaaagaaaaagaaauaaauguauccagauaggaaaagaagaaguaaaacuauuugca

SEQ ID NO: 635757 - RNA, 64 nt, hsa
caagcaggcugcucccagagguggggaacccuucauaggaaauccccacccccguccaccccag

SEQ ID NO: 635758 - RNA, 64 nt, hsa
cuaacuuuucaaaaacuaacauuaaaugucaauuauaggaaaacauaguuggaaauguaaucau

SEQ ID NO: 635759 - RNA, 64 nt, hsa
guacuauuugauccucauuguguucaggcaaaaaauaggaaaugaguaauuuugaguuugaaau

SEQ ID NO: 635760 - RNA, 64 nt, hsa
cuagcacauacuacaucuaagaggcuaaacucugauaggaaaagcacuuuaaacauaauuaaaa

SEQ ID NO: 635761 - RNA, 64 nt, hsa
ggugucuccuaagaacugugccucggguuuuucaauaggaaaauaaggugagacucuuccaugg

SEQ ID NO: 635762 - RNA, 64 nt, hsa
aaugucauguauaaaauaugaauaaaauguccacauaggaaauuaacacauauauaccuucucu

SEQ ID NO: 635763 - RNA, 64 nt, hsa
cuguuaaaaguguggccacugagcauuugauuuuauaggaaaaaauaguauuuuugagaauaac

SEQ ID NO: 635764 - RNA, 64 nt, hsa
gcacugauggcccugaagaagcggauccagucacauaggaaaggaggcuguguuagugaaagca

SEQ ID NO: 635765 - RNA, 64 nt, hsa
uugcuuuguuuccuuuuuuagaaaguucuagaaaauaggaaaacgaaaaauuucauugagauga

SEQ ID NO: 635766 - RNA, 64 nt, hsa
cuauguauuuccuauaaugaugucugauauuuaaauaggaaaucagacaaacaauauucagaaa

SEQ ID NO: 635767 - RNA, 64 nt, hsa
aacaaagauaauauacuuucgaugaaaguaaauuauaggaaaaaaauuaacuguuuuaaaaaga

SEQ ID NO: 635768 - RNA, 64 nt, hsa
cuaaauaauuucagggguaggggagauguugucaauaggaaaugggauaaaauaucaagagaca

SEQ ID NO: 635769 - RNA, 64 nt, hsa
uccaguguuuuuaagagaauguuucuuaaaaccaauaggaaacuuaagcgagguuucaugacac

SEQ ID NO: 635770 - RNA, 64 nt, hsa
uauuucauuaugauugaaaaacauaaaaacuaacauaggaaagugaaugaucaguuacuuauga

SEQ ID NO: 635771 - RNA, 64 nt, hsa
uaaaauuugugaggugauuuugaaucuuguccauauaggaaaaugaagcacagaauuacucagu

SEQ ID NO: 635772 - RNA, 64 nt, hsa
uguaauauauccugaaagcauuauuuuuuguugaauaggaaauaaaauuaaugaagacagaggc

SEQ ID NO: 635773 - RNA, 64 nt, hsa
guauccuguuguucuuacucacucuucucauaaaauaggaaauauuuuaguucuguuucuuggg

SEQ ID NO: 635774 - RNA, 64 nt, hsa
acuguuaauguuuguucacaaauucagaaaucuaauaggaaaacaugauacuuucaaugugcca

SEQ ID NO: 635775 - RNA, 64 nt, hsa
uagucuaucugcaauuacucaacgaggcauuuucauaggaaacagacuaugauuaauccauuua

SEQ ID NO: 635776 - RNA, 64 nt, hsa
guacaaggucugaaaugacaagggcaagagugagauaggaaacugugugugaaaggaaagcccu

SEQ ID NO: 635777 - RNA, 64 nt, hsa
auuauuuaaccaguuacuuccaccuggacauacgauaggaaauucaaacucaaaauaugaaaau

SEQ ID NO: 635778 - RNA, 64 nt, hsa
guaagauuccuuuugugaaaaguuugguaaugggauaggaaaaaaagauuuccaagaaaguaaa

SEQ ID NO: 635779 - RNA, 64 nt, hsa
uaagccucaaaugcuagcacuuuuuggcaguuggauaggaaaugagacauucuuuggcagccaa

SEQ ID NO: 635780 - RNA, 64 nt, hsa
aaauaacauuugcuguuuuauagguuugaagaacauaggaaaaacuaagagguuuuguuuuuau

SEQ ID NO: 635781 - RNA, 64 nt, hsa
aaauaaugugaaguguuuuuuauaucagauuaauauaggaaauguuuauucuugaaaaauacuc

SEQ ID NO: 635782 - RNA, 55 nt, hsa
uuuauuuucaguuuauuuagauuugauaggaaaauuaaagcuaacugaaagacuu

SEQ ID NO: 635783 - RNA, 64 nt, hsa
uuugagaagaaagggucucuugaccuguauuaacauaggaaaguaaaguucuuuuuguuuuucu

SEQ ID NO: 635784 - RNA, 64 nt, hsa
gcaguaagucuuuuuugaucauucccuuuuccauauaggaaacauaauuuugaaguggccagau

SEQ ID NO: 635785 - RNA, 64 nt, hsa
ccuaaccuuaauuauucuguaagaacaugcuuccauaggaaauaguggauaauuuucagcuauu

SEQ ID NO: 635786 - RNA, 64 nt, hsa
uuaauggcuucacuugaauuuaaaccagcucuagauaggaaaaaaaucagucuccucauuugcu

SEQ ID NO: 635787 - RNA, 64 nt, hsa
uggaaauacacuguuaucuucacuuuuauaagaaauaggaaauauuuuaauguuucuuggggaa

SEQ ID NO: 635788 - RNA, 64 nt, hsa
uguauaaaaauguauuggcucuuuuaucaucagaauaggaaaaauugucauggauucaaguuau

SEQ ID NO: 635789 - RNA, 64 nt, hsa
uuucaaguauacuaagaguaaagcaacucaaguuauaggaaaggaagcagauaccuugcaaagc

SEQ ID NO: 635790 - RNA, 64 nt, hsa
guguguaguuacuuaaagguuauuccucuuuguaauaggaaacuauaugggaugaacacuuuua

SEQ ID NO: 635791 - RNA, 64 nt, hsa
ucuuccauugagugaaugaugaauaccugugaggauaggaaauuaguucugagaucuagucccu

SEQ ID NO: 635792 - RNA, 64 nt, hsa
agacuaaucaaaggcaaacaaaggcuauuaacacauaggaaaaaauguauuuacuaagugucac

SEQ ID NO: 635793 - RNA, 64 nt, hsa
auauuucccaauacauaccacuuugaauaggaugauaggaaauaaaugauguacuacauuaaau

SEQ ID NO: 635794 - RNA, 64 nt, hsa
ucuacuuucuacuagccccaauaguugaacucuuauaggaaaaucgaaagauaaagugaaaguu

SEQ ID NO: 635795 - RNA, 64 nt, hsa
uuuucacaguggggaaguggguuacaauauuggaauaggaaaauuugaugcuguaauuuggguc

SEQ ID NO: 635796 - RNA, 64 nt, hsa
uauuaauguggauuuuaaaauuguaagcaauagaauaggaaauaaaacaacuaccuaauacaaa

SEQ ID NO: 635797 - RNA, 64 nt, hsa
agaauuuaucaggcauuaccaagucuaggcacauauaggaaaugcagcacucagaaugguuuca

SEQ ID NO: 635798 - RNA, 64 nt, hsa
aaauauauacuuuauuaaaucauccaaccaaagcauaggaaacauugacccagaaccugacuua

SEQ ID NO: 635799 - RNA, 64 nt, hsa
ccuuuauuucaguggugaagggauagagagugggauaggaaaauauuuacucaggauaugugau

SEQ ID NO: 635800 - RNA, 64 nt, hsa
acuguguuaauaaaugacagaaccugaagaagucauaggaaagaaacuugagcgguauacucag

SEQ ID NO: 635801 - RNA, 62 nt, hsa
ccguaaccgugaaagagugacaaggacagccuauaggaaaaacaauaccacuuaaaacaauc

SEQ ID NO: 635802 - RNA, 64 nt, hsa
auucaacccacuacaaggaguuuuuuaaacaaaaauaggaaacuuagauguaacuuagcacuuu

SEQ ID NO: 635803 - RNA, 64 nt, hsa
uaagacuuucuuuuucaucuuuuauagcguuaccauaggaaacuguuccaaacugaguuagcuu

SEQ ID NO: 635804 - RNA, 64 nt, hsa
uuauguacuauuuaacuuaaauauauuuuguuuaauaggaaauauauaauaauagcauuuuaug

SEQ ID NO: 635805 - RNA, 64 nt, hsa
aaugucaauauauauuuaaaauaauaauggaaacauaggaaaucagcuauuuaaaccagaucac

SEQ ID NO: 635806 - RNA, 64 nt, hsa
ccuccuaugucucuuuucaaguuguaauuacuauauaggaaaaacuaaguugucacccaauauc

SEQ ID NO: 635807 - RNA, 64 nt, hsa
caauguuuuucucaaaaagcugcuauccaaugauauaggaaaauacauuguguuuuccuaaaca

SEQ ID NO: 635808 - RNA, 64 nt, hsa
ucuucuacccaauagaauauuuucaugccuggaaauaggaaaaugugugaacagcguauucucu

SEQ ID NO: 635809 - RNA, 64 nt, hsa
ugaugggauugggucacuuuugaauguggcuuucauaggaaagcagcuuaaacauaaauaucag

SEQ ID NO: 635810 - RNA, 64 nt, hsa
uaccauagaaagaugacaaaagaaaauuuuccacauaggaaaaugccaugaaaauugcuuuuga

SEQ ID NO: 635811 - RNA, 64 nt, hsa
cggguuaccuguaucugaaggacgguucuggggcauaggaaacacauacacuuccauaaauagc

SEQ ID NO: 635812 - RNA, 64 nt, hsa
accaguguucuccaccuuguccuccacagaucucauaggaaauguucaacaauucugugaaagg

SEQ ID NO: 635813 - RNA, 64 nt, hsa
acauuguaaaauuccagguuuucauaauguuaaaauaggaaaguagaauauaaaguaucaacaa

SEQ ID NO: 635814 - RNA, 64 nt, hsa
uaguacuaagcaaugugucuugcauuuguuuucaauaggaaaacaaaguucuagauagguuaaa

SEQ ID NO: 635815 - RNA, 64 nt, hsa
aauaauuuaagacacuacaaugggggcaaaugaaauaggaaaauuuuuagugaguuacacguac

SEQ ID NO: 635816 - RNA, 64 nt, hsa
acaucauauaauuucugcccauaauuguauugaaauaggaaaguugcugcucuugcacuugcug

SEQ ID NO: 635817 - RNA, 64 nt, hsa
augguucuaaaaauugcauucaaacauaauuuacauaggaaauguacugugggaacuauucuau

SEQ ID NO: 635818 - RNA, 64 nt, hsa
uaagaaccuaggagggaaaggaagauugagcaacauaggaaaaggggaagagaggcugaguguc

SEQ ID NO: 635819 - RNA, 64 nt, hsa
aguaguuaagaaauggcccuuuugaauguugaagauaggaaagaaagccauauauucaaauaug

SEQ ID NO: 635820 - RNA, 64 nt, hsa
uuucuguuuuauauucaacucauaagacuuugggauaggaaaaaugaguaaugguuacuaggcu

SEQ ID NO: 635821 - RNA, 64 nt, hsa
uuuuuguauggucauggagcuccaaccauuuuuaauaggaaagucuuuuguaaauuguugucgu

SEQ ID NO: 635822 - RNA, 64 nt, hsa
aggcagagcaaauacccuagagauucucugugauauaggaaauuuggaugaagggagcuagaag

SEQ ID NO: 635823 - RNA, 64 nt, hsa
aggcagagcaaauacccuagagauucucugugauauaggaaauuuggaucaaggaagcuaaaag

SEQ ID NO: 635824 - RNA, 64 nt, hsa
cuaguguucuccuaaucccuuaagacuagaaccuauaggaaacuacuuggagcaaacucaaagg

SEQ ID NO: 635825 - RNA, 64 nt, hsa
gcaaaccaaagaauuggaucuuaccaaugcggcuauaggaaaacagccuguugcaugguaagag

SEQ ID NO: 635826 - RNA, 64 nt, hsa
aggaguuaauaaagaaguucauuuugguuuaaacauaggaaagaagagaaccaugaaaaugggg

SEQ ID NO: 635827 - RNA, 64 nt, hsa
ggccggcgccguacugccugcguugugucagagaauaggaaaagcagcuuuguuuggggcauua

SEQ ID NO: 635828 - RNA, 64 nt, hsa
auuuacuuguuugugaaaacaauaccccaagguaauaggaaaaguuugaguuaaguguuuuuaa

SEQ ID NO: 635829 - RNA, 64 nt, hsa
uucauguuucuccuucugacuuuuaauaaugguaauaggaaaacaaaacccaaagcuuuucaga

SEQ ID NO: 635830 - RNA, 64 nt, hsa
ggauggaaaucaacugucagaauuaccucaggaaauaggaaaucugaagaaccugcuguguuua

SEQ ID NO: 635831 - RNA, 64 nt, hsa
auauauuuuaaguggugcacuaauuagugaauauauaggaaaauuaucugacgaguaucugaag

SEQ ID NO: 635832 - RNA, 64 nt, hsa
gacagagagagaauacauaucacugccaggccugauaggaaaaaucugcucuuccuuuuaauaa

SEQ ID NO: 635833 - RNA, 64 nt, hsa
cagcuggcgccagggaacgauggccucccaauagauaggaaacaccugaagcuggugaucagcc

SEQ ID NO: 635834 - RNA, 64 nt, hsa
cucuaggaaggcguagaauuuuaaagaacugguaauaggaaagcauguacuauuuucuuaaagc

SEQ ID NO: 635835 - RNA, 64 nt, hsa
cccauucuuuauuccccagaccaacuccaggcugauaggaaaaaagaugaaaacagauucuuca

SEQ ID NO: 635836 - RNA, 64 nt, hsa
cucucaguaauauagagaccggaauacaugguuuauaggaaaugaucaaaugauccaaaaaaac

SEQ ID NO: 635837 - RNA, 64 nt, hsa
acacacauaaaguuccauguguaagcuucucuaaauaggaaaccacaauuugucaaauauguuu

SEQ ID NO: 635838 - RNA, 64 nt, hsa
uuguuuucuuuacagcugcaauauuugugacugaauaggaaaauaaaugaguuuggagacuuca

SEQ ID NO: 635839 - RNA, 64 nt, hsa
augguaauuauaguucuguuaccaagaauaaauaauaggaaagugauuacaaauauuaccucca

SEQ ID NO: 635840 - RNA, 64 nt, hsa
acagacuggauagcuuuucuaauaauuuucaucaauaggaaaaaagaaauacgucucauucuuc

SEQ ID NO: 635841 - RNA, 64 nt, hsa
auuaguaacagcucuaagauggucaugcagugagauaggaaaucaagauggaagcagagaaucu

SEQ ID NO: 635842 - RNA, 64 nt, hsa
aaaauacuaugcauaaucuagaaagauuugucagauaggaaauuuuauaaugcauuagccauua

SEQ ID NO: 635843 - RNA, 64 nt, hsa
uaauaccugagugccuucuuaaggaaaccauuugauaggaaagaugaaccaaauaacucaauga

SEQ ID NO: 635844 - RNA, 64 nt, hsa
uuuucucccccacgaguggaaaauagacuucuacauaggaaagcuaaaauauguuaauauuuuu

SEQ ID NO: 635845 - RNA, 64 nt, hsa
gcaaaacuuaauugauccuacaagcuuacuacacauaggaaaauucauacuggagagaaacuac

SEQ ID NO: 635846 - RNA, 64 nt, hsa
uaaaugauucugaauguuaguguuuuauguucauauaggaaauauuuucauugaguccaaaaua

SEQ ID NO: 635847 - RNA, 64 nt, hsa
caaaccucaugccuuauucagcaucacaaaaugcauaggaaagagaaaucguaugaauguaaug

SEQ ID NO: 635848 - RNA, 64 nt, hsa
uguggugguuucuguuugcauuuuugcaggagccauaggaaacuacugaaaugauugugcuggg

SEQ ID NO: 635849 - RNA, 64 nt, hsa
gauaaaauuaauugcaaucuaccauaucuuaaguauaggaaauuugguguccaaccuggagaug

SEQ ID NO: 635850 - RNA, 64 nt, hsa
agucagcagaugagagacacaaagagaagugguaauaggaaacggaagagacuugguagacgag

SEQ ID NO: 635851 - RNA, 64 nt, hsa
cccugagauuaaaaaaagacuauuuggauaacuuauaggaaagccuagaaccucccaguagagu

SEQ ID NO: 635852 - RNA, 64 nt, hsa
aauacaugagaacugcuugucaugaccagacaagauaggaaaggggaaaccccagaaacgugcu

SEQ ID NO: 635853 - RNA, 64 nt, hsa
gagaaguuuuguucauuccacagaauaccuccuuauaggaaaguuaauuuccaauugcacacau

SEQ ID NO: 635854 - RNA, 64 nt, hsa
uuuuaugcugaaaguaugcucugaacuuuagaguauaggaaauuaacuauuagaauuuaaagaa

SEQ ID NO: 635855 - RNA, 64 nt, hsa
cuguuuagcuuuauaaaacaaacacuuugcugaaauaggaaaaugagccuuauugacaauuaag

SEQ ID NO: 635856 - RNA, 64 nt, hsa
acuccccguacagugcgcacaggcuuuaucgagaauaggaaaaccuuuaaaccccggucauccg

SEQ ID NO: 635857 - RNA, 64 nt, hsa
aagaaacauuuuacauaaaaugcuaaaauuuauuauaggaaaauaaaucaaacccaaagaaagu

SEQ ID NO: 635858 - RNA, 64 nt, hsa
cuggcauguaauucuuccucuauaaagaauagguauaggaaagacugaauaaaaauggagggau

SEQ ID NO: 635859 - RNA, 64 nt, hsa
uuuugguaugaugauacucagaaauggagauauuauaggaaaaagaaauccuuuggaauuuuaa

SEQ ID NO: 635860 - RNA, 64 nt, hsa
ucuugcuuuuucaauucuccuguugcaaugacacauaggaaaaucuuaaaauucuugggagugu

SEQ ID NO: 635861 - RNA, 64 nt, hsa
cccagaggaggccucuuugguugguucuuuuuucauaggaaauuccuucauaaaacauguaaca

SEQ ID NO: 635862 - RNA, 64 nt, hsa
cacaauauaacuuuacauucuuugccaauauuccauaggaaaaauuuugacaauguggaguuuu

SEQ ID NO: 635863 - RNA, 64 nt, hsa
uuguuuacagcauauuuaagucuugugaaacuguauaggaaaaaaguaucuacguuuuuaguuu

SEQ ID NO: 635864 - RNA, 64 nt, hsa
gcagccaggaaggacaggcuuuccccuguauaucauaggaaacucagggacauuucaaguugcu

SEQ ID NO: 635865 - RNA, 64 nt, hsa
cauaaucugcuuagcagaaaaugacgauuaaucuauaggaaagcucaaguaaaugcauuaucaa

SEQ ID NO: 635866 - RNA, 64 nt, hsa
aaaguagcaacauaugucaacauaugucacugaaauaggaaacagucauuggaauguugcacag

SEQ ID NO: 635867 - RNA, 64 nt, hsa
agccugcaucccucccuuccuuucucuuacugccauaggaaauuauuuuagggguuggaggugg

SEQ ID NO: 635868 - RNA, 64 nt, hsa
gugaauguguugagauuuuuuacuguuuugcaugauaggaaaauugagaaagaauacguauaaa

SEQ ID NO: 635869 - RNA, 64 nt, hsa
gacagucaaagagacaucucccucaauaaucgucauaggaaagacgugccaguuguggaggaaa

SEQ ID NO: 635870 - RNA, 64 nt, hsa
cugcagcuuugggcucccccauagugacugugccauaggaaagcagccccuccucacacauaca

SEQ ID NO: 635871 - RNA, 64 nt, hsa
cgccucuugccccuucuaggggcaggugaaaggaauaggaaauugaaccugggguuuugacuug

SEQ ID NO: 635872 - RNA, 64 nt, hsa
agucagagggauuccccuuuuucaucucauuuuaauaggaaaauuccuuaugguuaacaucucc

SEQ ID NO: 635873 - RNA, 64 nt, hsa
ugaguuguuuucaguuuucagacgaaugaauguaauaggaaacuauggaguuaccaauauugcc

SEQ ID NO: 635874 - RNA, 64 nt, hsa
uggugcuuauguaaccauuuuaaacgugguuucuauaggaaagaccaacauuuguuuagcuugc

SEQ ID NO: 635875 - RNA, 64 nt, hsa
uauuugaggaaaaaaugaguuuucacauuguuuuauaggaaauuaaauuuguccaaagauuugg

SEQ ID NO: 635876 - RNA, 64 nt, hsa
uuuguugacuucugacauuccacuuuccuagguuauaggaaagaucuguuuauguaguuuguuu

SEQ ID NO: 635877 - RNA, 64 nt, hsa
cucugccaacaacucuuuuguggaauucuaauuuauaggaaacauuuuaguaugagcuucagug

SEQ ID NO: 635878 - RNA, 64 nt, hsa
ucacaauuguugacuaaaaugcugcuuuuaaaacauaggaaaguagaaugguugagugcaaauc

SEQ ID NO: 635879 - RNA, 64 nt, hsa
guuugcacagucuuacuucuguagaacacuggccauaggaaaugcuguuuuuuuguacuggacu

SEQ ID NO: 635880 - RNA, 64 nt, hsa
cauugcuuaaccugaguccgagauggacaaugguauaggaaagauauucgguauggagaaucag

SEQ ID NO: 635881 - RNA, 64 nt, hsa
gaauguauaaaauuucucaggcagaguccuggauauaggaaaaaguaauuuaugaaguaaacuu

SEQ ID NO: 635882 - RNA, 64 nt, hsa
ucccccuguuuuuagagcuuccaaaugugucagaauaggaaaacauugcaauaaauggcuugau

SEQ ID NO: 635883 - RNA, 64 nt, hsa
aacagaaacgccuuaagacacuauguuugggaauauaggaaacuaugugugucccaaggaaauc

SEQ ID NO: 635884 - RNA, 64 nt, hsa
agcuggcgccaucgcuccggauuaguugguuuccauaggaaaggcaugcuuucagccagaugcu

SEQ ID NO: 635885 - RNA, 64 nt, hsa
guuuguuacuuacgguucugagaggaggggccacauaggaaagccccacggugggucagaaggc

SEQ ID NO: 635886 - RNA, 64 nt, hsa
ccuucugcuuagauccagggcccuucuacuggagauaggaaaaguagaauucaggaauuaaaag

SEQ ID NO: 635887 - RNA, 64 nt, hsa
acuucaaacacuggcaccuugggucucacccaccauaggaaacaagacaacauucaauuugaua

SEQ ID NO: 635888 - RNA, 64 nt, hsa
caauugucacauuuuaagacuuuuuuuuuuccauauaggaaagccauuauuaguaguaaacuuu

SEQ ID NO: 635889 - RNA, 64 nt, hsa
aguuuacauaaagaaguuuuuuuaaguuauugagauaggaaauauauucacugcugcuuuuaau

SEQ ID NO: 635890 - RNA, 64 nt, hsa
aacaaaagguagaauagggcugaagcaucugauaauaggaaaagaaaaggacaaaaguccucaa

SEQ ID NO: 635891 - RNA, 64 nt, hsa
guaaauccaggaauauuaggcucuuugucaucuuauaggaaaauauaugaagaacccaucauuu

SEQ ID NO: 635892 - RNA, 64 nt, hsa
uaaauuacaccugugugcaccuguauuacugaauauaggaaagagauacccauuacauaguuac

SEQ ID NO: 635893 - RNA, 64 nt, hsa
gguacauuccuugauuuccaggauaguuuuucaaauaggaaagcaauaauggcaguaguucuca

SEQ ID NO: 635894 - RNA, 64 nt, hsa
uuaacuuauuucauuaaagaaguugggagaacaaauaggaaaaaaaaaacuuauuuuucuagua

SEQ ID NO: 635895 - RNA, 64 nt, hsa
cuguggggaaaggucaggaagguauaguccuucaauaggaaauuguaauuaaaauauaauuuua

SEQ ID NO: 635896 - RNA, 64 nt, hsa
gguuuucaauaacagggcuuggaaaugaacuagaauaggaaauagaucuuuucagaugcugcuu

SEQ ID NO: 635897 - RNA, 64 nt, hsa
uuugaguucucucuaacccagcuuacugugggacauaggaaaacucaguagaaauaccuuuggu

SEQ ID NO: 635898 - RNA, 64 nt, hsa
uuugaacugcagaccuguaugagaacccaaugucauaggaaauaugguuugcuaaaaucuauaa

SEQ ID NO: 635899 - RNA, 64 nt, hsa
ugugaauuuuaaaaugcaaauauugcuauuguuuauaggaaauaaaucuaaauauaaaugaaau

SEQ ID NO: 635900 - RNA, 64 nt, hsa
cacauaaagggaacaaaugucuaguuuuauuuguauaggaaauuucccugacccuaaauaauac

SEQ ID NO: 635901 - RNA, 64 nt, hsa
accauuucaaaacuguuucuucuauuccugguucauaggaaagaaaaaaguuauucaaaguauu

SEQ ID NO: 635902 - RNA, 64 nt, hsa
augaggggaugacaaagaacaguuuuuaagcuauauaggaaacauuguuauugguguugcccua

SEQ ID NO: 635903 - RNA, 64 nt, hsa
acuuuaauuauauauuuucauccuauaagcuuaaauaggaaaguuucuucaacaggauuacagu

SEQ ID NO: 635904 - RNA, 64 nt, hsa
gucucuuggcccagucaggugcugccagguuuagauaggaaaguacaugucccauuuucauggg

SEQ ID NO: 635905 - RNA, 64 nt, hsa
acaugagauuccuuuugcuggauaugcagaaaugauaggaaaaaaaccaauggugaaauuucaa

SEQ ID NO: 635906 - RNA, 64 nt, hsa
augaauugccuaauugcugcaaaguauaacccagauaggaaaucauauguuuuuuuccaagagu

SEQ ID NO: 635907 - RNA, 64 nt, hsa
uuaugagaacacauuuucacaguuauguuucuucauaggaaaacuauauuuagugggcaacaac

SEQ ID NO: 635908 - RNA, 64 nt, hsa
auuuugauaacuagcuuuccagguggacuuagccauaggaaaauauuacuaauguaauuuaaca

SEQ ID NO: 635909 - RNA, 64 nt, hsa
aauaguaguuggaugcuuggcacgucguccuguaauaggaaacccuugccucaucaguuuuccu

SEQ ID NO: 635910 - RNA, 64 nt, hsa
augaaauggacagauucauggaacuuagaguccaauaggaaagugagacccagacaaugacaau

SEQ ID NO: 635911 - RNA, 64 nt, hsa
cuuucaagaugaaccaagguuuuuuaaaagaaauauaggaaacacuucauucuuuauaaaacuu

SEQ ID NO: 635912 - RNA, 64 nt, hsa
ucuuuuccacaacauaggacuuugaauagcaaugauaggaaaaacaauggaacaaggguggguu

SEQ ID NO: 635913 - RNA, 64 nt, hsa
ucaguggcuuuaugaaguaaaguuaaaaacaaacauaggaaaugugaaaauauuuguguuuguu

SEQ ID NO: 635914 - RNA, 64 nt, hsa
gaaguaaacccucacugugaaucagagaauucacauaggaaagaaaccagaugaagaugaaugc

SEQ ID NO: 635915 - RNA, 64 nt, hsa
uuagagccucuuuuucucccaacucauauuuuugauaggaaaaacagaaaacccauccaguucu

SEQ ID NO: 635916 - RNA, 64 nt, hsa
cagcuccugaacagaaacuagcuucagggcucuuauaggaaaugcuaagccuggacuaagugcc

SEQ ID NO: 635917 - RNA, 64 nt, hsa
uuuuaaacuaccauaauuccauuuuuucccuuacauaggaaaacuguaaguuggaauuaucuuu

SEQ ID NO: 635918 - RNA, 64 nt, hsa
gucccgagagauuuacuaaaccccaauucauagaauaggaaacuguggcucagaggucaucuac

SEQ ID NO: 635919 - RNA, 64 nt, hsa
ucaccuuccgcacgcggauuaauuugcaucugaaauaggaaacaagugaaagcauauggguuag

SEQ ID NO: 635920 - RNA, 64 nt, hsa
cagcaaauuuauccuugaaggugugaugguagaaauaggaaaacaacaaaagaaaaacaauaac

SEQ ID NO: 635921 - RNA, 64 nt, hsa
cuuguaaaaauaacauaauaaauagaucuuaaacauaggaaaaccauacuguucugauaauaaa

SEQ ID NO: 635922 - RNA, 64 nt, hsa
aucuuuguaguuaugccuuggguucuaaaauguuauaggaaacugcugaauugaauccuagcuu

SEQ ID NO: 635923 - RNA, 64 nt, hsa
acuaaaaguggaaaaaacuuauuggugaaugaauauaggaaacauuuugcccaaugccacucuu

SEQ ID NO: 635924 - RNA, 64 nt, hsa
gaggccagagaaaaugcacaaacuguaggaaacuauaggaaagcauuuacuaugagguuauauu

SEQ ID NO: 635925 - RNA, 64 nt, hsa
ggcuaaaagggagcagcacagggagagaaacaggauaggaaagcagaauggcgagcagccuaug

SEQ ID NO: 635926 - RNA, 64 nt, hsa
agcuccucccagggcuguguggaucugacaggguauaggaaaauaaaaagcggagaaggugucu

SEQ ID NO: 635927 - RNA, 64 nt, hsa
gguuaaacaccaaagaaagacugguguguacugaauaggaaagggaaguuuuauuuggaaccuu

SEQ ID NO: 635928 - RNA, 64 nt, hsa
uguugcucgccuucaggucaccagcugagcugcgauaggaaaaucugaauggaggcagcaaaca

SEQ ID NO: 635929 - RNA, 64 nt, hsa
acauuuuaaaauagaacuauccuuguucgauagcauaggaaaauguucuggugauugucagggu

SEQ ID NO: 635930 - RNA, 64 nt, hsa
aauuaaaacauacaagccaggaugaaugaagccaauaggaaauaaaaaacaggcacacaacauu

SEQ ID NO: 635931 - RNA, 64 nt, hsa
ugcacgagggagaacaaggccuuugcuguuguggauaggaaagacuuaaccuaaaauuaaacca

SEQ ID NO: 635932 - RNA, 64 nt, hsa
guacuccuacucucuuauacuggcugcuuuuauaauaggaaaaaaaaauaugcauuugcuuagu

SEQ ID NO: 635933 - RNA, 64 nt, hsa
uaucucucuucucacaauuaugcuccacuggauaauaggaaaaacacuucuuuccuucauuuuu

SEQ ID NO: 635934 - RNA, 64 nt, hsa
aguugguggguguuaagcuagaaugggcugugugauaggaaacaaaugccuuacagaugugccu

SEQ ID NO: 635935 - RNA, 64 nt, hsa
guuucuaagaguuuagccacaguagcuucuagagauaggaaauuagauuuagugggugggaaga

SEQ ID NO: 635936 - RNA, 64 nt, hsa
gacaugaucuuuugcaauaccucaauuuugaaauauaggaaagaaaaugauauuuucuaaguaa

SEQ ID NO: 635937 - RNA, 64 nt, hsa
caauugauccccaaccugccaggcuuccuaucucauaggaaacauccucauugauccucuucag

SEQ ID NO: 635938 - RNA, 64 nt, hsa
cuuuuaauuucaguuuuaaugaaagcugaacuuaauaggaaagcuagcucuugguaacuagcaa

SEQ ID NO: 635939 - RNA, 64 nt, hsa
uuuaaauaaaauuuuaagugaugcuguauuauauauaggaaaaaaugcuuaaaauccugucauu

SEQ ID NO: 635940 - RNA, 64 nt, hsa
augauggcaugaaguaaaaggggccucaaugaugauaggaaaaucaguucuuuuaaaauuucuu

SEQ ID NO: 635941 - RNA, 64 nt, hsa
uaagucuacaggggcuggugaccucuuuuugcuaauaggaaaaucacauuacuacaaaaugggg

SEQ ID NO: 635942 - RNA, 64 nt, hsa
gauuggagugauacauugugggaacccucagaagauaggaaaaaagcauggaauagauucuccc

SEQ ID NO: 635943 - RNA, 64 nt, hsa
ucuacucagaaauuuuuauuuuucuaagguucucauaggaaaaguacauuuaauacagcagugu

SEQ ID NO: 635944 - RNA, 64 nt, hsa
uugauucaguaguuguuaccaagaaacauauguuauaggaaaacaacuugguauuuaaguauga

SEQ ID NO: 635945 - RNA, 64 nt, hsa
aaguugaacaugggagcuuauugcuaauuuagagauaggaaacugaagcauaaagaauuaauga

SEQ ID NO: 635946 - RNA, 64 nt, hsa
uagaagauuagaaacuaccaaucccaacuacguaauaggaaaauguaggaucaaaaggcccaug

SEQ ID NO: 635947 - RNA, 64 nt, hsa
aagaggcguguagguuugcaaacaaaguuaagaaauaggaaacugaauuuuucauuguacagaa

SEQ ID NO: 635948 - RNA, 64 nt, hsa
aaagccugucuccucacccacccccagcccuagcauaggaaaagcuuccuugaugugagcucug

SEQ ID NO: 635949 - RNA, 64 nt, hsa
ggacuagaugcauaccguuuugugaaaaccagccauaggaaaacaugugagcaacaacccccau

SEQ ID NO: 635950 - RNA, 64 nt, hsa
ugcugaguauagccaaaugccuguucugaaacuuauaggaaauuggaauuuuguuuaaaauuuu

SEQ ID NO: 635951 - RNA, 64 nt, hsa
uuuaaauaugaaguacuuaaauguacuuacuaugauaggaaauauaaugugugccuucuaggau

SEQ ID NO: 635952 - RNA, 64 nt, hsa
accccaaacucaggccgaaugaucaaggggacccauaggaaaucuuguccagagacaagacuuc

SEQ ID NO: 635953 - RNA, 64 nt, hsa
gccagcuuucuucuguugaugccguucccugaacauaggaaaauagaaacuugcuuaucaaaac

SEQ ID NO: 635954 - RNA, 64 nt, hsa
guaaaaaucaauucaggggauuuguauagugucuauaggaaaguagcccaugucuugaaauaug

SEQ ID NO: 635955 - RNA, 64 nt, hsa
gguuuuuaaguuuagaaauauucaugccaauaaaauaggaaauuauaaauauauaguuuuaagc

SEQ ID NO: 635956 - RNA, 64 nt, hsa
uucuaagagauuggauacuuuggaaugucuuuauauaggaaauagaccucccauuucuuaagca

SEQ ID NO: 635957 - RNA, 64 nt, hsa
ucucuaacaugauauuggaaaauaauggaugaaaauaggaaaaaugauuguuaaugcugacugu

SEQ ID NO: 635958 - RNA, 64 nt, hsa
aaaacuuacauuacuugccaagcaguaugauguuauaggaaacauaaauaagauuacagaggua

SEQ ID NO: 635959 - RNA, 64 nt, hsa
gguggauuccaugacauauauuguaauucuuuucauaggaaaugucauuacaguaugaauuaua

SEQ ID NO: 635960 - RNA, 64 nt, hsa
gagaaggccuuuucugaagggauaucuaaaaagcauaggaaauccuugguucagagggaagugg

SEQ ID NO: 635961 - RNA, 64 nt, hsa
ugaggccauucccuguaggaguaaagauaaaaggauaggaaaagauucaaagcucuaauagagu

SEQ ID NO: 635962 - RNA, 64 nt, hsa
ccucuucaguaugcaaauguaaauaaauuguaauauaggaaaucuuuuguuuuaauauaagaau

SEQ ID NO: 635963 - RNA, 64 nt, hsa
auacauauauauuuuuugcuuuuguauauccuauauaggaaacuaagcauuguauuuuuuuuaa

SEQ ID NO: 635964 - RNA, 64 nt, hsa
cauuuacagucuuguauuuacaagcuaaauauauauaggaaaucacaaauaaaucccuuuuaag

SEQ ID NO: 635965 - RNA, 64 nt, hsa
agauuuucuuccauuucuaagacuguuauuuacaauaggaaaauuccuguuuggcuuuuugucu

SEQ ID NO: 635966 - RNA, 64 nt, hsa
uucuuuucaagacuuccucaugaaucucucaauuauaggaaaaguuauugugauaaaauaggaa

SEQ ID NO: 635967 - RNA, 64 nt, hsa
cuccuaauggaaacauuaucuuuaaaaguugcauauaggaaauauacauauuuuacguuugaac

SEQ ID NO: 635968 - RNA, 64 nt, hsa
uuuauccagaugaagguauuuuuauauuuugacaauaggaaacagugaccauuuucagaguaau

SEQ ID NO: 635969 - RNA, 64 nt, hsa
agagucaccagcagguuccaaauugauguguaugauaggaaaaaaaccuuaauuuuaaauauaa

SEQ ID NO: 635970 - RNA, 64 nt, hsa
aagugucgaucuugaauucccugaaaaaauuucuauaggaaaugaagcuucccugguccccucc

SEQ ID NO: 635971 - RNA, 64 nt, hsa
cauguuauagacuuucacuuaugucagauuuaugauaggaaaaauuccaucuucauuacugccu

SEQ ID NO: 635972 - RNA, 64 nt, hsa
cgccuuccucacuccauauagaacaccuuucccaauaggaaaccccaacagguaaacuagaaau

SEQ ID NO: 635973 - RNA, 64 nt, hsa
gacgcgcaggagucagacuuccgcugggacgucaauaggaaacgggggaauuacuguguauuug

SEQ ID NO: 635974 - RNA, 64 nt, hsa
uuguauaauauguaauuguagggaaacugcucucauaggaaaguuuucugcuuuuuaaauacaa

SEQ ID NO: 635975 - RNA, 64 nt, hsa
auucugugugugugugugugugugugcacaauaaauaggaaauguagaaaccaagcaagaaggc

SEQ ID NO: 635976 - RNA, 64 nt, hsa
uuucuuuuucuuuguuuuuuucuugaucacuuguauaggaaacaauauuuuccaguguuauuug

SEQ ID NO: 635977 - RNA, 64 nt, hsa
caaggguuggggcagcugcacuuuuagguugccuauaggaaauauugcauauggagauuacagu

SEQ ID NO: 635978 - RNA, 64 nt, hsa
aguuguauauaauauuuaagaugcugaguauuucauaggaaagcugaaugcugcuguaaagugc

SEQ ID NO: 635979 - RNA, 64 nt, hsa
uuuaacucaaauauugucuucgacugcuauguguauaggaaagcagucucuguaucaauguuua

SEQ ID NO: 635980 - RNA, 64 nt, hsa
cuuaaauacaccugcugguacuuggugugguuaaauaggaaaauuguuauuaaauaaagaauuu

SEQ ID NO: 635981 - RNA, 64 nt, hsa
agauauuugaauuaucuugauuggaauguuauucauaggaaauaacaggaagauuccaaagacg

SEQ ID NO: 635982 - RNA, 64 nt, hsa
uuuuucuuucuuuuucuuuguuuuugaguuuucuauaggaaauaaauagcuuucuauauaugag

SEQ ID NO: 635983 - RNA, 64 nt, hsa
uuuuauuauguaaugaauauguguugcuuuuguaauaggaaaauaauaaaguuaaaauuucaac

SEQ ID NO: 635984 - RNA, 64 nt, hsa
uauagaguaauauuugagcuguguucaaaaauacauaggaaaagacugauaaaaugaaauaugg

SEQ ID NO: 635985 - RNA, 64 nt, hsa
accugcuuucauguuuuaauguuuguuuaauuuaauaggaaaccucauuuuaaauauaacacuc

SEQ ID NO: 635986 - RNA, 64 nt, hsa
aaguuguuauuguuaaccuuuucggcagcuuuuaauaggaaaguuaaacguuuuaaacauggua

SEQ ID NO: 635987 - RNA, 64 nt, hsa
auuuaaaaaacaaacuucauuguaguaaauucaaauaggaaaaaaugggggaguaguuaagcaa

SEQ ID NO: 635988 - RNA, 64 nt, hsa
gaagguaacguguuccuagaaaagaaaaugcugcauaggaaaacugagaugccuuuuauuccaa

SEQ ID NO: 635989 - RNA, 64 nt, hsa
agagagaaaaaaagacuuagagaagaggaagagaauaggaaaaccauuacaguaguguaauaua

SEQ ID NO: 635990 - RNA, 64 nt, hsa
gguacaucucaugaccucaauucccucaccugaaauaggaaaugagaauguuucauuguagccc

SEQ ID NO: 635991 - RNA, 64 nt, hsa
cugucucacuggcaucuuguugagggccuugcacauaggaaacuuuugauaaguaucugcggaa

SEQ ID NO: 635992 - RNA, 64 nt, hsa
aaacguagaaagaagacauagcgccugccagggaauaggaaaugagggcacuuacacauuaaug

SEQ ID NO: 635993 - RNA, 64 nt, hsa
gcuuuuguggagaaauuagcacaccccaacuuuaauaggaaauuuguucucuuuuuccgccccu

SEQ ID NO: 635994 - RNA, 51 nt, hsa
ccgauuauugcguauucuaaaauaggaaacaagacuuuaaauuuuaaaaaa

SEQ ID NO: 635995 - RNA, 64 nt, hsa
acuauuuuuauaucugcugucuuucagaaggcaaauaggaaacuauauauuugcuuaaaaauug

SEQ ID NO: 635996 - RNA, 64 nt, hsa
gaucuaguaguaaccaaaaauuccaguuuugagaauaggaaagauuccgccugcuuaccuguga

SEQ ID NO: 635997 - RNA, 64 nt, hsa
auuguacagguccauaauuucauuuuaauuaauuauaggaaagaagaaaagauaauacccauuu

SEQ ID NO: 635998 - RNA, 64 nt, hsa
uucuuguggcaaguaauucacaguuguaaaguaaauaggaaaaauuauuuuauuuuuauugaug

SEQ ID NO: 635999 - RNA, 64 nt, hsa
cuuaaaaaucuaugccuaaaaaguaucauuacauauaggaaaacaauaauuuuaacuuuuaagg

SEQ ID NO: 636000 - RNA, 64 nt, hsa
uucaccagcauaauuuuaucuuaaggaauaacuaauaggaaaagucagcuuaauuauuuaaggc

SEQ ID NO: 636001 - RNA, 64 nt, hsa
aagcaccuaagaaaagaacugcaaagucugagaaauaggaaaaaugucugagacagcaaaauau

SEQ ID NO: 636002 - RNA, 64 nt, hsa
uuuuacaaauccccagcucaugaacgugaagcugauaggaaaucaccccagggaacccgaaaaa

SEQ ID NO: 636003 - RNA, 64 nt, hsa
aguggucuccaagcuuuugugauuguauauuccuauaggaaaaaaagaauugauuaugcauacc

SEQ ID NO: 636004 - RNA, 64 nt, hsa
aguccaagucagacuauuucacaaagucagagcgauaggaaagcacccugcccuucaucuucau

SEQ ID NO: 636005 - RNA, 64 nt, hsa
auucuguucuguuacagugauuuaaaccaguaguauaggaaaaaacuuaaaaaaacaaaaaaac

SEQ ID NO: 636006 - RNA, 64 nt, hsa
aacccuaggaaguagggagaaaugaaggaagggcauaggaaaauuuucccaguaaauccccuga

SEQ ID NO: 636007 - RNA, 64 nt, hsa
acgcagcggaaaugucauuaugaacagauguuaaauaggaaauuauuacuuguuaacuucuuac

SEQ ID NO: 636008 - RNA, 64 nt, hsa
uaaauaaaacuaugguaaaugugacaagcauuuaauaggaaaaugcuaaggaggccucauaaau

SEQ ID NO: 636009 - RNA, 64 nt, hsa
aauaguguuccuaagauaucucuuaaauccucccauaggaaauagaauuacagguaagguacac

SEQ ID NO: 636010 - RNA, 64 nt, hsa
uaauuuuggguauacuugugguuaguuuugugccauaggaaaaaauuaucuuaaaacuuuggcc

SEQ ID NO: 636011 - RNA, 64 nt, hsa
uaaaaaaaagugagguauagucuaaauggugcauauaggaaauacugacaguguuuagcaacau

SEQ ID NO: 636012 - RNA, 64 nt, hsa
cuauuugcaccgaaaugucuuguuuuguugcgacauaggaaaauaaccaagcacaaaguuauau

SEQ ID NO: 636013 - RNA, 64 nt, hsa
ugugaauaacugaagaaaauaacuugcuggcuauauaggaaaaugcuguggaaaugaacugugu

SEQ ID NO: 636014 - RNA, 64 nt, hsa
uucuagauguagcuugugcagauguagcaggaaaauaggaaaaccuaccaucucagugagcacc

SEQ ID NO: 636015 - RNA, 64 nt, hsa
agaaagaacaaaaaauguuuuaaauuucucuuauauaggaaauaauaggaacgucaaagcucug

SEQ ID NO: 636016 - RNA, 64 nt, hsa
uuccugaguugccuaguagcaauaaaacaagugaauaggaaaauaauuaauauauuauucuauu

SEQ ID NO: 636017 - RNA, 64 nt, hsa
auccucuugccauaugaauagcguuuuccaugaaauaggaaaauauuacuugguauagcauuuc

SEQ ID NO: 636018 - RNA, 64 nt, hsa
auaauaaccaagacuuuucaagcuucuagaucucauaggaaagcuuguaauagcaaaauuguaa

SEQ ID NO: 636019 - RNA, 64 nt, hsa
caguuccuauaauuuuuacugggggggauuugugauaggaaaguccuugggaaacauuuccaau

SEQ ID NO: 636020 - RNA, 64 nt, hsa
uguaacacaguggugaguauuuguguuuacaaacauaggaaagguacaguaaaacuaugguauu

SEQ ID NO: 636021 - RNA, 64 nt, hsa
ccugaugccaccuccucuguucuuggaacaacgcauaggaaaagaaucuccuuuggaaggugac

SEQ ID NO: 636022 - RNA, 64 nt, hsa
aaauacguauguuuaaaaacccuuccugcuauacauaggaaaagacacacauccaccuaaaauu

SEQ ID NO: 636023 - RNA, 64 nt, hsa
uaagcaugcagaugacuuacaauauaaaugaagaauaggaaacauuuuaucuucuuaccaagua

SEQ ID NO: 636024 - RNA, 64 nt, hsa
gagugauaaagccagcggggagggacugauuuuuauaggaaaggaggaaaaauaauggaaacac

SEQ ID NO: 636025 - RNA, 64 nt, hsa
ucagucccugcagacucuucucaacucuuucccuauaggaaacuuacuccgcguccugccccca

SEQ ID NO: 636026 - RNA, 64 nt, hsa
cauuucuuuuuucuucuucuuuaacuccccuguaauaggaaauaaaguauuuuugugaugagga

SEQ ID NO: 636027 - RNA, 64 nt, hsa
auauaugcauccuccaaauguuucaugcuuauuuauaggaaaguuauauuaaugagauuaauaa

SEQ ID NO: 636028 - RNA, 64 nt, hsa
ucuucaggauaaaaagaacuucugaaucucugcaauaggaaauguuucgaucaugcaagugcuu

SEQ ID NO: 636029 - RNA, 64 nt, hsa
aaaaaaaaagagagagugugugauuagaagcuaaauaggaaaguuuugagcuucaagucaguga

SEQ ID NO: 636030 - RNA, 64 nt, hsa
gugcuguucugaagucuucaaauuuuucccucuaauaggaaacaguauaaauuuuaauuaaaaa

SEQ ID NO: 636031 - RNA, 64 nt, hsa
cuugaguguugaaaggaauuguuuacuuuggaauauaggaaaacaguugaaugucagacucuca

SEQ ID NO: 636032 - RNA, 64 nt, hsa
uguacccaguuuauuuaaggggacaugcacuggaauaggaaaugucccccaucucccuuccugc

SEQ ID NO: 636033 - RNA, 64 nt, hsa
caauccucuccugaaacuuaaaaacagugggaauauaggaaagggaaccaaaucucauuaauua

SEQ ID NO: 636034 - RNA, 64 nt, hsa
aaagcucuauuuuaaaauuuaauguuuauuuuaaauaggaaagcauuucuagugcuacaggcau

SEQ ID NO: 636035 - RNA, 64 nt, hsa
aauaaauggagagagagagaagccuuguuguuggauaggaaaacccguacuaaagauacucuac

SEQ ID NO: 636036 - RNA, 64 nt, hsa
uugugauacagcggucacuauuuucucuuaacacauaggaaaaaaguucagacaucgcuacaau

SEQ ID NO: 636037 - RNA, 64 nt, hsa
cugucuggaaccagugaaugcauuagaaccuuccauaggaaaagaaaaggggcugaguuccauu

SEQ ID NO: 636038 - RNA, 64 nt, hsa
uagugaccauuuggcaucaaguuaacaucacacaauaggaaacaccacuuccacaagucucaag

SEQ ID NO: 636039 - RNA, 64 nt, hsa
guucuuagucauugauuuuuguguuuaaaaaaaaauaggaaagagggaaacugcagcuuucauu

SEQ ID NO: 636040 - RNA, 64 nt, hsa
uuaccgagaaaaggagaaaggagcucugaaucugauaggaaaagaaggcugccuaaggaggagu

SEQ ID NO: 636041 - RNA, 64 nt, hsa
uuuguaaauuuaugugauggcaaagaaggagagcauaggaaaccacacagacuugggcagggua

SEQ ID NO: 636042 - RNA, 64 nt, hsa
ugcaucaaucuguuugccugcuaaacaaguuagaauaggaaauaguaaaauaaauccaaacaag

SEQ ID NO: 636043 - RNA, 63 nt, hsa; identical to SEQ ID NO: 635600

SEQ ID NO: 636044 - RNA, 64 nt, hsa
gcugagguuuucucugagguuuuuuugaugcuuuauaggaaacuauuuuuuaaaaaaagccauu

SEQ ID NO: 636045 - RNA, 64 nt, hsa
cuaccccaggagugggccaggccgggccacagcaauaggaaagccagggccagagcgagccaug

SEQ ID NO: 636046 - RNA, 64 nt, hsa
uggccaaccuggugaaaugcagugucaacuaaaaauaggaaaaucagccaggcgugguggcaga

SEQ ID NO: 636047 - RNA, 64 nt, hsa
uuuuccauuggcuucagggcgcauccauguggauauaggaaaagccucuuuccacagacuuagg

SEQ ID NO: 636048 - RNA, 64 nt, hsa
ccaucucaaaaaaauuauaaauaacucuuugcaaauaggaaagugaagcucaaggguaaccagu

SEQ ID NO: 636049 - RNA, 64 nt, hsa
gucuuuauacuuuauaguaaugcacaacauuuuuauaggaaaauauuuguaucauuuccuuuuu

SEQ ID NO: 636050 - RNA, 64 nt, hsa
acaagaugaaucuuauaaacuauauuuuaugaauauaggaaaaucuucauuaggaauuuaucag

SEQ ID NO: 636051 - RNA, 64 nt, hsa
ugaagcagcagauuugauagacuggcaaagaugaauaggaaaaacuuugacucuugcccagugc

SEQ ID NO: 636052 - RNA, 64 nt, hsa
cggguuuuauaaauaaauauauauauauauguacauaggaaaaaccaaauauacauacuuauuu

SEQ ID NO: 636053 - RNA, 64 nt, hsa
ccucuaccacccaacacccugggcucacuuuuggauaggaaauaaacucuuuauuuuuguaguu

SEQ ID NO: 636054 - RNA, 64 nt, hsa
uagacuguagauuauuuauuaaaauucuuuaauaauaggaaaaggggaaaguauuuauuguaca

SEQ ID NO: 636055 - RNA, 64 nt, hsa
auuuugguuuuucaacacugaaaaaauacuaccuauaggaaagucugucagguuugguuuuuuu

SEQ ID NO: 636056 - RNA, 64 nt, hsa
cuccuucugauuuugccugucuuauauaaugagcauaggaaaauuuuggaaugaggcagaaaag

SEQ ID NO: 636057 - RNA, 64 nt, hsa
acuucaaaagaccauaaucaaccaggagcuuauuauaggaaaggcugaacagaagggcuagugu

SEQ ID NO: 636058 - RNA, 64 nt, hsa
uuugcacaacuuugguuuuaaaagcuguugaaaaauaggaaaacaaagggcauuguucacagau

SEQ ID NO: 636059 - RNA, 64 nt, hsa
uguauggauuuuuuuguuaucuucacuuuacugcauaggaaacaaucuaccucaucauuuaaaa

SEQ ID NO: 636060 - RNA, 64 nt, hsa
gccagagggcucaggaugggaaaggaagaaggggauaggaaaagaagagguaauuuuacauuuc

SEQ ID NO: 636061 - RNA, 64 nt, hsa
uaaaugcucccugucccauggagagggacccagcauaggaaagccacauacucagccuggaugg

SEQ ID NO: 636062 - RNA, 61 nt, hsa
agaagaggaaugaacauuaauaccugaaacuauaggaaagguuaauuugccuauaauuaua

SEQ ID NO: 636063 - RNA, 64 nt, hsa
ucacaauuucaacaugucaaaccuaugaagggagauaggaaacaaugagaaacuuacuuuugcu

SEQ ID NO: 636064 - RNA, 64 nt, hsa
uauccaguuugaaaaucauucccuaaagcaugcaauaggaaaaagaaccuccuggcugggacug

SEQ ID NO: 636065 - RNA, 64 nt, hsa
acuauuccccaacagauauuguggcaaaucacacauaggaaagagaauuugggaauacaguagc

SEQ ID NO: 636066 - RNA, 64 nt, hsa
aauuaucuaaagaaucauugucuuucagagacucauaggaaaaaaaaacuaggaaaagugucac

SEQ ID NO: 636067 - RNA, 64 nt, hsa
auaaauccuacuagaguaaaaauuaggugugaaaauaggaaaauacagugcaaaauguguuaag

SEQ ID NO: 636068 - RNA, 64 nt, hsa
cuauauuacuguaggacuggauauuaggugucauauaggaaacacaaaaguuuauugcuguuug

SEQ ID NO: 636069 - RNA, 64 nt, hsa
uaccaaauaguaugacaccaauuggcacaaaguuauaggaaaaucaccuacaggagauguaaac

SEQ ID NO: 636070 - RNA, 64 nt, hsa
caacuagaaauccaguuagaagugcaauuuucuuauaggaaauagguauagugugcaaguguac

SEQ ID NO: 636071 - RNA, 64 nt, hsa
auuuauucagcuaaaauaguacuucacaggaaauauaggaaaagaaacacuaguucaguuuuau

SEQ ID NO: 636072 - RNA, 64 nt, hsa
ugagcaaacauauuugaaaguuaacuuuuggaugauaggaaagaucguacagugacauaaguuc

SEQ ID NO: 636073 - RNA, 64 nt, hsa
aaaguagaaagugcuugguauuucugucuuauacauaggaaaacauuuaaaauaaauaguuuuu

SEQ ID NO: 636074 - RNA, 64 nt, hsa
cgaaggacagcgaugggaaaaaugcccuuaaaucauaggaaaguauuuuuuuaagcuaccaauu

SEQ ID NO: 636075 - RNA, 64 nt, hsa
auucagaguugaauuuaaugaaaacucagaggaaauaggaaaaucugcucaggagaaagaagcu

SEQ ID NO: 636076 - RNA, 64 nt, hsa
cuuguugaucauuaccuguaaaugaaagaccuuaauaggaaaaaaagaguaaagcucaguguga

SEQ ID NO: 636077 - RNA, 64 nt, hsa
cuuagauacuaguugucugaauugaguuacuuugauaggaaaaauacuucauuaccuaaaauca

SEQ ID NO: 636078 - RNA, 64 nt, hsa
cuccgucuaccuggcguuuuguuagaaaugucagauaggaaaauaaaaaccauuugaguaaaaa

SEQ ID NO: 636079 - RNA, 64 nt, hsa
ggaauuuuucaguuccaagugcaucccuuauucuauaggaaauaaacuggagacaaaucucauu

SEQ ID NO: 636080 - RNA, 64 nt, hsa
agaaauaguggcuucccuggaauuguuuaacuugauaggaaaaaucuaucauauauaggacaua

SEQ ID NO: 636081 - RNA, 64 nt, hsa
uaucccuccucaauuggaggcuggacagagcugaauaggaaagacuugcuauugccuaaggcua

SEQ ID NO: 636082 - RNA, 64 nt, hsa
cugacaggauugagagauuaaaguaaagacaggcauaggaaaucacaaggguauugacugggga

SEQ ID NO: 636083 - RNA, 64 nt, hsa
aagcuuccacgggugaaugccggcagcugugccaauaggaaaaagcuaccuagacuaggcaugu

SEQ ID NO: 636084 - RNA, 64 nt, hsa
acuaguaauacagcuguugaagaauuagagggaaauaggaaaugauuuucccauaauuccagaa

SEQ ID NO: 636085 - RNA, 64 nt, hsa
uucauacugacaaggaaccgagucaauuuggugaauaggaaaagccuucucaugaaaacuacaa

SEQ ID NO: 636086 - RNA, 64 nt, hsa; identical to SEQ ID NO: 636085

SEQ ID NO: 636087 - RNA, 64 nt, hsa
uuuguauuauuuuuauuuggccccauuauuuuaaauaggaaaaacaguauguuuucaguccauu

SEQ ID NO: 636088 - RNA, 64 nt, hsa
aaaugaauaacacuuuuuuguuuuuaaaauuguuauaggaaaauuuauauauguagcucacgua

SEQ ID NO: 636089 - RNA, 64 nt, hsa
uacucaacauuauauaauguauagugugauuaauauaggaaauccuugauuuugaaauuaucaa

SEQ ID NO: 636090 - RNA, 64 nt, hsa
cuauccaucugagagccaacacaggagaaaaaccauaggaaagugacauguaggagggcuauag

SEQ ID NO: 636091 - RNA, 64 nt, hsa
aaaaauacuuuuuauuagccugauuuucaucuuuauaggaaauaguuuaagugaugacaaguuc

SEQ ID NO: 636092 - RNA, 64 nt, hsa
ugcccuugagcagggaaggaacuuacugucuaauauaggaaaaacacaugagaacaggugcaau

SEQ ID NO: 636093 - RNA, 64 nt, hsa
auccguguuccagcaucuaaccuuuuacuuuugcauaggaaauacuugauuuaauuacaggucc

SEQ ID NO: 636094 - RNA, 64 nt, hsa
guucucugaaaaaugaugucccaaaaguauuauaauaggaaaaaagcauuaaauauaauaaacu

SEQ ID NO: 636095 - RNA, 64 nt, hsa
uugaaaaccugcuuuguagaugcagagagaagcuauaggaaacccaguaccaccccuggucugu

SEQ ID NO: 636096 - RNA, 64 nt, hsa
gaguauuguaggggaaggaaauuuacaagauuuaauaggaaaugaaacagcuugaauuucaaac

SEQ ID NO: 636097 - RNA, 64 nt, hsa
gggcugcccaucuccccaacccagucacagagagauaggaaacggcauuugaguggguguccag

SEQ ID NO: 636098 - RNA, 64 nt, hsa
ugaaagccagaacaagagagcgcuccucucccagauaggaaaagggccucuaacaaggagaaau

SEQ ID NO: 636099 - RNA, 64 nt, hsa
ugugguuuuuguguuuuuuuuuuuuucuuuuuccauaggaaagaauauauaaauuuguaaaucc

SEQ ID NO: 636100 - RNA, 64 nt, hsa
gaauuaaaaauaacacagucuuuuuaaaacuaacauaggaaagccuuuccuauuauuucucuuc

SEQ ID NO: 636101 - RNA, 64 nt, hsa
gagagucugguaggcaaagcagucugagaaagaaauaggaaaugcagaaauagguuuugucugg

SEQ ID NO: 636102 - RNA, 64 nt, hsa
uguagguucuuuuaacuuugguuuaaaauguaagauaggaaaauguuggauauuugaggccaug

SEQ ID NO: 636103 - RNA, 64 nt, hsa
ccugacccagaacagccuuuaaaucacaagcaaaauaggaaaguuaaccacggaggcaccgagu

SEQ ID NO: 636104 - RNA, 64 nt, hsa
uuuuguuaagaguacaauugcaaaucuuaucuauauaggaaaauagcuaaaugucauucuccau

SEQ ID NO: 636105 - RNA, 64 nt, hsa
gcaccccuacucguuccuauagaacacagaggacauaggaaacccuuaaaacacacaugggauu

SEQ ID NO: 636106 - RNA, 64 nt, hsa
accauuugccuuaccugucuuagucugaaauguaauaggaaagauaacgggaagaugccaguug

SEQ ID NO: 636107 - RNA, 64 nt, hsa
cagauugccagagaaaucugggucaaagaaaggaauaggaaagaaaguuucuguagucaagcac

SEQ ID NO: 636108 - RNA, 64 nt, hsa
aaucccagaggcagucccagccucagaacccaggauaggaaauggguguguuuaguggggaaag

SEQ ID NO: 636109 - RNA, 64 nt, hsa
caagccaucugcauguuuauuuccucugcucauaauaggaaaauggauguuauggagcuucaag

SEQ ID NO: 636110 - RNA, 64 nt, hsa
gaagaucagauauuuugcuuaaaggucugaucauauaggaaauauaugcagaacauuuuaaaga

SEQ ID NO: 636111 - RNA, 64 nt, hsa
acaauuaaauucaaaguucuucccuuuuuuaaagauaggaaacaggcauugccaaaaaaaaaaa

SEQ ID NO: 636112 - RNA, 64 nt, hsa
cccacuaauuauaaugacuuucugucuggaucuuauaggaaaagauacuuucuuuuuucuucca

SEQ ID NO: 636113 - RNA, 64 nt, hsa
aaugugucagggaauagaugugaaacaagggaucauaggaaaaggggaaagagaaaugaucugu

SEQ ID NO: 636114 - RNA, 64 nt, hsa
gauaacuuaucagggcuaguuuaaacaaauguguauaggaaaggauguuauuuauauauucuua

SEQ ID NO: 636115 - RNA, 64 nt, hsa
uauaauuaauaaacuuccuacaucuauagaauguauaggaaauuuuauguugugcacauuugca

SEQ ID NO: 636116 - RNA, 64 nt, hsa
aaacucuuuaacuuguaauaaacccuuaacuggcauaggaaaugguauccagaauggaauuuug

SEQ ID NO: 636117 - RNA, 64 nt, hsa
uagggggaaccuuauuuauuuguguguuaacugaauaggaaaauguacauacuauguucaugau

SEQ ID NO: 636118 - RNA, 64 nt, hsa
ucuucaaccagggauuguuucuguuuaacuucuuauaggaaagcuugaguaaaauaaauauugu

SEQ ID NO: 636119 - RNA, 64 nt, hsa
accacacccugggccccuaaucccaggccccgagauaggaaagccagcuagucucuucucuucu

SEQ ID NO: 636120 - RNA, 64 nt, hsa
acauauaugccaucuguccucaaguguuaucuacauaggaaauaaaauggaauugauguaaagu

SEQ ID NO: 636121 - RNA, 64 nt, hsa
acauauaaacaugaaauaaacagugccaguauucauaggaaagugagaaacuguaauauuuggc

SEQ ID NO: 636122 - RNA, 64 nt, hsa
cacugaauaaaguacaccauauagcauuauuuuuauaggaaauauuucaugucccuuaaauauu

SEQ ID NO: 636123 - RNA, 64 nt, hsa
cagauuagcucauauucuauacagcaucguuuaaauaggaaaaauuuaaugcuagcaaaaaaua

SEQ ID NO: 636124 - RNA, 64 nt, hsa
augggaagagggugauaauagaagaguggcagcuauaggaaauuaucaacauaccuuggccagc

SEQ ID NO: 636125 - RNA, 64 nt, hsa
agcuaauuuuuuuuuuuuuaccaaaucucucaauauaggaaacauuuuuuggaaaggauggauu

SEQ ID NO: 636126 - RNA, 64 nt, hsa
cagcaggaaccuaaaauaucugccaucaucugccauaggaaagauacccagagacccaucaugu

SEQ ID NO: 636127 - RNA, 64 nt, hsa
cucugcuucuaaaaacuucuaugucuagucuuccauaggaaauccucacuguuuaaccauguga

SEQ ID NO: 636128 - RNA, 64 nt, hsa
ucaauggcuugcaauaaaugugcaaacugcaucuauaggaaacauuuuugugauuacggaauac

SEQ ID NO: 636129 - RNA, 64 nt, hsa
gggugggggcauggggcccaggagguugcuagagauaggaaauggggcaaaucgcaggugaccu

SEQ ID NO: 636130 - RNA, 64 nt, hsa
gucagucuccuucagaaauauaaucuccauauugauaggaaagcaauaauugccaugagguaac

SEQ ID NO: 636131 - RNA, 64 nt, hsa; identical to SEQ ID NO: 42679

SEQ ID NO: 636132 - RNA, 64 nt, hsa; identical to SEQ ID NO: 42680

SEQ ID NO: 636133 - RNA, 64 nt, hsa; identical to SEQ ID NO: 42681

SEQ ID NO: 636134 - RNA, 64 nt, hsa; identical to SEQ ID NO: 42682

SEQ ID NO: 636135 - RNA, 64 nt, hsa; identical to SEQ ID NO: 42683

SEQ ID NO: 636136 - RNA, 64 nt, hsa; identical to SEQ ID NO: 42684

SEQ ID NO: 636137 - RNA, 64 nt, hsa; identical to SEQ ID NO: 42685

SEQ ID NO: 636138 - RNA, 64 nt, hsa; identical to SEQ ID NO: 42686

SEQ ID NO: 636139 - RNA, 64 nt, hsa; identical to SEQ ID NO: 42687

SEQ ID NO: 636140 - RNA, 64 nt, hsa; identical to SEQ ID NO: 42688

SEQ ID NO: 636141 - RNA, 64 nt, hsa; identical to SEQ ID NO: 42689

SEQ ID NO: 636142 - RNA, 64 nt, hsa; identical to SEQ ID NO: 42690

SEQ ID NO: 636143 - RNA, 64 nt, hsa; identical to SEQ ID NO: 42691

SEQ ID NO: 636144 - RNA, 64 nt, hsa; identical to SEQ ID NO: 42692

SEQ ID NO: 636145 - RNA, 64 nt, hsa; identical to SEQ ID NO: 42693

SEQ ID NO: 636146 - RNA, 64 nt, hsa; identical to SEQ ID NO: 42694

SEQ ID NO: 636147 - RNA, 64 nt, hsa; identical to SEQ ID NO: 42695

SEQ ID NO: 636148 - RNA, 64 nt, hsa; identical to SEQ ID NO: 42696

SEQ ID NO: 636149 - RNA, 64 nt, hsa; identical to SEQ ID NO: 42697

SEQ ID NO: 636150 - RNA, 64 nt, hsa; identical to SEQ ID NO: 42698

SEQ ID NO: 636151 - RNA, 64 nt, hsa; identical to SEQ ID NO: 42699

SEQ ID NO: 636152 - RNA, 64 nt, hsa; identical to SEQ ID NO: 42700

SEQ ID NO: 636153 - RNA, 64 nt, hsa; identical to SEQ ID NO: 42701

SEQ ID NO: 636154 - RNA, 64 nt, hsa; identical to SEQ ID NO: 42702

SEQ ID NO: 636155 - RNA, 64 nt, hsa; identical to SEQ ID NO: 42703

SEQ ID NO: 636156 - RNA, 64 nt, hsa; identical to SEQ ID NO: 42704

SEQ ID NO: 636157 - RNA, 64 nt, hsa; identical to SEQ ID NO: 42705

SEQ ID NO: 636158 - RNA, 64 nt, hsa; identical to SEQ ID NO: 42706

SEQ ID NO: 636159 - RNA, 64 nt, hsa; identical to SEQ ID NO: 42707

SEQ ID NO: 636160 - RNA, 64 nt, hsa; identical to SEQ ID NO: 42708

SEQ ID NO: 636161 - RNA, 64 nt, hsa; identical to SEQ ID NO: 42709

SEQ ID NO: 636162 - RNA, 64 nt, hsa; identical to SEQ ID NO: 42710

SEQ ID NO: 636163 - RNA, 64 nt, hsa; identical to SEQ ID NO: 42711

SEQ ID NO: 636164 - RNA, 64 nt, hsa; identical to SEQ ID NO: 42712

SEQ ID NO: 636165 - RNA, 64 nt, hsa; identical to SEQ ID NO: 42713

SEQ ID NO: 636166 - RNA, 64 nt, hsa; identical to SEQ ID NO: 42714

SEQ ID NO: 636167 - RNA, 64 nt, hsa; identical to SEQ ID NO: 42715

SEQ ID NO: 636168 - RNA, 64 nt, hsa; identical to SEQ ID NO: 42716

SEQ ID NO: 636169 - RNA, 64 nt, hsa; identical to SEQ ID NO: 42717

SEQ ID NO: 636170 - RNA, 64 nt, hsa; identical to SEQ ID NO: 42718

SEQ ID NO: 636171 - RNA, 64 nt, hsa; identical to SEQ ID NO: 42719

SEQ ID NO: 636172 - RNA, 64 nt, hsa; identical to SEQ ID NO: 42720

SEQ ID NO: 636173 - RNA, 64 nt, hsa; identical to SEQ ID NO: 42721

SEQ ID NO: 636174 - RNA, 64 nt, hsa; identical to SEQ ID NO: 42722

SEQ ID NO: 636175 - RNA, 64 nt, hsa; identical to SEQ ID NO: 42723

SEQ ID NO: 636176 - RNA, 64 nt, hsa; identical to SEQ ID NO: 42724

SEQ ID NO: 636177 - RNA, 64 nt, hsa; identical to SEQ ID NO: 42725

SEQ ID NO: 636178 - RNA, 64 nt, hsa; identical to SEQ ID NO: 42726

SEQ ID NO: 636179 - RNA, 64 nt, hsa; identical to SEQ ID NO: 42727

SEQ ID NO: 636180 - RNA, 64 nt, hsa; identical to SEQ ID NO: 42728

SEQ ID NO: 636181 - RNA, 64 nt, hsa; identical to SEQ ID NO: 42729

SEQ ID NO: 636182 - RNA, 64 nt, hsa; identical to SEQ ID NO: 42730

SEQ ID NO: 636183 - RNA, 64 nt, hsa; identical to SEQ ID NO: 42731

SEQ ID NO: 636184 - RNA, 64 nt, hsa; identical to SEQ ID NO: 42732

SEQ ID NO: 636185 - RNA, 64 nt, hsa; identical to SEQ ID NO: 42733

SEQ ID NO: 636186 - RNA, 64 nt, hsa; identical to SEQ ID NO: 42734

SEQ ID NO: 636187 - RNA, 64 nt, hsa; identical to SEQ ID NO: 42735

SEQ ID NO: 636188 - RNA, 64 nt, hsa; identical to SEQ ID NO: 42736

SEQ ID NO: 636189 - RNA, 64 nt, hsa; identical to SEQ ID NO: 42737

SEQ ID NO: 636190 - RNA, 64 nt, hsa; identical to SEQ ID NO: 42738

SEQ ID NO: 636191 - RNA, 64 nt, hsa; identical to SEQ ID NO: 42739

SEQ ID NO: 636192 - RNA, 64 nt, hsa; identical to SEQ ID NO: 42740

SEQ ID NO: 636193 - RNA, 64 nt, hsa; identical to SEQ ID NO: 42741

SEQ ID NO: 636194 - RNA, 64 nt, hsa; identical to SEQ ID NO: 42742

SEQ ID NO: 636195 - RNA, 64 nt, hsa; identical to SEQ ID NO: 42743

SEQ ID NO: 636196 - RNA, 64 nt, hsa; identical to SEQ ID NO: 42744

SEQ ID NO: 636197 - RNA, 64 nt, hsa; identical to SEQ ID NO: 42745

SEQ ID NO: 636198 - RNA, 64 nt, hsa; identical to SEQ ID NO: 42746

SEQ ID NO: 636199 - RNA, 64 nt, hsa; identical to SEQ ID NO: 42747

SEQ ID NO: 636200 - RNA, 64 nt, hsa; identical to SEQ ID NO: 42748

SEQ ID NO: 636201 - RNA, 64 nt, hsa; identical to SEQ ID NO: 42749

SEQ ID NO: 636202 - RNA, 64 nt, hsa; identical to SEQ ID NO: 42750

SEQ ID NO: 636203 - RNA, 64 nt, hsa; identical to SEQ ID NO: 42751

SEQ ID NO: 636204 - RNA, 64 nt, hsa; identical to SEQ ID NO: 42752

SEQ ID NO: 636205 - RNA, 64 nt, hsa; identical to SEQ ID NO: 42753

SEQ ID NO: 636206 - RNA, 64 nt, hsa; identical to SEQ ID NO: 42754

SEQ ID NO: 636207 - RNA, 64 nt, hsa; identical to SEQ ID NO: 42755

SEQ ID NO: 636208 - RNA, 64 nt, hsa; identical to SEQ ID NO: 42756

SEQ ID NO: 636209 - RNA, 64 nt, hsa; identical to SEQ ID NO: 42757

SEQ ID NO: 636210 - RNA, 64 nt, hsa; identical to SEQ ID NO: 42758

SEQ ID NO: 636211 - RNA, 64 nt, hsa; identical to SEQ ID NO: 42759

SEQ ID NO: 636212 - RNA, 64 nt, hsa; identical to SEQ ID NO: 42760

SEQ ID NO: 636213 - RNA, 64 nt, hsa; identical to SEQ ID NO: 42761

SEQ ID NO: 636214 - RNA, 64 nt, hsa; identical to SEQ ID NO: 42762

SEQ ID NO: 636215 - RNA, 64 nt, hsa; identical to SEQ ID NO: 42763

SEQ ID NO: 636216 - RNA, 64 nt, hsa; identical to SEQ ID NO: 42764

SEQ ID NO: 636217 - RNA, 64 nt, hsa; identical to SEQ ID NO: 42765

SEQ ID NO: 636218 - RNA, 64 nt, hsa; identical to SEQ ID NO: 42766

SEQ ID NO: 636219 - RNA, 64 nt, hsa; identical to SEQ ID NO: 42767

SEQ ID NO: 636220 - RNA, 64 nt, hsa; identical to SEQ ID NO: 42768

SEQ ID NO: 636221 - RNA, 64 nt, hsa; identical to SEQ ID NO: 42769

SEQ ID NO: 636222 - RNA, 64 nt, hsa; identical to SEQ ID NO: 42770

SEQ ID NO: 636223 - RNA, 64 nt, hsa; identical to SEQ ID NO: 42771

SEQ ID NO: 636224 - RNA, 64 nt, hsa; identical to SEQ ID NO: 42772

SEQ ID NO: 636225 - RNA, 64 nt, hsa; identical to SEQ ID NO: 42773

SEQ ID NO: 636226 - RNA, 64 nt, hsa; identical to SEQ ID NO: 42774

SEQ ID NO: 636227 - RNA, 64 nt, hsa; identical to SEQ ID NO: 42775

SEQ ID NO: 636228 - RNA, 64 nt, hsa; identical to SEQ ID NO: 42776

SEQ ID NO: 636229 - RNA, 64 nt, hsa; identical to SEQ ID NO: 42777

SEQ ID NO: 636230 - RNA, 64 nt, hsa; identical to SEQ ID NO: 42778

SEQ ID NO: 636231 - RNA, 64 nt, hsa; identical to SEQ ID NO: 42779

SEQ ID NO: 636232 - RNA, 64 nt, hsa; identical to SEQ ID NO: 42780

SEQ ID NO: 636233 - RNA, 64 nt, hsa; identical to SEQ ID NO: 42781

SEQ ID NO: 636234 - RNA, 64 nt, hsa; identical to SEQ ID NO: 42782

SEQ ID NO: 636235 - RNA, 64 nt, hsa; identical to SEQ ID NO: 42783

SEQ ID NO: 636236 - RNA, 64 nt, hsa; identical to SEQ ID NO: 42784

SEQ ID NO: 636237 - RNA, 64 nt, hsa; identical to SEQ ID NO: 42785

SEQ ID NO: 636238 - RNA, 64 nt, hsa; identical to SEQ ID NO: 42786

SEQ ID NO: 636239 - RNA, 64 nt, hsa; identical to SEQ ID NO: 42787

SEQ ID NO: 636240 - RNA, 64 nt, hsa; identical to SEQ ID NO: 42788

SEQ ID NO: 636241 - RNA, 64 nt, hsa; identical to SEQ ID NO: 42789

SEQ ID NO: 636242 - RNA, 64 nt, hsa; identical to SEQ ID NO: 42790

SEQ ID NO: 636243 - RNA, 64 nt, hsa; identical to SEQ ID NO: 42791

SEQ ID NO: 636244 - RNA, 64 nt, hsa; identical to SEQ ID NO: 42792

SEQ ID NO: 636245 - RNA, 64 nt, hsa; identical to SEQ ID NO: 42793

SEQ ID NO: 636246 - RNA, 64 nt, hsa; identical to SEQ ID NO: 42794

SEQ ID NO: 636247 - RNA, 64 nt, hsa; identical to SEQ ID NO: 42795

SEQ ID NO: 636248 - RNA, 64 nt, hsa; identical to SEQ ID NO: 42796

SEQ ID NO: 636249 - RNA, 64 nt, hsa; identical to SEQ ID NO: 42797

SEQ ID NO: 636250 - RNA, 64 nt, hsa; identical to SEQ ID NO: 42798

SEQ ID NO: 636251 - RNA, 64 nt, hsa; identical to SEQ ID NO: 42799

SEQ ID NO: 636252 - RNA, 64 nt, hsa; identical to SEQ ID NO: 42800

SEQ ID NO: 636253 - RNA, 64 nt, hsa; identical to SEQ ID NO: 42801

SEQ ID NO: 636254 - RNA, 64 nt, hsa; identical to SEQ ID NO: 42802

SEQ ID NO: 636255 - RNA, 64 nt, hsa; identical to SEQ ID NO: 42803

SEQ ID NO: 636256 - RNA, 64 nt, hsa; identical to SEQ ID NO: 42804

SEQ ID NO: 636257 - RNA, 64 nt, hsa; identical to SEQ ID NO: 42805

SEQ ID NO: 636258 - RNA, 64 nt, hsa; identical to SEQ ID NO: 42806

SEQ ID NO: 636259 - RNA, 64 nt, hsa; identical to SEQ ID NO: 42807

SEQ ID NO: 636260 - RNA, 64 nt, hsa; identical to SEQ ID NO: 42808

SEQ ID NO: 636261 - RNA, 64 nt, hsa; identical to SEQ ID NO: 42809

SEQ ID NO: 636262 - RNA, 64 nt, hsa; identical to SEQ ID NO: 42810

SEQ ID NO: 636263 - RNA, 64 nt, hsa; identical to SEQ ID NO: 42811

SEQ ID NO: 636264 - RNA, 64 nt, hsa; identical to SEQ ID NO: 42812

SEQ ID NO: 636265 - RNA, 64 nt, hsa; identical to SEQ ID NO: 42813

SEQ ID NO: 636266 - RNA, 64 nt, hsa; identical to SEQ ID NO: 42814

SEQ ID NO: 636267 - RNA, 64 nt, hsa; identical to SEQ ID NO: 42815

SEQ ID NO: 636268 - RNA, 64 nt, hsa; identical to SEQ ID NO: 42816

SEQ ID NO: 636269 - RNA, 64 nt, hsa; identical to SEQ ID NO: 42817

SEQ ID NO: 636270 - RNA, 64 nt, hsa; identical to SEQ ID NO: 42818

SEQ ID NO: 636271 - RNA, 64 nt, hsa; identical to SEQ ID NO: 42819

SEQ ID NO: 636272 - RNA, 64 nt, hsa; identical to SEQ ID NO: 42820

SEQ ID NO: 636273 - RNA, 64 nt, hsa; identical to SEQ ID NO: 42821

SEQ ID NO: 636274 - RNA, 64 nt, hsa; identical to SEQ ID NO: 42822

SEQ ID NO: 636275 - RNA, 64 nt, hsa; identical to SEQ ID NO: 42823

SEQ ID NO: 636276 - RNA, 64 nt, hsa; identical to SEQ ID NO: 42824

SEQ ID NO: 636277 - RNA, 64 nt, hsa; identical to SEQ ID NO: 42825

SEQ ID NO: 636278 - RNA, 64 nt, hsa; identical to SEQ ID NO: 42826

SEQ ID NO: 636279 - RNA, 64 nt, hsa; identical to SEQ ID NO: 42827

SEQ ID NO: 636280 - RNA, 64 nt, hsa; identical to SEQ ID NO: 42828

SEQ ID NO: 636281 - RNA, 64 nt, hsa; identical to SEQ ID NO: 42829

SEQ ID NO: 636282 - RNA, 64 nt, hsa; identical to SEQ ID NO: 42830

SEQ ID NO: 636283 - RNA, 64 nt, hsa; identical to SEQ ID NO: 42831

SEQ ID NO: 636284 - RNA, 64 nt, hsa; identical to SEQ ID NO: 42832

SEQ ID NO: 636285 - RNA, 64 nt, hsa; identical to SEQ ID NO: 42833

SEQ ID NO: 636286 - RNA, 64 nt, hsa; identical to SEQ ID NO: 42834

SEQ ID NO: 636287 - RNA, 64 nt, hsa; identical to SEQ ID NO: 42835

SEQ ID NO: 636288 - RNA, 64 nt, hsa; identical to SEQ ID NO: 42836

SEQ ID NO: 636289 - RNA, 64 nt, hsa; identical to SEQ ID NO: 42837

SEQ ID NO: 636290 - RNA, 64 nt, hsa; identical to SEQ ID NO: 42838

SEQ ID NO: 636291 - RNA, 64 nt, hsa; identical to SEQ ID NO: 42839

SEQ ID NO: 636292 - RNA, 64 nt, hsa; identical to SEQ ID NO: 42840

SEQ ID NO: 636293 - RNA, 64 nt, hsa; identical to SEQ ID NO: 42841

SEQ ID NO: 636294 - RNA, 64 nt, hsa; identical to SEQ ID NO: 42842

SEQ ID NO: 636295 - RNA, 64 nt, hsa; identical to SEQ ID NO: 42843

SEQ ID NO: 636296 - RNA, 64 nt, hsa; identical to SEQ ID NO: 42844

SEQ ID NO: 636297 - RNA, 64 nt, hsa; identical to SEQ ID NO: 42845

SEQ ID NO: 636298 - RNA, 64 nt, hsa; identical to SEQ ID NO: 42846

SEQ ID NO: 636299 - RNA, 64 nt, hsa; identical to SEQ ID NO: 42847

SEQ ID NO: 636300 - RNA, 64 nt, hsa; identical to SEQ ID NO: 42848

SEQ ID NO: 636301 - RNA, 64 nt, hsa; identical to SEQ ID NO: 42849

SEQ ID NO: 636302 - RNA, 64 nt, hsa; identical to SEQ ID NO: 42850

SEQ ID NO: 636303 - RNA, 64 nt, hsa; identical to SEQ ID NO: 42851

SEQ ID NO: 636304 - RNA, 64 nt, hsa; identical to SEQ ID NO: 42852

SEQ ID NO: 636305 - RNA, 64 nt, hsa; identical to SEQ ID NO: 42853

SEQ ID NO: 636306 - RNA, 64 nt, hsa; identical to SEQ ID NO: 42854

SEQ ID NO: 636307 - RNA, 64 nt, hsa; identical to SEQ ID NO: 42855

SEQ ID NO: 636308 - RNA, 64 nt, hsa; identical to SEQ ID NO: 42856

SEQ ID NO: 636309 - RNA, 64 nt, hsa; identical to SEQ ID NO: 42857

SEQ ID NO: 636310 - RNA, 64 nt, hsa; identical to SEQ ID NO: 42858

SEQ ID NO: 636311 - RNA, 64 nt, hsa; identical to SEQ ID NO: 42859

SEQ ID NO: 636312 - RNA, 64 nt, hsa; identical to SEQ ID NO: 42860

SEQ ID NO: 636313 - RNA, 64 nt, hsa; identical to SEQ ID NO: 42861

SEQ ID NO: 636314 - RNA, 64 nt, hsa; identical to SEQ ID NO: 42862

SEQ ID NO: 636315 - RNA, 64 nt, hsa; identical to SEQ ID NO: 42863

SEQ ID NO: 636316 - RNA, 64 nt, hsa; identical to SEQ ID NO: 42864

SEQ ID NO: 636317 - RNA, 64 nt, hsa; identical to SEQ ID NO: 42865

SEQ ID NO: 636318 - RNA, 64 nt, hsa; identical to SEQ ID NO: 42866

SEQ ID NO: 636319 - RNA, 64 nt, hsa; identical to SEQ ID NO: 42867

SEQ ID NO: 636320 - RNA, 64 nt, hsa; identical to SEQ ID NO: 42868

SEQ ID NO: 636321 - RNA, 64 nt, hsa; identical to SEQ ID NO: 42869

SEQ ID NO: 636322 - RNA, 64 nt, hsa; identical to SEQ ID NO: 42870

SEQ ID NO: 636323 - RNA, 64 nt, hsa; identical to SEQ ID NO: 42871

SEQ ID NO: 636324 - RNA, 64 nt, hsa; identical to SEQ ID NO: 42872

SEQ ID NO: 636325 - RNA, 64 nt, hsa; identical to SEQ ID NO: 42873

SEQ ID NO: 636326 - RNA, 64 nt, hsa; identical to SEQ ID NO: 42874

SEQ ID NO: 636327 - RNA, 64 nt, hsa; identical to SEQ ID NO: 42875

SEQ ID NO: 636328 - RNA, 64 nt, hsa; identical to SEQ ID NO: 42876

SEQ ID NO: 636329 - RNA, 64 nt, hsa; identical to SEQ ID NO: 42877

SEQ ID NO: 636330 - RNA, 64 nt, hsa; identical to SEQ ID NO: 42878

SEQ ID NO: 636331 - RNA, 64 nt, hsa; identical to SEQ ID NO: 42879

SEQ ID NO: 636332 - RNA, 64 nt, hsa; identical to SEQ ID NO: 42880

SEQ ID NO: 636333 - RNA, 64 nt, hsa; identical to SEQ ID NO: 42881

SEQ ID NO: 636334 - RNA, 64 nt, hsa; identical to SEQ ID NO: 42882

SEQ ID NO: 636335 - RNA, 64 nt, hsa; identical to SEQ ID NO: 42883

SEQ ID NO: 636336 - RNA, 64 nt, hsa; identical to SEQ ID NO: 42884

SEQ ID NO: 636337 - RNA, 64 nt, hsa; identical to SEQ ID NO: 42885

SEQ ID NO: 636338 - RNA, 64 nt, hsa; identical to SEQ ID NO: 42886

SEQ ID NO: 636339 - RNA, 64 nt, hsa; identical to SEQ ID NO: 42887

SEQ ID NO: 636340 - RNA, 64 nt, hsa; identical to SEQ ID NO: 42888

SEQ ID NO: 636341 - RNA, 64 nt, hsa; identical to SEQ ID NO: 42889

SEQ ID NO: 636342 - RNA, 64 nt, hsa; identical to SEQ ID NO: 42890

SEQ ID NO: 636343 - RNA, 64 nt, hsa; identical to SEQ ID NO: 42891

SEQ ID NO: 636344 - RNA, 64 nt, hsa; identical to SEQ ID NO: 42892

SEQ ID NO: 636345 - RNA, 64 nt, hsa; identical to SEQ ID NO: 42893

SEQ ID NO: 636346 - RNA, 64 nt, hsa; identical to SEQ ID NO: 42894

SEQ ID NO: 636347 - RNA, 64 nt, hsa; identical to SEQ ID NO: 42895

SEQ ID NO: 636348 - RNA, 64 nt, hsa; identical to SEQ ID NO: 42896

SEQ ID NO: 636349 - RNA, 64 nt, hsa; identical to SEQ ID NO: 42897

SEQ ID NO: 636350 - RNA, 64 nt, hsa; identical to SEQ ID NO: 42898

SEQ ID NO: 636351 - RNA, 64 nt, hsa; identical to SEQ ID NO: 42899

SEQ ID NO: 636352 - RNA, 64 nt, hsa; identical to SEQ ID NO: 42900

SEQ ID NO: 636353 - RNA, 64 nt, hsa; identical to SEQ ID NO: 42901

SEQ ID NO: 636354 - RNA, 64 nt, hsa; identical to SEQ ID NO: 42902

SEQ ID NO: 636355 - RNA, 64 nt, hsa; identical to SEQ ID NO: 42903

SEQ ID NO: 636356 - RNA, 64 nt, hsa; identical to SEQ ID NO: 42904

SEQ ID NO: 636357 - RNA, 64 nt, hsa; identical to SEQ ID NO: 42905

SEQ ID NO: 636358 - RNA, 64 nt, hsa; identical to SEQ ID NO: 42906

SEQ ID NO: 636359 - RNA, 64 nt, hsa; identical to SEQ ID NO: 42907

SEQ ID NO: 636360 - RNA, 64 nt, hsa; identical to SEQ ID NO: 42908

SEQ ID NO: 636361 - RNA, 64 nt, hsa; identical to SEQ ID NO: 42909

SEQ ID NO: 636362 - RNA, 64 nt, hsa; identical to SEQ ID NO: 42910

SEQ ID NO: 636363 - RNA, 64 nt, hsa; identical to SEQ ID NO: 42911

SEQ ID NO: 636364 - RNA, 64 nt, hsa; identical to SEQ ID NO: 42912

SEQ ID NO: 636365 - RNA, 64 nt, hsa; identical to SEQ ID NO: 42913

SEQ ID NO: 636366 - RNA, 64 nt, hsa; identical to SEQ ID NO: 42914

SEQ ID NO: 636367 - RNA, 64 nt, hsa; identical to SEQ ID NO: 42915

SEQ ID NO: 636368 - RNA, 64 nt, hsa; identical to SEQ ID NO: 42916

SEQ ID NO: 636369 - RNA, 64 nt, hsa; identical to SEQ ID NO: 42917

SEQ ID NO: 636370 - RNA, 64 nt, hsa; identical to SEQ ID NO: 42918

SEQ ID NO: 636371 - RNA, 64 nt, hsa; identical to SEQ ID NO: 42919

SEQ ID NO: 636372 - RNA, 64 nt, hsa; identical to SEQ ID NO: 42920

SEQ ID NO: 636373 - RNA, 64 nt, hsa; identical to SEQ ID NO: 42921

SEQ ID NO: 636374 - RNA, 64 nt, hsa; identical to SEQ ID NO: 42922

SEQ ID NO: 636375 - RNA, 64 nt, hsa; identical to SEQ ID NO: 42923

SEQ ID NO: 636376 - RNA, 64 nt, hsa; identical to SEQ ID NO: 42924

SEQ ID NO: 636377 - RNA, 64 nt, hsa; identical to SEQ ID NO: 42925

SEQ ID NO: 636378 - RNA, 64 nt, hsa; identical to SEQ ID NO: 42926

SEQ ID NO: 636379 - RNA, 64 nt, hsa; identical to SEQ ID NO: 42927

SEQ ID NO: 636380 - RNA, 64 nt, hsa; identical to SEQ ID NO: 42928

SEQ ID NO: 636381 - RNA, 64 nt, hsa; identical to SEQ ID NO: 42929

SEQ ID NO: 636382 - RNA, 64 nt, hsa; identical to SEQ ID NO: 42930

SEQ ID NO: 636383 - RNA, 64 nt, hsa; identical to SEQ ID NO: 42931

SEQ ID NO: 636384 - RNA, 64 nt, hsa; identical to SEQ ID NO: 42932

SEQ ID NO: 636385 - RNA, 64 nt, hsa; identical to SEQ ID NO: 42933

SEQ ID NO: 636386 - RNA, 64 nt, hsa; identical to SEQ ID NO: 42934

SEQ ID NO: 636387 - RNA, 64 nt, hsa; identical to SEQ ID NO: 42935

SEQ ID NO: 636388 - RNA, 64 nt, hsa; identical to SEQ ID NO: 42936

SEQ ID NO: 636389 - RNA, 64 nt, hsa; identical to SEQ ID NO: 42937

SEQ ID NO: 636390 - RNA, 64 nt, hsa; identical to SEQ ID NO: 42938

SEQ ID NO: 636391 - RNA, 64 nt, hsa; identical to SEQ ID NO: 42939

SEQ ID NO: 636392 - RNA, 64 nt, hsa; identical to SEQ ID NO: 42940

SEQ ID NO: 636393 - RNA, 64 nt, hsa; identical to SEQ ID NO: 42941

SEQ ID NO: 636394 - RNA, 64 nt, hsa; identical to SEQ ID NO: 42942

SEQ ID NO: 636395 - RNA, 64 nt, hsa; identical to SEQ ID NO: 42943

SEQ ID NO: 636396 - RNA, 64 nt, hsa; identical to SEQ ID NO: 42944

SEQ ID NO: 636397 - RNA, 64 nt, hsa; identical to SEQ ID NO: 42945

SEQ ID NO: 636398 - RNA, 64 nt, hsa; identical to SEQ ID NO: 42946

SEQ ID NO: 636399 - RNA, 64 nt, hsa; identical to SEQ ID NO: 42947

SEQ ID NO: 636400 - RNA, 64 nt, hsa; identical to SEQ ID NO: 42948

SEQ ID NO: 636401 - RNA, 64 nt, hsa; identical to SEQ ID NO: 42949

SEQ ID NO: 636402 - RNA, 64 nt, hsa; identical to SEQ ID NO: 42950

SEQ ID NO: 636403 - RNA, 64 nt, hsa; identical to SEQ ID NO: 42951

SEQ ID NO: 636404 - RNA, 64 nt, hsa; identical to SEQ ID NO: 42952

SEQ ID NO: 636405 - RNA, 64 nt, hsa; identical to SEQ ID NO: 42953

SEQ ID NO: 636406 - RNA, 64 nt, hsa; identical to SEQ ID NO: 42954

SEQ ID NO: 636407 - RNA, 64 nt, hsa; identical to SEQ ID NO: 42955

SEQ ID NO: 636408 - RNA, 64 nt, hsa; identical to SEQ ID NO: 42956

SEQ ID NO: 636409 - RNA, 64 nt, hsa; identical to SEQ ID NO: 42957

SEQ ID NO: 636410 - RNA, 64 nt, hsa; identical to SEQ ID NO: 42958

SEQ ID NO: 636411 - RNA, 64 nt, hsa; identical to SEQ ID NO: 42959

SEQ ID NO: 636412 - RNA, 64 nt, hsa; identical to SEQ ID NO: 42960

SEQ ID NO: 636413 - RNA, 64 nt, hsa; identical to SEQ ID NO: 42961

SEQ ID NO: 636414 - RNA, 64 nt, hsa; identical to SEQ ID NO: 42962

SEQ ID NO: 636415 - RNA, 64 nt, hsa; identical to SEQ ID NO: 42963

SEQ ID NO: 636416 - RNA, 64 nt, hsa; identical to SEQ ID NO: 42964

SEQ ID NO: 636417 - RNA, 64 nt, hsa; identical to SEQ ID NO: 42965

SEQ ID NO: 636418 - RNA, 64 nt, hsa; identical to SEQ ID NO: 42966

SEQ ID NO: 636419 - RNA, 64 nt, hsa; identical to SEQ ID NO: 42967

SEQ ID NO: 636420 - RNA, 64 nt, hsa; identical to SEQ ID NO: 42968

SEQ ID NO: 636421 - RNA, 64 nt, hsa; identical to SEQ ID NO: 42969

SEQ ID NO: 636422 - RNA, 64 nt, hsa; identical to SEQ ID NO: 42970

SEQ ID NO: 636423 - RNA, 64 nt, hsa; identical to SEQ ID NO: 42971

SEQ ID NO: 636424 - RNA, 64 nt, hsa; identical to SEQ ID NO: 42972

SEQ ID NO: 636425 - RNA, 64 nt, hsa; identical to SEQ ID NO: 42973

SEQ ID NO: 636426 - RNA, 64 nt, hsa; identical to SEQ ID NO: 42974

SEQ ID NO: 636427 - RNA, 64 nt, hsa; identical to SEQ ID NO: 42975

SEQ ID NO: 636428 - RNA, 64 nt, hsa; identical to SEQ ID NO: 42976

SEQ ID NO: 636429 - RNA, 64 nt, hsa; identical to SEQ ID NO: 42977

SEQ ID NO: 636430 - RNA, 64 nt, hsa; identical to SEQ ID NO: 42978

SEQ ID NO: 636431 - RNA, 64 nt, hsa; identical to SEQ ID NO: 42979

SEQ ID NO: 636432 - RNA, 64 nt, hsa; identical to SEQ ID NO: 42980

SEQ ID NO: 636433 - RNA, 64 nt, hsa; identical to SEQ ID NO: 42981

SEQ ID NO: 636434 - RNA, 64 nt, hsa; identical to SEQ ID NO: 42982

SEQ ID NO: 636435 - RNA, 64 nt, hsa; identical to SEQ ID NO: 42983

SEQ ID NO: 636436 - RNA, 64 nt, hsa; identical to SEQ ID NO: 42984

SEQ ID NO: 636437 - RNA, 64 nt, hsa; identical to SEQ ID NO: 42985

SEQ ID NO: 636438 - RNA, 64 nt, hsa; identical to SEQ ID NO: 42986

SEQ ID NO: 636439 - RNA, 64 nt, hsa; identical to SEQ ID NO: 42987

SEQ ID NO: 636440 - RNA, 64 nt, hsa; identical to SEQ ID NO: 42988

SEQ ID NO: 636441 - RNA, 64 nt, hsa; identical to SEQ ID NO: 42989

SEQ ID NO: 636442 - RNA, 64 nt, hsa; identical to SEQ ID NO: 42990

SEQ ID NO: 636443 - RNA, 64 nt, hsa; identical to SEQ ID NO: 42991

SEQ ID NO: 636444 - RNA, 64 nt, hsa; identical to SEQ ID NO: 42992

SEQ ID NO: 636445 - RNA, 64 nt, hsa; identical to SEQ ID NO: 42993

SEQ ID NO: 636446 - RNA, 64 nt, hsa; identical to SEQ ID NO: 42994

SEQ ID NO: 636447 - RNA, 64 nt, hsa; identical to SEQ ID NO: 42995

SEQ ID NO: 636448 - RNA, 64 nt, hsa; identical to SEQ ID NO: 42996

SEQ ID NO: 636449 - RNA, 64 nt, hsa; identical to SEQ ID NO: 42997

SEQ ID NO: 636450 - RNA, 64 nt, hsa; identical to SEQ ID NO: 42998

SEQ ID NO: 636451 - RNA, 64 nt, hsa; identical to SEQ ID NO: 42999

SEQ ID NO: 636452 - RNA, 64 nt, hsa; identical to SEQ ID NO: 43000

SEQ ID NO: 636453 - RNA, 64 nt, hsa; identical to SEQ ID NO: 43001

SEQ ID NO: 636454 - RNA, 64 nt, hsa; identical to SEQ ID NO: 43002

SEQ ID NO: 636455 - RNA, 64 nt, hsa; identical to SEQ ID NO: 43003

SEQ ID NO: 636456 - RNA, 64 nt, hsa; identical to SEQ ID NO: 43004

SEQ ID NO: 636457 - RNA, 64 nt, hsa; identical to SEQ ID NO: 43005

SEQ ID NO: 636458 - RNA, 64 nt, hsa; identical to SEQ ID NO: 43006

SEQ ID NO: 636459 - RNA, 64 nt, hsa; identical to SEQ ID NO: 43007

SEQ ID NO: 636460 - RNA, 64 nt, hsa; identical to SEQ ID NO: 43008

SEQ ID NO: 636461 - RNA, 64 nt, hsa; identical to SEQ ID NO: 43009

SEQ ID NO: 636462 - RNA, 64 nt, hsa; identical to SEQ ID NO: 43010

SEQ ID NO: 636463 - RNA, 64 nt, hsa; identical to SEQ ID NO: 43011

SEQ ID NO: 636464 - RNA, 64 nt, hsa; identical to SEQ ID NO: 43012

SEQ ID NO: 636465 - RNA, 62 nt, hsa; identical to SEQ ID NO: 43013

SEQ ID NO: 636466 - RNA, 64 nt, hsa; identical to SEQ ID NO: 43014

SEQ ID NO: 636467 - RNA, 64 nt, hsa; identical to SEQ ID NO: 43015

SEQ ID NO: 636468 - RNA, 64 nt, hsa; identical to SEQ ID NO: 43016

SEQ ID NO: 636469 - RNA, 64 nt, hsa; identical to SEQ ID NO: 43017

SEQ ID NO: 636470 - RNA, 64 nt, hsa; identical to SEQ ID NO: 43018

SEQ ID NO: 636471 - RNA, 64 nt, hsa; identical to SEQ ID NO: 43019

SEQ ID NO: 636472 - RNA, 64 nt, hsa; identical to SEQ ID NO: 43020

SEQ ID NO: 636473 - RNA, 64 nt, hsa; identical to SEQ ID NO: 43021

SEQ ID NO: 636474 - RNA, 64 nt, hsa; identical to SEQ ID NO: 43022

SEQ ID NO: 636475 - RNA, 64 nt, hsa; identical to SEQ ID NO: 43023

SEQ ID NO: 636476 - RNA, 64 nt, hsa; identical to SEQ ID NO: 43024

SEQ ID NO: 636477 - RNA, 64 nt, hsa; identical to SEQ ID NO: 43025

SEQ ID NO: 636478 - RNA, 64 nt, hsa; identical to SEQ ID NO: 43026

SEQ ID NO: 636479 - RNA, 64 nt, hsa; identical to SEQ ID NO: 43027

SEQ ID NO: 636480 - RNA, 64 nt, hsa; identical to SEQ ID NO: 43028

SEQ ID NO: 636481 - RNA, 64 nt, hsa; identical to SEQ ID NO: 43029

SEQ ID NO: 636482 - RNA, 64 nt, hsa; identical to SEQ ID NO: 43030

SEQ ID NO: 636483 - RNA, 64 nt, hsa; identical to SEQ ID NO: 43031

SEQ ID NO: 636484 - RNA, 64 nt, hsa; identical to SEQ ID NO: 43032

SEQ ID NO: 636485 - RNA, 64 nt, hsa; identical to SEQ ID NO: 43033

SEQ ID NO: 636486 - RNA, 64 nt, hsa; identical to SEQ ID NO: 43034

SEQ ID NO: 636487 - RNA, 64 nt, hsa; identical to SEQ ID NO: 43035

SEQ ID NO: 636488 - RNA, 64 nt, hsa; identical to SEQ ID NO: 43036

SEQ ID NO: 636489 - RNA, 64 nt, hsa; identical to SEQ ID NO: 43037

SEQ ID NO: 636490 - RNA, 64 nt, hsa; identical to SEQ ID NO: 43038

SEQ ID NO: 636491 - RNA, 64 nt, hsa; identical to SEQ ID NO: 43039

SEQ ID NO: 636492 - RNA, 64 nt, hsa; identical to SEQ ID NO: 43040

SEQ ID NO: 636493 - RNA, 64 nt, hsa; identical to SEQ ID NO: 43041

SEQ ID NO: 636494 - RNA, 64 nt, hsa; identical to SEQ ID NO: 43042

SEQ ID NO: 636495 - RNA, 64 nt, hsa; identical to SEQ ID NO: 43043

SEQ ID NO: 636496 - RNA, 64 nt, hsa; identical to SEQ ID NO: 43044

SEQ ID NO: 636497 - RNA, 64 nt, hsa; identical to SEQ ID NO: 43045

SEQ ID NO: 636498 - RNA, 64 nt, hsa; identical to SEQ ID NO: 43046

SEQ ID NO: 636499 - RNA, 64 nt, hsa; identical to SEQ ID NO: 43047

SEQ ID NO: 636500 - RNA, 64 nt, hsa; identical to SEQ ID NO: 43048

SEQ ID NO: 636501 - RNA, 64 nt, hsa; identical to SEQ ID NO: 43049

SEQ ID NO: 636502 - RNA, 64 nt, hsa; identical to SEQ ID NO: 43050

SEQ ID NO: 636503 - RNA, 64 nt, hsa; identical to SEQ ID NO: 43051

SEQ ID NO: 636504 - RNA, 64 nt, hsa; identical to SEQ ID NO: 43052

SEQ ID NO: 636505 - RNA, 64 nt, hsa; identical to SEQ ID NO: 43053

SEQ ID NO: 636506 - RNA, 64 nt, hsa; identical to SEQ ID NO: 43054

SEQ ID NO: 636507 - RNA, 64 nt, hsa; identical to SEQ ID NO: 43055

SEQ ID NO: 636508 - RNA, 64 nt, hsa; identical to SEQ ID NO: 43056

SEQ ID NO: 636509 - RNA, 64 nt, hsa; identical to SEQ ID NO: 43057

SEQ ID NO: 636510 - RNA, 64 nt, hsa; identical to SEQ ID NO: 43058

SEQ ID NO: 636511 - RNA, 64 nt, hsa; identical to SEQ ID NO: 43059

SEQ ID NO: 636512 - RNA, 64 nt, hsa; identical to SEQ ID NO: 43060

SEQ ID NO: 636513 - RNA, 64 nt, hsa; identical to SEQ ID NO: 43061

SEQ ID NO: 636514 - RNA, 64 nt, hsa; identical to SEQ ID NO: 43062

SEQ ID NO: 636515 - RNA, 64 nt, hsa; identical to SEQ ID NO: 43063

SEQ ID NO: 636516 - RNA, 64 nt, hsa; identical to SEQ ID NO: 43064

SEQ ID NO: 636517 - RNA, 64 nt, hsa; identical to SEQ ID NO: 43065

SEQ ID NO: 636518 - RNA, 64 nt, hsa; identical to SEQ ID NO: 43066

SEQ ID NO: 636519 - RNA, 64 nt, hsa; identical to SEQ ID NO: 43067

SEQ ID NO: 636520 - RNA, 64 nt, hsa; identical to SEQ ID NO: 43068

SEQ ID NO: 636521 - RNA, 64 nt, hsa; identical to SEQ ID NO: 43069

SEQ ID NO: 636522 - RNA, 64 nt, hsa; identical to SEQ ID NO: 43070

SEQ ID NO: 636523 - RNA, 64 nt, hsa; identical to SEQ ID NO: 43071

SEQ ID NO: 636524 - RNA, 64 nt, hsa; identical to SEQ ID NO: 43072

SEQ ID NO: 636525 - RNA, 64 nt, hsa; identical to SEQ ID NO: 43073

SEQ ID NO: 636526 - RNA, 64 nt, hsa; identical to SEQ ID NO: 43074

SEQ ID NO: 636527 - RNA, 64 nt, hsa; identical to SEQ ID NO: 43075

SEQ ID NO: 636528 - RNA, 64 nt, hsa; identical to SEQ ID NO: 43076

SEQ ID NO: 636529 - RNA, 64 nt, hsa; identical to SEQ ID NO: 43077

SEQ ID NO: 636530 - RNA, 64 nt, hsa; identical to SEQ ID NO: 43078

SEQ ID NO: 636531 - RNA, 64 nt, hsa; identical to SEQ ID NO: 43079

SEQ ID NO: 636532 - RNA, 64 nt, hsa; identical to SEQ ID NO: 43080

SEQ ID NO: 636533 - RNA, 64 nt, hsa; identical to SEQ ID NO: 43081

SEQ ID NO: 636534 - RNA, 64 nt, hsa; identical to SEQ ID NO: 43082

SEQ ID NO: 636535 - RNA, 64 nt, hsa; identical to SEQ ID NO: 43083

SEQ ID NO: 636536 - RNA, 64 nt, hsa; identical to SEQ ID NO: 43084

SEQ ID NO: 636537 - RNA, 64 nt, hsa; identical to SEQ ID NO: 43085

SEQ ID NO: 636538 - RNA, 64 nt, hsa; identical to SEQ ID NO: 43086

SEQ ID NO: 636539 - RNA, 64 nt, hsa; identical to SEQ ID NO: 43087

SEQ ID NO: 636540 - RNA, 64 nt, hsa; identical to SEQ ID NO: 43088

SEQ ID NO: 636541 - RNA, 64 nt, hsa; identical to SEQ ID NO: 43089

SEQ ID NO: 636542 - RNA, 64 nt, hsa; identical to SEQ ID NO: 43090

SEQ ID NO: 636543 - RNA, 64 nt, hsa; identical to SEQ ID NO: 43091

SEQ ID NO: 636544 - RNA, 64 nt, hsa; identical to SEQ ID NO: 43092

SEQ ID NO: 636545 - RNA, 64 nt, hsa; identical to SEQ ID NO: 43093

SEQ ID NO: 636546 - RNA, 64 nt, hsa; identical to SEQ ID NO: 43094

SEQ ID NO: 636547 - RNA, 64 nt, hsa; identical to SEQ ID NO: 43095

SEQ ID NO: 636548 - RNA, 64 nt, hsa; identical to SEQ ID NO: 43096

SEQ ID NO: 636549 - RNA, 64 nt, hsa; identical to SEQ ID NO: 43097

SEQ ID NO: 636550 - RNA, 64 nt, hsa; identical to SEQ ID NO: 43098

SEQ ID NO: 636551 - RNA, 64 nt, hsa; identical to SEQ ID NO: 43099

SEQ ID NO: 636552 - RNA, 63 nt, hsa; identical to SEQ ID NO: 43100

SEQ ID NO: 636553 - RNA, 64 nt, hsa; identical to SEQ ID NO: 43101

SEQ ID NO: 636554 - RNA, 64 nt, hsa; identical to SEQ ID NO: 43102

SEQ ID NO: 636555 - RNA, 64 nt, hsa; identical to SEQ ID NO: 43103

SEQ ID NO: 636556 - RNA, 64 nt, hsa; identical to SEQ ID NO: 43104

SEQ ID NO: 636557 - RNA, 64 nt, hsa; identical to SEQ ID NO: 43105

SEQ ID NO: 636558 - RNA, 64 nt, hsa; identical to SEQ ID NO: 43106

SEQ ID NO: 636559 - RNA, 64 nt, hsa; identical to SEQ ID NO: 43107

SEQ ID NO: 636560 - RNA, 64 nt, hsa; identical to SEQ ID NO: 43108

SEQ ID NO: 636561 - RNA, 64 nt, hsa; identical to SEQ ID NO: 43109

SEQ ID NO: 636562 - RNA, 64 nt, hsa; identical to SEQ ID NO: 43110

SEQ ID NO: 636563 - RNA, 64 nt, hsa; identical to SEQ ID NO: 43111

SEQ ID NO: 636564 - RNA, 64 nt, hsa; identical to SEQ ID NO: 43112

SEQ ID NO: 636565 - RNA, 64 nt, hsa; identical to SEQ ID NO: 43113

SEQ ID NO: 636566 - RNA, 64 nt, hsa; identical to SEQ ID NO: 43114

SEQ ID NO: 636567 - RNA, 64 nt, hsa; identical to SEQ ID NO: 43115

SEQ ID NO: 636568 - RNA, 64 nt, hsa; identical to SEQ ID NO: 43116

SEQ ID NO: 636569 - RNA, 64 nt, hsa; identical to SEQ ID NO: 43117

SEQ ID NO: 636570 - RNA, 64 nt, hsa; identical to SEQ ID NO: 43118

SEQ ID NO: 636571 - RNA, 64 nt, hsa; identical to SEQ ID NO: 43119

SEQ ID NO: 636572 - RNA, 64 nt, hsa; identical to SEQ ID NO: 43120

SEQ ID NO: 636573 - RNA, 64 nt, hsa; identical to SEQ ID NO: 43121

SEQ ID NO: 636574 - RNA, 64 nt, hsa; identical to SEQ ID NO: 43122

SEQ ID NO: 636575 - RNA, 64 nt, hsa; identical to SEQ ID NO: 43123

SEQ ID NO: 636576 - RNA, 64 nt, hsa; identical to SEQ ID NO: 43124

SEQ ID NO: 636577 - RNA, 64 nt, hsa; identical to SEQ ID NO: 43125

SEQ ID NO: 636578 - RNA, 64 nt, hsa; identical to SEQ ID NO: 43126

SEQ ID NO: 636579 - RNA, 64 nt, hsa; identical to SEQ ID NO: 43127

SEQ ID NO: 636580 - RNA, 64 nt, hsa; identical to SEQ ID NO: 43128

SEQ ID NO: 636581 - RNA, 64 nt, hsa; identical to SEQ ID NO: 43129

SEQ ID NO: 636582 - RNA, 64 nt, hsa; identical to SEQ ID NO: 43130

SEQ ID NO: 636583 - RNA, 64 nt, hsa; identical to SEQ ID NO: 43131

SEQ ID NO: 636584 - RNA, 64 nt, hsa; identical to SEQ ID NO: 43132

SEQ ID NO: 636585 - RNA, 61 nt, hsa; identical to SEQ ID NO: 43133

SEQ ID NO: 636586 - RNA, 64 nt, hsa; identical to SEQ ID NO: 43134

SEQ ID NO: 636587 - RNA, 64 nt, hsa; identical to SEQ ID NO: 43135

SEQ ID NO: 636588 - RNA, 64 nt, hsa; identical to SEQ ID NO: 43136

SEQ ID NO: 636589 - RNA, 64 nt, hsa; identical to SEQ ID NO: 43137

SEQ ID NO: 636590 - RNA, 64 nt, hsa; identical to SEQ ID NO: 43138

SEQ ID NO: 636591 - RNA, 64 nt, hsa; identical to SEQ ID NO: 43139

SEQ ID NO: 636592 - RNA, 64 nt, hsa; identical to SEQ ID NO: 43140

SEQ ID NO: 636593 - RNA, 64 nt, hsa; identical to SEQ ID NO: 43141

SEQ ID NO: 636594 - RNA, 64 nt, hsa; identical to SEQ ID NO: 43142

SEQ ID NO: 636595 - RNA, 64 nt, hsa; identical to SEQ ID NO: 43143

SEQ ID NO: 636596 - RNA, 64 nt, hsa; identical to SEQ ID NO: 43144

SEQ ID NO: 636597 - RNA, 64 nt, hsa; identical to SEQ ID NO: 43145

SEQ ID NO: 636598 - RNA, 64 nt, hsa; identical to SEQ ID NO: 43146

SEQ ID NO: 636599 - RNA, 64 nt, hsa; identical to SEQ ID NO: 43147

SEQ ID NO: 636600 - RNA, 64 nt, hsa; identical to SEQ ID NO: 43148

SEQ ID NO: 636601 - RNA, 64 nt, hsa; identical to SEQ ID NO: 43149

SEQ ID NO: 636602 - RNA, 64 nt, hsa; identical to SEQ ID NO: 43150

SEQ ID NO: 636603 - RNA, 64 nt, hsa; identical to SEQ ID NO: 43151

SEQ ID NO: 636604 - RNA, 64 nt, hsa; identical to SEQ ID NO: 43152

SEQ ID NO: 636605 - RNA, 64 nt, hsa; identical to SEQ ID NO: 43153

SEQ ID NO: 636606 - RNA, 64 nt, hsa; identical to SEQ ID NO: 43154

SEQ ID NO: 636607 - RNA, 64 nt, hsa; identical to SEQ ID NO: 43155

SEQ ID NO: 636608 - RNA, 64 nt, hsa; identical to SEQ ID NO: 43156

SEQ ID NO: 636609 - RNA, 64 nt, hsa; identical to SEQ ID NO: 43157

SEQ ID NO: 636610 - RNA, 64 nt, hsa; identical to SEQ ID NO: 43158

SEQ ID NO: 636611 - RNA, 64 nt, hsa; identical to SEQ ID NO: 43159

SEQ ID NO: 636612 - RNA, 64 nt, hsa; identical to SEQ ID NO: 43160

SEQ ID NO: 636613 - RNA, 64 nt, hsa; identical to SEQ ID NO: 43161

SEQ ID NO: 636614 - RNA, 64 nt, hsa; identical to SEQ ID NO: 43162

SEQ ID NO: 636615 - RNA, 64 nt, hsa; identical to SEQ ID NO: 43163

SEQ ID NO: 636616 - RNA, 64 nt, hsa; identical to SEQ ID NO: 43164

SEQ ID NO: 636617 - RNA, 64 nt, hsa; identical to SEQ ID NO: 43165

SEQ ID NO: 636618 - RNA, 64 nt, hsa; identical to SEQ ID NO: 43166

SEQ ID NO: 636619 - RNA, 64 nt, hsa; identical to SEQ ID NO: 43167

SEQ ID NO: 636620 - RNA, 64 nt, hsa; identical to SEQ ID NO: 43168

SEQ ID NO: 636621 - RNA, 64 nt, hsa; identical to SEQ ID NO: 43169

SEQ ID NO: 636622 - RNA, 64 nt, hsa; identical to SEQ ID NO: 43170

SEQ ID NO: 636623 - RNA, 64 nt, hsa; identical to SEQ ID NO: 43171

SEQ ID NO: 636624 - RNA, 64 nt, hsa; identical to SEQ ID NO: 43172

SEQ ID NO: 636625 - RNA, 64 nt, hsa; identical to SEQ ID NO: 43173

SEQ ID NO: 636626 - RNA, 64 nt, hsa; identical to SEQ ID NO: 43174

SEQ ID NO: 636627 - RNA, 64 nt, hsa; identical to SEQ ID NO: 43175

SEQ ID NO: 636628 - RNA, 64 nt, hsa; identical to SEQ ID NO: 43176

SEQ ID NO: 636629 - RNA, 64 nt, hsa; identical to SEQ ID NO: 43177

SEQ ID NO: 636630 - RNA, 64 nt, hsa; identical to SEQ ID NO: 43178

SEQ ID NO: 636631 - RNA, 64 nt, hsa; identical to SEQ ID NO: 43179

SEQ ID NO: 636632 - RNA, 64 nt, hsa; identical to SEQ ID NO: 43180

SEQ ID NO: 636633 - RNA, 64 nt, hsa; identical to SEQ ID NO: 43181

SEQ ID NO: 636634 - RNA, 64 nt, hsa; identical to SEQ ID NO: 43182

SEQ ID NO: 636635 - RNA, 64 nt, hsa; identical to SEQ ID NO: 43183

SEQ ID NO: 636636 - RNA, 63 nt, hsa; identical to SEQ ID NO: 43184

SEQ ID NO: 636637 - RNA, 64 nt, hsa; identical to SEQ ID NO: 43185

SEQ ID NO: 636638 - RNA, 64 nt, hsa; identical to SEQ ID NO: 43186

SEQ ID NO: 636639 - RNA, 64 nt, hsa; identical to SEQ ID NO: 43187

SEQ ID NO: 636640 - RNA, 64 nt, hsa; identical to SEQ ID NO: 43188

SEQ ID NO: 636641 - RNA, 64 nt, hsa; identical to SEQ ID NO: 43189

SEQ ID NO: 636642 - RNA, 64 nt, hsa; identical to SEQ ID NO: 43190

SEQ ID NO: 636643 - RNA, 64 nt, hsa; identical to SEQ ID NO: 43191

SEQ ID NO: 636644 - RNA, 64 nt, hsa; identical to SEQ ID NO: 43192

SEQ ID NO: 636645 - RNA, 64 nt, hsa; identical to SEQ ID NO: 43193

SEQ ID NO: 636646 - RNA, 64 nt, hsa; identical to SEQ ID NO: 43194

SEQ ID NO: 636647 - RNA, 64 nt, hsa; identical to SEQ ID NO: 43195

SEQ ID NO: 636648 - RNA, 64 nt, hsa; identical to SEQ ID NO: 43196

SEQ ID NO: 636649 - RNA, 64 nt, hsa; identical to SEQ ID NO: 43197

SEQ ID NO: 636650 - RNA, 64 nt, hsa; identical to SEQ ID NO: 43198

SEQ ID NO: 636651 - RNA, 64 nt, hsa; identical to SEQ ID NO: 43199

SEQ ID NO: 636652 - RNA, 64 nt, hsa; identical to SEQ ID NO: 43200

SEQ ID NO: 636653 - RNA, 64 nt, hsa; identical to SEQ ID NO: 43201

SEQ ID NO: 636654 - RNA, 64 nt, hsa; identical to SEQ ID NO: 43202

SEQ ID NO: 636655 - RNA, 64 nt, hsa; identical to SEQ ID NO: 43203

SEQ ID NO: 636656 - RNA, 64 nt, hsa; identical to SEQ ID NO: 43204

SEQ ID NO: 636657 - RNA, 64 nt, hsa; identical to SEQ ID NO: 43205

SEQ ID NO: 636658 - RNA, 64 nt, hsa; identical to SEQ ID NO: 43206

SEQ ID NO: 636659 - RNA, 64 nt, hsa; identical to SEQ ID NO: 43207

SEQ ID NO: 636660 - RNA, 64 nt, hsa; identical to SEQ ID NO: 43208

SEQ ID NO: 636661 - RNA, 64 nt, hsa; identical to SEQ ID NO: 43209

SEQ ID NO: 636662 - RNA, 64 nt, hsa; identical to SEQ ID NO: 43210

SEQ ID NO: 636663 - RNA, 64 nt, hsa; identical to SEQ ID NO: 43211

SEQ ID NO: 636664 - RNA, 64 nt, hsa; identical to SEQ ID NO: 43212

SEQ ID NO: 636665 - RNA, 64 nt, hsa; identical to SEQ ID NO: 43213

SEQ ID NO: 636666 - RNA, 64 nt, hsa; identical to SEQ ID NO: 43214

SEQ ID NO: 636667 - RNA, 64 nt, hsa; identical to SEQ ID NO: 43215

SEQ ID NO: 636668 - RNA, 64 nt, hsa; identical to SEQ ID NO: 43216

SEQ ID NO: 636669 - RNA, 64 nt, hsa; identical to SEQ ID NO: 43217

SEQ ID NO: 636670 - RNA, 64 nt, hsa; identical to SEQ ID NO: 43218

SEQ ID NO: 636671 - RNA, 64 nt, hsa; identical to SEQ ID NO: 43219

SEQ ID NO: 636672 - RNA, 64 nt, hsa; identical to SEQ ID NO: 43220

SEQ ID NO: 636673 - RNA, 64 nt, hsa; identical to SEQ ID NO: 43221

SEQ ID NO: 636674 - RNA, 64 nt, hsa; identical to SEQ ID NO: 43222

SEQ ID NO: 636675 - RNA, 64 nt, hsa; identical to SEQ ID NO: 43223

SEQ ID NO: 636676 - RNA, 64 nt, hsa; identical to SEQ ID NO: 43224

SEQ ID NO: 636677 - RNA, 64 nt, hsa; identical to SEQ ID NO: 43225

SEQ ID NO: 636678 - RNA, 64 nt, hsa; identical to SEQ ID NO: 43226

SEQ ID NO: 636679 - RNA, 64 nt, hsa; identical to SEQ ID NO: 43227

SEQ ID NO: 636680 - RNA, 64 nt, hsa; identical to SEQ ID NO: 43228

SEQ ID NO: 636681 - RNA, 64 nt, hsa; identical to SEQ ID NO: 43229

SEQ ID NO: 636682 - RNA, 64 nt, hsa; identical to SEQ ID NO: 43230

SEQ ID NO: 636683 - RNA, 64 nt, hsa; identical to SEQ ID NO: 43231

SEQ ID NO: 636684 - RNA, 64 nt, hsa; identical to SEQ ID NO: 43232

SEQ ID NO: 636685 - RNA, 64 nt, hsa; identical to SEQ ID NO: 43233

SEQ ID NO: 636686 - RNA, 64 nt, hsa; identical to SEQ ID NO: 43234

SEQ ID NO: 636687 - RNA, 64 nt, hsa; identical to SEQ ID NO: 43235

SEQ ID NO: 636688 - RNA, 64 nt, hsa; identical to SEQ ID NO: 43236

SEQ ID NO: 636689 - RNA, 64 nt, hsa; identical to SEQ ID NO: 43237

SEQ ID NO: 636690 - RNA, 64 nt, hsa; identical to SEQ ID NO: 43238

SEQ ID NO: 636691 - RNA, 64 nt, hsa; identical to SEQ ID NO: 43239

SEQ ID NO: 636692 - RNA, 64 nt, hsa; identical to SEQ ID NO: 43240

SEQ ID NO: 636693 - RNA, 64 nt, hsa; identical to SEQ ID NO: 43241

SEQ ID NO: 636694 - RNA, 64 nt, hsa; identical to SEQ ID NO: 43242

SEQ ID NO: 636695 - RNA, 64 nt, hsa; identical to SEQ ID NO: 43243

SEQ ID NO: 636696 - RNA, 64 nt, hsa; identical to SEQ ID NO: 43244

SEQ ID NO: 636697 - RNA, 64 nt, hsa; identical to SEQ ID NO: 43245

SEQ ID NO: 636698 - RNA, 64 nt, hsa; identical to SEQ ID NO: 43246

SEQ ID NO: 636699 - RNA, 64 nt, hsa; identical to SEQ ID NO: 43247

SEQ ID NO: 636700 - RNA, 64 nt, hsa; identical to SEQ ID NO: 43248

SEQ ID NO: 636701 - RNA, 64 nt, hsa; identical to SEQ ID NO: 43249

SEQ ID NO: 636702 - RNA, 64 nt, hsa; identical to SEQ ID NO: 43250

SEQ ID NO: 636703 - RNA, 64 nt, hsa; identical to SEQ ID NO: 43251

SEQ ID NO: 636704 - RNA, 64 nt, hsa; identical to SEQ ID NO: 43252

SEQ ID NO: 636705 - RNA, 64 nt, hsa; identical to SEQ ID NO: 43253

SEQ ID NO: 636706 - RNA, 64 nt, hsa; identical to SEQ ID NO: 43254

SEQ ID NO: 636707 - RNA, 64 nt, hsa; identical to SEQ ID NO: 43255

SEQ ID NO: 636708 - RNA, 64 nt, hsa; identical to SEQ ID NO: 43256

SEQ ID NO: 636709 - RNA, 64 nt, hsa; identical to SEQ ID NO: 43257

SEQ ID NO: 636710 - RNA, 64 nt, hsa; identical to SEQ ID NO: 43258

SEQ ID NO: 636711 - RNA, 64 nt, hsa; identical to SEQ ID NO: 43259

SEQ ID NO: 636712 - RNA, 64 nt, hsa; identical to SEQ ID NO: 43260

SEQ ID NO: 636713 - RNA, 64 nt, hsa; identical to SEQ ID NO: 43261

SEQ ID NO: 636714 - RNA, 64 nt, hsa; identical to SEQ ID NO: 43262

SEQ ID NO: 636715 - RNA, 64 nt, hsa; identical to SEQ ID NO: 43263

SEQ ID NO: 636716 - RNA, 64 nt, hsa; identical to SEQ ID NO: 43264

SEQ ID NO: 636717 - RNA, 64 nt, hsa; identical to SEQ ID NO: 43265

SEQ ID NO: 636718 - RNA, 64 nt, hsa; identical to SEQ ID NO: 43266

SEQ ID NO: 636719 - RNA, 64 nt, hsa; identical to SEQ ID NO: 43267

SEQ ID NO: 636720 - RNA, 64 nt, hsa; identical to SEQ ID NO: 43268

SEQ ID NO: 636721 - RNA, 64 nt, hsa; identical to SEQ ID NO: 43269

SEQ ID NO: 636722 - RNA, 64 nt, hsa; identical to SEQ ID NO: 43270

SEQ ID NO: 636723 - RNA, 64 nt, hsa; identical to SEQ ID NO: 43271

SEQ ID NO: 636724 - RNA, 64 nt, hsa; identical to SEQ ID NO: 43272

SEQ ID NO: 636725 - RNA, 64 nt, hsa; identical to SEQ ID NO: 43273

SEQ ID NO: 636726 - RNA, 64 nt, hsa; identical to SEQ ID NO: 43274

SEQ ID NO: 636727 - RNA, 64 nt, hsa; identical to SEQ ID NO: 43275

SEQ ID NO: 636728 - RNA, 64 nt, hsa; identical to SEQ ID NO: 43276

SEQ ID NO: 636729 - RNA, 64 nt, hsa; identical to SEQ ID NO: 43277

SEQ ID NO: 636730 - RNA, 64 nt, hsa; identical to SEQ ID NO: 43278

SEQ ID NO: 636731 - RNA, 64 nt, hsa; identical to SEQ ID NO: 43279

SEQ ID NO: 636732 - RNA, 64 nt, hsa; identical to SEQ ID NO: 43280

SEQ ID NO: 636733 - RNA, 64 nt, hsa; identical to SEQ ID NO: 43281

SEQ ID NO: 636734 - RNA, 64 nt, hsa; identical to SEQ ID NO: 43282

SEQ ID NO: 636735 - RNA, 64 nt, hsa; identical to SEQ ID NO: 43283

SEQ ID NO: 636736 - RNA, 64 nt, hsa; identical to SEQ ID NO: 43284

SEQ ID NO: 636737 - RNA, 64 nt, hsa; identical to SEQ ID NO: 43285

SEQ ID NO: 636738 - RNA, 64 nt, hsa; identical to SEQ ID NO: 43286

SEQ ID NO: 636739 - RNA, 64 nt, hsa; identical to SEQ ID NO: 43287

SEQ ID NO: 636740 - RNA, 63 nt, hsa; identical to SEQ ID NO: 43288

SEQ ID NO: 636741 - RNA, 64 nt, hsa; identical to SEQ ID NO: 43289

SEQ ID NO: 636742 - RNA, 64 nt, hsa; identical to SEQ ID NO: 43290

SEQ ID NO: 636743 - RNA, 64 nt, hsa; identical to SEQ ID NO: 43291

SEQ ID NO: 636744 - RNA, 64 nt, hsa; identical to SEQ ID NO: 43292

SEQ ID NO: 636745 - RNA, 64 nt, hsa; identical to SEQ ID NO: 43293

SEQ ID NO: 636746 - RNA, 64 nt, hsa; identical to SEQ ID NO: 43294

SEQ ID NO: 636747 - RNA, 64 nt, hsa; identical to SEQ ID NO: 43295

SEQ ID NO: 636748 - RNA, 64 nt, hsa; identical to SEQ ID NO: 43296

SEQ ID NO: 636749 - RNA, 64 nt, hsa; identical to SEQ ID NO: 43297

SEQ ID NO: 636750 - RNA, 64 nt, hsa; identical to SEQ ID NO: 43298

SEQ ID NO: 636751 - RNA, 64 nt, hsa; identical to SEQ ID NO: 43299

SEQ ID NO: 636752 - RNA, 64 nt, hsa; identical to SEQ ID NO: 43300

SEQ ID NO: 636753 - RNA, 64 nt, hsa; identical to SEQ ID NO: 43301

SEQ ID NO: 636754 - RNA, 64 nt, hsa; identical to SEQ ID NO: 43302

SEQ ID NO: 636755 - RNA, 64 nt, hsa; identical to SEQ ID NO: 43303

SEQ ID NO: 636756 - RNA, 64 nt, hsa; identical to SEQ ID NO: 43304

SEQ ID NO: 636757 - RNA, 64 nt, hsa; identical to SEQ ID NO: 43305

SEQ ID NO: 636758 - RNA, 64 nt, hsa; identical to SEQ ID NO: 43306

SEQ ID NO: 636759 - RNA, 64 nt, hsa; identical to SEQ ID NO: 43307

SEQ ID NO: 636760 - RNA, 64 nt, hsa; identical to SEQ ID NO: 43308

SEQ ID NO: 636761 - RNA, 64 nt, hsa; identical to SEQ ID NO: 43309

SEQ ID NO: 636762 - RNA, 64 nt, hsa; identical to SEQ ID NO: 43310

SEQ ID NO: 636763 - RNA, 64 nt, hsa; identical to SEQ ID NO: 43311

SEQ ID NO: 636764 - RNA, 64 nt, hsa; identical to SEQ ID NO: 43312

SEQ ID NO: 636765 - RNA, 64 nt, hsa; identical to SEQ ID NO: 43313

SEQ ID NO: 636766 - RNA, 64 nt, hsa; identical to SEQ ID NO: 43314

SEQ ID NO: 636767 - RNA, 64 nt, hsa; identical to SEQ ID NO: 43315

SEQ ID NO: 636768 - RNA, 64 nt, hsa; identical to SEQ ID NO: 43316

SEQ ID NO: 636769 - RNA, 64 nt, hsa; identical to SEQ ID NO: 43317

SEQ ID NO: 636770 - RNA, 64 nt, hsa; identical to SEQ ID NO: 43318

SEQ ID NO: 636771 - RNA, 64 nt, hsa; identical to SEQ ID NO: 43319

SEQ ID NO: 636772 - RNA, 64 nt, hsa; identical to SEQ ID NO: 43320

SEQ ID NO: 636773 - RNA, 64 nt, hsa; identical to SEQ ID NO: 43321

SEQ ID NO: 636774 - RNA, 64 nt, hsa; identical to SEQ ID NO: 43322

SEQ ID NO: 636775 - RNA, 64 nt, hsa; identical to SEQ ID NO: 43323

SEQ ID NO: 636776 - RNA, 64 nt, hsa; identical to SEQ ID NO: 43324

SEQ ID NO: 636777 - RNA, 64 nt, hsa; identical to SEQ ID NO: 43325

SEQ ID NO: 636778 - RNA, 64 nt, hsa; identical to SEQ ID NO: 43326

SEQ ID NO: 636779 - RNA, 64 nt, hsa; identical to SEQ ID NO: 43327

SEQ ID NO: 636780 - RNA, 64 nt, hsa; identical to SEQ ID NO: 43328

SEQ ID NO: 636781 - RNA, 64 nt, hsa; identical to SEQ ID NO: 43329

SEQ ID NO: 636782 - RNA, 64 nt, hsa; identical to SEQ ID NO: 43330

SEQ ID NO: 636783 - RNA, 64 nt, hsa; identical to SEQ ID NO: 43331

SEQ ID NO: 636784 - RNA, 64 nt, hsa; identical to SEQ ID NO: 43332

SEQ ID NO: 636785 - RNA, 64 nt, hsa; identical to SEQ ID NO: 43333

SEQ ID NO: 636786 - RNA, 64 nt, hsa; identical to SEQ ID NO: 43334

SEQ ID NO: 636787 - RNA, 64 nt, hsa; identical to SEQ ID NO: 43335

SEQ ID NO: 636788 - RNA, 64 nt, hsa; identical to SEQ ID NO: 43336

SEQ ID NO: 636789 - RNA, 64 nt, hsa; identical to SEQ ID NO: 43337

SEQ ID NO: 636790 - RNA, 64 nt, hsa; identical to SEQ ID NO: 43338

SEQ ID NO: 636791 - RNA, 64 nt, hsa; identical to SEQ ID NO: 43339

SEQ ID NO: 636792 - RNA, 64 nt, hsa; identical to SEQ ID NO: 43340

SEQ ID NO: 636793 - RNA, 64 nt, hsa; identical to SEQ ID NO: 43341

SEQ ID NO: 636794 - RNA, 64 nt, hsa; identical to SEQ ID NO: 43342

SEQ ID NO: 636795 - RNA, 54 nt, hsa; identical to SEQ ID NO: 43343

SEQ ID NO: 636796 - RNA, 64 nt, hsa; identical to SEQ ID NO: 43344

SEQ ID NO: 636797 - RNA, 64 nt, hsa; identical to SEQ ID NO: 43345

SEQ ID NO: 636798 - RNA, 64 nt, hsa; identical to SEQ ID NO: 43346

SEQ ID NO: 636799 - RNA, 64 nt, hsa; identical to SEQ ID NO: 43347

SEQ ID NO: 636800 - RNA, 64 nt, hsa; identical to SEQ ID NO: 43348

SEQ ID NO: 636801 - RNA, 64 nt, hsa; identical to SEQ ID NO: 43349

SEQ ID NO: 636802 - RNA, 64 nt, hsa; identical to SEQ ID NO: 43350

SEQ ID NO: 636803 - RNA, 64 nt, hsa; identical to SEQ ID NO: 43351

SEQ ID NO: 636804 - RNA, 64 nt, hsa; identical to SEQ ID NO: 43352

SEQ ID NO: 636805 - RNA, 64 nt, hsa; identical to SEQ ID NO: 43353

SEQ ID NO: 636806 - RNA, 64 nt, hsa; identical to SEQ ID NO: 43354

SEQ ID NO: 636807 - RNA, 64 nt, hsa; identical to SEQ ID NO: 43355

SEQ ID NO: 636808 - RNA, 64 nt, hsa; identical to SEQ ID NO: 43356

SEQ ID NO: 636809 - RNA, 64 nt, hsa; identical to SEQ ID NO: 43357

SEQ ID NO: 636810 - RNA, 64 nt, hsa; identical to SEQ ID NO: 43358

SEQ ID NO: 636811 - RNA, 64 nt, hsa; identical to SEQ ID NO: 43359

SEQ ID NO: 636812 - RNA, 64 nt, hsa; identical to SEQ ID NO: 43360

SEQ ID NO: 636813 - RNA, 64 nt, hsa; identical to SEQ ID NO: 43361

SEQ ID NO: 636814 - RNA, 64 nt, hsa; identical to SEQ ID NO: 43362

SEQ ID NO: 636815 - RNA, 64 nt, hsa; identical to SEQ ID NO: 43363

SEQ ID NO: 636816 - RNA, 64 nt, hsa; identical to SEQ ID NO: 43364

SEQ ID NO: 636817 - RNA, 64 nt, hsa; identical to SEQ ID NO: 43365

SEQ ID NO: 636818 - RNA, 64 nt, hsa; identical to SEQ ID NO: 43366

SEQ ID NO: 636819 - RNA, 64 nt, hsa; identical to SEQ ID NO: 43367

SEQ ID NO: 636820 - RNA, 64 nt, hsa; identical to SEQ ID NO: 43368

SEQ ID NO: 636821 - RNA, 64 nt, hsa; identical to SEQ ID NO: 43369

SEQ ID NO: 636822 - RNA, 64 nt, hsa; identical to SEQ ID NO: 43370

SEQ ID NO: 636823 - RNA, 64 nt, hsa; identical to SEQ ID NO: 43371

SEQ ID NO: 636824 - RNA, 64 nt, hsa; identical to SEQ ID NO: 43372

SEQ ID NO: 636825 - RNA, 64 nt, hsa; identical to SEQ ID NO: 43373

SEQ ID NO: 636826 - RNA, 64 nt, hsa; identical to SEQ ID NO: 43374

SEQ ID NO: 636827 - RNA, 64 nt, hsa; identical to SEQ ID NO: 43375

SEQ ID NO: 636828 - RNA, 64 nt, hsa; identical to SEQ ID NO: 43376

SEQ ID NO: 636829 - RNA, 64 nt, hsa; identical to SEQ ID NO: 43377

SEQ ID NO: 636830 - RNA, 64 nt, hsa; identical to SEQ ID NO: 43378

SEQ ID NO: 636831 - RNA, 64 nt, hsa; identical to SEQ ID NO: 43379

SEQ ID NO: 636832 - RNA, 64 nt, hsa; identical to SEQ ID NO: 43380

SEQ ID NO: 636833 - RNA, 64 nt, hsa; identical to SEQ ID NO: 43381

SEQ ID NO: 636834 - RNA, 64 nt, hsa; identical to SEQ ID NO: 43382

SEQ ID NO: 636835 - RNA, 64 nt, hsa; identical to SEQ ID NO: 43383

SEQ ID NO: 636836 - RNA, 64 nt, hsa; identical to SEQ ID NO: 43384

SEQ ID NO: 636837 - RNA, 64 nt, hsa; identical to SEQ ID NO: 43385

SEQ ID NO: 636838 - RNA, 64 nt, hsa; identical to SEQ ID NO: 43386

SEQ ID NO: 636839 - RNA, 64 nt, hsa; identical to SEQ ID NO: 43387

SEQ ID NO: 636840 - RNA, 64 nt, hsa; identical to SEQ ID NO: 43388

SEQ ID NO: 636841 - RNA, 64 nt, hsa; identical to SEQ ID NO: 43389

SEQ ID NO: 636842 - RNA, 64 nt, hsa; identical to SEQ ID NO: 43390

SEQ ID NO: 636843 - RNA, 64 nt, hsa; identical to SEQ ID NO: 43391

SEQ ID NO: 636844 - RNA, 64 nt, hsa; identical to SEQ ID NO: 43392

SEQ ID NO: 636845 - RNA, 64 nt, hsa; identical to SEQ ID NO: 43393

SEQ ID NO: 636846 - RNA, 64 nt, hsa; identical to SEQ ID NO: 43394

SEQ ID NO: 636847 - RNA, 64 nt, hsa; identical to SEQ ID NO: 43395

SEQ ID NO: 636848 - RNA, 64 nt, hsa; identical to SEQ ID NO: 43396

SEQ ID NO: 636849 - RNA, 64 nt, hsa; identical to SEQ ID NO: 43397

SEQ ID NO: 636850 - RNA, 64 nt, hsa; identical to SEQ ID NO: 43398

SEQ ID NO: 636851 - RNA, 64 nt, hsa; identical to SEQ ID NO: 43399

SEQ ID NO: 636852 - RNA, 64 nt, hsa; identical to SEQ ID NO: 43400

SEQ ID NO: 636853 - RNA, 64 nt, hsa; identical to SEQ ID NO: 43401

SEQ ID NO: 636854 - RNA, 64 nt, hsa; identical to SEQ ID NO: 43402

SEQ ID NO: 636855 - RNA, 64 nt, hsa; identical to SEQ ID NO: 43403

SEQ ID NO: 636856 - RNA, 64 nt, hsa; identical to SEQ ID NO: 43404

SEQ ID NO: 636857 - RNA, 64 nt, hsa; identical to SEQ ID NO: 43405

SEQ ID NO: 636858 - RNA, 64 nt, hsa; identical to SEQ ID NO: 43406

SEQ ID NO: 636859 - RNA, 64 nt, hsa; identical to SEQ ID NO: 43407

SEQ ID NO: 636860 - RNA, 64 nt, hsa; identical to SEQ ID NO: 43408

SEQ ID NO: 636861 - RNA, 64 nt, hsa; identical to SEQ ID NO: 43409

SEQ ID NO: 636862 - RNA, 64 nt, hsa; identical to SEQ ID NO: 43410

SEQ ID NO: 636863 - RNA, 64 nt, hsa; identical to SEQ ID NO: 43411

SEQ ID NO: 636864 - RNA, 64 nt, hsa; identical to SEQ ID NO: 43412

SEQ ID NO: 636865 - RNA, 64 nt, hsa; identical to SEQ ID NO: 43413

SEQ ID NO: 636866 - RNA, 64 nt, hsa; identical to SEQ ID NO: 43414

SEQ ID NO: 636867 - RNA, 64 nt, hsa; identical to SEQ ID NO: 43415

SEQ ID NO: 636868 - RNA, 64 nt, hsa; identical to SEQ ID NO: 43416

SEQ ID NO: 636869 - RNA, 64 nt, hsa; identical to SEQ ID NO: 43417

SEQ ID NO: 636870 - RNA, 64 nt, hsa; identical to SEQ ID NO: 43418

SEQ ID NO: 636871 - RNA, 64 nt, hsa; identical to SEQ ID NO: 43419

SEQ ID NO: 636872 - RNA, 64 nt, hsa; identical to SEQ ID NO: 43420

SEQ ID NO: 636873 - RNA, 64 nt, hsa; identical to SEQ ID NO: 43421

SEQ ID NO: 636874 - RNA, 64 nt, hsa; identical to SEQ ID NO: 43422

SEQ ID NO: 636875 - RNA, 64 nt, hsa; identical to SEQ ID NO: 43423

SEQ ID NO: 636876 - RNA, 64 nt, hsa; identical to SEQ ID NO: 43424

SEQ ID NO: 636877 - RNA, 64 nt, hsa; identical to SEQ ID NO: 43425

SEQ ID NO: 636878 - RNA, 64 nt, hsa; identical to SEQ ID NO: 43426

SEQ ID NO: 636879 - RNA, 64 nt, hsa; identical to SEQ ID NO: 43427

SEQ ID NO: 636880 - RNA, 64 nt, hsa; identical to SEQ ID NO: 43428

SEQ ID NO: 636881 - RNA, 64 nt, hsa; identical to SEQ ID NO: 43429

SEQ ID NO: 636882 - RNA, 64 nt, hsa; identical to SEQ ID NO: 43430

SEQ ID NO: 636883 - RNA, 64 nt, hsa; identical to SEQ ID NO: 43431

SEQ ID NO: 636884 - RNA, 64 nt, hsa; identical to SEQ ID NO: 43432

SEQ ID NO: 636885 - RNA, 64 nt, hsa; identical to SEQ ID NO: 43433

SEQ ID NO: 636886 - RNA, 64 nt, hsa; identical to SEQ ID NO: 43434

SEQ ID NO: 636887 - RNA, 64 nt, hsa; identical to SEQ ID NO: 43435

SEQ ID NO: 636888 - RNA, 64 nt, hsa; identical to SEQ ID NO: 43436

SEQ ID NO: 636889 - RNA, 64 nt, hsa; identical to SEQ ID NO: 43437

SEQ ID NO: 636890 - RNA, 64 nt, hsa; identical to SEQ ID NO: 43438

SEQ ID NO: 636891 - RNA, 64 nt, hsa; identical to SEQ ID NO: 43439

SEQ ID NO: 636892 - RNA, 64 nt, hsa; identical to SEQ ID NO: 43440

SEQ ID NO: 636893 - RNA, 64 nt, hsa; identical to SEQ ID NO: 43441

SEQ ID NO: 636894 - RNA, 64 nt, hsa; identical to SEQ ID NO: 43442

SEQ ID NO: 636895 - RNA, 64 nt, hsa; identical to SEQ ID NO: 43443

SEQ ID NO: 636896 - RNA, 64 nt, hsa; identical to SEQ ID NO: 43444

SEQ ID NO: 636897 - RNA, 64 nt, hsa; identical to SEQ ID NO: 43445

SEQ ID NO: 636898 - RNA, 64 nt, hsa; identical to SEQ ID NO: 43446

SEQ ID NO: 636899 - RNA, 64 nt, hsa; identical to SEQ ID NO: 43447

SEQ ID NO: 636900 - RNA, 64 nt, hsa; identical to SEQ ID NO: 43448

SEQ ID NO: 636901 - RNA, 64 nt, hsa; identical to SEQ ID NO: 43449

SEQ ID NO: 636902 - RNA, 64 nt, hsa; identical to SEQ ID NO: 43450

SEQ ID NO: 636903 - RNA, 64 nt, hsa; identical to SEQ ID NO: 43451

SEQ ID NO: 636904 - RNA, 64 nt, hsa; identical to SEQ ID NO: 43452

SEQ ID NO: 636905 - RNA, 64 nt, hsa; identical to SEQ ID NO: 43453

SEQ ID NO: 636906 - RNA, 64 nt, hsa; identical to SEQ ID NO: 43454

SEQ ID NO: 636907 - RNA, 64 nt, hsa; identical to SEQ ID NO: 43455

SEQ ID NO: 636908 - RNA, 64 nt, hsa; identical to SEQ ID NO: 43456

SEQ ID NO: 636909 - RNA, 64 nt, hsa; identical to SEQ ID NO: 43457

SEQ ID NO: 636910 - RNA, 64 nt, hsa; identical to SEQ ID NO: 43458

SEQ ID NO: 636911 - RNA, 64 nt, hsa; identical to SEQ ID NO: 43459

SEQ ID NO: 636912 - RNA, 64 nt, hsa; identical to SEQ ID NO: 43460

SEQ ID NO: 636913 - RNA, 64 nt, hsa; identical to SEQ ID NO: 43461

SEQ ID NO: 636914 - RNA, 64 nt, hsa; identical to SEQ ID NO: 43462

SEQ ID NO: 636915 - RNA, 64 nt, hsa; identical to SEQ ID NO: 43463

SEQ ID NO: 636916 - RNA, 64 nt, hsa; identical to SEQ ID NO: 43464

SEQ ID NO: 636917 - RNA, 64 nt, hsa; identical to SEQ ID NO: 43465

SEQ ID NO: 636918 - RNA, 64 nt, hsa; identical to SEQ ID NO: 43466

SEQ ID NO: 636919 - RNA, 64 nt, hsa; identical to SEQ ID NO: 43467

SEQ ID NO: 636920 - RNA, 64 nt, hsa; identical to SEQ ID NO: 43468

SEQ ID NO: 636921 - RNA, 64 nt, hsa; identical to SEQ ID NO: 43469

SEQ ID NO: 636922 - RNA, 64 nt, hsa; identical to SEQ ID NO: 43470

SEQ ID NO: 636923 - RNA, 64 nt, hsa; identical to SEQ ID NO: 43471

SEQ ID NO: 636924 - RNA, 64 nt, hsa; identical to SEQ ID NO: 43472

SEQ ID NO: 636925 - RNA, 64 nt, hsa; identical to SEQ ID NO: 43473

SEQ ID NO: 636926 - RNA, 64 nt, hsa; identical to SEQ ID NO: 43474

SEQ ID NO: 636927 - RNA, 64 nt, hsa; identical to SEQ ID NO: 43475

SEQ ID NO: 636928 - RNA, 64 nt, hsa; identical to SEQ ID NO: 43476

SEQ ID NO: 636929 - RNA, 64 nt, hsa; identical to SEQ ID NO: 43477

SEQ ID NO: 636930 - RNA, 64 nt, hsa; identical to SEQ ID NO: 43478

SEQ ID NO: 636931 - RNA, 64 nt, hsa; identical to SEQ ID NO: 43479

SEQ ID NO: 636932 - RNA, 64 nt, hsa; identical to SEQ ID NO: 43480

SEQ ID NO: 636933 - RNA, 64 nt, hsa; identical to SEQ ID NO: 43481

SEQ ID NO: 636934 - RNA, 64 nt, hsa; identical to SEQ ID NO: 43482

SEQ ID NO: 636935 - RNA, 64 nt, hsa; identical to SEQ ID NO: 43483

SEQ ID NO: 636936 - RNA, 64 nt, hsa; identical to SEQ ID NO: 43484

SEQ ID NO: 636937 - RNA, 64 nt, hsa; identical to SEQ ID NO: 43485

SEQ ID NO: 636938 - RNA, 64 nt, hsa; identical to SEQ ID NO: 43486

SEQ ID NO: 636939 - RNA, 64 nt, hsa; identical to SEQ ID NO: 43487

SEQ ID NO: 636940 - RNA, 64 nt, hsa; identical to SEQ ID NO: 43488

SEQ ID NO: 636941 - RNA, 64 nt, hsa; identical to SEQ ID NO: 43489

SEQ ID NO: 636942 - RNA, 64 nt, hsa; identical to SEQ ID NO: 43490

SEQ ID NO: 636943 - RNA, 64 nt, hsa; identical to SEQ ID NO: 43491

SEQ ID NO: 636944 - RNA, 64 nt, hsa; identical to SEQ ID NO: 43492

SEQ ID NO: 636945 - RNA, 64 nt, hsa; identical to SEQ ID NO: 43493

SEQ ID NO: 636946 - RNA, 64 nt, hsa; identical to SEQ ID NO: 43494

SEQ ID NO: 636947 - RNA, 64 nt, hsa; identical to SEQ ID NO: 43495

SEQ ID NO: 636948 - RNA, 64 nt, hsa; identical to SEQ ID NO: 43496

SEQ ID NO: 636949 - RNA, 64 nt, hsa; identical to SEQ ID NO: 43497

SEQ ID NO: 636950 - RNA, 64 nt, hsa; identical to SEQ ID NO: 43498

SEQ ID NO: 636951 - RNA, 64 nt, hsa; identical to SEQ ID NO: 43499

SEQ ID NO: 636952 - RNA, 64 nt, hsa; identical to SEQ ID NO: 43500

SEQ ID NO: 636953 - RNA, 64 nt, hsa; identical to SEQ ID NO: 43501

SEQ ID NO: 636954 - RNA, 64 nt, hsa; identical to SEQ ID NO: 43502

SEQ ID NO: 636955 - RNA, 64 nt, hsa; identical to SEQ ID NO: 43503

SEQ ID NO: 636956 - RNA, 64 nt, hsa; identical to SEQ ID NO: 43504

SEQ ID NO: 636957 - RNA, 64 nt, hsa; identical to SEQ ID NO: 43505

SEQ ID NO: 636958 - RNA, 64 nt, hsa; identical to SEQ ID NO: 43506

SEQ ID NO: 636959 - RNA, 64 nt, hsa; identical to SEQ ID NO: 43507

SEQ ID NO: 636960 - RNA, 64 nt, hsa; identical to SEQ ID NO: 43508

SEQ ID NO: 636961 - RNA, 64 nt, hsa; identical to SEQ ID NO: 43509

SEQ ID NO: 636962 - RNA, 62 nt, hsa; identical to SEQ ID NO: 43510

SEQ ID NO: 636963 - RNA, 64 nt, hsa; identical to SEQ ID NO: 43511

SEQ ID NO: 636964 - RNA, 64 nt, hsa; identical to SEQ ID NO: 43512

SEQ ID NO: 636965 - RNA, 64 nt, hsa; identical to SEQ ID NO: 43513

SEQ ID NO: 636966 - RNA, 64 nt, hsa; identical to SEQ ID NO: 43514

SEQ ID NO: 636967 - RNA, 64 nt, hsa; identical to SEQ ID NO: 43515

SEQ ID NO: 636968 - RNA, 64 nt, hsa; identical to SEQ ID NO: 43516

SEQ ID NO: 636969 - RNA, 64 nt, hsa; identical to SEQ ID NO: 43517

SEQ ID NO: 636970 - RNA, 64 nt, hsa; identical to SEQ ID NO: 43518

SEQ ID NO: 636971 - RNA, 64 nt, hsa; identical to SEQ ID NO: 43519

SEQ ID NO: 636972 - RNA, 64 nt, hsa; identical to SEQ ID NO: 43520

SEQ ID NO: 636973 - RNA, 64 nt, hsa; identical to SEQ ID NO: 43521

SEQ ID NO: 636974 - RNA, 64 nt, hsa; identical to SEQ ID NO: 43522

SEQ ID NO: 636975 - RNA, 64 nt, hsa; identical to SEQ ID NO: 43523

SEQ ID NO: 636976 - RNA, 64 nt, hsa; identical to SEQ ID NO: 43524

SEQ ID NO: 636977 - RNA, 64 nt, hsa; identical to SEQ ID NO: 43525

SEQ ID NO: 636978 - RNA, 64 nt, hsa; identical to SEQ ID NO: 43526

SEQ ID NO: 636979 - RNA, 64 nt, hsa; identical to SEQ ID NO: 43527

SEQ ID NO: 636980 - RNA, 64 nt, hsa; identical to SEQ ID NO: 43528

SEQ ID NO: 636981 - RNA, 64 nt, hsa; identical to SEQ ID NO: 43529

SEQ ID NO: 636982 - RNA, 64 nt, hsa; identical to SEQ ID NO: 43530

SEQ ID NO: 636983 - RNA, 64 nt, hsa; identical to SEQ ID NO: 43531

SEQ ID NO: 636984 - RNA, 64 nt, hsa; identical to SEQ ID NO: 43532

SEQ ID NO: 636985 - RNA, 64 nt, hsa; identical to SEQ ID NO: 43533

SEQ ID NO: 636986 - RNA, 64 nt, hsa; identical to SEQ ID NO: 43534

SEQ ID NO: 636987 - RNA, 64 nt, hsa; identical to SEQ ID NO: 43535

SEQ ID NO: 636988 - RNA, 64 nt, hsa; identical to SEQ ID NO: 43536

SEQ ID NO: 636989 - RNA, 64 nt, hsa; identical to SEQ ID NO: 43537

SEQ ID NO: 636990 - RNA, 64 nt, hsa; identical to SEQ ID NO: 43538

SEQ ID NO: 636991 - RNA, 64 nt, hsa; identical to SEQ ID NO: 43539

SEQ ID NO: 636992 - RNA, 61 nt, hsa; identical to SEQ ID NO: 43540

SEQ ID NO: 636993 - RNA, 64 nt, hsa; identical to SEQ ID NO: 43541

SEQ ID NO: 636994 - RNA, 64 nt, hsa; identical to SEQ ID NO: 43542

SEQ ID NO: 636995 - RNA, 64 nt, hsa; identical to SEQ ID NO: 43543

SEQ ID NO: 636996 - RNA, 64 nt, hsa; identical to SEQ ID NO: 43544

SEQ ID NO: 636997 - RNA, 64 nt, hsa; identical to SEQ ID NO: 43545

SEQ ID NO: 636998 - RNA, 64 nt, hsa; identical to SEQ ID NO: 43546

SEQ ID NO: 636999 - RNA, 64 nt, hsa; identical to SEQ ID NO: 43547

SEQ ID NO: 637000 - RNA, 64 nt, hsa; identical to SEQ ID NO: 43548

SEQ ID NO: 637001 - RNA, 64 nt, hsa; identical to SEQ ID NO: 43549

SEQ ID NO: 637002 - RNA, 64 nt, hsa; identical to SEQ ID NO: 43550

SEQ ID NO: 637003 - RNA, 64 nt, hsa; identical to SEQ ID NO: 43551

SEQ ID NO: 637004 - RNA, 64 nt, hsa; identical to SEQ ID NO: 43552

SEQ ID NO: 637005 - RNA, 64 nt, hsa; identical to SEQ ID NO: 43553

SEQ ID NO: 637006 - RNA, 64 nt, hsa; identical to SEQ ID NO: 43554

SEQ ID NO: 637007 - RNA, 64 nt, hsa; identical to SEQ ID NO: 43555

SEQ ID NO: 637008 - RNA, 64 nt, hsa; identical to SEQ ID NO: 43556

SEQ ID NO: 637009 - RNA, 64 nt, hsa; identical to SEQ ID NO: 43557

SEQ ID NO: 637010 - RNA, 64 nt, hsa; identical to SEQ ID NO: 43558

SEQ ID NO: 637011 - RNA, 64 nt, hsa; identical to SEQ ID NO: 43559

SEQ ID NO: 637012 - RNA, 64 nt, hsa; identical to SEQ ID NO: 43560

SEQ ID NO: 637013 - RNA, 64 nt, hsa; identical to SEQ ID NO: 43561

SEQ ID NO: 637014 - RNA, 64 nt, hsa; identical to SEQ ID NO: 43562

SEQ ID NO: 637015 - RNA, 64 nt, hsa; identical to SEQ ID NO: 43563

SEQ ID NO: 637016 - RNA, 64 nt, hsa; identical to SEQ ID NO: 43564

SEQ ID NO: 637017 - RNA, 64 nt, hsa; identical to SEQ ID NO: 43565

SEQ ID NO: 637018 - RNA, 64 nt, hsa; identical to SEQ ID NO: 43566

SEQ ID NO: 637019 - RNA, 64 nt, hsa; identical to SEQ ID NO: 43567

SEQ ID NO: 637020 - RNA, 64 nt, hsa; identical to SEQ ID NO: 43568

SEQ ID NO: 637021 - RNA, 64 nt, hsa; identical to SEQ ID NO: 43569

SEQ ID NO: 637022 - RNA, 64 nt, hsa; identical to SEQ ID NO: 43570

SEQ ID NO: 637023 - RNA, 64 nt, hsa; identical to SEQ ID NO: 43571

SEQ ID NO: 637024 - RNA, 64 nt, hsa; identical to SEQ ID NO: 43572

SEQ ID NO: 637025 - RNA, 64 nt, hsa; identical to SEQ ID NO: 43573

SEQ ID NO: 637026 - RNA, 64 nt, hsa; identical to SEQ ID NO: 43574

SEQ ID NO: 637027 - RNA, 64 nt, hsa; identical to SEQ ID NO: 43575

SEQ ID NO: 637028 - RNA, 64 nt, hsa; identical to SEQ ID NO: 43576

SEQ ID NO: 637029 - RNA, 64 nt, hsa; identical to SEQ ID NO: 43577

SEQ ID NO: 637030 - RNA, 64 nt, hsa; identical to SEQ ID NO: 43578

SEQ ID NO: 637031 - RNA, 64 nt, hsa; identical to SEQ ID NO: 43579

SEQ ID NO: 637032 - RNA, 64 nt, hsa; identical to SEQ ID NO: 43580

SEQ ID NO: 637033 - RNA, 64 nt, hsa; identical to SEQ ID NO: 43581

SEQ ID NO: 637034 - RNA, 64 nt, hsa; identical to SEQ ID NO: 43582

SEQ ID NO: 637035 - RNA, 64 nt, hsa; identical to SEQ ID NO: 43583

SEQ ID NO: 637036 - RNA, 64 nt, hsa; identical to SEQ ID NO: 43584

SEQ ID NO: 637037 - RNA, 64 nt, hsa; identical to SEQ ID NO: 43585

SEQ ID NO: 637038 - RNA, 64 nt, hsa; identical to SEQ ID NO: 43586

SEQ ID NO: 637039 - RNA, 64 nt, hsa; identical to SEQ ID NO: 43587

SEQ ID NO: 637040 - RNA, 64 nt, hsa; identical to SEQ ID NO: 43588

SEQ ID NO: 637041 - RNA, 64 nt, hsa; identical to SEQ ID NO: 43589

SEQ ID NO: 637042 - RNA, 64 nt, hsa; identical to SEQ ID NO: 43590

SEQ ID NO: 637043 - RNA, 64 nt, hsa; identical to SEQ ID NO: 43591

SEQ ID NO: 637044 - RNA, 64 nt, hsa; identical to SEQ ID NO: 43592

SEQ ID NO: 637045 - RNA, 64 nt, hsa; identical to SEQ ID NO: 43593

SEQ ID NO: 637046 - RNA, 64 nt, hsa; identical to SEQ ID NO: 43594

SEQ ID NO: 637047 - RNA, 64 nt, hsa; identical to SEQ ID NO: 43595

SEQ ID NO: 637048 - RNA, 64 nt, hsa; identical to SEQ ID NO: 43596

SEQ ID NO: 637049 - RNA, 64 nt, hsa; identical to SEQ ID NO: 43597

SEQ ID NO: 637050 - RNA, 64 nt, hsa; identical to SEQ ID NO: 43598

SEQ ID NO: 637051 - RNA, 64 nt, hsa; identical to SEQ ID NO: 43599

SEQ ID NO: 637052 - RNA, 64 nt, hsa; identical to SEQ ID NO: 43600

SEQ ID NO: 637053 - RNA, 64 nt, hsa; identical to SEQ ID NO: 43601

SEQ ID NO: 637054 - RNA, 64 nt, hsa; identical to SEQ ID NO: 43602

SEQ ID NO: 637055 - RNA, 64 nt, hsa; identical to SEQ ID NO: 43603

SEQ ID NO: 637056 - RNA, 64 nt, hsa; identical to SEQ ID NO: 43604

SEQ ID NO: 637057 - RNA, 64 nt, hsa; identical to SEQ ID NO: 43605

SEQ ID NO: 637058 - RNA, 64 nt, hsa; identical to SEQ ID NO: 43606

SEQ ID NO: 637059 - RNA, 64 nt, hsa; identical to SEQ ID NO: 43607

SEQ ID NO: 637060 - RNA, 64 nt, hsa; identical to SEQ ID NO: 43608

SEQ ID NO: 637061 - RNA, 64 nt, hsa; identical to SEQ ID NO: 43609

SEQ ID NO: 637062 - RNA, 64 nt, hsa; identical to SEQ ID NO: 43610

SEQ ID NO: 637063 - RNA, 64 nt, hsa; identical to SEQ ID NO: 43611

SEQ ID NO: 637064 - RNA, 64 nt, hsa; identical to SEQ ID NO: 43612

SEQ ID NO: 637065 - RNA, 64 nt, hsa; identical to SEQ ID NO: 43613

SEQ ID NO: 637066 - RNA, 64 nt, hsa; identical to SEQ ID NO: 43614

SEQ ID NO: 637067 - RNA, 64 nt, hsa; identical to SEQ ID NO: 43615

SEQ ID NO: 637068 - RNA, 64 nt, hsa; identical to SEQ ID NO: 43616

SEQ ID NO: 637069 - RNA, 64 nt, hsa; identical to SEQ ID NO: 43617

SEQ ID NO: 637070 - RNA, 64 nt, hsa; identical to SEQ ID NO: 43618

SEQ ID NO: 637071 - RNA, 64 nt, hsa; identical to SEQ ID NO: 43619

SEQ ID NO: 637072 - RNA, 64 nt, hsa; identical to SEQ ID NO: 43620

SEQ ID NO: 637073 - RNA, 64 nt, hsa; identical to SEQ ID NO: 43621

SEQ ID NO: 637074 - RNA, 64 nt, hsa; identical to SEQ ID NO: 43622

SEQ ID NO: 637075 - RNA, 64 nt, hsa; identical to SEQ ID NO: 43623

SEQ ID NO: 637076 - RNA, 64 nt, hsa; identical to SEQ ID NO: 43624

SEQ ID NO: 637077 - RNA, 64 nt, hsa; identical to SEQ ID NO: 43625

SEQ ID NO: 637078 - RNA, 64 nt, hsa; identical to SEQ ID NO: 43626

SEQ ID NO: 637079 - RNA, 64 nt, hsa; identical to SEQ ID NO: 43627

SEQ ID NO: 637080 - RNA, 64 nt, hsa; identical to SEQ ID NO: 43628

SEQ ID NO: 637081 - RNA, 64 nt, hsa; identical to SEQ ID NO: 43629

SEQ ID NO: 637082 - RNA, 64 nt, hsa; identical to SEQ ID NO: 43630

SEQ ID NO: 637083 - RNA, 64 nt, hsa; identical to SEQ ID NO: 43631

SEQ ID NO: 637084 - RNA, 64 nt, hsa; identical to SEQ ID NO: 43632

SEQ ID NO: 637085 - RNA, 64 nt, hsa; identical to SEQ ID NO: 43633

SEQ ID NO: 637086 - RNA, 64 nt, hsa; identical to SEQ ID NO: 43634

SEQ ID NO: 637087 - RNA, 64 nt, hsa; identical to SEQ ID NO: 43635

SEQ ID NO: 637088 - RNA, 64 nt, hsa; identical to SEQ ID NO: 43636

SEQ ID NO: 637089 - RNA, 64 nt, hsa; identical to SEQ ID NO: 43637

SEQ ID NO: 637090 - RNA, 64 nt, hsa; identical to SEQ ID NO: 43638

SEQ ID NO: 637091 - RNA, 64 nt, hsa; identical to SEQ ID NO: 43639

SEQ ID NO: 637092 - RNA, 64 nt, hsa; identical to SEQ ID NO: 43640

SEQ ID NO: 637093 - RNA, 64 nt, hsa; identical to SEQ ID NO: 43641

SEQ ID NO: 637094 - RNA, 64 nt, hsa; identical to SEQ ID NO: 43642

SEQ ID NO: 637095 - RNA, 64 nt, hsa; identical to SEQ ID NO: 43643

SEQ ID NO: 637096 - RNA, 64 nt, hsa; identical to SEQ ID NO: 43644

SEQ ID NO: 637097 - RNA, 64 nt, hsa; identical to SEQ ID NO: 43645

SEQ ID NO: 637098 - RNA, 64 nt, hsa; identical to SEQ ID NO: 43646

SEQ ID NO: 637099 - RNA, 64 nt, hsa; identical to SEQ ID NO: 43647

SEQ ID NO: 637100 - RNA, 64 nt, hsa; identical to SEQ ID NO: 43648

SEQ ID NO: 637101 - RNA, 64 nt, hsa; identical to SEQ ID NO: 43649

SEQ ID NO: 637102 - RNA, 64 nt, hsa; identical to SEQ ID NO: 43650

SEQ ID NO: 637103 - RNA, 64 nt, hsa; identical to SEQ ID NO: 43651

SEQ ID NO: 637104 - RNA, 64 nt, hsa; identical to SEQ ID NO: 43652

SEQ ID NO: 637105 - RNA, 64 nt, hsa; identical to SEQ ID NO: 43653

SEQ ID NO: 637106 - RNA, 64 nt, hsa; identical to SEQ ID NO: 43654

SEQ ID NO: 637107 - RNA, 64 nt, hsa; identical to SEQ ID NO: 43655

SEQ ID NO: 637108 - RNA, 64 nt, hsa; identical to SEQ ID NO: 43656

SEQ ID NO: 637109 - RNA, 64 nt, hsa; identical to SEQ ID NO: 43657

SEQ ID NO: 637110 - RNA, 64 nt, hsa; identical to SEQ ID NO: 43658

SEQ ID NO: 637111 - RNA, 64 nt, hsa; identical to SEQ ID NO: 43659

SEQ ID NO: 637112 - RNA, 64 nt, hsa; identical to SEQ ID NO: 43660

SEQ ID NO: 637113 - RNA, 64 nt, hsa; identical to SEQ ID NO: 43661

SEQ ID NO: 637114 - RNA, 64 nt, hsa; identical to SEQ ID NO: 43662

SEQ ID NO: 637115 - RNA, 64 nt, hsa; identical to SEQ ID NO: 43663

SEQ ID NO: 637116 - RNA, 64 nt, hsa; identical to SEQ ID NO: 43664

SEQ ID NO: 637117 - RNA, 64 nt, hsa; identical to SEQ ID NO: 43665

SEQ ID NO: 637118 - RNA, 64 nt, hsa; identical to SEQ ID NO: 43666

SEQ ID NO: 637119 - RNA, 64 nt, hsa; identical to SEQ ID NO: 43667

SEQ ID NO: 637120 - RNA, 64 nt, hsa; identical to SEQ ID NO: 43668

SEQ ID NO: 637121 - RNA, 64 nt, hsa; identical to SEQ ID NO: 43669

SEQ ID NO: 637122 - RNA, 64 nt, hsa; identical to SEQ ID NO: 43670

SEQ ID NO: 637123 - RNA, 64 nt, hsa; identical to SEQ ID NO: 43671

SEQ ID NO: 637124 - RNA, 64 nt, hsa; identical to SEQ ID NO: 43672

SEQ ID NO: 637125 - RNA, 64 nt, hsa; identical to SEQ ID NO: 43673

SEQ ID NO: 637126 - RNA, 64 nt, hsa; identical to SEQ ID NO: 43674

SEQ ID NO: 637127 - RNA, 64 nt, hsa; identical to SEQ ID NO: 43675

SEQ ID NO: 637128 - RNA, 64 nt, hsa; identical to SEQ ID NO: 43676

SEQ ID NO: 637129 - RNA, 64 nt, hsa; identical to SEQ ID NO: 43677

SEQ ID NO: 637130 - RNA, 64 nt, hsa; identical to SEQ ID NO: 43678

SEQ ID NO: 637131 - RNA, 64 nt, hsa; identical to SEQ ID NO: 43679

SEQ ID NO: 637132 - RNA, 64 nt, hsa; identical to SEQ ID NO: 43680

SEQ ID NO: 637133 - RNA, 64 nt, hsa; identical to SEQ ID NO: 43681

SEQ ID NO: 637134 - RNA, 64 nt, hsa; identical to SEQ ID NO: 43682

SEQ ID NO: 637135 - RNA, 64 nt, hsa; identical to SEQ ID NO: 43683

SEQ ID NO: 637136 - RNA, 64 nt, hsa; identical to SEQ ID NO: 43684

SEQ ID NO: 637137 - RNA, 64 nt, hsa; identical to SEQ ID NO: 43685

SEQ ID NO: 637138 - RNA, 64 nt, hsa; identical to SEQ ID NO: 43686

SEQ ID NO: 637139 - RNA, 64 nt, hsa; identical to SEQ ID NO: 43687

SEQ ID NO: 637140 - RNA, 64 nt, hsa; identical to SEQ ID NO: 43688

SEQ ID NO: 637141 - RNA, 64 nt, hsa; identical to SEQ ID NO: 43689

SEQ ID NO: 637142 - RNA, 64 nt, hsa; identical to SEQ ID NO: 43690

SEQ ID NO: 637143 - RNA, 64 nt, hsa; identical to SEQ ID NO: 43691

SEQ ID NO: 637144 - RNA, 64 nt, hsa; identical to SEQ ID NO: 43692

SEQ ID NO: 637145 - RNA, 64 nt, hsa; identical to SEQ ID NO: 43693

SEQ ID NO: 637146 - RNA, 64 nt, hsa; identical to SEQ ID NO: 43694

SEQ ID NO: 637147 - RNA, 64 nt, hsa; identical to SEQ ID NO: 90702

SEQ ID NO: 637148 - RNA, 64 nt, hsa; identical to SEQ ID NO: 90703

SEQ ID NO: 637149 - RNA, 64 nt, hsa; identical to SEQ ID NO: 90704

SEQ ID NO: 637150 - RNA, 64 nt, hsa; identical to SEQ ID NO: 90705

SEQ ID NO: 637151 - RNA, 64 nt, hsa; identical to SEQ ID NO: 90706

SEQ ID NO: 637152 - RNA, 64 nt, hsa; identical to SEQ ID NO: 90707

SEQ ID NO: 637153 - RNA, 64 nt, hsa; identical to SEQ ID NO: 90708

SEQ ID NO: 637154 - RNA, 64 nt, hsa; identical to SEQ ID NO: 90709

SEQ ID NO: 637155 - RNA, 64 nt, hsa; identical to SEQ ID NO: 90710

SEQ ID NO: 637156 - RNA, 64 nt, hsa; identical to SEQ ID NO: 90711

SEQ ID NO: 637157 - RNA, 64 nt, hsa; identical to SEQ ID NO: 90712

SEQ ID NO: 637158 - RNA, 64 nt, hsa; identical to SEQ ID NO: 90713

SEQ ID NO: 637159 - RNA, 64 nt, hsa; identical to SEQ ID NO: 90714

SEQ ID NO: 637160 - RNA, 64 nt, hsa; identical to SEQ ID NO: 90715

SEQ ID NO: 637161 - RNA, 64 nt, hsa; identical to SEQ ID NO: 90716

SEQ ID NO: 637162 - RNA, 64 nt, hsa; identical to SEQ ID NO: 90717

SEQ ID NO: 637163 - RNA, 64 nt, hsa; identical to SEQ ID NO: 90718

SEQ ID NO: 637164 - RNA, 64 nt, hsa; identical to SEQ ID NO: 90719

SEQ ID NO: 637165 - RNA, 64 nt, hsa; identical to SEQ ID NO: 90720

SEQ ID NO: 637166 - RNA, 64 nt, hsa; identical to SEQ ID NO: 90721

SEQ ID NO: 637167 - RNA, 64 nt, hsa; identical to SEQ ID NO: 90722

SEQ ID NO: 637168 - RNA, 64 nt, hsa; identical to SEQ ID NO: 90723

SEQ ID NO: 637169 - RNA, 64 nt, hsa; identical to SEQ ID NO: 90724

SEQ ID NO: 637170 - RNA, 64 nt, hsa; identical to SEQ ID NO: 90725

SEQ ID NO: 637171 - RNA, 64 nt, hsa; identical to SEQ ID NO: 90726

SEQ ID NO: 637172 - RNA, 64 nt, hsa; identical to SEQ ID NO: 90727

SEQ ID NO: 637173 - RNA, 64 nt, hsa; identical to SEQ ID NO: 90728

SEQ ID NO: 637174 - RNA, 64 nt, hsa; identical to SEQ ID NO: 90729

SEQ ID NO: 637175 - RNA, 64 nt, hsa; identical to SEQ ID NO: 90730

SEQ ID NO: 637176 - RNA, 64 nt, hsa; identical to SEQ ID NO: 90731

SEQ ID NO: 637177 - RNA, 64 nt, hsa; identical to SEQ ID NO: 90732

SEQ ID NO: 637178 - RNA, 64 nt, hsa; identical to SEQ ID NO: 90733

SEQ ID NO: 637179 - RNA, 64 nt, hsa; identical to SEQ ID NO: 90734

SEQ ID NO: 637180 - RNA, 61 nt, hsa
cucuuguuucucaggcugccugcagaagaagucgcuauaaauuaucuguugucuacauggu

SEQ ID NO: 637181 - RNA, 61 nt, hsa
agguccuagagcuccaggacaaugauaagacucgcuauauggggaagggugucucaaagcc

SEQ ID NO: 637182 - RNA, 61 nt, hsa
aucuucaaaccaaggcagaaauaauuuuaugucgcuauaguauaaaaacauuaauaagaua

SEQ ID NO: 637183 - RNA, 61 nt, hsa
aacauaaauguauuauuaaccaugaagcugcucgcuauauuuuuggcauaacaaaauaaua

SEQ ID NO: 637184 - RNA, 61 nt, hsa
augauaaauuaugauaauauaugaggaggccucgcuauagcaaaaauaguuaaaaugcuga

SEQ ID NO: 637185 - RNA, 61 nt, hsa
gugcccggccacucucuguacuuuaaacauuucgcuauacucucuucuuggcucguguagu

SEQ ID NO: 637186 - RNA, 61 nt, hsa
agucacugcacuggagucuacgagccggaacucgcuauaugcacguguguguguccguaug

SEQ ID NO: 637187 - RNA, 61 nt, hsa
gaaggugaggccaguaaccaucucaugggauucgcuauaaucagccuauuugagcugcugg

SEQ ID NO: 637188 - RNA, 61 nt, hsa
ccuccuuucuucagagaagccaguacuugaaucgcuauauuucuauuuuuuuuucccugua

SEQ ID NO: 637189 - RNA, 61 nt, hsa
aaaauauauauaaauauauaauagauaucuaucgcuauagaauaaugcauuaauaaaauga

SEQ ID NO: 637190 - RNA, 61 nt, hsa
ggucccaccuaaagucccuaaccgggaggcaucgcuauacuccccuccuucaacucucccc

SEQ ID NO: 637191 - RNA, 61 nt, hsa
gccuuuuuuucuucagagcuuguugucuuuuucgcuauauuagacuuugcaguaugcccag

SEQ ID NO: 637192 - RNA, 61 nt, hsa
cagucuaaucuagugacaccucagucauauuucgcuauagauuuuaccucaaaucagucca

SEQ ID NO: 637193 - RNA, 61 nt, hsa
caucagaagcacauuuacugugcuaucuauaucgcuauauaaaaguguuuuauaaaaaccc

SEQ ID NO: 637194 - RNA, 61 nt, hsa
aguucugacacauuuuccaugaaacaaaccaucgcuauauucaagauaaugaaccuaucua

SEQ ID NO: 637195 - RNA, 61 nt, hsa
ccugggggauggccgugcaugggguguacacucgcuauaggcauaggcccggcauggcugu

SEQ ID NO: 637196 - RNA, 61 nt, hsa
uuuguuacucuguaaaugaaaaaacccauuuucgcuauaaauaaaagguaacuguacaaaa

SEQ ID NO: 637197 - RNA, 61 nt, hsa
gcaacuuaaauauuugcuagacuuugaaucaucgcuauaucaaguaucuaaaauuugggag

SEQ ID NO: 637198 - RNA, 64 nt, hsa; identical to SEQ ID NO: 175212

SEQ ID NO: 637199 - RNA, 64 nt, hsa; identical to SEQ ID NO: 175213

SEQ ID NO: 637200 - RNA, 64 nt, hsa; identical to SEQ ID NO: 175214

SEQ ID NO: 637201 - RNA, 64 nt, hsa; identical to SEQ ID NO: 175215

SEQ ID NO: 637202 - RNA, 64 nt, hsa; identical to SEQ ID NO: 175216

SEQ ID NO: 637203 - RNA, 64 nt, hsa; identical to SEQ ID NO: 175217

SEQ ID NO: 637204 - RNA, 64 nt, hsa; identical to SEQ ID NO: 175218

SEQ ID NO: 637205 - RNA, 64 nt, hsa; identical to SEQ ID NO: 175219

SEQ ID NO: 637206 - RNA, 64 nt, hsa; identical to SEQ ID NO: 175220

SEQ ID NO: 637207 - RNA, 64 nt, hsa; identical to SEQ ID NO: 175221

SEQ ID NO: 637208 - RNA, 64 nt, hsa; identical to SEQ ID NO: 175222

SEQ ID NO: 637209 - RNA, 64 nt, hsa; identical to SEQ ID NO: 175223

SEQ ID NO: 637210 - RNA, 64 nt, hsa; identical to SEQ ID NO: 175224

SEQ ID NO: 637211 - RNA, 64 nt, hsa; identical to SEQ ID NO: 175225

SEQ ID NO: 637212 - RNA, 64 nt, hsa; identical to SEQ ID NO: 175226

SEQ ID NO: 637213 - RNA, 64 nt, hsa; identical to SEQ ID NO: 175227

SEQ ID NO: 637214 - RNA, 64 nt, hsa; identical to SEQ ID NO: 175228

SEQ ID NO: 637215 - RNA, 64 nt, hsa; identical to SEQ ID NO: 175229

SEQ ID NO: 637216 - RNA, 64 nt, hsa; identical to SEQ ID NO: 175230

SEQ ID NO: 637217 - RNA, 64 nt, hsa; identical to SEQ ID NO: 175231

SEQ ID NO: 637218 - RNA, 64 nt, hsa; identical to SEQ ID NO: 175232

SEQ ID NO: 637219 - RNA, 64 nt, hsa; identical to SEQ ID NO: 175233

SEQ ID NO: 637220 - RNA, 64 nt, hsa; identical to SEQ ID NO: 175234

SEQ ID NO: 637221 - RNA, 64 nt, hsa; identical to SEQ ID NO: 175235

SEQ ID NO: 637222 - RNA, 64 nt, hsa; identical to SEQ ID NO: 175236

SEQ ID NO: 637223 - RNA, 64 nt, hsa; identical to SEQ ID NO: 97987

SEQ ID NO: 637224 - RNA, 64 nt, hsa; identical to SEQ ID NO: 97988

SEQ ID NO: 637225 - RNA, 64 nt, hsa; identical to SEQ ID NO: 97989

SEQ ID NO: 637226 - RNA, 64 nt, hsa; identical to SEQ ID NO: 97990

SEQ ID NO: 637227 - RNA, 64 nt, hsa; identical to SEQ ID NO: 97991

SEQ ID NO: 637228 - RNA, 64 nt, hsa; identical to SEQ ID NO: 97992

SEQ ID NO: 637229 - RNA, 64 nt, hsa; identical to SEQ ID NO: 97993

SEQ ID NO: 637230 - RNA, 64 nt, hsa; identical to SEQ ID NO: 97994

SEQ ID NO: 637231 - RNA, 64 nt, hsa; identical to SEQ ID NO: 97995

SEQ ID NO: 637232 - RNA, 64 nt, hsa; identical to SEQ ID NO: 97996

SEQ ID NO: 637233 - RNA, 64 nt, hsa; identical to SEQ ID NO: 97997

SEQ ID NO: 637234 - RNA, 64 nt, hsa; identical to SEQ ID NO: 97998

SEQ ID NO: 637235 - RNA, 64 nt, hsa; identical to SEQ ID NO: 97999

SEQ ID NO: 637236 - RNA, 64 nt, hsa; identical to SEQ ID NO: 98000

SEQ ID NO: 637237 - RNA, 64 nt, hsa; identical to SEQ ID NO: 98001

SEQ ID NO: 637238 - RNA, 64 nt, hsa; identical to SEQ ID NO: 98002

SEQ ID NO: 637239 - RNA, 64 nt, hsa; identical to SEQ ID NO: 98003

SEQ ID NO: 637240 - RNA, 64 nt, hsa; identical to SEQ ID NO: 98004

SEQ ID NO: 637241 - RNA, 64 nt, hsa; identical to SEQ ID NO: 98005

SEQ ID NO: 637242 - RNA, 64 nt, hsa; identical to SEQ ID NO: 98006

SEQ ID NO: 637243 - RNA, 64 nt, hsa; identical to SEQ ID NO: 98007

SEQ ID NO: 637244 - RNA, 64 nt, hsa; identical to SEQ ID NO: 98008

SEQ ID NO: 637245 - RNA, 53 nt, hsa; identical to SEQ ID NO: 98009

SEQ ID NO: 637246 - RNA, 64 nt, hsa; identical to SEQ ID NO: 98010

SEQ ID NO: 637247 - RNA, 64 nt, hsa; identical to SEQ ID NO: 164628

SEQ ID NO: 637248 - RNA, 64 nt, hsa; identical to SEQ ID NO: 164629

SEQ ID NO: 637249 - RNA, 64 nt, hsa; identical to SEQ ID NO: 164630

SEQ ID NO: 637250 - RNA, 64 nt, hsa; identical to SEQ ID NO: 164631

SEQ ID NO: 637251 - RNA, 64 nt, hsa; identical to SEQ ID NO: 164632

SEQ ID NO: 637252 - RNA, 64 nt, hsa; identical to SEQ ID NO: 164633

SEQ ID NO: 637253 - RNA, 64 nt, hsa; identical to SEQ ID NO: 164634

SEQ ID NO: 637254 - RNA, 64 nt, hsa; identical to SEQ ID NO: 164635

SEQ ID NO: 637255 - RNA, 64 nt, hsa; identical to SEQ ID NO: 164636

SEQ ID NO: 637256 - RNA, 64 nt, hsa; identical to SEQ ID NO: 164637

SEQ ID NO: 637257 - RNA, 64 nt, hsa; identical to SEQ ID NO: 164638

SEQ ID NO: 637258 - RNA, 64 nt, hsa; identical to SEQ ID NO: 164639

SEQ ID NO: 637259 - RNA, 64 nt, hsa; identical to SEQ ID NO: 164640

SEQ ID NO: 637260 - RNA, 64 nt, hsa; identical to SEQ ID NO: 164641

SEQ ID NO: 637261 - RNA, 64 nt, hsa; identical to SEQ ID NO: 164642

SEQ ID NO: 637262 - RNA, 64 nt, hsa; identical to SEQ ID NO: 164643

SEQ ID NO: 637263 - RNA, 64 nt, hsa; identical to SEQ ID NO: 286103

SEQ ID NO: 637264 - RNA, 64 nt, hsa; identical to SEQ ID NO: 286104

SEQ ID NO: 637265 - RNA, 64 nt, hsa; identical to SEQ ID NO: 286105

SEQ ID NO: 637266 - RNA, 64 nt, hsa; identical to SEQ ID NO: 286106

SEQ ID NO: 637267 - RNA, 64 nt, hsa; identical to SEQ ID NO: 286107

SEQ ID NO: 637268 - RNA, 64 nt, hsa; identical to SEQ ID NO: 286108

SEQ ID NO: 637269 - RNA, 64 nt, hsa; identical to SEQ ID NO: 286109

SEQ ID NO: 637270 - RNA, 64 nt, hsa; identical to SEQ ID NO: 286110

SEQ ID NO: 637271 - RNA, 64 nt, hsa; identical to SEQ ID NO: 286111

SEQ ID NO: 637272 - RNA, 64 nt, hsa; identical to SEQ ID NO: 286112

SEQ ID NO: 637273 - RNA, 64 nt, hsa; identical to SEQ ID NO: 286113

SEQ ID NO: 637274 - RNA, 64 nt, hsa; identical to SEQ ID NO: 286114

SEQ ID NO: 637275 - RNA, 64 nt, hsa; identical to SEQ ID NO: 286115

SEQ ID NO: 637276 - RNA, 64 nt, hsa; identical to SEQ ID NO: 286116

SEQ ID NO: 637277 - RNA, 64 nt, hsa; identical to SEQ ID NO: 286117

SEQ ID NO: 637278 - RNA, 64 nt, hsa; identical to SEQ ID NO: 286118

SEQ ID NO: 637279 - RNA, 64 nt, hsa; identical to SEQ ID NO: 286119

SEQ ID NO: 637280 - RNA, 64 nt, hsa; identical to SEQ ID NO: 286120

SEQ ID NO: 637281 - RNA, 64 nt, hsa; identical to SEQ ID NO: 286121

SEQ ID NO: 637282 - RNA, 64 nt, hsa; identical to SEQ ID NO: 286122

SEQ ID NO: 637283 - RNA, 64 nt, hsa; identical to SEQ ID NO: 286123

SEQ ID NO: 637284 - RNA, 64 nt, hsa; identical to SEQ ID NO: 286124

SEQ ID NO: 637285 - RNA, 64 nt, hsa; identical to SEQ ID NO: 288178

SEQ ID NO: 637286 - RNA, 64 nt, hsa; identical to SEQ ID NO: 288179

SEQ ID NO: 637287 - RNA, 64 nt, hsa; identical to SEQ ID NO: 288180

SEQ ID NO: 637288 - RNA, 64 nt, hsa; identical to SEQ ID NO: 288181

SEQ ID NO: 637289 - RNA, 64 nt, hsa; identical to SEQ ID NO: 288182

SEQ ID NO: 637290 - RNA, 64 nt, hsa; identical to SEQ ID NO: 288183

SEQ ID NO: 637291 - RNA, 64 nt, hsa; identical to SEQ ID NO: 288184

SEQ ID NO: 637292 - RNA, 64 nt, hsa; identical to SEQ ID NO: 288185

SEQ ID NO: 637293 - RNA, 64 nt, hsa; identical to SEQ ID NO: 288186

SEQ ID NO: 637294 - RNA, 64 nt, hsa; identical to SEQ ID NO: 288187

SEQ ID NO: 637295 - RNA, 64 nt, hsa; identical to SEQ ID NO: 288188

SEQ ID NO: 637296 - RNA, 64 nt, hsa; identical to SEQ ID NO: 288189

SEQ ID NO: 637297 - RNA, 64 nt, hsa; identical to SEQ ID NO: 288190

SEQ ID NO: 637298 - RNA, 64 nt, hsa; identical to SEQ ID NO: 288191

SEQ ID NO: 637299 - RNA, 64 nt, hsa; identical to SEQ ID NO: 288192

SEQ ID NO: 637300 - RNA, 64 nt, hsa; identical to SEQ ID NO: 288193

SEQ ID NO: 637301 - RNA, 64 nt, hsa; identical to SEQ ID NO: 288194

SEQ ID NO: 637302 - RNA, 64 nt, hsa; identical to SEQ ID NO: 288195

SEQ ID NO: 637303 - RNA, 64 nt, hsa
aagauauucuugguaguaacugacaaguauguugcacauguauugggggaggcgcuucauuuuu

SEQ ID NO: 637304 - RNA, 64 nt, hsa
guauugggggaggcgcuucauuuuuauuuuaauacacauguauuuccuccuugcacaggauuuu

SEQ ID NO: 637305 - RNA, 64 nt, hsa
cauguauucauauguaacaaaccugcacguugugcacauguacccuagaacuuaaaguauauaa

SEQ ID NO: 637306 - RNA, 64 nt, hsa
augacgaguuaaugggugcagccaaccaaccuggcacauguauucauauguaacaaaccugcac

SEQ ID NO: 637307 - RNA, 64 nt, hsa
uaugaaaagaaaacacuguauuccuuaugcaaaacacauguaucuuucauuauuuauaaguggc

SEQ ID NO: 637308 - RNA, 64 nt, hsa
uguguaccaccccauauauuucauauuacuguuucacauguacagcuuucuacuucuuuguaag

SEQ ID NO: 637309 - RNA, 64 nt, hsa
cauguauacauauguagcuaaccugcacguugugcacauguacccuaaaacuuaaaguauaauu

SEQ ID NO: 637310 - RNA, 64 nt, hsa
augacgaguuacuggaugcagcacgccaacauggcacauguauacauauguagcuaaccugcac

SEQ ID NO: 637311 - RNA, 64 nt, hsa
uugguaagagugacuaaccagccuaacuuuaauacacauguauaaagauguucacagagaaaga

SEQ ID NO: 637312 - RNA, 64 nt, hsa
uagaggacagacugauaguuucuuucuuucauaucacauguauagagaaauaauuauaucagaa

SEQ ID NO: 637313 - RNA, 64 nt, hsa
aacccaucacuucugguguuaacccuaaaauacccacauguauugagcuggucuucugcauuua

SEQ ID NO: 637314 - RNA, 64 nt, hsa
uucgugggguuacaucugugaauagccuguuuuccacauguaaauuugugccuuacaccuugag

SEQ ID NO: 637315 - RNA, 64 nt, hsa
aaguuguguaugugugugcacaucugagcacgugcacauguacaccugagccaaaaacacgaga

SEQ ID NO: 637316 - RNA, 64 nt, hsa
auugaucauuuagacuauucuggcuaagucugcccacauguaauuaccggcuaauucaagcgag

SEQ ID NO: 637317 - RNA, 64 nt, hsa
cauguauacauauguaacaaaucugcacguugugcacauguacccuagaacuuaaaaaaaaaaa

SEQ ID NO: 637318 - RNA, 64 nt, hsa
augacgaguuaaugggugcagcacaccaacauggcacauguauacauauguaacaaaucugcac

SEQ ID NO: 637319 - RNA, 64 nt, hsa
gagauacucugguggagggacucuagcuaccaugcacauguacauauccacagaauaugggaag

SEQ ID NO: 637320 - RNA, 64 nt, hsa
cagccccugcucaagaaaaagcaugagcuggccacacauguaauccauaaccaccaaaaauacu

SEQ ID NO: 637321 - RNA, 64 nt, hsa
acgugugauacacacaugcauguacagguaagcacacauguacaagcuccuacaggcuugcucu

SEQ ID NO: 637322 - RNA, 64 nt, hsa
gucucccacacgugagcucccacacguacacaugcacauguacgcaccacaaacacaugcgcag

SEQ ID NO: 637323 - RNA, 64 nt, hsa
cauguauaccuguguaacaaaccugcacauucagcacauguaucccagaacuuaaaguauaaua

SEQ ID NO: 637324 - RNA, 64 nt, hsa
augauggguugaugggugcagcaaaguaccauggcacauguauaccuguguaacaaaccugcac

SEQ ID NO: 637325 - RNA, 64 nt, hsa
gagucaugaaauacuuaacacaugugcacauguacacauguacauuuauaugcagugaauuguu

SEQ ID NO: 637326 - RNA, 64 nt, hsa
aaaggcuugagucaugaaauacuuaacacaugugcacauguacacauguacauuuauaugcagu

SEQ ID NO: 637327 - RNA, 64 nt, hsa
aagaauuuggugaauuuuaaagaggaacaagaugacaucugagcucacacucaguguuugcacu

SEQ ID NO: 637328 - RNA, 64 nt, hsa
uuguguaagaaggagcccuagacugaaagucaagacaucugaauuucaggcuggaaaacuauca

SEQ ID NO: 637329 - RNA, 64 nt, hsa
uccucaaguugcuacgguucagugagagaggcagacaucugaacaggcagguaggauucagugu

SEQ ID NO: 637330 - RNA, 64 nt, hsa
cuuagaggaagagaagaaacauggcaagcagauuacaucugagccguuugaauuguguuuuucu

SEQ ID NO: 637331 - RNA, 64 nt, hsa
aagaauuaaacuugucaauuuuaacauugcuguuacaucugaaauaaacuuaugugauguucug

SEQ ID NO: 637332 - RNA, 64 nt, hsa
gcuuugacagauugauaacuuuguaagaugggagacaucugaaauauucauguuuuccuuuugu

SEQ ID NO: 637333 - RNA, 64 nt, hsa
augugaaaccaagaaauguaaucaagcaguaaaaacaucugaauguagaccaugaucucaaguu

SEQ ID NO: 637334 - RNA, 64 nt, hsa
aacaaaauuauguuaauaaauauucccacauaauacaucugaaugguuaaaaauacuggaagag

SEQ ID NO: 637335 - RNA, 64 nt, hsa
agaguauacauugcuauuaugggagaccacccagacaucugacuaauggcucugugcccacacu

SEQ ID NO: 637336 - RNA, 64 nt, hsa
ugcucacgaugaguuuaguguguaaaguuuagagacaucugacuuugauagcuaaauuaaacca

SEQ ID NO: 637337 - RNA, 64 nt, hsa
ggcuugaaaugcccuacaggcccagaacuuucucacaucugaaauggaggcauugcaaugaaaa

SEQ ID NO: 637338 - RNA, 64 nt, hsa
aucagacaaauccacauuaggggcauucugcuaaacaucugacccagacucuucaaaaaugaag

SEQ ID NO: 637339 - RNA, 64 nt, hsa
guuucucaaauuaucuucccuucucuuggggacaacaucugaaggguauguugcaugcauuuuu

SEQ ID NO: 637340 - RNA, 64 nt, hsa
cucuggaccauccuggcuggaaacuuggcuguagacaucugaagagggugcaccuuuucucuuu

SEQ ID NO: 637341 - RNA, 64 nt, hsa
ggcucuuccauuuugcagauaagucaaauaaucaacacuaaaggaggcuaaacuguugaugaau

SEQ ID NO: 637342 - RNA, 64 nt, hsa
uuagauuaauauggccaacccuguacacaucacuacacuaaacacugcucuagauaaacugcuc

SEQ ID NO: 637343 - RNA, 64 nt, hsa
uuauuuaauggccaaaugguuuuugcaagauuuaacacuaaaaagguuucaccugaucauauag

SEQ ID NO: 637344 - RNA, 64 nt, hsa
auuaaguaaaccaaaaaggcuaguuuauuuuguuacacuaaagggcaggugguucuaauauuuu

SEQ ID NO: 637345 - RNA, 64 nt, hsa
augaacaaauuuucgguuacagaucagcucucaaacacuaaaguccuuaauggcaaggucuuuu

SEQ ID NO: 637346 - RNA, 64 nt, hsa
ugaaccagaggacauacuagucacauguuauuauacacuaaaaaauaggaagucaucuugaaag

SEQ ID NO: 637347 - RNA, 64 nt, hsa
augucucauuuugcaguaacuccuacaguguguaacacuaaaaauaagaacuaaugauggcuaa

SEQ ID NO: 637348 - RNA, 64 nt, hsa
uguaacacuaaaaauaagaacuaaugauggcuaaacacuaaaguagccauucauacuuaugcau

SEQ ID NO: 637349 - RNA, 64 nt, hsa
agcuuuuaaaagacacuaaauuguacucuaaaagacacuaaauuguacuaauuguacaaagguc

SEQ ID NO: 637350 - RNA, 64 nt, hsa
aaaauguuuuaaauauuuaggaagcuuuuaaaagacacuaaauuguacucuaaaagacacuaaa

SEQ ID NO: 637351 - RNA, 64 nt, hsa
auauugaaacuucaucuagucucuuaauuuuuuaacacuaaauucaagucauuuguuuuaaguc

SEQ ID NO: 637352 - RNA, 64 nt, hsa
cauccauucauaugcauggggucugaucgcaaauacacuaaauguggaguguaggaaccaaaau

SEQ ID NO: 637353 - RNA, 64 nt, hsa
aagauagagcuacaaacucagcuguacaguucguacacuaaacucuucuugcuuuugcauuaua

SEQ ID NO: 637354 - RNA, 64 nt, hsa
gcugcguuccuaauuuaguaaaauaaaagaauagacacuaaaaucauguugaucuauaauuaca

SEQ ID NO: 637355 - RNA, 64 nt, hsa
gcagcuaaagaugagaggggcucaguuuuacgcaacacuaaauucuagaaaguacuuuggccuc

SEQ ID NO: 637356 - RNA, 64 nt, hsa
gagccauaugacaagccuuugugcucuauagcagacacuaaagacuggguuacauaugccucca

SEQ ID NO: 637357 - RNA, 64 nt, hsa
uauauacauacauacaaacauaggcuaucuuggcacacuaaaugcuaagcacugucuuaagagg

SEQ ID NO: 637358 - RNA, 64 nt, hsa
gagauuugaaguuuggggcuaugcaugaaacccaacacuaaauuuugcaagucaaguaaccaaa

SEQ ID NO: 637359 - RNA, 64 nt, hsa
gcuaacauuuucagagauacagcuucuuauaguaacacuaaaacuuucuuccucuuuggacuga

SEQ ID NO: 637360 - RNA, 64 nt, hsa
aaauucugcugacaaaaaauuuuaagccaguuuuacacuaaauguuccucagucugauuaauuu

SEQ ID NO: 637361 - RNA, 64 nt, hsa
uaggugacauggugacaucuaucccuuuauuuugacacuaaaacauggacacaacuagaaagag

SEQ ID NO: 637362 - RNA, 64 nt, hsa
uugaaaguauuuguuaauuaucugcuuaguauuaacacuaaauuuguagaaugacuuucagguu

SEQ ID NO: 637363 - RNA, 64 nt, hsa
aaagcuaaaauggcuuaacaucaugcuacacuuuacacuaaaaaucuauuacugugaguggucu

SEQ ID NO: 637364 - RNA, 64 nt, hsa
uaaucugagggaaaacauguucagggcuucuagaacacuaaaaaauuuggcuuaaaccaguguu

SEQ ID NO: 637365 - RNA, 64 nt, hsa; identical to SEQ ID NO: 335989

SEQ ID NO: 637366 - RNA, 64 nt, hsa; identical to SEQ ID NO: 335990

SEQ ID NO: 637367 - RNA, 64 nt, hsa; identical to SEQ ID NO: 335991

SEQ ID NO: 637368 - RNA, 64 nt, hsa; identical to SEQ ID NO: 335992

SEQ ID NO: 637369 - RNA, 64 nt, hsa; identical to SEQ ID NO: 335993

SEQ ID NO: 637370 - RNA, 64 nt, hsa; identical to SEQ ID NO: 335994

SEQ ID NO: 637371 - RNA, 64 nt, hsa; identical to SEQ ID NO: 335995

SEQ ID NO: 637372 - RNA, 64 nt, hsa; identical to SEQ ID NO: 335996

SEQ ID NO: 637373 - RNA, 62 nt, hsa; identical to SEQ ID NO: 335997

SEQ ID NO: 637374 - RNA, 64 nt, hsa; identical to SEQ ID NO: 335998

SEQ ID NO: 637375 - RNA, 64 nt, hsa; identical to SEQ ID NO: 335999

SEQ ID NO: 637376 - RNA, 64 nt, hsa; identical to SEQ ID NO: 336000

SEQ ID NO: 637377 - RNA, 64 nt, hsa; identical to SEQ ID NO: 336001

SEQ ID NO: 637378 - RNA, 64 nt, hsa; identical to SEQ ID NO: 336002

SEQ ID NO: 637379 - RNA, 64 nt, hsa; identical to SEQ ID NO: 336003

SEQ ID NO: 637380 - RNA, 64 nt, hsa; identical to SEQ ID NO: 336004

SEQ ID NO: 637381 - RNA, 64 nt, hsa; identical to SEQ ID NO: 336005

SEQ ID NO: 637382 - RNA, 64 nt, hsa; identical to SEQ ID NO: 336006

SEQ ID NO: 637383 - RNA, 64 nt, hsa; identical to SEQ ID NO: 336007

SEQ ID NO: 637384 - RNA, 64 nt, hsa; identical to SEQ ID NO: 336008

SEQ ID NO: 637385 - RNA, 64 nt, hsa; identical to SEQ ID NO: 336009

SEQ ID NO: 637386 - RNA, 64 nt, hsa; identical to SEQ ID NO: 336010

SEQ ID NO: 637387 - RNA, 64 nt, hsa; identical to SEQ ID NO: 336011

SEQ ID NO: 637388 - RNA, 64 nt, hsa; identical to SEQ ID NO: 336012

SEQ ID NO: 637389 - RNA, 64 nt, hsa; identical to SEQ ID NO: 336013

SEQ ID NO: 637390 - RNA, 64 nt, hsa; identical to SEQ ID NO: 336014

SEQ ID NO: 637391 - RNA, 64 nt, hsa; identical to SEQ ID NO: 336015

SEQ ID NO: 637392 - RNA, 64 nt, hsa; identical to SEQ ID NO: 336016

SEQ ID NO: 637393 - RNA, 64 nt, hsa; identical to SEQ ID NO: 336017

SEQ ID NO: 637394 - RNA, 64 nt, hsa; identical to SEQ ID NO: 336018

SEQ ID NO: 637395 - RNA, 64 nt, hsa; identical to SEQ ID NO: 336019

SEQ ID NO: 637396 - RNA, 64 nt, hsa; identical to SEQ ID NO: 336020

SEQ ID NO: 637397 - RNA, 64 nt, hsa; identical to SEQ ID NO: 336021

SEQ ID NO: 637398 - RNA, 64 nt, hsa; identical to SEQ ID NO: 336022

SEQ ID NO: 637399 - RNA, 64 nt, hsa; identical to SEQ ID NO: 336023

SEQ ID NO: 637400 - RNA, 64 nt, hsa; identical to SEQ ID NO: 336024

SEQ ID NO: 637401 - RNA, 64 nt, hsa; identical to SEQ ID NO: 336025

SEQ ID NO: 637402 - RNA, 64 nt, hsa; identical to SEQ ID NO: 336026

SEQ ID NO: 637403 - RNA, 64 nt, hsa; identical to SEQ ID NO: 336027

SEQ ID NO: 637404 - RNA, 64 nt, hsa; identical to SEQ ID NO: 336028

SEQ ID NO: 637405 - RNA, 64 nt, hsa; identical to SEQ ID NO: 95656

SEQ ID NO: 637406 - RNA, 64 nt, hsa; identical to SEQ ID NO: 95657

SEQ ID NO: 637407 - RNA, 64 nt, hsa; identical to SEQ ID NO: 95658

SEQ ID NO: 637408 - RNA, 64 nt, hsa; identical to SEQ ID NO: 95659

SEQ ID NO: 637409 - RNA, 64 nt, hsa; identical to SEQ ID NO: 95660

SEQ ID NO: 637410 - RNA, 64 nt, hsa; identical to SEQ ID NO: 95661

SEQ ID NO: 637411 - RNA, 64 nt, hsa; identical to SEQ ID NO: 95662

SEQ ID NO: 637412 - RNA, 64 nt, hsa; identical to SEQ ID NO: 95663

SEQ ID NO: 637413 - RNA, 64 nt, hsa; identical to SEQ ID NO: 95664

SEQ ID NO: 637414 - RNA, 64 nt, hsa; identical to SEQ ID NO: 95665

SEQ ID NO: 637415 - RNA, 64 nt, hsa; identical to SEQ ID NO: 95666

SEQ ID NO: 637416 - RNA, 64 nt, hsa; identical to SEQ ID NO: 95667

SEQ ID NO: 637417 - RNA, 64 nt, hsa; identical to SEQ ID NO: 95668

SEQ ID NO: 637418 - RNA, 64 nt, hsa; identical to SEQ ID NO: 95669

SEQ ID NO: 637419 - RNA, 64 nt, hsa; identical to SEQ ID NO: 95670

SEQ ID NO: 637420 - RNA, 64 nt, hsa; identical to SEQ ID NO: 95671

SEQ ID NO: 637421 - RNA, 64 nt, hsa; identical to SEQ ID NO: 95672

SEQ ID NO: 637422 - RNA, 64 nt, hsa; identical to SEQ ID NO: 95673

SEQ ID NO: 637423 - RNA, 64 nt, hsa; identical to SEQ ID NO: 95674

SEQ ID NO: 637424 - RNA, 64 nt, hsa; identical to SEQ ID NO: 95675

SEQ ID NO: 637425 - RNA, 64 nt, hsa; identical to SEQ ID NO: 95676

SEQ ID NO: 637426 - RNA, 64 nt, hsa; identical to SEQ ID NO: 95677

SEQ ID NO: 637427 - RNA, 64 nt, hsa; identical to SEQ ID NO: 95678

SEQ ID NO: 637428 - RNA, 64 nt, hsa; identical to SEQ ID NO: 95679

SEQ ID NO: 637429 - RNA, 64 nt, hsa; identical to SEQ ID NO: 95680

SEQ ID NO: 637430 - RNA, 64 nt, hsa; identical to SEQ ID NO: 95681

SEQ ID NO: 637431 - RNA, 64 nt, hsa; identical to SEQ ID NO: 95682

SEQ ID NO: 637432 - RNA, 64 nt, hsa; identical to SEQ ID NO: 95683

SEQ ID NO: 637433 - RNA, 64 nt, hsa; identical to SEQ ID NO: 95684

SEQ ID NO: 637434 - RNA, 64 nt, hsa; identical to SEQ ID NO: 95685

SEQ ID NO: 637435 - RNA, 64 nt, hsa; identical to SEQ ID NO: 95686

SEQ ID NO: 637436 - RNA, 64 nt, hsa; identical to SEQ ID NO: 95687

SEQ ID NO: 637437 - RNA, 64 nt, hsa; identical to SEQ ID NO: 95688

SEQ ID NO: 637438 - RNA, 64 nt, hsa
gacaguguagaagaauuccugagugaaaaguuggaacgcauauaaaucuugcuuaaauuuuguc

SEQ ID NO: 637439 - RNA, 64 nt, hsa
uuuuagagcuagguauagugaccgugaacuuucuaacgcauaauauucugugauacagccauuc

SEQ ID NO: 637440 - RNA, 64 nt, hsa
cuucaaauguuaagaaauaacagucugggcaaagaacgcauauucuauaggaagccagguuuac

SEQ ID NO: 637441 - RNA, 64 nt, hsa
ggaguugugggggaauaaugugcauuucagucucaacgcauagauaaauuuaggggaauuggau

SEQ ID NO: 637442 - RNA, 64 nt, hsa
uaaaugcccacaagggaaagcaggaaagaucaaaaacgcauacccuaacaucaccauuaaaagg

SEQ ID NO: 637443 - RNA, 64 nt, hsa
caaccaaaagccaaaaaccaaagcaagacuuacuaacgcauaucaaauaaauuaaagguacaaa

SEQ ID NO: 637444 - RNA, 64 nt, hsa
guugaguggcacaaccuuguaaaugugaaaguacaacgcauauuuaucucugaugugccauugg

SEQ ID NO: 637445 - RNA, 64 nt, hsa
cauaagcuaauaccacuguagggauuuuguuuugaacgcauauugacagcacgcuuuacuuagu

SEQ ID NO: 637446 - RNA, 64 nt, hsa
ucccauuauaacagugaacagagcuccagguaauaacgcauaggcaugucagguugcaucugua

SEQ ID NO: 637447 - RNA, 64 nt, hsa
cccagccugaugccaccuccucuguucuuggaacaacgcauaggaaaagaaucuccuuuggaag

SEQ ID NO: 637448 - RNA, 64 nt, hsa
uauaacuugggcuuuguagcuuuuauuuauucagaacgcauacggcauguuaaugacucugaug

SEQ ID NO: 637449 - RNA, 64 nt, hsa
caaaauauuuaccuucuacgauacaacuaauguuaacgcauaaaguaucuuacugguaacaaaa

SEQ ID NO: 637450 - RNA, 64 nt, hsa
gcugugcaggcaaaaccuagcaggaaaaaaaaacaacgcauaaagaaaaauggccgggccaggu

SEQ ID NO: 637451 - RNA, 64 nt, hsa; identical to SEQ ID NO: 201839

SEQ ID NO: 637452 - RNA, 64 nt, hsa; identical to SEQ ID NO: 201840

SEQ ID NO: 637453 - RNA, 64 nt, hsa; identical to SEQ ID NO: 201841

SEQ ID NO: 637454 - RNA, 64 nt, hsa; identical to SEQ ID NO: 201842

SEQ ID NO: 637455 - RNA, 64 nt, hsa; identical to SEQ ID NO: 201843

SEQ ID NO: 637456 - RNA, 64 nt, hsa; identical to SEQ ID NO: 201844

SEQ ID NO: 637457 - RNA, 64 nt, hsa; identical to SEQ ID NO: 201845

SEQ ID NO: 637458 - RNA, 64 nt, hsa; identical to SEQ ID NO: 201846

SEQ ID NO: 637459 - RNA, 64 nt, hsa
gagaaucucguuaguagcauguggccuaacaaaaggaaaaaauguuuuuaaacacacacacaca

SEQ ID NO: 637460 - RNA, 64 nt, hsa
gggaggagacaucuggccuuuuuagaaccugagaggaaaaaaagagucuuuuuuuccccucugu

SEQ ID NO: 637461 - RNA, 64 nt, hsa
agacgucaccaagaaaacaugcaacucaaacgacggaaaaaaaaagggaaugggaaaaaagaaa

SEQ ID NO: 637462 - RNA, 64 nt, hsa
augcaacucaaacgacggaaaaaaaaagggaaugggaaaaaagaaaacagauccugggaggggg

SEQ ID NO: 637463 - RNA, 64 nt, hsa
gaaagcuaucuaccuauccugagucuaucuuaaaggaaaaaaagaaaaaaaccuuaucucuugc

SEQ ID NO: 637464 - RNA, 64 nt, hsa
cacucuuucauuaauuuguuuuaagcuccguguuggaaaaaagggguagugcauuuuaaauuga

SEQ ID NO: 637465 - RNA, 64 nt, hsa
uacuaacuccaguuuuacuauuauuauuuugguuggaaaaaaaauucacucuuuacgugcuaau

SEQ ID NO: 637466 - RNA, 64 nt, hsa
uccucucguaucucaccccaaaccccaaacugggggaaaaaaaguuaacucuuugugaauggaa

SEQ ID NO: 637467 - RNA, 64 nt, hsa
uugcacuuucugguaaaaaguuaaaaauuuuuaaggaaaaaauaauuucaaugguuaaaguuuu

SEQ ID NO: 637468 - RNA, 64 nt, hsa
guuuacauuuaaagaucauuugcaccuuuuucaaggaaaaaaaguauugaguaaacaauuguuu

SEQ ID NO: 637469 - RNA, 64 nt, hsa
uugacaagcuuuauuaaguugagagagagagaggggaaaaaaaaaagccuuucguaguucagua

SEQ ID NO: 637470 - RNA, 64 nt, hsa
gaaaauacaaaauacccaagauuuaagaccggggggaaaaaaccacaaauugguaaauaaaggu

SEQ ID NO: 637471 - RNA, 64 nt, hsa
ccuaaguaaucccagaacaauggcuauucaugugggaaaaaaagaaauuuuacuuucucucacc

SEQ ID NO: 637472 - RNA, 64 nt, hsa
ccucacaauaagaaugaaucucagaaaauauuaaggaaaaaagcaaguuugaagagaccacaug

SEQ ID NO: 637473 - RNA, 64 nt, hsa
ccaucuacgccauauacccaucaccaucccaugaggaaaaaaaaaaaaguaaaacaaagacaaa

SEQ ID NO: 637474 - RNA, 64 nt, hsa
cugcacagcggcagcaaggauuaccccaagggcaggaaaaaagucuuuggaaauagauugaaaa

SEQ ID NO: 637475 - RNA, 64 nt, hsa
uuauugcuuucuuuuaugguagaccuguuaauggggaaaaaauacaucaaaucaaauagaaucu

SEQ ID NO: 637476 - RNA, 64 nt, hsa
cuguuuuuguacuuuacuaaucuuuaaacuaucaggaaaaaaaccaaaacuuuauaccaaugau

SEQ ID NO: 637477 - RNA, 64 nt, hsa
ccuuccccagccacagguauguggaauacggugaggaaaaaaaaaauuaaaaaaaaaaugcaag

SEQ ID NO: 637478 - RNA, 64 nt, hsa
uuucaaacaaugguuucucugcguuaauuauugaggaaaaaaaaagaugggguaagaaaacuac

SEQ ID NO: 637479 - RNA, 64 nt, hsa
acaaauauguaaagcaauuguaggaaauuugaaaggaaaaaaagaaaccgaagccaguauuuua

SEQ ID NO: 637480 - RNA, 64 nt, hsa
gaaucaugggcuugauugaauuaauuacucuuggggaaaaaagacaccuuguggcauuaagucu

SEQ ID NO: 637481 - RNA, 64 nt, hsa
guaggagauauagugacccagacuucaugcaaauggaaaaaaaguuuuaacugaaauauuuauu

SEQ ID NO: 637482 - RNA, 64 nt, hsa
aauugcaucacacuaauuacaaaauacaaguucuggaaaaaauauuuuucuucauuuuaaaacu

SEQ ID NO: 637483 - RNA, 64 nt, hsa
uguuuaacuggaguugucaaguaugagucccucaggaaaaaaaaaaaauucuguuuuaaaaagc

SEQ ID NO: 637484 - RNA, 64 nt, hsa
aaggauggagaaaaaucuaggacagugucuucucggaaaaaaccagccuugaagguaaugaaac

SEQ ID NO: 637485 - RNA, 64 nt, hsa
ugaugagaaggauucuuuuucgaauauaaccagaggaaaaaaggauggagaaauaucuaggaaa

SEQ ID NO: 637486 - RNA, 64 nt, hsa
uucugagaaaccaccaggcuugaagugucuucucggaaaaaaccauccuuggagguaaugaaac

SEQ ID NO: 637487 - RNA, 64 nt, hsa
agcuuguuuauauuucauacuuuuuauacuuugaggaaaaaaagucaaagaaaaauuguauuug

SEQ ID NO: 637488 - RNA, 64 nt, hsa
gaggaaaaaaagucaaagaaaaauuguauuugagggaaaaaaccaugaccaaguaaaggauaaa

SEQ ID NO: 637489 - RNA, 64 nt, hsa
cgacccgccgaccuucagcuuugugggacuaucaggaaaaaacaaaacaaaaacaaaauguaga

SEQ ID NO: 637490 - RNA, 64 nt, hsa
uauugagaauguuaacuuauugcuuuguaucuugggaaaaaaacuuuguaaauaaguuauaaag

SEQ ID NO: 637491 - RNA, 64 nt, hsa
uucauaugcaguaaaagaaagaaagaaaaaaaaaggaaaaaaaaaaaaaaaccaauguuuugca

SEQ ID NO: 637492 - RNA, 64 nt, hsa
ucuuaaaagguaucaauguaccuuuuuugguaguggaaaaaaaaaagacaggcugccacaguau

SEQ ID NO: 637493 - RNA, 64 nt, hsa
acuagcuugccuggagaugauguuucuugcuuuuggaaaaaaaaaaaaagucucugaaauuuga

SEQ ID NO: 637494 - RNA, 64 nt, hsa
gacauguugagaucauuguuguuucauuguuuaaggaaaaaaaaaaaugccuguaccuacaaug

SEQ ID NO: 637495 - RNA, 64 nt, hsa
uuuacugggacuuuuaaaucuagcuauagaguugggaaaaaauauuuccacuuagauauuuuac

SEQ ID NO: 637496 - RNA, 64 nt, hsa
aggcugggagagacuaggaaggcuugguaggaggggaaaaaagucaggaaaauauaucaaauca

SEQ ID NO: 637497 - RNA, 64 nt, hsa
auauaagcuauaacaucaaaucagggaaaaaugaggaaaaaaaauagauucugaaccauuuauu

SEQ ID NO: 637498 - RNA, 64 nt, hsa
gcuguggcuuuuagggcuugguucauaccaugggggaaaaaaaaguccuaggagaaagcgacgu

SEQ ID NO: 637499 - RNA, 64 nt, hsa
uuggugaucuaauccuaaauuuaaaagauuuguuggaaaaaauuuuuaggaaacucaccuuccu

SEQ ID NO: 637500 - RNA, 64 nt, hsa
uacuuuggcaacccuuuugaaaaguagcaauuauggaaaaaaaauauucaauaagagauuagga

SEQ ID NO: 637501 - RNA, 64 nt, hsa
cuauaauacagugggcuucuggauggauuuuauaggaaaaaauaaacaggucaaugaaugaaac

SEQ ID NO: 637502 - RNA, 64 nt, hsa
cccccuuugacugaucagugugauaaggacuuuaggaaaaaaagcauguauguuuuuuacuguu

SEQ ID NO: 637503 - RNA, 64 nt, hsa
uucguuaaucuugcugcuuaugugccaauuuaguggaaaaaaacaacccuugcugaaaaauucc

SEQ ID NO: 637504 - RNA, 64 nt, hsa
gcuaguuuauaaugucuuacuaaugcagaaacaaggaaaaaagcaaaauuggccugaauauucu

SEQ ID NO: 637505 - RNA, 64 nt, hsa
auuaguugauucacaguacagaacaagguauaaaggaaaaaacccugcuagguaguguuauaau

SEQ ID NO: 637506 - RNA, 64 nt, hsa
aucugaagauacaugucuuucuccagggacauguggaaaaaaaaaagauguuauacaaccauca

SEQ ID NO: 637507 - RNA, 64 nt, hsa
uaaaaggguaucccaaaaauaaaacuauccuuuuggaaaaaaaaagauuuaaaauaauuccugg

SEQ ID NO: 637508 - RNA, 64 nt, hsa
ggaaggcgagcuaagaggagacuuagauccagugggaaaaaaaauagcguuucacauaaaaagc

SEQ ID NO: 637509 - RNA, 64 nt, hsa
gaacacaccaaaaaagugaaagagaaauugaaagggaaaaaagacaaaaagcauaaggcuccaa

SEQ ID NO: 637510 - RNA, 64 nt, hsa
uuucugcaaaaaggaaaaagaaaccacaaauuggggaaaaaaaaagaagaaaaaccuguuuccg

SEQ ID NO: 637511 - RNA, 64 nt, hsa
gggaagagaggagagggagaaaaauaaaaugaaaggaaaaaaaaaaguuugcaaauucagacag

SEQ ID NO: 637512 - RNA, 64 nt, hsa
cagcuugacacccaccaagcaaaaguuucagccuggaaaaaaaaugggggggaaggguggauga

SEQ ID NO: 637513 - RNA, 64 nt, hsa
uguggggugccagaaagugucugcugauauuuguggaaaaaaaaucuauuuuguuuaccuacug

SEQ ID NO: 637514 - RNA, 64 nt, hsa
cauggagaaaacccgguacgcucaaaaagaaaaaggaaaaaaaaaaaucccaucacccacagca

SEQ ID NO: 637515 - RNA, 64 nt, hsa
uuggacauuuuaauuguuuaaaaauuguacaaaaggaaaaaauuagaauaaguacuggcgaacc

SEQ ID NO: 637516 - RNA, 64 nt, hsa
cuuuauauuaacgauacuaaaaaaaaauagcuuuggaaaaaaaacuacuguauguaacggaauu

SEQ ID NO: 637517 - RNA, 64 nt, hsa
ggcgggccaaccccgagaaugaagauuggaaaaaggaaaaaaaaaaaaacacgucaaaaguuag

SEQ ID NO: 637518 - RNA, 64 nt, hsa
gagcauagagaaacaaaaaucuuuuaugauguacggaaaaaaaccaugcugauacagcuggcua

SEQ ID NO: 637519 - RNA, 64 nt, hsa
aaagagccaaaauaaauauacuuuggcacuuuuuggaaaaaaaguuugcagacaccugcccuaa

SEQ ID NO: 637520 - RNA, 64 nt, hsa
agcugccucaugacaaguacauguuauuuaaggaggaaaaaauauuaaauuuugaauugagugu

SEQ ID NO: 637521 - RNA, 64 nt, hsa
uuaaaaguguggccacugagcauuugauuuuauaggaaaaaauaguauuuuugagaauaacaua

SEQ ID NO: 637522 - RNA, 64 nt, hsa
acuugccacuagauggcagugccuguauagauggggaaaaaauugccaccauucuugguauaau

SEQ ID NO: 637523 - RNA, 64 nt, hsa
agggaaacucagaguacuaggacguuuauuaaaaggaaaaaaaugucuugcaaugugcuguaau

SEQ ID NO: 637524 - RNA, 64 nt, hsa
cugaagaaacugccgcucugagacugcacauccaggaaaaaagacuaggacuugccacacacug

SEQ ID NO: 637525 - RNA, 64 nt, hsa
uggccuauuaucuggaugucccuugccuagagcaggaaaaaagucucagaauuaccuaaaaaca

SEQ ID NO: 637526 - RNA, 64 nt, hsa
acuucauaucacacaaaaugaauuuucuauaaagggaaaaaaguuugcuccuccauagauuuuu

SEQ ID NO: 637527 - RNA, 64 nt, hsa
auuucuuggagaauuuggaugccuaaggcauaaaggaaaaaaacagaguucauaguuugagcug

SEQ ID NO: 637528 - RNA, 64 nt, hsa
cuucaauuauuucccaucuccacaaauagucgggggaaaaaauuaaaauuuuccuuuaugauuc

SEQ ID NO: 637529 - RNA, 64 nt, hsa
cuuuuagucagaaaugauucaggguuauuugaggggaaaaaaccccauagugccuugauuuuaa

SEQ ID NO: 637530 - RNA, 64 nt, hsa
aaaaguacauugguaauuugggcacauucagaguggaaaaaauuuguucuauuuuuacaucuuu

SEQ ID NO: 637531 - RNA, 64 nt, hsa
aauaaaauaaaaauaacauauuggugaagaugcgggaaaaaaaaaagaacucuuagacacugcu

SEQ ID NO: 637532 - RNA, 64 nt, hsa
uuuauuugaagauggagcacugcugauuuaugaaggaaaaaagaagaauuuucuaaagauuaca

SEQ ID NO: 637533 - RNA, 64 nt, hsa
auucaggauuuaagucugagguagucaacccucaggaaaaaaaaaauggcuuaucugaaaucag

SEQ ID NO: 637534 - RNA, 64 nt, hsa
cuuaauuaugacaugagaaugaagaaauuauuuuggaaaaaaaaaaugaccuaauuuaccuauc

SEQ ID NO: 637535 - RNA, 64 nt, hsa
aggcuuauggcaugaucucuggaacaaauuuguaggaaaaaauuacuccaauugaaugacugau

SEQ ID NO: 637536 - RNA, 64 nt, hsa
aaauuaaccuccuaaaaggaauucauauuuuaaaggaaaaaaauacaacuaaugaugcacauuu

SEQ ID NO: 637537 - RNA, 64 nt, hsa
aucauaugguauugugauuuucuuuccccugcuaggaaaaaauugcacugaaaugcugacaaaa

SEQ ID NO: 637538 - RNA, 64 nt, hsa
gccaauaggugccuaguaaauguuaacuguucuuggaaaaaauaaaaacaucaguaacaaaaga

SEQ ID NO: 637539 - RNA, 64 nt, hsa
ucccaguauguuuuaacaaaaaaaaaaaaaagcaggaaaaaaggaauauuuagcaguauuguuc

SEQ ID NO: 637540 - RNA, 64 nt, hsa
aaaagaaauaaaaauauuuuuauuuucuauaaaaggaaaaaaguauaacaaaauguuuuauuuu

SEQ ID NO: 637541 - RNA, 64 nt, hsa
aggagaccagagaccgccuacuggagagaaaggaggaaaaaagaaauaaaaauauuuuuauuuu

SEQ ID NO: 637542 - RNA, 64 nt, hsa
agaauguaauauguaaacugugauuugguccucuggaaaaaaaaaaaugaaaugaagaguggga

SEQ ID NO: 637543 - RNA, 64 nt, hsa
uaugacacaaucucuuuauaauuuuacaaauaaaggaaaaaagaaccauguaagauaugugugc

SEQ ID NO: 637544 - RNA, 64 nt, hsa
auagcaccguuuguucugugagcuggaaacagaaggaaaaaacauacccuuggguacccauagc

SEQ ID NO: 637545 - RNA, 64 nt, hsa
gagauaaugaaaagugauaucuucgcauacgaaaggaaaaaagguugagguauauaugauuuuu

SEQ ID NO: 637546 - RNA, 64 nt, hsa
cauccuuaagauuuaaaaaaaaaaaaaaaaaaaaggaaaaaaaagugauggaagccguaagugc

SEQ ID NO: 637547 - RNA, 64 nt, hsa
uugucuauuuuuucucuucauguuguaacaaaaaggaaaaaagaaaaaaaaaucccaucccuuu

SEQ ID NO: 637548 - RNA, 64 nt, hsa
cgaaaaggacagacgaagaguuuaaagagaaaagggaaaaaagaaagaaaaaguaagcagggcu

SEQ ID NO: 637549 - RNA, 64 nt, hsa
guacaggggcagucaguggagggcgagugguuucggaaaaaaaaaaagaaaaaaagaaaaaaaa

SEQ ID NO: 637550 - RNA, 64 nt, hsa
cuuaaaauucaaggccacaaaaacaauguuugggggaaaaaaaagaaaaaaucaugccagcuaa

SEQ ID NO: 637551 - RNA, 64 nt, hsa
aaauaccuggcaaaacuaaauaaauuaccaaaaaggaaaaaaaauccaccaaaccaugauaaac

SEQ ID NO: 637552 - RNA, 64 nt, hsa
guguuuauuuauuguggauucccaucaggaaagaggaaaaaauacacauguucuuucauauagg

SEQ ID NO: 637553 - RNA, 64 nt, hsa
caggaagcauauaccggggaauguguagccuucaggaaaaaaaugccaauugacacaaagcauu

SEQ ID NO: 637554 - RNA, 64 nt, hsa
uuucacauuuugauuuauuagguacuagcacugaggaaaaaaaauucagcacuuggacuaucau

SEQ ID NO: 637555 - RNA, 64 nt, hsa
acaacacuacaagucuugaguuaagaaggaaagaggaaaaaagaaaaaacaccaauacccagau

SEQ ID NO: 637556 - RNA, 64 nt, hsa
aaugcuuucuuuuccagucgucuuugagaauaaaggaaaaaaaaaucuucagaugcaaugguuu

SEQ ID NO: 637557 - RNA, 64 nt, hsa
gacuuuuaugaaagccaaagacugcuugcuaguaggaaaaaauuucaaauaauaaccaaagcug

SEQ ID NO: 637558 - RNA, 64 nt, hsa
uacaccaucugcaaccauaugcuauuaauaaaauggaaaaaaacaaaauggucauuuugcauau

SEQ ID NO: 637559 - RNA, 64 nt, hsa
gauaaauaauaaaacuugucauaauuuugaacuuggaaaaaaguuucuuuugcucucauagaaa

SEQ ID NO: 637560 - RNA, 64 nt, hsa
cuugcucugauaugugaaguaauggacaagagugggaaaaaagagauccuuuucaaaaagauua

SEQ ID NO: 637561 - RNA, 64 nt, hsa
uaauaacaaaguugcuaggcaggaaaaaaaaucaggaaaaaagcuugucgcuauuugagaaucu

SEQ ID NO: 637562 - RNA, 64 nt, hsa
uagacagugaggauaauaacaaaguugcuaggcaggaaaaaaaaucaggaaaaaagcuugucgc

SEQ ID NO: 637563 - RNA, 64 nt, hsa
gucauugguauaugguggcuguuuaccaauaaaaggaaaaaauucauuaaccgguugcuuccaa

SEQ ID NO: 637564 - RNA, 64 nt, hsa
ucagaguuauccacuguauuuauaaggaagagucggaaaaaacaaugaccuuaguuuuuuuuaa

SEQ ID NO: 637565 - RNA, 64 nt, hsa
gcaaaaaaauguaagaggaaaaaaaguaaauuaaggaaaaaauccucacucauucccauguugu

SEQ ID NO: 637566 - RNA, 64 nt, hsa
uaucaauggagcaugugugcaaaaaaauguaagaggaaaaaaaguaaauuaaggaaaaaauccu

SEQ ID NO: 637567 - RNA, 63 nt, hsa
aaauauggaugaaaauuaauaaaguacugucaagggaaaaaauauguauaaccuuguaaguga

SEQ ID NO: 637568 - RNA, 64 nt, hsa
aaccugggcaacauggugaccucccgucucucucggaaaaaaaaaaagaaaaaagaaaaagccg

SEQ ID NO: 637569 - RNA, 64 nt, hsa
uuuucagccauuuuugccacauauacauuuuuaaggaaaaaagauuuuucucuguaagaaaguu

SEQ ID NO: 637570 - RNA, 64 nt, hsa
uuuacagcauauuuaagucuugugaaacuguauaggaaaaaaguaucuacguuuuuaguuuuuu

SEQ ID NO: 637571 - RNA, 64 nt, hsa
ccuaaaaccuuuuagugacaaaauccuaauauguggaaaaaagcauaugcauaaaggaauaaua

SEQ ID NO: 637572 - RNA, 64 nt, hsa
aaauuuuccuguuuuucccccuuugaaaaacucaggaaaaaaggaagauugaacuaauaaaauu

SEQ ID NO: 637573 - RNA, 64 nt, hsa
uuucacauuuuaauuuagcaaauugauuuaccuaggaaaaaauuaucaccuucaaagauaggca

SEQ ID NO: 637574 - RNA, 64 nt, hsa
acuucuauaaugcuuauuaugguaaaauaaaauuggaaaaaauuaaaacugaccuauaagagug

SEQ ID NO: 637575 - RNA, 64 nt, hsa
acaguggucuguaucucaacauuuucuuuuuaaaggaaaaaauauauauauauaguuucuuuuu

SEQ ID NO: 637576 - RNA, 64 nt, hsa
uuucucuuacuacguacucacagguuugcaaaugggaaaaaaguuuacauuucaguuuaggggc

SEQ ID NO: 637577 - RNA, 64 nt, hsa
uugcacuuaaaguugcauugccuacuguuauacuggaaaaaauagaguucaagaauaauaugac

SEQ ID NO: 637578 - RNA, 64 nt, hsa
aaaagugugauagcgauauuagugccaaucaaauggaaaaaagguaguuuuaauaaacaagaca

SEQ ID NO: 637579 - RNA, 64 nt, hsa
uguuuaaaaaagaucucaauuuauauaaaguacuggaaaaaagcuaaguaauuuuuaguucuau

SEQ ID NO: 637580 - RNA, 64 nt, hsa
uuuuuuuccccuauuuauucuuuguuuccuucugggaaaaaaccccacaaaaaucagcacuccu

SEQ ID NO: 637581 - RNA, 64 nt, hsa
uuaguuucuggggaaagaauaguaaccaugcaauggaaaaaaauggacaaccucuugacuaggu

SEQ ID NO: 637582 - RNA, 64 nt, hsa
gagaaaaaaauaaaauaaauucccaauuccauugggaaaaaauagaaauccaugaauccauacu

SEQ ID NO: 637583 - RNA, 64 nt, hsa
agugauauuucucuaguaguuaaaaaaaaaaaaaggaaaaaaagacucuuuuugguuguccuca

SEQ ID NO: 637584 - RNA, 64 nt, hsa
auuaaaagucacaauguucuuuauauacaauaauggaaaaaaaaaaaagaggaaaacccucaag

SEQ ID NO: 637585 - RNA, 64 nt, hsa
ggggauucuuuucuaagguaauauuaaugagaagggaaaaaaguaucuuuaacagcucuuuguu

SEQ ID NO: 637586 - RNA, 64 nt, hsa
aagaaggaaaugaaaauauuuuuaugccuacuuaggaaaaaaaggguagcacuuauucauucca

SEQ ID NO: 637587 - RNA, 64 nt, hsa
acuuauuucauuaaagaaguugggagaacaaauaggaaaaaaaaaacuuauuuuucuaguaaau

SEQ ID NO: 637588 - RNA, 64 nt, hsa
uacagaagaaaagcaaaugacuaguaaacaugugggaaaaaauauuacauuuuaagggggaaaa

SEQ ID NO: 637589 - RNA, 64 nt, hsa
uaaacaugugggaaaaaauauuacauuuuaagggggaaaaaaaaacccaccauucucuucuccc

SEQ ID NO: 637590 - RNA, 64 nt, hsa
cuggacaacauagggagaccccaucucuaccggaggaaaaaaaaaagagucaggccugguggug

SEQ ID NO: 637591 - RNA, 64 nt, hsa
cagagugagaccuugucucaaaaaaguaacauaaggaaaaaagaagccuugcuuuagcacaggu

SEQ ID NO: 637592 - RNA, 64 nt, hsa
gaaaaaaugaaaaaaaaaggaaaaaaagaaaaaaggaaaaaaacaguuugaacacaaaggcucu

SEQ ID NO: 637593 - RNA, 64 nt, hsa
ugaaaucuuaaaaaaagaaaaaaugaaaaaaaaaggaaaaaaagaaaaaaggaaaaaaacaguu

SEQ ID NO: 637594 - RNA, 64 nt, hsa
cucucucuagagcgagcaagagagggagagaggaggaaaaaauacacauaauacaaacauacau

SEQ ID NO: 637595 - RNA, 64 nt, hsa
cuuacguagacagaaauaauaaaaauauuaacuaggaaaaaacaguauagcaccaagccaguau

SEQ ID NO: 637596 - RNA, 64 nt, hsa
guuuuuaaaaauguagcacuugacuuuuugccaaggaaaaaaauaaaaauuauuccagugcaca

SEQ ID NO: 637597 - RNA, 64 nt, hsa
gucccccucuucucuggguguaagaagggaaauuggaaaaaaaauuauauauauauucuccuuu

SEQ ID NO: 637598 - RNA, 64 nt, hsa
cuuaaugauaccccaaaaugauuacacccagggaggaaaaaaaggagcgcuuucuagggucaga

SEQ ID NO: 637599 - RNA, 64 nt, hsa
cacauuagagacuaacuguaacuuaagugcugggggaaaaaaaaugugaacuaacuuauuuaau

SEQ ID NO: 637600 - RNA, 64 nt, hsa
auaaauuguugcaaauuuguuuuuaugaauaaaaggaaaaaaccugucgucuuuaaugccuacu

SEQ ID NO: 637601 - RNA, 64 nt, hsa
caaagagagguuauggagguacuguagcuuuuagggaaaaaaaaauguuaacacaucacagguc

SEQ ID NO: 637602 - RNA, 64 nt, hsa
uaauaagaugucagaauaacuaauaauuuuauuaggaaaaaaucauguuuuaaauuucaaaaug

SEQ ID NO: 637603 - RNA, 64 nt, hsa
ucuacaaaaauaaccuucaggaaaaagaaaaucaggaaaaaaauuuuuuuucaauaaucuuauu

SEQ ID NO: 637604 - RNA, 64 nt, hsa
aaaaguuguuugcuuaaaaaaaauuucaugugagggaaaaaaaaaaaaccuauuccagaauaag

SEQ ID NO: 637605 - RNA, 64 nt, hsa
aaacagaaaacaauuccacgaggccaaucuaaagggaaaaaauccuacacuacuuuuacuacuu

SEQ ID NO: 637606 - RNA, 64 nt, hsa
gcaacuucuucugguugauaccugagacuguuaaggaaaaaaauuuuaaaccccugauuuauau

SEQ ID NO: 637607 - RNA, 64 nt, hsa
auuauagauguaaaaugaaauuucauuuguaauuggaaaaaauccaauaaaaaggauauucauu

SEQ ID NO: 637608 - RNA, 64 nt, hsa
ucaguucucacaguauagaagagaacuuaaagagggaaaaaacaauaugaagauagggaaugca

SEQ ID NO: 637609 - RNA, 64 nt, hsa
uuuggaccauacacuauguuacaaaacuaaaaguggaaaaaacuuauuggugaaugaauauagg

SEQ ID NO: 637610 - RNA, 64 nt, hsa
gaguugcaggauaucuagcaauuuaagaaaauguggaaaaaauauuuuuauugagaaauagcau

SEQ ID NO: 637611 - RNA, 64 nt, hsa
ucuagccuggaagacagagugagaccccaucucaggaaaaaagaaaaaaaaaaagaugucauuc

SEQ ID NO: 637612 - RNA, 64 nt, hsa
cugugaggaaggaugggccuugcugaaguguggaggaaaaaauuaugaacgggccaaggccugc

SEQ ID NO: 637613 - RNA, 64 nt, hsa
uaagaucagccauauuucauuuugaaucugcaguggaaaaaaagcccacauuugagguggcuca

SEQ ID NO: 637614 - RNA, 64 nt, hsa
caaucuaauagucaccuaaaauaucuuuuuuguuggaaaaaaguuuauaauaaaaaaguuuguc

SEQ ID NO: 637615 - RNA, 64 nt, hsa
caaauguuuauuaaguagcuagaaauaauuauguggaaaaaaaugaauaauggaaaauagugag

SEQ ID NO: 637616 - RNA, 64 nt, hsa
uauuagaguauuucccuuccaaagagggauguuuggaaaaaacucugaaggagaggaggaauua

SEQ ID NO: 637617 - RNA, 64 nt, hsa
cuacagccuagggcagacaauaguauagaagucuggaaaaaaacaaaaacagaauuugagaacc

SEQ ID NO: 637618 - RNA, 64 nt, hsa
uccuucaauuccauauauccuuuucuucuauguaggaaaaaaauagucuaguguaguauucuuc

SEQ ID NO: 637619 - RNA, 64 nt, hsa
uuaggcuuucagcuuacacaaaucuauuuaauuaggaaaaaaacuauuaaggauguagcuuuuc

SEQ ID NO: 637620 - RNA, 64 nt, hsa
acauggagcaaaagagacagggagagguggagaaggaaaaaacccuacaaaacaaaaacaaacc

SEQ ID NO: 637621 - RNA, 64 nt, hsa
agggugcccacaaaaagaaucaggacuuguacugggaaaaaaaccccuaaauuaauuauauuuc

SEQ ID NO: 637622 - RNA, 64 nt, hsa
cucagcaaggcauguuacuacuuuuaucaucuaaggaaaaaagacaagggaauuccagucaggc

SEQ ID NO: 637623 - RNA, 64 nt, hsa
uuccguuucaagaccuuuuucuuuuauugcaaggggaaaaaaaugucaucuccccccaccucau

SEQ ID NO: 637624 - RNA, 64 nt, hsa
uuuuuuaauuaaugcacuuuaaauaagguagaauggaaaaaacccagagagcaaagugcauuac

SEQ ID NO: 637625 - RNA, 64 nt, hsa
cacuggaugagcggugagacgaacaaaagggaaaggaaaaaaugggggugggggguggggggug

SEQ ID NO: 637626 - RNA, 64 nt, hsa
aaaucugaacaauccuacagggaaaucagaauuaggaaaaaaaucuggagaacaauaugguuga

SEQ ID NO: 637627 - RNA, 64 nt, hsa
uggagugauacauugugggaacccucagaagauaggaaaaaagcauggaauagauucucccuca

SEQ ID NO: 637628 - RNA, 64 nt, hsa
uccugaccccagauucaacuuugcaaacaacaggggaaaaaaauggggaaaagaaaaaccacga

SEQ ID NO: 637629 - RNA, 64 nt, hsa
gaaaaaaauggggaaaagaaaaaccacgagagagggaaaaaaaauuauucugcaccuguaaaaa

SEQ ID NO: 637630 - RNA, 64 nt, hsa
aguaaguucuucaaacacccauuuuugcucuaugggaaaaaaacgauuuaccaauuaauauuac

SEQ ID NO: 637631 - RNA, 64 nt, hsa
aagguauugcacuacauuauggaaucaugcaaaaggaaaaaaaguuucaugauaucuguuguug

SEQ ID NO: 637632 - RNA, 64 nt, hsa
aaggaaauaucaucguauuucuuuuuuuuaauaaggaaaaaauaauauccauacagucaagaua

SEQ ID NO: 637633 - RNA, 64 nt, hsa
uuguuuugacuugaauaaaguacuacaucaguguggaaaaaaauucugauacauuagcagcuau

SEQ ID NO: 637634 - RNA, 64 nt, hsa
uuuuuuaugcaagggcaaaaaucuuuguaucuggggaaaaaaaacuuuuuuuuaaauuaaaaag

SEQ ID NO: 637635 - RNA, 64 nt, hsa
caaggcagggaagaaggauguguguguccaggaaggaaaaaaagguggaucagugauuuuacuu

SEQ ID NO: 637636 - RNA, 64 nt, hsa
auacccucaguuaagcauguuaacauuuauaggaggaaaaaaaucacuuugggagaaaauaaaa

SEQ ID NO: 637637 - RNA, 64 nt, hsa
uuugcuccaaauucuuauuuuacuuaaccagaagggaaaaaaaguuguauuuuccugaagcuac

SEQ ID NO: 637638 - RNA, 64 nt, hsa
auuuaaggaaaaaaugggauuuuguuuuagaguuggaaaaaaagccugauuaaagaguuucugc

SEQ ID NO: 637639 - RNA, 64 nt, hsa
gcaaaguucucuguuccugaggaacuaaauuuaaggaaaaaaugggauuuuguuuuagaguugg

SEQ ID NO: 637640 - RNA, 64 nt, hsa
aaacuguuguuugguuaaaggacacagauuugaaggaaaaaaauuuugauguaacaauuuuuua

SEQ ID NO: 637641 - RNA, 64 nt, hsa
gaauuaaaaauuuucuaaauauuaauacuaacugggaaaaaaaaacuagugugaaguuuacagu

SEQ ID NO: 637642 - RNA, 64 nt, hsa
uuaaacaaacaaaaaaaaauuuuaaacaaagaaaggaaaaaaauugacaauaaaagucacucuu

SEQ ID NO: 637643 - RNA, 64 nt, hsa
gaagauucuuucuucugaaagccaagcaccacaaggaaaaaaaaaauuauuaauagcucagguu

SEQ ID NO: 637644 - RNA, 64 nt, hsa
uaagcuuacuugaacuaauuacuugaaaacugguggaaaaaagagaccaacuuuguuauuuuuu

SEQ ID NO: 637645 - RNA, 64 nt, hsa
uagcaugugccucacuuuaagaaaguccuguaggggaaaaaaaaaacugucagagcgaauucau

SEQ ID NO: 637646 - RNA, 64 nt, hsa
ugcaaaguuaagaucgaauccauccgcuuguaggggaaaaaaaggaaaaaaauuaaccagagag

SEQ ID NO: 637647 - RNA, 64 nt, hsa
aagaucgaauccauccgcuuguaggggaaaaaaaggaaaaaaauuaaccagagagggucuguaa

SEQ ID NO: 637648 - RNA, 64 nt, hsa
auuaauguaguugaacuuuuuaaauuuuugaauuggaaaaaaauucuaaugaaacccugauauc

SEQ ID NO: 637649 - RNA, 64 nt, hsa
ccaagguuaaucaggaaaaauagcuuuugacaggggaaaaaacucaauaacuagcuauuuuuga

SEQ ID NO: 637650 - RNA, 64 nt, hsa
augcuacuugugaggcagaagaguuuucugugaaggaaaaaagcccauuagaguucuucaauuc

SEQ ID NO: 637651 - RNA, 64 nt, hsa
uuuauauuuuaagacuuuaaguagaauaaacccuggaaaaaagaucaagaguaaaaauauauag

SEQ ID NO: 637652 - RNA, 64 nt, hsa
gccaugauugauuagcaaugucugcacuggauacggaaaaaagaaggugcuugcagguuuacag

SEQ ID NO: 637653 - RNA, 64 nt, hsa
caaugcaguuagguggcucuuuccaagacucuggggaaaaaaguaguaaaaagcuaaaugcaau

SEQ ID NO: 637654 - RNA, 64 nt, hsa
aauguauuaacucauacugccugucuuuuauaggggaaaaaaauaaccuuuuuuauuuuaaagu

SEQ ID NO: 637655 - RNA, 64 nt, hsa
gucaccagcagguuccaaauugauguguaugauaggaaaaaaaccuuaauuuuaaauauaauau

SEQ ID NO: 637656 - RNA, 64 nt, hsa
uuaccagcacgcugucucagaaaacgaaaacggaggaaaaaaaccccaaaccccaaacaaucuu

SEQ ID NO: 637657 - RNA, 64 nt, hsa
gacguggaacuacacacgaaguguaauuagugggggaaaaaauauuuuuuaaacaaaggauaua

SEQ ID NO: 637658 - RNA, 64 nt, hsa
cggcuaaaugaaauaaaguggaaaaaaaaaaaaaggaaaaaaccaaaagcauaaaaaaccacag

SEQ ID NO: 637659 - RNA, 64 nt, hsa
gcucuagccacugagcggcuaaaugaaauaaaguggaaaaaaaaaaaaaggaaaaaaccaaaag

SEQ ID NO: 637660 - RNA, 64 nt, hsa
auagcagagcaaaauauggauaaugaaaguguugggaaaaaagugaugugacagggagugaaga

SEQ ID NO: 637661 - RNA, 64 nt, hsa
ccgagcguuuuuauguaugcuguuccugcaguuaggaaaaaaaaauccaagaaauguauugaau

SEQ ID NO: 637662 - RNA, 64 nt, hsa
augaaccuuaaaaaaaaaaaaaaagguuuugaagggaaaaaaagugguuucacaccucuuguua

SEQ ID NO: 637663 - RNA, 64 nt, hsa
aagaccaaaaaaugagguuuugcuuuuguaaucaggaaaaaaaaaaauuaaugaaccuuaaaaa

SEQ ID NO: 637664 - RNA, 64 nt, hsa
auuauuugaagaaagaaaaaacagauuuuaggguggaaaaaacagucaacucacacaaagaaug

SEQ ID NO: 637665 - RNA, 64 nt, hsa
aggguggaaaaaacagucaacucacacaaagaauggaaaaaaauacugaguuaaauuaagcaaa

SEQ ID NO: 637666 - RNA, 64 nt, hsa
guguuaauucuaauuaucuauuucaaauuuagcaggaaaaaagagaacaucaccuuguaaaacu

SEQ ID NO: 637667 - RNA, 64 nt, hsa
uuagguuuaauaaauagccuuaacuauuuggaggggaaaaaaugggucaacuuuuuuuuuuuuu

SEQ ID NO: 637668 - RNA, 64 nt, hsa
aguuggauuaaaggguuguaacugacuacagcauggaaaaaaauaguucuuuuaauucuuucac

SEQ ID NO: 637669 - RNA, 64 nt, hsa
acuagaugcaccaaccguaucauuauuuguuugaggaaaaaaagaaaucugcauuuuaauucau

SEQ ID NO: 637670 - RNA, 64 nt, hsa
aguuuguaaaauuauuuugguuuucuucuacaaaggaaaaaauuggauuuauauauauaagguu

SEQ ID NO: 637671 - RNA, 64 nt, hsa
aauguauuuuaaacacauaucguuucuuuuucuuggaaaaaaaguugauuaggaccacagauuu

SEQ ID NO: 637672 - RNA, 64 nt, hsa
uuucaccuaucuggaaaaaaaaaaauaugagauuggaaaaaauuagacaagucuaguggaacca

SEQ ID NO: 637673 - RNA, 64 nt, hsa
guggaaggcacacugagcaaguuuucaccuaucuggaaaaaaaaaaauaugagauuggaaaaaa

SEQ ID NO: 637674 - RNA, 64 nt, hsa
aacggcagugucauuccccuuugcacuguaaugaggaaaaaaugguauaaaagguugccaaauu

SEQ ID NO: 637675 - RNA, 64 nt, hsa
uacuaugguaacacuuugcuuucugaauuggaagggaaaaaaaauguagcgacagcauuuuaag

SEQ ID NO: 637676 - RNA, 64 nt, hsa
cacugcugcugccucugaaacagaaaguuggaaaggaaaaaagaaaaaagcaauuagguagcac

SEQ ID NO: 637677 - RNA, 64 nt, hsa
uuacuaaaaaaaguguguauuaggaggagagagaggaaaaaaagaggaaagaaggaaaaaaaaa

SEQ ID NO: 637678 - RNA, 64 nt, hsa
uuaggaggagagagaggaaaaaaagaggaaagaaggaaaaaaaaaagaauuaaaaaaaaaaaaa

SEQ ID NO: 637679 - RNA, 64 nt, hsa
aaaaaaaaaaagaaaaacagaagaugaccuugauggaaaaaaaauauuuuuuaaaaaaaagaua

SEQ ID NO: 637680 - RNA, 64 nt, hsa
auuaauaccagaccaaagacauuuucuguuuccuggaaaaaaaaaaugaaucauguuaggcuuu

SEQ ID NO: 637681 - RNA, 64 nt, hsa
uaauuaguaggcuccugcugccaaaaugcaaaggggaaaaaaaggcagggauugggggggaugg

SEQ ID NO: 637682 - RNA, 64 nt, hsa
auagaucacauacguuaucaaaaacuacucccuuggaaaaaauaucuuucgaaaaucaaauuua

SEQ ID NO: 637683 - RNA, 64 nt, hsa
agagucaagguugcgaguacaggccaagaccaugggaaaaaaagccaugcucacuggccaauaa

SEQ ID NO: 637684 - RNA, 64 nt, hsa
augggaaagcaaagcagaaaacagugccccaaauggaaaaaagauacucacacagaacaaaaca

SEQ ID NO: 637685 - RNA, 64 nt, hsa
aucacuuuguucugguauugacgcaauuauauuaggaaaaaaguugguugacuguuuuuguuua

SEQ ID NO: 637686 - RNA, 64 nt, hsa
uuuuggguauacuugugguuaguuuugugccauaggaaaaaauuaucuuaaaacuuuggccaua

SEQ ID NO: 637687 - RNA, 64 nt, hsa
uaaaguauuccagcaaaagaggauguagccucugggaaaaaacaaacauguuacaguguuuuuu

SEQ ID NO: 637688 - RNA, 64 nt, hsa
acagcagcacuguauauaccugucucuaaguaaaggaaaaaacaaaauaaggacuucaauccaa

SEQ ID NO: 637689 - RNA, 64 nt, hsa
auaauugaaguucagagucacccguggcuccuaaggaaaaaacagcaucaugaaaggcaaaaag

SEQ ID NO: 637690 - RNA, 64 nt, hsa
guaaugcauaaugcuuucucaccaacagaaaaaaggaaaaaaauuguuuucaguuaaacacuac

SEQ ID NO: 637691 - RNA, 64 nt, hsa
cugcuugcugccuuuaauugucuugcucucuaugggaaaaaaacaaaagggcuucagucucaug

SEQ ID NO: 637692 - RNA, 64 nt, hsa
uuaccucauuucaagaaaauaugcuuaacagagaggaaaaaaaugugguuuggccuugcugcug

SEQ ID NO: 637693 - RNA, 64 nt, hsa
uagcuuguugaaauguuuugcaucugucaauuaaggaaaaaaaaaaucacucuauguugcccca

SEQ ID NO: 637694 - RNA, 64 nt, hsa
gauaaacuagcucauuauuuccaucuuuggaaaaggaaaaaaaaaaaaacuucuuuaggcauuu

SEQ ID NO: 637695 - RNA, 64 nt, hsa
auuagggagaaaacuagucuaaauuauuucaacuggaaaaaagaaaaaagaguccucuucuuuu

SEQ ID NO: 637696 - RNA, 64 nt, hsa
ucuauggaagucgugucuuacuccaggugaagggggaaaaaaaaagccuauacuuuggcagguu

SEQ ID NO: 637697 - RNA, 64 nt, hsa
uaauguuuccauguucccaacuauguugagaaguggaaaaaaacccagguucuagaugggugaa

SEQ ID NO: 637698 - RNA, 64 nt, hsa
aauaggcgggaucgcuuuguuggucaaagugaggggaaaaaagcacgaccuacugcacgaaggg

SEQ ID NO: 637699 - RNA, 64 nt, hsa
gcaacucuaaaaaaaaaaaaaauacaaauaaaaaggaaaaaaaauuacauuuuuuaucuuauac

SEQ ID NO: 637700 - RNA, 64 nt, hsa
ggcaguauucagcuucuuaaccagucgcuauuuaggaaaaaaaacccacuaguuaggccaucaa

SEQ ID NO: 637701 - RNA, 64 nt, hsa
auugauaucacugcugacuuuuauauuaugggagggaaaaaauaacauuaauaaaaaggugaua

SEQ ID NO: 637702 - RNA, 64 nt, hsa
uacccccccacuaugcccucauuuuuuuaaaaaaggaaaaaaaaaagaaacuggguuccagucu

SEQ ID NO: 637703 - RNA, 64 nt, hsa
uaaaaaaauaaauaaaaauaaaaaaaauaaaaaaggaaaaaaaaaaaagaagaaacaagacaug

SEQ ID NO: 637704 - RNA, 64 nt, hsa
ugccgucuucacagacaaacuugaaagguauuaaggaaaaaauuccacauagcucugggccuuu

SEQ ID NO: 637705 - RNA, 64 nt, hsa
cacuacaguagaagaacuuacuucugaaaugaagggaaaaaaaccaccccaucguucccuacuc

SEQ ID NO: 637706 - RNA, 64 nt, hsa
acuccauuccaccugacccuguguguacaauccaggaaaaaaacaaaccccacucagaaacaga

SEQ ID NO: 637707 - RNA, 64 nt, hsa
gcacacaauggguuuggagcugacugggaacaauggaaaaaauuacauuagcugugguuguaaa

SEQ ID NO: 637708 - RNA, 64 nt, hsa
aauuucauagccuguaucuaucauuuagaugcauggaaaaaaaugggcuuugcacacaaugggu

SEQ ID NO: 637709 - RNA, 64 nt, hsa
uagcuuguauuauaguuauuaagcuuguuuuuguggaaaaaaacuuacuaaaaccuagguaacu

SEQ ID NO: 637710 - RNA, 64 nt, hsa
guaaaaaggaaucuugccagauguagcuacuuaaggaaaaaaggguuuuuaauagaaaugaacu

SEQ ID NO: 637711 - RNA, 64 nt, hsa
augcagucauguggaaccuugcuuucuaguccugggaaaaaaagaugucucuaauuacuggcuu

SEQ ID NO: 637712 - RNA, 64 nt, hsa
augaauuuaauguauaaaauguugucaaaccaagggaaaaaaccacaguucaccauguggaguu

SEQ ID NO: 637713 - RNA, 64 nt, hsa
gucaacggccacuguguguggcugcucugagugaggaaaaaauuaaaaagaaaaacugguucca

SEQ ID NO: 637714 - RNA, 64 nt, hsa
aaaggcucagcuggggaugguguuugacuucggaggaaaaaaguugcuauugcccguuaaaggc

SEQ ID NO: 637715 - RNA, 64 nt, hsa
cuccuguuugcaauugcuucccucaucucaguagggaaaaaauugagugggaguacugagaugu

SEQ ID NO: 637716 - RNA, 64 nt, hsa
cauacagagguugaauugaguauauauuugaaaaggaaaaaacaaaaaacaaacccagacccca

SEQ ID NO: 637717 - RNA, 64 nt, hsa
aguuaaaaaaaaagacauauaagguugauuaaagggaaaaaaggcuccaguuuguuuuacaggu

SEQ ID NO: 637718 - RNA, 64 nt, hsa
aaaauaacaaaagaggaaaaaaaaaaucccuccuggaaaaaaaaaaaaacccuggaaaauagaa

SEQ ID NO: 637719 - RNA, 64 nt, hsa
aggcgagcaagccuuuuugaaaaauaacaaaagaggaaaaaaaaaaucccuccuggaaaaaaaa

SEQ ID NO: 637720 - RNA, 64 nt, hsa
auccuaggcaacagagugauacgcuguuuaaaaaggaaaaaauccuucccuagagcuaguaucc

SEQ ID NO: 637721 - RNA, 64 nt, hsa
cugggugacagagugagacuccaucucaacagaaggaaaaaaaaggaaaauaggagaaggugga

SEQ ID NO: 637722 - RNA, 64 nt, hsa
gcuuuugcaaaaaucuuuauugguguugaaaacuggaaaaaauaacucauccagaauucauauu

SEQ ID NO: 637723 - RNA, 64 nt, hsa
agcagaacaaaucgucaggugccuggagcaaaaaggaaaaaaaaaaaagaaaggacauugaguu

SEQ ID NO: 637724 - RNA, 64 nt, hsa
uugaaacugugaguuguuuuuuuuuuaacaacugggaaaaaacaaaaacaaaaaacuauaguua

SEQ ID NO: 637725 - RNA, 64 nt, hsa
caaaugauaaauugaccccuuuuuauaaauggagggaaaaaaugaacagauuucagagauuaaa

SEQ ID NO: 637726 - RNA, 64 nt, hsa
uauuauaugccaaaaagauccuacauuuugguagggaaaaaacaacacuguguuugacguauuu

SEQ ID NO: 637727 - RNA, 64 nt, hsa
uauacaguauaaacuaccucacuugccuuucuugggaaaaaaaaaaugaauggacuuuaacaau

SEQ ID NO: 637728 - RNA, 64 nt, hsa
cagauuuguagugcauagguguguguuucaagaaggaaaaaaaaagacuucuguucaaaguuaa

SEQ ID NO: 637729 - RNA, 64 nt, hsa
uuauuauacacuguacauuuuuuucacagcaauuggaaaaaaacaaccacuugcaaucauucaa

SEQ ID NO: 637730 - RNA, 64 nt, hsa
guugaucauuaccuguaaaugaaagaccuuaauaggaaaaaaagaguaaagcucagugugaaug

SEQ ID NO: 637731 - RNA, 64 nt, hsa
uaucauaaaauuuucauauaugccuagauaauggggaaaaaaagucuugugauugacuuucgca

SEQ ID NO: 637732 - RNA, 64 nt, hsa
ugaauguaacugugcacaggaaaugacugguaauggaaaaaauguuguaauaaaauaaucuaau

SEQ ID NO: 637733 - RNA, 64 nt, hsa
cuccuucuccuccuccuccuccucuucccuugggggaaaaaaaaaaaugugcuaauaaaacuuc

SEQ ID NO: 637734 - RNA, 64 nt, hsa
acacaucacacaguguccuguagcuaagugucuaggaaaaaacaaaaacuccaaacccuucagu

SEQ ID NO: 637735 - RNA, 64 nt, hsa
agccuauaacuuuucagcuggugcuuuuacuuagggaaaaaaacaauuuguaaauacagaacau

SEQ ID NO: 637736 - RNA, 64 nt, hsa
aauuuauaaauuaaacuuuagauauguauguacaggaaaaaauguaguauauaguaucguauau

SEQ ID NO: 637737 - RNA, 64 nt, hsa
aaaaauguaguauauaguaucguauauauguacaggaaaaaaacguacuaucugugguuucagg

SEQ ID NO: 637738 - RNA, 64 nt, hsa
agaaaacacacagaagagauuuaaaaaaaaaaaaggaaaaaaaaaaaagacauaaacuggcacc

SEQ ID NO: 637739 - RNA, 64 nt, hsa
aucaaaaaagcgacaaaaaaacacaaacagaagaggaaaaaaaagcaacaaaaaaagaaaacac

SEQ ID NO: 637740 - RNA, 64 nt, hsa
uuugggcagcguggugggggauaaauaaauaaaaggaaaaaaaacuuagccuagaauuagaauu

SEQ ID NO: 637741 - RNA, 64 nt, hsa
agccaagaauaagcagcagaacccuguuccauauggaaaaaagaaaaacaauuuuuugucccua

SEQ ID NO: 637742 - RNA, 64 nt, hsa
guuaguauuuaaaaauagagaaauugcacuuccuggaaaaaauuaaaaaguaguuaguuuaauu

SEQ ID NO: 637743 - RNA, 64 nt, hsa
ucaacuagaccccacaccagggcacccuaagaggggaaaaaagugaauucaaagcaaaaauaac

SEQ ID NO: 637744 - RNA, 64 nt, hsa
aaagaauucccuguaucaucuggaucucaacaucggaaaaaagaagcggauaguguuuauggag

SEQ ID NO: 637745 - RNA, 64 nt, hsa
gagaaaaaugggcuggagagaaggagaaggauuaggaaaaaacaaagaaggcaauaaggaaccc

SEQ ID NO: 637746 - RNA, 64 nt, hsa
cauguauuuauucaagugcauuaaagucuacaauggaaaaaaagcagugaagcauuagaugcug

SEQ ID NO: 637747 - RNA, 64 nt, hsa
ccaucucagucuuuauuuguguaauucauuuugaggaaaaaacaacuccauguauuuauucaag

SEQ ID NO: 637748 - RNA, 64 nt, hsa
uuauuuguguuauucuggauguauaaaaaucaauggaaaaaaauaaacuuucaaauugaaauga

SEQ ID NO: 637749 - RNA, 64 nt, hsa
aaggacuuuuucuuagguuugcuaaauacuguagggaaaaaaaugcuucuuucuacuuuguuua

SEQ ID NO: 637750 - RNA, 64 nt, hsa
ugucugaccugcaaaaaugcuggagaaaaaugaaggaaaaaauuauguuuuucaguuuaauucu

SEQ ID NO: 637751 - RNA, 64 nt, hsa
gugaggaaaaaacauucagacaaauguucagugaggaaaaaaaggggaaguuggggauaggcag

SEQ ID NO: 637752 - RNA, 64 nt, hsa
uguucagugugagugaggaaaacauguucagugaggaaaaaacauucagacaaauguucaguga

SEQ ID NO: 637753 - RNA, 64 nt, hsa
cugcagauaaguggccuugacacauuacaagccuggaaaaaaacaucagaaauaauaaaaaauu

SEQ ID NO: 637754 - RNA, 64 nt, hsa
uaaaguaguaaaagaagaaauaguucugugacuaggaaaaaauugcuuuugagagaacauagau

SEQ ID NO: 637755 - RNA, 64 nt, hsa
uucaacuuuuuaguuuuguuccuucaaaguugaaggaaaaaaaguuugguuuuauaaaauucau

SEQ ID NO: 637756 - RNA, 64 nt, hsa
uuuuuguauaaaaauuuaaauugaauuaaaagaaggaaaaaaaaagcccaaacuuaaccucuga

SEQ ID NO: 637757 - RNA, 64 nt, hsa
aagggagcucaaagucacaagaagaaaaaugaaaggaaaaaacagcagcccuauucagaaauug

SEQ ID NO: 637758 - RNA, 64 nt, hsa
caggagucaucaauucauccauaaauauaaaaagggaaaaaaacuuaaggcaguagucugcauu

SEQ ID NO: 637759 - RNA, 64 nt, hsa; identical to SEQ ID NO: 38325

SEQ ID NO: 637760 - RNA, 64 nt, hsa; identical to SEQ ID NO: 38326

SEQ ID NO: 637761 - RNA, 64 nt, hsa; identical to SEQ ID NO: 38327

SEQ ID NO: 637762 - RNA, 64 nt, hsa; identical to SEQ ID NO: 38328

SEQ ID NO: 637763 - RNA, 64 nt, hsa; identical to SEQ ID NO: 38329

SEQ ID NO: 637764 - RNA, 64 nt, hsa; identical to SEQ ID NO: 38330

SEQ ID NO: 637765 - RNA, 64 nt, hsa; identical to SEQ ID NO: 38331

SEQ ID NO: 637766 - RNA, 64 nt, hsa; identical to SEQ ID NO: 38332

SEQ ID NO: 637767 - RNA, 64 nt, hsa; identical to SEQ ID NO: 38333

SEQ ID NO: 637768 - RNA, 64 nt, hsa; identical to SEQ ID NO: 38334

SEQ ID NO: 637769 - RNA, 64 nt, hsa; identical to SEQ ID NO: 38335

SEQ ID NO: 637770 - RNA, 64 nt, hsa; identical to SEQ ID NO: 38336

SEQ ID NO: 637771 - RNA, 64 nt, hsa; identical to SEQ ID NO: 38337

SEQ ID NO: 637772 - RNA, 64 nt, hsa; identical to SEQ ID NO: 38338

SEQ ID NO: 637773 - RNA, 64 nt, hsa; identical to SEQ ID NO: 38339

SEQ ID NO: 637774 - RNA, 64 nt, hsa; identical to SEQ ID NO: 38340

SEQ ID NO: 637775 - RNA, 64 nt, hsa; identical to SEQ ID NO: 38341

SEQ ID NO: 637776 - RNA, 64 nt, hsa; identical to SEQ ID NO: 38342

SEQ ID NO: 637777 - RNA, 64 nt, hsa; identical to SEQ ID NO: 38343

SEQ ID NO: 637778 - RNA, 64 nt, hsa; identical to SEQ ID NO: 38344

SEQ ID NO: 637779 - RNA, 64 nt, hsa; identical to SEQ ID NO: 38345

SEQ ID NO: 637780 - RNA, 64 nt, hsa; identical to SEQ ID NO: 38346

SEQ ID NO: 637781 - RNA, 64 nt, hsa; identical to SEQ ID NO: 38347

SEQ ID NO: 637782 - RNA, 64 nt, hsa; identical to SEQ ID NO: 38348

SEQ ID NO: 637783 - RNA, 64 nt, hsa; identical to SEQ ID NO: 38349

SEQ ID NO: 637784 - RNA, 64 nt, hsa; identical to SEQ ID NO: 38350

SEQ ID NO: 637785 - RNA, 64 nt, hsa; identical to SEQ ID NO: 38351

SEQ ID NO: 637786 - RNA, 64 nt, hsa; identical to SEQ ID NO: 38352

SEQ ID NO: 637787 - RNA, 64 nt, hsa; identical to SEQ ID NO: 38353

SEQ ID NO: 637788 - RNA, 64 nt, hsa; identical to SEQ ID NO: 38354

SEQ ID NO: 637789 - RNA, 64 nt, hsa; identical to SEQ ID NO: 38355

SEQ ID NO: 637790 - RNA, 64 nt, hsa; identical to SEQ ID NO: 38356

SEQ ID NO: 637791 - RNA, 64 nt, hsa; identical to SEQ ID NO: 38357

SEQ ID NO: 637792 - RNA, 64 nt, hsa; identical to SEQ ID NO: 38358

SEQ ID NO: 637793 - RNA, 64 nt, hsa; identical to SEQ ID NO: 38359

SEQ ID NO: 637794 - RNA, 64 nt, hsa; identical to SEQ ID NO: 38360

SEQ ID NO: 637795 - RNA, 64 nt, hsa; identical to SEQ ID NO: 38361

SEQ ID NO: 637796 - RNA, 64 nt, hsa; identical to SEQ ID NO: 38362

SEQ ID NO: 637797 - RNA, 64 nt, hsa; identical to SEQ ID NO: 38363

SEQ ID NO: 637798 - RNA, 64 nt, hsa; identical to SEQ ID NO: 38364

SEQ ID NO: 637799 - RNA, 64 nt, hsa; identical to SEQ ID NO: 38365

SEQ ID NO: 637800 - RNA, 64 nt, hsa; identical to SEQ ID NO: 38366

SEQ ID NO: 637801 - RNA, 64 nt, hsa; identical to SEQ ID NO: 38367

SEQ ID NO: 637802 - RNA, 64 nt, hsa; identical to SEQ ID NO: 38368

SEQ ID NO: 637803 - RNA, 64 nt, hsa; identical to SEQ ID NO: 38369

SEQ ID NO: 637804 - RNA, 64 nt, hsa; identical to SEQ ID NO: 38370

SEQ ID NO: 637805 - RNA, 64 nt, hsa; identical to SEQ ID NO: 38371

SEQ ID NO: 637806 - RNA, 64 nt, hsa; identical to SEQ ID NO: 38372

SEQ ID NO: 637807 - RNA, 64 nt, hsa; identical to SEQ ID NO: 38373

SEQ ID NO: 637808 - RNA, 64 nt, hsa; identical to SEQ ID NO: 38374

SEQ ID NO: 637809 - RNA, 64 nt, hsa; identical to SEQ ID NO: 38375

SEQ ID NO: 637810 - RNA, 64 nt, hsa; identical to SEQ ID NO: 38376

SEQ ID NO: 637811 - RNA, 64 nt, hsa; identical to SEQ ID NO: 38377

SEQ ID NO: 637812 - RNA, 64 nt, hsa; identical to SEQ ID NO: 38378

SEQ ID NO: 637813 - RNA, 64 nt, hsa; identical to SEQ ID NO: 38379

SEQ ID NO: 637814 - RNA, 64 nt, hsa; identical to SEQ ID NO: 38380

SEQ ID NO: 637815 - RNA, 64 nt, hsa; identical to SEQ ID NO: 38381

SEQ ID NO: 637816 - RNA, 64 nt, hsa; identical to SEQ ID NO: 38382

SEQ ID NO: 637817 - RNA, 64 nt, hsa; identical to SEQ ID NO: 38383

SEQ ID NO: 637818 - RNA, 64 nt, hsa; identical to SEQ ID NO: 38384

SEQ ID NO: 637819 - RNA, 64 nt, hsa
ccuggagagcuagaaccuggagaacuagaaccuggagggcuagaacuggagaggcuagaaccaa

SEQ ID NO: 637820 - RNA, 64 nt, hsa
ccuggagggcuggaaucuggagagcuagaaccuggagggcuagaaccuggagggcuagaaucug

SEQ ID NO: 637821 - RNA, 64 nt, hsa
ucuggagagcuagaaccuggagggcuagaaccuggagggcuagaaucuggagagcuagaaccug

SEQ ID NO: 637822 - RNA, 64 nt, hsa
ccuggagggcuagaaucuggagagcuagaaccuggagggcuagaaucuggagagcuagaaccug

SEQ ID NO: 637823 - RNA, 64 nt, hsa
ccuggagggcuagaaucuggagagcuagaaccuggagggcuagaaccuggagagcuagaaccua

SEQ ID NO: 637824 - RNA, 64 nt, hsa
ccuggagggcuggaaucuggagagcuagaaccuggagggcuagaaccuggagggcuagaaccua

SEQ ID NO: 637825 - RNA, 64 nt, hsa
ucuggagagcuagaaccuggagggcuagaaccuggagggcuagaaccuagaagggcuagaaccu

SEQ ID NO: 637826 - RNA, 64 nt, hsa; identical to SEQ ID NO: 637824

SEQ ID NO: 637827 - RNA, 64 nt, hsa; identical to SEQ ID NO: 637825

SEQ ID NO: 637828 - RNA, 64 nt, hsa
cuggagggcuagaaccuagaagggcuagaaccuggagggcuagaaccuggcagguuagaaccua

SEQ ID NO: 637829 - RNA, 64 nt, hsa
cuagaagggcuagaaccuggagagccagaaccuggagggcuagaaccuggaagggcuagaaccu

SEQ ID NO: 637830 - RNA, 64 nt, hsa
ccuggcaagcuagaaccuggagggaaugaaccuggagggcuagaaccuggagaaugagaaaaau

SEQ ID NO: 637831 - RNA, 64 nt, hsa; identical to SEQ ID NO: 276332

SEQ ID NO: 637832 - RNA, 64 nt, hsa; identical to SEQ ID NO: 276333

SEQ ID NO: 637833 - RNA, 64 nt, hsa; identical to SEQ ID NO: 276334

SEQ ID NO: 637834 - RNA, 64 nt, hsa; identical to SEQ ID NO: 276335

SEQ ID NO: 637835 - RNA, 64 nt, hsa; identical to SEQ ID NO: 276336

SEQ ID NO: 637836 - RNA, 64 nt, hsa; identical to SEQ ID NO: 276337

SEQ ID NO: 637837 - RNA, 64 nt, hsa; identical to SEQ ID NO: 276338

SEQ ID NO: 637838 - RNA, 64 nt, hsa; identical to SEQ ID NO: 276339

SEQ ID NO: 637839 - RNA, 64 nt, hsa; identical to SEQ ID NO: 276340

SEQ ID NO: 637840 - RNA, 64 nt, hsa; identical to SEQ ID NO: 276341

SEQ ID NO: 637841 - RNA, 64 nt, hsa; identical to SEQ ID NO: 276342

SEQ ID NO: 637842 - RNA, 64 nt, hsa; identical to SEQ ID NO: 276343

SEQ ID NO: 637843 - RNA, 64 nt, hsa; identical to SEQ ID NO: 276344

SEQ ID NO: 637844 - RNA, 64 nt, hsa; identical to SEQ ID NO: 276345

SEQ ID NO: 637845 - RNA, 64 nt, hsa; identical to SEQ ID NO: 276346

SEQ ID NO: 637846 - RNA, 64 nt, hsa; identical to SEQ ID NO: 276347

SEQ ID NO: 637847 - RNA, 64 nt, hsa; identical to SEQ ID NO: 276348

SEQ ID NO: 637848 - RNA, 64 nt, hsa; identical to SEQ ID NO: 276349

SEQ ID NO: 637849 - RNA, 64 nt, hsa; identical to SEQ ID NO: 276350

SEQ ID NO: 637850 - RNA, 64 nt, hsa; identical to SEQ ID NO: 276351

SEQ ID NO: 637851 - RNA, 64 nt, hsa; identical to SEQ ID NO: 276352

SEQ ID NO: 637852 - RNA, 64 nt, hsa; identical to SEQ ID NO: 276353

SEQ ID NO: 637853 - RNA, 64 nt, hsa; identical to SEQ ID NO: 276354

SEQ ID NO: 637854 - RNA, 64 nt, hsa; identical to SEQ ID NO: 276355

SEQ ID NO: 637855 - RNA, 64 nt, hsa; identical to SEQ ID NO: 276356

SEQ ID NO: 637856 - RNA, 64 nt, hsa; identical to SEQ ID NO: 276357

SEQ ID NO: 637857 - RNA, 64 nt, hsa; identical to SEQ ID NO: 276358

SEQ ID NO: 637858 - RNA, 64 nt, hsa; identical to SEQ ID NO: 276359

SEQ ID NO: 637859 - RNA, 64 nt, hsa; identical to SEQ ID NO: 257770

SEQ ID NO: 637860 - RNA, 64 nt, hsa; identical to SEQ ID NO: 257771

SEQ ID NO: 637861 - RNA, 61 nt, hsa; identical to SEQ ID NO: 257772

SEQ ID NO: 637862 - RNA, 64 nt, hsa; identical to SEQ ID NO: 257773

SEQ ID NO: 637863 - RNA, 64 nt, hsa; identical to SEQ ID NO: 257774

SEQ ID NO: 637864 - RNA, 64 nt, hsa; identical to SEQ ID NO: 257775

SEQ ID NO: 637865 - RNA, 64 nt, hsa; identical to SEQ ID NO: 475408

SEQ ID NO: 637866 - RNA, 57 nt, hsa; identical to SEQ ID NO: 475409

SEQ ID NO: 637867 - RNA, 64 nt, hsa; identical to SEQ ID NO: 133894

SEQ ID NO: 637868 - RNA, 64 nt, hsa; identical to SEQ ID NO: 133895

SEQ ID NO: 637869 - RNA, 64 nt, hsa; identical to SEQ ID NO: 133896

SEQ ID NO: 637870 - RNA, 64 nt, hsa; identical to SEQ ID NO: 133897

SEQ ID NO: 637871 - RNA, 64 nt, hsa; identical to SEQ ID NO: 133898

SEQ ID NO: 637872 - RNA, 64 nt, hsa; identical to SEQ ID NO: 133899

SEQ ID NO: 637873 - RNA, 64 nt, hsa; identical to SEQ ID NO: 133900

SEQ ID NO: 637874 - RNA, 64 nt, hsa; identical to SEQ ID NO: 133901

SEQ ID NO: 637875 - RNA, 64 nt, hsa; identical to SEQ ID NO: 133902

SEQ ID NO: 637876 - RNA, 64 nt, hsa; identical to SEQ ID NO: 133903

SEQ ID NO: 637877 - RNA, 64 nt, hsa; identical to SEQ ID NO: 133904

SEQ ID NO: 637878 - RNA, 64 nt, hsa; identical to SEQ ID NO: 133905

SEQ ID NO: 637879 - RNA, 64 nt, hsa; identical to SEQ ID NO: 133906

SEQ ID NO: 637880 - RNA, 64 nt, hsa; identical to SEQ ID NO: 133907

SEQ ID NO: 637881 - RNA, 64 nt, hsa; identical to SEQ ID NO: 133908

SEQ ID NO: 637882 - RNA, 64 nt, hsa; identical to SEQ ID NO: 133909

SEQ ID NO: 637883 - RNA, 64 nt, hsa; identical to SEQ ID NO: 133910

SEQ ID NO: 637884 - RNA, 64 nt, hsa; identical to SEQ ID NO: 133911

SEQ ID NO: 637885 - RNA, 64 nt, hsa; identical to SEQ ID NO: 133912

SEQ ID NO: 637886 - RNA, 64 nt, hsa; identical to SEQ ID NO: 133913

SEQ ID NO: 637887 - RNA, 64 nt, hsa; identical to SEQ ID NO: 133914

SEQ ID NO: 637888 - RNA, 64 nt, hsa; identical to SEQ ID NO: 133915

SEQ ID NO: 637889 - RNA, 64 nt, hsa; identical to SEQ ID NO: 444674

SEQ ID NO: 637890 - RNA, 64 nt, hsa; identical to SEQ ID NO: 444675

SEQ ID NO: 637891 - RNA, 64 nt, hsa; identical to SEQ ID NO: 444676

SEQ ID NO: 637892 - RNA, 64 nt, hsa; identical to SEQ ID NO: 444677

SEQ ID NO: 637893 - RNA, 64 nt, hsa; identical to SEQ ID NO: 444678

SEQ ID NO: 637894 - RNA, 64 nt, hsa; identical to SEQ ID NO: 444679

SEQ ID NO: 637895 - RNA, 64 nt, hsa; identical to SEQ ID NO: 444680

SEQ ID NO: 637896 - RNA, 64 nt, hsa; identical to SEQ ID NO: 444681

SEQ ID NO: 637897 - RNA, 64 nt, hsa; identical to SEQ ID NO: 444682

SEQ ID NO: 637898 - RNA, 64 nt, hsa; identical to SEQ ID NO: 444683

SEQ ID NO: 637899 - RNA, 64 nt, hsa; identical to SEQ ID NO: 444684

SEQ ID NO: 637900 - RNA, 64 nt, hsa; identical to SEQ ID NO: 444685

SEQ ID NO: 637901 - RNA, 64 nt, hsa; identical to SEQ ID NO: 444686

SEQ ID NO: 637902 - RNA, 64 nt, hsa; identical to SEQ ID NO: 444687

SEQ ID NO: 637903 - RNA, 64 nt, hsa; identical to SEQ ID NO: 444688

SEQ ID NO: 637904 - RNA, 64 nt, hsa; identical to SEQ ID NO: 444689

SEQ ID NO: 637905 - RNA, 64 nt, hsa; identical to SEQ ID NO: 444690

SEQ ID NO: 637906 - RNA, 64 nt, hsa; identical to SEQ ID NO: 444691

SEQ ID NO: 637907 - RNA, 64 nt, hsa; identical to SEQ ID NO: 444692

SEQ ID NO: 637908 - RNA, 64 nt, hsa; identical to SEQ ID NO: 444693

SEQ ID NO: 637909 - RNA, 64 nt, hsa; identical to SEQ ID NO: 444694

SEQ ID NO: 637910 - RNA, 64 nt, hsa; identical to SEQ ID NO: 444695

SEQ ID NO: 637911 - RNA, 64 nt, hsa; identical to SEQ ID NO: 444696

SEQ ID NO: 637912 - RNA, 64 nt, hsa; identical to SEQ ID NO: 444697

SEQ ID NO: 637913 - RNA, 64 nt, hsa; identical to SEQ ID NO: 444698

SEQ ID NO: 637914 - RNA, 64 nt, hsa; identical to SEQ ID NO: 444699

SEQ ID NO: 637915 - RNA, 64 nt, hsa; identical to SEQ ID NO: 444700

SEQ ID NO: 637916 - RNA, 64 nt, hsa; identical to SEQ ID NO: 444701

SEQ ID NO: 637917 - RNA, 64 nt, hsa; identical to SEQ ID NO: 444702

SEQ ID NO: 637918 - RNA, 64 nt, hsa; identical to SEQ ID NO: 444703

SEQ ID NO: 637919 - RNA, 64 nt, hsa; identical to SEQ ID NO: 444704

SEQ ID NO: 637920 - RNA, 64 nt, hsa; identical to SEQ ID NO: 444705

SEQ ID NO: 637921 - RNA, 64 nt, hsa; identical to SEQ ID NO: 444706

SEQ ID NO: 637922 - RNA, 64 nt, hsa; identical to SEQ ID NO: 444707

SEQ ID NO: 637923 - RNA, 64 nt, hsa; identical to SEQ ID NO: 444708

SEQ ID NO: 637924 - RNA, 64 nt, hsa; identical to SEQ ID NO: 444709

SEQ ID NO: 637925 - RNA, 64 nt, hsa; identical to SEQ ID NO: 444710

SEQ ID NO: 637926 - RNA, 64 nt, hsa; identical to SEQ ID NO: 444711

SEQ ID NO: 637927 - RNA, 64 nt, hsa; identical to SEQ ID NO: 444712

SEQ ID NO: 637928 - RNA, 64 nt, hsa; identical to SEQ ID NO: 444713

SEQ ID NO: 637929 - RNA, 64 nt, hsa; identical to SEQ ID NO: 444714

SEQ ID NO: 637930 - RNA, 64 nt, hsa; identical to SEQ ID NO: 444715

SEQ ID NO: 637931 - RNA, 64 nt, hsa; identical to SEQ ID NO: 444716

SEQ ID NO: 637932 - RNA, 64 nt, hsa; identical to SEQ ID NO: 444717

SEQ ID NO: 637933 - RNA, 64 nt, hsa; identical to SEQ ID NO: 444718

SEQ ID NO: 637934 - RNA, 64 nt, hsa; identical to SEQ ID NO: 444719

SEQ ID NO: 637935 - RNA, 64 nt, hsa; identical to SEQ ID NO: 444720

SEQ ID NO: 637936 - RNA, 64 nt, hsa; identical to SEQ ID NO: 444721

SEQ ID NO: 637937 - RNA, 64 nt, hsa; identical to SEQ ID NO: 444722

SEQ ID NO: 637938 - RNA, 64 nt, hsa; identical to SEQ ID NO: 444723

SEQ ID NO: 637939 - RNA, 64 nt, hsa; identical to SEQ ID NO: 444724

SEQ ID NO: 637940 - RNA, 64 nt, hsa; identical to SEQ ID NO: 444725

SEQ ID NO: 637941 - RNA, 64 nt, hsa; identical to SEQ ID NO: 444726

SEQ ID NO: 637942 - RNA, 64 nt, hsa; identical to SEQ ID NO: 444727

SEQ ID NO: 637943 - RNA, 64 nt, hsa
caggcauaggcagggaaccgagcagcaggucagagcaggcgagcugacauucugcagccuggac

SEQ ID NO: 637944 - RNA, 64 nt, hsa
gcagagagaccagugcagggcuguuaacaggguugcaggcgagagacuggggugcugggcuccc

SEQ ID NO: 637945 - RNA, 61 nt, hsa
uccugcucuuccccgacuagggcgggcagaugcgcucgagccccacgggccuuccaccucc

SEQ ID NO: 637946 - RNA, 64 nt, hsa
auggaggaugaugcauacaugucggucaaguucagcgcucgacauuuuauggaaagauuuuuuu

SEQ ID NO: 637947 - RNA, 64 nt, hsa
uaggauuuccaauuguuaauaacgcuauguuagcgcgcucgaggaagaagguaggaaucccggc

SEQ ID NO: 637948 - RNA, 64 nt, hsa
gucuccaugugugugccaagcccuggcccccacagcgcucgauggaccucagcaagcugcccag

SEQ ID NO: 637949 - RNA, 64 nt, hsa
gcggccugccgccacgucagcagcccagggcacagcgcucgaggugugcuguuaggcuaagagg

SEQ ID NO: 637950 - RNA, 59 nt, hsa
cauccuggaucauccaaugagcagccguggcgcucgacugcacaggagcccgagacaau

SEQ ID NO: 637951 - RNA, 64 nt, hsa
ggcgccccgggucuuccgccgcccugggcuccuagcgcucgaaagcccaacgccucccggaccg

SEQ ID NO: 637952 - RNA, 64 nt, hsa
uucagguuccgagccugaccccuggaacugaccagcgcucgauugucagccuuggccugggguu

SEQ ID NO: 637953 - RNA, 64 nt, hsa
ccugccucagccucccaaagugcuggcauuacaggcgcucgaggcuuucugauguggcugcugc

SEQ ID NO: 637954 - RNA, 64 nt, hsa
gagcggagcacgccggcucccaguacuaggggcugcgcucgagcaguggcgggggcggaggggu

SEQ ID NO: 637955 - RNA, 64 nt, hsa
acacgugguagaugcccaccuccuccaugccucggcgcucgaucuccuccacgcacuggcgcac

SEQ ID NO: 637956 - RNA, 64 nt, hsa
aauaaaaugguucgauccggucuugacuugccaggcgcucgaggcgggguggggcugcccgggc

SEQ ID NO: 637957 - RNA, 64 nt, hsa
cuuucuuucuuuuuuuuuuuuaaauagcauuuuggcgcucgaaguugaucuccccagcgagggc

SEQ ID NO: 637958 - RNA, 64 nt, hsa
uucuugucuggaagaguucugcaggaaauggccagccucaaacgacaauucacggaacuguuau

SEQ ID NO: 637959 - RNA, 64 nt, hsa
gcucauugaaccuccacacaccgauucucuucgugccucaaaaauacgauuacgagacuuagga

SEQ ID NO: 637960 - RNA, 64 nt, hsa
ugccuguuuugaucuguuuugaaaaagauaaagagccucaaaucagaccagcacugauuaauua

SEQ ID NO: 637961 - RNA, 64 nt, hsa
gcacacuccaaucugggugaaagaccgagacuccgccucaaaaaaaaaaaaaaaagaaagaaag

SEQ ID NO: 637962 - RNA, 64 nt, hsa
agcauggcauauagugcccuuggaagaaaauuaggccucaaaugacaguagcauugaaguguuu

SEQ ID NO: 637963 - RNA, 64 nt, hsa
aguauggcaaaaguaggcaucuaaagaauauaaagccucaaaucuuccuuacugucucucuugu

SEQ ID NO: 637964 - RNA, 64 nt, hsa
auuccauaauguuacaauggauuuaagcuaugaagccucaaaacaucacgagauaagcaugaug

SEQ ID NO: 637965 - RNA, 64 nt, hsa
uaucuacgauaaaaauuuuuauacagaaccuacugccucaaacugaaucccaucaagaaaacua

SEQ ID NO: 637966 - RNA, 64 nt, hsa
ugggccuucgagccuucgaagcccacgugcaagcgccucaaaccaagucacgcuuggcgaggcc

SEQ ID NO: 637967 - RNA, 64 nt, hsa
ggucuugaccacgagcuaguucugaauugcaggggccucaaagcagcaccuaaaccuugagggg

SEQ ID NO: 637968 - RNA, 64 nt, hsa
gccauaugggcucacagcacccuggaggagaagggccucaaacugugcauguaagccuuuguuu

SEQ ID NO: 637969 - RNA, 64 nt, hsa
aacaugucgcaaaaugaaccaaacuucuggcuaggccucaaaacugacuuggucccacuuggag

SEQ ID NO: 637970 - RNA, 64 nt, hsa
gagagguuuuagauuuuuguuuuuuuuuuguucugccucaaagcucaguuuauugaagacauuu

SEQ ID NO: 637971 - RNA, 64 nt, hsa
ugcucuccuaugaccccaaaucauagucaauggugccucaaacauagcaccuuaaguuaaaggc

SEQ ID NO: 637972 - RNA, 64 nt, hsa
auuguguacaauuuggggccucaaauuugacucugccucaaaaaaaagaaauauauccuaugca

SEQ ID NO: 637973 - RNA, 64 nt, hsa
agccaccaaaaaaaaguauuguguacaauuuggggccucaaauuugacucugccucaaaaaaaa

SEQ ID NO: 637974 - RNA, 64 nt, hsa
uugcuacguugcccacacugcucuccaacuacuggccucaaacgauccuccugccucggccucc

SEQ ID NO: 637975 - RNA, 64 nt, hsa
cugaagugcgguggugcaaucauggcucacugcagccucaaauuccugggcucaagcgauccuc

SEQ ID NO: 637976 - RNA, 61 nt, hsa
agcccaccuggcucacacacagccucauggguagggucagcaaaccagauggcuuguuguu

SEQ ID NO: 637977 - RNA, 61 nt, hsa
ucacuguuagaaauaggcuuuguuagcugacuagggucagggaaacuuuucucuucaaauu

SEQ ID NO: 637978 - RNA, 61 nt, hsa
cauuccaguugcugggacggaaggcugaauguagggucauuuuguaugggauaugcagagc

SEQ ID NO: 637979 - RNA, 61 nt, hsa
cugccaaugaccccugggagagggacuuugguagggucaugauaaaguggcgggggucugg

SEQ ID NO: 637980 - RNA, 61 nt, hsa
ugggcuucuucugggguuccacccugacaaguagggucacagaggcuggugcacaguuucu

SEQ ID NO: 637981 - RNA, 61 nt, hsa
cauugagguaacugagcacuugagaauauuuuagggucaaaguguaauuauucauaaugaa

SEQ ID NO: 637982 - RNA, 61 nt, hsa
agccaugguccucuagaugcaguuaaccaaauagggucauuuuuauuaaaaguaguguuuc

SEQ ID NO: 637983 - RNA, 61 nt, hsa
caggggggaguaugagcagagugccugaguuuagggucaaggacaaaaaaccucaggccug

SEQ ID NO: 637984 - RNA, 61 nt, hsa
guugguaauacugaaugguagaauguuuugauagggucacauuugugccucacuggaauua

SEQ ID NO: 637985 - RNA, 61 nt, hsa
gauaaacugaagaaagugucuauauuggaacuagggucauuugaaagcuucagucucggaa

SEQ ID NO: 637986 - RNA, 61 nt, hsa
aagccaaggaacuaccccgcucccugcgcuauagggucacuuuaagcucuggggaaaaagg

SEQ ID NO: 637987 - RNA, 61 nt, hsa
cugcagccucgaaaaaguugcccuuaccuccuagggucaccucugcugccauucugaggaa

SEQ ID NO: 637988 - RNA, 61 nt, hsa
ccccagagcuugccagguuggguuuugagauuagggucaggucauggguauguggagaaug

SEQ ID NO: 637989 - RNA, 61 nt, hsa
cagcuugaauugauggggagggagguaagaguagggucagaguuacucaucccuuuucaaa

SEQ ID NO: 637990 - RNA, 61 nt, hsa
gugucuaaccuccaacugcugugcugucugcuagggucaccuccuguuugugaaaggggac

SEQ ID NO: 637991 - RNA, 61 nt, hsa
gcacggccccuuuuauccugcgcauguggccuagggucauccccagcccaucccuguguca

SEQ ID NO: 637992 - RNA, 61 nt, hsa
cuuguucccugaugugucucgagcccauugguagggucauacaaagcccacgguuacaagc

SEQ ID NO: 637993 - RNA, 61 nt, hsa
cgcaggccaacccauccccaguugagccuuauagggucaguagcucuccacaugaagaccu

SEQ ID NO: 637994 - RNA, 61 nt, hsa
ugagcuuguagcucugauuaucuagcauuuuuagggucauucuccuuaauaggcuuuuaug

SEQ ID NO: 637995 - RNA, 61 nt, hsa
aguuaugggaaagagaaugcauagaccuaucuagggucaucauagaagccuuuauaauuua

SEQ ID NO: 637996 - RNA, 61 nt, hsa
acuuuucuuauccaggggaaaauugccauuuuagggucagcaugaacagcucuuucuugua

SEQ ID NO: 637997 - RNA, 61 nt, hsa
uauuuacauuuuauauuuuuguacauauuguuagggucagccauuuuuaaugaucucggau

SEQ ID NO: 637998 - RNA, 61 nt, hsa
agugggcacucccaaccucagcacuuguccguagggucacacgcgugcccuguugcugaau

SEQ ID NO: 637999 - RNA, 61 nt, hsa
agcacccagacagauuuagaagcccaaaguuuagggucaaauguaaacccuggaaccugag

SEQ ID NO: 638000 - RNA, 61 nt, hsa
gcaucacuguguugggaucauaccaggacaauagggucauuccauaugauaaaacuaaagg

SEQ ID NO: 638001 - RNA, 61 nt, hsa
agacagcuucgagaaccagaggagaagagcauagggucauggagcaggugggcugaagcca

SEQ ID NO: 638002 - RNA, 61 nt, hsa
gauuuuccucucaguuuauuauuuggggggauagggucagguggguauaguaguacuuuac

SEQ ID NO: 638003 - RNA, 61 nt, hsa
uuaaaacagcagaaguacaagaauacagcuguagggucauugcuuuaaauuauauaaaaug

SEQ ID NO: 638004 - RNA, 61 nt, hsa
cuuacacugaagaguccuuuagcucaauugauagggucagcgucucgcaagcaaaaaaucu

SEQ ID NO: 638005 - RNA, 61 nt, hsa
aaaaccagagcacuugaugaacucgggguacuagggucagggcuuauagcaggaugucugg

SEQ ID NO: 638006 - RNA, 61 nt, hsa
uaucuucccuuuguuaagguguaacuugauguagggucaagguuuuugugacaacaggcag

SEQ ID NO: 638007 - RNA, 56 nt, hsa
ggcccagagagaugaaguagcuugucuagggucacgcagcuuguaaguggcagagc

SEQ ID NO: 638008 - RNA, 61 nt, hsa
guuucagccuccagaagacagcagagccuucuagggucaccuuaagaauagguuuagcuag

SEQ ID NO: 638009 - RNA, 61 nt, hsa
uccauuauuggagcuuuaauaauuuuugguauagggucaucucuccaccuuguuuuucuuc

SEQ ID NO: 638010 - RNA, 61 nt, hsa
cagaguucuauccugcccccacuguccacuguagggucauccgcaaagcccuagcagaaug

SEQ ID NO: 638011 - RNA, 61 nt, hsa
uauauaaauagcaaagggcuauugccaauacuagggucaaaaaugaauuugagggaacagu

SEQ ID NO: 638012 - RNA, 61 nt, hsa
ugaaacgcagacacugagaucuguuugaguuuagggucauuuuuagaaaggggcaguuuaa

SEQ ID NO: 638013 - RNA, 61 nt, hsa
aguuuccuaggauaauacaguccaugcaaaguagggucauagagaaauaaaagcaugcccu

SEQ ID NO: 638014 - RNA, 61 nt, hsa
uaaacucauuggagucuaguuccaaauuugguagggucaucaucucuacauuccuuaggau

SEQ ID NO: 638015 - RNA, 61 nt, hsa
gcauuuuaguaaacuuuuagacaaaauuuguuagggucauucaugaaaacuuuaauacuaa

SEQ ID NO: 638016 - RNA, 61 nt, hsa
uccagaugacagcacagcuguuugggacugauagggucacaguugccagguugggaaugcu

SEQ ID NO: 638017 - RNA, 61 nt, hsa
cuguuagaggagacauauaaauaagcucaucuagggucaccucauuuuccuaaauauguuu

SEQ ID NO: 638018 - RNA, 61 nt, hsa
uugcaccacggcaggugccucuguguggagcuagggucaagcccugagcagcuucacuucc

SEQ ID NO: 638019 - RNA, 61 nt, hsa
cagccggguggugacaaggagaaaagccuucuagggucacugucauucccuggccauguug

SEQ ID NO: 638020 - RNA, 61 nt, hsa
agagcagcuagaggcuccuccucugcuggcuuagggucagaaguaccucacagugguugug

SEQ ID NO: 638021 - RNA, 61 nt, hsa
cagaguuacugacacucaggcuuucuucccuuagggucacagggugaggaucaaagacaca

SEQ ID NO: 638022 - RNA, 61 nt, hsa
aacaugagcccugcccucaauuacaguaacguagggucagcuauaaaaucagacaaacauu

SEQ ID NO: 638023 - RNA, 61 nt, hsa
aaacguauuguuguauauuuccauuuuugaauagggucaaggagcccaagcaaaucauuuc

SEQ ID NO: 638024 - RNA, 61 nt, hsa
cuggauaguaguuauguugcugugaaaacuguagggucaaagccuuauagcaaaaaaaauu

SEQ ID NO: 638025 - RNA, 61 nt, hsa
uauuucuguaagaucugagaaguggaauuuguagggucauagguuauguacacuuaaguuu

SEQ ID NO: 638026 - RNA, 61 nt, hsa
uugaguguuacaaaaucuguagaccuggcaguagggucaugauguugggaaggguguagug

SEQ ID NO: 638027 - RNA, 61 nt, hsa
aaggacaagaucaggauagcuuuggugaagguagggucauauuaauaugaugauaaugugc

SEQ ID NO: 638028 - RNA, 61 nt, hsa
cgccaaggauuccaaagguggaaugagagaguagggucaaacugucacaguaucugcucca

SEQ ID NO: 638029 - RNA, 61 nt, hsa
aaggauagcauuucuaagauauuuugaauauuagggucauuuggcacuucucagcaaguag

SEQ ID NO: 638030 - RNA, 61 nt, hsa
acacccagggaggaaaaaaaggagcgcuuucuagggucagaaucguggagagaauacucag

SEQ ID NO: 638031 - RNA, 61 nt, hsa
ugauuuauuggaacagucuacacaaaaaccauagggucaagauccaugucuuacuccaaca

SEQ ID NO: 638032 - RNA, 61 nt, hsa
uuccuuuuuuuaacuuuaaaaauguauauucuagggucaggggaaauguaaucuggaauua

SEQ ID NO: 638033 - RNA, 61 nt, hsa
aucaaaaguuacuggaacuggaaaagcacauuagggucacuauucaaaaaacagauaauca

SEQ ID NO: 638034 - RNA, 61 nt, hsa
ucacacauuuacacauaccaauuuuuuucaauagggucacguuaagccaugcuguaagcau

SEQ ID NO: 638035 - RNA, 61 nt, hsa
ccuuggaggccaccgggacagaccuggacacuagggucaggcggggugcugugguggggag

SEQ ID NO: 638036 - RNA, 61 nt, hsa
auaaggacccucagugacuaauuauuguggguagggucaagauuaacuaguuuuauacaga

SEQ ID NO: 638037 - RNA, 61 nt, hsa
acuaacacauguuaaaaggacauuguuuuuauagggucauuuuaggcccuuugacuaaguu

SEQ ID NO: 638038 - RNA, 61 nt, hsa
uaaagcuuuccaggugguucuaaaggacaccuagggucaauaacccauuauaaaaugaucu

SEQ ID NO: 638039 - RNA, 61 nt, hsa
gcaugugagaugagacuuggcaugugagacauagggucacuagagacccuucugggucaga

SEQ ID NO: 638040 - RNA, 61 nt, hsa
aaggagaugagcguccuaaggcauguugggauagggucagaugcaccacccauggagaggu

SEQ ID NO: 638041 - RNA, 61 nt, hsa
uagcugguucuggguuggaguuggcucuggauagggucagucaccaggccuggacugaagg

SEQ ID NO: 638042 - RNA, 61 nt, hsa
ccuccuuccuccagugccugcugaaccaucuuagggucacucacacccucuguaauuuuaa

SEQ ID NO: 638043 - RNA, 61 nt, hsa
ucggcuccccagaauuccuagacuggguuaauagggucauauugugaaugucucacuacaa

SEQ ID NO: 638044 - RNA, 61 nt, hsa
caccuucagaauguaucgacaccagcuggguuagggucaagggugccuggggagggugagu

SEQ ID NO: 638045 - RNA, 61 nt, hsa
gguguacaaugcccuguuuguacuuacugguuagggucaggguaacuugccagcccaagau

SEQ ID NO: 638046 - RNA, 61 nt, hsa
caguguuugcuccaccuucauauuggcuagguagggucaccuagggaagcacuugcucaaa

SEQ ID NO: 638047 - RNA, 61 nt, hsa
acaacucaagguggaaguauuucagagggcauagggucaugaauccuuacccaaaggaagc

SEQ ID NO: 638048 - RNA, 61 nt, hsa
uccacuuccaguacuggacgugcucagggucuagggucacagauggugcuauuaauugaac

SEQ ID NO: 638049 - RNA, 61 nt, hsa
uggucaugcuccugugaguuuuuugggaagguagggucauuucucccugccugcuuugugc

SEQ ID NO: 638050 - RNA, 61 nt, hsa
aucacaggcgccuauacagcuucugucucaauagggucagauauuuugcacuguauauucu

SEQ ID NO: 638051 - RNA, 61 nt, hsa
augcuaaaggugauucuaguuaaucugggauuagggucaggaaaaugauagcaagacacau

SEQ ID NO: 638052 - RNA, 61 nt, hsa
uguacauaaaggcuuaauuuguuuuccuuguuagggucaaggguguccuccacucuuuaac

SEQ ID NO: 638053 - RNA, 61 nt, hsa
aaagaauaguuaggaaauaacuugguuuugauagggucaugauuaagaaaugauauauugg

SEQ ID NO: 638054 - RNA, 61 nt, hsa
aagcauauacaauccacuucccacuaagaauuagggucaaagacauucuauuugaacacuu

SEQ ID NO: 638055 - RNA, 61 nt, hsa
uaaaagccaguauucuaaaaauaauaaaggguagggucauuuuugaguuuguuuuucuuuu

SEQ ID NO: 638056 - RNA, 61 nt, hsa
accauaucaaauuaaacaauucaugccuuuauagggucaggccuacaaugaauagguaugg

SEQ ID NO: 638057 - RNA, 61 nt, hsa
gcuccucaggacccucugggucacacaucuuuagggucaguggccaauggggcacauuugg

SEQ ID NO: 638058 - RNA, 61 nt, hsa
acccccacaagaccaagcaucacauggaguguagggucacugggagagcagaggucacagc

SEQ ID NO: 638059 - RNA, 61 nt, hsa
uuuuuucaacguuuuuuuuucuuucaaacuguagggucacuuuugauugaggcaaaggggu

SEQ ID NO: 638060 - RNA, 61 nt, hsa
aggcuguccauugaaaccccuuguccaugaauagggucauacuccuaagacugauggggug

SEQ ID NO: 638061 - RNA, 61 nt, hsa
aaucacuggaacugagcauucuguaauauucuagggucacuccccuuagauacaaccaaug

SEQ ID NO: 638062 - RNA, 61 nt, hsa
aggggagugcacaagccgcccaugcaaagaguagggucagccauggcaaggccggaaguug

SEQ ID NO: 638063 - RNA, 61 nt, hsa
acucacugaagaaacuacuuuucaggcacuguagggucacccauaugccuccagcucaguu

SEQ ID NO: 638064 - RNA, 61 nt, hsa
cucugcugucaacuucccaucuggcucagcauagggucacuuugccauuaugcaaauggag

SEQ ID NO: 638065 - RNA, 61 nt, hsa
agaggauaguaaugaaaaugucucaguauuuuagggucaaugagagccauaaaaauauaac

SEQ ID NO: 638066 - RNA, 61 nt, hsa
ccuguagucccaccuacucgagaagcugagauagggucaccugagccugguaggcugaggc

SEQ ID NO: 638067 - RNA, 61 nt, hsa
guggcugaccugggcugcugguuccguugacuagggucaucuugaucucugcaguuugcuc

SEQ ID NO: 638068 - RNA, 61 nt, hsa
cucucagccuggaggcuggcuggacaucuccuagggucacugugccucucagcuaguuggc

SEQ ID NO: 638069 - RNA, 61 nt, hsa
acucuucccaccucagugcccacagccaagguagggucacuaaccaagccagaaacguaac

SEQ ID NO: 638070 - RNA, 61 nt, hsa
aaugggguguuuucuugcugaccugaggcuauagggucacuugccauuuccuaccuucucu

SEQ ID NO: 638071 - RNA, 61 nt, hsa
acggcccucuggccaccuacccgagagaucguagggucacauacauccaacuucaccacuu

SEQ ID NO: 638072 - RNA, 61 nt, hsa
uccccuaaugccugcggaguugugcacguaguagggucaggccacggcagccuaccggcaa

SEQ ID NO: 638073 - RNA, 61 nt, hsa
gaauuccuaaauccaggaagaagccuggacguagggucauuagcuuugggaauagaaggcu

SEQ ID NO: 638074 - RNA, 61 nt, hsa
cuguugauggacuuuuacauuguuuacagcuuagggucauaauaaaucaugcuucugagaa

SEQ ID NO: 638075 - RNA, 61 nt, hsa
uacaggguuccacuuuagaagugcgcgcggcuagggucaccgcccgcccuucccggcgcag

SEQ ID NO: 638076 - RNA, 61 nt, hsa
gggagaauuggccauugguaaaaagacuucauagggucacuggaaugcuuuguguuguuuu

SEQ ID NO: 638077 - RNA, 61 nt, hsa
cuucuggugggcaagggccccugggcucuaauagggucaucucuggcagcccacuugggcc

SEQ ID NO: 638078 - RNA, 61 nt, hsa
cuugucagggucucuucggagacccaggauuuagggucacaugcugcaggcagggcugugg

SEQ ID NO: 638079 - RNA, 61 nt, hsa
gcaugcagcuaacuccucuuuaguuuugucuuagggucaagugaucuuuaugggaugccua

SEQ ID NO: 638080 - RNA, 61 nt, hsa
gcagcucugggaccuaggaguuugcuucugauagggucagcuuucccauuucccuucaaug

SEQ ID NO: 638081 - RNA, 61 nt, hsa
gggauuuaaugcacagguguacuuuaauguuuagggucaguuuguaguauucuugagaaaa

SEQ ID NO: 638082 - RNA, 61 nt, hsa
ccauauguuaauggaaagcuuuucuuaggccuagggucaaaaggguuuauuuccuuaugau

SEQ ID NO: 638083 - RNA, 61 nt, hsa
cacguaggccuguugcugagggaaggcccucuagggucaucugguccagggguucuuugcu

SEQ ID NO: 638084 - RNA, 61 nt, hsa
aacacugagcauuuaauuuacaaauguuugcuagggucacccucucggccaucccacgagg

SEQ ID NO: 638085 - RNA, 61 nt, hsa
gucggcugcugaugucuagaugaguccccuguagggucagagacaaugucaaacuguguaa

SEQ ID NO: 638086 - RNA, 61 nt, hsa
cugguccccagggcaagggaacagcagaacuuagggucagggucucagggaacccugagcu

SEQ ID NO: 638087 - RNA, 61 nt, hsa
aggucagcaccuuccuguagggcacuggggcuagggucacagccccuaacucauaaagcaa

SEQ ID NO: 638088 - RNA, 61 nt, hsa
ggcaguggaugggaugcagccagucauggguuagggucagcagagacucagaguccagggc

SEQ ID NO: 638089 - RNA, 61 nt, hsa
uuaagaugauugaagcuuuacugguuaaguauagggucaccagagaaaguuccuuucccca

SEQ ID NO: 638090 - RNA, 61 nt, hsa
cugucauagaccaaaggaaucugauucucccuagggucaagaacaggcuaaggauacuaac

SEQ ID NO: 638091 - RNA, 61 nt, hsa
cacaaaaagaggcagaugauagacacugggguagggucauaccacagggaaauaccuuucc

SEQ ID NO: 638092 - RNA, 61 nt, hsa
agcauauaaauuaugacaauccuuuuagagguagggucaauauaguggauaaaccugucua

SEQ ID NO: 638093 - RNA, 61 nt, hsa
agaggccaguuuaaauaggcuuucaagagucuagggucagaaaagcaauagucacuaagcu

SEQ ID NO: 638094 - RNA, 64 nt, hsa; identical to SEQ ID NO: 411830

SEQ ID NO: 638095 - RNA, 64 nt, hsa; identical to SEQ ID NO: 411831

SEQ ID NO: 638096 - RNA, 64 nt, hsa; identical to SEQ ID NO: 411832

SEQ ID NO: 638097 - RNA, 64 nt, hsa; identical to SEQ ID NO: 411833

SEQ ID NO: 638098 - RNA, 64 nt, hsa; identical to SEQ ID NO: 411834

SEQ ID NO: 638099 - RNA, 64 nt, hsa; identical to SEQ ID NO: 411835

SEQ ID NO: 638100 - RNA, 64 nt, hsa; identical to SEQ ID NO: 411836

SEQ ID NO: 638101 - RNA, 64 nt, hsa; identical to SEQ ID NO: 411837

SEQ ID NO: 638102 - RNA, 64 nt, hsa; identical to SEQ ID NO: 411838

SEQ ID NO: 638103 - RNA, 64 nt, hsa; identical to SEQ ID NO: 411839

SEQ ID NO: 638104 - RNA, 64 nt, hsa; identical to SEQ ID NO: 411840

SEQ ID NO: 638105 - RNA, 64 nt, hsa; identical to SEQ ID NO: 411841

SEQ ID NO: 638106 - RNA, 64 nt, hsa; identical to SEQ ID NO: 411842

SEQ ID NO: 638107 - RNA, 64 nt, hsa; identical to SEQ ID NO: 411843

SEQ ID NO: 638108 - RNA, 64 nt, hsa; identical to SEQ ID NO: 411844

SEQ ID NO: 638109 - RNA, 64 nt, hsa; identical to SEQ ID NO: 411845

SEQ ID NO: 638110 - RNA, 64 nt, hsa; identical to SEQ ID NO: 411846

SEQ ID NO: 638111 - RNA, 64 nt, hsa; identical to SEQ ID NO: 411847

SEQ ID NO: 638112 - RNA, 64 nt, hsa; identical to SEQ ID NO: 411848

SEQ ID NO: 638113 - RNA, 64 nt, hsa; identical to SEQ ID NO: 411849

SEQ ID NO: 638114 - RNA, 64 nt, hsa; identical to SEQ ID NO: 411850

SEQ ID NO: 638115 - RNA, 64 nt, hsa; identical to SEQ ID NO: 411851

SEQ ID NO: 638116 - RNA, 64 nt, hsa; identical to SEQ ID NO: 411852

SEQ ID NO: 638117 - RNA, 64 nt, hsa; identical to SEQ ID NO: 411853

SEQ ID NO: 638118 - RNA, 64 nt, hsa; identical to SEQ ID NO: 411854

SEQ ID NO: 638119 - RNA, 64 nt, hsa; identical to SEQ ID NO: 411855

SEQ ID NO: 638120 - RNA, 64 nt, hsa; identical to SEQ ID NO: 411856

SEQ ID NO: 638121 - RNA, 64 nt, hsa
cacccagcacagugcugugaaccuuggcagaugcuagauaaauguguguugaaugaaugugccu

SEQ ID NO: 638122 - RNA, 64 nt, hsa
cccucagauuuuauaaacugggggauuucuuaauuagauaaaaguucauuacugaagauggaau

SEQ ID NO: 638123 - RNA, 64 nt, hsa
auuucuuacaugauuuuuuguuuuccucuguugcuagauaaauagaaacuaauaauagcucuau

SEQ ID NO: 638124 - RNA, 64 nt, hsa
ucuuuuucacuguagaauaauguggaaauaacccuagauaaaaauucagucugauaaccucaaa

SEQ ID NO: 638125 - RNA, 64 nt, hsa; identical to SEQ ID NO: 163278

SEQ ID NO: 638126 - RNA, 64 nt, hsa; identical to SEQ ID NO: 163279

SEQ ID NO: 638127 - RNA, 64 nt, hsa; identical to SEQ ID NO: 163280

SEQ ID NO: 638128 - RNA, 64 nt, hsa; identical to SEQ ID NO: 163281

SEQ ID NO: 638129 - RNA, 64 nt, hsa; identical to SEQ ID NO: 163282

SEQ ID NO: 638130 - RNA, 64 nt, hsa; identical to SEQ ID NO: 163283

SEQ ID NO: 638131 - RNA, 64 nt, hsa; identical to SEQ ID NO: 163284

SEQ ID NO: 638132 - RNA, 64 nt, hsa; identical to SEQ ID NO: 163285

SEQ ID NO: 638133 - RNA, 64 nt, hsa; identical to SEQ ID NO: 163286

SEQ ID NO: 638134 - RNA, 64 nt, hsa; identical to SEQ ID NO: 163287

SEQ ID NO: 638135 - RNA, 64 nt, hsa; identical to SEQ ID NO: 163288

SEQ ID NO: 638136 - RNA, 64 nt, hsa; identical to SEQ ID NO: 163289

SEQ ID NO: 638137 - RNA, 64 nt, hsa; identical to SEQ ID NO: 163290

SEQ ID NO: 638138 - RNA, 64 nt, hsa; identical to SEQ ID NO: 163291

SEQ ID NO: 638139 - RNA, 64 nt, hsa; identical to SEQ ID NO: 163292

SEQ ID NO: 638140 - RNA, 64 nt, hsa; identical to SEQ ID NO: 163293

SEQ ID NO: 638141 - RNA, 64 nt, hsa; identical to SEQ ID NO: 163294

SEQ ID NO: 638142 - RNA, 64 nt, hsa; identical to SEQ ID NO: 163295

SEQ ID NO: 638143 - RNA, 64 nt, hsa; identical to SEQ ID NO: 163296

SEQ ID NO: 638144 - RNA, 64 nt, hsa; identical to SEQ ID NO: 163297

SEQ ID NO: 638145 - RNA, 64 nt, hsa; identical to SEQ ID NO: 163298

SEQ ID NO: 638146 - RNA, 64 nt, hsa; identical to SEQ ID NO: 163299

SEQ ID NO: 638147 - RNA, 64 nt, hsa; identical to SEQ ID NO: 163300

SEQ ID NO: 638148 - RNA, 64 nt, hsa; identical to SEQ ID NO: 163301

SEQ ID NO: 638149 - RNA, 64 nt, hsa; identical to SEQ ID NO: 163302

SEQ ID NO: 638150 - RNA, 64 nt, hsa; identical to SEQ ID NO: 163303

SEQ ID NO: 638151 - RNA, 64 nt, hsa; identical to SEQ ID NO: 163304

SEQ ID NO: 638152 - RNA, 64 nt, hsa; identical to SEQ ID NO: 163305

SEQ ID NO: 638153 - RNA, 64 nt, hsa; identical to SEQ ID NO: 163306

SEQ ID NO: 638154 - RNA, 64 nt, hsa; identical to SEQ ID NO: 163307

SEQ ID NO: 638155 - RNA, 64 nt, hsa; identical to SEQ ID NO: 163308

SEQ ID NO: 638156 - RNA, 64 nt, hsa; identical to SEQ ID NO: 163309

SEQ ID NO: 638157 - RNA, 64 nt, hsa; identical to SEQ ID NO: 163310

SEQ ID NO: 638158 - RNA, 64 nt, hsa; identical to SEQ ID NO: 163311

SEQ ID NO: 638159 - RNA, 64 nt, hsa; identical to SEQ ID NO: 163312

SEQ ID NO: 638160 - RNA, 64 nt, hsa; identical to SEQ ID NO: 163313

SEQ ID NO: 638161 - RNA, 64 nt, hsa; identical to SEQ ID NO: 163314

SEQ ID NO: 638162 - RNA, 64 nt, hsa; identical to SEQ ID NO: 163315

SEQ ID NO: 638163 - RNA, 62 nt, hsa
auguccuucaaugcccaccucaaaagguaccucuucuguaaagcuuucccugguaucaggaa

SEQ ID NO: 638164 - RNA, 62 nt, hsa
ccuuauaggauuuucuuucuggccaagauuuccuucuguaucacuccaagcagccucagcag

SEQ ID NO: 638165 - RNA, 62 nt, hsa
caacagaaaucugucucuguuaaguguuuuaccuucuguaaguagagaugguagagccaaga

SEQ ID NO: 638166 - RNA, 62 nt, hsa
uauaguauuuggggcuuuccuaccccuuuagccuucuguaccuaguaccauauuccaguuuu

SEQ ID NO: 638167 - RNA, 62 nt, hsa
aggcccugggacgucugugauguucccaccugcuucuguagaaaugugucaccccagagggc

SEQ ID NO: 638168 - RNA, 62 nt, hsa
gcccacccuggccuggacagccuccuucagcccuucuguaccuggcagcccugggccccagg

SEQ ID NO: 638169 - RNA, 62 nt, hsa
guagaguaagaacuuagugacuacagcuuauucuucuguaacauaugguuucaaacaucuuu

SEQ ID NO: 638170 - RNA, 62 nt, hsa
gcugaauuuacuuguuguaagucuauuuuaaccuucuguaugacaucaugcuuuaucauuuc

SEQ ID NO: 638171 - RNA, 62 nt, hsa
ggaugagagcaaaaaccugggagaaugaugugcuucuguagucggugacaaaggaagaggca

SEQ ID NO: 638172 - RNA, 62 nt, hsa
gugaccucccugggccucuggaagcuuuguuucuucuguacccggguaaagugggggccuca

SEQ ID NO: 638173 - RNA, 62 nt, hsa
uuucugcuuuaugccucaguuugguuuaaaaacuucuguacuggcaaauggugguauucagu

SEQ ID NO: 638174 - RNA, 62 nt, hsa
aaaaucaagggaaauacaaguugauugcauuacuucuguauguugcuugcuauuaaaaaggu

SEQ ID NO: 638175 - RNA, 62 nt, hsa
uuggcuggggauaugguauaacgagccugagccuucuguacgugucugacacuagcacuguc

SEQ ID NO: 638176 - RNA, 62 nt, hsa
agucuagggaggagggaguggaagggucucugcuucuguacaaaaucuccaggauuuacaaa

SEQ ID NO: 638177 - RNA, 62 nt, hsa
uuaauaaaugcugcucccccauauagucuucccuucuguauaauuaacauagguugucucau

SEQ ID NO: 638178 - RNA, 62 nt, hsa
auuaagagaggcaugauaaugccauuuuuuuucuucuguacaacuggucagauuucaauaaa

SEQ ID NO: 638179 - RNA, 62 nt, hsa
agcaaggaagaauucucauguccuuugucuuccuucuguagccauuaacugcugaauccaug

SEQ ID NO: 638180 - RNA, 62 nt, hsa
cuauugcuauaaaccuagccaguucucuugcucuucuguauuuuccuauuucccugccauca

SEQ ID NO: 638181 - RNA, 62 nt, hsa
uaaaaguaaauuuccucauuaagccaaccugccuucuguaagucacagugcuuaaaucucag

SEQ ID NO: 638182 - RNA, 62 nt, hsa
uaaaacuccuauuaaaaauguuuagauguuugcuucuguagaugucacuuuaguaaaauacc

SEQ ID NO: 638183 - RNA, 62 nt, hsa
cuuauuuaauauaaucucuauuguauugauuucuucuguauuuaccuuuuggauuuuguaaa

SEQ ID NO: 638184 - RNA, 62 nt, hsa
cucuuauucugccuuacgaggauuucuggaagcuucuguaacuguagggaagaaagcuguag

SEQ ID NO: 638185 - RNA, 62 nt, hsa
cacccuugccccaugcccuuguucuuuccagacuucuguaggccuaauuuucccuuauaaac

SEQ ID NO: 638186 - RNA, 62 nt, hsa
uuucaagcaucacaagacaaccuuuucagagucuucuguauucuuaguaagaugaguuucua

SEQ ID NO: 638187 - RNA, 62 nt, hsa
aauguuuucauaacaauauuaaucuaugggugcuucuguaagauggaugaucaucuuaauau

SEQ ID NO: 638188 - RNA, 62 nt, hsa
uuauucuuggauguauaaagugaacuuuuuggcuucuguaaguaugcucuaugcaccucuaa

SEQ ID NO: 638189 - RNA, 62 nt, hsa
cugguccaugaggcugcccagagaaagcacugcuucuguaugucucuugugguauuggaaca

SEQ ID NO: 638190 - RNA, 62 nt, hsa
auccaguacuauguaagauagaaggugcaugucuucuguauucuguauuucccauuucuuuu

SEQ ID NO: 638191 - RNA, 62 nt, hsa
auugguauucuaaaccuccuaagauauuuaggcuucuguacauaaaaguguuuuugcuaaau

SEQ ID NO: 638192 - RNA, 64 nt, hsa
uaaugaucaauuuaccugcauauaaaauuuauuuuuaaucaagcugaucuuaauguauauaauc

SEQ ID NO: 638193 - RNA, 64 nt, hsa
gcuaggaaaugcugaaaacaacuguguuuuuuaauuaaucaauaacugcaaaauuaaaguaccu

SEQ ID NO: 638194 - RNA, 64 nt, hsa
ggaauuuuaauauauuccuuuaaaagaaagcaauuuaaucaauugcaaagcaauuauauaaaac

SEQ ID NO: 638195 - RNA, 64 nt, hsa
aguguuuggccuggaagagugauaugcuugcugcuuaaucaaaggauuaaagauuuaaagaugu

SEQ ID NO: 638196 - RNA, 64 nt, hsa
aaaaugcacguuucaggguguguuugcauaugauuuaaucaaucaguaugguuacauugauaaa

SEQ ID NO: 638197 - RNA, 64 nt, hsa
uuagaauucauauugaauuaaauuaauugcuagcuuaaucaaaauguuugauucuccuauacuu

SEQ ID NO: 638198 - RNA, 64 nt, hsa
aaaucauauacauuagaaaaucacagucagauguuuaaucaauccaaaauguccacuauuucuu

SEQ ID NO: 638199 - RNA, 64 nt, hsa
uagucuacauguuucuaaacauauaaaugugaauuuaaucaauuccuuucauaguuuuauaauu

SEQ ID NO: 638200 - RNA, 64 nt, hsa
ucuuccccaaggauuucaagaugaauugaaauuuuuaaucaagauagugugcuuuauucuguug

SEQ ID NO: 638201 - RNA, 64 nt, hsa
uaaugaauuauauauagauagauagagugauuaguuaaucaaaacuauauauuuguuaaaaauu

SEQ ID NO: 638202 - RNA, 64 nt, hsa
augaaacacacaacguaaguuauuuagaaucacuuuaaucaaccaauaauccuuagccaauuua

SEQ ID NO: 638203 - RNA, 64 nt, hsa
auucuaaguuuuggguaauguuaacucagaacacuuaaucaaauugagcuaugugccauaaggu

SEQ ID NO: 638204 - RNA, 64 nt, hsa
uggaauucagacacuguucuuaccguguuuguuuuuaaucaaauauuaccuaaaaauguacaaa

SEQ ID NO: 638205 - RNA, 64 nt, hsa
ggauauugaugcacaauuuaaggauuaaacauuuuuaaucaauuguggaugauggcuuauuaaa

SEQ ID NO: 638206 - RNA, 64 nt, hsa
gauuuugguaaugauguugauaauuucagggaaauuaaucaaguaccuauauugauuuaaaagu

SEQ ID NO: 638207 - RNA, 64 nt, hsa
auuccuauuaaauauuaaaaguaguucugguuuauuaaucaacggggaaaacaucuucuccaaa

SEQ ID NO: 638208 - RNA, 64 nt, hsa
ccuuuuaaaacuggaccaacuaaguaauugguauuuaaucaaagagaaaaugguaauaaacuuu

SEQ ID NO: 638209 - RNA, 64 nt, hsa
guagaugaaacuguauaagauuuuuacaucuugcuuaaucaauauuuucagagucuauuaguuc

SEQ ID NO: 638210 - RNA, 64 nt, hsa
cuaaaauguauauuuugcauaaaagagauauucuuuaaucaauuacuuuuuugugaguuuugug

SEQ ID NO: 638211 - RNA, 64 nt, hsa
auguucugaaguguguuguguuucauguucaagcuuaaucaaggcagccauuaauauacgaacu

SEQ ID NO: 638212 - RNA, 64 nt, hsa
gucauagccaaucuaacgguaaugguaaaugcuuuuaaucaagcaggaaaaaguucucaugauu

SEQ ID NO: 638213 - RNA, 64 nt, hsa
ugguaaugcuuggaauggcaauaggguagaaugauuaaucaaaggcauaucuucuauaucugaa

SEQ ID NO: 638214 - RNA, 64 nt, hsa
aggguuuaauagacugagucagaugggucugauauuaaucaaaauugucucuucugaggaccgc

SEQ ID NO: 638215 - RNA, 64 nt, hsa
cuguauggcaaaaccaucaucaugaguucuagcauuaaucaacaucagugaguccauacuaagu

SEQ ID NO: 638216 - RNA, 64 nt, hsa
uggaauagagaacaguuauaucacaguugagaguuuaaucaaaaugaccggaucagcauauucu

SEQ ID NO: 638217 - RNA, 64 nt, hsa
aaacccuacaaguguaaugaauguggcauaguuuuuaaucaacagucacaccuugcaagucauc

SEQ ID NO: 638218 - RNA, 64 nt, hsa
aaacuuuacaaguguaaugaauguggcaagguuuuuaaucaaaaaacaacccuugcacgucauc

SEQ ID NO: 638219 - RNA, 64 nt, hsa
aaaccuuacaagcacaaugaaugugacaugguuuuuaaucaacaaucacaccuugcaagucauc

SEQ ID NO: 638220 - RNA, 64 nt, hsa
aaaccuuacaagcauaaugaauguggcaagguuuuuaaucaaaaagcaaccuuugcacaucacc

SEQ ID NO: 638221 - RNA, 64 nt, hsa
acuguccugugcuauuccuaccaaggacaauuuauuaaucaauugacuuagaaaauagggggag

SEQ ID NO: 638222 - RNA, 64 nt, hsa
agcuaaacacuuacuaguagugucuuuaaauuauuuaaucaaccuugucuuuucaaggaaauua

SEQ ID NO: 638223 - RNA, 64 nt, hsa
cccaccaggaggaaagaggcccagcucucagcugacgauggaggcagaaccggagucggguuug

SEQ ID NO: 638224 - RNA, 64 nt, hsa
agauagugacaaggugaugcagaugugaccuaggacgauggaccgccggacucuuuucugcagc

SEQ ID NO: 638225 - RNA, 64 nt, hsa
uuuaguaaucuaggcuuugccuguaaagaauacaacgauggauuuuaaauacuguuuguggaau

SEQ ID NO: 638226 - RNA, 64 nt, hsa
uagcuauagcuucagaagcauuuuuacuugcaagacgauggacacauuccccuugggcuuuuug

SEQ ID NO: 638227 - RNA, 64 nt, hsa
caagugauguacauccaagugauguauucuggaaacgauggaauuuuacaguuacaguuccauu

SEQ ID NO: 638228 - RNA, 64 nt, hsa
ggaauaacuuggaaguaagguucauucccuuaagacgauggauucuguugaacuaugggguccc

SEQ ID NO: 638229 - RNA, 64 nt, hsa
ccaaaaucagcugaguugaaguuugucaccaagaacgauggauauguacacauucacccuucau

SEQ ID NO: 638230 - RNA, 64 nt, hsa
uguccaucugaccccaaaggaguucuugaucuggacgauggauauugcuuccaaugaaagguuu

SEQ ID NO: 638231 - RNA, 64 nt, hsa
uccggacaccacaccacaugagcccaacagguccacgauggauccaccagucccaccccagccu

SEQ ID NO: 638232 - RNA, 64 nt, hsa
gggaaucgaaccuagggauagugcuccacuucugacgauggagugaagacacuuggcagacuug

SEQ ID NO: 638233 - RNA, 64 nt, hsa
uauggugcgccgcaugacaugggaggcgauggggacgauggacagagacagagcgugcacacgu

SEQ ID NO: 638234 - RNA, 64 nt, hsa
agaagccaccugcacagcagagcucauuguggaaacgauggaggaaggugaaggggaaggggaa

SEQ ID NO: 638235 - RNA, 64 nt, hsa
ggaaccgcggaguuuggcucaccgcaaagcugcaacgauggacucuugcauagaaaaaaaaauc

SEQ ID NO: 638236 - RNA, 64 nt, hsa
cagaaugaggauuuuuuuguaaauaggucagaagacgauggaacuguccuggguuaguauagua

SEQ ID NO: 638237 - RNA, 55 nt, hsa
ucaaugaagaucuaaguuaggaaagacgauggagguggaauccuuuaagauuaug

SEQ ID NO: 638238 - RNA, 64 nt, hsa
ucagugauguauaugcaacauuuuguugaaagccacgauggacuuacaagcuuuaauggacucg

SEQ ID NO: 638239 - RNA, 64 nt, hsa
uccucugaagcauuugguggccuaauuuacaagcacgauggagagagccuuauaaacagauaau

SEQ ID NO: 638240 - RNA, 64 nt, hsa
ccagagacaaugcucaguauucauucauacacagacgauggaagaagccacuucuucccugggc

SEQ ID NO: 638241 - RNA, 64 nt, hsa
uguaagcuauguugggccaauuccaaaauauuauacgauggagaggucaaauuuaccuacuucu

SEQ ID NO: 638242 - RNA, 64 nt, hsa
gucaggaaaaggcaauauaucaggucuccucaggacgauggaggccuuauaugguguguuaccu

SEQ ID NO: 638243 - RNA, 64 nt, hsa
guaaauucaaugaaaaaaaaugugguacauagauacgauggaaaacuaugcagccaugaaacac

SEQ ID NO: 638244 - RNA, 64 nt, hsa
ugugcggccagauagcuguuccugaguugcaggcacgauggagauuuggacacugugugcuuuu

SEQ ID NO: 638245 - RNA, 64 nt, hsa
cgaggccuuugcuuuacagcacuguauguguugcacgauggauccgugacagcacuuuccuguu

SEQ ID NO: 638246 - RNA, 64 nt, hsa
gaauccagauccuguggaaggcccuugguguuacacgauggaucccaaagucagaugggaguac

SEQ ID NO: 638247 - RNA, 64 nt, hsa
ucuagaacagugcugucuaauagaacuuucugugacgauggauauuuuguagacuuuugcuguc

SEQ ID NO: 638248 - RNA, 64 nt, hsa
cagacacggaccuauggacuauggauggaugcggacgauggaaccguucaguaaagaacccaag

SEQ ID NO: 638249 - RNA, 64 nt, hsa
ucuacacacuugugauuccuauucgauauuauguacgauggagauugggaaacuuaaccguuac

SEQ ID NO: 638250 - RNA, 64 nt, hsa
augcuaaauuauuauuuagcuucucccaucgcccacgauggaauguaaaauaaauugguuuugu

SEQ ID NO: 638251 - RNA, 64 nt, hsa
aaaauaaggaaggaaaacguagcugcaguuguccacgauggauauugguucuuuaaaauauauc

SEQ ID NO: 638252 - RNA, 64 nt, hsa
agaguuugcuucuggcuggcggcaagggaaagggacgauggagaaggcacggcugcuucuuacc

SEQ ID NO: 638253 - RNA, 64 nt, hsa
gaaauuucagcagcaaaguuguuauucagugggcacgauggacuccaaaugccucaaguuaugu

SEQ ID NO: 638254 - RNA, 64 nt, hsa
ccaagaauuauagcguuuauaaguacaacuuggaacgauggaaugcaucuguuacuagagacug

SEQ ID NO: 638255 - RNA, 64 nt, hsa
ugagaccuggccaucaaaugacacaaacaacuaaacgauggaagagagagcgagcccggguccu

SEQ ID NO: 638256 - RNA, 64 nt, hsa
agcgagaacuacgcacagcugccgcguugagcguacgauggaggccuaccucucguuucugccc

SEQ ID NO: 638257 - RNA, 64 nt, hsa
gauacuacagaugugggugcaggcaugcacacacacgauggaauauggccauuccuacacaggu

SEQ ID NO: 638258 - RNA, 64 nt, hsa
ggcaguagcacacuuugcacacgauaaagcaaagacgauggauugacaagcccuuccgaucaug

SEQ ID NO: 638259 - RNA, 64 nt, hsa
auuaaaugagggcaggcccugugcucauagcuuuacgauggagagaugccagugaccucauaau

SEQ ID NO: 638260 - RNA, 64 nt, hsa
aaaauacaguagaaacaccacuguuuacgauuauacgauggacauucauaaaaagcauaauuuc

SEQ ID NO: 638261 - RNA, 64 nt, hsa
ucgaccauaugguauugguuaaauuaacaucuauacgauggaauacuagauggucauuaaaauu

SEQ ID NO: 638262 - RNA, 64 nt, hsa
uuaacaggcuucaacauaguaugugugcagauggacgauggauuuaaagagcauaccuuaugau

SEQ ID NO: 638263 - RNA, 64 nt, hsa
uauuuacugucugugagagcauugggaguaggaaacgauggacuccaaaguacaagggagaaua

SEQ ID NO: 638264 - RNA, 64 nt, hsa
uugcagucagcuucauaccauuuuuaaagucaauacgauggaaaucaauaaaucugaauuccga

SEQ ID NO: 638265 - RNA, 64 nt, hsa
guugcagauacgugacuuggagcacccgugucuuacgauggacagugauaaaggugaacacaca

SEQ ID NO: 638266 - RNA, 64 nt, hsa
uucucucacagggggacccaauucucugaagucuacgauggagcauuuuuugagaagaaacuaa

SEQ ID NO: 638267 - RNA, 64 nt, hsa
uuccuauuuuugacgauuggagcccuuaagaugcacgauggaauuguguuuugcguuuuuuggu

SEQ ID NO: 638268 - RNA, 64 nt, hsa
uucccguggagugguuugaucuauauacacugugacgauggacagaagguacuuuuaaaagugg

SEQ ID NO: 638269 - RNA, 64 nt, hsa
cauggguaacuugggggagagaagaauccuccaaacgauggaguagccagugguaauacaaagc

SEQ ID NO: 638270 - RNA, 64 nt, hsa
ccgucgcuaaacugcacgauccugcaaugaaugcacgauggagugugggggucuggagggggcu

SEQ ID NO: 638271 - RNA, 64 nt, hsa
uggcauguaagugcccacuuccucauguuuucacacgauggagaccaacaaauaggucggucgg

SEQ ID NO: 638272 - RNA, 64 nt, hsa
uuuuuagcauuuaaggugugaaaugcuccucaacacgauggauaagugagagagagucagguug

SEQ ID NO: 638273 - RNA, 64 nt, hsa
acccagggcucagcuuuugauugaagagagagacacgauggagaccauugguaagcugcccuau

SEQ ID NO: 638274 - RNA, 64 nt, hsa
guugaggggguuguaccugccagacuuccaggggacgauggaauacccagaacgcuccuucuga

SEQ ID NO: 638275 - RNA, 64 nt, hsa
caaaagaacaacaaaaaaacccagcacaaaaccgacgauggaguuuguuucuuugauuucuuug

SEQ ID NO: 638276 - RNA, 64 nt, hsa
cagucacauccugagcugcuccuggcugauaaccacgauggagcccguguuuguccugccaucu

SEQ ID NO: 638277 - RNA, 64 nt, hsa
ugcgucucggaugucugucuuuugccucgaagccacgauggaucgcugguuuccucugcagcgc

SEQ ID NO: 638278 - RNA, 64 nt, hsa
ugagucauuuggaauuguggguaaauuauuauguacgauggaauccacggaugagaccucaggu

SEQ ID NO: 638279 - RNA, 64 nt, hsa
ucuucucauuuugcagaagagaaacugaggcccagaggcggagggcagucugcucaaggucacg

SEQ ID NO: 638280 - RNA, 64 nt, hsa
agauugaagaugcauccaacccucugcugcugaagaggcggaagaaagcucgggcccuggaggc

SEQ ID NO: 638281 - RNA, 64 nt, hsa
uuggaggcgaggcacgagaaucgcuugaaccugggaggcggaguuugcagugagccgagaucac

SEQ ID NO: 638282 - RNA, 64 nt, hsa
gggaggcugaggcaggagaaucgcuugaacccgggaggcggagguuacagugagccgagaucac

SEQ ID NO: 638283 - RNA, 64 nt, hsa
uuuuaaauuacaguuaguuuuuuuguuuguuuuugaggcggagucucuguuacccaggcuggag

SEQ ID NO: 638284 - RNA, 64 nt, hsa
uggaggcucaggcacaagaaucacuugaaccuacgaggcggagguugcagugggccaggaucgu

SEQ ID NO: 638285 - RNA, 64 nt, hsa
gugcgcgcauguaaucccagcuacucgggaggcugaggcggaagaaucacuugaacccgggagg

SEQ ID NO: 638286 - RNA, 64 nt, hsa
gggaggcugaggcggaagaaucacuugaacccgggaggcggagguuccagugagccgagauggc

SEQ ID NO: 638287 - RNA, 64 nt, hsa
aggaggcugagggaggagaaucccuugaacccgggaggcggagguucauggggaacccagcagg

SEQ ID NO: 638288 - RNA, 64 nt, hsa
aggaggcugaggcagaagaaucgcuugaacccuggaggcggagguugccgugagccaagaucgc

SEQ ID NO: 638289 - RNA, 64 nt, hsa
gcucacaccuguaaucccagcacuuugggaggcugaggcggauggaucacgaggucaggcaguc

SEQ ID NO: 638290 - RNA, 64 nt, hsa
aggaggcugaggcaggagaacugcuugaaccugggaggcggagguugcagugagccgagauugc

SEQ ID NO: 638291 - RNA, 64 nt, hsa
gggaggcugagacaggagauuugcuugaacccgggaggcggagguugcagugagccaagauugu

SEQ ID NO: 638292 - RNA, 64 nt, hsa
aggaaggcugaggcggcagaaucacuugaacccggaggcggagguugcgguaagccgagaucac

SEQ ID NO: 638293 - RNA, 64 nt, hsa
agaaggcugaggcaggagaaucacuugaaccuaggaggcggagguugcagugagccaagauggc

SEQ ID NO: 638294 - RNA, 64 nt, hsa
gggaggcugaggcaggagaaucgcuugaacccaggaggcggagguugcagugagccaagauggc

SEQ ID NO: 638295 - RNA, 64 nt, hsa
aggaggcugaggcaugagaaucgcuuaaacccaggaggcggagguugcagugagcugagaucac

SEQ ID NO: 638296 - RNA, 64 nt, hsa
aggaggcugaggcagcagaaucguuugaacccgggaggcggagguugcagugaguggagaucgu

SEQ ID NO: 638297 - RNA, 64 nt, hsa
guuuacgccuguaaucccagcacugugggaggccgaggcggauggaucaccugaggucgggaau

SEQ ID NO: 638298 - RNA, 64 nt, hsa
gggaggcugaggcaggaaaaucacuugaacccgggaggcggagguugcggugagccaagaucgc

SEQ ID NO: 638299 - RNA, 64 nt, hsa
gcccgcggugaucccagccagggccccgagcgcagaggcggagcugugcucagcacaggccugg

SEQ ID NO: 638300 - RNA, 64 nt, hsa
ggacagagcucagaggcccccgagguguguguaggaggcggaggcccgcagagcacagagcagg

SEQ ID NO: 638301 - RNA, 64 nt, hsa
gggaggcugaggcaggagaaucgcuugaaccugagaggcggagguugcagugagccaaaauugc

SEQ ID NO: 638302 - RNA, 64 nt, hsa
gcucacgccuguaaucccagcacuuugggaggccgaggcggaucauaaggucaggagaucaaga

SEQ ID NO: 638303 - RNA, 64 nt, hsa
aggaggcugaggcaggagaauggcgugaacccgggaggcggagcuugcagugagccgagaucgc

SEQ ID NO: 638304 - RNA, 64 nt, hsa
gugcacaccaguauucccagcuacucuggaggcugaggcggaggcaggauugcuugauaugagg

SEQ ID NO: 638305 - RNA, 64 nt, hsa
gggaggcugaggcaggagaauggcgugaaccugggaggcggagcuugcagugagccaagaucgc

SEQ ID NO: 638306 - RNA, 64 nt, hsa
gcgguggcucaugccuguaauaccagcacuuugggaggcggaggcgggcagaucgcgaggucag

SEQ ID NO: 638307 - RNA, 64 nt, hsa
caacaauggauugaucagggcuacucagaaggcugaggcggaaggauugcuugaggccaggagu

SEQ ID NO: 638308 - RNA, 64 nt, hsa
cgugaggacgcugcgggccagcggcuucagcucggaggcggacguccccacucugggugagugg

SEQ ID NO: 638309 - RNA, 64 nt, hsa
ccaaccacacgcuguaccccauggucacgcgguggaggcggaacgaggauggagccaucugcag

SEQ ID NO: 638310 - RNA, 64 nt, hsa
ucaguuaaaaggaagcccgaaguuguguuugugcugcccacaggacagugggaguuacaguuca

SEQ ID NO: 638311 - RNA, 64 nt, hsa
uucaauguguuuacauuguaugaauugagcuuuuugcccacagauucuugauuuguaguuguuu

SEQ ID NO: 638312 - RNA, 64 nt, hsa
ugggcucucaaagcccugcgccuguuaccacggaugcccacagggccugggcaguugcuguggc

SEQ ID NO: 638313 - RNA, 64 nt, hsa
uguccgcucucagcccacucucccuguuacacacugcccacacucagagcaagaugaguugcug

SEQ ID NO: 638314 - RNA, 64 nt, hsa
cagaacgaauguggaggccggccgaaacugaugcugcccacagucccagugaaguuaggugggu

SEQ ID NO: 638315 - RNA, 64 nt, hsa
ugccauuccuuucuaaguguguuuuauggcauccugcccacaaagaacucacagucugauuagg

SEQ ID NO: 638316 - RNA, 64 nt, hsa
caccacucacucaaccaguggcacaguguccuugugcccacacugagccagcaaguccugcugu

SEQ ID NO: 638317 - RNA, 64 nt, hsa
cuaugaccccacgucugacagccauguccaccugugcccacagcuuccgcccacagaccuccag

SEQ ID NO: 638318 - RNA, 64 nt, hsa
gagacagaagucaaaaggaagagcaguggagccuugcccacagggcugcugcuucaugcgagag

SEQ ID NO: 638319 - RNA, 64 nt, hsa
cuggcucaacuucaccaagaugcauucucauaccugcccacagcuccauuuuggaggcaggcag

SEQ ID NO: 638320 - RNA, 64 nt, hsa
acuaagaaacauaucaaggugcuuuuggcacaggugcccacaaauacggaugcagugcugagau

SEQ ID NO: 638321 - RNA, 64 nt, hsa
gcaaaagaggcuacuugauugguggccaaccucgugcccacauggaagguaucuuuaauagggu

SEQ ID NO: 638322 - RNA, 64 nt, hsa
ccuggggaaacaucagugaauaaaacacggucccugcccacagugcuuagggccuacugaggga

SEQ ID NO: 638323 - RNA, 64 nt, hsa
gcuccuuuuucuggcuggggccugacaccaguuuugcccacauugcuauggugggaagagggcc

SEQ ID NO: 638324 - RNA, 64 nt, hsa
ccucaggugugcgagugccucugggaggcgcagaugcccacacagccagcacugacuuguguuc

SEQ ID NO: 638325 - RNA, 64 nt, hsa
cccacccugggguuggggaggagcagggagugggugcccacaguuuuccuuugcuucucccaga

SEQ ID NO: 638326 - RNA, 64 nt, hsa
guggguucgcugacaggcgagggucagccugcugugcccacacacacccacuaaggagaaagaa

SEQ ID NO: 638327 - RNA, 64 nt, hsa
uuuuccacuuugagggaggugcuucgaagaauguugcccacaccuaaguguuagaagccuaugu

SEQ ID NO: 638328 - RNA, 64 nt, hsa
gcggccacaggcgagggugggcugaggcugaaguugcccacacugggggccagagcuagggugg

SEQ ID NO: 638329 - RNA, 64 nt, hsa
guggagcugccugccuugcccucacugcccacucugcccacacuucccugccuagagacccggg

SEQ ID NO: 638330 - RNA, 64 nt, hsa
caguuuuuuaaucuaacaacuacuuuuggggacuugcccacaucucugggauuugaauggggau

SEQ ID NO: 638331 - RNA, 64 nt, hsa
aauacuucauuccuuaacucucccucauuugcuuugcccacagccuauucaguuccuuuguuug

SEQ ID NO: 638332 - RNA, 64 nt, hsa
ugaguccacacugucccugagugauccaggaggcugcccacauccccacaugugcacugugguu

SEQ ID NO: 638333 - RNA, 64 nt, hsa
cagcacaaccagccaccagugguuggugaggcagugcccacaaggcucauguuguaugccuuug

SEQ ID NO: 638334 - RNA, 64 nt, hsa
uuccuuccccuaagauguuuccagggcccucuggugcccacacuguccucuuccuuccacuugg

SEQ ID NO: 638335 - RNA, 64 nt, hsa
ggcccacagccaguggccuguccgcauugcccugugcccacaagcaacaguccacagcccuugg

SEQ ID NO: 638336 - RNA, 64 nt, hsa
ggcuguggguggaggccugacuccaggccucuccugcccacacccucugggcugaguuccuucu

SEQ ID NO: 638337 - RNA, 64 nt, hsa
ucagggagccccaagggggauuuugugggaccgcugcccacagauccagguguuggaagggcag

SEQ ID NO: 638338 - RNA, 64 nt, hsa
auggagcacucugagaucucaucgcggacaccacugcccacaccuccaucccguccugcgcagg

SEQ ID NO: 638339 - RNA, 64 nt, hsa
cugggggagcugcugauggaguccucgcugcucaugcccacagcccucccagagugcuaugcga

SEQ ID NO: 638340 - RNA, 64 nt, hsa
cccuccugcacccaggcuggcgacagcccagcagugcccacacaggacugggcccuccgcaggg

SEQ ID NO: 638341 - RNA, 64 nt, hsa
ccucucagcccaacugcaggugguaggauaggggugcccacagagggcaaagaaacugcccaug

SEQ ID NO: 638342 - RNA, 64 nt, hsa
aggaacuugaaauguggggagugauaauaguccagugauuaaacuacaguccagugauuaccac

SEQ ID NO: 638343 - RNA, 64 nt, hsa
gugggccgcuacccuucuuucccuuuagaaaacugugauuaauuaaauaaaaagucuuacuacu

SEQ ID NO: 638344 - RNA, 64 nt, hsa
cauuuacuguccaauuuaaaacuuuggaauugcugugauuaaagugaucaaaaugccaaaauac

SEQ ID NO: 638345 - RNA, 64 nt, hsa
uucuuuguaagaacaccaaccaaccaagguuuaagugauuaauaggcuugagcaccggguggca

SEQ ID NO: 638346 - RNA, 64 nt, hsa
guacuuuccuuauuggcaacuuauggacucgcuagugauuaaacgaggcaaugacugugagcga

SEQ ID NO: 638347 - RNA, 64 nt, hsa
cauuggccuuaauauaccuaaaucuccaaaaacagugauuaaagcaagagaauuauuacaaggg

SEQ ID NO: 638348 - RNA, 64 nt, hsa
ucaaguugcuuggcagcacaacuaucuuugcaaaaaaaaguaaagaaaaaguaaaugaugguuu

SEQ ID NO: 638349 - RNA, 64 nt, hsa
ggcagcacaacuaucuuugcaaaaaaaaguaaagaaaaaguaaaugaugguuuaaaaaauacac

SEQ ID NO: 638350 - RNA, 64 nt, hsa
cuuaaaauuccuggauggcugcagauguugggggaaaaaguacgugauauuuuagaaacuuagu

SEQ ID NO: 638351 - RNA, 64 nt, hsa
uuaaaagcuacauuuuauaacacuggcacacacaaaaaaguaguuuuaagcuuguuugcacagu

SEQ ID NO: 638352 - RNA, 64 nt, hsa
acacuguaauaacauauacugugaaaacauuccuaaaaaguaaccaaaggguuugcuaacucug

SEQ ID NO: 638353 - RNA, 64 nt, hsa
ucucugugccaaauacauuauaucaggauuacacaaaaaguaucacaaaggauggucuuggcca

SEQ ID NO: 638354 - RNA, 64 nt, hsa
aaauaaguggaauuauguaucuuuucuaaaguuaaaaaaguaaaauauuuuauuaugaguuauu

SEQ ID NO: 638355 - RNA, 64 nt, hsa
uaggaagaugacaguauuuuuuucaaguuaucauaaaaaguaauucagaugacauuugagaagu

SEQ ID NO: 638356 - RNA, 64 nt, hsa
gaaacacugaccgacccuccuggggucugucaggaaaaaguagaagaaaagccacccccugcac

SEQ ID NO: 638357 - RNA, 64 nt, hsa
uuuuuggaaacuuuagcugugcugucaacuuuggaaaaaguaucccgguuuacuguguugaguu

SEQ ID NO: 638358 - RNA, 64 nt, hsa
gacccaaggccuaugcugaggucuaaaccucugaaaaaaguauaguaucgaguacccguucccu

SEQ ID NO: 638359 - RNA, 64 nt, hsa
ucuuuuuaaaugucuuucuuauauggguuuuaaaaaaaaguaauaaaagccuguugcaaaaaug

SEQ ID NO: 638360 - RNA, 64 nt, hsa
aagaaagggaagaaaggggagaagggaagagguuaaaaaguaagugcucagaccuaugaacgua

SEQ ID NO: 638361 - RNA, 64 nt, hsa
uuuaagguacacugcauuuugcaaaaaaaaaaaaaaaaaguaaucuuuuagcaaccccaguauu

SEQ ID NO: 638362 - RNA, 64 nt, hsa
guauggaugaaagcaaucugagagauuugaauagaaaaaguaaucaaguuaaaaccugcaaagc

SEQ ID NO: 638363 - RNA, 64 nt, hsa
cucuuuguucaguugacuuacuguuucuuaccuuaaaaaguaauuguagauggaaaucaguugu

SEQ ID NO: 638364 - RNA, 64 nt, hsa
uacaaagcuaguugccauauuucuauuuuauuuuaaaaaguaaacaugcggcugggcguggugg

SEQ ID NO: 638365 - RNA, 64 nt, hsa
ccugggcaacaagagcaaaaaucccucucaaaaaaaaaaguaaacaugggcacugauuguuuua

SEQ ID NO: 638366 - RNA, 64 nt, hsa
uugacagaaaacucucuaagauuuaguaagugaaaaaaaguaggaugcaagaguuuuuauaguu

SEQ ID NO: 638367 - RNA, 64 nt, hsa
auuuauuaaaacauacuuuuuuuuucuucaaauaaaaaaguaaccaugucuuugucuaaaugug

SEQ ID NO: 638368 - RNA, 64 nt, hsa
ugauuuaauuuuuaaauguuuuaaucuccuuuacaaaaaguauacguuaauauaccguccucaa

SEQ ID NO: 638369 - RNA, 64 nt, hsa
gaaaaaccugggcaccuaagcaaugagccacagcaaaaaguaaagaacaacaacaaaauaaagc

SEQ ID NO: 638370 - RNA, 64 nt, hsa
acuaaucuuucugaacuguaaauauuuaaagaaaaaaaaguaguuuuguaucaaccuaaaugag

SEQ ID NO: 638371 - RNA, 64 nt, hsa
cuaauagaaauuauguuuucauguguuucacaugaaaaaguauauauauacaaaguuaauauag

SEQ ID NO: 638372 - RNA, 64 nt, hsa
uuacugaugcuuuauguuaccaaaacauacaguaaaaaaguagaaauuuaugaaauacuuuuga

SEQ ID NO: 638373 - RNA, 64 nt, hsa
gcagaaaacuugagucagaaaauucuggaacuugaaaaaguaguaagggccuccagaauugacu

SEQ ID NO: 638374 - RNA, 64 nt, hsa
uuauccauaaugaucuaaacuaauaagauucaccaaaaaguaaaaauucaauuuuacaauauac

SEQ ID NO: 638375 - RNA, 64 nt, hsa
uuuuuuguuuaaaaaaaaaaaaaacacugcauuaaaaaaguaucuguugcauuaaggcacauag

SEQ ID NO: 638376 - RNA, 64 nt, hsa
uuauuuuaaauauauuuuuaaugaaaagggacuuaaaaaguaaacaugauuaucuaaauuacuu

SEQ ID NO: 638377 - RNA, 64 nt, hsa
uugcuuuaauguguauugaagaaaagcacuuuuuaaaaaguacucuuuaagagugaaauaauua

SEQ ID NO: 638378 - RNA, 64 nt, hsa
gugcucucaucagaaaugucaucaaauauuaccaaaaaaguauuuuuuuaaguuagagaauaua

SEQ ID NO: 638379 - RNA, 64 nt, hsa
caguggcaucagcagucacagagcaccaagccaaaaaaaguacggcccucagccagucgcuaug

SEQ ID NO: 638380 - RNA, 64 nt, hsa
uuauuuugccaccuuuauauuguauuuauaaaaaaaaaaguacuaucaaucaaucauacuacuu

SEQ ID NO: 638381 - RNA, 64 nt, hsa
auucuuaugucgcucaaaaaauaaaauuuaauuuaaaaaguaucugauuuuuaaaguaaauauu

SEQ ID NO: 638382 - RNA, 64 nt, hsa
gcauauugagacucugucucuacaaaaaaauuuuaaaaaguaaaaauuagcugggcgugguggc

SEQ ID NO: 638383 - RNA, 64 nt, hsa
auuucacuaaauuuagagaaaugcacaugguaauaaaaaguauaaauuauaaaugcaauuaacu

SEQ ID NO: 638384 - RNA, 64 nt, hsa
ugaagaugugaucauuugugauguuacuuguaaaaaaaaguauauauacauaucuuuugaagug

SEQ ID NO: 638385 - RNA, 64 nt, hsa
agaaucuguuuguugaucaagugacuguccccguaaaaaguagaagauaaguuuguuaaaguau

SEQ ID NO: 638386 - RNA, 64 nt, hsa
ugggcuguguacuuuugcuucaaaaaccauuguuaaaaaguauuucuuuuguaaucaaucuaaa

SEQ ID NO: 638387 - RNA, 64 nt, hsa
agauucaaacaaucuuuuauucaaagauugaaauaaaaaguaucgggugccaacugugauuuuu

SEQ ID NO: 638388 - RNA, 64 nt, hsa
caguggagccuuucagugaaauaggugacuauuaaaaaaguaauaguauuacagaaaaaugagc

SEQ ID NO: 638389 - RNA, 64 nt, hsa
gagcaacuauuuuauaugacuguucuguacaaacaaaaaguauguaauacccauuuuaaaaaac

SEQ ID NO: 638390 - RNA, 64 nt, hsa
guuuuuguuucaauuuuuaucaucauaaaugggcaaaaaguaguuggacuaauuucgguuuuua

SEQ ID NO: 638391 - RNA, 64 nt, hsa
ucauuauuucuucaguauaaaguuauucuuccugaaaaaguaagauauaccugggaaauauucu

SEQ ID NO: 638392 - RNA, 64 nt, hsa
auuacuucacuugaggguacuugacaauaugaacaaaaaguaaauuuuuauuugcauaauuuua

SEQ ID NO: 638393 - RNA, 64 nt, hsa
ugaaauuaaauuaucuauucuucccccccccaaaaaaaaguauuguaaauccuuaaguaaaauu

SEQ ID NO: 638394 - RNA, 64 nt, hsa
cacacccggcacaucuucauucuuuuuauguaguaaaaaguauaaggccacacaugguuuauuu

SEQ ID NO: 638395 - RNA, 64 nt, hsa
guuuucuaguuuaaguuguucccccucccucugaaaaaaguauguauuuuuacauuagaaaagg

SEQ ID NO: 638396 - RNA, 64 nt, hsa
auauuuuugaaaggcauguuccucugucaaugaaaaaaaguacauguauguguugugauauuaa

SEQ ID NO: 638397 - RNA, 64 nt, hsa
guguuagauagaauuuccaauauuggagcauaucaaaaaguauuaaaacuaaaaaggaccagag

SEQ ID NO: 638398 - RNA, 64 nt, hsa
uuguguugaucauuauuuccauucuuaaugugaaaaaaaguaauuauuuauacuuauuauaaaa

SEQ ID NO: 638399 - RNA, 64 nt, hsa
aaugugaaaaaaaguaauuauuuauacuuauuauaaaaaguauuugaaauuugcacauuuaauu

SEQ ID NO: 638400 - RNA, 64 nt, hsa
acaaaaccaagaacauaucuagcaagaaaacuugaaaaaguauaagcauuuguuaaaaauguga

SEQ ID NO: 638401 - RNA, 64 nt, hsa
aauaaaacccaaucauaguaagugauuaacuagcaaaaaguaaagcuauuuauagcaaauuucu

SEQ ID NO: 638402 - RNA, 63 nt, hsa
uauaucuuugaacuuuucaagaauaaaaaagcuuaaaaaguauacauggccugguccuaccag

SEQ ID NO: 638403 - RNA, 64 nt, hsa
ggcaaauuguauguuauaccuauuuuacuacaauaaaaaguauaaaaaagagaagauauuuagg

SEQ ID NO: 638404 - RNA, 64 nt, hsa
aaugguacaggcaaaugugacuggauuucccucaaaaaaguaacuauuaaacagucuugaucuc

SEQ ID NO: 638405 - RNA, 64 nt, hsa
aggccaacgguccaagggauuacaucugcaguuuaaaaaguaaauauauauucuaucguauuca

SEQ ID NO: 638406 - RNA, 64 nt, hsa
aaucauacugcauacaugcuacaaaaaaguagcaaaaaaguacaaaguuggcuuagauaacuug

SEQ ID NO: 638407 - RNA, 64 nt, hsa
ggaaguccagaaaucauacugcauacaugcuacaaaaaaguagcaaaaaaguacaaaguuggcu

SEQ ID NO: 638408 - RNA, 64 nt, hsa
agugucagauggcaguggaagcauguguguuucuaaaaaguaaaaaucucaagaaaacagaaau

SEQ ID NO: 638409 - RNA, 64 nt, hsa
acuuagugaaagagagcugcaguugaaauuguuuaaaaaguagcagguacaaugaauauuguca

SEQ ID NO: 638410 - RNA, 64 nt, hsa
acaagagugaaacuccaucuccaaaaaaaaaaagaaaaaguaacaaaaggaaauuauuuguuuu

SEQ ID NO: 638411 - RNA, 64 nt, hsa
ugagcuuucuagaauauuugccuaauugggaauuaaaaaguaaaauaauaggccaggcauggug

SEQ ID NO: 638412 - RNA, 64 nt, hsa
ugggugccacagcgagacccuaguuaagagaaaaaaaaaguaaaaacaaauugugggucaaagu

SEQ ID NO: 638413 - RNA, 64 nt, hsa
cagaauucugaaguuuccuaugacuaauucacaaaaaaaguaauuguaaacuaguacuauuaug

SEQ ID NO: 638414 - RNA, 64 nt, hsa
guccuaaagggacaauaacucugagcaugccccaaaaaaguaguuuagcaaccuuuuguuggua

SEQ ID NO: 638415 - RNA, 64 nt, hsa
gucaauucugaaccaccaccccccgccccccgcaaaaaaguaaaagucaaaccaaacuuccuca

SEQ ID NO: 638416 - RNA, 64 nt, hsa
cugauaguucuauauuuucaaaauauuugaaaauaaaaaguauucccaagugauuuuaauuuaa

SEQ ID NO: 638417 - RNA, 64 nt, hsa
uuuuauuuuuuaauaugggucagacuuuuggauuaaaaaguauuauaucauggacauacauuuu

SEQ ID NO: 638418 - RNA, 64 nt, hsa
agcauguagagaucaucacauguauggaaaccuuaaaaaguaaacuuauuuuuucuaacuagaa

SEQ ID NO: 638419 - RNA, 64 nt, hsa
ugaauuccaauuauaccuuacaucagcaaguuaaaaaaaguacuuuaaaauaaagcaaagggag

SEQ ID NO: 638420 - RNA, 64 nt, hsa
agacuuuagaugucuuguauuaaaaauuacacaaaaaaaguaaaacuuuuuauacuuacccuuu

SEQ ID NO: 638421 - RNA, 64 nt, hsa
ucugcuguuuuuuauuuuuaacauguucauaauuaaaaaguauuuuccagcaguccaaagaugu

SEQ ID NO: 638422 - RNA, 64 nt, hsa
gacaucuucaccggacacauuucagaggagagaaaaaaaguaauauugaaucuuaaaguguuua

SEQ ID NO: 638423 - RNA, 64 nt, hsa
uuuacugugugccacauauuagacaauaaauggaaaaaaguaccauguucaauggggguauggg

SEQ ID NO: 638424 - RNA, 64 nt, hsa
aauuaaaggacauccacaauucaauguauaacagaaaaaguaaugauuaaagcuugugaaucug

SEQ ID NO: 638425 - RNA, 64 nt, hsa
uuucuguauuuaccugacauuuauuuuaauguucaaaaaguaaacacuuuaaguuugauguguu

SEQ ID NO: 638426 - RNA, 64 nt, hsa
ccccaguucagaguugaauguuuauuauuaaagaaaaaaguaauguacauauggcuggauuuuu

SEQ ID NO: 638427 - RNA, 64 nt, hsa
caucuuuaggauauauuuacauuuucacucaucuaaaaaguauacaaaaauaaaaaguggaaaa

SEQ ID NO: 638428 - RNA, 64 nt, hsa
uuuccccugccgucuccucauccugcacccccuaaaaaaguaccaaacauuugcauucucagaa

SEQ ID NO: 638429 - RNA, 64 nt, hsa
ccuauauugaaaauguauauuauuuauauaacuuaaaaaguaaaaauaacuauguuuugagaua

SEQ ID NO: 638430 - RNA, 64 nt, hsa
gaugcaauaguagaaagcuacuuauuuuaaugaaaaaaaguaaaacuucguucuuuaucagccu

SEQ ID NO: 638431 - RNA, 64 nt, hsa
uugcaauguuuuuauuguuaauguagcauauauaaaaaaguaucucauaauuuuaauuuguguu

SEQ ID NO: 638432 - RNA, 64 nt, hsa
auucgaagugauuauuaucagcuuaauuggauuaaaaaaguacuucaagaaauuauuuuaucau

SEQ ID NO: 638433 - RNA, 64 nt, hsa
uauguucuuuaccaaauuguugcaucugguucugaaaaaguauagcauguagcagcuuccaaac

SEQ ID NO: 638434 - RNA, 64 nt, hsa
uauucaugaaacuucauugcagggguaauagaagaaaaaguaaauugggaggacuuaauggaag

SEQ ID NO: 638435 - RNA, 64 nt, hsa
ucugauguuugugauuguuuuucucacggugaugaaaaaguaugugcuauaaguagaggagcgc

SEQ ID NO: 638436 - RNA, 64 nt, hsa
cugaucugagacguugggaggcaagaauaaagugaaaaaguauauguaaucccaacaucuaauu

SEQ ID NO: 638437 - RNA, 64 nt, hsa
uacugaaaguuuauauaguauagucuauguagauaaaaaguaccacuugucuuuucugugaauu

SEQ ID NO: 638438 - RNA, 64 nt, hsa
aguuauaugucugcuaucuguguugcucauuuaaaaaaaguauacauugaauaaggcuguuuau

SEQ ID NO: 638439 - RNA, 64 nt, hsa
uuaacuuuguauuuugauuguugagaacaaaaacaaaaaguaucaauguguauguggcuguuug

SEQ ID NO: 638440 - RNA, 64 nt, hsa
uuuuaagauuaaagguacacugauggacaaaaaaaaaaaguaaaacauggcaaaaaauaaaaua

SEQ ID NO: 638441 - RNA, 64 nt, hsa
uuggggauucaaaggggauugcuacaccauguagaaaaaguauguagaaaaaaagugcuuaaua

SEQ ID NO: 638442 - RNA, 64 nt, hsa
caaaacuuuuuuuuugaaaugaaaagacuuuuuaaaaaaguaaaacaagaaaaguacauucuuu

SEQ ID NO: 638443 - RNA, 64 nt, hsa
cauguuauauauauguaguuggcauuugguucccaaaaaguaggauguagguauuuauuguguu

SEQ ID NO: 638444 - RNA, 64 nt, hsa
gcugguuuauaccuauguucauuuauaugcuguaaaaaaguaguagcuucuucuacaauguaaa

SEQ ID NO: 638445 - RNA, 64 nt, hsa
cagauugucagaaguuccagacagaugagaaagcaaaaaguacuuuguaaaguguuauacaauc

SEQ ID NO: 638446 - RNA, 64 nt, hsa
aaauauauauauauacacacccugugagaacuguaaaaaguaccucugguucuugguuuaaguu

SEQ ID NO: 638447 - RNA, 64 nt, hsa
agacaugugaagcaaauucauauuugcaauggguaaaaaguauuaaagccuuucucuugccugc

SEQ ID NO: 638448 - RNA, 64 nt, hsa
uuccugcauuguuuuagucaaguaauggcuuuugaaaaaguaaaguucaauaauaacuaaggcu

SEQ ID NO: 638449 - RNA, 64 nt, hsa
uugaaauuucagacaaagcaaacccagcagguauaaaaaguaguauaaauacaaaucuguaagu

SEQ ID NO: 638450 - RNA, 64 nt, hsa
gaaaugccaacaauaguuugaauuguguucuguaaaaaaguauuagucaauuauuuuucaaaau

SEQ ID NO: 638451 - RNA, 64 nt, hsa
guaaauaguaguguuggucuuacguauuucaaguaaaaaguagacagcugcacuuuuuuugcac

SEQ ID NO: 638452 - RNA, 64 nt, hsa
gcaggucaugagugugaaauucucaaauuuacauaaaaaguagaaguauagacaguuuaacauu

SEQ ID NO: 638453 - RNA, 64 nt, hsa
guccauucugcagcuguuagaucugccucucaggaaaaaguacuaacuuguucuuuuuguuccu

SEQ ID NO: 638454 - RNA, 64 nt, hsa
ggcgacagagccagacccugucucaaaaaaaaaaaaaaaguacaugaaaggauucacucuggag

SEQ ID NO: 638455 - RNA, 64 nt, hsa
caaaauggugaaaccaugucucuacaaaaaauagaaaaaguagcagguguggugguaugccccu

SEQ ID NO: 638456 - RNA, 64 nt, hsa
acuuaaaaaaaguauuauaaauuuaauuacugucaaaaaguauuucagaaaauauaagcuuuua

SEQ ID NO: 638457 - RNA, 64 nt, hsa
gcucacaucuuacucaacaucagagaguacuuaaaaaaaguauuauaaauuuaauuacugucaa

SEQ ID NO: 638458 - RNA, 64 nt, hsa
aaaaauagagaaauugcacuuccuggaaaaaauuaaaaaguaguuaguuuaauuauucuguaaa

SEQ ID NO: 638459 - RNA, 64 nt, hsa
uuguuauuuauucuuuuaauaauggaauuuuuuuaaaaaguauuuuguaacugaggaauuuuga

SEQ ID NO: 638460 - RNA, 64 nt, hsa
ugaacagaguuuugaaaggcauugcuuuaaaggaaaaaaguauagguauguguacauauauaau

SEQ ID NO: 638461 - RNA, 64 nt, hsa
ucucuuuggaugaauaggagacaguaguagccauaaaaaguacuuauacuuuagaaaacagucc

SEQ ID NO: 638462 - RNA, 64 nt, hsa
acagggcaaaagaggggaguaaaaagaaauagccaaaaaguacaauuguuaacagugacuuuaa

SEQ ID NO: 638463 - RNA, 64 nt, hsa
aauauugucauccgcuugcugugcuguggggaaaaaaaaguagaggaaaaagugugugguuaag

SEQ ID NO: 638464 - RNA, 64 nt, hsa
uaggguucccugccucccaucuuuccacuguuguaaaaaguauaucaaauuauuccuucaaguu

SEQ ID NO: 638465 - RNA, 64 nt, hsa
gaacaaguaauuuuauauugugcuuuaauuuuuuaaaaaguauucuuuauucauauguauagaa

SEQ ID NO: 638466 - RNA, 64 nt, hsa
aaggaccuucacucuaagauguuauauuuuucuuaaaaaguaacuccuaguagggguaccacug

SEQ ID NO: 638467 - RNA, 64 nt, hsa
ugcacaugauuucacaaauauuaaaaagucuuuuaaaaaguauugccaaacauuaauguugauu

SEQ ID NO: 638468 - RNA, 64 nt, hsa
gcaacagagcgagacuccaucucaaaaaaaaaaaaaaaaguaagaaagaaaaggacucccuuag

SEQ ID NO: 638469 - RNA, 64 nt, hsa
cagccugagugauagagugagacucugucucaaaaaaaaguaucucuaaauacaggauuauaau

SEQ ID NO: 638470 - RNA, 64 nt, hsa
aauaaauuguacuaaaagucauuuaagaaauaccaaaaaguaagcuuuuguuucuaaccauugu

SEQ ID NO: 638471 - RNA, 64 nt, hsa
ucaaagauucuuuccuaaaguauaacguguuguuaaaaaguagugguguuauaacucucaaugu

SEQ ID NO: 638472 - RNA, 64 nt, hsa; identical to SEQ ID NO: 164102

SEQ ID NO: 638473 - RNA, 64 nt, hsa; identical to SEQ ID NO: 164103

SEQ ID NO: 638474 - RNA, 64 nt, hsa; identical to SEQ ID NO: 164104

SEQ ID NO: 638475 - RNA, 64 nt, hsa; identical to SEQ ID NO: 164105

SEQ ID NO: 638476 - RNA, 64 nt, hsa; identical to SEQ ID NO: 164106

SEQ ID NO: 638477 - RNA, 64 nt, hsa; identical to SEQ ID NO: 164107

SEQ ID NO: 638478 - RNA, 64 nt, hsa
acaugauuauguuaagaggcuuuaagauuuaaaaguuucacacaaccauaaguauaguauuuca

SEQ ID NO: 638479 - RNA, 64 nt, hsa
ggacuggaauuuuuuucauuaauguguucaucaaguuucacaucuaaguugaaacagggugugu

SEQ ID NO: 638480 - RNA, 64 nt, hsa
caauauaaguaaauauagauuauauauguauaguguuucacaaagcuuagaccuuuaccuucca

SEQ ID NO: 638481 - RNA, 64 nt, hsa
gucagggaagaacgaaccuugacguugcagugcaguuucacagaucguuguuagaucuuuauuu

SEQ ID NO: 638482 - RNA, 64 nt, hsa
uuuaacacugcuaauagaaauuauguuuucauguguuucacaugaaaaaguauauauauacaaa

SEQ ID NO: 638483 - RNA, 64 nt, hsa
gcaucuguuuuaggucucaaaauauaacucagcuguuucacacuguauauguacauuguuuucu

SEQ ID NO: 638484 - RNA, 64 nt, hsa
auaaaggacugaauaaucuaaaaagcauauaaaaguuucacacagcauaaaagauaccaaaaua

SEQ ID NO: 638485 - RNA, 64 nt, hsa
uaaugcauacuggaaguacuuugauacucaaguuguuucacaagauuuauaauauagaugguuu

SEQ ID NO: 638486 - RNA, 64 nt, hsa
gucucaggaaaugcauguuuccaugaguuuuuuaguuucacaguuuuacagauccaacgacaca

SEQ ID NO: 638487 - RNA, 64 nt, hsa
cuauccgagggaugagauuaaggcagaggcaaaaguuucacacaaaguuucugcaaccuaacgu

SEQ ID NO: 638488 - RNA, 64 nt, hsa
uaaucagugauuuuuguuauaugaaaauaauaguguuucacaguauuucuauuuaaggcagcua

SEQ ID NO: 638489 - RNA, 64 nt, hsa
ugcugcuucgugucucacucgagaguugcuucugguuucacacuuuuuaaccccucugugcuuu

SEQ ID NO: 638490 - RNA, 64 nt, hsa
uuaugaucagggauuuuauaaacaugcgggccugguuucacaucggauggcaccuuuuggcuuc

SEQ ID NO: 638491 - RNA, 64 nt, hsa
agagaacaggugguuuuuaaggguuaucuuagauguuucacaccggaagguuuuuaaacacuaa

SEQ ID NO: 638492 - RNA, 64 nt, hsa
aaugugauuacugcucuauuccaaaaagguugcuguuucacaauaccucaugcuucacuuagcc

SEQ ID NO: 638493 - RNA, 64 nt, hsa
gcagagcuccuaagucaccacucaaccaguggcuguuucacaaggauuugagggcacuugccug

SEQ ID NO: 638494 - RNA, 64 nt, hsa
ucugucuccuuuuuuuacauaagaaccaauccguguuucacauugggcuaaguggauuccuuau

SEQ ID NO: 638495 - RNA, 64 nt, hsa; identical to SEQ ID NO: 261645

SEQ ID NO: 638496 - RNA, 64 nt, hsa; identical to SEQ ID NO: 261646

SEQ ID NO: 638497 - RNA, 64 nt, hsa; identical to SEQ ID NO: 261647

SEQ ID NO: 638498 - RNA, 64 nt, hsa; identical to SEQ ID NO: 261648

SEQ ID NO: 638499 - RNA, 64 nt, hsa
gucugucuguaaggcguagaaucuguccgucuguaaggcguagaaugaggguuguuaauccauc

SEQ ID NO: 638500 - RNA, 64 nt, hsa
cuuuuccuuuuagguuuaaguccugucugucuguaaggcguagaaucuguccgucuguaaggcg

SEQ ID NO: 638501 - RNA, 64 nt, hsa; identical to SEQ ID NO: 156691

SEQ ID NO: 638502 - RNA, 64 nt, hsa; identical to SEQ ID NO: 156692

SEQ ID NO: 638503 - RNA, 64 nt, hsa; identical to SEQ ID NO: 156693

SEQ ID NO: 638504 - RNA, 64 nt, hsa; identical to SEQ ID NO: 156694

SEQ ID NO: 638505 - RNA, 64 nt, hsa; identical to SEQ ID NO: 156695

SEQ ID NO: 638506 - RNA, 64 nt, hsa; identical to SEQ ID NO: 156696

SEQ ID NO: 638507 - RNA, 64 nt, hsa; identical to SEQ ID NO: 156697

SEQ ID NO: 638508 - RNA, 64 nt, hsa; identical to SEQ ID NO: 156698

SEQ ID NO: 638509 - RNA, 64 nt, hsa; identical to SEQ ID NO: 156699

SEQ ID NO: 638510 - RNA, 64 nt, hsa; identical to SEQ ID NO: 156700

SEQ ID NO: 638511 - RNA, 64 nt, hsa; identical to SEQ ID NO: 156701

SEQ ID NO: 638512 - RNA, 64 nt, hsa; identical to SEQ ID NO: 156702

SEQ ID NO: 638513 - RNA, 64 nt, hsa; identical to SEQ ID NO: 156703

SEQ ID NO: 638514 - RNA, 64 nt, hsa; identical to SEQ ID NO: 156704

SEQ ID NO: 638515 - RNA, 64 nt, hsa; identical to SEQ ID NO: 156705

SEQ ID NO: 638516 - RNA, 64 nt, hsa; identical to SEQ ID NO: 156706

SEQ ID NO: 638517 - RNA, 64 nt, hsa; identical to SEQ ID NO: 156707

SEQ ID NO: 638518 - RNA, 64 nt, hsa; identical to SEQ ID NO: 156708

SEQ ID NO: 638519 - RNA, 64 nt, hsa; identical to SEQ ID NO: 156709

SEQ ID NO: 638520 - RNA, 64 nt, hsa; identical to SEQ ID NO: 156710

SEQ ID NO: 638521 - RNA, 64 nt, hsa; identical to SEQ ID NO: 156711

SEQ ID NO: 638522 - RNA, 64 nt, hsa; identical to SEQ ID NO: 156712

SEQ ID NO: 638523 - RNA, 64 nt, hsa; identical to SEQ ID NO: 156713

SEQ ID NO: 638524 - RNA, 64 nt, hsa; identical to SEQ ID NO: 156714

SEQ ID NO: 638525 - RNA, 64 nt, hsa; identical to SEQ ID NO: 156715

SEQ ID NO: 638526 - RNA, 64 nt, hsa; identical to SEQ ID NO: 156716

SEQ ID NO: 638527 - RNA, 64 nt, hsa; identical to SEQ ID NO: 156717

SEQ ID NO: 638528 - RNA, 64 nt, hsa; identical to SEQ ID NO: 156718

SEQ ID NO: 638529 - RNA, 64 nt, hsa; identical to SEQ ID NO: 156719

SEQ ID NO: 638530 - RNA, 64 nt, hsa; identical to SEQ ID NO: 156720

SEQ ID NO: 638531 - RNA, 64 nt, hsa; identical to SEQ ID NO: 156721

SEQ ID NO: 638532 - RNA, 64 nt, hsa; identical to SEQ ID NO: 156722

SEQ ID NO: 638533 - RNA, 64 nt, hsa; identical to SEQ ID NO: 156723

SEQ ID NO: 638534 - RNA, 50 nt, hsa; identical to SEQ ID NO: 156724

SEQ ID NO: 638535 - RNA, 64 nt, hsa; identical to SEQ ID NO: 156725

SEQ ID NO: 638536 - RNA, 64 nt, hsa; identical to SEQ ID NO: 156726

SEQ ID NO: 638537 - RNA, 64 nt, hsa; identical to SEQ ID NO: 156727

SEQ ID NO: 638538 - RNA, 64 nt, hsa; identical to SEQ ID NO: 156728

SEQ ID NO: 638539 - RNA, 64 nt, hsa; identical to SEQ ID NO: 156729

SEQ ID NO: 638540 - RNA, 64 nt, hsa; identical to SEQ ID NO: 156730

SEQ ID NO: 638541 - RNA, 64 nt, hsa; identical to SEQ ID NO: 156731

SEQ ID NO: 638542 - RNA, 64 nt, hsa; identical to SEQ ID NO: 156732

SEQ ID NO: 638543 - RNA, 64 nt, hsa; identical to SEQ ID NO: 156733

SEQ ID NO: 638544 - RNA, 64 nt, hsa; identical to SEQ ID NO: 156734

SEQ ID NO: 638545 - RNA, 64 nt, hsa; identical to SEQ ID NO: 156735

SEQ ID NO: 638546 - RNA, 64 nt, hsa; identical to SEQ ID NO: 156736

SEQ ID NO: 638547 - RNA, 64 nt, hsa; identical to SEQ ID NO: 156737

SEQ ID NO: 638548 - RNA, 64 nt, hsa; identical to SEQ ID NO: 156738

SEQ ID NO: 638549 - RNA, 64 nt, hsa
cuccccucgugucagcucaggcagcucgaggcccccgaccaacacuugcaggggucccugcuag

SEQ ID NO: 638550 - RNA, 64 nt, hsa
guuuuguuucguguguuguuuguaaagcugccauccgaccaaggucuccugugcugaaguugcc

SEQ ID NO: 638551 - RNA, 64 nt, hsa
ccucaaaacaaacaagagauggcaaagcagcaguccgaccaagcccacuggaauuauccuuuaa

SEQ ID NO: 638552 - RNA, 64 nt, hsa
gaccuucugugggguuuggggaucuccaggaagcccgaccaagcuguccccuuccccugugcca

SEQ ID NO: 638553 - RNA, 64 nt, hsa
uggaccacauucggaaggggaacuuagagaucacccgaccaacccuucguuuuacaguugccca

SEQ ID NO: 638554 - RNA, 64 nt, hsa
gugggucaccugagguugggaguucgagaccagcccgaccaacauggugaaaccccgucucuac

SEQ ID NO: 638555 - RNA, 64 nt, hsa
gaggugaaaaaugguuguauggcuguugguuuuaccgaccaaaugaaacauuccaccuggcuac

SEQ ID NO: 638556 - RNA, 64 nt, hsa
cuuucugauaaucagagagaacguuuugucuaguccgaccaagagcgaaggaauguuuguuugu

SEQ ID NO: 638557 - RNA, 64 nt, hsa
auccugaugccccagguuauccacagccuccuucccgaccaagacccuauccaccuggaccucc

SEQ ID NO: 638558 - RNA, 64 nt, hsa
ucucaugacagcuccaucaagaaugugggaugugccgaccaaggauuugagaaaguuguacaga

SEQ ID NO: 638559 - RNA, 64 nt, hsa
ggacccagagcgagauggguuuguucggugccagccgaccaagauugacuaguuuguuggacuu

SEQ ID NO: 638560 - RNA, 64 nt, hsa
cgggcggaucaugaggucaggaguucgagaccaaccgaccaacauggugaaaccccaucuuuac

SEQ ID NO: 638561 - RNA, 64 nt, hsa
ccuugccagcugaccuucaaacccugcauuugaaccgaccaacauuaaguccagagaguaaacu

SEQ ID NO: 638562 - RNA, 64 nt, hsa
gcuucuuagggcccucucccugccccagcuuuccccgaccaaucacgccuacagugcuuugaag

SEQ ID NO: 638563 - RNA, 64 nt, hsa
agucaaauaaugaauuucuuccucccucucgcaaccgaccaaaauuuugacaacgaugauguuc

SEQ ID NO: 638564 - RNA, 64 nt, hsa
ccaccugcagccucccuggguggccuaggcucccccgaccaagagaccucccucucaugaucac

SEQ ID NO: 638565 - RNA, 64 nt, hsa
cuccuuccucuccccuggggcugggaggcuccauccgaccaaugucuguaaagugcuuugagga

SEQ ID NO: 638566 - RNA, 64 nt, hsa
cccuccacucuucccgcgaacaucacaccguuccccgaccaagccgugugcaauacaacagagg

SEQ ID NO: 638567 - RNA, 64 nt, hsa
uuugaccucagugaucacgagaagaaagccaugaccgaccaauauguugacauacugauccucu

SEQ ID NO: 638568 - RNA, 64 nt, hsa
uauuaugcagcuuauuuuaccugaaacuguuaagccgaccaagaucccucccugcaagacagau

SEQ ID NO: 638569 - RNA, 64 nt, hsa
cccccagggucccaaggccccgcagcuuccucccccgaccaaaccccaagaccuggaucccagg

SEQ ID NO: 638570 - RNA, 64 nt, hsa
gugugaaggagaagaggcaagaacgaccccuggaccgaccaaagcccgcgcgcugcugcguccc

SEQ ID NO: 638571 - RNA, 64 nt, hsa
agccuguuggcaagagcugguauucccugcccagccgaccaaaugaccucugcauucuucaggu

SEQ ID NO: 638572 - RNA, 64 nt, hsa
ugccagacacugcgccccgccugaccugggggagccgaccaauuagucacugcugcuacugccc

SEQ ID NO: 638573 - RNA, 64 nt, hsa
gcggaucaccugaggucgggaguuugagaccagcccgaccaacauggagaaacccugucucuac

SEQ ID NO: 638574 - RNA, 64 nt, hsa
gccuccugcuguggcagaggagcagcugggauucccgaccaaagccccagggggugcagaagac

SEQ ID NO: 638575 - RNA, 64 nt, hsa
aaacccaaagcaaguagugaucauaguacagaacccgaccaaaguaggcuggugaggaagucca

SEQ ID NO: 638576 - RNA, 64 nt, hsa
ccuucucugggucugauuuucucacugaacuccaccgaccaacugcccuaagcccccagggccu

SEQ ID NO: 638577 - RNA, 64 nt, hsa
gaaccucucacguugcuguguccuggugagcagcccgaccaauaaaccugcuuuucuaaaagga

SEQ ID NO: 638578 - RNA, 64 nt, hsa
ugguauggagggauuaacucagucauggcauucuccgaccaaaaccacaccugugucucuggca

SEQ ID NO: 638579 - RNA, 64 nt, hsa
gacccucagcccuggccuuuuucuuuaaggucccccgaccaauccccagccuaggacgccaacu

SEQ ID NO: 638580 - RNA, 64 nt, hsa
augacagggcagggggcagucuuccucccccuccccgaccaaaccucggggagcccuccugugc

SEQ ID NO: 638581 - RNA, 64 nt, hsa
guucaggagaccggccuguuccugaguuugagugccgaccaacccccaggauggcggaagcuca

SEQ ID NO: 638582 - RNA, 64 nt, hsa
gugcucgccuucggccucucuuggaacugcaccaccgaccaacuccagacuugggagcuuuaaa

SEQ ID NO: 638583 - RNA, 64 nt, hsa
ugugucccuugauaacagugacuuaacaauauacauuccucauaaauaaaaaaaaaacaagaau

SEQ ID NO: 638584 - RNA, 64 nt, hsa
gucauacuagggugugagagagguaggucguagcauuccucaucacauggucaggggauuuuuu

SEQ ID NO: 638585 - RNA, 64 nt, hsa
guaccuuuguacccagacaaaacaauuauguuacauuccucaaaguggcaugggcuuucuucuc

SEQ ID NO: 638586 - RNA, 64 nt, hsa
gcugagucuguggaaugauacuucugaaaucaaaauuccucauaaggcaugaaguuguaaaaac

SEQ ID NO: 638587 - RNA, 64 nt, hsa
ugcuacguucuuucuucaugccuaugugugcuccauuccucauuucuacuuggcucaagaaaac

SEQ ID NO: 638588 - RNA, 64 nt, hsa
guaagacuuuuaagaaaagaaaaaguuaugccucauuccucauguggcuuccaauaaguaucuu

SEQ ID NO: 638589 - RNA, 64 nt, hsa
uuucuuuugaucgugcacuuauagucuucauuuaauuccucauagaaucccagucaccuuuaua

SEQ ID NO: 638590 - RNA, 64 nt, hsa
aauuaccuuuauauaucauauguuauuggaagagauuccucaguaaucuccaaucucucauagu

SEQ ID NO: 638591 - RNA, 64 nt, hsa
uguuaauuuuaaggucuuuaucauuuaaagaaacauuccucaguguaacauuugggaggggauu

SEQ ID NO: 638592 - RNA, 64 nt, hsa
uguuucucuguggacugggcaaggugggguauuuauuccucacuagcuggguuaccaucuucag

SEQ ID NO: 638593 - RNA, 64 nt, hsa
uuaugugaucaguuuuggggguuaacuuugcuuaauuccucaggcuuugcgauuuaaggaggag

SEQ ID NO: 638594 - RNA, 64 nt, hsa
aucuuuuuuuauuauuaaaagcaaguuucuuuguauuccucacccuagauuuguauaaaugccu

SEQ ID NO: 638595 - RNA, 64 nt, hsa
caguggcuggggaaacccuuccuagucucacuugauuccucaugacggaaaucacacuaaagag

SEQ ID NO: 638596 - RNA, 64 nt, hsa
cacuguugcugagguugaaaauaaucaugcagucauuccucaauuacugccugcagcaauuccu

SEQ ID NO: 638597 - RNA, 64 nt, hsa
gagugcggugaugaacuuacgugacaaugauuguauuccucaguagcacuuuaaacgccgaaga

SEQ ID NO: 638598 - RNA, 64 nt, hsa
gaugaaaguuuugcccaguuguguuuuaaaaacaauuccucaugaacacuaagauuaauugugu

SEQ ID NO: 638599 - RNA, 64 nt, hsa
ugauucucaucauugggagaucuuaaaucuuagcaagcauuagcaauauuaaaugccaaaauuc

SEQ ID NO: 638600 - RNA, 64 nt, hsa
ucagguuucuacaaauaggguaauuguaaauuuaaagcauuagcauuuauuggugaauaaugua

SEQ ID NO: 638601 - RNA, 64 nt, hsa
cucuuguaaauggaaugguuugggguuuuuaaauaagcauuaacuaacaaccuuucuauaguua

SEQ ID NO: 638602 - RNA, 64 nt, hsa
aaaguguuugagaacuucauccaaaccuacuuuaaagcauuaugugcaauuaaguuguuaugac

SEQ ID NO: 638603 - RNA, 63 nt, hsa
cccggacgcuggucaugugagacauuuccagaaaagcauuaugguuuucagaacacuucaagu

SEQ ID NO: 638604 - RNA, 64 nt, hsa
cuaaacauaugcauauauuuuuaaaaaucaguaaaagcauuacucuaaguguagacuuaauacc

SEQ ID NO: 638605 - RNA, 64 nt, hsa
uugcugaagaaugugucugugguuaggauagcacaagcauuaacuuuuguuuuauaguuaugcu

SEQ ID NO: 638606 - RNA, 64 nt, hsa
ucccuuauauggcaaucaggcagaggcguuccuuaagcauuagagaguucugaagcuuaagauu

SEQ ID NO: 638607 - RNA, 64 nt, hsa
aaaugcauauauuuagcggguauuugaaagauagaagcauuauuuauaacugaagaguauaaca

SEQ ID NO: 638608 - RNA, 64 nt, hsa
cugauauauuuaauaagagguauagaagcucuucaagcauuaaaauagaguugauguuucauuc

SEQ ID NO: 638609 - RNA, 64 nt, hsa
aauauuguaaaaccuacaugagcagaugaaauagaagcauuaaauauuuuuaucuauauccaaa

SEQ ID NO: 638610 - RNA, 64 nt, hsa
gcagccacuggaaauacauucugugguguccuagaagcauuauugguagguucuaaaguuuucu

SEQ ID NO: 638611 - RNA, 64 nt, hsa
ccaggucuuauguucccaggcccugucuucuggaaagcauuacugggaaguggacacuaggaau

SEQ ID NO: 638612 - RNA, 64 nt, hsa
aucauuguagccacacaucauugcugggagaauuaagcauuauccugaagacucugccaggaga

SEQ ID NO: 638613 - RNA, 64 nt, hsa
gcagcugcaggcaagcauuaugcugcuauugaagaagcauuagggguaugccuggcagguguga

SEQ ID NO: 638614 - RNA, 64 nt, hsa
gcuccuccaaaguucuggcuuagcagcugcaggcaagcauuaugcugcuauugaagaagcauua

SEQ ID NO: 638615 - RNA, 64 nt, hsa
ugggaaagccuuuaagcaguccucaacucuuacuaagcauuaaauauuggccgggugcgguggc

SEQ ID NO: 638616 - RNA, 64 nt, hsa
auuuuacucaacacagagaguuccugcuuaauaaaagcauuauaagugcaauuacugucaaaag

SEQ ID NO: 638617 - RNA, 64 nt, hsa
ugaccugaguuugaguugacuuaacauugaguuuaagcauuaauugacauuaaacuguuuaugu

SEQ ID NO: 638618 - RNA, 64 nt, hsa
guuguuucaaaugccauuaguauagcaagccaucaagcauuaauugacauuacaguuaaaugag

SEQ ID NO: 638619 - RNA, 64 nt, hsa
cuugaccugaguuuguugauuuaacauugauuucaagcauuaauugccauuaaacuguuuaugu

SEQ ID NO: 638620 - RNA, 64 nt, hsa
guuguuucaaaugcagugaguauagcaaaccaucaagcauuaauugacauuagagucaaaucag

SEQ ID NO: 638621 - RNA, 64 nt, hsa
ggaaaaaucuauauaaaacaguaucagugugucaaagcauuauggcugucacaagcuugugaaa

SEQ ID NO: 638622 - RNA, 64 nt, hsa
ugaccugaguuugaguugacuuaacauugauuucaagcauuaaucgacauuaaacuguuuaugu

SEQ ID NO: 638623 - RNA, 64 nt, hsa; identical to SEQ ID NO: 182986

SEQ ID NO: 638624 - RNA, 64 nt, hsa; identical to SEQ ID NO: 182987

SEQ ID NO: 638625 - RNA, 64 nt, hsa; identical to SEQ ID NO: 182988

SEQ ID NO: 638626 - RNA, 64 nt, hsa; identical to SEQ ID NO: 182989

SEQ ID NO: 638627 - RNA, 64 nt, hsa; identical to SEQ ID NO: 182990

SEQ ID NO: 638628 - RNA, 64 nt, hsa; identical to SEQ ID NO: 182991

SEQ ID NO: 638629 - RNA, 64 nt, hsa; identical to SEQ ID NO: 182992

SEQ ID NO: 638630 - RNA, 64 nt, hsa; identical to SEQ ID NO: 182993

SEQ ID NO: 638631 - RNA, 64 nt, hsa; identical to SEQ ID NO: 182994

SEQ ID NO: 638632 - RNA, 64 nt, hsa; identical to SEQ ID NO: 182995

SEQ ID NO: 638633 - RNA, 64 nt, hsa; identical to SEQ ID NO: 182996

SEQ ID NO: 638634 - RNA, 64 nt, hsa; identical to SEQ ID NO: 182997

SEQ ID NO: 638635 - RNA, 64 nt, hsa; identical to SEQ ID NO: 182998

SEQ ID NO: 638636 - RNA, 64 nt, hsa; identical to SEQ ID NO: 182999

SEQ ID NO: 638637 - RNA, 64 nt, hsa; identical to SEQ ID NO: 183000

SEQ ID NO: 638638 - RNA, 64 nt, hsa; identical to SEQ ID NO: 183001

SEQ ID NO: 638639 - RNA, 64 nt, hsa; identical to SEQ ID NO: 183002

SEQ ID NO: 638640 - RNA, 64 nt, hsa; identical to SEQ ID NO: 183003

SEQ ID NO: 638641 - RNA, 64 nt, hsa; identical to SEQ ID NO: 183004

SEQ ID NO: 638642 - RNA, 64 nt, hsa; identical to SEQ ID NO: 183005

SEQ ID NO: 638643 - RNA, 64 nt, hsa; identical to SEQ ID NO: 183006

SEQ ID NO: 638644 - RNA, 64 nt, hsa; identical to SEQ ID NO: 183007

SEQ ID NO: 638645 - RNA, 64 nt, hsa; identical to SEQ ID NO: 183008

SEQ ID NO: 638646 - RNA, 64 nt, hsa; identical to SEQ ID NO: 183009

SEQ ID NO: 638647 - RNA, 64 nt, hsa; identical to SEQ ID NO: 183010

SEQ ID NO: 638648 - RNA, 64 nt, hsa; identical to SEQ ID NO: 183011

SEQ ID NO: 638649 - RNA, 64 nt, hsa; identical to SEQ ID NO: 183012

SEQ ID NO: 638650 - RNA, 64 nt, hsa; identical to SEQ ID NO: 183013

SEQ ID NO: 638651 - RNA, 64 nt, hsa; identical to SEQ ID NO: 183014

SEQ ID NO: 638652 - RNA, 64 nt, hsa; identical to SEQ ID NO: 183015

SEQ ID NO: 638653 - RNA, 64 nt, hsa; identical to SEQ ID NO: 183016

SEQ ID NO: 638654 - RNA, 64 nt, hsa; identical to SEQ ID NO: 183017

SEQ ID NO: 638655 - RNA, 64 nt, hsa; identical to SEQ ID NO: 183018

SEQ ID NO: 638656 - RNA, 64 nt, hsa; identical to SEQ ID NO: 183019

SEQ ID NO: 638657 - RNA, 64 nt, hsa; identical to SEQ ID NO: 183020

SEQ ID NO: 638658 - RNA, 64 nt, hsa; identical to SEQ ID NO: 183021

SEQ ID NO: 638659 - RNA, 64 nt, hsa; identical to SEQ ID NO: 183022

SEQ ID NO: 638660 - RNA, 64 nt, hsa; identical to SEQ ID NO: 183023

SEQ ID NO: 638661 - RNA, 64 nt, hsa; identical to SEQ ID NO: 183024

SEQ ID NO: 638662 - RNA, 64 nt, hsa; identical to SEQ ID NO: 183025

SEQ ID NO: 638663 - RNA, 64 nt, hsa; identical to SEQ ID NO: 183026

SEQ ID NO: 638664 - RNA, 64 nt, hsa; identical to SEQ ID NO: 183027

SEQ ID NO: 638665 - RNA, 64 nt, hsa; identical to SEQ ID NO: 183028

SEQ ID NO: 638666 - RNA, 64 nt, hsa; identical to SEQ ID NO: 183029

SEQ ID NO: 638667 - RNA, 64 nt, hsa; identical to SEQ ID NO: 183030

SEQ ID NO: 638668 - RNA, 64 nt, hsa; identical to SEQ ID NO: 183031

SEQ ID NO: 638669 - RNA, 64 nt, hsa; identical to SEQ ID NO: 183032

SEQ ID NO: 638670 - RNA, 64 nt, hsa; identical to SEQ ID NO: 183033

SEQ ID NO: 638671 - RNA, 64 nt, hsa; identical to SEQ ID NO: 183034

SEQ ID NO: 638672 - RNA, 64 nt, hsa; identical to SEQ ID NO: 183035

SEQ ID NO: 638673 - RNA, 64 nt, hsa; identical to SEQ ID NO: 183036

SEQ ID NO: 638674 - RNA, 64 nt, hsa; identical to SEQ ID NO: 183037

SEQ ID NO: 638675 - RNA, 64 nt, hsa; identical to SEQ ID NO: 183038

SEQ ID NO: 638676 - RNA, 64 nt, hsa; identical to SEQ ID NO: 183039

SEQ ID NO: 638677 - RNA, 64 nt, hsa; identical to SEQ ID NO: 183040

SEQ ID NO: 638678 - RNA, 64 nt, hsa; identical to SEQ ID NO: 183041

SEQ ID NO: 638679 - RNA, 64 nt, hsa; identical to SEQ ID NO: 183042

SEQ ID NO: 638680 - RNA, 64 nt, hsa; identical to SEQ ID NO: 183043

SEQ ID NO: 638681 - RNA, 64 nt, hsa; identical to SEQ ID NO: 183044

SEQ ID NO: 638682 - RNA, 64 nt, hsa; identical to SEQ ID NO: 183045

SEQ ID NO: 638683 - RNA, 64 nt, hsa; identical to SEQ ID NO: 183046

SEQ ID NO: 638684 - RNA, 64 nt, hsa; identical to SEQ ID NO: 183047

SEQ ID NO: 638685 - RNA, 64 nt, hsa; identical to SEQ ID NO: 183048

SEQ ID NO: 638686 - RNA, 64 nt, hsa; identical to SEQ ID NO: 183049

SEQ ID NO: 638687 - RNA, 64 nt, hsa; identical to SEQ ID NO: 183050

SEQ ID NO: 638688 - RNA, 64 nt, hsa; identical to SEQ ID NO: 183051

SEQ ID NO: 638689 - RNA, 64 nt, hsa; identical to SEQ ID NO: 183052

SEQ ID NO: 638690 - RNA, 64 nt, hsa; identical to SEQ ID NO: 183053

SEQ ID NO: 638691 - RNA, 64 nt, hsa; identical to SEQ ID NO: 183054

SEQ ID NO: 638692 - RNA, 64 nt, hsa; identical to SEQ ID NO: 183055

SEQ ID NO: 638693 - RNA, 64 nt, hsa; identical to SEQ ID NO: 183056

SEQ ID NO: 638694 - RNA, 64 nt, hsa; identical to SEQ ID NO: 183057

SEQ ID NO: 638695 - RNA, 64 nt, hsa; identical to SEQ ID NO: 183058

SEQ ID NO: 638696 - RNA, 64 nt, hsa; identical to SEQ ID NO: 183059

SEQ ID NO: 638697 - RNA, 64 nt, hsa; identical to SEQ ID NO: 183060

SEQ ID NO: 638698 - RNA, 64 nt, hsa; identical to SEQ ID NO: 183061

SEQ ID NO: 638699 - RNA, 64 nt, hsa; identical to SEQ ID NO: 183062

SEQ ID NO: 638700 - RNA, 64 nt, hsa; identical to SEQ ID NO: 183063

SEQ ID NO: 638701 - RNA, 64 nt, hsa; identical to SEQ ID NO: 183064

SEQ ID NO: 638702 - RNA, 64 nt, hsa; identical to SEQ ID NO: 183065

SEQ ID NO: 638703 - RNA, 64 nt, hsa; identical to SEQ ID NO: 183066

SEQ ID NO: 638704 - RNA, 64 nt, hsa; identical to SEQ ID NO: 183067

SEQ ID NO: 638705 - RNA, 64 nt, hsa; identical to SEQ ID NO: 183068

SEQ ID NO: 638706 - RNA, 64 nt, hsa; identical to SEQ ID NO: 183069

SEQ ID NO: 638707 - RNA, 64 nt, hsa; identical to SEQ ID NO: 183070

SEQ ID NO: 638708 - RNA, 64 nt, hsa; identical to SEQ ID NO: 183071

SEQ ID NO: 638709 - RNA, 64 nt, hsa; identical to SEQ ID NO: 183072

SEQ ID NO: 638710 - RNA, 64 nt, hsa; identical to SEQ ID NO: 183073

SEQ ID NO: 638711 - RNA, 64 nt, hsa; identical to SEQ ID NO: 183074

SEQ ID NO: 638712 - RNA, 64 nt, hsa; identical to SEQ ID NO: 183075

SEQ ID NO: 638713 - RNA, 64 nt, hsa; identical to SEQ ID NO: 183076

SEQ ID NO: 638714 - RNA, 64 nt, hsa; identical to SEQ ID NO: 183077

SEQ ID NO: 638715 - RNA, 64 nt, hsa; identical to SEQ ID NO: 183078

SEQ ID NO: 638716 - RNA, 64 nt, hsa; identical to SEQ ID NO: 183079

SEQ ID NO: 638717 - RNA, 64 nt, hsa; identical to SEQ ID NO: 183080

SEQ ID NO: 638718 - RNA, 64 nt, hsa; identical to SEQ ID NO: 183081

SEQ ID NO: 638719 - RNA, 64 nt, hsa; identical to SEQ ID NO: 183082

SEQ ID NO: 638720 - RNA, 64 nt, hsa; identical to SEQ ID NO: 183083

SEQ ID NO: 638721 - RNA, 64 nt, hsa; identical to SEQ ID NO: 183084

SEQ ID NO: 638722 - RNA, 64 nt, hsa; identical to SEQ ID NO: 183085

SEQ ID NO: 638723 - RNA, 64 nt, hsa; identical to SEQ ID NO: 183086

SEQ ID NO: 638724 - RNA, 64 nt, hsa; identical to SEQ ID NO: 183087

SEQ ID NO: 638725 - RNA, 64 nt, hsa; identical to SEQ ID NO: 183088

SEQ ID NO: 638726 - RNA, 64 nt, hsa; identical to SEQ ID NO: 183089

SEQ ID NO: 638727 - RNA, 64 nt, hsa; identical to SEQ ID NO: 183090

SEQ ID NO: 638728 - RNA, 64 nt, hsa; identical to SEQ ID NO: 183091

SEQ ID NO: 638729 - RNA, 64 nt, hsa; identical to SEQ ID NO: 183092

SEQ ID NO: 638730 - RNA, 64 nt, hsa; identical to SEQ ID NO: 183093

SEQ ID NO: 638731 - RNA, 64 nt, hsa; identical to SEQ ID NO: 183094

SEQ ID NO: 638732 - RNA, 64 nt, hsa; identical to SEQ ID NO: 183095

SEQ ID NO: 638733 - RNA, 64 nt, hsa; identical to SEQ ID NO: 183096

SEQ ID NO: 638734 - RNA, 64 nt, hsa; identical to SEQ ID NO: 183097

SEQ ID NO: 638735 - RNA, 64 nt, hsa; identical to SEQ ID NO: 183098

SEQ ID NO: 638736 - RNA, 64 nt, hsa; identical to SEQ ID NO: 183099

SEQ ID NO: 638737 - RNA, 64 nt, hsa; identical to SEQ ID NO: 183100

SEQ ID NO: 638738 - RNA, 64 nt, hsa; identical to SEQ ID NO: 183101

SEQ ID NO: 638739 - RNA, 64 nt, hsa; identical to SEQ ID NO: 183102

SEQ ID NO: 638740 - RNA, 64 nt, hsa; identical to SEQ ID NO: 183103

SEQ ID NO: 638741 - RNA, 64 nt, hsa; identical to SEQ ID NO: 183104

SEQ ID NO: 638742 - RNA, 64 nt, hsa; identical to SEQ ID NO: 183105

SEQ ID NO: 638743 - RNA, 64 nt, hsa; identical to SEQ ID NO: 183106

SEQ ID NO: 638744 - RNA, 64 nt, hsa; identical to SEQ ID NO: 183107

SEQ ID NO: 638745 - RNA, 64 nt, hsa; identical to SEQ ID NO: 183108

SEQ ID NO: 638746 - RNA, 64 nt, hsa; identical to SEQ ID NO: 183109

SEQ ID NO: 638747 - RNA, 64 nt, hsa; identical to SEQ ID NO: 183110

SEQ ID NO: 638748 - RNA, 64 nt, hsa; identical to SEQ ID NO: 183111

SEQ ID NO: 638749 - RNA, 64 nt, hsa; identical to SEQ ID NO: 183112

SEQ ID NO: 638750 - RNA, 64 nt, hsa; identical to SEQ ID NO: 183113

SEQ ID NO: 638751 - RNA, 64 nt, hsa; identical to SEQ ID NO: 183114

SEQ ID NO: 638752 - RNA, 64 nt, hsa; identical to SEQ ID NO: 183115

SEQ ID NO: 638753 - RNA, 64 nt, hsa; identical to SEQ ID NO: 183116

SEQ ID NO: 638754 - RNA, 64 nt, hsa; identical to SEQ ID NO: 183117

SEQ ID NO: 638755 - RNA, 64 nt, hsa; identical to SEQ ID NO: 183118

SEQ ID NO: 638756 - RNA, 64 nt, hsa; identical to SEQ ID NO: 183119

SEQ ID NO: 638757 - RNA, 64 nt, hsa; identical to SEQ ID NO: 183120

SEQ ID NO: 638758 - RNA, 64 nt, hsa; identical to SEQ ID NO: 183121

SEQ ID NO: 638759 - RNA, 64 nt, hsa; identical to SEQ ID NO: 183122

SEQ ID NO: 638760 - RNA, 64 nt, hsa; identical to SEQ ID NO: 183123

SEQ ID NO: 638761 - RNA, 64 nt, hsa; identical to SEQ ID NO: 183124

SEQ ID NO: 638762 - RNA, 64 nt, hsa; identical to SEQ ID NO: 183125

SEQ ID NO: 638763 - RNA, 64 nt, hsa; identical to SEQ ID NO: 183126

SEQ ID NO: 638764 - RNA, 64 nt, hsa; identical to SEQ ID NO: 183127

SEQ ID NO: 638765 - RNA, 64 nt, hsa; identical to SEQ ID NO: 183128

SEQ ID NO: 638766 - RNA, 64 nt, hsa; identical to SEQ ID NO: 183129

SEQ ID NO: 638767 - RNA, 64 nt, hsa; identical to SEQ ID NO: 183130

SEQ ID NO: 638768 - RNA, 64 nt, hsa; identical to SEQ ID NO: 183131

SEQ ID NO: 638769 - RNA, 64 nt, hsa; identical to SEQ ID NO: 183132

SEQ ID NO: 638770 - RNA, 64 nt, hsa; identical to SEQ ID NO: 183133

SEQ ID NO: 638771 - RNA, 64 nt, hsa; identical to SEQ ID NO: 183134

SEQ ID NO: 638772 - RNA, 64 nt, hsa; identical to SEQ ID NO: 183135

SEQ ID NO: 638773 - RNA, 64 nt, hsa; identical to SEQ ID NO: 183136

SEQ ID NO: 638774 - RNA, 64 nt, hsa; identical to SEQ ID NO: 183137

SEQ ID NO: 638775 - RNA, 64 nt, hsa; identical to SEQ ID NO: 183138

SEQ ID NO: 638776 - RNA, 64 nt, hsa; identical to SEQ ID NO: 183139

SEQ ID NO: 638777 - RNA, 64 nt, hsa; identical to SEQ ID NO: 183140

SEQ ID NO: 638778 - RNA, 64 nt, hsa; identical to SEQ ID NO: 183141

SEQ ID NO: 638779 - RNA, 64 nt, hsa; identical to SEQ ID NO: 183142

SEQ ID NO: 638780 - RNA, 64 nt, hsa; identical to SEQ ID NO: 183143

SEQ ID NO: 638781 - RNA, 64 nt, hsa; identical to SEQ ID NO: 183144

SEQ ID NO: 638782 - RNA, 64 nt, hsa; identical to SEQ ID NO: 183145

SEQ ID NO: 638783 - RNA, 64 nt, hsa; identical to SEQ ID NO: 183146

SEQ ID NO: 638784 - RNA, 64 nt, hsa; identical to SEQ ID NO: 183147

SEQ ID NO: 638785 - RNA, 64 nt, hsa; identical to SEQ ID NO: 183148

SEQ ID NO: 638786 - RNA, 64 nt, hsa; identical to SEQ ID NO: 183149

SEQ ID NO: 638787 - RNA, 64 nt, hsa; identical to SEQ ID NO: 183150

SEQ ID NO: 638788 - RNA, 64 nt, hsa; identical to SEQ ID NO: 183151

SEQ ID NO: 638789 - RNA, 64 nt, hsa; identical to SEQ ID NO: 183152

SEQ ID NO: 638790 - RNA, 64 nt, hsa; identical to SEQ ID NO: 183153

SEQ ID NO: 638791 - RNA, 64 nt, hsa; identical to SEQ ID NO: 183154

SEQ ID NO: 638792 - RNA, 64 nt, hsa; identical to SEQ ID NO: 183155

SEQ ID NO: 638793 - RNA, 64 nt, hsa; identical to SEQ ID NO: 183156

SEQ ID NO: 638794 - RNA, 64 nt, hsa; identical to SEQ ID NO: 183157

SEQ ID NO: 638795 - RNA, 64 nt, hsa; identical to SEQ ID NO: 183158

SEQ ID NO: 638796 - RNA, 64 nt, hsa; identical to SEQ ID NO: 183159

SEQ ID NO: 638797 - RNA, 64 nt, hsa; identical to SEQ ID NO: 183160

SEQ ID NO: 638798 - RNA, 64 nt, hsa; identical to SEQ ID NO: 183161

SEQ ID NO: 638799 - RNA, 64 nt, hsa; identical to SEQ ID NO: 183162

SEQ ID NO: 638800 - RNA, 64 nt, hsa; identical to SEQ ID NO: 183163

SEQ ID NO: 638801 - RNA, 64 nt, hsa; identical to SEQ ID NO: 183164

SEQ ID NO: 638802 - RNA, 64 nt, hsa; identical to SEQ ID NO: 183165

SEQ ID NO: 638803 - RNA, 64 nt, hsa; identical to SEQ ID NO: 183166

SEQ ID NO: 638804 - RNA, 64 nt, hsa; identical to SEQ ID NO: 183167

SEQ ID NO: 638805 - RNA, 64 nt, hsa; identical to SEQ ID NO: 183168

SEQ ID NO: 638806 - RNA, 64 nt, hsa; identical to SEQ ID NO: 183169

SEQ ID NO: 638807 - RNA, 64 nt, hsa; identical to SEQ ID NO: 183170

SEQ ID NO: 638808 - RNA, 64 nt, hsa; identical to SEQ ID NO: 183171

SEQ ID NO: 638809 - RNA, 64 nt, hsa; identical to SEQ ID NO: 183172

SEQ ID NO: 638810 - RNA, 64 nt, hsa; identical to SEQ ID NO: 183173

SEQ ID NO: 638811 - RNA, 64 nt, hsa; identical to SEQ ID NO: 183174

SEQ ID NO: 638812 - RNA, 64 nt, hsa; identical to SEQ ID NO: 183175

SEQ ID NO: 638813 - RNA, 64 nt, hsa; identical to SEQ ID NO: 183176

SEQ ID NO: 638814 - RNA, 64 nt, hsa; identical to SEQ ID NO: 183177

SEQ ID NO: 638815 - RNA, 64 nt, hsa; identical to SEQ ID NO: 183178

SEQ ID NO: 638816 - RNA, 64 nt, hsa; identical to SEQ ID NO: 183179

SEQ ID NO: 638817 - RNA, 64 nt, hsa; identical to SEQ ID NO: 183180

SEQ ID NO: 638818 - RNA, 64 nt, hsa; identical to SEQ ID NO: 183181

SEQ ID NO: 638819 - RNA, 64 nt, hsa; identical to SEQ ID NO: 183182

SEQ ID NO: 638820 - RNA, 64 nt, hsa; identical to SEQ ID NO: 183183

SEQ ID NO: 638821 - RNA, 64 nt, hsa; identical to SEQ ID NO: 183184

SEQ ID NO: 638822 - RNA, 64 nt, hsa; identical to SEQ ID NO: 183185

SEQ ID NO: 638823 - RNA, 64 nt, hsa; identical to SEQ ID NO: 183186

SEQ ID NO: 638824 - RNA, 64 nt, hsa; identical to SEQ ID NO: 183187

SEQ ID NO: 638825 - RNA, 64 nt, hsa; identical to SEQ ID NO: 183188

SEQ ID NO: 638826 - RNA, 64 nt, hsa; identical to SEQ ID NO: 183189

SEQ ID NO: 638827 - RNA, 64 nt, hsa; identical to SEQ ID NO: 183190

SEQ ID NO: 638828 - RNA, 64 nt, hsa; identical to SEQ ID NO: 183191

SEQ ID NO: 638829 - RNA, 64 nt, hsa; identical to SEQ ID NO: 183192

SEQ ID NO: 638830 - RNA, 64 nt, hsa; identical to SEQ ID NO: 183193

SEQ ID NO: 638831 - RNA, 64 nt, hsa; identical to SEQ ID NO: 183194

SEQ ID NO: 638832 - RNA, 64 nt, hsa; identical to SEQ ID NO: 183195

SEQ ID NO: 638833 - RNA, 64 nt, hsa; identical to SEQ ID NO: 183196

SEQ ID NO: 638834 - RNA, 64 nt, hsa; identical to SEQ ID NO: 183197

SEQ ID NO: 638835 - RNA, 64 nt, hsa; identical to SEQ ID NO: 183198

SEQ ID NO: 638836 - RNA, 64 nt, hsa; identical to SEQ ID NO: 183199

SEQ ID NO: 638837 - RNA, 64 nt, hsa; identical to SEQ ID NO: 183200

SEQ ID NO: 638838 - RNA, 64 nt, hsa; identical to SEQ ID NO: 183201

SEQ ID NO: 638839 - RNA, 64 nt, hsa; identical to SEQ ID NO: 183202

SEQ ID NO: 638840 - RNA, 64 nt, hsa; identical to SEQ ID NO: 183203

SEQ ID NO: 638841 - RNA, 64 nt, hsa; identical to SEQ ID NO: 183204

SEQ ID NO: 638842 - RNA, 64 nt, hsa; identical to SEQ ID NO: 183205

SEQ ID NO: 638843 - RNA, 64 nt, hsa; identical to SEQ ID NO: 183206

SEQ ID NO: 638844 - RNA, 64 nt, hsa; identical to SEQ ID NO: 183207

SEQ ID NO: 638845 - RNA, 64 nt, hsa; identical to SEQ ID NO: 183208

SEQ ID NO: 638846 - RNA, 64 nt, hsa; identical to SEQ ID NO: 183209

SEQ ID NO: 638847 - RNA, 64 nt, hsa; identical to SEQ ID NO: 183210

SEQ ID NO: 638848 - RNA, 64 nt, hsa; identical to SEQ ID NO: 183211

SEQ ID NO: 638849 - RNA, 64 nt, hsa; identical to SEQ ID NO: 183212

SEQ ID NO: 638850 - RNA, 64 nt, hsa; identical to SEQ ID NO: 183213

SEQ ID NO: 638851 - RNA, 64 nt, hsa; identical to SEQ ID NO: 183214

SEQ ID NO: 638852 - RNA, 64 nt, hsa; identical to SEQ ID NO: 183215

SEQ ID NO: 638853 - RNA, 64 nt, hsa; identical to SEQ ID NO: 183216

SEQ ID NO: 638854 - RNA, 64 nt, hsa; identical to SEQ ID NO: 183217

SEQ ID NO: 638855 - RNA, 64 nt, hsa; identical to SEQ ID NO: 183218

SEQ ID NO: 638856 - RNA, 64 nt, hsa; identical to SEQ ID NO: 183219

SEQ ID NO: 638857 - RNA, 64 nt, hsa; identical to SEQ ID NO: 183220

SEQ ID NO: 638858 - RNA, 64 nt, hsa; identical to SEQ ID NO: 183221

SEQ ID NO: 638859 - RNA, 64 nt, hsa; identical to SEQ ID NO: 183222

SEQ ID NO: 638860 - RNA, 64 nt, hsa; identical to SEQ ID NO: 183223

SEQ ID NO: 638861 - RNA, 64 nt, hsa; identical to SEQ ID NO: 183224

SEQ ID NO: 638862 - RNA, 64 nt, hsa; identical to SEQ ID NO: 183225

SEQ ID NO: 638863 - RNA, 64 nt, hsa; identical to SEQ ID NO: 183226

SEQ ID NO: 638864 - RNA, 64 nt, hsa; identical to SEQ ID NO: 183227

SEQ ID NO: 638865 - RNA, 64 nt, hsa; identical to SEQ ID NO: 183228

SEQ ID NO: 638866 - RNA, 64 nt, hsa; identical to SEQ ID NO: 183229

SEQ ID NO: 638867 - RNA, 64 nt, hsa; identical to SEQ ID NO: 183230

SEQ ID NO: 638868 - RNA, 64 nt, hsa; identical to SEQ ID NO: 183231

SEQ ID NO: 638869 - RNA, 64 nt, hsa; identical to SEQ ID NO: 183232

SEQ ID NO: 638870 - RNA, 64 nt, hsa; identical to SEQ ID NO: 183233

SEQ ID NO: 638871 - RNA, 64 nt, hsa; identical to SEQ ID NO: 183234

SEQ ID NO: 638872 - RNA, 64 nt, hsa; identical to SEQ ID NO: 183235

SEQ ID NO: 638873 - RNA, 64 nt, hsa; identical to SEQ ID NO: 183236

SEQ ID NO: 638874 - RNA, 64 nt, hsa; identical to SEQ ID NO: 183237

SEQ ID NO: 638875 - RNA, 64 nt, hsa; identical to SEQ ID NO: 183238

SEQ ID NO: 638876 - RNA, 64 nt, hsa; identical to SEQ ID NO: 183239

SEQ ID NO: 638877 - RNA, 64 nt, hsa; identical to SEQ ID NO: 183240

SEQ ID NO: 638878 - RNA, 64 nt, hsa; identical to SEQ ID NO: 183241

SEQ ID NO: 638879 - RNA, 64 nt, hsa; identical to SEQ ID NO: 183242

SEQ ID NO: 638880 - RNA, 64 nt, hsa; identical to SEQ ID NO: 183243

SEQ ID NO: 638881 - RNA, 64 nt, hsa; identical to SEQ ID NO: 183244

SEQ ID NO: 638882 - RNA, 64 nt, hsa; identical to SEQ ID NO: 183245

SEQ ID NO: 638883 - RNA, 64 nt, hsa; identical to SEQ ID NO: 183246

SEQ ID NO: 638884 - RNA, 64 nt, hsa; identical to SEQ ID NO: 183247

SEQ ID NO: 638885 - RNA, 64 nt, hsa; identical to SEQ ID NO: 183248

SEQ ID NO: 638886 - RNA, 64 nt, hsa; identical to SEQ ID NO: 183249

SEQ ID NO: 638887 - RNA, 64 nt, hsa; identical to SEQ ID NO: 183250

SEQ ID NO: 638888 - RNA, 64 nt, hsa; identical to SEQ ID NO: 183251

SEQ ID NO: 638889 - RNA, 64 nt, hsa; identical to SEQ ID NO: 183252

SEQ ID NO: 638890 - RNA, 64 nt, hsa; identical to SEQ ID NO: 183253

SEQ ID NO: 638891 - RNA, 64 nt, hsa; identical to SEQ ID NO: 183254

SEQ ID NO: 638892 - RNA, 64 nt, hsa; identical to SEQ ID NO: 183255

SEQ ID NO: 638893 - RNA, 64 nt, hsa; identical to SEQ ID NO: 183256

SEQ ID NO: 638894 - RNA, 64 nt, hsa; identical to SEQ ID NO: 183257

SEQ ID NO: 638895 - RNA, 64 nt, hsa; identical to SEQ ID NO: 183258

SEQ ID NO: 638896 - RNA, 64 nt, hsa; identical to SEQ ID NO: 183259

SEQ ID NO: 638897 - RNA, 64 nt, hsa; identical to SEQ ID NO: 183260

SEQ ID NO: 638898 - RNA, 64 nt, hsa; identical to SEQ ID NO: 183261

SEQ ID NO: 638899 - RNA, 64 nt, hsa; identical to SEQ ID NO: 183262

SEQ ID NO: 638900 - RNA, 64 nt, hsa; identical to SEQ ID NO: 183263

SEQ ID NO: 638901 - RNA, 64 nt, hsa; identical to SEQ ID NO: 183264

SEQ ID NO: 638902 - RNA, 64 nt, hsa; identical to SEQ ID NO: 183265

SEQ ID NO: 638903 - RNA, 64 nt, hsa; identical to SEQ ID NO: 183266

SEQ ID NO: 638904 - RNA, 64 nt, hsa; identical to SEQ ID NO: 183267

SEQ ID NO: 638905 - RNA, 64 nt, hsa; identical to SEQ ID NO: 183268

SEQ ID NO: 638906 - RNA, 64 nt, hsa; identical to SEQ ID NO: 183269

SEQ ID NO: 638907 - RNA, 64 nt, hsa; identical to SEQ ID NO: 183270

SEQ ID NO: 638908 - RNA, 64 nt, hsa; identical to SEQ ID NO: 183271

SEQ ID NO: 638909 - RNA, 64 nt, hsa; identical to SEQ ID NO: 183272

SEQ ID NO: 638910 - RNA, 64 nt, hsa; identical to SEQ ID NO: 183273

SEQ ID NO: 638911 - RNA, 64 nt, hsa; identical to SEQ ID NO: 183274

SEQ ID NO: 638912 - RNA, 64 nt, hsa; identical to SEQ ID NO: 183275

SEQ ID NO: 638913 - RNA, 64 nt, hsa; identical to SEQ ID NO: 183276

SEQ ID NO: 638914 - RNA, 64 nt, hsa; identical to SEQ ID NO: 183277

SEQ ID NO: 638915 - RNA, 64 nt, hsa; identical to SEQ ID NO: 183278

SEQ ID NO: 638916 - RNA, 64 nt, hsa; identical to SEQ ID NO: 183279

SEQ ID NO: 638917 - RNA, 64 nt, hsa; identical to SEQ ID NO: 183280

SEQ ID NO: 638918 - RNA, 64 nt, hsa; identical to SEQ ID NO: 183281

SEQ ID NO: 638919 - RNA, 64 nt, hsa; identical to SEQ ID NO: 183282

SEQ ID NO: 638920 - RNA, 64 nt, hsa; identical to SEQ ID NO: 183283

SEQ ID NO: 638921 - RNA, 64 nt, hsa; identical to SEQ ID NO: 183284

SEQ ID NO: 638922 - RNA, 64 nt, hsa; identical to SEQ ID NO: 183285

SEQ ID NO: 638923 - RNA, 64 nt, hsa; identical to SEQ ID NO: 183286

SEQ ID NO: 638924 - RNA, 64 nt, hsa; identical to SEQ ID NO: 183287

SEQ ID NO: 638925 - RNA, 64 nt, hsa; identical to SEQ ID NO: 183288

SEQ ID NO: 638926 - RNA, 64 nt, hsa; identical to SEQ ID NO: 183289

SEQ ID NO: 638927 - RNA, 64 nt, hsa; identical to SEQ ID NO: 183290

SEQ ID NO: 638928 - RNA, 64 nt, hsa; identical to SEQ ID NO: 183291

SEQ ID NO: 638929 - RNA, 64 nt, hsa; identical to SEQ ID NO: 183292

SEQ ID NO: 638930 - RNA, 64 nt, hsa; identical to SEQ ID NO: 183293

SEQ ID NO: 638931 - RNA, 64 nt, hsa; identical to SEQ ID NO: 183294

SEQ ID NO: 638932 - RNA, 64 nt, hsa; identical to SEQ ID NO: 183295

SEQ ID NO: 638933 - RNA, 64 nt, hsa; identical to SEQ ID NO: 183296

SEQ ID NO: 638934 - RNA, 64 nt, hsa; identical to SEQ ID NO: 183297

SEQ ID NO: 638935 - RNA, 64 nt, hsa; identical to SEQ ID NO: 183298

SEQ ID NO: 638936 - RNA, 64 nt, hsa; identical to SEQ ID NO: 183299

SEQ ID NO: 638937 - RNA, 64 nt, hsa; identical to SEQ ID NO: 183300

SEQ ID NO: 638938 - RNA, 64 nt, hsa; identical to SEQ ID NO: 183301

SEQ ID NO: 638939 - RNA, 64 nt, hsa; identical to SEQ ID NO: 183302

SEQ ID NO: 638940 - RNA, 64 nt, hsa; identical to SEQ ID NO: 183303

SEQ ID NO: 638941 - RNA, 64 nt, hsa; identical to SEQ ID NO: 183304

SEQ ID NO: 638942 - RNA, 64 nt, hsa; identical to SEQ ID NO: 183305

SEQ ID NO: 638943 - RNA, 64 nt, hsa; identical to SEQ ID NO: 183306

SEQ ID NO: 638944 - RNA, 64 nt, hsa; identical to SEQ ID NO: 183307

SEQ ID NO: 638945 - RNA, 64 nt, hsa; identical to SEQ ID NO: 183308

SEQ ID NO: 638946 - RNA, 64 nt, hsa; identical to SEQ ID NO: 183309

SEQ ID NO: 638947 - RNA, 64 nt, hsa; identical to SEQ ID NO: 183310

SEQ ID NO: 638948 - RNA, 64 nt, hsa; identical to SEQ ID NO: 183311

SEQ ID NO: 638949 - RNA, 64 nt, hsa; identical to SEQ ID NO: 183312

SEQ ID NO: 638950 - RNA, 64 nt, hsa; identical to SEQ ID NO: 183313

SEQ ID NO: 638951 - RNA, 64 nt, hsa; identical to SEQ ID NO: 183314

SEQ ID NO: 638952 - RNA, 64 nt, hsa; identical to SEQ ID NO: 183315

SEQ ID NO: 638953 - RNA, 64 nt, hsa; identical to SEQ ID NO: 183316

SEQ ID NO: 638954 - RNA, 64 nt, hsa; identical to SEQ ID NO: 183317

SEQ ID NO: 638955 - RNA, 64 nt, hsa; identical to SEQ ID NO: 183318

SEQ ID NO: 638956 - RNA, 64 nt, hsa; identical to SEQ ID NO: 183319

SEQ ID NO: 638957 - RNA, 64 nt, hsa; identical to SEQ ID NO: 183320

SEQ ID NO: 638958 - RNA, 64 nt, hsa; identical to SEQ ID NO: 183321

SEQ ID NO: 638959 - RNA, 64 nt, hsa; identical to SEQ ID NO: 183322

SEQ ID NO: 638960 - RNA, 64 nt, hsa; identical to SEQ ID NO: 183323

SEQ ID NO: 638961 - RNA, 64 nt, hsa; identical to SEQ ID NO: 183324

SEQ ID NO: 638962 - RNA, 64 nt, hsa; identical to SEQ ID NO: 183325

SEQ ID NO: 638963 - RNA, 64 nt, hsa; identical to SEQ ID NO: 183326

SEQ ID NO: 638964 - RNA, 64 nt, hsa; identical to SEQ ID NO: 183327

SEQ ID NO: 638965 - RNA, 64 nt, hsa; identical to SEQ ID NO: 183328

SEQ ID NO: 638966 - RNA, 64 nt, hsa; identical to SEQ ID NO: 183329

SEQ ID NO: 638967 - RNA, 64 nt, hsa; identical to SEQ ID NO: 183330

SEQ ID NO: 638968 - RNA, 64 nt, hsa; identical to SEQ ID NO: 183331

SEQ ID NO: 638969 - RNA, 64 nt, hsa; identical to SEQ ID NO: 183332

SEQ ID NO: 638970 - RNA, 64 nt, hsa; identical to SEQ ID NO: 183333

SEQ ID NO: 638971 - RNA, 64 nt, hsa; identical to SEQ ID NO: 183334

SEQ ID NO: 638972 - RNA, 64 nt, hsa; identical to SEQ ID NO: 183335

SEQ ID NO: 638973 - RNA, 64 nt, hsa; identical to SEQ ID NO: 183336

SEQ ID NO: 638974 - RNA, 64 nt, hsa; identical to SEQ ID NO: 183337

SEQ ID NO: 638975 - RNA, 64 nt, hsa; identical to SEQ ID NO: 183338

SEQ ID NO: 638976 - RNA, 64 nt, hsa; identical to SEQ ID NO: 183339

SEQ ID NO: 638977 - RNA, 64 nt, hsa; identical to SEQ ID NO: 183340

SEQ ID NO: 638978 - RNA, 64 nt, hsa; identical to SEQ ID NO: 183341

SEQ ID NO: 638979 - RNA, 64 nt, hsa; identical to SEQ ID NO: 183342

SEQ ID NO: 638980 - RNA, 64 nt, hsa; identical to SEQ ID NO: 183343

SEQ ID NO: 638981 - RNA, 64 nt, hsa; identical to SEQ ID NO: 183344

SEQ ID NO: 638982 - RNA, 64 nt, hsa; identical to SEQ ID NO: 183345

SEQ ID NO: 638983 - RNA, 64 nt, hsa; identical to SEQ ID NO: 183346

SEQ ID NO: 638984 - RNA, 64 nt, hsa; identical to SEQ ID NO: 183347

SEQ ID NO: 638985 - RNA, 64 nt, hsa; identical to SEQ ID NO: 183348

SEQ ID NO: 638986 - RNA, 64 nt, hsa; identical to SEQ ID NO: 183349

SEQ ID NO: 638987 - RNA, 64 nt, hsa; identical to SEQ ID NO: 183350

SEQ ID NO: 638988 - RNA, 64 nt, hsa; identical to SEQ ID NO: 183351

SEQ ID NO: 638989 - RNA, 64 nt, hsa; identical to SEQ ID NO: 183352

SEQ ID NO: 638990 - RNA, 64 nt, hsa; identical to SEQ ID NO: 183353

SEQ ID NO: 638991 - RNA, 64 nt, hsa; identical to SEQ ID NO: 183354

SEQ ID NO: 638992 - RNA, 64 nt, hsa; identical to SEQ ID NO: 183355

SEQ ID NO: 638993 - RNA, 64 nt, hsa; identical to SEQ ID NO: 183356

SEQ ID NO: 638994 - RNA, 64 nt, hsa; identical to SEQ ID NO: 183357

SEQ ID NO: 638995 - RNA, 64 nt, hsa; identical to SEQ ID NO: 183358

SEQ ID NO: 638996 - RNA, 64 nt, hsa; identical to SEQ ID NO: 183359

SEQ ID NO: 638997 - RNA, 64 nt, hsa; identical to SEQ ID NO: 183360

SEQ ID NO: 638998 - RNA, 64 nt, hsa; identical to SEQ ID NO: 183361

SEQ ID NO: 638999 - RNA, 64 nt, hsa; identical to SEQ ID NO: 183362

SEQ ID NO: 639000 - RNA, 64 nt, hsa; identical to SEQ ID NO: 183363

SEQ ID NO: 639001 - RNA, 64 nt, hsa; identical to SEQ ID NO: 183364

SEQ ID NO: 639002 - RNA, 64 nt, hsa; identical to SEQ ID NO: 183365

SEQ ID NO: 639003 - RNA, 64 nt, hsa; identical to SEQ ID NO: 183366

SEQ ID NO: 639004 - RNA, 64 nt, hsa; identical to SEQ ID NO: 183367

SEQ ID NO: 639005 - RNA, 64 nt, hsa; identical to SEQ ID NO: 183368

SEQ ID NO: 639006 - RNA, 63 nt, hsa; identical to SEQ ID NO: 183369

SEQ ID NO: 639007 - RNA, 64 nt, hsa; identical to SEQ ID NO: 183370

SEQ ID NO: 639008 - RNA, 64 nt, hsa; identical to SEQ ID NO: 183371

SEQ ID NO: 639009 - RNA, 64 nt, hsa; identical to SEQ ID NO: 183372

SEQ ID NO: 639010 - RNA, 64 nt, hsa; identical to SEQ ID NO: 183373

SEQ ID NO: 639011 - RNA, 64 nt, hsa; identical to SEQ ID NO: 183374

SEQ ID NO: 639012 - RNA, 64 nt, hsa; identical to SEQ ID NO: 183375

SEQ ID NO: 639013 - RNA, 64 nt, hsa; identical to SEQ ID NO: 183376

SEQ ID NO: 639014 - RNA, 64 nt, hsa; identical to SEQ ID NO: 183377

SEQ ID NO: 639015 - RNA, 64 nt, hsa; identical to SEQ ID NO: 183378

SEQ ID NO: 639016 - RNA, 64 nt, hsa; identical to SEQ ID NO: 183379

SEQ ID NO: 639017 - RNA, 64 nt, hsa; identical to SEQ ID NO: 183380

SEQ ID NO: 639018 - RNA, 64 nt, hsa; identical to SEQ ID NO: 183381

SEQ ID NO: 639019 - RNA, 64 nt, hsa; identical to SEQ ID NO: 183382

SEQ ID NO: 639020 - RNA, 64 nt, hsa; identical to SEQ ID NO: 183383

SEQ ID NO: 639021 - RNA, 64 nt, hsa; identical to SEQ ID NO: 183384

SEQ ID NO: 639022 - RNA, 64 nt, hsa; identical to SEQ ID NO: 183385

SEQ ID NO: 639023 - RNA, 64 nt, hsa; identical to SEQ ID NO: 183386

SEQ ID NO: 639024 - RNA, 64 nt, hsa; identical to SEQ ID NO: 183387

SEQ ID NO: 639025 - RNA, 64 nt, hsa; identical to SEQ ID NO: 183388

SEQ ID NO: 639026 - RNA, 64 nt, hsa; identical to SEQ ID NO: 183389

SEQ ID NO: 639027 - RNA, 64 nt, hsa; identical to SEQ ID NO: 183390

SEQ ID NO: 639028 - RNA, 64 nt, hsa; identical to SEQ ID NO: 183391

SEQ ID NO: 639029 - RNA, 64 nt, hsa; identical to SEQ ID NO: 183392

SEQ ID NO: 639030 - RNA, 64 nt, hsa; identical to SEQ ID NO: 183393

SEQ ID NO: 639031 - RNA, 64 nt, hsa; identical to SEQ ID NO: 183394

SEQ ID NO: 639032 - RNA, 64 nt, hsa; identical to SEQ ID NO: 183395

SEQ ID NO: 639033 - RNA, 64 nt, hsa; identical to SEQ ID NO: 183396

SEQ ID NO: 639034 - RNA, 64 nt, hsa; identical to SEQ ID NO: 183397

SEQ ID NO: 639035 - RNA, 64 nt, hsa; identical to SEQ ID NO: 183398

SEQ ID NO: 639036 - RNA, 64 nt, hsa; identical to SEQ ID NO: 183399

SEQ ID NO: 639037 - RNA, 64 nt, hsa; identical to SEQ ID NO: 183400

SEQ ID NO: 639038 - RNA, 64 nt, hsa; identical to SEQ ID NO: 183401

SEQ ID NO: 639039 - RNA, 64 nt, hsa; identical to SEQ ID NO: 183402

SEQ ID NO: 639040 - RNA, 64 nt, hsa; identical to SEQ ID NO: 183403

SEQ ID NO: 639041 - RNA, 64 nt, hsa; identical to SEQ ID NO: 183404

SEQ ID NO: 639042 - RNA, 64 nt, hsa; identical to SEQ ID NO: 183405

SEQ ID NO: 639043 - RNA, 64 nt, hsa; identical to SEQ ID NO: 183406

SEQ ID NO: 639044 - RNA, 64 nt, hsa; identical to SEQ ID NO: 183407

SEQ ID NO: 639045 - RNA, 64 nt, hsa; identical to SEQ ID NO: 183408

SEQ ID NO: 639046 - RNA, 64 nt, hsa; identical to SEQ ID NO: 183409

SEQ ID NO: 639047 - RNA, 64 nt, hsa; identical to SEQ ID NO: 183410

SEQ ID NO: 639048 - RNA, 64 nt, hsa; identical to SEQ ID NO: 183411

SEQ ID NO: 639049 - RNA, 64 nt, hsa; identical to SEQ ID NO: 183412

SEQ ID NO: 639050 - RNA, 64 nt, hsa; identical to SEQ ID NO: 183413

SEQ ID NO: 639051 - RNA, 64 nt, hsa; identical to SEQ ID NO: 183414

SEQ ID NO: 639052 - RNA, 64 nt, hsa; identical to SEQ ID NO: 183415

SEQ ID NO: 639053 - RNA, 64 nt, hsa; identical to SEQ ID NO: 183416

SEQ ID NO: 639054 - RNA, 64 nt, hsa; identical to SEQ ID NO: 183417

SEQ ID NO: 639055 - RNA, 64 nt, hsa; identical to SEQ ID NO: 183418

SEQ ID NO: 639056 - RNA, 64 nt, hsa; identical to SEQ ID NO: 183419

SEQ ID NO: 639057 - RNA, 64 nt, hsa; identical to SEQ ID NO: 183420

SEQ ID NO: 639058 - RNA, 64 nt, hsa; identical to SEQ ID NO: 183421

SEQ ID NO: 639059 - RNA, 64 nt, hsa; identical to SEQ ID NO: 183422

SEQ ID NO: 639060 - RNA, 64 nt, hsa; identical to SEQ ID NO: 183423

SEQ ID NO: 639061 - RNA, 64 nt, hsa; identical to SEQ ID NO: 183424

SEQ ID NO: 639062 - RNA, 64 nt, hsa; identical to SEQ ID NO: 183425

SEQ ID NO: 639063 - RNA, 64 nt, hsa; identical to SEQ ID NO: 183426

SEQ ID NO: 639064 - RNA, 64 nt, hsa; identical to SEQ ID NO: 183427

SEQ ID NO: 639065 - RNA, 64 nt, hsa; identical to SEQ ID NO: 183428

SEQ ID NO: 639066 - RNA, 64 nt, hsa; identical to SEQ ID NO: 183429

SEQ ID NO: 639067 - RNA, 64 nt, hsa; identical to SEQ ID NO: 183430

SEQ ID NO: 639068 - RNA, 64 nt, hsa; identical to SEQ ID NO: 183431

SEQ ID NO: 639069 - RNA, 64 nt, hsa; identical to SEQ ID NO: 183432

SEQ ID NO: 639070 - RNA, 64 nt, hsa; identical to SEQ ID NO: 183433

SEQ ID NO: 639071 - RNA, 64 nt, hsa; identical to SEQ ID NO: 183434

SEQ ID NO: 639072 - RNA, 64 nt, hsa; identical to SEQ ID NO: 183435

SEQ ID NO: 639073 - RNA, 64 nt, hsa; identical to SEQ ID NO: 183436

SEQ ID NO: 639074 - RNA, 64 nt, hsa; identical to SEQ ID NO: 183437

SEQ ID NO: 639075 - RNA, 64 nt, hsa; identical to SEQ ID NO: 183438

SEQ ID NO: 639076 - RNA, 64 nt, hsa; identical to SEQ ID NO: 183439

SEQ ID NO: 639077 - RNA, 64 nt, hsa; identical to SEQ ID NO: 183440

SEQ ID NO: 639078 - RNA, 64 nt, hsa; identical to SEQ ID NO: 183441

SEQ ID NO: 639079 - RNA, 64 nt, hsa; identical to SEQ ID NO: 183442

SEQ ID NO: 639080 - RNA, 64 nt, hsa; identical to SEQ ID NO: 183443

SEQ ID NO: 639081 - RNA, 64 nt, hsa; identical to SEQ ID NO: 183444

SEQ ID NO: 639082 - RNA, 64 nt, hsa; identical to SEQ ID NO: 183445

SEQ ID NO: 639083 - RNA, 64 nt, hsa; identical to SEQ ID NO: 183446

SEQ ID NO: 639084 - RNA, 64 nt, hsa; identical to SEQ ID NO: 183447

SEQ ID NO: 639085 - RNA, 64 nt, hsa; identical to SEQ ID NO: 183448

SEQ ID NO: 639086 - RNA, 64 nt, hsa; identical to SEQ ID NO: 183449

SEQ ID NO: 639087 - RNA, 64 nt, hsa; identical to SEQ ID NO: 183450

SEQ ID NO: 639088 - RNA, 64 nt, hsa; identical to SEQ ID NO: 183451

SEQ ID NO: 639089 - RNA, 64 nt, hsa; identical to SEQ ID NO: 183452

SEQ ID NO: 639090 - RNA, 64 nt, hsa; identical to SEQ ID NO: 183453

SEQ ID NO: 639091 - RNA, 64 nt, hsa; identical to SEQ ID NO: 183454

SEQ ID NO: 639092 - RNA, 64 nt, hsa; identical to SEQ ID NO: 183455

SEQ ID NO: 639093 - RNA, 64 nt, hsa; identical to SEQ ID NO: 183456

SEQ ID NO: 639094 - RNA, 64 nt, hsa; identical to SEQ ID NO: 183457

SEQ ID NO: 639095 - RNA, 64 nt, hsa; identical to SEQ ID NO: 183458

SEQ ID NO: 639096 - RNA, 64 nt, hsa; identical to SEQ ID NO: 183459

SEQ ID NO: 639097 - RNA, 64 nt, hsa; identical to SEQ ID NO: 183460

SEQ ID NO: 639098 - RNA, 64 nt, hsa; identical to SEQ ID NO: 183461

SEQ ID NO: 639099 - RNA, 64 nt, hsa; identical to SEQ ID NO: 183462

SEQ ID NO: 639100 - RNA, 64 nt, hsa; identical to SEQ ID NO: 183463

SEQ ID NO: 639101 - RNA, 64 nt, hsa; identical to SEQ ID NO: 183464

SEQ ID NO: 639102 - RNA, 64 nt, hsa; identical to SEQ ID NO: 183465

SEQ ID NO: 639103 - RNA, 64 nt, hsa; identical to SEQ ID NO: 183466

SEQ ID NO: 639104 - RNA, 64 nt, hsa; identical to SEQ ID NO: 183467

SEQ ID NO: 639105 - RNA, 64 nt, hsa; identical to SEQ ID NO: 183468

SEQ ID NO: 639106 - RNA, 64 nt, hsa; identical to SEQ ID NO: 183469

SEQ ID NO: 639107 - RNA, 64 nt, hsa; identical to SEQ ID NO: 183470

SEQ ID NO: 639108 - RNA, 64 nt, hsa; identical to SEQ ID NO: 183471

SEQ ID NO: 639109 - RNA, 64 nt, hsa; identical to SEQ ID NO: 183472

SEQ ID NO: 639110 - RNA, 64 nt, hsa; identical to SEQ ID NO: 183473

SEQ ID NO: 639111 - RNA, 64 nt, hsa; identical to SEQ ID NO: 183474

SEQ ID NO: 639112 - RNA, 64 nt, hsa; identical to SEQ ID NO: 183475

SEQ ID NO: 639113 - RNA, 64 nt, hsa; identical to SEQ ID NO: 183476

SEQ ID NO: 639114 - RNA, 64 nt, hsa; identical to SEQ ID NO: 183477

SEQ ID NO: 639115 - RNA, 64 nt, hsa; identical to SEQ ID NO: 183478

SEQ ID NO: 639116 - RNA, 64 nt, hsa; identical to SEQ ID NO: 183479

SEQ ID NO: 639117 - RNA, 64 nt, hsa; identical to SEQ ID NO: 183480

SEQ ID NO: 639118 - RNA, 64 nt, hsa; identical to SEQ ID NO: 183481

SEQ ID NO: 639119 - RNA, 64 nt, hsa; identical to SEQ ID NO: 183482

SEQ ID NO: 639120 - RNA, 64 nt, hsa; identical to SEQ ID NO: 183483

SEQ ID NO: 639121 - RNA, 64 nt, hsa; identical to SEQ ID NO: 183484

SEQ ID NO: 639122 - RNA, 64 nt, hsa; identical to SEQ ID NO: 183485

SEQ ID NO: 639123 - RNA, 64 nt, hsa; identical to SEQ ID NO: 183486

SEQ ID NO: 639124 - RNA, 64 nt, hsa; identical to SEQ ID NO: 183487

SEQ ID NO: 639125 - RNA, 64 nt, hsa; identical to SEQ ID NO: 183488

SEQ ID NO: 639126 - RNA, 64 nt, hsa; identical to SEQ ID NO: 183489

SEQ ID NO: 639127 - RNA, 64 nt, hsa; identical to SEQ ID NO: 183490

SEQ ID NO: 639128 - RNA, 64 nt, hsa; identical to SEQ ID NO: 183491

SEQ ID NO: 639129 - RNA, 64 nt, hsa; identical to SEQ ID NO: 183492

SEQ ID NO: 639130 - RNA, 64 nt, hsa; identical to SEQ ID NO: 183493

SEQ ID NO: 639131 - RNA, 64 nt, hsa; identical to SEQ ID NO: 183494

SEQ ID NO: 639132 - RNA, 64 nt, hsa; identical to SEQ ID NO: 183495

SEQ ID NO: 639133 - RNA, 64 nt, hsa; identical to SEQ ID NO: 183496

SEQ ID NO: 639134 - RNA, 64 nt, hsa; identical to SEQ ID NO: 183497

SEQ ID NO: 639135 - RNA, 64 nt, hsa; identical to SEQ ID NO: 183498

SEQ ID NO: 639136 - RNA, 64 nt, hsa; identical to SEQ ID NO: 183499

SEQ ID NO: 639137 - RNA, 64 nt, hsa; identical to SEQ ID NO: 183500

SEQ ID NO: 639138 - RNA, 64 nt, hsa; identical to SEQ ID NO: 183501

SEQ ID NO: 639139 - RNA, 64 nt, hsa; identical to SEQ ID NO: 183502

SEQ ID NO: 639140 - RNA, 64 nt, hsa; identical to SEQ ID NO: 183503

SEQ ID NO: 639141 - RNA, 64 nt, hsa; identical to SEQ ID NO: 183504

SEQ ID NO: 639142 - RNA, 64 nt, hsa; identical to SEQ ID NO: 183505

SEQ ID NO: 639143 - RNA, 64 nt, hsa; identical to SEQ ID NO: 183506

SEQ ID NO: 639144 - RNA, 64 nt, hsa; identical to SEQ ID NO: 183507

SEQ ID NO: 639145 - RNA, 64 nt, hsa; identical to SEQ ID NO: 183508

SEQ ID NO: 639146 - RNA, 64 nt, hsa; identical to SEQ ID NO: 183509

SEQ ID NO: 639147 - RNA, 64 nt, hsa; identical to SEQ ID NO: 183510

SEQ ID NO: 639148 - RNA, 64 nt, hsa; identical to SEQ ID NO: 183511

SEQ ID NO: 639149 - RNA, 64 nt, hsa; identical to SEQ ID NO: 183512

SEQ ID NO: 639150 - RNA, 64 nt, hsa; identical to SEQ ID NO: 183513

SEQ ID NO: 639151 - RNA, 64 nt, hsa; identical to SEQ ID NO: 183514

SEQ ID NO: 639152 - RNA, 64 nt, hsa; identical to SEQ ID NO: 183515

SEQ ID NO: 639153 - RNA, 64 nt, hsa; identical to SEQ ID NO: 183516

SEQ ID NO: 639154 - RNA, 64 nt, hsa; identical to SEQ ID NO: 183517

SEQ ID NO: 639155 - RNA, 64 nt, hsa; identical to SEQ ID NO: 183518

SEQ ID NO: 639156 - RNA, 64 nt, hsa; identical to SEQ ID NO: 183519

SEQ ID NO: 639157 - RNA, 64 nt, hsa; identical to SEQ ID NO: 183520

SEQ ID NO: 639158 - RNA, 64 nt, hsa; identical to SEQ ID NO: 183521

SEQ ID NO: 639159 - RNA, 64 nt, hsa; identical to SEQ ID NO: 183522

SEQ ID NO: 639160 - RNA, 64 nt, hsa; identical to SEQ ID NO: 183523

SEQ ID NO: 639161 - RNA, 64 nt, hsa; identical to SEQ ID NO: 183524

SEQ ID NO: 639162 - RNA, 64 nt, hsa; identical to SEQ ID NO: 183525

SEQ ID NO: 639163 - RNA, 64 nt, hsa; identical to SEQ ID NO: 183526

SEQ ID NO: 639164 - RNA, 64 nt, hsa; identical to SEQ ID NO: 183527

SEQ ID NO: 639165 - RNA, 64 nt, hsa; identical to SEQ ID NO: 183528

SEQ ID NO: 639166 - RNA, 64 nt, hsa; identical to SEQ ID NO: 183529

SEQ ID NO: 639167 - RNA, 64 nt, hsa; identical to SEQ ID NO: 183530

SEQ ID NO: 639168 - RNA, 64 nt, hsa; identical to SEQ ID NO: 183531

SEQ ID NO: 639169 - RNA, 64 nt, hsa; identical to SEQ ID NO: 183532

SEQ ID NO: 639170 - RNA, 64 nt, hsa; identical to SEQ ID NO: 183533

SEQ ID NO: 639171 - RNA, 64 nt, hsa; identical to SEQ ID NO: 183534

SEQ ID NO: 639172 - RNA, 64 nt, hsa; identical to SEQ ID NO: 183535

SEQ ID NO: 639173 - RNA, 64 nt, hsa; identical to SEQ ID NO: 183536

SEQ ID NO: 639174 - RNA, 64 nt, hsa; identical to SEQ ID NO: 183537

SEQ ID NO: 639175 - RNA, 64 nt, hsa; identical to SEQ ID NO: 183538

SEQ ID NO: 639176 - RNA, 64 nt, hsa; identical to SEQ ID NO: 183539

SEQ ID NO: 639177 - RNA, 64 nt, hsa; identical to SEQ ID NO: 183540

SEQ ID NO: 639178 - RNA, 64 nt, hsa; identical to SEQ ID NO: 183541

SEQ ID NO: 639179 - RNA, 64 nt, hsa; identical to SEQ ID NO: 183542

SEQ ID NO: 639180 - RNA, 64 nt, hsa; identical to SEQ ID NO: 183543

SEQ ID NO: 639181 - RNA, 64 nt, hsa; identical to SEQ ID NO: 183544

SEQ ID NO: 639182 - RNA, 64 nt, hsa; identical to SEQ ID NO: 183545

SEQ ID NO: 639183 - RNA, 64 nt, hsa; identical to SEQ ID NO: 183546

SEQ ID NO: 639184 - RNA, 64 nt, hsa; identical to SEQ ID NO: 183547

SEQ ID NO: 639185 - RNA, 64 nt, hsa; identical to SEQ ID NO: 183548

SEQ ID NO: 639186 - RNA, 64 nt, hsa; identical to SEQ ID NO: 183549

SEQ ID NO: 639187 - RNA, 64 nt, hsa; identical to SEQ ID NO: 183550

SEQ ID NO: 639188 - RNA, 64 nt, hsa; identical to SEQ ID NO: 183551

SEQ ID NO: 639189 - RNA, 64 nt, hsa; identical to SEQ ID NO: 183552

SEQ ID NO: 639190 - RNA, 64 nt, hsa; identical to SEQ ID NO: 183553

SEQ ID NO: 639191 - RNA, 64 nt, hsa; identical to SEQ ID NO: 183554

SEQ ID NO: 639192 - RNA, 64 nt, hsa; identical to SEQ ID NO: 183555

SEQ ID NO: 639193 - RNA, 64 nt, hsa; identical to SEQ ID NO: 183556

SEQ ID NO: 639194 - RNA, 64 nt, hsa; identical to SEQ ID NO: 183557

SEQ ID NO: 639195 - RNA, 64 nt, hsa; identical to SEQ ID NO: 183558

SEQ ID NO: 639196 - RNA, 64 nt, hsa; identical to SEQ ID NO: 183559

SEQ ID NO: 639197 - RNA, 64 nt, hsa; identical to SEQ ID NO: 183560

SEQ ID NO: 639198 - RNA, 64 nt, hsa; identical to SEQ ID NO: 183561

SEQ ID NO: 639199 - RNA, 64 nt, hsa; identical to SEQ ID NO: 183562

SEQ ID NO: 639200 - RNA, 64 nt, hsa; identical to SEQ ID NO: 183563

SEQ ID NO: 639201 - RNA, 64 nt, hsa; identical to SEQ ID NO: 183564

SEQ ID NO: 639202 - RNA, 64 nt, hsa; identical to SEQ ID NO: 183565

SEQ ID NO: 639203 - RNA, 64 nt, hsa; identical to SEQ ID NO: 183566

SEQ ID NO: 639204 - RNA, 64 nt, hsa; identical to SEQ ID NO: 183567

SEQ ID NO: 639205 - RNA, 64 nt, hsa; identical to SEQ ID NO: 183568

SEQ ID NO: 639206 - RNA, 64 nt, hsa; identical to SEQ ID NO: 183569

SEQ ID NO: 639207 - RNA, 64 nt, hsa; identical to SEQ ID NO: 183570

SEQ ID NO: 639208 - RNA, 64 nt, hsa; identical to SEQ ID NO: 183571

SEQ ID NO: 639209 - RNA, 64 nt, hsa; identical to SEQ ID NO: 183572

SEQ ID NO: 639210 - RNA, 64 nt, hsa; identical to SEQ ID NO: 183573

SEQ ID NO: 639211 - RNA, 64 nt, hsa; identical to SEQ ID NO: 183574

SEQ ID NO: 639212 - RNA, 64 nt, hsa; identical to SEQ ID NO: 183575

SEQ ID NO: 639213 - RNA, 64 nt, hsa; identical to SEQ ID NO: 183576

SEQ ID NO: 639214 - RNA, 64 nt, hsa; identical to SEQ ID NO: 183577

SEQ ID NO: 639215 - RNA, 64 nt, hsa; identical to SEQ ID NO: 183578

SEQ ID NO: 639216 - RNA, 64 nt, hsa; identical to SEQ ID NO: 183579

SEQ ID NO: 639217 - RNA, 64 nt, hsa; identical to SEQ ID NO: 183580

SEQ ID NO: 639218 - RNA, 64 nt, hsa; identical to SEQ ID NO: 183581

SEQ ID NO: 639219 - RNA, 64 nt, hsa; identical to SEQ ID NO: 183582

SEQ ID NO: 639220 - RNA, 64 nt, hsa; identical to SEQ ID NO: 183583

SEQ ID NO: 639221 - RNA, 64 nt, hsa; identical to SEQ ID NO: 183584

SEQ ID NO: 639222 - RNA, 64 nt, hsa; identical to SEQ ID NO: 183585

SEQ ID NO: 639223 - RNA, 64 nt, hsa; identical to SEQ ID NO: 183586

SEQ ID NO: 639224 - RNA, 64 nt, hsa; identical to SEQ ID NO: 183587

SEQ ID NO: 639225 - RNA, 64 nt, hsa; identical to SEQ ID NO: 183588

SEQ ID NO: 639226 - RNA, 64 nt, hsa; identical to SEQ ID NO: 183589

SEQ ID NO: 639227 - RNA, 64 nt, hsa; identical to SEQ ID NO: 183590

SEQ ID NO: 639228 - RNA, 64 nt, hsa; identical to SEQ ID NO: 183591

SEQ ID NO: 639229 - RNA, 64 nt, hsa; identical to SEQ ID NO: 183592

SEQ ID NO: 639230 - RNA, 64 nt, hsa; identical to SEQ ID NO: 183593

SEQ ID NO: 639231 - RNA, 64 nt, hsa; identical to SEQ ID NO: 183594

SEQ ID NO: 639232 - RNA, 64 nt, hsa; identical to SEQ ID NO: 183595

SEQ ID NO: 639233 - RNA, 64 nt, hsa; identical to SEQ ID NO: 183596

SEQ ID NO: 639234 - RNA, 64 nt, hsa; identical to SEQ ID NO: 183597

SEQ ID NO: 639235 - RNA, 64 nt, hsa; identical to SEQ ID NO: 183598

SEQ ID NO: 639236 - RNA, 64 nt, hsa; identical to SEQ ID NO: 183599

SEQ ID NO: 639237 - RNA, 64 nt, hsa; identical to SEQ ID NO: 183600

SEQ ID NO: 639238 - RNA, 64 nt, hsa; identical to SEQ ID NO: 183601

SEQ ID NO: 639239 - RNA, 64 nt, hsa; identical to SEQ ID NO: 183602

SEQ ID NO: 639240 - RNA, 64 nt, hsa; identical to SEQ ID NO: 183603

SEQ ID NO: 639241 - RNA, 64 nt, hsa; identical to SEQ ID NO: 541607

SEQ ID NO: 639242 - RNA, 64 nt, hsa; identical to SEQ ID NO: 541608

SEQ ID NO: 639243 - RNA, 64 nt, hsa; identical to SEQ ID NO: 541609

SEQ ID NO: 639244 - RNA, 64 nt, hsa; identical to SEQ ID NO: 541610

SEQ ID NO: 639245 - RNA, 64 nt, hsa; identical to SEQ ID NO: 182986

SEQ ID NO: 639246 - RNA, 64 nt, hsa; identical to SEQ ID NO: 182987

SEQ ID NO: 639247 - RNA, 64 nt, hsa; identical to SEQ ID NO: 182988

SEQ ID NO: 639248 - RNA, 64 nt, hsa; identical to SEQ ID NO: 182989

SEQ ID NO: 639249 - RNA, 64 nt, hsa; identical to SEQ ID NO: 182990

SEQ ID NO: 639250 - RNA, 64 nt, hsa; identical to SEQ ID NO: 182991

SEQ ID NO: 639251 - RNA, 64 nt, hsa; identical to SEQ ID NO: 182992

SEQ ID NO: 639252 - RNA, 64 nt, hsa; identical to SEQ ID NO: 182993

SEQ ID NO: 639253 - RNA, 64 nt, hsa; identical to SEQ ID NO: 182994

SEQ ID NO: 639254 - RNA, 64 nt, hsa; identical to SEQ ID NO: 182995

SEQ ID NO: 639255 - RNA, 64 nt, hsa; identical to SEQ ID NO: 182996

SEQ ID NO: 639256 - RNA, 64 nt, hsa; identical to SEQ ID NO: 182997

SEQ ID NO: 639257 - RNA, 64 nt, hsa; identical to SEQ ID NO: 182998

SEQ ID NO: 639258 - RNA, 64 nt, hsa; identical to SEQ ID NO: 182999

SEQ ID NO: 639259 - RNA, 64 nt, hsa; identical to SEQ ID NO: 183000

SEQ ID NO: 639260 - RNA, 64 nt, hsa; identical to SEQ ID NO: 183001

SEQ ID NO: 639261 - RNA, 64 nt, hsa; identical to SEQ ID NO: 183002

SEQ ID NO: 639262 - RNA, 64 nt, hsa; identical to SEQ ID NO: 183003

SEQ ID NO: 639263 - RNA, 64 nt, hsa; identical to SEQ ID NO: 183004

SEQ ID NO: 639264 - RNA, 64 nt, hsa; identical to SEQ ID NO: 183005

SEQ ID NO: 639265 - RNA, 64 nt, hsa; identical to SEQ ID NO: 183006

SEQ ID NO: 639266 - RNA, 64 nt, hsa; identical to SEQ ID NO: 183007

SEQ ID NO: 639267 - RNA, 64 nt, hsa; identical to SEQ ID NO: 183008

SEQ ID NO: 639268 - RNA, 64 nt, hsa; identical to SEQ ID NO: 183009

SEQ ID NO: 639269 - RNA, 64 nt, hsa; identical to SEQ ID NO: 183010

SEQ ID NO: 639270 - RNA, 64 nt, hsa; identical to SEQ ID NO: 183011

SEQ ID NO: 639271 - RNA, 64 nt, hsa; identical to SEQ ID NO: 183012

SEQ ID NO: 639272 - RNA, 64 nt, hsa; identical to SEQ ID NO: 183013

SEQ ID NO: 639273 - RNA, 64 nt, hsa; identical to SEQ ID NO: 183014

SEQ ID NO: 639274 - RNA, 64 nt, hsa; identical to SEQ ID NO: 183015

SEQ ID NO: 639275 - RNA, 64 nt, hsa; identical to SEQ ID NO: 183016

SEQ ID NO: 639276 - RNA, 64 nt, hsa; identical to SEQ ID NO: 183017

SEQ ID NO: 639277 - RNA, 64 nt, hsa; identical to SEQ ID NO: 183018

SEQ ID NO: 639278 - RNA, 64 nt, hsa; identical to SEQ ID NO: 183019

SEQ ID NO: 639279 - RNA, 64 nt, hsa; identical to SEQ ID NO: 183020

SEQ ID NO: 639280 - RNA, 64 nt, hsa; identical to SEQ ID NO: 183021

SEQ ID NO: 639281 - RNA, 64 nt, hsa; identical to SEQ ID NO: 183022

SEQ ID NO: 639282 - RNA, 64 nt, hsa; identical to SEQ ID NO: 183023

SEQ ID NO: 639283 - RNA, 64 nt, hsa; identical to SEQ ID NO: 183024

SEQ ID NO: 639284 - RNA, 64 nt, hsa; identical to SEQ ID NO: 183025

SEQ ID NO: 639285 - RNA, 64 nt, hsa; identical to SEQ ID NO: 183026

SEQ ID NO: 639286 - RNA, 64 nt, hsa; identical to SEQ ID NO: 183027

SEQ ID NO: 639287 - RNA, 64 nt, hsa; identical to SEQ ID NO: 183028

SEQ ID NO: 639288 - RNA, 64 nt, hsa; identical to SEQ ID NO: 183029

SEQ ID NO: 639289 - RNA, 64 nt, hsa; identical to SEQ ID NO: 183030

SEQ ID NO: 639290 - RNA, 64 nt, hsa; identical to SEQ ID NO: 183031

SEQ ID NO: 639291 - RNA, 64 nt, hsa; identical to SEQ ID NO: 183032

SEQ ID NO: 639292 - RNA, 64 nt, hsa; identical to SEQ ID NO: 183033

SEQ ID NO: 639293 - RNA, 64 nt, hsa; identical to SEQ ID NO: 183034

SEQ ID NO: 639294 - RNA, 64 nt, hsa; identical to SEQ ID NO: 183035

SEQ ID NO: 639295 - RNA, 64 nt, hsa; identical to SEQ ID NO: 183036

SEQ ID NO: 639296 - RNA, 64 nt, hsa; identical to SEQ ID NO: 183037

SEQ ID NO: 639297 - RNA, 64 nt, hsa; identical to SEQ ID NO: 183038

SEQ ID NO: 639298 - RNA, 64 nt, hsa; identical to SEQ ID NO: 183039

SEQ ID NO: 639299 - RNA, 64 nt, hsa; identical to SEQ ID NO: 183040

SEQ ID NO: 639300 - RNA, 64 nt, hsa; identical to SEQ ID NO: 183041

SEQ ID NO: 639301 - RNA, 64 nt, hsa; identical to SEQ ID NO: 183042

SEQ ID NO: 639302 - RNA, 64 nt, hsa; identical to SEQ ID NO: 183043

SEQ ID NO: 639303 - RNA, 64 nt, hsa; identical to SEQ ID NO: 183044

SEQ ID NO: 639304 - RNA, 64 nt, hsa; identical to SEQ ID NO: 183045

SEQ ID NO: 639305 - RNA, 64 nt, hsa; identical to SEQ ID NO: 183046

SEQ ID NO: 639306 - RNA, 64 nt, hsa; identical to SEQ ID NO: 183047

SEQ ID NO: 639307 - RNA, 64 nt, hsa; identical to SEQ ID NO: 183048

SEQ ID NO: 639308 - RNA, 64 nt, hsa; identical to SEQ ID NO: 183049

SEQ ID NO: 639309 - RNA, 64 nt, hsa; identical to SEQ ID NO: 183050

SEQ ID NO: 639310 - RNA, 64 nt, hsa; identical to SEQ ID NO: 183051

SEQ ID NO: 639311 - RNA, 64 nt, hsa; identical to SEQ ID NO: 183052

SEQ ID NO: 639312 - RNA, 64 nt, hsa; identical to SEQ ID NO: 183053

SEQ ID NO: 639313 - RNA, 64 nt, hsa; identical to SEQ ID NO: 183054

SEQ ID NO: 639314 - RNA, 64 nt, hsa; identical to SEQ ID NO: 183055

SEQ ID NO: 639315 - RNA, 64 nt, hsa; identical to SEQ ID NO: 183056

SEQ ID NO: 639316 - RNA, 64 nt, hsa; identical to SEQ ID NO: 183057

SEQ ID NO: 639317 - RNA, 64 nt, hsa; identical to SEQ ID NO: 183058

SEQ ID NO: 639318 - RNA, 64 nt, hsa; identical to SEQ ID NO: 183059

SEQ ID NO: 639319 - RNA, 64 nt, hsa; identical to SEQ ID NO: 183060

SEQ ID NO: 639320 - RNA, 64 nt, hsa; identical to SEQ ID NO: 183061

SEQ ID NO: 639321 - RNA, 64 nt, hsa; identical to SEQ ID NO: 183062

SEQ ID NO: 639322 - RNA, 64 nt, hsa; identical to SEQ ID NO: 183063

SEQ ID NO: 639323 - RNA, 64 nt, hsa; identical to SEQ ID NO: 183064

SEQ ID NO: 639324 - RNA, 64 nt, hsa; identical to SEQ ID NO: 183065

SEQ ID NO: 639325 - RNA, 64 nt, hsa; identical to SEQ ID NO: 183066

SEQ ID NO: 639326 - RNA, 64 nt, hsa; identical to SEQ ID NO: 183067

SEQ ID NO: 639327 - RNA, 64 nt, hsa; identical to SEQ ID NO: 183068

SEQ ID NO: 639328 - RNA, 64 nt, hsa; identical to SEQ ID NO: 183069

SEQ ID NO: 639329 - RNA, 64 nt, hsa; identical to SEQ ID NO: 183070

SEQ ID NO: 639330 - RNA, 64 nt, hsa; identical to SEQ ID NO: 183071

SEQ ID NO: 639331 - RNA, 64 nt, hsa; identical to SEQ ID NO: 183072

SEQ ID NO: 639332 - RNA, 64 nt, hsa; identical to SEQ ID NO: 183073

SEQ ID NO: 639333 - RNA, 64 nt, hsa; identical to SEQ ID NO: 183074

SEQ ID NO: 639334 - RNA, 64 nt, hsa; identical to SEQ ID NO: 183075

SEQ ID NO: 639335 - RNA, 64 nt, hsa; identical to SEQ ID NO: 183076

SEQ ID NO: 639336 - RNA, 64 nt, hsa; identical to SEQ ID NO: 183077

SEQ ID NO: 639337 - RNA, 64 nt, hsa; identical to SEQ ID NO: 183078

SEQ ID NO: 639338 - RNA, 64 nt, hsa; identical to SEQ ID NO: 183079

SEQ ID NO: 639339 - RNA, 64 nt, hsa; identical to SEQ ID NO: 183080

SEQ ID NO: 639340 - RNA, 64 nt, hsa; identical to SEQ ID NO: 183081

SEQ ID NO: 639341 - RNA, 64 nt, hsa; identical to SEQ ID NO: 183082

SEQ ID NO: 639342 - RNA, 64 nt, hsa; identical to SEQ ID NO: 183083

SEQ ID NO: 639343 - RNA, 64 nt, hsa; identical to SEQ ID NO: 183084

SEQ ID NO: 639344 - RNA, 64 nt, hsa; identical to SEQ ID NO: 183085

SEQ ID NO: 639345 - RNA, 64 nt, hsa; identical to SEQ ID NO: 183086

SEQ ID NO: 639346 - RNA, 64 nt, hsa; identical to SEQ ID NO: 183087

SEQ ID NO: 639347 - RNA, 64 nt, hsa; identical to SEQ ID NO: 183088

SEQ ID NO: 639348 - RNA, 64 nt, hsa; identical to SEQ ID NO: 183089

SEQ ID NO: 639349 - RNA, 64 nt, hsa; identical to SEQ ID NO: 183090

SEQ ID NO: 639350 - RNA, 64 nt, hsa; identical to SEQ ID NO: 183091

SEQ ID NO: 639351 - RNA, 64 nt, hsa; identical to SEQ ID NO: 183092

SEQ ID NO: 639352 - RNA, 64 nt, hsa; identical to SEQ ID NO: 183093

SEQ ID NO: 639353 - RNA, 64 nt, hsa; identical to SEQ ID NO: 183094

SEQ ID NO: 639354 - RNA, 64 nt, hsa; identical to SEQ ID NO: 183095

SEQ ID NO: 639355 - RNA, 64 nt, hsa; identical to SEQ ID NO: 183096

SEQ ID NO: 639356 - RNA, 64 nt, hsa; identical to SEQ ID NO: 183097

SEQ ID NO: 639357 - RNA, 64 nt, hsa; identical to SEQ ID NO: 183098

SEQ ID NO: 639358 - RNA, 64 nt, hsa; identical to SEQ ID NO: 183099

SEQ ID NO: 639359 - RNA, 64 nt, hsa; identical to SEQ ID NO: 183100

SEQ ID NO: 639360 - RNA, 64 nt, hsa; identical to SEQ ID NO: 183101

SEQ ID NO: 639361 - RNA, 64 nt, hsa; identical to SEQ ID NO: 183102

SEQ ID NO: 639362 - RNA, 64 nt, hsa; identical to SEQ ID NO: 183103

SEQ ID NO: 639363 - RNA, 64 nt, hsa; identical to SEQ ID NO: 183104

SEQ ID NO: 639364 - RNA, 64 nt, hsa; identical to SEQ ID NO: 183105

SEQ ID NO: 639365 - RNA, 64 nt, hsa; identical to SEQ ID NO: 183106

SEQ ID NO: 639366 - RNA, 64 nt, hsa; identical to SEQ ID NO: 183107

SEQ ID NO: 639367 - RNA, 64 nt, hsa; identical to SEQ ID NO: 183108

SEQ ID NO: 639368 - RNA, 64 nt, hsa; identical to SEQ ID NO: 183109

SEQ ID NO: 639369 - RNA, 64 nt, hsa; identical to SEQ ID NO: 183110

SEQ ID NO: 639370 - RNA, 64 nt, hsa; identical to SEQ ID NO: 183111

SEQ ID NO: 639371 - RNA, 64 nt, hsa; identical to SEQ ID NO: 183112

SEQ ID NO: 639372 - RNA, 64 nt, hsa; identical to SEQ ID NO: 183113

SEQ ID NO: 639373 - RNA, 64 nt, hsa; identical to SEQ ID NO: 183114

SEQ ID NO: 639374 - RNA, 64 nt, hsa; identical to SEQ ID NO: 183115

SEQ ID NO: 639375 - RNA, 64 nt, hsa; identical to SEQ ID NO: 183116

SEQ ID NO: 639376 - RNA, 64 nt, hsa; identical to SEQ ID NO: 183117

SEQ ID NO: 639377 - RNA, 64 nt, hsa; identical to SEQ ID NO: 183118

SEQ ID NO: 639378 - RNA, 64 nt, hsa; identical to SEQ ID NO: 183119

SEQ ID NO: 639379 - RNA, 64 nt, hsa; identical to SEQ ID NO: 183120

SEQ ID NO: 639380 - RNA, 64 nt, hsa; identical to SEQ ID NO: 183121

SEQ ID NO: 639381 - RNA, 64 nt, hsa; identical to SEQ ID NO: 183122

SEQ ID NO: 639382 - RNA, 64 nt, hsa; identical to SEQ ID NO: 183123

SEQ ID NO: 639383 - RNA, 64 nt, hsa; identical to SEQ ID NO: 183124

SEQ ID NO: 639384 - RNA, 64 nt, hsa; identical to SEQ ID NO: 183125

SEQ ID NO: 639385 - RNA, 64 nt, hsa; identical to SEQ ID NO: 183126

SEQ ID NO: 639386 - RNA, 64 nt, hsa; identical to SEQ ID NO: 183127

SEQ ID NO: 639387 - RNA, 64 nt, hsa; identical to SEQ ID NO: 183128

SEQ ID NO: 639388 - RNA, 64 nt, hsa; identical to SEQ ID NO: 183129

SEQ ID NO: 639389 - RNA, 64 nt, hsa; identical to SEQ ID NO: 183130

SEQ ID NO: 639390 - RNA, 64 nt, hsa; identical to SEQ ID NO: 183131

SEQ ID NO: 639391 - RNA, 64 nt, hsa; identical to SEQ ID NO: 183132

SEQ ID NO: 639392 - RNA, 64 nt, hsa; identical to SEQ ID NO: 183133

SEQ ID NO: 639393 - RNA, 64 nt, hsa; identical to SEQ ID NO: 183134

SEQ ID NO: 639394 - RNA, 64 nt, hsa; identical to SEQ ID NO: 183135

SEQ ID NO: 639395 - RNA, 64 nt, hsa; identical to SEQ ID NO: 183136

SEQ ID NO: 639396 - RNA, 64 nt, hsa; identical to SEQ ID NO: 183137

SEQ ID NO: 639397 - RNA, 64 nt, hsa; identical to SEQ ID NO: 183138

SEQ ID NO: 639398 - RNA, 64 nt, hsa; identical to SEQ ID NO: 183139

SEQ ID NO: 639399 - RNA, 64 nt, hsa; identical to SEQ ID NO: 183140

SEQ ID NO: 639400 - RNA, 64 nt, hsa; identical to SEQ ID NO: 183141

SEQ ID NO: 639401 - RNA, 64 nt, hsa; identical to SEQ ID NO: 183142

SEQ ID NO: 639402 - RNA, 64 nt, hsa; identical to SEQ ID NO: 183143

SEQ ID NO: 639403 - RNA, 64 nt, hsa; identical to SEQ ID NO: 183144

SEQ ID NO: 639404 - RNA, 64 nt, hsa; identical to SEQ ID NO: 183145

SEQ ID NO: 639405 - RNA, 64 nt, hsa; identical to SEQ ID NO: 183146

SEQ ID NO: 639406 - RNA, 64 nt, hsa; identical to SEQ ID NO: 183147

SEQ ID NO: 639407 - RNA, 64 nt, hsa; identical to SEQ ID NO: 183148

SEQ ID NO: 639408 - RNA, 64 nt, hsa; identical to SEQ ID NO: 183149

SEQ ID NO: 639409 - RNA, 64 nt, hsa; identical to SEQ ID NO: 183150

SEQ ID NO: 639410 - RNA, 64 nt, hsa; identical to SEQ ID NO: 183151

SEQ ID NO: 639411 - RNA, 64 nt, hsa; identical to SEQ ID NO: 183152

SEQ ID NO: 639412 - RNA, 64 nt, hsa; identical to SEQ ID NO: 183153

SEQ ID NO: 639413 - RNA, 64 nt, hsa; identical to SEQ ID NO: 183154

SEQ ID NO: 639414 - RNA, 64 nt, hsa; identical to SEQ ID NO: 183155

SEQ ID NO: 639415 - RNA, 64 nt, hsa; identical to SEQ ID NO: 183156

SEQ ID NO: 639416 - RNA, 64 nt, hsa; identical to SEQ ID NO: 183157

SEQ ID NO: 639417 - RNA, 64 nt, hsa; identical to SEQ ID NO: 183158

SEQ ID NO: 639418 - RNA, 64 nt, hsa; identical to SEQ ID NO: 183159

SEQ ID NO: 639419 - RNA, 64 nt, hsa; identical to SEQ ID NO: 183160

SEQ ID NO: 639420 - RNA, 64 nt, hsa; identical to SEQ ID NO: 183161

SEQ ID NO: 639421 - RNA, 64 nt, hsa; identical to SEQ ID NO: 183162

SEQ ID NO: 639422 - RNA, 64 nt, hsa; identical to SEQ ID NO: 183163

SEQ ID NO: 639423 - RNA, 64 nt, hsa; identical to SEQ ID NO: 183164

SEQ ID NO: 639424 - RNA, 64 nt, hsa; identical to SEQ ID NO: 183165

SEQ ID NO: 639425 - RNA, 64 nt, hsa; identical to SEQ ID NO: 183166

SEQ ID NO: 639426 - RNA, 64 nt, hsa; identical to SEQ ID NO: 183167

SEQ ID NO: 639427 - RNA, 64 nt, hsa; identical to SEQ ID NO: 183168

SEQ ID NO: 639428 - RNA, 64 nt, hsa; identical to SEQ ID NO: 183169

SEQ ID NO: 639429 - RNA, 64 nt, hsa; identical to SEQ ID NO: 183170

SEQ ID NO: 639430 - RNA, 64 nt, hsa; identical to SEQ ID NO: 183171

SEQ ID NO: 639431 - RNA, 64 nt, hsa; identical to SEQ ID NO: 183172

SEQ ID NO: 639432 - RNA, 64 nt, hsa; identical to SEQ ID NO: 183173

SEQ ID NO: 639433 - RNA, 64 nt, hsa; identical to SEQ ID NO: 183174

SEQ ID NO: 639434 - RNA, 64 nt, hsa; identical to SEQ ID NO: 183175

SEQ ID NO: 639435 - RNA, 64 nt, hsa; identical to SEQ ID NO: 183176

SEQ ID NO: 639436 - RNA, 64 nt, hsa; identical to SEQ ID NO: 183177

SEQ ID NO: 639437 - RNA, 64 nt, hsa; identical to SEQ ID NO: 183178

SEQ ID NO: 639438 - RNA, 64 nt, hsa; identical to SEQ ID NO: 183179

SEQ ID NO: 639439 - RNA, 64 nt, hsa; identical to SEQ ID NO: 183180

SEQ ID NO: 639440 - RNA, 64 nt, hsa; identical to SEQ ID NO: 183181

SEQ ID NO: 639441 - RNA, 64 nt, hsa; identical to SEQ ID NO: 183182

SEQ ID NO: 639442 - RNA, 64 nt, hsa; identical to SEQ ID NO: 183183

SEQ ID NO: 639443 - RNA, 64 nt, hsa; identical to SEQ ID NO: 183184

SEQ ID NO: 639444 - RNA, 64 nt, hsa; identical to SEQ ID NO: 183185

SEQ ID NO: 639445 - RNA, 64 nt, hsa; identical to SEQ ID NO: 183186

SEQ ID NO: 639446 - RNA, 64 nt, hsa; identical to SEQ ID NO: 183187

SEQ ID NO: 639447 - RNA, 64 nt, hsa; identical to SEQ ID NO: 183188

SEQ ID NO: 639448 - RNA, 64 nt, hsa; identical to SEQ ID NO: 183189

SEQ ID NO: 639449 - RNA, 64 nt, hsa; identical to SEQ ID NO: 183190

SEQ ID NO: 639450 - RNA, 64 nt, hsa; identical to SEQ ID NO: 183191

SEQ ID NO: 639451 - RNA, 64 nt, hsa; identical to SEQ ID NO: 183192

SEQ ID NO: 639452 - RNA, 64 nt, hsa; identical to SEQ ID NO: 183193

SEQ ID NO: 639453 - RNA, 64 nt, hsa; identical to SEQ ID NO: 183194

SEQ ID NO: 639454 - RNA, 64 nt, hsa; identical to SEQ ID NO: 183195

SEQ ID NO: 639455 - RNA, 64 nt, hsa; identical to SEQ ID NO: 183196

SEQ ID NO: 639456 - RNA, 64 nt, hsa; identical to SEQ ID NO: 183197

SEQ ID NO: 639457 - RNA, 64 nt, hsa; identical to SEQ ID NO: 183198

SEQ ID NO: 639458 - RNA, 64 nt, hsa; identical to SEQ ID NO: 183199

SEQ ID NO: 639459 - RNA, 64 nt, hsa; identical to SEQ ID NO: 183200

SEQ ID NO: 639460 - RNA, 64 nt, hsa; identical to SEQ ID NO: 183201

SEQ ID NO: 639461 - RNA, 64 nt, hsa; identical to SEQ ID NO: 183202

SEQ ID NO: 639462 - RNA, 64 nt, hsa; identical to SEQ ID NO: 183203

SEQ ID NO: 639463 - RNA, 64 nt, hsa; identical to SEQ ID NO: 183204

SEQ ID NO: 639464 - RNA, 64 nt, hsa; identical to SEQ ID NO: 183205

SEQ ID NO: 639465 - RNA, 64 nt, hsa; identical to SEQ ID NO: 183206

SEQ ID NO: 639466 - RNA, 64 nt, hsa; identical to SEQ ID NO: 183207

SEQ ID NO: 639467 - RNA, 64 nt, hsa; identical to SEQ ID NO: 183208

SEQ ID NO: 639468 - RNA, 64 nt, hsa; identical to SEQ ID NO: 183209

SEQ ID NO: 639469 - RNA, 64 nt, hsa; identical to SEQ ID NO: 183210

SEQ ID NO: 639470 - RNA, 64 nt, hsa; identical to SEQ ID NO: 183211

SEQ ID NO: 639471 - RNA, 64 nt, hsa; identical to SEQ ID NO: 183212

SEQ ID NO: 639472 - RNA, 64 nt, hsa; identical to SEQ ID NO: 183213

SEQ ID NO: 639473 - RNA, 64 nt, hsa; identical to SEQ ID NO: 183214

SEQ ID NO: 639474 - RNA, 64 nt, hsa; identical to SEQ ID NO: 183215

SEQ ID NO: 639475 - RNA, 64 nt, hsa; identical to SEQ ID NO: 183216

SEQ ID NO: 639476 - RNA, 64 nt, hsa; identical to SEQ ID NO: 183217

SEQ ID NO: 639477 - RNA, 64 nt, hsa; identical to SEQ ID NO: 183218

SEQ ID NO: 639478 - RNA, 64 nt, hsa; identical to SEQ ID NO: 183219

SEQ ID NO: 639479 - RNA, 64 nt, hsa; identical to SEQ ID NO: 183220

SEQ ID NO: 639480 - RNA, 64 nt, hsa; identical to SEQ ID NO: 183221

SEQ ID NO: 639481 - RNA, 64 nt, hsa; identical to SEQ ID NO: 183222

SEQ ID NO: 639482 - RNA, 64 nt, hsa; identical to SEQ ID NO: 183223

SEQ ID NO: 639483 - RNA, 64 nt, hsa; identical to SEQ ID NO: 183224

SEQ ID NO: 639484 - RNA, 64 nt, hsa; identical to SEQ ID NO: 183225

SEQ ID NO: 639485 - RNA, 64 nt, hsa; identical to SEQ ID NO: 183226

SEQ ID NO: 639486 - RNA, 64 nt, hsa; identical to SEQ ID NO: 183227

SEQ ID NO: 639487 - RNA, 64 nt, hsa; identical to SEQ ID NO: 183228

SEQ ID NO: 639488 - RNA, 64 nt, hsa; identical to SEQ ID NO: 183229

SEQ ID NO: 639489 - RNA, 64 nt, hsa; identical to SEQ ID NO: 183230

SEQ ID NO: 639490 - RNA, 64 nt, hsa; identical to SEQ ID NO: 183231

SEQ ID NO: 639491 - RNA, 64 nt, hsa; identical to SEQ ID NO: 183232

SEQ ID NO: 639492 - RNA, 64 nt, hsa; identical to SEQ ID NO: 183233

SEQ ID NO: 639493 - RNA, 64 nt, hsa; identical to SEQ ID NO: 183234

SEQ ID NO: 639494 - RNA, 64 nt, hsa; identical to SEQ ID NO: 183235

SEQ ID NO: 639495 - RNA, 64 nt, hsa; identical to SEQ ID NO: 183236

SEQ ID NO: 639496 - RNA, 64 nt, hsa; identical to SEQ ID NO: 183237

SEQ ID NO: 639497 - RNA, 64 nt, hsa; identical to SEQ ID NO: 183238

SEQ ID NO: 639498 - RNA, 64 nt, hsa; identical to SEQ ID NO: 183239

SEQ ID NO: 639499 - RNA, 64 nt, hsa; identical to SEQ ID NO: 183240

SEQ ID NO: 639500 - RNA, 64 nt, hsa; identical to SEQ ID NO: 183241

SEQ ID NO: 639501 - RNA, 64 nt, hsa; identical to SEQ ID NO: 183242

SEQ ID NO: 639502 - RNA, 64 nt, hsa; identical to SEQ ID NO: 183243

SEQ ID NO: 639503 - RNA, 64 nt, hsa; identical to SEQ ID NO: 183244

SEQ ID NO: 639504 - RNA, 64 nt, hsa; identical to SEQ ID NO: 183245

SEQ ID NO: 639505 - RNA, 64 nt, hsa; identical to SEQ ID NO: 183246

SEQ ID NO: 639506 - RNA, 64 nt, hsa; identical to SEQ ID NO: 183247

SEQ ID NO: 639507 - RNA, 64 nt, hsa; identical to SEQ ID NO: 183248

SEQ ID NO: 639508 - RNA, 64 nt, hsa; identical to SEQ ID NO: 183249

SEQ ID NO: 639509 - RNA, 64 nt, hsa; identical to SEQ ID NO: 183250

SEQ ID NO: 639510 - RNA, 64 nt, hsa; identical to SEQ ID NO: 183251

SEQ ID NO: 639511 - RNA, 64 nt, hsa; identical to SEQ ID NO: 183252

SEQ ID NO: 639512 - RNA, 64 nt, hsa; identical to SEQ ID NO: 183253

SEQ ID NO: 639513 - RNA, 64 nt, hsa; identical to SEQ ID NO: 183254

SEQ ID NO: 639514 - RNA, 64 nt, hsa; identical to SEQ ID NO: 183255

SEQ ID NO: 639515 - RNA, 64 nt, hsa; identical to SEQ ID NO: 183256

SEQ ID NO: 639516 - RNA, 64 nt, hsa; identical to SEQ ID NO: 183257

SEQ ID NO: 639517 - RNA, 64 nt, hsa; identical to SEQ ID NO: 183258

SEQ ID NO: 639518 - RNA, 64 nt, hsa; identical to SEQ ID NO: 183259

SEQ ID NO: 639519 - RNA, 64 nt, hsa; identical to SEQ ID NO: 183260

SEQ ID NO: 639520 - RNA, 64 nt, hsa; identical to SEQ ID NO: 183261

SEQ ID NO: 639521 - RNA, 64 nt, hsa; identical to SEQ ID NO: 183262

SEQ ID NO: 639522 - RNA, 64 nt, hsa; identical to SEQ ID NO: 183263

SEQ ID NO: 639523 - RNA, 64 nt, hsa; identical to SEQ ID NO: 183264

SEQ ID NO: 639524 - RNA, 64 nt, hsa; identical to SEQ ID NO: 183265

SEQ ID NO: 639525 - RNA, 64 nt, hsa; identical to SEQ ID NO: 183266

SEQ ID NO: 639526 - RNA, 64 nt, hsa; identical to SEQ ID NO: 183267

SEQ ID NO: 639527 - RNA, 64 nt, hsa; identical to SEQ ID NO: 183268

SEQ ID NO: 639528 - RNA, 64 nt, hsa; identical to SEQ ID NO: 183269

SEQ ID NO: 639529 - RNA, 64 nt, hsa; identical to SEQ ID NO: 183270

SEQ ID NO: 639530 - RNA, 64 nt, hsa; identical to SEQ ID NO: 183271

SEQ ID NO: 639531 - RNA, 64 nt, hsa; identical to SEQ ID NO: 183272

SEQ ID NO: 639532 - RNA, 64 nt, hsa; identical to SEQ ID NO: 183273

SEQ ID NO: 639533 - RNA, 64 nt, hsa; identical to SEQ ID NO: 183274

SEQ ID NO: 639534 - RNA, 64 nt, hsa; identical to SEQ ID NO: 183275

SEQ ID NO: 639535 - RNA, 64 nt, hsa; identical to SEQ ID NO: 183276

SEQ ID NO: 639536 - RNA, 64 nt, hsa; identical to SEQ ID NO: 183277

SEQ ID NO: 639537 - RNA, 64 nt, hsa; identical to SEQ ID NO: 183278

SEQ ID NO: 639538 - RNA, 64 nt, hsa; identical to SEQ ID NO: 183279

SEQ ID NO: 639539 - RNA, 64 nt, hsa; identical to SEQ ID NO: 183280

SEQ ID NO: 639540 - RNA, 64 nt, hsa; identical to SEQ ID NO: 183281

SEQ ID NO: 639541 - RNA, 64 nt, hsa; identical to SEQ ID NO: 183282

SEQ ID NO: 639542 - RNA, 64 nt, hsa; identical to SEQ ID NO: 183283

SEQ ID NO: 639543 - RNA, 64 nt, hsa; identical to SEQ ID NO: 183284

SEQ ID NO: 639544 - RNA, 64 nt, hsa; identical to SEQ ID NO: 183285

SEQ ID NO: 639545 - RNA, 64 nt, hsa; identical to SEQ ID NO: 183286

SEQ ID NO: 639546 - RNA, 64 nt, hsa; identical to SEQ ID NO: 183287

SEQ ID NO: 639547 - RNA, 64 nt, hsa; identical to SEQ ID NO: 183288

SEQ ID NO: 639548 - RNA, 64 nt, hsa; identical to SEQ ID NO: 183289

SEQ ID NO: 639549 - RNA, 64 nt, hsa; identical to SEQ ID NO: 183290

SEQ ID NO: 639550 - RNA, 64 nt, hsa; identical to SEQ ID NO: 183291

SEQ ID NO: 639551 - RNA, 64 nt, hsa; identical to SEQ ID NO: 183292

SEQ ID NO: 639552 - RNA, 64 nt, hsa; identical to SEQ ID NO: 183293

SEQ ID NO: 639553 - RNA, 64 nt, hsa; identical to SEQ ID NO: 183294

SEQ ID NO: 639554 - RNA, 64 nt, hsa; identical to SEQ ID NO: 183295

SEQ ID NO: 639555 - RNA, 64 nt, hsa; identical to SEQ ID NO: 183296

SEQ ID NO: 639556 - RNA, 64 nt, hsa; identical to SEQ ID NO: 183297

SEQ ID NO: 639557 - RNA, 64 nt, hsa; identical to SEQ ID NO: 183298

SEQ ID NO: 639558 - RNA, 64 nt, hsa; identical to SEQ ID NO: 183299

SEQ ID NO: 639559 - RNA, 64 nt, hsa; identical to SEQ ID NO: 183300

SEQ ID NO: 639560 - RNA, 64 nt, hsa; identical to SEQ ID NO: 183301

SEQ ID NO: 639561 - RNA, 64 nt, hsa; identical to SEQ ID NO: 183302

SEQ ID NO: 639562 - RNA, 64 nt, hsa; identical to SEQ ID NO: 183303

SEQ ID NO: 639563 - RNA, 64 nt, hsa; identical to SEQ ID NO: 183304

SEQ ID NO: 639564 - RNA, 64 nt, hsa; identical to SEQ ID NO: 183305

SEQ ID NO: 639565 - RNA, 64 nt, hsa; identical to SEQ ID NO: 183306

SEQ ID NO: 639566 - RNA, 64 nt, hsa; identical to SEQ ID NO: 183307

SEQ ID NO: 639567 - RNA, 64 nt, hsa; identical to SEQ ID NO: 183308

SEQ ID NO: 639568 - RNA, 64 nt, hsa; identical to SEQ ID NO: 183309

SEQ ID NO: 639569 - RNA, 64 nt, hsa; identical to SEQ ID NO: 183310

SEQ ID NO: 639570 - RNA, 64 nt, hsa; identical to SEQ ID NO: 183311

SEQ ID NO: 639571 - RNA, 64 nt, hsa; identical to SEQ ID NO: 183312

SEQ ID NO: 639572 - RNA, 64 nt, hsa; identical to SEQ ID NO: 183313

SEQ ID NO: 639573 - RNA, 64 nt, hsa; identical to SEQ ID NO: 183314

SEQ ID NO: 639574 - RNA, 64 nt, hsa; identical to SEQ ID NO: 183315

SEQ ID NO: 639575 - RNA, 64 nt, hsa; identical to SEQ ID NO: 183316

SEQ ID NO: 639576 - RNA, 64 nt, hsa; identical to SEQ ID NO: 183317

SEQ ID NO: 639577 - RNA, 64 nt, hsa; identical to SEQ ID NO: 183318

SEQ ID NO: 639578 - RNA, 64 nt, hsa; identical to SEQ ID NO: 183319

SEQ ID NO: 639579 - RNA, 64 nt, hsa; identical to SEQ ID NO: 183320

SEQ ID NO: 639580 - RNA, 64 nt, hsa; identical to SEQ ID NO: 183321

SEQ ID NO: 639581 - RNA, 64 nt, hsa; identical to SEQ ID NO: 183322

SEQ ID NO: 639582 - RNA, 64 nt, hsa; identical to SEQ ID NO: 183323

SEQ ID NO: 639583 - RNA, 64 nt, hsa; identical to SEQ ID NO: 183324

SEQ ID NO: 639584 - RNA, 64 nt, hsa; identical to SEQ ID NO: 183325

SEQ ID NO: 639585 - RNA, 64 nt, hsa; identical to SEQ ID NO: 183326

SEQ ID NO: 639586 - RNA, 64 nt, hsa; identical to SEQ ID NO: 183327

SEQ ID NO: 639587 - RNA, 64 nt, hsa; identical to SEQ ID NO: 183328

SEQ ID NO: 639588 - RNA, 64 nt, hsa; identical to SEQ ID NO: 183329

SEQ ID NO: 639589 - RNA, 64 nt, hsa; identical to SEQ ID NO: 183330

SEQ ID NO: 639590 - RNA, 64 nt, hsa; identical to SEQ ID NO: 183331

SEQ ID NO: 639591 - RNA, 64 nt, hsa; identical to SEQ ID NO: 183332

SEQ ID NO: 639592 - RNA, 64 nt, hsa; identical to SEQ ID NO: 183333

SEQ ID NO: 639593 - RNA, 64 nt, hsa; identical to SEQ ID NO: 183334

SEQ ID NO: 639594 - RNA, 64 nt, hsa; identical to SEQ ID NO: 183335

SEQ ID NO: 639595 - RNA, 64 nt, hsa; identical to SEQ ID NO: 183336

SEQ ID NO: 639596 - RNA, 64 nt, hsa; identical to SEQ ID NO: 183337

SEQ ID NO: 639597 - RNA, 64 nt, hsa; identical to SEQ ID NO: 183338

SEQ ID NO: 639598 - RNA, 64 nt, hsa; identical to SEQ ID NO: 183339

SEQ ID NO: 639599 - RNA, 64 nt, hsa; identical to SEQ ID NO: 183340

SEQ ID NO: 639600 - RNA, 64 nt, hsa; identical to SEQ ID NO: 183341

SEQ ID NO: 639601 - RNA, 64 nt, hsa; identical to SEQ ID NO: 183342

SEQ ID NO: 639602 - RNA, 64 nt, hsa; identical to SEQ ID NO: 183343

SEQ ID NO: 639603 - RNA, 64 nt, hsa; identical to SEQ ID NO: 183344

SEQ ID NO: 639604 - RNA, 64 nt, hsa; identical to SEQ ID NO: 183345

SEQ ID NO: 639605 - RNA, 64 nt, hsa; identical to SEQ ID NO: 183346

SEQ ID NO: 639606 - RNA, 64 nt, hsa; identical to SEQ ID NO: 183347

SEQ ID NO: 639607 - RNA, 64 nt, hsa; identical to SEQ ID NO: 183348

SEQ ID NO: 639608 - RNA, 64 nt, hsa; identical to SEQ ID NO: 183349

SEQ ID NO: 639609 - RNA, 64 nt, hsa; identical to SEQ ID NO: 183350

SEQ ID NO: 639610 - RNA, 64 nt, hsa; identical to SEQ ID NO: 183351

SEQ ID NO: 639611 - RNA, 64 nt, hsa; identical to SEQ ID NO: 183352

SEQ ID NO: 639612 - RNA, 64 nt, hsa; identical to SEQ ID NO: 183353

SEQ ID NO: 639613 - RNA, 64 nt, hsa; identical to SEQ ID NO: 183354

SEQ ID NO: 639614 - RNA, 64 nt, hsa; identical to SEQ ID NO: 183355

SEQ ID NO: 639615 - RNA, 64 nt, hsa; identical to SEQ ID NO: 183356

SEQ ID NO: 639616 - RNA, 64 nt, hsa; identical to SEQ ID NO: 183357

SEQ ID NO: 639617 - RNA, 64 nt, hsa; identical to SEQ ID NO: 183358

SEQ ID NO: 639618 - RNA, 64 nt, hsa; identical to SEQ ID NO: 183359

SEQ ID NO: 639619 - RNA, 64 nt, hsa; identical to SEQ ID NO: 183360

SEQ ID NO: 639620 - RNA, 64 nt, hsa; identical to SEQ ID NO: 183361

SEQ ID NO: 639621 - RNA, 64 nt, hsa; identical to SEQ ID NO: 183362

SEQ ID NO: 639622 - RNA, 64 nt, hsa; identical to SEQ ID NO: 183363

SEQ ID NO: 639623 - RNA, 64 nt, hsa; identical to SEQ ID NO: 183364

SEQ ID NO: 639624 - RNA, 64 nt, hsa; identical to SEQ ID NO: 183365

SEQ ID NO: 639625 - RNA, 64 nt, hsa; identical to SEQ ID NO: 183366

SEQ ID NO: 639626 - RNA, 64 nt, hsa; identical to SEQ ID NO: 183367

SEQ ID NO: 639627 - RNA, 64 nt, hsa; identical to SEQ ID NO: 183368

SEQ ID NO: 639628 - RNA, 63 nt, hsa; identical to SEQ ID NO: 183369

SEQ ID NO: 639629 - RNA, 64 nt, hsa; identical to SEQ ID NO: 183370

SEQ ID NO: 639630 - RNA, 64 nt, hsa; identical to SEQ ID NO: 183371

SEQ ID NO: 639631 - RNA, 64 nt, hsa; identical to SEQ ID NO: 183372

SEQ ID NO: 639632 - RNA, 64 nt, hsa; identical to SEQ ID NO: 183373

SEQ ID NO: 639633 - RNA, 64 nt, hsa; identical to SEQ ID NO: 183374

SEQ ID NO: 639634 - RNA, 64 nt, hsa; identical to SEQ ID NO: 183375

SEQ ID NO: 639635 - RNA, 64 nt, hsa; identical to SEQ ID NO: 183376

SEQ ID NO: 639636 - RNA, 64 nt, hsa; identical to SEQ ID NO: 183377

SEQ ID NO: 639637 - RNA, 64 nt, hsa; identical to SEQ ID NO: 183378

SEQ ID NO: 639638 - RNA, 64 nt, hsa; identical to SEQ ID NO: 183379

SEQ ID NO: 639639 - RNA, 64 nt, hsa; identical to SEQ ID NO: 183380

SEQ ID NO: 639640 - RNA, 64 nt, hsa; identical to SEQ ID NO: 183381

SEQ ID NO: 639641 - RNA, 64 nt, hsa; identical to SEQ ID NO: 183382

SEQ ID NO: 639642 - RNA, 64 nt, hsa; identical to SEQ ID NO: 183383

SEQ ID NO: 639643 - RNA, 64 nt, hsa; identical to SEQ ID NO: 183384

SEQ ID NO: 639644 - RNA, 64 nt, hsa; identical to SEQ ID NO: 183385

SEQ ID NO: 639645 - RNA, 64 nt, hsa; identical to SEQ ID NO: 183386

SEQ ID NO: 639646 - RNA, 64 nt, hsa; identical to SEQ ID NO: 183387

SEQ ID NO: 639647 - RNA, 64 nt, hsa; identical to SEQ ID NO: 183388

SEQ ID NO: 639648 - RNA, 64 nt, hsa; identical to SEQ ID NO: 183389

SEQ ID NO: 639649 - RNA, 64 nt, hsa; identical to SEQ ID NO: 183390

SEQ ID NO: 639650 - RNA, 64 nt, hsa; identical to SEQ ID NO: 183391

SEQ ID NO: 639651 - RNA, 64 nt, hsa; identical to SEQ ID NO: 183392

SEQ ID NO: 639652 - RNA, 64 nt, hsa; identical to SEQ ID NO: 183393

SEQ ID NO: 639653 - RNA, 64 nt, hsa; identical to SEQ ID NO: 183394

SEQ ID NO: 639654 - RNA, 64 nt, hsa; identical to SEQ ID NO: 183395

SEQ ID NO: 639655 - RNA, 64 nt, hsa; identical to SEQ ID NO: 183396

SEQ ID NO: 639656 - RNA, 64 nt, hsa; identical to SEQ ID NO: 183397

SEQ ID NO: 639657 - RNA, 64 nt, hsa; identical to SEQ ID NO: 183398

SEQ ID NO: 639658 - RNA, 64 nt, hsa; identical to SEQ ID NO: 183399

SEQ ID NO: 639659 - RNA, 64 nt, hsa; identical to SEQ ID NO: 183400

SEQ ID NO: 639660 - RNA, 64 nt, hsa; identical to SEQ ID NO: 183401

SEQ ID NO: 639661 - RNA, 64 nt, hsa; identical to SEQ ID NO: 183402

SEQ ID NO: 639662 - RNA, 64 nt, hsa; identical to SEQ ID NO: 183403

SEQ ID NO: 639663 - RNA, 64 nt, hsa; identical to SEQ ID NO: 183404

SEQ ID NO: 639664 - RNA, 64 nt, hsa; identical to SEQ ID NO: 183405

SEQ ID NO: 639665 - RNA, 64 nt, hsa; identical to SEQ ID NO: 183406

SEQ ID NO: 639666 - RNA, 64 nt, hsa; identical to SEQ ID NO: 183407

SEQ ID NO: 639667 - RNA, 64 nt, hsa; identical to SEQ ID NO: 183408

SEQ ID NO: 639668 - RNA, 64 nt, hsa; identical to SEQ ID NO: 183409

SEQ ID NO: 639669 - RNA, 64 nt, hsa; identical to SEQ ID NO: 183410

SEQ ID NO: 639670 - RNA, 64 nt, hsa; identical to SEQ ID NO: 183411

SEQ ID NO: 639671 - RNA, 64 nt, hsa; identical to SEQ ID NO: 183412

SEQ ID NO: 639672 - RNA, 64 nt, hsa; identical to SEQ ID NO: 183413

SEQ ID NO: 639673 - RNA, 64 nt, hsa; identical to SEQ ID NO: 183414

SEQ ID NO: 639674 - RNA, 64 nt, hsa; identical to SEQ ID NO: 183415

SEQ ID NO: 639675 - RNA, 64 nt, hsa; identical to SEQ ID NO: 183416

SEQ ID NO: 639676 - RNA, 64 nt, hsa; identical to SEQ ID NO: 183417

SEQ ID NO: 639677 - RNA, 64 nt, hsa; identical to SEQ ID NO: 183418

SEQ ID NO: 639678 - RNA, 64 nt, hsa; identical to SEQ ID NO: 183419

SEQ ID NO: 639679 - RNA, 64 nt, hsa; identical to SEQ ID NO: 183420

SEQ ID NO: 639680 - RNA, 64 nt, hsa; identical to SEQ ID NO: 183421

SEQ ID NO: 639681 - RNA, 64 nt, hsa; identical to SEQ ID NO: 183422

SEQ ID NO: 639682 - RNA, 64 nt, hsa; identical to SEQ ID NO: 183423

SEQ ID NO: 639683 - RNA, 64 nt, hsa; identical to SEQ ID NO: 183424

SEQ ID NO: 639684 - RNA, 64 nt, hsa; identical to SEQ ID NO: 183425

SEQ ID NO: 639685 - RNA, 64 nt, hsa; identical to SEQ ID NO: 183426

SEQ ID NO: 639686 - RNA, 64 nt, hsa; identical to SEQ ID NO: 183427

SEQ ID NO: 639687 - RNA, 64 nt, hsa; identical to SEQ ID NO: 183428

SEQ ID NO: 639688 - RNA, 64 nt, hsa; identical to SEQ ID NO: 183429

SEQ ID NO: 639689 - RNA, 64 nt, hsa; identical to SEQ ID NO: 183430

SEQ ID NO: 639690 - RNA, 64 nt, hsa; identical to SEQ ID NO: 183431

SEQ ID NO: 639691 - RNA, 64 nt, hsa; identical to SEQ ID NO: 183432

SEQ ID NO: 639692 - RNA, 64 nt, hsa; identical to SEQ ID NO: 183433

SEQ ID NO: 639693 - RNA, 64 nt, hsa; identical to SEQ ID NO: 183434

SEQ ID NO: 639694 - RNA, 64 nt, hsa; identical to SEQ ID NO: 183435

SEQ ID NO: 639695 - RNA, 64 nt, hsa; identical to SEQ ID NO: 183436

SEQ ID NO: 639696 - RNA, 64 nt, hsa; identical to SEQ ID NO: 183437

SEQ ID NO: 639697 - RNA, 64 nt, hsa; identical to SEQ ID NO: 183438

SEQ ID NO: 639698 - RNA, 64 nt, hsa; identical to SEQ ID NO: 183439

SEQ ID NO: 639699 - RNA, 64 nt, hsa; identical to SEQ ID NO: 183440

SEQ ID NO: 639700 - RNA, 64 nt, hsa; identical to SEQ ID NO: 183441

SEQ ID NO: 639701 - RNA, 64 nt, hsa; identical to SEQ ID NO: 183442

SEQ ID NO: 639702 - RNA, 64 nt, hsa; identical to SEQ ID NO: 183443

SEQ ID NO: 639703 - RNA, 64 nt, hsa; identical to SEQ ID NO: 183444

SEQ ID NO: 639704 - RNA, 64 nt, hsa; identical to SEQ ID NO: 183445

SEQ ID NO: 639705 - RNA, 64 nt, hsa; identical to SEQ ID NO: 183446

SEQ ID NO: 639706 - RNA, 64 nt, hsa; identical to SEQ ID NO: 183447

SEQ ID NO: 639707 - RNA, 64 nt, hsa; identical to SEQ ID NO: 183448

SEQ ID NO: 639708 - RNA, 64 nt, hsa; identical to SEQ ID NO: 183449

SEQ ID NO: 639709 - RNA, 64 nt, hsa; identical to SEQ ID NO: 183450

SEQ ID NO: 639710 - RNA, 64 nt, hsa; identical to SEQ ID NO: 183451

SEQ ID NO: 639711 - RNA, 64 nt, hsa; identical to SEQ ID NO: 183452

SEQ ID NO: 639712 - RNA, 64 nt, hsa; identical to SEQ ID NO: 183453

SEQ ID NO: 639713 - RNA, 64 nt, hsa; identical to SEQ ID NO: 183454

SEQ ID NO: 639714 - RNA, 64 nt, hsa; identical to SEQ ID NO: 183455

SEQ ID NO: 639715 - RNA, 64 nt, hsa; identical to SEQ ID NO: 183456

SEQ ID NO: 639716 - RNA, 64 nt, hsa; identical to SEQ ID NO: 183457

SEQ ID NO: 639717 - RNA, 64 nt, hsa; identical to SEQ ID NO: 183458

SEQ ID NO: 639718 - RNA, 64 nt, hsa; identical to SEQ ID NO: 183459

SEQ ID NO: 639719 - RNA, 64 nt, hsa; identical to SEQ ID NO: 183460

SEQ ID NO: 639720 - RNA, 64 nt, hsa; identical to SEQ ID NO: 183461

SEQ ID NO: 639721 - RNA, 64 nt, hsa; identical to SEQ ID NO: 183462

SEQ ID NO: 639722 - RNA, 64 nt, hsa; identical to SEQ ID NO: 183463

SEQ ID NO: 639723 - RNA, 64 nt, hsa; identical to SEQ ID NO: 183464

SEQ ID NO: 639724 - RNA, 64 nt, hsa; identical to SEQ ID NO: 183465

SEQ ID NO: 639725 - RNA, 64 nt, hsa; identical to SEQ ID NO: 183466

SEQ ID NO: 639726 - RNA, 64 nt, hsa; identical to SEQ ID NO: 183467

SEQ ID NO: 639727 - RNA, 64 nt, hsa; identical to SEQ ID NO: 183468

SEQ ID NO: 639728 - RNA, 64 nt, hsa; identical to SEQ ID NO: 183469

SEQ ID NO: 639729 - RNA, 64 nt, hsa; identical to SEQ ID NO: 183470

SEQ ID NO: 639730 - RNA, 64 nt, hsa; identical to SEQ ID NO: 183471

SEQ ID NO: 639731 - RNA, 64 nt, hsa; identical to SEQ ID NO: 183472

SEQ ID NO: 639732 - RNA, 64 nt, hsa; identical to SEQ ID NO: 183473

SEQ ID NO: 639733 - RNA, 64 nt, hsa; identical to SEQ ID NO: 183474

SEQ ID NO: 639734 - RNA, 64 nt, hsa; identical to SEQ ID NO: 183475

SEQ ID NO: 639735 - RNA, 64 nt, hsa; identical to SEQ ID NO: 183476

SEQ ID NO: 639736 - RNA, 64 nt, hsa; identical to SEQ ID NO: 183477

SEQ ID NO: 639737 - RNA, 64 nt, hsa; identical to SEQ ID NO: 183478

SEQ ID NO: 639738 - RNA, 64 nt, hsa; identical to SEQ ID NO: 183479

SEQ ID NO: 639739 - RNA, 64 nt, hsa; identical to SEQ ID NO: 183480

SEQ ID NO: 639740 - RNA, 64 nt, hsa; identical to SEQ ID NO: 183481

SEQ ID NO: 639741 - RNA, 64 nt, hsa; identical to SEQ ID NO: 183482

SEQ ID NO: 639742 - RNA, 64 nt, hsa; identical to SEQ ID NO: 183483

SEQ ID NO: 639743 - RNA, 64 nt, hsa; identical to SEQ ID NO: 183484

SEQ ID NO: 639744 - RNA, 64 nt, hsa; identical to SEQ ID NO: 183485

SEQ ID NO: 639745 - RNA, 64 nt, hsa; identical to SEQ ID NO: 183486

SEQ ID NO: 639746 - RNA, 64 nt, hsa; identical to SEQ ID NO: 183487

SEQ ID NO: 639747 - RNA, 64 nt, hsa; identical to SEQ ID NO: 183488

SEQ ID NO: 639748 - RNA, 64 nt, hsa; identical to SEQ ID NO: 183489

SEQ ID NO: 639749 - RNA, 64 nt, hsa; identical to SEQ ID NO: 183490

SEQ ID NO: 639750 - RNA, 64 nt, hsa; identical to SEQ ID NO: 183491

SEQ ID NO: 639751 - RNA, 64 nt, hsa; identical to SEQ ID NO: 183492

SEQ ID NO: 639752 - RNA, 64 nt, hsa; identical to SEQ ID NO: 183493

SEQ ID NO: 639753 - RNA, 64 nt, hsa; identical to SEQ ID NO: 183494

SEQ ID NO: 639754 - RNA, 64 nt, hsa; identical to SEQ ID NO: 183495

SEQ ID NO: 639755 - RNA, 64 nt, hsa; identical to SEQ ID NO: 183496

SEQ ID NO: 639756 - RNA, 64 nt, hsa; identical to SEQ ID NO: 183497

SEQ ID NO: 639757 - RNA, 64 nt, hsa; identical to SEQ ID NO: 183498

SEQ ID NO: 639758 - RNA, 64 nt, hsa; identical to SEQ ID NO: 183499

SEQ ID NO: 639759 - RNA, 64 nt, hsa; identical to SEQ ID NO: 183500

SEQ ID NO: 639760 - RNA, 64 nt, hsa; identical to SEQ ID NO: 183501

SEQ ID NO: 639761 - RNA, 64 nt, hsa; identical to SEQ ID NO: 183502

SEQ ID NO: 639762 - RNA, 64 nt, hsa; identical to SEQ ID NO: 183503

SEQ ID NO: 639763 - RNA, 64 nt, hsa; identical to SEQ ID NO: 183504

SEQ ID NO: 639764 - RNA, 64 nt, hsa; identical to SEQ ID NO: 183505

SEQ ID NO: 639765 - RNA, 64 nt, hsa; identical to SEQ ID NO: 183506

SEQ ID NO: 639766 - RNA, 64 nt, hsa; identical to SEQ ID NO: 183507

SEQ ID NO: 639767 - RNA, 64 nt, hsa; identical to SEQ ID NO: 183508

SEQ ID NO: 639768 - RNA, 64 nt, hsa; identical to SEQ ID NO: 183509

SEQ ID NO: 639769 - RNA, 64 nt, hsa; identical to SEQ ID NO: 183510

SEQ ID NO: 639770 - RNA, 64 nt, hsa; identical to SEQ ID NO: 183511

SEQ ID NO: 639771 - RNA, 64 nt, hsa; identical to SEQ ID NO: 183512

SEQ ID NO: 639772 - RNA, 64 nt, hsa; identical to SEQ ID NO: 183513

SEQ ID NO: 639773 - RNA, 64 nt, hsa; identical to SEQ ID NO: 183514

SEQ ID NO: 639774 - RNA, 64 nt, hsa; identical to SEQ ID NO: 183515

SEQ ID NO: 639775 - RNA, 64 nt, hsa; identical to SEQ ID NO: 183516

SEQ ID NO: 639776 - RNA, 64 nt, hsa; identical to SEQ ID NO: 183517

SEQ ID NO: 639777 - RNA, 64 nt, hsa; identical to SEQ ID NO: 183518

SEQ ID NO: 639778 - RNA, 64 nt, hsa; identical to SEQ ID NO: 183519

SEQ ID NO: 639779 - RNA, 64 nt, hsa; identical to SEQ ID NO: 183520

SEQ ID NO: 639780 - RNA, 64 nt, hsa; identical to SEQ ID NO: 183521

SEQ ID NO: 639781 - RNA, 64 nt, hsa; identical to SEQ ID NO: 183522

SEQ ID NO: 639782 - RNA, 64 nt, hsa; identical to SEQ ID NO: 183523

SEQ ID NO: 639783 - RNA, 64 nt, hsa; identical to SEQ ID NO: 183524

SEQ ID NO: 639784 - RNA, 64 nt, hsa; identical to SEQ ID NO: 183525

SEQ ID NO: 639785 - RNA, 64 nt, hsa; identical to SEQ ID NO: 183526

SEQ ID NO: 639786 - RNA, 64 nt, hsa; identical to SEQ ID NO: 183527

SEQ ID NO: 639787 - RNA, 64 nt, hsa; identical to SEQ ID NO: 183528

SEQ ID NO: 639788 - RNA, 64 nt, hsa; identical to SEQ ID NO: 183529

SEQ ID NO: 639789 - RNA, 64 nt, hsa; identical to SEQ ID NO: 183530

SEQ ID NO: 639790 - RNA, 64 nt, hsa; identical to SEQ ID NO: 183531

SEQ ID NO: 639791 - RNA, 64 nt, hsa; identical to SEQ ID NO: 183532

SEQ ID NO: 639792 - RNA, 64 nt, hsa; identical to SEQ ID NO: 183533

SEQ ID NO: 639793 - RNA, 64 nt, hsa; identical to SEQ ID NO: 183534

SEQ ID NO: 639794 - RNA, 64 nt, hsa; identical to SEQ ID NO: 183535

SEQ ID NO: 639795 - RNA, 64 nt, hsa; identical to SEQ ID NO: 183536

SEQ ID NO: 639796 - RNA, 64 nt, hsa; identical to SEQ ID NO: 183537

SEQ ID NO: 639797 - RNA, 64 nt, hsa; identical to SEQ ID NO: 183538

SEQ ID NO: 639798 - RNA, 64 nt, hsa; identical to SEQ ID NO: 183539

SEQ ID NO: 639799 - RNA, 64 nt, hsa; identical to SEQ ID NO: 183540

SEQ ID NO: 639800 - RNA, 64 nt, hsa; identical to SEQ ID NO: 183541

SEQ ID NO: 639801 - RNA, 64 nt, hsa; identical to SEQ ID NO: 183542

SEQ ID NO: 639802 - RNA, 64 nt, hsa; identical to SEQ ID NO: 183543

SEQ ID NO: 639803 - RNA, 64 nt, hsa; identical to SEQ ID NO: 183544

SEQ ID NO: 639804 - RNA, 64 nt, hsa; identical to SEQ ID NO: 183545

SEQ ID NO: 639805 - RNA, 64 nt, hsa; identical to SEQ ID NO: 183546

SEQ ID NO: 639806 - RNA, 64 nt, hsa; identical to SEQ ID NO: 183547

SEQ ID NO: 639807 - RNA, 64 nt, hsa; identical to SEQ ID NO: 183548

SEQ ID NO: 639808 - RNA, 64 nt, hsa; identical to SEQ ID NO: 183549

SEQ ID NO: 639809 - RNA, 64 nt, hsa; identical to SEQ ID NO: 183550

SEQ ID NO: 639810 - RNA, 64 nt, hsa; identical to SEQ ID NO: 183551

SEQ ID NO: 639811 - RNA, 64 nt, hsa; identical to SEQ ID NO: 183552

SEQ ID NO: 639812 - RNA, 64 nt, hsa; identical to SEQ ID NO: 183553

SEQ ID NO: 639813 - RNA, 64 nt, hsa; identical to SEQ ID NO: 183554

SEQ ID NO: 639814 - RNA, 64 nt, hsa; identical to SEQ ID NO: 183555

SEQ ID NO: 639815 - RNA, 64 nt, hsa; identical to SEQ ID NO: 183556

SEQ ID NO: 639816 - RNA, 64 nt, hsa; identical to SEQ ID NO: 183557

SEQ ID NO: 639817 - RNA, 64 nt, hsa; identical to SEQ ID NO: 183558

SEQ ID NO: 639818 - RNA, 64 nt, hsa; identical to SEQ ID NO: 183559

SEQ ID NO: 639819 - RNA, 64 nt, hsa; identical to SEQ ID NO: 183560

SEQ ID NO: 639820 - RNA, 64 nt, hsa; identical to SEQ ID NO: 183561

SEQ ID NO: 639821 - RNA, 64 nt, hsa; identical to SEQ ID NO: 183562

SEQ ID NO: 639822 - RNA, 64 nt, hsa; identical to SEQ ID NO: 183563

SEQ ID NO: 639823 - RNA, 64 nt, hsa; identical to SEQ ID NO: 183564

SEQ ID NO: 639824 - RNA, 64 nt, hsa; identical to SEQ ID NO: 183565

SEQ ID NO: 639825 - RNA, 64 nt, hsa; identical to SEQ ID NO: 183566

SEQ ID NO: 639826 - RNA, 64 nt, hsa; identical to SEQ ID NO: 183567

SEQ ID NO: 639827 - RNA, 64 nt, hsa; identical to SEQ ID NO: 183568

SEQ ID NO: 639828 - RNA, 64 nt, hsa; identical to SEQ ID NO: 183569

SEQ ID NO: 639829 - RNA, 64 nt, hsa; identical to SEQ ID NO: 183570

SEQ ID NO: 639830 - RNA, 64 nt, hsa; identical to SEQ ID NO: 183571

SEQ ID NO: 639831 - RNA, 64 nt, hsa; identical to SEQ ID NO: 183572

SEQ ID NO: 639832 - RNA, 64 nt, hsa; identical to SEQ ID NO: 183573

SEQ ID NO: 639833 - RNA, 64 nt, hsa; identical to SEQ ID NO: 183574

SEQ ID NO: 639834 - RNA, 64 nt, hsa; identical to SEQ ID NO: 183575

SEQ ID NO: 639835 - RNA, 64 nt, hsa; identical to SEQ ID NO: 183576

SEQ ID NO: 639836 - RNA, 64 nt, hsa; identical to SEQ ID NO: 183577

SEQ ID NO: 639837 - RNA, 64 nt, hsa; identical to SEQ ID NO: 183578

SEQ ID NO: 639838 - RNA, 64 nt, hsa; identical to SEQ ID NO: 183579

SEQ ID NO: 639839 - RNA, 64 nt, hsa; identical to SEQ ID NO: 183580

SEQ ID NO: 639840 - RNA, 64 nt, hsa; identical to SEQ ID NO: 183581

SEQ ID NO: 639841 - RNA, 64 nt, hsa; identical to SEQ ID NO: 183582

SEQ ID NO: 639842 - RNA, 64 nt, hsa; identical to SEQ ID NO: 183583

SEQ ID NO: 639843 - RNA, 64 nt, hsa; identical to SEQ ID NO: 183584

SEQ ID NO: 639844 - RNA, 64 nt, hsa; identical to SEQ ID NO: 183585

SEQ ID NO: 639845 - RNA, 64 nt, hsa; identical to SEQ ID NO: 183586

SEQ ID NO: 639846 - RNA, 64 nt, hsa; identical to SEQ ID NO: 183587

SEQ ID NO: 639847 - RNA, 64 nt, hsa; identical to SEQ ID NO: 183588

SEQ ID NO: 639848 - RNA, 64 nt, hsa; identical to SEQ ID NO: 183589

SEQ ID NO: 639849 - RNA, 64 nt, hsa; identical to SEQ ID NO: 183590

SEQ ID NO: 639850 - RNA, 64 nt, hsa; identical to SEQ ID NO: 183591

SEQ ID NO: 639851 - RNA, 64 nt, hsa; identical to SEQ ID NO: 183592

SEQ ID NO: 639852 - RNA, 64 nt, hsa; identical to SEQ ID NO: 183593

SEQ ID NO: 639853 - RNA, 64 nt, hsa; identical to SEQ ID NO: 183594

SEQ ID NO: 639854 - RNA, 64 nt, hsa; identical to SEQ ID NO: 183595

SEQ ID NO: 639855 - RNA, 64 nt, hsa; identical to SEQ ID NO: 183596

SEQ ID NO: 639856 - RNA, 64 nt, hsa; identical to SEQ ID NO: 183597

SEQ ID NO: 639857 - RNA, 64 nt, hsa; identical to SEQ ID NO: 183598

SEQ ID NO: 639858 - RNA, 64 nt, hsa; identical to SEQ ID NO: 183599

SEQ ID NO: 639859 - RNA, 64 nt, hsa; identical to SEQ ID NO: 183600

SEQ ID NO: 639860 - RNA, 64 nt, hsa; identical to SEQ ID NO: 183601

SEQ ID NO: 639861 - RNA, 64 nt, hsa; identical to SEQ ID NO: 183602

SEQ ID NO: 639862 - RNA, 64 nt, hsa; identical to SEQ ID NO: 183603

SEQ ID NO: 639863 - RNA, 64 nt, hsa; identical to SEQ ID NO: 541607

SEQ ID NO: 639864 - RNA, 64 nt, hsa; identical to SEQ ID NO: 541608

SEQ ID NO: 639865 - RNA, 64 nt, hsa; identical to SEQ ID NO: 541609

SEQ ID NO: 639866 - RNA, 64 nt, hsa; identical to SEQ ID NO: 541610

SEQ ID NO: 639867 - RNA, 64 nt, hsa; identical to SEQ ID NO: 345901

SEQ ID NO: 639868 - RNA, 64 nt, hsa; identical to SEQ ID NO: 345902

SEQ ID NO: 639869 - RNA, 64 nt, hsa; identical to SEQ ID NO: 345903

SEQ ID NO: 639870 - RNA, 64 nt, hsa; identical to SEQ ID NO: 345904

SEQ ID NO: 639871 - RNA, 64 nt, hsa; identical to SEQ ID NO: 345905

SEQ ID NO: 639872 - RNA, 64 nt, hsa; identical to SEQ ID NO: 345906

SEQ ID NO: 639873 - RNA, 64 nt, hsa; identical to SEQ ID NO: 345907

SEQ ID NO: 639874 - RNA, 64 nt, hsa; identical to SEQ ID NO: 345908

SEQ ID NO: 639875 - RNA, 64 nt, hsa; identical to SEQ ID NO: 345909

SEQ ID NO: 639876 - RNA, 64 nt, hsa; identical to SEQ ID NO: 345910

SEQ ID NO: 639877 - RNA, 64 nt, hsa; identical to SEQ ID NO: 345911

SEQ ID NO: 639878 - RNA, 64 nt, hsa; identical to SEQ ID NO: 345912

SEQ ID NO: 639879 - RNA, 64 nt, hsa; identical to SEQ ID NO: 345913

SEQ ID NO: 639880 - RNA, 64 nt, hsa; identical to SEQ ID NO: 345914

SEQ ID NO: 639881 - RNA, 64 nt, hsa; identical to SEQ ID NO: 345915

SEQ ID NO: 639882 - RNA, 64 nt, hsa; identical to SEQ ID NO: 345916

SEQ ID NO: 639883 - RNA, 64 nt, hsa; identical to SEQ ID NO: 345917

SEQ ID NO: 639884 - RNA, 64 nt, hsa; identical to SEQ ID NO: 345918

SEQ ID NO: 639885 - RNA, 64 nt, hsa; identical to SEQ ID NO: 345919

SEQ ID NO: 639886 - RNA, 64 nt, hsa; identical to SEQ ID NO: 345920

SEQ ID NO: 639887 - RNA, 64 nt, hsa; identical to SEQ ID NO: 345921

SEQ ID NO: 639888 - RNA, 64 nt, hsa; identical to SEQ ID NO: 345922

SEQ ID NO: 639889 - RNA, 64 nt, hsa; identical to SEQ ID NO: 345923

SEQ ID NO: 639890 - RNA, 64 nt, hsa; identical to SEQ ID NO: 345924

SEQ ID NO: 639891 - RNA, 64 nt, hsa; identical to SEQ ID NO: 345925

SEQ ID NO: 639892 - RNA, 64 nt, hsa; identical to SEQ ID NO: 345926

SEQ ID NO: 639893 - RNA, 64 nt, hsa; identical to SEQ ID NO: 345927

SEQ ID NO: 639894 - RNA, 64 nt, hsa; identical to SEQ ID NO: 345928

SEQ ID NO: 639895 - RNA, 64 nt, hsa; identical to SEQ ID NO: 345929

SEQ ID NO: 639896 - RNA, 64 nt, hsa; identical to SEQ ID NO: 345930

SEQ ID NO: 639897 - RNA, 64 nt, hsa; identical to SEQ ID NO: 345931

SEQ ID NO: 639898 - RNA, 64 nt, hsa; identical to SEQ ID NO: 345932

SEQ ID NO: 639899 - RNA, 64 nt, hsa; identical to SEQ ID NO: 345933

SEQ ID NO: 639900 - RNA, 64 nt, hsa; identical to SEQ ID NO: 345934

SEQ ID NO: 639901 - RNA, 64 nt, hsa; identical to SEQ ID NO: 345935

SEQ ID NO: 639902 - RNA, 64 nt, hsa; identical to SEQ ID NO: 345936

SEQ ID NO: 639903 - RNA, 64 nt, hsa; identical to SEQ ID NO: 345937

SEQ ID NO: 639904 - RNA, 64 nt, hsa; identical to SEQ ID NO: 345938

SEQ ID NO: 639905 - RNA, 64 nt, hsa; identical to SEQ ID NO: 345939

SEQ ID NO: 639906 - RNA, 64 nt, hsa; identical to SEQ ID NO: 345940

SEQ ID NO: 639907 - RNA, 64 nt, hsa; identical to SEQ ID NO: 345941

SEQ ID NO: 639908 - RNA, 64 nt, hsa; identical to SEQ ID NO: 345942

SEQ ID NO: 639909 - RNA, 64 nt, hsa; identical to SEQ ID NO: 345943

SEQ ID NO: 639910 - RNA, 64 nt, hsa; identical to SEQ ID NO: 345944

SEQ ID NO: 639911 - RNA, 64 nt, hsa; identical to SEQ ID NO: 345945

SEQ ID NO: 639912 - RNA, 64 nt, hsa; identical to SEQ ID NO: 345946

SEQ ID NO: 639913 - RNA, 64 nt, hsa; identical to SEQ ID NO: 345947

SEQ ID NO: 639914 - RNA, 64 nt, hsa; identical to SEQ ID NO: 345948

SEQ ID NO: 639915 - RNA, 64 nt, hsa; identical to SEQ ID NO: 345949

SEQ ID NO: 639916 - RNA, 64 nt, hsa; identical to SEQ ID NO: 345950

SEQ ID NO: 639917 - RNA, 64 nt, hsa; identical to SEQ ID NO: 345951

SEQ ID NO: 639918 - RNA, 64 nt, hsa; identical to SEQ ID NO: 345952

SEQ ID NO: 639919 - RNA, 64 nt, hsa; identical to SEQ ID NO: 345953

SEQ ID NO: 639920 - RNA, 64 nt, hsa; identical to SEQ ID NO: 345954

SEQ ID NO: 639921 - RNA, 64 nt, hsa; identical to SEQ ID NO: 345955

SEQ ID NO: 639922 - RNA, 64 nt, hsa; identical to SEQ ID NO: 345956

SEQ ID NO: 639923 - RNA, 64 nt, hsa; identical to SEQ ID NO: 345957

SEQ ID NO: 639924 - RNA, 64 nt, hsa; identical to SEQ ID NO: 345958

SEQ ID NO: 639925 - RNA, 64 nt, hsa; identical to SEQ ID NO: 345959

SEQ ID NO: 639926 - RNA, 64 nt, hsa; identical to SEQ ID NO: 345960

SEQ ID NO: 639927 - RNA, 64 nt, hsa; identical to SEQ ID NO: 345961

SEQ ID NO: 639928 - RNA, 64 nt, hsa; identical to SEQ ID NO: 345962

SEQ ID NO: 639929 - RNA, 64 nt, hsa; identical to SEQ ID NO: 345963

SEQ ID NO: 639930 - RNA, 64 nt, hsa; identical to SEQ ID NO: 345964

SEQ ID NO: 639931 - RNA, 64 nt, hsa; identical to SEQ ID NO: 345965

SEQ ID NO: 639932 - RNA, 64 nt, hsa; identical to SEQ ID NO: 345966

SEQ ID NO: 639933 - RNA, 64 nt, hsa; identical to SEQ ID NO: 345967

SEQ ID NO: 639934 - RNA, 50 nt, hsa; identical to SEQ ID NO: 345968

SEQ ID NO: 639935 - RNA, 64 nt, hsa; identical to SEQ ID NO: 345969

SEQ ID NO: 639936 - RNA, 64 nt, hsa; identical to SEQ ID NO: 345970

SEQ ID NO: 639937 - RNA, 64 nt, hsa; identical to SEQ ID NO: 345971

SEQ ID NO: 639938 - RNA, 64 nt, hsa; identical to SEQ ID NO: 345972

SEQ ID NO: 639939 - RNA, 64 nt, hsa; identical to SEQ ID NO: 345973

SEQ ID NO: 639940 - RNA, 64 nt, hsa; identical to SEQ ID NO: 345974

SEQ ID NO: 639941 - RNA, 64 nt, hsa; identical to SEQ ID NO: 345975

SEQ ID NO: 639942 - RNA, 64 nt, hsa; identical to SEQ ID NO: 345976

SEQ ID NO: 639943 - RNA, 64 nt, hsa; identical to SEQ ID NO: 345977

SEQ ID NO: 639944 - RNA, 64 nt, hsa; identical to SEQ ID NO: 345978

SEQ ID NO: 639945 - RNA, 64 nt, hsa; identical to SEQ ID NO: 345979

SEQ ID NO: 639946 - RNA, 64 nt, hsa; identical to SEQ ID NO: 345980

SEQ ID NO: 639947 - RNA, 64 nt, hsa; identical to SEQ ID NO: 345981

SEQ ID NO: 639948 - RNA, 64 nt, hsa; identical to SEQ ID NO: 345982

SEQ ID NO: 639949 - RNA, 64 nt, hsa; identical to SEQ ID NO: 345983

SEQ ID NO: 639950 - RNA, 64 nt, hsa; identical to SEQ ID NO: 345984

SEQ ID NO: 639951 - RNA, 64 nt, hsa; identical to SEQ ID NO: 345985

SEQ ID NO: 639952 - RNA, 64 nt, hsa; identical to SEQ ID NO: 345986

SEQ ID NO: 639953 - RNA, 64 nt, hsa; identical to SEQ ID NO: 345987

SEQ ID NO: 639954 - RNA, 64 nt, hsa; identical to SEQ ID NO: 345988

SEQ ID NO: 639955 - RNA, 64 nt, hsa; identical to SEQ ID NO: 345989

SEQ ID NO: 639956 - RNA, 64 nt, hsa; identical to SEQ ID NO: 345990

SEQ ID NO: 639957 - RNA, 64 nt, hsa; identical to SEQ ID NO: 345991

SEQ ID NO: 639958 - RNA, 64 nt, hsa; identical to SEQ ID NO: 345992

SEQ ID NO: 639959 - RNA, 51 nt, hsa; identical to SEQ ID NO: 345993

SEQ ID NO: 639960 - RNA, 64 nt, hsa; identical to SEQ ID NO: 345994

SEQ ID NO: 639961 - RNA, 64 nt, hsa; identical to SEQ ID NO: 345995

SEQ ID NO: 639962 - RNA, 64 nt, hsa; identical to SEQ ID NO: 345996

SEQ ID NO: 639963 - RNA, 64 nt, hsa; identical to SEQ ID NO: 345997

SEQ ID NO: 639964 - RNA, 64 nt, hsa; identical to SEQ ID NO: 345998

SEQ ID NO: 639965 - RNA, 64 nt, hsa; identical to SEQ ID NO: 345999

SEQ ID NO: 639966 - RNA, 64 nt, hsa; identical to SEQ ID NO: 346000

SEQ ID NO: 639967 - RNA, 64 nt, hsa; identical to SEQ ID NO: 346001

SEQ ID NO: 639968 - RNA, 64 nt, hsa; identical to SEQ ID NO: 346002

SEQ ID NO: 639969 - RNA, 64 nt, hsa; identical to SEQ ID NO: 346003

SEQ ID NO: 639970 - RNA, 64 nt, hsa; identical to SEQ ID NO: 346004

SEQ ID NO: 639971 - RNA, 64 nt, hsa; identical to SEQ ID NO: 346005

SEQ ID NO: 639972 - RNA, 64 nt, hsa; identical to SEQ ID NO: 346006

SEQ ID NO: 639973 - RNA, 64 nt, hsa; identical to SEQ ID NO: 346007

SEQ ID NO: 639974 - RNA, 64 nt, hsa; identical to SEQ ID NO: 346008

SEQ ID NO: 639975 - RNA, 64 nt, hsa; identical to SEQ ID NO: 346009

SEQ ID NO: 639976 - RNA, 64 nt, hsa; identical to SEQ ID NO: 346010

SEQ ID NO: 639977 - RNA, 64 nt, hsa; identical to SEQ ID NO: 346011

SEQ ID NO: 639978 - RNA, 64 nt, hsa; identical to SEQ ID NO: 346012

SEQ ID NO: 639979 - RNA, 64 nt, hsa; identical to SEQ ID NO: 346013

SEQ ID NO: 639980 - RNA, 64 nt, hsa; identical to SEQ ID NO: 346014

SEQ ID NO: 639981 - RNA, 64 nt, hsa; identical to SEQ ID NO: 346015

SEQ ID NO: 639982 - RNA, 64 nt, hsa; identical to SEQ ID NO: 346016

SEQ ID NO: 639983 - RNA, 64 nt, hsa; identical to SEQ ID NO: 346017

SEQ ID NO: 639984 - RNA, 64 nt, hsa; identical to SEQ ID NO: 346018

SEQ ID NO: 639985 - RNA, 64 nt, hsa; identical to SEQ ID NO: 346019

SEQ ID NO: 639986 - RNA, 64 nt, hsa; identical to SEQ ID NO: 346020

SEQ ID NO: 639987 - RNA, 64 nt, hsa; identical to SEQ ID NO: 346021

SEQ ID NO: 639988 - RNA, 64 nt, hsa; identical to SEQ ID NO: 346022

SEQ ID NO: 639989 - RNA, 64 nt, hsa; identical to SEQ ID NO: 346023

SEQ ID NO: 639990 - RNA, 64 nt, hsa; identical to SEQ ID NO: 346024

SEQ ID NO: 639991 - RNA, 64 nt, hsa; identical to SEQ ID NO: 346025

SEQ ID NO: 639992 - RNA, 64 nt, hsa; identical to SEQ ID NO: 346026

SEQ ID NO: 639993 - RNA, 64 nt, hsa; identical to SEQ ID NO: 346027

SEQ ID NO: 639994 - RNA, 64 nt, hsa; identical to SEQ ID NO: 346028

SEQ ID NO: 639995 - RNA, 64 nt, hsa; identical to SEQ ID NO: 346029

SEQ ID NO: 639996 - RNA, 64 nt, hsa; identical to SEQ ID NO: 346030

SEQ ID NO: 639997 - RNA, 64 nt, hsa; identical to SEQ ID NO: 346031

SEQ ID NO: 639998 - RNA, 64 nt, hsa; identical to SEQ ID NO: 346032

SEQ ID NO: 639999 - RNA, 64 nt, hsa; identical to SEQ ID NO: 346033

SEQ ID NO: 640000 - RNA, 64 nt, hsa; identical to SEQ ID NO: 346034

SEQ ID NO: 640001 - RNA, 64 nt, hsa; identical to SEQ ID NO: 346035

SEQ ID NO: 640002 - RNA, 64 nt, hsa; identical to SEQ ID NO: 346036

SEQ ID NO: 640003 - RNA, 64 nt, hsa; identical to SEQ ID NO: 346037

SEQ ID NO: 640004 - RNA, 64 nt, hsa; identical to SEQ ID NO: 346038

SEQ ID NO: 640005 - RNA, 64 nt, hsa; identical to SEQ ID NO: 346039

SEQ ID NO: 640006 - RNA, 64 nt, hsa; identical to SEQ ID NO: 346040

SEQ ID NO: 640007 - RNA, 64 nt, hsa; identical to SEQ ID NO: 346041

SEQ ID NO: 640008 - RNA, 64 nt, hsa; identical to SEQ ID NO: 346042

SEQ ID NO: 640009 - RNA, 64 nt, hsa; identical to SEQ ID NO: 346043

SEQ ID NO: 640010 - RNA, 64 nt, hsa; identical to SEQ ID NO: 346044

SEQ ID NO: 640011 - RNA, 64 nt, hsa; identical to SEQ ID NO: 346045

SEQ ID NO: 640012 - RNA, 64 nt, hsa; identical to SEQ ID NO: 346046

SEQ ID NO: 640013 - RNA, 64 nt, hsa; identical to SEQ ID NO: 346047

SEQ ID NO: 640014 - RNA, 64 nt, hsa; identical to SEQ ID NO: 346048

SEQ ID NO: 640015 - RNA, 64 nt, hsa; identical to SEQ ID NO: 346049

SEQ ID NO: 640016 - RNA, 64 nt, hsa; identical to SEQ ID NO: 346050

SEQ ID NO: 640017 - RNA, 64 nt, hsa; identical to SEQ ID NO: 346051

SEQ ID NO: 640018 - RNA, 64 nt, hsa; identical to SEQ ID NO: 346052

SEQ ID NO: 640019 - RNA, 64 nt, hsa; identical to SEQ ID NO: 346053

SEQ ID NO: 640020 - RNA, 64 nt, hsa; identical to SEQ ID NO: 346054

SEQ ID NO: 640021 - RNA, 64 nt, hsa; identical to SEQ ID NO: 346055

SEQ ID NO: 640022 - RNA, 64 nt, hsa; identical to SEQ ID NO: 346056

SEQ ID NO: 640023 - RNA, 64 nt, hsa; identical to SEQ ID NO: 346057

SEQ ID NO: 640024 - RNA, 64 nt, hsa; identical to SEQ ID NO: 346058

SEQ ID NO: 640025 - RNA, 64 nt, hsa; identical to SEQ ID NO: 346059

SEQ ID NO: 640026 - RNA, 64 nt, hsa; identical to SEQ ID NO: 346060

SEQ ID NO: 640027 - RNA, 64 nt, hsa; identical to SEQ ID NO: 346061

SEQ ID NO: 640028 - RNA, 64 nt, hsa; identical to SEQ ID NO: 346062

SEQ ID NO: 640029 - RNA, 64 nt, hsa; identical to SEQ ID NO: 346063

SEQ ID NO: 640030 - RNA, 64 nt, hsa; identical to SEQ ID NO: 346064

SEQ ID NO: 640031 - RNA, 64 nt, hsa; identical to SEQ ID NO: 346065

SEQ ID NO: 640032 - RNA, 64 nt, hsa; identical to SEQ ID NO: 346066

SEQ ID NO: 640033 - RNA, 64 nt, hsa; identical to SEQ ID NO: 346067

SEQ ID NO: 640034 - RNA, 64 nt, hsa; identical to SEQ ID NO: 346068

SEQ ID NO: 640035 - RNA, 64 nt, hsa; identical to SEQ ID NO: 346069

SEQ ID NO: 640036 - RNA, 64 nt, hsa; identical to SEQ ID NO: 346070

SEQ ID NO: 640037 - RNA, 64 nt, hsa; identical to SEQ ID NO: 346071

SEQ ID NO: 640038 - RNA, 64 nt, hsa; identical to SEQ ID NO: 346072

SEQ ID NO: 640039 - RNA, 64 nt, hsa; identical to SEQ ID NO: 346073

SEQ ID NO: 640040 - RNA, 64 nt, hsa; identical to SEQ ID NO: 346074

SEQ ID NO: 640041 - RNA, 64 nt, hsa; identical to SEQ ID NO: 346075

SEQ ID NO: 640042 - RNA, 64 nt, hsa; identical to SEQ ID NO: 346076

SEQ ID NO: 640043 - RNA, 64 nt, hsa; identical to SEQ ID NO: 346077

SEQ ID NO: 640044 - RNA, 64 nt, hsa; identical to SEQ ID NO: 346078

SEQ ID NO: 640045 - RNA, 64 nt, hsa; identical to SEQ ID NO: 346079

SEQ ID NO: 640046 - RNA, 64 nt, hsa; identical to SEQ ID NO: 346080

SEQ ID NO: 640047 - RNA, 64 nt, hsa; identical to SEQ ID NO: 346081

SEQ ID NO: 640048 - RNA, 64 nt, hsa; identical to SEQ ID NO: 346082

SEQ ID NO: 640049 - RNA, 64 nt, hsa; identical to SEQ ID NO: 346083

SEQ ID NO: 640050 - RNA, 64 nt, hsa; identical to SEQ ID NO: 346084

SEQ ID NO: 640051 - RNA, 64 nt, hsa; identical to SEQ ID NO: 346085

SEQ ID NO: 640052 - RNA, 64 nt, hsa; identical to SEQ ID NO: 346086

SEQ ID NO: 640053 - RNA, 64 nt, hsa; identical to SEQ ID NO: 346087

SEQ ID NO: 640054 - RNA, 64 nt, hsa; identical to SEQ ID NO: 346088

SEQ ID NO: 640055 - RNA, 64 nt, hsa; identical to SEQ ID NO: 346089

SEQ ID NO: 640056 - RNA, 64 nt, hsa; identical to SEQ ID NO: 346090

SEQ ID NO: 640057 - RNA, 64 nt, hsa; identical to SEQ ID NO: 346091

SEQ ID NO: 640058 - RNA, 64 nt, hsa; identical to SEQ ID NO: 346092

SEQ ID NO: 640059 - RNA, 64 nt, hsa; identical to SEQ ID NO: 346093

SEQ ID NO: 640060 - RNA, 64 nt, hsa; identical to SEQ ID NO: 346094

SEQ ID NO: 640061 - RNA, 64 nt, hsa; identical to SEQ ID NO: 346095

SEQ ID NO: 640062 - RNA, 59 nt, hsa; identical to SEQ ID NO: 346096

SEQ ID NO: 640063 - RNA, 64 nt, hsa; identical to SEQ ID NO: 346097

SEQ ID NO: 640064 - RNA, 64 nt, hsa; identical to SEQ ID NO: 346098

SEQ ID NO: 640065 - RNA, 64 nt, hsa; identical to SEQ ID NO: 346099

SEQ ID NO: 640066 - RNA, 64 nt, hsa; identical to SEQ ID NO: 346100

SEQ ID NO: 640067 - RNA, 64 nt, hsa; identical to SEQ ID NO: 346101

SEQ ID NO: 640068 - RNA, 64 nt, hsa; identical to SEQ ID NO: 346102

SEQ ID NO: 640069 - RNA, 64 nt, hsa; identical to SEQ ID NO: 346103

SEQ ID NO: 640070 - RNA, 64 nt, hsa; identical to SEQ ID NO: 346104

SEQ ID NO: 640071 - RNA, 64 nt, hsa; identical to SEQ ID NO: 346105

SEQ ID NO: 640072 - RNA, 64 nt, hsa; identical to SEQ ID NO: 346106

SEQ ID NO: 640073 - RNA, 64 nt, hsa; identical to SEQ ID NO: 346107

SEQ ID NO: 640074 - RNA, 64 nt, hsa; identical to SEQ ID NO: 346108

SEQ ID NO: 640075 - RNA, 64 nt, hsa; identical to SEQ ID NO: 346109

SEQ ID NO: 640076 - RNA, 64 nt, hsa; identical to SEQ ID NO: 346110

SEQ ID NO: 640077 - RNA, 64 nt, hsa; identical to SEQ ID NO: 346111

SEQ ID NO: 640078 - RNA, 64 nt, hsa; identical to SEQ ID NO: 346112

SEQ ID NO: 640079 - RNA, 64 nt, hsa; identical to SEQ ID NO: 346113

SEQ ID NO: 640080 - RNA, 64 nt, hsa; identical to SEQ ID NO: 346114

SEQ ID NO: 640081 - RNA, 64 nt, hsa; identical to SEQ ID NO: 346115

SEQ ID NO: 640082 - RNA, 64 nt, hsa; identical to SEQ ID NO: 346116

SEQ ID NO: 640083 - RNA, 64 nt, hsa
uugcucucuuuugucuuggucgcugcuucuagaaucuaugcaggggauagcagugaggucagaa

SEQ ID NO: 640084 - RNA, 64 nt, hsa
uguggcccacagcauagcacuggggacagagcgcucuaugcaggugaggcguaugagaacagca

SEQ ID NO: 640085 - RNA, 64 nt, hsa
gaaagaucuugaugcaggguuucuuaaccugcagucuaugcacaacacuauauuuccauguaau

SEQ ID NO: 640086 - RNA, 64 nt, hsa
aaugcaacuaagaaaauacucauagugaguacgcucuaugcauaguaugacuucuauuuuaaug

SEQ ID NO: 640087 - RNA, 64 nt, hsa
ggcuuaaacuugacuguuguauguuagcauauuuucuaugcagcaguuggucaacuucaacuca

SEQ ID NO: 640088 - RNA, 64 nt, hsa
uaccauuugcaguuaccauaagugcuuuaucuucucuaugcacaggcuuaaacuugacuguugu

SEQ ID NO: 640089 - RNA, 64 nt, hsa
guauucgaauuuugucuuuaaaauucaugugguuucuaugcaaaguucuucauaucaucacaac

SEQ ID NO: 640090 - RNA, 64 nt, hsa
aaaagauguauuauaccagugaaaagguguuauaucuaugcaaaccuacuaacaaauuauacug

SEQ ID NO: 640091 - RNA, 64 nt, hsa
accccuaaacucaggagucaacguguuuaccucuucuaugcaagccuugcuagacagccagguu

SEQ ID NO: 640092 - RNA, 64 nt, hsa
ucgucuuuauguccgcccaccuagugcuuccacuucuaugcaaaugccuccaagccauucacuu

SEQ ID NO: 640093 - RNA, 64 nt, hsa
cugagcugagccaggcuagcuggagccugggauuucuaugcaguggccccuuaggccagugaug

SEQ ID NO: 640094 - RNA, 64 nt, hsa
aagagcuccccuacggaccagguauagagaaaggucuaugcagaaauagguuagaguuucccua

SEQ ID NO: 640095 - RNA, 64 nt, hsa; identical to SEQ ID NO: 523234

SEQ ID NO: 640096 - RNA, 64 nt, hsa; identical to SEQ ID NO: 523235

SEQ ID NO: 640097 - RNA, 64 nt, hsa; identical to SEQ ID NO: 523236

SEQ ID NO: 640098 - RNA, 64 nt, hsa; identical to SEQ ID NO: 523237

SEQ ID NO: 640099 - RNA, 64 nt, hsa; identical to SEQ ID NO: 523238

SEQ ID NO: 640100 - RNA, 64 nt, hsa; identical to SEQ ID NO: 523239

SEQ ID NO: 640101 - RNA, 64 nt, hsa; identical to SEQ ID NO: 523240

SEQ ID NO: 640102 - RNA, 64 nt, hsa; identical to SEQ ID NO: 523241

SEQ ID NO: 640103 - RNA, 64 nt, hsa
agccagauuaucugugugugcgguggugugcgugugcgugcaugugugaaugugagcagcauag

SEQ ID NO: 640104 - RNA, 64 nt, hsa
gcauaguugauauuuacccacaaacaccuguauaugcgugcauauacaaccaaguggguagacc

SEQ ID NO: 640105 - RNA, 64 nt, hsa
cagcaggaggcugccuguguguuuccuccugggaugcgugcaaggcagaccuggugcugcaaag

SEQ ID NO: 640106 - RNA, 64 nt, hsa
ccgugagcgucccagaggccgggagcgugggcccugcgugcagucauuccucugggguugcugu

SEQ ID NO: 640107 - RNA, 64 nt, hsa; identical to SEQ ID NO: 297037

SEQ ID NO: 640108 - RNA, 64 nt, hsa; identical to SEQ ID NO: 297038

SEQ ID NO: 640109 - RNA, 64 nt, hsa; identical to SEQ ID NO: 297039

SEQ ID NO: 640110 - RNA, 64 nt, hsa; identical to SEQ ID NO: 297040

SEQ ID NO: 640111 - RNA, 64 nt, hsa; identical to SEQ ID NO: 519022

SEQ ID NO: 640112 - RNA, 64 nt, hsa; identical to SEQ ID NO: 519023

SEQ ID NO: 640113 - RNA, 64 nt, hsa; identical to SEQ ID NO: 519024

SEQ ID NO: 640114 - RNA, 64 nt, hsa; identical to SEQ ID NO: 519025

SEQ ID NO: 640115 - RNA, 64 nt, hsa; identical to SEQ ID NO: 519026

SEQ ID NO: 640116 - RNA, 64 nt, hsa; identical to SEQ ID NO: 519027

SEQ ID NO: 640117 - RNA, 64 nt, hsa; identical to SEQ ID NO: 519028

SEQ ID NO: 640118 - RNA, 64 nt, hsa; identical to SEQ ID NO: 519029

SEQ ID NO: 640119 - RNA, 64 nt, hsa; identical to SEQ ID NO: 519030

SEQ ID NO: 640120 - RNA, 64 nt, hsa; identical to SEQ ID NO: 519031

SEQ ID NO: 640121 - RNA, 64 nt, hsa; identical to SEQ ID NO: 519032

SEQ ID NO: 640122 - RNA, 64 nt, hsa; identical to SEQ ID NO: 519033

SEQ ID NO: 640123 - RNA, 64 nt, hsa
ugugccuuccccuacucucuucucaucuucguauaugacgaagucagaaaacucaucaucaggc

SEQ ID NO: 640124 - RNA, 64 nt, hsa
uugagcccaggaguucaagaccagccugggcuacaugacgaaacuccaucucuaucaaaaauac

SEQ ID NO: 640125 - RNA, 64 nt, hsa
cugaggucaggaguuuuagaccagccuggccaacaugacgaaacccggucucuacuaaaaauac

SEQ ID NO: 640126 - RNA, 64 nt, hsa
aaagaagcagaaguguaauuuuccuuuucccagcaugacgaaaaauuggaguucugccauuuga

SEQ ID NO: 640127 - RNA, 64 nt, hsa
ccuucugccaccccagcagaagccuucauacaacaugacgaaacaagggaucauguugaagugu

SEQ ID NO: 640128 - RNA, 64 nt, hsa
cugaggucaggaguucaagaccagccuggccaacaugacgaaaccccaucucuacuaaaaagac

SEQ ID NO: 640129 - RNA, 64 nt, hsa
agagaaauuucccagccuauucuaaaucuuguuaaugacgaagaguccaauguaucucauuauu

SEQ ID NO: 640130 - RNA, 64 nt, hsa
uugagaacaggauuuugagaacagcuuggacaucaugacgaaaccccaucuccacaaaaaaauu

SEQ ID NO: 640131 - RNA, 64 nt, hsa
cguuucugacagcucccagcugggagaaaccaacaugacgaaaagacaaagaauacuggagaag

SEQ ID NO: 640132 - RNA, 64 nt, hsa
aggaauucuccaguacgggaagaugcagucacuuaugacgaaauaagucaccccugaacgccuc

SEQ ID NO: 640133 - RNA, 64 nt, hsa
aaaaaaggucuccugcagaucugucugggcugugaugacgaauauuaugaaaugugccuuuucu

SEQ ID NO: 640134 - RNA, 64 nt, hsa
uaccauucaggacauaggcacaggcaaagauuucaugacgaagacgccaaaaacaauugcaaca

SEQ ID NO: 640135 - RNA, 64 nt, hsa
cgucauuuuuguauggauccuuucacuugaucauaugacgaaaugcuuauagagaguagcuccg

SEQ ID NO: 640136 - RNA, 64 nt, hsa
uaaucuucaggauuucaagaccagccuagccaacaugacgaaaccccaucucuacugaaaauag

SEQ ID NO: 640137 - RNA, 64 nt, hsa
cugaggucaggaguucgagaccaaccuggccaacaugacgaaacuccgucucuauuuaaaauac

SEQ ID NO: 640138 - RNA, 64 nt, hsa
cccagaggaaauuaugaauuacgccaugagguuuaugacgaauaaaugaaucacggcaauuucu

SEQ ID NO: 640139 - RNA, 64 nt, hsa
auaagaaguccacacaagcaagccaaauuuuuagaugacgaaguccauaaauaacuagagaauu

SEQ ID NO: 640140 - RNA, 64 nt, hsa
aaaaauuacgaaagaaaagaaaucucuaugcaaaaugacgaacaugguccuguggacuccucug

SEQ ID NO: 640141 - RNA, 64 nt, hsa
uugagcccaggaguucgagagcagccugggcaacaugacgaaaccccgucucuacagagaauac

SEQ ID NO: 640142 - RNA, 64 nt, hsa
guguuaaaauuugcaucacgucgccuuccuauguaugacgaaacaagaaacagagauuuccaau

SEQ ID NO: 640143 - RNA, 64 nt, hsa
uuauccacuccaucuucuagguuaucuuaguuguaugacgaacugauaaaucugucugacuggg

SEQ ID NO: 640144 - RNA, 64 nt, hsa
gaugaacugcacauuguugaagcagaggccaugaaugacgaaggcaguccaauuaaaguaacac

SEQ ID NO: 640145 - RNA, 64 nt, hsa
cgcuuguuuugggugcacaggagccccacugcugaugacgaacuaucucuaacuggucuugacc

SEQ ID NO: 640146 - RNA, 64 nt, hsa
ucugauuuuuaagguagugggcaucucucuccuaaugacgaagcugcucagcaacuccaccugc

SEQ ID NO: 640147 - RNA, 64 nt, hsa
ccucaugcaucaucagaugacaaggacaacccucaugacgaagcaacaugaauuagggggccuc

SEQ ID NO: 640148 - RNA, 64 nt, hsa
cacgaugauaccagaguccacgcugacauacagaaugacgaaaaggguauauauauuuucuuau

SEQ ID NO: 640149 - RNA, 64 nt, hsa; identical to SEQ ID NO: 640148

SEQ ID NO: 640150 - RNA, 64 nt, hsa
aaauuaaaauuuuaugacaguaucgaggcuugugaugacgaauccugcucuaaaauacacaagg

SEQ ID NO: 640151 - RNA, 64 nt, hsa
cucuugagccaaacacuguguuucguuuggcucaaugacgaauguugaagaugcuuuuauguuc

SEQ ID NO: 640152 - RNA, 64 nt, hsa
ugggacagggucucacucugucacccaggcuggaaugacgaagugaaguagugcaaacauagcu

SEQ ID NO: 640153 - RNA, 64 nt, hsa
cagccaaguggcgguagcacagauguggugaacaaugacgaauugaggcagggaauagaccuca

SEQ ID NO: 640154 - RNA, 64 nt, hsa
aaaaggccacguaugugccuugaauguagccaaaaugacgaacaacacccagaaaucugugauu

SEQ ID NO: 640155 - RNA, 64 nt, hsa
gggccaguagacccccggagaagcaguaccgacaaugacgaagauaccagaucccuucccaacc

SEQ ID NO: 640156 - RNA, 64 nt, hsa
aguaaggaucugcaaaucuugaaucguccucaaaaugacgaagcuugaauuguccucaagaugg

SEQ ID NO: 640157 - RNA, 64 nt, hsa
uucuaaaaauuauaccccaugggcuugccagguaaugacgaaaacuuaauggguguacuuuuuu

SEQ ID NO: 640158 - RNA, 61 nt, hsa; identical to SEQ ID NO: 76426

SEQ ID NO: 640159 - RNA, 61 nt, hsa; identical to SEQ ID NO: 76427

SEQ ID NO: 640160 - RNA, 61 nt, hsa; identical to SEQ ID NO: 76428

SEQ ID NO: 640161 - RNA, 61 nt, hsa; identical to SEQ ID NO: 76429

SEQ ID NO: 640162 - RNA, 61 nt, hsa; identical to SEQ ID NO: 76430

SEQ ID NO: 640163 - RNA, 61 nt, hsa; identical to SEQ ID NO: 76431

SEQ ID NO: 640164 - RNA, 61 nt, hsa; identical to SEQ ID NO: 76432

SEQ ID NO: 640165 - RNA, 61 nt, hsa; identical to SEQ ID NO: 76433

SEQ ID NO: 640166 - RNA, 61 nt, hsa; identical to SEQ ID NO: 76434

SEQ ID NO: 640167 - RNA, 61 nt, hsa; identical to SEQ ID NO: 76435

SEQ ID NO: 640168 - RNA, 61 nt, hsa; identical to SEQ ID NO: 76436

SEQ ID NO: 640169 - RNA, 61 nt, hsa; identical to SEQ ID NO: 76437

SEQ ID NO: 640170 - RNA, 61 nt, hsa; identical to SEQ ID NO: 76438

SEQ ID NO: 640171 - RNA, 61 nt, hsa; identical to SEQ ID NO: 76439

SEQ ID NO: 640172 - RNA, 61 nt, hsa; identical to SEQ ID NO: 76440

SEQ ID NO: 640173 - RNA, 61 nt, hsa; identical to SEQ ID NO: 76441

SEQ ID NO: 640174 - RNA, 61 nt, hsa; identical to SEQ ID NO: 76442

SEQ ID NO: 640175 - RNA, 61 nt, hsa; identical to SEQ ID NO: 76443

SEQ ID NO: 640176 - RNA, 61 nt, hsa; identical to SEQ ID NO: 76444

SEQ ID NO: 640177 - RNA, 61 nt, hsa; identical to SEQ ID NO: 76445

SEQ ID NO: 640178 - RNA, 61 nt, hsa; identical to SEQ ID NO: 76446

SEQ ID NO: 640179 - RNA, 61 nt, hsa; identical to SEQ ID NO: 76447

SEQ ID NO: 640180 - RNA, 61 nt, hsa; identical to SEQ ID NO: 76448

SEQ ID NO: 640181 - RNA, 61 nt, hsa; identical to SEQ ID NO: 76449

SEQ ID NO: 640182 - RNA, 61 nt, hsa; identical to SEQ ID NO: 76450

SEQ ID NO: 640183 - RNA, 61 nt, hsa; identical to SEQ ID NO: 76451

SEQ ID NO: 640184 - RNA, 61 nt, hsa; identical to SEQ ID NO: 76452

SEQ ID NO: 640185 - RNA, 61 nt, hsa; identical to SEQ ID NO: 76453

SEQ ID NO: 640186 - RNA, 61 nt, hsa; identical to SEQ ID NO: 76454

SEQ ID NO: 640187 - RNA, 61 nt, hsa; identical to SEQ ID NO: 76455

SEQ ID NO: 640188 - RNA, 64 nt, hsa; identical to SEQ ID NO: 72205

SEQ ID NO: 640189 - RNA, 64 nt, hsa; identical to SEQ ID NO: 72206

SEQ ID NO: 640190 - RNA, 64 nt, hsa; identical to SEQ ID NO: 72207

SEQ ID NO: 640191 - RNA, 64 nt, hsa; identical to SEQ ID NO: 72208

SEQ ID NO: 640192 - RNA, 64 nt, hsa; identical to SEQ ID NO: 72209

SEQ ID NO: 640193 - RNA, 64 nt, hsa; identical to SEQ ID NO: 72210

SEQ ID NO: 640194 - RNA, 64 nt, hsa; identical to SEQ ID NO: 72211

SEQ ID NO: 640195 - RNA, 64 nt, hsa; identical to SEQ ID NO: 72212

SEQ ID NO: 640196 - RNA, 64 nt, hsa; identical to SEQ ID NO: 72213

SEQ ID NO: 640197 - RNA, 64 nt, hsa; identical to SEQ ID NO: 72214

SEQ ID NO: 640198 - RNA, 64 nt, hsa; identical to SEQ ID NO: 72215

SEQ ID NO: 640199 - RNA, 64 nt, hsa; identical to SEQ ID NO: 72216

SEQ ID NO: 640200 - RNA, 64 nt, hsa; identical to SEQ ID NO: 72217

SEQ ID NO: 640201 - RNA, 64 nt, hsa; identical to SEQ ID NO: 72218

SEQ ID NO: 640202 - RNA, 64 nt, hsa; identical to SEQ ID NO: 72219

SEQ ID NO: 640203 - RNA, 64 nt, hsa; identical to SEQ ID NO: 72220

SEQ ID NO: 640204 - RNA, 64 nt, hsa; identical to SEQ ID NO: 72221

SEQ ID NO: 640205 - RNA, 64 nt, hsa; identical to SEQ ID NO: 72222

SEQ ID NO: 640206 - RNA, 64 nt, hsa; identical to SEQ ID NO: 72223

SEQ ID NO: 640207 - RNA, 64 nt, hsa; identical to SEQ ID NO: 72224

SEQ ID NO: 640208 - RNA, 64 nt, hsa; identical to SEQ ID NO: 72225

SEQ ID NO: 640209 - RNA, 64 nt, hsa; identical to SEQ ID NO: 72226

SEQ ID NO: 640210 - RNA, 64 nt, hsa; identical to SEQ ID NO: 72227

SEQ ID NO: 640211 - RNA, 64 nt, hsa; identical to SEQ ID NO: 72228

SEQ ID NO: 640212 - RNA, 64 nt, hsa; identical to SEQ ID NO: 72229

SEQ ID NO: 640213 - RNA, 64 nt, hsa; identical to SEQ ID NO: 72230

SEQ ID NO: 640214 - RNA, 64 nt, hsa; identical to SEQ ID NO: 72231

SEQ ID NO: 640215 - RNA, 64 nt, hsa; identical to SEQ ID NO: 72232

SEQ ID NO: 640216 - RNA, 64 nt, hsa; identical to SEQ ID NO: 72233

SEQ ID NO: 640217 - RNA, 64 nt, hsa; identical to SEQ ID NO: 72234

SEQ ID NO: 640218 - RNA, 64 nt, hsa; identical to SEQ ID NO: 72235

SEQ ID NO: 640219 - RNA, 64 nt, hsa; identical to SEQ ID NO: 72236

SEQ ID NO: 640220 - RNA, 64 nt, hsa; identical to SEQ ID NO: 72237

SEQ ID NO: 640221 - RNA, 64 nt, hsa; identical to SEQ ID NO: 72238

SEQ ID NO: 640222 - RNA, 64 nt, hsa; identical to SEQ ID NO: 72239

SEQ ID NO: 640223 - RNA, 64 nt, hsa; identical to SEQ ID NO: 72240

SEQ ID NO: 640224 - RNA, 64 nt, hsa; identical to SEQ ID NO: 72241

SEQ ID NO: 640225 - RNA, 64 nt, hsa; identical to SEQ ID NO: 72242

SEQ ID NO: 640226 - RNA, 64 nt, hsa; identical to SEQ ID NO: 72243

SEQ ID NO: 640227 - RNA, 64 nt, hsa; identical to SEQ ID NO: 72244

SEQ ID NO: 640228 - RNA, 64 nt, hsa; identical to SEQ ID NO: 72245

SEQ ID NO: 640229 - RNA, 64 nt, hsa; identical to SEQ ID NO: 72246

SEQ ID NO: 640230 - RNA, 64 nt, hsa; identical to SEQ ID NO: 72247

SEQ ID NO: 640231 - RNA, 64 nt, hsa; identical to SEQ ID NO: 72248

SEQ ID NO: 640232 - RNA, 64 nt, hsa; identical to SEQ ID NO: 72249

SEQ ID NO: 640233 - RNA, 64 nt, hsa; identical to SEQ ID NO: 72250

SEQ ID NO: 640234 - RNA, 64 nt, hsa; identical to SEQ ID NO: 72251

SEQ ID NO: 640235 - RNA, 64 nt, hsa; identical to SEQ ID NO: 72252

SEQ ID NO: 640236 - RNA, 64 nt, hsa; identical to SEQ ID NO: 72253

SEQ ID NO: 640237 - RNA, 64 nt, hsa; identical to SEQ ID NO: 72254

SEQ ID NO: 640238 - RNA, 64 nt, hsa; identical to SEQ ID NO: 72255

SEQ ID NO: 640239 - RNA, 64 nt, hsa; identical to SEQ ID NO: 72256

SEQ ID NO: 640240 - RNA, 64 nt, hsa; identical to SEQ ID NO: 72257

SEQ ID NO: 640241 - RNA, 64 nt, hsa; identical to SEQ ID NO: 72258

SEQ ID NO: 640242 - RNA, 64 nt, hsa; identical to SEQ ID NO: 72259

SEQ ID NO: 640243 - RNA, 64 nt, hsa; identical to SEQ ID NO: 72260

SEQ ID NO: 640244 - RNA, 64 nt, hsa; identical to SEQ ID NO: 72261

SEQ ID NO: 640245 - RNA, 64 nt, hsa; identical to SEQ ID NO: 72262

SEQ ID NO: 640246 - RNA, 64 nt, hsa; identical to SEQ ID NO: 72263

SEQ ID NO: 640247 - RNA, 64 nt, hsa; identical to SEQ ID NO: 72264

SEQ ID NO: 640248 - RNA, 64 nt, hsa; identical to SEQ ID NO: 72265

SEQ ID NO: 640249 - RNA, 64 nt, hsa; identical to SEQ ID NO: 72266

SEQ ID NO: 640250 - RNA, 64 nt, hsa; identical to SEQ ID NO: 72267

SEQ ID NO: 640251 - RNA, 64 nt, hsa; identical to SEQ ID NO: 72268

SEQ ID NO: 640252 - RNA, 64 nt, hsa; identical to SEQ ID NO: 72269

SEQ ID NO: 640253 - RNA, 64 nt, hsa; identical to SEQ ID NO: 72270

SEQ ID NO: 640254 - RNA, 64 nt, hsa; identical to SEQ ID NO: 72271

SEQ ID NO: 640255 - RNA, 64 nt, hsa; identical to SEQ ID NO: 72272

SEQ ID NO: 640256 - RNA, 64 nt, hsa; identical to SEQ ID NO: 72273

SEQ ID NO: 640257 - RNA, 61 nt, hsa; identical to SEQ ID NO: 286917

SEQ ID NO: 640258 - RNA, 64 nt, hsa; identical to SEQ ID NO: 286918

SEQ ID NO: 640259 - RNA, 64 nt, hsa; identical to SEQ ID NO: 286919

SEQ ID NO: 640260 - RNA, 64 nt, hsa; identical to SEQ ID NO: 286920

SEQ ID NO: 640261 - RNA, 64 nt, hsa; identical to SEQ ID NO: 286921

SEQ ID NO: 640262 - RNA, 64 nt, hsa; identical to SEQ ID NO: 286922

SEQ ID NO: 640263 - RNA, 64 nt, hsa; identical to SEQ ID NO: 286923

SEQ ID NO: 640264 - RNA, 64 nt, hsa; identical to SEQ ID NO: 286924

SEQ ID NO: 640265 - RNA, 64 nt, hsa; identical to SEQ ID NO: 286925

SEQ ID NO: 640266 - RNA, 64 nt, hsa; identical to SEQ ID NO: 286926

SEQ ID NO: 640267 - RNA, 64 nt, hsa; identical to SEQ ID NO: 286927

SEQ ID NO: 640268 - RNA, 64 nt, hsa; identical to SEQ ID NO: 286928

SEQ ID NO: 640269 - RNA, 64 nt, hsa; identical to SEQ ID NO: 286929

SEQ ID NO: 640270 - RNA, 64 nt, hsa; identical to SEQ ID NO: 286930

SEQ ID NO: 640271 - RNA, 64 nt, hsa; identical to SEQ ID NO: 286931

SEQ ID NO: 640272 - RNA, 64 nt, hsa; identical to SEQ ID NO: 286932

SEQ ID NO: 640273 - RNA, 64 nt, hsa; identical to SEQ ID NO: 286933

SEQ ID NO: 640274 - RNA, 64 nt, hsa; identical to SEQ ID NO: 286934

SEQ ID NO: 640275 - RNA, 64 nt, hsa; identical to SEQ ID NO: 286935

SEQ ID NO: 640276 - RNA, 64 nt, hsa; identical to SEQ ID NO: 286936

SEQ ID NO: 640277 - RNA, 64 nt, hsa; identical to SEQ ID NO: 286937

SEQ ID NO: 640278 - RNA, 64 nt, hsa; identical to SEQ ID NO: 286938

SEQ ID NO: 640279 - RNA, 64 nt, hsa; identical to SEQ ID NO: 286939

SEQ ID NO: 640280 - RNA, 64 nt, hsa; identical to SEQ ID NO: 286940

SEQ ID NO: 640281 - RNA, 64 nt, hsa; identical to SEQ ID NO: 286941

SEQ ID NO: 640282 - RNA, 64 nt, hsa; identical to SEQ ID NO: 286942

SEQ ID NO: 640283 - RNA, 64 nt, hsa; identical to SEQ ID NO: 286943

SEQ ID NO: 640284 - RNA, 64 nt, hsa; identical to SEQ ID NO: 286944

SEQ ID NO: 640285 - RNA, 64 nt, hsa; identical to SEQ ID NO: 286945

SEQ ID NO: 640286 - RNA, 64 nt, hsa; identical to SEQ ID NO: 286946

SEQ ID NO: 640287 - RNA, 64 nt, hsa; identical to SEQ ID NO: 286947

SEQ ID NO: 640288 - RNA, 64 nt, hsa; identical to SEQ ID NO: 286948

SEQ ID NO: 640289 - RNA, 64 nt, hsa; identical to SEQ ID NO: 286949

SEQ ID NO: 640290 - RNA, 64 nt, hsa; identical to SEQ ID NO: 286950

SEQ ID NO: 640291 - RNA, 64 nt, hsa; identical to SEQ ID NO: 286951

SEQ ID NO: 640292 - RNA, 64 nt, hsa; identical to SEQ ID NO: 286952

SEQ ID NO: 640293 - RNA, 64 nt, hsa; identical to SEQ ID NO: 286953

SEQ ID NO: 640294 - RNA, 64 nt, hsa; identical to SEQ ID NO: 286954

SEQ ID NO: 640295 - RNA, 64 nt, hsa; identical to SEQ ID NO: 286955

SEQ ID NO: 640296 - RNA, 64 nt, hsa; identical to SEQ ID NO: 286956

SEQ ID NO: 640297 - RNA, 64 nt, hsa; identical to SEQ ID NO: 286957

SEQ ID NO: 640298 - RNA, 64 nt, hsa; identical to SEQ ID NO: 286958

SEQ ID NO: 640299 - RNA, 64 nt, hsa; identical to SEQ ID NO: 286959

SEQ ID NO: 640300 - RNA, 64 nt, hsa; identical to SEQ ID NO: 286960

SEQ ID NO: 640301 - RNA, 64 nt, hsa; identical to SEQ ID NO: 286961

SEQ ID NO: 640302 - RNA, 64 nt, hsa; identical to SEQ ID NO: 286962

SEQ ID NO: 640303 - RNA, 64 nt, hsa; identical to SEQ ID NO: 286963

SEQ ID NO: 640304 - RNA, 64 nt, hsa; identical to SEQ ID NO: 286964

SEQ ID NO: 640305 - RNA, 64 nt, hsa; identical to SEQ ID NO: 286965

SEQ ID NO: 640306 - RNA, 64 nt, hsa; identical to SEQ ID NO: 286966

SEQ ID NO: 640307 - RNA, 64 nt, hsa; identical to SEQ ID NO: 286967

SEQ ID NO: 640308 - RNA, 64 nt, hsa; identical to SEQ ID NO: 286968

SEQ ID NO: 640309 - RNA, 64 nt, hsa; identical to SEQ ID NO: 286969

SEQ ID NO: 640310 - RNA, 64 nt, hsa; identical to SEQ ID NO: 286970

SEQ ID NO: 640311 - RNA, 64 nt, hsa; identical to SEQ ID NO: 286971

SEQ ID NO: 640312 - RNA, 64 nt, hsa; identical to SEQ ID NO: 286972

SEQ ID NO: 640313 - RNA, 64 nt, hsa; identical to SEQ ID NO: 286973

SEQ ID NO: 640314 - RNA, 64 nt, hsa; identical to SEQ ID NO: 286974

SEQ ID NO: 640315 - RNA, 64 nt, hsa; identical to SEQ ID NO: 286975

SEQ ID NO: 640316 - RNA, 64 nt, hsa; identical to SEQ ID NO: 286976

SEQ ID NO: 640317 - RNA, 64 nt, hsa; identical to SEQ ID NO: 286977

SEQ ID NO: 640318 - RNA, 64 nt, hsa; identical to SEQ ID NO: 286978

SEQ ID NO: 640319 - RNA, 64 nt, hsa; identical to SEQ ID NO: 286979

SEQ ID NO: 640320 - RNA, 64 nt, hsa; identical to SEQ ID NO: 286980

SEQ ID NO: 640321 - RNA, 64 nt, hsa; identical to SEQ ID NO: 286981

SEQ ID NO: 640322 - RNA, 64 nt, hsa; identical to SEQ ID NO: 286982

SEQ ID NO: 640323 - RNA, 64 nt, hsa; identical to SEQ ID NO: 286983

SEQ ID NO: 640324 - RNA, 64 nt, hsa; identical to SEQ ID NO: 286984

SEQ ID NO: 640325 - RNA, 64 nt, hsa; identical to SEQ ID NO: 286985

SEQ ID NO: 640326 - RNA, 64 nt, hsa; identical to SEQ ID NO: 286986

SEQ ID NO: 640327 - RNA, 64 nt, hsa; identical to SEQ ID NO: 286987

SEQ ID NO: 640328 - RNA, 64 nt, hsa; identical to SEQ ID NO: 286988

SEQ ID NO: 640329 - RNA, 64 nt, hsa; identical to SEQ ID NO: 286989

SEQ ID NO: 640330 - RNA, 64 nt, hsa; identical to SEQ ID NO: 286990

SEQ ID NO: 640331 - RNA, 64 nt, hsa
guccugggccuguguugggguguugggggaagcugggcaucaguggccacaugggcaucagggg

SEQ ID NO: 640332 - RNA, 64 nt, hsa
gguguugggggaagcugggcaucaguggccacaugggcaucaggggcuggccccacagagaccc

SEQ ID NO: 640333 - RNA, 64 nt, hsa
uugagugacagcccagggacuuaauguggccaucgggcaucaagcacaaggccaugcaggugau

SEQ ID NO: 640334 - RNA, 64 nt, hsa
auggggagcccuaccccagaaguguaucccacgagggcaucagggacgcagugaguguugcuca

SEQ ID NO: 640335 - RNA, 64 nt, hsa
gaauugcuugaguccaggaguuugagaugcgccugggcaacauagaaaccugugucuacaaaaa

SEQ ID NO: 640336 - RNA, 64 nt, hsa
agugagcugagaucgcaccauuacacuccagccugggcaacagagccagacucugucucaaaaa

SEQ ID NO: 640337 - RNA, 64 nt, hsa
agugagccaagaucaugccacaucacuccaaccugggcaacagaacaagaacccaucucaaaca

SEQ ID NO: 640338 - RNA, 64 nt, hsa
ggauugccugagcucaggaguucaagaucagucugggcaacacgaugaaacuccgucucuacua

SEQ ID NO: 640339 - RNA, 64 nt, hsa
guaagccaagaucacaccacuggcacuccagccugggcaacagagugagacccugucucaaaca

SEQ ID NO: 640340 - RNA, 64 nt, hsa
uaagcauuuuuuaaauugaguuugagacuagccugggcaacauagugagaccccaucucuauuu

SEQ ID NO: 640341 - RNA, 64 nt, hsa
guuauuaaaaaauuacaaaggccuagaccagccugggcaacauggugaaaccccaucucuacaa

SEQ ID NO: 640342 - RNA, 64 nt, hsa
agugaaucaugaucaugccacuguacuccagccugggcaacagagaccaucuuaaaaaaaaaaa

SEQ ID NO: 640343 - RNA, 64 nt, hsa
ggaucacuuagguccaggaguucgagacuagccugggcaacauagugagacaccggaucuacaa

SEQ ID NO: 640344 - RNA, 64 nt, hsa
agugagccgugauugcaccacugcacuccagccugggcaacagagcaagacccugucuuggaga

SEQ ID NO: 640345 - RNA, 64 nt, hsa
aguucgcuugggcccaagaguucgagaccagccugggcaacauggugaaacccuaucuccguga

SEQ ID NO: 640346 - RNA, 64 nt, hsa
gccgaggucaugccacugcacuccagccuggccugggcaacagagcaagacccugucucaaaau

SEQ ID NO: 640347 - RNA, 64 nt, hsa
agugagcuuugaucacaccacugcacuccagccugggcaacagagcaagaccccauccuccacc

SEQ ID NO: 640348 - RNA, 64 nt, hsa
cgaacccuugaggccaggaguuccagacuaacuugggcaacacagggcgacccccaucucuaca

SEQ ID NO: 640349 - RNA, 64 nt, hsa
auugagcugagaucaugcuagugcgcuccagccugggcaacagagcgagacuucaucucagaaa

SEQ ID NO: 640350 - RNA, 64 nt, hsa
agugagcugagaucgcgccaccgcacuccagccugggcaacagagcgagacuccaucucaaaca

SEQ ID NO: 640351 - RNA, 64 nt, hsa
caggaauuugagucugggaguuugaguccagcaugggcaacauaacaagaccccaucccuuauu

SEQ ID NO: 640352 - RNA, 64 nt, hsa
agaucaccugagcucaggaguccaagaccagccugggcaacauggcaaaacaccgucucuacaa

SEQ ID NO: 640353 - RNA, 64 nt, hsa
aaugagcuaugauuucaccacugcauucuagccugggcaacagagugagauccugacucaaaua

SEQ ID NO: 640354 - RNA, 64 nt, hsa
ggauugcuugaggccgaggguucaagacuagccugggcaacauagcgagacugcaucucuacaa

SEQ ID NO: 640355 - RNA, 64 nt, hsa
agugagcacagaucacaccacugcacuccagccugggcaacagagugagacccuauuucaaaaa

SEQ ID NO: 640356 - RNA, 64 nt, hsa
ggauugcuuaagcccaggaguucaagaccagccugggcaacauggcuaaaccccaucucuacaa

SEQ ID NO: 640357 - RNA, 64 nt, hsa
agugagccaaggucacgucacugcacucuagccugggcaacagaguaagacaaaaaaauauaua

SEQ ID NO: 640358 - RNA, 64 nt, hsa
agauuacuugagcccaggaauucaagaccagccugggcaacauggugaaacccuguuucuauaa

SEQ ID NO: 640359 - RNA, 64 nt, hsa
agauugccugagcucaggaguucgagaccagccagggcaacauggugaaaccccaucucuacua

SEQ ID NO: 640360 - RNA, 64 nt, hsa
uugugccacugaacuccaaccugcacuccagccugggcaacagagcgagacuccaucucuaaau

SEQ ID NO: 640361 - RNA, 64 nt, hsa
agagugagccgugaucaccagugcacucuagccugggcaacagagaaagacccugucucaaaaa

SEQ ID NO: 640362 - RNA, 64 nt, hsa
ggaucgcuugaggccaggaguucgagaccacccugggcaacagagcgagaucccaucacuacaa

SEQ ID NO: 640363 - RNA, 64 nt, hsa
acugagccgagaucgcgccacuauacuccagccugggcaacagacauccugucucaaauaaauu

SEQ ID NO: 640364 - RNA, 64 nt, hsa
agugagccaagauugcgccacuguacuccagcuugggcaacagagcaagacuccaucucaaaaa

SEQ ID NO: 640365 - RNA, 64 nt, hsa
agugagccgagaucgcaccauugcacuccugccugggcaacaagagugaaacuccaucuccaaa

SEQ ID NO: 640366 - RNA, 64 nt, hsa
agauuauuugagcucaggaguuugagaccauccugggcaacauggcgaaacccuaucucuacaa

SEQ ID NO: 640367 - RNA, 64 nt, hsa
agugggcugugaucacaccacugcacuccagccugggcaacagagugagacccugucucugaaa

SEQ ID NO: 640368 - RNA, 64 nt, hsa
ggaucacuugagcccaggaguucaagaccagccugggcaacauagugagacuccugucucuaca

SEQ ID NO: 640369 - RNA, 64 nt, hsa
accagugagcacugguuaguacugguccccuucugggcaacauggcccuaccagacacugcugc

SEQ ID NO: 640370 - RNA, 64 nt, hsa
gagccaucaucauggcaucauugcauuccagccugggcaacagagcaagaccucgucucaaaaa

SEQ ID NO: 640371 - RNA, 64 nt, hsa
agugagccaagaucgugccacuacacuccagccugggcaacaaagcaagaccuugucucaaaaa

SEQ ID NO: 640372 - RNA, 64 nt, hsa
agaucacuugagcccaggaguucgagagcagccugggcaacaugacgaaaccccgucucuacag

SEQ ID NO: 640373 - RNA, 64 nt, hsa
uacuugugaugagagauaaccuugcccuaguugugggcaacacaugcagaauaauccuguuuua

SEQ ID NO: 640374 - RNA, 64 nt, hsa
agugauccacgaucguaccacuacacuccagccugggcaacagagcaagacccugucucaaagc

SEQ ID NO: 640375 - RNA, 64 nt, hsa
gaggaucacuugaguccagguucaagacuagccugggcaacauggcaagacccugucccuauaa

SEQ ID NO: 640376 - RNA, 64 nt, hsa
agugaacugagaucacgacacugcacuccagccugggcaacaguaaaaccuggucuccaaaaaa

SEQ ID NO: 640377 - RNA, 64 nt, hsa
caguagccgagaucgcgccacugcauuccagccugggcaacaaaagcgaaacucugucucaaaa

SEQ ID NO: 640378 - RNA, 64 nt, hsa
agugagcugagaucgcaccauugcacuccagccugggcaacaagagcgaaacucugucucaaaa

SEQ ID NO: 640379 - RNA, 64 nt, hsa
agugagccaagauugcaccacugugcucccaccugggcaacagugagacccugucucaaaaaaa

SEQ ID NO: 640380 - RNA, 64 nt, hsa
agaucacugaagcucaggaguucaagaccagccugggcaacauggcgaaacuccauuucuauaa

SEQ ID NO: 640381 - RNA, 64 nt, hsa
aaguaccaaacauaacccagaguauguggaauaugggcaacauauauauagccuucuguauuua

SEQ ID NO: 640382 - RNA, 64 nt, hsa
gaugccuugcagacaucauucaguuucuaauauugggcaacaauuauuauuaaaugaauuauuu

SEQ ID NO: 640383 - RNA, 64 nt, hsa
ggaucgcugcagcccaggaguucgagacuagccugggcaacauagcgagaccucgucucuacaa

SEQ ID NO: 640384 - RNA, 64 nt, hsa
ggauugcuugagcccaggaguuugagaccagccugggcaacacagcgagaccuugucucuuaaa

SEQ ID NO: 640385 - RNA, 64 nt, hsa
ggcuugaggccagagguuugagaccgaccagccagggcaacacagugagaccccuucucaaaaa

SEQ ID NO: 640386 - RNA, 64 nt, hsa
agugagcugagauugugccacuguacuccagccugggcaacaagagcgagacuccguuuccaaa

SEQ ID NO: 640387 - RNA, 64 nt, hsa
gcagagccgggacuaucccuuaucccuguggguugggcaacacuauuuaguccugaaaccgaau

SEQ ID NO: 640388 - RNA, 64 nt, hsa
ccauugcucaccaggccucacugggcccacagcugggcaacaagaaaaauguuugaauuggacc

SEQ ID NO: 640389 - RNA, 64 nt, hsa
agugagucaagaucacgccauugcacuccagccugggcaacaagagcgaaacuccaucucaaaa

SEQ ID NO: 640390 - RNA, 64 nt, hsa
ggauuacuugaaacccacaguuugagaccagccugggcaacauagugagacccugucucuaaaa

SEQ ID NO: 640391 - RNA, 64 nt, hsa
auuuggaaacuguuuuccucuguuuuggucucuugggcaacauuuuuggcccaaguuugggcaa

SEQ ID NO: 640392 - RNA, 64 nt, hsa
uuggucucuugggcaacauuuuuggcccaaguuugggcaacauuuggcccaaguuugggcauuu

SEQ ID NO: 640393 - RNA, 64 nt, hsa
agugagcugagauugugccacugcacuccagccugggcaacaaagcaagacucugucucaaaaa

SEQ ID NO: 640394 - RNA, 64 nt, hsa
agugagccaagaucaugucacugcauuccagccugggcaacagaggaagacuccgucucaaaaa

SEQ ID NO: 640395 - RNA, 64 nt, hsa
gcaggagggccuacaaacgggcccagcaagagcugggcaacagcuggcuugugaaaugagacac

SEQ ID NO: 640396 - RNA, 64 nt, hsa
ccagagggcucaggaugccccaggaaggaaagaagggcaacagacuacacgauuggacgugugu

SEQ ID NO: 640397 - RNA, 64 nt, hsa
acugcgcgggccugagacugcuggauacaauguugggcaacaacucagccagccugauggcagc

SEQ ID NO: 640398 - RNA, 64 nt, hsa
cgugagcuaugauuaugccacugcuuuccagccugggcaacauaguaagaccccaucucuuaaa

SEQ ID NO: 640399 - RNA, 64 nt, hsa
agugagccaugaucgagccacugcacuccagccugggcaacagaugaagacccuauuucagaaa

SEQ ID NO: 640400 - RNA, 64 nt, hsa
ggauugcuugaagccaggaguuugggaccagccugggcaacauagggggaucccaucucuacac

SEQ ID NO: 640401 - RNA, 64 nt, hsa
agugagcuaugauuguaccacugcacuccagccugggcaacagagcaagaccuugucucaaaaa

SEQ ID NO: 640402 - RNA, 64 nt, hsa
gcacuguggaaagacaggaguucgaaaccagccugggcaacauagugagacccugccucauggc

SEQ ID NO: 640403 - RNA, 64 nt, hsa
agugagcugagaucgcaccacugcacucuagcuugggcaacagagcaagacucugucucuuaaa

SEQ ID NO: 640404 - RNA, 64 nt, hsa
ggaucacuuaaggccaggaguucgagaccagccugggcaacagcaagaccucaucucuacaaaa

SEQ ID NO: 640405 - RNA, 64 nt, hsa
agugagcuguguucacaccacugcacuccagucugggcaacagugcaagacccugucacuuaaa

SEQ ID NO: 640406 - RNA, 64 nt, hsa
agagagcuaugacugcaucacugcacuccagccugggcaacacagcaagauccugucuaaaaau

SEQ ID NO: 640407 - RNA, 64 nt, hsa
ggacugcuuaagcucaggaguuugagaccagccugggcaacauagcaagacccccaccaucucu

SEQ ID NO: 640408 - RNA, 64 nt, hsa
auugagccaugauugcaccacugcacuccagccugggcaacagagggagcccccgucucaacaa

SEQ ID NO: 640409 - RNA, 64 nt, hsa
ggauugauugaggccaggaguucaagaccagccugggcaacauggugagaccccaucucuacaa

SEQ ID NO: 640410 - RNA, 64 nt, hsa
ggaucccuuuagcccaggaguuaaagaccagccugggcaacauagggagacccugucuuuuuuu

SEQ ID NO: 640411 - RNA, 64 nt, hsa
aggugggaggaucccaggaguucaaauccugccugggcaacauagcaagacccugucucuuaaa

SEQ ID NO: 640412 - RNA, 64 nt, hsa
ccaguagccacauguggcuaguggcugcugugacgggcaacacagauauggaacacuuguaucc

SEQ ID NO: 640413 - RNA, 64 nt, hsa
ggaucacuugagcucaggagcuugagaccagccugggcaacauggugaaacccaguuucuacaa

SEQ ID NO: 640414 - RNA, 64 nt, hsa
agugagcugagaucacgccacugcacuccagccugggcaacagagugagacucugucucaaaaa

SEQ ID NO: 640415 - RNA, 64 nt, hsa
agugagcugaagucccgccacugcacuccagccugggcaacagagcgagacucagucucaaaaa

SEQ ID NO: 640416 - RNA, 64 nt, hsa
agugagcugagaucgugccacugcacuccagccugggcaacagagccagacuccgucucuaaac

SEQ ID NO: 640417 - RNA, 64 nt, hsa
agaucaccugagaucaggaguucgggaccagccugggcaacauggugaaacccugucucuacua

SEQ ID NO: 640418 - RNA, 64 nt, hsa
agugagccaagaucuugccauugcacuccagccugggcaacaagagugaaauucugucucaaaa

SEQ ID NO: 640419 - RNA, 64 nt, hsa
aaugagccgagaucacaccacugcacuccagccugggcaacagugaaacuccaucucaaaaaau

SEQ ID NO: 640420 - RNA, 64 nt, hsa; identical to SEQ ID NO: 24125

SEQ ID NO: 640421 - RNA, 64 nt, hsa; identical to SEQ ID NO: 24126

SEQ ID NO: 640422 - RNA, 64 nt, hsa; identical to SEQ ID NO: 24127

SEQ ID NO: 640423 - RNA, 64 nt, hsa; identical to SEQ ID NO: 24128

SEQ ID NO: 640424 - RNA, 64 nt, hsa; identical to SEQ ID NO: 24129

SEQ ID NO: 640425 - RNA, 64 nt, hsa; identical to SEQ ID NO: 24130

SEQ ID NO: 640426 - RNA, 64 nt, hsa; identical to SEQ ID NO: 24131

SEQ ID NO: 640427 - RNA, 64 nt, hsa; identical to SEQ ID NO: 24132

SEQ ID NO: 640428 - RNA, 64 nt, hsa; identical to SEQ ID NO: 24133

SEQ ID NO: 640429 - RNA, 64 nt, hsa; identical to SEQ ID NO: 24134

SEQ ID NO: 640430 - RNA, 64 nt, hsa; identical to SEQ ID NO: 24135

SEQ ID NO: 640431 - RNA, 64 nt, hsa; identical to SEQ ID NO: 24136

SEQ ID NO: 640432 - RNA, 64 nt, hsa; identical to SEQ ID NO: 24137

SEQ ID NO: 640433 - RNA, 64 nt, hsa; identical to SEQ ID NO: 24138

SEQ ID NO: 640434 - RNA, 64 nt, hsa; identical to SEQ ID NO: 24139

SEQ ID NO: 640435 - RNA, 64 nt, hsa; identical to SEQ ID NO: 24140

SEQ ID NO: 640436 - RNA, 64 nt, hsa; identical to SEQ ID NO: 24141

SEQ ID NO: 640437 - RNA, 64 nt, hsa; identical to SEQ ID NO: 24142

SEQ ID NO: 640438 - RNA, 64 nt, hsa; identical to SEQ ID NO: 24143

SEQ ID NO: 640439 - RNA, 64 nt, hsa; identical to SEQ ID NO: 24144

SEQ ID NO: 640440 - RNA, 64 nt, hsa; identical to SEQ ID NO: 24145

SEQ ID NO: 640441 - RNA, 64 nt, hsa; identical to SEQ ID NO: 24146

SEQ ID NO: 640442 - RNA, 64 nt, hsa; identical to SEQ ID NO: 24147

SEQ ID NO: 640443 - RNA, 64 nt, hsa; identical to SEQ ID NO: 24148

SEQ ID NO: 640444 - RNA, 64 nt, hsa; identical to SEQ ID NO: 24149

SEQ ID NO: 640445 - RNA, 64 nt, hsa; identical to SEQ ID NO: 24150

SEQ ID NO: 640446 - RNA, 64 nt, hsa; identical to SEQ ID NO: 24151

SEQ ID NO: 640447 - RNA, 64 nt, hsa; identical to SEQ ID NO: 24152

SEQ ID NO: 640448 - RNA, 64 nt, hsa; identical to SEQ ID NO: 24153

SEQ ID NO: 640449 - RNA, 64 nt, hsa; identical to SEQ ID NO: 24154

SEQ ID NO: 640450 - RNA, 64 nt, hsa; identical to SEQ ID NO: 24155

SEQ ID NO: 640451 - RNA, 64 nt, hsa; identical to SEQ ID NO: 24156

SEQ ID NO: 640452 - RNA, 64 nt, hsa; identical to SEQ ID NO: 24157

SEQ ID NO: 640453 - RNA, 64 nt, hsa; identical to SEQ ID NO: 24158

SEQ ID NO: 640454 - RNA, 64 nt, hsa; identical to SEQ ID NO: 24159

SEQ ID NO: 640455 - RNA, 64 nt, hsa; identical to SEQ ID NO: 24160

SEQ ID NO: 640456 - RNA, 64 nt, hsa
uaugaugauauaaauaaaaacagcucucuaucccaauacgcaccuuuguauuuucaagaacucu

SEQ ID NO: 640457 - RNA, 64 nt, hsa
aaaggaauuuuagagauugauuguuuuaaaaaaaaauacgcacauuguccaauccagugauuuu

SEQ ID NO: 640458 - RNA, 64 nt, hsa
auacucuucggugguaguuucaaaagacacuacuaauacgcaggaagcguuccagcuauuuaau

SEQ ID NO: 640459 - RNA, 64 nt, hsa
uacugaccacugagcucugagggccuguagcuggaauacgcaucucuccagcauuccguccugg

SEQ ID NO: 640460 - RNA, 64 nt, hsa
gagagccugcaggagcgcaagcaagcacuauaugaauacgcaagaaggugaggggguuagagga

SEQ ID NO: 640461 - RNA, 64 nt, hsa
gccuuuacugagcucaggacuccagcuaaaucaaaauacgcauguucucacccagagugacaaa

SEQ ID NO: 640462 - RNA, 64 nt, hsa
gauuuauuuucacuguuauauuuaacuauauauaaauacgcauauauuguaauuuuaaugucug

SEQ ID NO: 640463 - RNA, 64 nt, hsa
cuuuauauauuacauuugguaaaaucagugcuuaaauacgcaaugauuuaaacuggaaccugag

SEQ ID NO: 640464 - RNA, 64 nt, hsa
guauuuuagcuauuuuaguaguauuuguucaauaaauacgcaagcuguaagguaacugucugau

SEQ ID NO: 640465 - RNA, 64 nt, hsa
auuuuuuauuguuuucaucuguuguuuuguuuuaaauacgcacuacaugugguuuauagagggc

SEQ ID NO: 640466 - RNA, 64 nt, hsa
acucaagccccaagacauccccuuagaugaucugaauacgcauucagggacagaucuaggcagu

SEQ ID NO: 640467 - RNA, 64 nt, hsa
cccagcccguuaaaugucaaacgucaacccccaaaauacgcaauuucagauaaguuacgcaguu

SEQ ID NO: 640468 - RNA, 64 nt, hsa
aaguuuguguuuguaaaauuuccauugugacaucaauacgcaauauauuuuguaauauaggagu

SEQ ID NO: 640469 - RNA, 64 nt, hsa
uuuuguuguuugauggaauuugagccaaaaaaaaaauacgcaggcuuuccuauuucuacaacug

SEQ ID NO: 640470 - RNA, 64 nt, hsa
ggaauuucuuguuucuccagauuuuuaauacguuaauacgcaggcaucugauuugcauauucau

SEQ ID NO: 640471 - RNA, 64 nt, hsa
gacacuucgugagccucccuguagccguggaccgaauacgcacucuugaaagcugcaucgagaa

SEQ ID NO: 640472 - RNA, 64 nt, hsa
auguagaagaugccuagcccuggggaccuugugaaauacgcaggaaccagggauaccaucuggu

SEQ ID NO: 640473 - RNA, 64 nt, hsa
ggugaacuaucucagacagaugccucuccuuuuuaauacgcauuugugcagcuaaaagacuggg

SEQ ID NO: 640474 - RNA, 64 nt, hsa
auuugacaucagagauguuguaaguauugcacuuaauacgcaccuauuucucaauaguguuauu

SEQ ID NO: 640475 - RNA, 64 nt, hsa
caugagucuucugacucuguucuuuucacuaugcaauacgcaaacaauaaaauguuauacaaau

SEQ ID NO: 640476 - RNA, 64 nt, hsa
cagugaggaugacagugacacccagagggaguagaauacgcagaacuaccagguggcaaaguac

SEQ ID NO: 640477 - RNA, 64 nt, hsa
guuuacugaauacagaggauacguuuacaaacugaauacgcauaauaaauaacugcacauucuc

SEQ ID NO: 640478 - RNA, 64 nt, hsa
cuacaaccaucuaaucuuugacaaaguugacaaaaauacgcaauggggaaagaauuccccauuc

SEQ ID NO: 640479 - RNA, 64 nt, hsa
caaugugcaaaauuuaaaauaaagaauauuuauuaauacgcacaguaaaauuugcuguacaugu

SEQ ID NO: 640480 - RNA, 64 nt, hsa
cuauuuuuuuuuuuuuuuuuuaaaccaugauuuuaauacgcaagcuguuucuaaggcgcugcca

SEQ ID NO: 640481 - RNA, 64 nt, hsa
gggucucucuaauucugguauuuugacauguuauaauacgcaaguaaaauaaaacaauaguuua

SEQ ID NO: 640482 - RNA, 64 nt, hsa
uuaugaaucaauuaaauauccugcacuuguuaggaauacgcauaucccuucuuuguugaguuua

SEQ ID NO: 640483 - RNA, 64 nt, hsa
uagcgguucuacuuaugaguaugaaugcucaggaaauacgcacuaggauauuuacuguggcuug

SEQ ID NO: 640484 - RNA, 64 nt, hsa
guaugacagaagcuuuauccaggucucagagcucaauacgcaucaaaagauacaucuuugauga

SEQ ID NO: 640485 - RNA, 64 nt, hsa
cuauuuggggcagugaaugcauagaagauauaaaaauacgcagcuuaacuauaucuuccugcgu

SEQ ID NO: 640486 - RNA, 64 nt, hsa
aaggaugugggaugguggacuccggggucgagggaauacgcagguuccugucccuccgggagac

SEQ ID NO: 640487 - RNA, 64 nt, hsa
cuuuuuaugaaggcuuucaugaauuuuaguauguaauacgcacugacgacacaugaugcuugga

SEQ ID NO: 640488 - RNA, 64 nt, hsa
gacacauaggcggggggcggcaccuggcaucagcaauacgcagucugugggagcccggccgcgc

SEQ ID NO: 640489 - RNA, 64 nt, hsa
auguuucuuuauugugugugcguguguguuuugaaauacgcacacagccacacccacauauaua

SEQ ID NO: 640490 - RNA, 64 nt, hsa
guuuuuuuguuguuguuagugagucucccuucaaaauacgcaguagguaguguaaauacugcuu

SEQ ID NO: 640491 - RNA, 64 nt, hsa
cugaaagcuucucacccuccacccucugccuugcaauacgcaaacugcgccugcuccugaaaag

SEQ ID NO: 640492 - RNA, 64 nt, hsa
aaaaaguuguuuaauauuuguuguuguauacccaaauacgcaccgaauaaacucuuuauauuca

SEQ ID NO: 640493 - RNA, 64 nt, hsa; identical to SEQ ID NO: 196485

SEQ ID NO: 640494 - RNA, 64 nt, hsa; identical to SEQ ID NO: 196486

SEQ ID NO: 640495 - RNA, 64 nt, hsa; identical to SEQ ID NO: 196487

SEQ ID NO: 640496 - RNA, 64 nt, hsa; identical to SEQ ID NO: 196488

SEQ ID NO: 640497 - RNA, 64 nt, hsa; identical to SEQ ID NO: 196489

SEQ ID NO: 640498 - RNA, 64 nt, hsa; identical to SEQ ID NO: 196490

SEQ ID NO: 640499 - RNA, 64 nt, hsa; identical to SEQ ID NO: 196491

SEQ ID NO: 640500 - RNA, 64 nt, hsa; identical to SEQ ID NO: 196492

SEQ ID NO: 640501 - RNA, 64 nt, hsa; identical to SEQ ID NO: 196493

SEQ ID NO: 640502 - RNA, 64 nt, hsa; identical to SEQ ID NO: 196494

SEQ ID NO: 640503 - RNA, 64 nt, hsa; identical to SEQ ID NO: 196495

SEQ ID NO: 640504 - RNA, 64 nt, hsa; identical to SEQ ID NO: 196496

SEQ ID NO: 640505 - RNA, 64 nt, hsa; identical to SEQ ID NO: 196497

SEQ ID NO: 640506 - RNA, 64 nt, hsa; identical to SEQ ID NO: 196498

SEQ ID NO: 640507 - RNA, 64 nt, hsa; identical to SEQ ID NO: 196499

SEQ ID NO: 640508 - RNA, 64 nt, hsa; identical to SEQ ID NO: 196500

SEQ ID NO: 640509 - RNA, 64 nt, hsa; identical to SEQ ID NO: 196501

SEQ ID NO: 640510 - RNA, 64 nt, hsa; identical to SEQ ID NO: 196502

SEQ ID NO: 640511 - RNA, 64 nt, hsa; identical to SEQ ID NO: 196503

SEQ ID NO: 640512 - RNA, 64 nt, hsa; identical to SEQ ID NO: 196504

SEQ ID NO: 640513 - RNA, 64 nt, hsa; identical to SEQ ID NO: 196505

SEQ ID NO: 640514 - RNA, 64 nt, hsa; identical to SEQ ID NO: 196506

SEQ ID NO: 640515 - RNA, 64 nt, hsa; identical to SEQ ID NO: 196507

SEQ ID NO: 640516 - RNA, 64 nt, hsa; identical to SEQ ID NO: 196508

SEQ ID NO: 640517 - RNA, 64 nt, hsa; identical to SEQ ID NO: 196509

SEQ ID NO: 640518 - RNA, 64 nt, hsa; identical to SEQ ID NO: 196510

SEQ ID NO: 640519 - RNA, 64 nt, hsa; identical to SEQ ID NO: 196511

SEQ ID NO: 640520 - RNA, 64 nt, hsa; identical to SEQ ID NO: 196512

SEQ ID NO: 640521 - RNA, 64 nt, hsa; identical to SEQ ID NO: 196513

SEQ ID NO: 640522 - RNA, 64 nt, hsa; identical to SEQ ID NO: 196514

SEQ ID NO: 640523 - RNA, 64 nt, hsa; identical to SEQ ID NO: 196515

SEQ ID NO: 640524 - RNA, 64 nt, hsa; identical to SEQ ID NO: 196516

SEQ ID NO: 640525 - RNA, 64 nt, hsa; identical to SEQ ID NO: 196517

SEQ ID NO: 640526 - RNA, 64 nt, hsa; identical to SEQ ID NO: 196518

SEQ ID NO: 640527 - RNA, 64 nt, hsa; identical to SEQ ID NO: 196519

SEQ ID NO: 640528 - RNA, 64 nt, hsa; identical to SEQ ID NO: 196520

SEQ ID NO: 640529 - RNA, 64 nt, hsa; identical to SEQ ID NO: 196521

SEQ ID NO: 640530 - RNA, 64 nt, hsa; identical to SEQ ID NO: 196522

SEQ ID NO: 640531 - RNA, 64 nt, hsa; identical to SEQ ID NO: 196523

SEQ ID NO: 640532 - RNA, 64 nt, hsa; identical to SEQ ID NO: 196524

SEQ ID NO: 640533 - RNA, 64 nt, hsa; identical to SEQ ID NO: 196525

SEQ ID NO: 640534 - RNA, 64 nt, hsa; identical to SEQ ID NO: 196526

SEQ ID NO: 640535 - RNA, 64 nt, hsa; identical to SEQ ID NO: 196527

SEQ ID NO: 640536 - RNA, 64 nt, hsa; identical to SEQ ID NO: 196528

SEQ ID NO: 640537 - RNA, 64 nt, hsa; identical to SEQ ID NO: 196529

SEQ ID NO: 640538 - RNA, 64 nt, hsa; identical to SEQ ID NO: 196530

SEQ ID NO: 640539 - RNA, 64 nt, hsa; identical to SEQ ID NO: 196531

SEQ ID NO: 640540 - RNA, 64 nt, hsa; identical to SEQ ID NO: 196532

SEQ ID NO: 640541 - RNA, 64 nt, hsa; identical to SEQ ID NO: 196533

SEQ ID NO: 640542 - RNA, 64 nt, hsa; identical to SEQ ID NO: 196534

SEQ ID NO: 640543 - RNA, 64 nt, hsa; identical to SEQ ID NO: 196535

SEQ ID NO: 640544 - RNA, 64 nt, hsa; identical to SEQ ID NO: 196536

SEQ ID NO: 640545 - RNA, 64 nt, hsa; identical to SEQ ID NO: 196537

SEQ ID NO: 640546 - RNA, 64 nt, hsa; identical to SEQ ID NO: 196538

SEQ ID NO: 640547 - RNA, 64 nt, hsa; identical to SEQ ID NO: 196539

SEQ ID NO: 640548 - RNA, 64 nt, hsa; identical to SEQ ID NO: 196540

SEQ ID NO: 640549 - RNA, 64 nt, hsa; identical to SEQ ID NO: 196541

SEQ ID NO: 640550 - RNA, 64 nt, hsa; identical to SEQ ID NO: 196542

SEQ ID NO: 640551 - RNA, 64 nt, hsa; identical to SEQ ID NO: 196543

SEQ ID NO: 640552 - RNA, 64 nt, hsa; identical to SEQ ID NO: 196544

SEQ ID NO: 640553 - RNA, 64 nt, hsa; identical to SEQ ID NO: 196545

SEQ ID NO: 640554 - RNA, 64 nt, hsa; identical to SEQ ID NO: 196546

SEQ ID NO: 640555 - RNA, 64 nt, hsa; identical to SEQ ID NO: 196547

SEQ ID NO: 640556 - RNA, 64 nt, hsa; identical to SEQ ID NO: 196548

SEQ ID NO: 640557 - RNA, 64 nt, hsa; identical to SEQ ID NO: 196549

SEQ ID NO: 640558 - RNA, 64 nt, hsa; identical to SEQ ID NO: 196550

SEQ ID NO: 640559 - RNA, 64 nt, hsa; identical to SEQ ID NO: 196551

SEQ ID NO: 640560 - RNA, 64 nt, hsa; identical to SEQ ID NO: 196551

SEQ ID NO: 640561 - RNA, 64 nt, hsa; identical to SEQ ID NO: 196553

SEQ ID NO: 640562 - RNA, 64 nt, hsa; identical to SEQ ID NO: 196554

SEQ ID NO: 640563 - RNA, 64 nt, hsa; identical to SEQ ID NO: 196555

SEQ ID NO: 640564 - RNA, 64 nt, hsa; identical to SEQ ID NO: 196556

SEQ ID NO: 640565 - RNA, 64 nt, hsa; identical to SEQ ID NO: 196557

SEQ ID NO: 640566 - RNA, 64 nt, hsa; identical to SEQ ID NO: 196558

SEQ ID NO: 640567 - RNA, 64 nt, hsa; identical to SEQ ID NO: 196559

SEQ ID NO: 640568 - RNA, 64 nt, hsa; identical to SEQ ID NO: 196560

SEQ ID NO: 640569 - RNA, 64 nt, hsa; identical to SEQ ID NO: 196561

SEQ ID NO: 640570 - RNA, 64 nt, hsa; identical to SEQ ID NO: 196562

SEQ ID NO: 640571 - RNA, 64 nt, hsa; identical to SEQ ID NO: 196563

SEQ ID NO: 640572 - RNA, 64 nt, hsa; identical to SEQ ID NO: 196564

SEQ ID NO: 640573 - RNA, 64 nt, hsa; identical to SEQ ID NO: 196565

SEQ ID NO: 640574 - RNA, 64 nt, hsa; identical to SEQ ID NO: 196566

SEQ ID NO: 640575 - RNA, 64 nt, hsa; identical to SEQ ID NO: 196567

SEQ ID NO: 640576 - RNA, 64 nt, hsa; identical to SEQ ID NO: 196568

SEQ ID NO: 640577 - RNA, 64 nt, hsa; identical to SEQ ID NO: 196569

SEQ ID NO: 640578 - RNA, 64 nt, hsa; identical to SEQ ID NO: 196570

SEQ ID NO: 640579 - RNA, 64 nt, hsa; identical to SEQ ID NO: 196571

SEQ ID NO: 640580 - RNA, 64 nt, hsa; identical to SEQ ID NO: 196572

SEQ ID NO: 640581 - RNA, 64 nt, hsa; identical to SEQ ID NO: 115778

SEQ ID NO: 640582 - RNA, 64 nt, hsa; identical to SEQ ID NO: 115779

SEQ ID NO: 640583 - RNA, 64 nt, hsa; identical to SEQ ID NO: 115780

SEQ ID NO: 640584 - RNA, 64 nt, hsa; identical to SEQ ID NO: 115781

SEQ ID NO: 640585 - RNA, 64 nt, hsa; identical to SEQ ID NO: 115782

SEQ ID NO: 640586 - RNA, 64 nt, hsa; identical to SEQ ID NO: 115783

SEQ ID NO: 640587 - RNA, 64 nt, hsa; identical to SEQ ID NO: 115784

SEQ ID NO: 640588 - RNA, 64 nt, hsa; identical to SEQ ID NO: 115785

SEQ ID NO: 640589 - RNA, 64 nt, hsa; identical to SEQ ID NO: 115786

SEQ ID NO: 640590 - RNA, 64 nt, hsa; identical to SEQ ID NO: 115787

SEQ ID NO: 640591 - RNA, 64 nt, hsa; identical to SEQ ID NO: 115788

SEQ ID NO: 640592 - RNA, 64 nt, hsa; identical to SEQ ID NO: 115789

SEQ ID NO: 640593 - RNA, 64 nt, hsa; identical to SEQ ID NO: 115790

SEQ ID NO: 640594 - RNA, 64 nt, hsa; identical to SEQ ID NO: 115791

SEQ ID NO: 640595 - RNA, 64 nt, hsa; identical to SEQ ID NO: 115792

SEQ ID NO: 640596 - RNA, 64 nt, hsa; identical to SEQ ID NO: 115793

SEQ ID NO: 640597 - RNA, 64 nt, hsa; identical to SEQ ID NO: 115794

SEQ ID NO: 640598 - RNA, 64 nt, hsa; identical to SEQ ID NO: 115795

SEQ ID NO: 640599 - RNA, 64 nt, hsa; identical to SEQ ID NO: 115796

SEQ ID NO: 640600 - RNA, 64 nt, hsa; identical to SEQ ID NO: 115797

SEQ ID NO: 640601 - RNA, 64 nt, hsa; identical to SEQ ID NO: 173467

SEQ ID NO: 640602 - RNA, 64 nt, hsa; identical to SEQ ID NO: 173468

SEQ ID NO: 640603 - RNA, 64 nt, hsa; identical to SEQ ID NO: 173469

SEQ ID NO: 640604 - RNA, 64 nt, hsa; identical to SEQ ID NO: 173470

SEQ ID NO: 640605 - RNA, 64 nt, hsa; identical to SEQ ID NO: 173471

SEQ ID NO: 640606 - RNA, 64 nt, hsa; identical to SEQ ID NO: 173472

SEQ ID NO: 640607 - RNA, 64 nt, hsa; identical to SEQ ID NO: 173473

SEQ ID NO: 640608 - RNA, 64 nt, hsa; identical to SEQ ID NO: 173474

SEQ ID NO: 640609 - RNA, 64 nt, hsa; identical to SEQ ID NO: 173475

SEQ ID NO: 640610 - RNA, 64 nt, hsa; identical to SEQ ID NO: 173476

SEQ ID NO: 640611 - RNA, 64 nt, hsa; identical to SEQ ID NO: 173477

SEQ ID NO: 640612 - RNA, 64 nt, hsa; identical to SEQ ID NO: 173478

SEQ ID NO: 640613 - RNA, 64 nt, hsa; identical to SEQ ID NO: 173479

SEQ ID NO: 640614 - RNA, 64 nt, hsa; identical to SEQ ID NO: 173480

SEQ ID NO: 640615 - RNA, 64 nt, hsa; identical to SEQ ID NO: 173481

SEQ ID NO: 640616 - RNA, 64 nt, hsa; identical to SEQ ID NO: 173482

SEQ ID NO: 640617 - RNA, 64 nt, hsa; identical to SEQ ID NO: 173483

SEQ ID NO: 640618 - RNA, 64 nt, hsa; identical to SEQ ID NO: 173484

SEQ ID NO: 640619 - RNA, 64 nt, hsa; identical to SEQ ID NO: 173485

SEQ ID NO: 640620 - RNA, 64 nt, hsa; identical to SEQ ID NO: 173486

SEQ ID NO: 640621 - RNA, 64 nt, hsa; identical to SEQ ID NO: 173487

SEQ ID NO: 640622 - RNA, 64 nt, hsa; identical to SEQ ID NO: 173488

SEQ ID NO: 640623 - RNA, 60 nt, hsa
gucuaaccagccucagcagugugcauagaccauuuccaggagggucuguccccagaugcu

SEQ ID NO: 640624 - RNA, 60 nt, hsa
acagccagaagccaccuugacacuuuugaacauuuccaguucuguagaguuuauugucaa

SEQ ID NO: 640625 - RNA, 60 nt, hsa
aguguguuuagacuuuucaaguaucuaacucauuuccaaacauguaccauguuuuauaaa

SEQ ID NO: 640626 - RNA, 60 nt, hsa
aauacuuuuguauugcugcuugcaaauaugcauuuccaaacuugaaauauaggugugaac

SEQ ID NO: 640627 - RNA, 60 nt, hsa
gacaagaggaagggcagguacuagguguuucauuuccagaauuaaaaaaaaaauccauuu

SEQ ID NO: 640628 - RNA, 60 nt, hsa
gaaaauaaugucuacaguccacagcuucagcauuuccagagaccacaugugagcuucuuu

SEQ ID NO: 640629 - RNA, 60 nt, hsa
uuuuucagaaaaugcaucccugauuucauucauuuccagcuugaaagccagccauauuac

SEQ ID NO: 640630 - RNA, 60 nt, hsa
ucuagucccuaccaaacugcucuagaaggucauuuccauuuuguuugugauauuuagacg

SEQ ID NO: 640631 - RNA, 60 nt, hsa
ccauggacucaaucugagaacaacagcauucauuuccauucauuuccauacuggcuuuug

SEQ ID NO: 640632 - RNA, 60 nt, hsa
aaucugagaacaacagcauucauuuccauucauuuccauacuggcuuuugauuauaugca

SEQ ID NO: 640633 - RNA, 60 nt, hsa
acuuuucuuccuuauggggcuacauuuguucauuuccagcaguagcauaaacuuacggug

SEQ ID NO: 640634 - RNA, 60 nt, hsa
ugaggguagagccacaaauuucaauucuuacauuuccauuugcaaagugacuagagaaaa

SEQ ID NO: 640635 - RNA, 60 nt, hsa
cugcagcaaacguuugccugggcauugaggcauuuccauacaucuucugaaaacuaggcg

SEQ ID NO: 640636 - RNA, 60 nt, hsa
gauugaacacuuuaguaaugcaaaauaacucauuuccaacuacugcugcagcauuuuggu

SEQ ID NO: 640637 - RNA, 60 nt, hsa
auguuuuuuucacuuaauauuuuauauauacauuuccauguauugauguaguuaguccac

SEQ ID NO: 640638 - RNA, 60 nt, hsa
guuuucauaggcuauuauauauucucgcagcauuuccaguuaagaggauauuagguauau

SEQ ID NO: 640639 - RNA, 60 nt, hsa
guuacccaaacucaucuucuaaaaucugugcauuuccaugguggcugacacacuugucau

SEQ ID NO: 640640 - RNA, 60 nt, hsa
aagugagcauuucuuuuuaaauuuucuugacauuuccaagcuuauuaugaauaauauugc

SEQ ID NO: 640641 - RNA, 60 nt, hsa
uuagauaucaguuaggauacaucacuaaaacauuuccacuaacuccacuguuucuauaau

SEQ ID NO: 640642 - RNA, 60 nt, hsa
gaaaagauaucacaacucuauggaaaaugacauuuccauuugccuuauugcuacuucaag

SEQ ID NO: 640643 - RNA, 60 nt, hsa
ucccaacuucauuucccccucacuguagcccauuuccaccccaccacaaaguugccacag

SEQ ID NO: 640644 - RNA, 60 nt, hsa
cuggaagugcaugaggcagagcguccguagcauuuccaguuuguucuguauaggaacaga

SEQ ID NO: 640645 - RNA, 60 nt, hsa
aaccagauucaugagcuuucucacauuuuccauuuccaaauaacuguuguguugaaucag

SEQ ID NO: 640646 - RNA, 60 nt, hsa
acugggcuuuaaagagcgaaaugagugugucauuuccacaugaaggagaggcaaggaaaa

SEQ ID NO: 640647 - RNA, 60 nt, hsa
uaccugcgcagucuaaacauagcuguggaucauuuccaacuuucaacuucacuccgggcc

SEQ ID NO: 640648 - RNA, 60 nt, hsa
aggcugguuuccugugcagcagguggaguucauuuccaacccagagguccgugcacagaa

SEQ ID NO: 640649 - RNA, 60 nt, hsa
gauaaaccaaggauuuuguguuuaacaauccauuuccagugucuucgccacauaaaauag

SEQ ID NO: 640650 - RNA, 60 nt, hsa
aaaggauaguuuaugaguaaucuuuaaaaccauuuccauaccaucuguauauaaccauuu

SEQ ID NO: 640651 - RNA, 60 nt, hsa
gauuccaggcgugagccacugcggccagcacauuuccacuuuuagauccuacuccauacc

SEQ ID NO: 640652 - RNA, 60 nt, hsa
cugugcuccuuaagccucauggccuuccuacauuuccacuuuauuuguuuguuuguuuau

SEQ ID NO: 640653 - RNA, 60 nt, hsa
aaaaugggcagagagagaugaccucggaagcauuuccacagauggugucaggguuucaag

SEQ ID NO: 640654 - RNA, 60 nt, hsa
caacuguggucaaaguucauaggugucguacauuuccauuauuugcuaaaaucaugcaau

SEQ ID NO: 640655 - RNA, 60 nt, hsa
ucuuugcaucagcuuaccuuguaccagaaacauuuccaauuuacuaucaaauuauaguaa

SEQ ID NO: 640656 - RNA, 60 nt, hsa
aaugcccagaaagugccagaagcaucguggcauuuccagaaccauggauucugccuuugg

SEQ ID NO: 640657 - RNA, 60 nt, hsa
agauccaaaguuagcaguauauggcugcuacauuuccauuuucauuuucgagccaucagu

SEQ ID NO: 640658 - RNA, 60 nt, hsa
uucauuguuuaaugaaauauuuuauucuugcauuuccauaaggaaagggaaagucaugau

SEQ ID NO: 640659 - RNA, 60 nt, hsa
gggcaaccuccuucgacgugggggaggucccauuuccacuucaucacuguuggagaucau

SEQ ID NO: 640660 - RNA, 60 nt, hsa; identical to SEQ ID NO: 59927

SEQ ID NO: 640661 - RNA, 60 nt, hsa
guguucugaccagggagugacagguuaugacauuuccaugucaacucuaaaugaagucuu

SEQ ID NO: 640662 - RNA, 60 nt, hsa
uauauacuuugccacuggaaaggacaaauacauuuccagaucuuuucagugaucuggaua

SEQ ID NO: 640663 - RNA, 60 nt, hsa
cguccauucuuuuaaauguugucucacuugcauuuccagucuuggccaucaaaucaauga

SEQ ID NO: 640664 - RNA, 60 nt, hsa
aaaguggcaucucauggugguuuuaauuugcauuuccauaauaucuaauuagguugagcu

SEQ ID NO: 640665 - RNA, 60 nt, hsa
auuuaauuuugaaaaaggugacucaccccucauuuccagaguguaggcaauuauguccug

SEQ ID NO: 640666 - RNA, 60 nt, hsa
aaaaaagaaaagaaaucuguuucuaccaaacauuuccagaaacguauuuauagcaugaag

SEQ ID NO: 640667 - RNA, 64 nt, hsa
ggucauaaaacauuaagaaaauuauggcuguugcugucauuacauaucuauuaaaugucaucaa

SEQ ID NO: 640668 - RNA, 64 nt, hsa
augaauaauaggaaaguuguauuaauucaguauuugucauuaugcaguauuuuaauaccuacau

SEQ ID NO: 640669 - RNA, 64 nt, hsa
gauauguucugagaaaugugucauuaggcgauuuugucauuaaacaucauagcauguacuucca

SEQ ID NO: 640670 - RNA, 64 nt, hsa
gucacuuaaggauggagauauguucugagaaaugugucauuaggcgauuuugucauuaaacauc

SEQ ID NO: 640671 - RNA, 64 nt, hsa
uagaagaauugcauaaaacguaguaaauggggucugucauuagcaaaggcaaaucuaagcaauc

SEQ ID NO: 640672 - RNA, 64 nt, hsa
guauuaaaagauuguuuaacaguauguguggugaugucauuaucuccagagaggcuucaagaaa

SEQ ID NO: 640673 - RNA, 64 nt, hsa
ccaggugaggugcuguguucaugcacggaacugaugucauuagacaccauccaaggaugggcag

SEQ ID NO: 640674 - RNA, 64 nt, hsa
ggaggccacccccaggaaggaguuugagguucauugucauuauggccacaguuuggugcuugug

SEQ ID NO: 640675 - RNA, 64 nt, hsa
cuuaagugauaaccagggucacggauuccaaacaugucauuauaaauuguuuuauauggugcuc

SEQ ID NO: 640676 - RNA, 64 nt, hsa
caacucccacaacaaagaauuauccagcccaaaaugucauuagugcugagguugagaaauacuc

SEQ ID NO: 640677 - RNA, 64 nt, hsa
aggaaauuguuugacauaacacaggguucaggggugucauuaaagacacacuuuuuuugccuug

SEQ ID NO: 640678 - RNA, 64 nt, hsa
caugaguguaauggugauaugaaaaacuuugucuugucauuauaauaauaaaaaaaugaacauu

SEQ ID NO: 640679 - RNA, 64 nt, hsa
uguaguaauuacucuuugaacagguuuuguguuuugucauuagcucugcccuuuuuaauuaaau

SEQ ID NO: 640680 - RNA, 64 nt, hsa
ucaucccuacccuggcccagaugaucacugaucuugucauuauagaugaguuuugccaguucaa

SEQ ID NO: 640681 - RNA, 64 nt, hsa
uacgguuuuucuaccugauugcauauagcauaugugucauuacaugugaugcugugcaaaacuu

SEQ ID NO: 640682 - RNA, 64 nt, hsa
uuaacauagguggcuagccaaaguuuagaauuuuugucauuaaauaugaaauggauauaugcua

SEQ ID NO: 640683 - RNA, 64 nt, hsa
aaaaauguuuggacugcuuuuaaaaccugagcaaugucauuaauccauauguggacuagugaug

SEQ ID NO: 640684 - RNA, 64 nt, hsa
cucuuguuuaaguguguguugcuaaauuuuuuacugucauuacuaaauaaucuguguggcaaaa

SEQ ID NO: 640685 - RNA, 64 nt, hsa
guauucuguaaauauuaucuguaauuguuauuauugucauuaguauuagugaauucacguaaaa

SEQ ID NO: 640686 - RNA, 64 nt, hsa
auguaaugaauguaggaaaaucuuuagccuuaucugucauuaucucccuuucuccacuugauua

SEQ ID NO: 640687 - RNA, 64 nt, hsa
aaaguucagcagugugugcacagcuuucuuuugguuggcagagauucaggaucauggaguacug

SEQ ID NO: 640688 - RNA, 64 nt, hsa
aguacugcucucauaauugaagacguguuuguuauuggcagagaaccuuaaaaaaggccuuuac

SEQ ID NO: 640689 - RNA, 64 nt, hsa
ucuugguucuagcuaguaauaacaauauaauucuuuggcagauauucagaauaacauuuuaaac

SEQ ID NO: 640690 - RNA, 64 nt, hsa
auacauuuaaauaucuuugauaauuguuauuuuuuuggcagauaauuccucuagaauguguauc

SEQ ID NO: 640691 - RNA, 64 nt, hsa
uucauuauuuuaaagcuaauugccugaaaauauauuggcagaauuuucccaaauuguaauaacu

SEQ ID NO: 640692 - RNA, 64 nt, hsa
aaccuuauauggugguuuuagucccuucuuaugguuggcagaagggcacugaacuguuggguga

SEQ ID NO: 640693 - RNA, 64 nt, hsa
aacaccuuguuugcgguguuggaacaugguuccuuuggcagaagugcuuuuuuuuuaaucgcag

SEQ ID NO: 640694 - RNA, 64 nt, hsa
cucaccucugccacccaucuacuugcauucgucuuuggcagaccucaagauaaauauggguuaa

SEQ ID NO: 640695 - RNA, 64 nt, hsa
ggcguuuuccuagccuggagaugggaaaauaugcuuggcagagacaggaaugcugugugcuugu

SEQ ID NO: 640696 - RNA, 64 nt, hsa
gaggguagacggcagaugccugacagagaguggguuggcagacaacacacuagcauuuucacgg

SEQ ID NO: 640697 - RNA, 64 nt, hsa
cuucccuuccaucucuucaccccuagcugucaguuuggcagauuuucccucguuaccuccaguu

SEQ ID NO: 640698 - RNA, 64 nt, hsa
acauuucaugcauagcuuggcucagaaggugccauuggcagacaggcacaugggaggcuggagu

SEQ ID NO: 640699 - RNA, 64 nt, hsa
agcaugcuagcacucuagacagaauucuagaaauuuggcagauaguggaagccuuuaauugaac

SEQ ID NO: 640700 - RNA, 64 nt, hsa
aucuuggcauaauggccagaaaauauuguauugcuuggcagaaaagaaaauaaggucuaaagga

SEQ ID NO: 640701 - RNA, 64 nt, hsa
ucuacucugugcaccaugcuaggaagcuuccuuuuuggcagaauauguuuggcagcaaagcuau

SEQ ID NO: 640702 - RNA, 64 nt, hsa
cauuuuuagcucagagcaacccuuaagagaacuuuuggcagauuuuguuggcauuauugaaaua

SEQ ID NO: 640703 - RNA, 64 nt, hsa
cacgugcccuacgauggccuaacaggagugcccauuggcagauuacacauguaaauaugaccuc

SEQ ID NO: 640704 - RNA, 64 nt, hsa
auaauaagguggaauuugcaggucagcccaggaauuggcagaggaaguaggugucugauaaccc

SEQ ID NO: 640705 - RNA, 64 nt, hsa
ucaauggcuggccaguguagugugaagucccagcuuggcagagacuugcccaaggcuggauagg

SEQ ID NO: 640706 - RNA, 64 nt, hsa
gacagcccccuccccuucccucugucuucuguguuuggcagaccagccccagcgaggacuuguu

SEQ ID NO: 640707 - RNA, 64 nt, hsa
ggauagaagcccaugacuucagacagacuuucucuuggcagaugcaggcgggccuccucccagg

SEQ ID NO: 640708 - RNA, 64 nt, hsa
ccugaauaacacguggcacaaaugggcccggccuuuggcagaggagcaagugauaugaugugua

SEQ ID NO: 640709 - RNA, 64 nt, hsa
uucugcuagacagauaacuuuuaauuuuucaaauuuggcagacacuuuuuuuuuuuuuuugaaa

SEQ ID NO: 640710 - RNA, 64 nt, hsa
aaauguaaguauccuuaaaaacaaagcaucuauuuuggcagaaauuguguucuuaaauucaguc

SEQ ID NO: 640711 - RNA, 64 nt, hsa
ggcauccggccugugcugggcauggguggugacauuggcagaaauggccacuggaaaggggagc

SEQ ID NO: 640712 - RNA, 64 nt, hsa
ccuggaagguucauggggaaacucgcuccuucuguuggcagaggacagccccuggggaacccca

SEQ ID NO: 640713 - RNA, 64 nt, hsa
auguaacuuaaagccuggcuuuaugauauccuacuuggcagaaagacauuuuucuccucaguag

SEQ ID NO: 640714 - RNA, 64 nt, hsa
ccaguuaagucccaguguaaggguuggucuuugguuggcagaacugaacauggugguuugcacu

SEQ ID NO: 640715 - RNA, 64 nt, hsa
uaauggcauguguuuguaaaauggauagcugggguuggcagauggcuagagaagaaucgccuuu

SEQ ID NO: 640716 - RNA, 64 nt, hsa
acuuuucaccuacuccuuucaugguuauaacacauuggcagacuuuuugcuggcucugggagcc

SEQ ID NO: 640717 - RNA, 64 nt, hsa; identical to SEQ ID NO: 437867

SEQ ID NO: 640718 - RNA, 64 nt, hsa; identical to SEQ ID NO: 437868

SEQ ID NO: 640719 - RNA, 64 nt, hsa; identical to SEQ ID NO: 437869

SEQ ID NO: 640720 - RNA, 64 nt, hsa; identical to SEQ ID NO: 437870

SEQ ID NO: 640721 - RNA, 64 nt, hsa; identical to SEQ ID NO: 437871

SEQ ID NO: 640722 - RNA, 64 nt, hsa; identical to SEQ ID NO: 437872

SEQ ID NO: 640723 - RNA, 64 nt, hsa; identical to SEQ ID NO: 437873

SEQ ID NO: 640724 - RNA, 64 nt, hsa; identical to SEQ ID NO: 437874

SEQ ID NO: 640725 - RNA, 64 nt, hsa; identical to SEQ ID NO: 437875

SEQ ID NO: 640726 - RNA, 64 nt, hsa; identical to SEQ ID NO: 437876

SEQ ID NO: 640727 - RNA, 64 nt, hsa; identical to SEQ ID NO: 437877

SEQ ID NO: 640728 - RNA, 64 nt, hsa; identical to SEQ ID NO: 437878

SEQ ID NO: 640729 - RNA, 64 nt, hsa; identical to SEQ ID NO: 437879

SEQ ID NO: 640730 - RNA, 64 nt, hsa; identical to SEQ ID NO: 437880

SEQ ID NO: 640731 - RNA, 64 nt, hsa; identical to SEQ ID NO: 437881

SEQ ID NO: 640732 - RNA, 64 nt, hsa; identical to SEQ ID NO: 437882

SEQ ID NO: 640733 - RNA, 64 nt, hsa; identical to SEQ ID NO: 437883

SEQ ID NO: 640734 - RNA, 64 nt, hsa; identical to SEQ ID NO: 437884

SEQ ID NO: 640735 - RNA, 64 nt, hsa; identical to SEQ ID NO: 437885

SEQ ID NO: 640736 - RNA, 64 nt, hsa; identical to SEQ ID NO: 437886

SEQ ID NO: 640737 - RNA, 64 nt, hsa; identical to SEQ ID NO: 437887

SEQ ID NO: 640738 - RNA, 64 nt, hsa; identical to SEQ ID NO: 437888

SEQ ID NO: 640739 - RNA, 64 nt, hsa; identical to SEQ ID NO: 437889

SEQ ID NO: 640740 - RNA, 64 nt, hsa; identical to SEQ ID NO: 437890

SEQ ID NO: 640741 - RNA, 64 nt, hsa; identical to SEQ ID NO: 437891

SEQ ID NO: 640742 - RNA, 64 nt, hsa; identical to SEQ ID NO: 437892

SEQ ID NO: 640743 - RNA, 64 nt, hsa
cuguguucagccacacccagugguagcuccaccaaaucaugaacagccuaauuuugagugucug

SEQ ID NO: 640744 - RNA, 64 nt, hsa
ucacauauugguauguuguuaaccugguagauuaaaucaugagaaugauuagaaagacgggcaa

SEQ ID NO: 640745 - RNA, 64 nt, hsa
auggguaaauaauuugucauuaaacuuguguuugaaucaugaauucccuuguuucaaaagacuu

SEQ ID NO: 640746 - RNA, 64 nt, hsa
auuuuauacauaaaggccagaagcugucugaggcaaucaugauugauuguauguaucacuuacu

SEQ ID NO: 640747 - RNA, 64 nt, hsa
acugaauaaaugacugagaacaaguuacaaaaggaaucaugaauccugguaaacaauaaagaag

SEQ ID NO: 640748 - RNA, 64 nt, hsa
auucaggaaagcugggugcugucuccaugccaugaaucaugagagcaaaggaucacugcuuaaa

SEQ ID NO: 640749 - RNA, 64 nt, hsa
accagcacugcucuuccccuccuauaaucauaauaaucaugauaaccugaaacauguuacuggg

SEQ ID NO: 640750 - RNA, 64 nt, hsa
caaagcaaaaaaaaaugcuuuaauucaaauuaaaaaucaugauacuagagaugggagucugugg

SEQ ID NO: 640751 - RNA, 64 nt, hsa
acuagguaacagguucuuaaauaguucaugugaaaaucaugacagacuaaggcaguggcugugg

SEQ ID NO: 640752 - RNA, 64 nt, hsa
uaagauuuaagcugagccagggaggacuugaaggaaucaugaugagagagaagguaaguggcuu

SEQ ID NO: 640753 - RNA, 64 nt, hsa
guaaucccagcacuuuggggggcugaggugggcgaaucaugagaucaggaguucgagaccagcc

SEQ ID NO: 640754 - RNA, 64 nt, hsa
uuaauuguacuuguauuagauuuuuaaggccuauaaucaugaaauaucacuaguugccagaaua

SEQ ID NO: 640755 - RNA, 64 nt, hsa
acauauugugauuaaugcuuucaaaacuuaugaaaaucaugaacuaccccagaauugaacuguu

SEQ ID NO: 640756 - RNA, 64 nt, hsa
aaagaauuuaagaaagaauauauuugucaaauaaaaucaugaucuuauuguuaaaauuaaugaa

SEQ ID NO: 640757 - RNA, 64 nt, hsa
gcccagucucuaugaauguuauggccuagggaagaaucaugaaacucuuuagcuugauuagaug

SEQ ID NO: 640758 - RNA, 64 nt, hsa
ggaagaagggaaggcggaggagucuauaagaaggaaucaugauuucuauuuagcagauuggaug

SEQ ID NO: 640759 - RNA, 64 nt, hsa
gacuucugugcuuucuuuccuguucccuacagguaaucaugaauauuuucaaggacuucccccc

SEQ ID NO: 640760 - RNA, 64 nt, hsa
cauugacuguaagaccucuguagggcaaugugaaaaucaugauugcuacagaagcacugagaua

SEQ ID NO: 640761 - RNA, 64 nt, hsa
gccugauaugccaauagcauacaaacucaauagcaaucaugacugagccaaucacuguuucuca

SEQ ID NO: 640762 - RNA, 64 nt, hsa
acugauacuuuugucagauaucacccuguccuuaaaucaugaucacuuaaaucaggggucagca

SEQ ID NO: 640763 - RNA, 64 nt, hsa; identical to SEQ ID NO: 502943

SEQ ID NO: 640764 - RNA, 64 nt, hsa; identical to SEQ ID NO: 502944

SEQ ID NO: 640765 - RNA, 64 nt, hsa; identical to SEQ ID NO: 502945

SEQ ID NO: 640766 - RNA, 64 nt, hsa; identical to SEQ ID NO: 502946

SEQ ID NO: 640767 - RNA, 64 nt, hsa; identical to SEQ ID NO: 502947

SEQ ID NO: 640768 - RNA, 64 nt, hsa; identical to SEQ ID NO: 502948

SEQ ID NO: 640769 - RNA, 64 nt, hsa; identical to SEQ ID NO: 502949

SEQ ID NO: 640770 - RNA, 64 nt, hsa; identical to SEQ ID NO: 502950

SEQ ID NO: 640771 - RNA, 64 nt, hsa; identical to SEQ ID NO: 502951

SEQ ID NO: 640772 - RNA, 64 nt, hsa; identical to SEQ ID NO: 502952

SEQ ID NO: 640773 - RNA, 64 nt, hsa; identical to SEQ ID NO: 502953

SEQ ID NO: 640774 - RNA, 64 nt, hsa; identical to SEQ ID NO: 502954

SEQ ID NO: 640775 - RNA, 64 nt, hsa; identical to SEQ ID NO: 502955

SEQ ID NO: 640776 - RNA, 64 nt, hsa; identical to SEQ ID NO: 502956

SEQ ID NO: 640777 - RNA, 64 nt, hsa; identical to SEQ ID NO: 502957

SEQ ID NO: 640778 - RNA, 64 nt, hsa; identical to SEQ ID NO: 502958

SEQ ID NO: 640779 - RNA, 64 nt, hsa; identical to SEQ ID NO: 502959

SEQ ID NO: 640780 - RNA, 64 nt, hsa; identical to SEQ ID NO: 502960

SEQ ID NO: 640781 - RNA, 64 nt, hsa; identical to SEQ ID NO: 502961

SEQ ID NO: 640782 - RNA, 64 nt, hsa; identical to SEQ ID NO: 502962

SEQ ID NO: 640783 - RNA, 64 nt, hsa; identical to SEQ ID NO: 502963

SEQ ID NO: 640784 - RNA, 64 nt, hsa; identical to SEQ ID NO: 502964

SEQ ID NO: 640785 - RNA, 64 nt, hsa; identical to SEQ ID NO: 502965

SEQ ID NO: 640786 - RNA, 64 nt, hsa; identical to SEQ ID NO: 502966

SEQ ID NO: 640787 - RNA, 64 nt, hsa; identical to SEQ ID NO: 502967

SEQ ID NO: 640788 - RNA, 64 nt, hsa; identical to SEQ ID NO: 502968

SEQ ID NO: 640789 - RNA, 64 nt, hsa; identical to SEQ ID NO: 502969

SEQ ID NO: 640790 - RNA, 64 nt, hsa; identical to SEQ ID NO: 502970

SEQ ID NO: 640791 - RNA, 64 nt, hsa; identical to SEQ ID NO: 502971

SEQ ID NO: 640792 - RNA, 64 nt, hsa; identical to SEQ ID NO: 502972

SEQ ID NO: 640793 - RNA, 64 nt, hsa; identical to SEQ ID NO: 502973

SEQ ID NO: 640794 - RNA, 64 nt, hsa; identical to SEQ ID NO: 502974

SEQ ID NO: 640795 - RNA, 64 nt, hsa; identical to SEQ ID NO: 502975

SEQ ID NO: 640796 - RNA, 64 nt, hsa; identical to SEQ ID NO: 502976

SEQ ID NO: 640797 - RNA, 64 nt, hsa; identical to SEQ ID NO: 502977

SEQ ID NO: 640798 - RNA, 64 nt, hsa; identical to SEQ ID NO: 502978

SEQ ID NO: 640799 - RNA, 64 nt, hsa; identical to SEQ ID NO: 502979

SEQ ID NO: 640800 - RNA, 64 nt, hsa; identical to SEQ ID NO: 315746

SEQ ID NO: 640801 - RNA, 64 nt, hsa; identical to SEQ ID NO: 315747

SEQ ID NO: 640802 - RNA, 64 nt, hsa; identical to SEQ ID NO: 315748

SEQ ID NO: 640803 - RNA, 64 nt, hsa; identical to SEQ ID NO: 315749

SEQ ID NO: 640804 - RNA, 64 nt, hsa; identical to SEQ ID NO: 114759

SEQ ID NO: 640805 - RNA, 64 nt, hsa; identical to SEQ ID NO: 114760

SEQ ID NO: 640806 - RNA, 64 nt, hsa; identical to SEQ ID NO: 114761

SEQ ID NO: 640807 - RNA, 64 nt, hsa; identical to SEQ ID NO: 114762

SEQ ID NO: 640808 - RNA, 64 nt, hsa; identical to SEQ ID NO: 114763

SEQ ID NO: 640809 - RNA, 64 nt, hsa; identical to SEQ ID NO: 114764

SEQ ID NO: 640810 - RNA, 64 nt, hsa; identical to SEQ ID NO: 114765

SEQ ID NO: 640811 - RNA, 64 nt, hsa; identical to SEQ ID NO: 114766

SEQ ID NO: 640812 - RNA, 64 nt, hsa; identical to SEQ ID NO: 114767

SEQ ID NO: 640813 - RNA, 64 nt, hsa; identical to SEQ ID NO: 114768

SEQ ID NO: 640814 - RNA, 64 nt, hsa; identical to SEQ ID NO: 114769

SEQ ID NO: 640815 - RNA, 64 nt, hsa; identical to SEQ ID NO: 114770

SEQ ID NO: 640816 - RNA, 64 nt, hsa; identical to SEQ ID NO: 114771

SEQ ID NO: 640817 - RNA, 64 nt, hsa; identical to SEQ ID NO: 114772

SEQ ID NO: 640818 - RNA, 64 nt, hsa; identical to SEQ ID NO: 114773

SEQ ID NO: 640819 - RNA, 64 nt, hsa; identical to SEQ ID NO: 114774

SEQ ID NO: 640820 - RNA, 64 nt, hsa; identical to SEQ ID NO: 114775

SEQ ID NO: 640821 - RNA, 64 nt, hsa; identical to SEQ ID NO: 114776

SEQ ID NO: 640822 - RNA, 64 nt, hsa; identical to SEQ ID NO: 114777

SEQ ID NO: 640823 - RNA, 64 nt, hsa; identical to SEQ ID NO: 114778

SEQ ID NO: 640824 - RNA, 64 nt, hsa; identical to SEQ ID NO: 114779

SEQ ID NO: 640825 - RNA, 64 nt, hsa; identical to SEQ ID NO: 114780

SEQ ID NO: 640826 - RNA, 64 nt, hsa; identical to SEQ ID NO: 114781

SEQ ID NO: 640827 - RNA, 64 nt, hsa; identical to SEQ ID NO: 114782

SEQ ID NO: 640828 - RNA, 64 nt, hsa; identical to SEQ ID NO: 114783

SEQ ID NO: 640829 - RNA, 64 nt, hsa; identical to SEQ ID NO: 114784

SEQ ID NO: 640830 - RNA, 64 nt, hsa; identical to SEQ ID NO: 114785

SEQ ID NO: 640831 - RNA, 64 nt, hsa; identical to SEQ ID NO: 114786

SEQ ID NO: 640832 - RNA, 64 nt, hsa; identical to SEQ ID NO: 114787

SEQ ID NO: 640833 - RNA, 64 nt, hsa; identical to SEQ ID NO: 114788

SEQ ID NO: 640834 - RNA, 64 nt, hsa; identical to SEQ ID NO: 114789

SEQ ID NO: 640835 - RNA, 64 nt, hsa; identical to SEQ ID NO: 114790

SEQ ID NO: 640836 - RNA, 64 nt, hsa; identical to SEQ ID NO: 114791

SEQ ID NO: 640837 - RNA, 64 nt, hsa; identical to SEQ ID NO: 114792

SEQ ID NO: 640838 - RNA, 64 nt, hsa; identical to SEQ ID NO: 114793

SEQ ID NO: 640839 - RNA, 64 nt, hsa; identical to SEQ ID NO: 114794

SEQ ID NO: 640840 - RNA, 64 nt, hsa; identical to SEQ ID NO: 114795

SEQ ID NO: 640841 - RNA, 64 nt, hsa; identical to SEQ ID NO: 114796

SEQ ID NO: 640842 - RNA, 64 nt, hsa; identical to SEQ ID NO: 114797

SEQ ID NO: 640843 - RNA, 64 nt, hsa; identical to SEQ ID NO: 114798

SEQ ID NO: 640844 - RNA, 64 nt, hsa; identical to SEQ ID NO: 114799

SEQ ID NO: 640845 - RNA, 64 nt, hsa; identical to SEQ ID NO: 114800

SEQ ID NO: 640846 - RNA, 64 nt, hsa; identical to SEQ ID NO: 114801

SEQ ID NO: 640847 - RNA, 64 nt, hsa; identical to SEQ ID NO: 114802

SEQ ID NO: 640848 - RNA, 64 nt, hsa; identical to SEQ ID NO: 114803

SEQ ID NO: 640849 - RNA, 64 nt, hsa; identical to SEQ ID NO: 114804

SEQ ID NO: 640850 - RNA, 64 nt, hsa; identical to SEQ ID NO: 114805

SEQ ID NO: 640851 - RNA, 64 nt, hsa; identical to SEQ ID NO: 114806

SEQ ID NO: 640852 - RNA, 64 nt, hsa; identical to SEQ ID NO: 114807

SEQ ID NO: 640853 - RNA, 64 nt, hsa; identical to SEQ ID NO: 415046

SEQ ID NO: 640854 - RNA, 64 nt, hsa; identical to SEQ ID NO: 415047

SEQ ID NO: 640855 - RNA, 64 nt, hsa
uugguucuagcuaguaauaacaauauaauucuuuggcagauauucagaauaacauuuuaaacua

SEQ ID NO: 640856 - RNA, 64 nt, hsa
acauuuaaauaucuuugauaauuguuauuuuuuuggcagauaauuccucuagaauguguaucuu

SEQ ID NO: 640857 - RNA, 64 nt, hsa
caauuugcauccaccuucccuucugacucagguuggcagauaaacuguccccagacccugccac

SEQ ID NO: 640858 - RNA, 64 nt, hsa
aagguuccuaugccuagccugugugccauuucauggcagauauguaagaaaggaaauggcccua

SEQ ID NO: 640859 - RNA, 64 nt, hsa
gccuugcacuggcucuucuaaaggacuuuuggagggcagauaauuucaucuguuaaauccaaca

SEQ ID NO: 640860 - RNA, 64 nt, hsa
uucacucuccuuagaauuggaacuaugcaguuaaggcagauaaaauguacagauguuucauaua

SEQ ID NO: 640861 - RNA, 64 nt, hsa; identical to SEQ ID NO: 283920

SEQ ID NO: 640862 - RNA, 64 nt, hsa; identical to SEQ ID NO: 283921

SEQ ID NO: 640863 - RNA, 64 nt, hsa; identical to SEQ ID NO: 283922

SEQ ID NO: 640864 - RNA, 64 nt, hsa; identical to SEQ ID NO: 283923

SEQ ID NO: 640865 - RNA, 64 nt, hsa; identical to SEQ ID NO: 283924

SEQ ID NO: 640866 - RNA, 64 nt, hsa; identical to SEQ ID NO: 283925

SEQ ID NO: 640867 - RNA, 64 nt, hsa; identical to SEQ ID NO: 283926

SEQ ID NO: 640868 - RNA, 64 nt, hsa; identical to SEQ ID NO: 283927

SEQ ID NO: 640869 - RNA, 64 nt, hsa; identical to SEQ ID NO: 283928

SEQ ID NO: 640870 - RNA, 64 nt, hsa; identical to SEQ ID NO: 283929

SEQ ID NO: 640871 - RNA, 64 nt, hsa; identical to SEQ ID NO: 283930

SEQ ID NO: 640872 - RNA, 64 nt, hsa; identical to SEQ ID NO: 283931

SEQ ID NO: 640873 - RNA, 64 nt, hsa; identical to SEQ ID NO: 283932

SEQ ID NO: 640874 - RNA, 64 nt, hsa; identical to SEQ ID NO: 283933

SEQ ID NO: 640875 - RNA, 64 nt, hsa; identical to SEQ ID NO: 283934

SEQ ID NO: 640876 - RNA, 64 nt, hsa; identical to SEQ ID NO: 283935

SEQ ID NO: 640877 - RNA, 64 nt, hsa; identical to SEQ ID NO: 283930

SEQ ID NO: 640878 - RNA, 64 nt, hsa; identical to SEQ ID NO: 283937

SEQ ID NO: 640879 - RNA, 64 nt, hsa; identical to SEQ ID NO: 283938

SEQ ID NO: 640880 - RNA, 64 nt, hsa; identical to SEQ ID NO: 283939

SEQ ID NO: 640881 - RNA, 64 nt, hsa; identical to SEQ ID NO: 283940

SEQ ID NO: 640882 - RNA, 64 nt, hsa; identical to SEQ ID NO: 283941

SEQ ID NO: 640883 - RNA, 64 nt, hsa; identical to SEQ ID NO: 283942

SEQ ID NO: 640884 - RNA, 64 nt, hsa; identical to SEQ ID NO: 283943

SEQ ID NO: 640885 - RNA, 64 nt, hsa; identical to SEQ ID NO: 283944

SEQ ID NO: 640886 - RNA, 60 nt, hsa; identical to SEQ ID NO: 283945

SEQ ID NO: 640887 - RNA, 64 nt, hsa; identical to SEQ ID NO: 283946

SEQ ID NO: 640888 - RNA, 64 nt, hsa; identical to SEQ ID NO: 283947

SEQ ID NO: 640889 - RNA, 64 nt, hsa; identical to SEQ ID NO: 283948

SEQ ID NO: 640890 - RNA, 64 nt, hsa; identical to SEQ ID NO: 283949

SEQ ID NO: 640891 - RNA, 64 nt, hsa; identical to SEQ ID NO: 283950

SEQ ID NO: 640892 - RNA, 64 nt, hsa; identical to SEQ ID NO: 283951

SEQ ID NO: 640893 - RNA, 64 nt, hsa; identical to SEQ ID NO: 283952

SEQ ID NO: 640894 - RNA, 64 nt, hsa; identical to SEQ ID NO: 283953

SEQ ID NO: 640895 - RNA, 64 nt, hsa; identical to SEQ ID NO: 283954

SEQ ID NO: 640896 - RNA, 64 nt, hsa; identical to SEQ ID NO: 283955

SEQ ID NO: 640897 - RNA, 64 nt, hsa; identical to SEQ ID NO: 283956

SEQ ID NO: 640898 - RNA, 64 nt, hsa; identical to SEQ ID NO: 283957

SEQ ID NO: 640899 - RNA, 64 nt, hsa; identical to SEQ ID NO: 283958

SEQ ID NO: 640900 - RNA, 64 nt, hsa; identical to SEQ ID NO: 283959

SEQ ID NO: 640901 - RNA, 64 nt, hsa; identical to SEQ ID NO: 283960

SEQ ID NO: 640902 - RNA, 64 nt, hsa; identical to SEQ ID NO: 283961

SEQ ID NO: 640903 - RNA, 64 nt, hsa; identical to SEQ ID NO: 283962

SEQ ID NO: 640904 - RNA, 64 nt, hsa; identical to SEQ ID NO: 283963

SEQ ID NO: 640905 - RNA, 64 nt, hsa; identical to SEQ ID NO: 283964

SEQ ID NO: 640906 - RNA, 64 nt, hsa; identical to SEQ ID NO: 283965

SEQ ID NO: 640907 - RNA, 64 nt, hsa; identical to SEQ ID NO: 283966

SEQ ID NO: 640908 - RNA, 64 nt, hsa; identical to SEQ ID NO: 283967

SEQ ID NO: 640909 - RNA, 64 nt, hsa; identical to SEQ ID NO: 283968

SEQ ID NO: 640910 - RNA, 64 nt, hsa; identical to SEQ ID NO: 283969

SEQ ID NO: 640911 - RNA, 64 nt, hsa; identical to SEQ ID NO: 283970

SEQ ID NO: 640912 - RNA, 64 nt, hsa; identical to SEQ ID NO: 283971

SEQ ID NO: 640913 - RNA, 64 nt, hsa; identical to SEQ ID NO: 283972

SEQ ID NO: 640914 - RNA, 64 nt, hsa; identical to SEQ ID NO: 283973

SEQ ID NO: 640915 - RNA, 64 nt, hsa; identical to SEQ ID NO: 283974

SEQ ID NO: 640916 - RNA, 64 nt, hsa; identical to SEQ ID NO: 283975

SEQ ID NO: 640917 - RNA, 64 nt, hsa; identical to SEQ ID NO: 283976

SEQ ID NO: 640918 - RNA, 64 nt, hsa; identical to SEQ ID NO: 283977

SEQ ID NO: 640919 - RNA, 64 nt, hsa; identical to SEQ ID NO: 283978

SEQ ID NO: 640920 - RNA, 64 nt, hsa; identical to SEQ ID NO: 283979

SEQ ID NO: 640921 - RNA, 64 nt, hsa; identical to SEQ ID NO: 283980

SEQ ID NO: 640922 - RNA, 64 nt, hsa; identical to SEQ ID NO: 283981

SEQ ID NO: 640923 - RNA, 64 nt, hsa; identical to SEQ ID NO: 283982

SEQ ID NO: 640924 - RNA, 64 nt, hsa; identical to SEQ ID NO: 283983

SEQ ID NO: 640925 - RNA, 64 nt, hsa; identical to SEQ ID NO: 283984

SEQ ID NO: 640926 - RNA, 64 nt, hsa; identical to SEQ ID NO: 311991

SEQ ID NO: 640927 - RNA, 64 nt, hsa; identical to SEQ ID NO: 311992

SEQ ID NO: 640928 - RNA, 64 nt, hsa; identical to SEQ ID NO: 311993

SEQ ID NO: 640929 - RNA, 64 nt, hsa; identical to SEQ ID NO: 311994

SEQ ID NO: 640930 - RNA, 64 nt, hsa; identical to SEQ ID NO: 311995

SEQ ID NO: 640931 - RNA, 64 nt, hsa; identical to SEQ ID NO: 311996

SEQ ID NO: 640932 - RNA, 64 nt, hsa; identical to SEQ ID NO: 132890

SEQ ID NO: 640933 - RNA, 64 nt, hsa; identical to SEQ ID NO: 132891

SEQ ID NO: 640934 - RNA, 64 nt, hsa; identical to SEQ ID NO: 132892

SEQ ID NO: 640935 - RNA, 64 nt, hsa; identical to SEQ ID NO: 132893

SEQ ID NO: 640936 - RNA, 61 nt, hsa; identical to SEQ ID NO: 132894

SEQ ID NO: 640937 - RNA, 64 nt, hsa; identical to SEQ ID NO: 132895

SEQ ID NO: 640938 - RNA, 52 nt, hsa; identical to SEQ ID NO: 132896

SEQ ID NO: 640939 - RNA, 64 nt, hsa; identical to SEQ ID NO: 132897

SEQ ID NO: 640940 - RNA, 64 nt, hsa; identical to SEQ ID NO: 132898

SEQ ID NO: 640941 - RNA, 64 nt, hsa; identical to SEQ ID NO: 132899

SEQ ID NO: 640942 - RNA, 64 nt, hsa; identical to SEQ ID NO: 132900

SEQ ID NO: 640943 - RNA, 64 nt, hsa; identical to SEQ ID NO: 132901

SEQ ID NO: 640944 - RNA, 64 nt, hsa; identical to SEQ ID NO: 132902

SEQ ID NO: 640945 - RNA, 64 nt, hsa; identical to SEQ ID NO: 132903

SEQ ID NO: 640946 - RNA, 64 nt, hsa; identical to SEQ ID NO: 132904

SEQ ID NO: 640947 - RNA, 64 nt, hsa; identical to SEQ ID NO: 132905

SEQ ID NO: 640948 - RNA, 64 nt, hsa; identical to SEQ ID NO: 132906

SEQ ID NO: 640949 - RNA, 64 nt, hsa; identical to SEQ ID NO: 132907

SEQ ID NO: 640950 - RNA, 64 nt, hsa; identical to SEQ ID NO: 132908

SEQ ID NO: 640951 - RNA, 64 nt, hsa; identical to SEQ ID NO: 132909

SEQ ID NO: 640952 - RNA, 64 nt, hsa; identical to SEQ ID NO: 132910

SEQ ID NO: 640953 - RNA, 64 nt, hsa; identical to SEQ ID NO: 132911

SEQ ID NO: 640954 - RNA, 64 nt, hsa; identical to SEQ ID NO: 132912

SEQ ID NO: 640955 - RNA, 64 nt, hsa; identical to SEQ ID NO: 132913

SEQ ID NO: 640956 - RNA, 64 nt, hsa; identical to SEQ ID NO: 132914

SEQ ID NO: 640957 - RNA, 63 nt, hsa; identical to SEQ ID NO: 132915

SEQ ID NO: 640958 - RNA, 64 nt, hsa; identical to SEQ ID NO: 132916

SEQ ID NO: 640959 - RNA, 64 nt, hsa; identical to SEQ ID NO: 132917

SEQ ID NO: 640960 - RNA, 64 nt, hsa; identical to SEQ ID NO: 132918

SEQ ID NO: 640961 - RNA, 64 nt, hsa; identical to SEQ ID NO: 132919

SEQ ID NO: 640962 - RNA, 64 nt, hsa; identical to SEQ ID NO: 132920

SEQ ID NO: 640963 - RNA, 64 nt, hsa; identical to SEQ ID NO: 132921

SEQ ID NO: 640964 - RNA, 53 nt, hsa; identical to SEQ ID NO: 132922

SEQ ID NO: 640965 - RNA, 64 nt, hsa; identical to SEQ ID NO: 132923

SEQ ID NO: 640966 - RNA, 64 nt, hsa; identical to SEQ ID NO: 119443

SEQ ID NO: 640967 - RNA, 64 nt, hsa; identical to SEQ ID NO: 119444

SEQ ID NO: 640968 - RNA, 64 nt, hsa; identical to SEQ ID NO: 119445

SEQ ID NO: 640969 - RNA, 64 nt, hsa; identical to SEQ ID NO: 119446

SEQ ID NO: 640970 - RNA, 64 nt, hsa; identical to SEQ ID NO: 119447

SEQ ID NO: 640971 - RNA, 64 nt, hsa; identical to SEQ ID NO: 119448

SEQ ID NO: 640972 - RNA, 64 nt, hsa; identical to SEQ ID NO: 119449

SEQ ID NO: 640973 - RNA, 64 nt, hsa; identical to SEQ ID NO: 119450

SEQ ID NO: 640974 - RNA, 64 nt, hsa; identical to SEQ ID NO: 119451

SEQ ID NO: 640975 - RNA, 64 nt, hsa; identical to SEQ ID NO: 119452

SEQ ID NO: 640976 - RNA, 64 nt, hsa; identical to SEQ ID NO: 119453

SEQ ID NO: 640977 - RNA, 64 nt, hsa; identical to SEQ ID NO: 119454

SEQ ID NO: 640978 - RNA, 64 nt, hsa; identical to SEQ ID NO: 119455

SEQ ID NO: 640979 - RNA, 64 nt, hsa; identical to SEQ ID NO: 119456

SEQ ID NO: 640980 - RNA, 64 nt, hsa; identical to SEQ ID NO: 119457

SEQ ID NO: 640981 - RNA, 64 nt, hsa; identical to SEQ ID NO: 119458

SEQ ID NO: 640982 - RNA, 64 nt, hsa; identical to SEQ ID NO: 119459

SEQ ID NO: 640983 - RNA, 64 nt, hsa; identical to SEQ ID NO: 119460

SEQ ID NO: 640984 - RNA, 51 nt, hsa; identical to SEQ ID NO: 119461

SEQ ID NO: 640985 - RNA, 64 nt, hsa; identical to SEQ ID NO: 119462

SEQ ID NO: 640986 - RNA, 64 nt, hsa; identical to SEQ ID NO: 119463

SEQ ID NO: 640987 - RNA, 64 nt, hsa; identical to SEQ ID NO: 119464

SEQ ID NO: 640988 - RNA, 64 nt, hsa; identical to SEQ ID NO: 119465

SEQ ID NO: 640989 - RNA, 64 nt, hsa; identical to SEQ ID NO: 119466

SEQ ID NO: 640990 - RNA, 64 nt, hsa; identical to SEQ ID NO: 119467

SEQ ID NO: 640991 - RNA, 64 nt, hsa; identical to SEQ ID NO: 119468

SEQ ID NO: 640992 - RNA, 64 nt, hsa; identical to SEQ ID NO: 119469

SEQ ID NO: 640993 - RNA, 64 nt, hsa; identical to SEQ ID NO: 119470

SEQ ID NO: 640994 - RNA, 64 nt, hsa; identical to SEQ ID NO: 119471

SEQ ID NO: 640995 - RNA, 64 nt, hsa; identical to SEQ ID NO: 119472

SEQ ID NO: 640996 - RNA, 64 nt, hsa; identical to SEQ ID NO: 119473

SEQ ID NO: 640997 - RNA, 64 nt, hsa; identical to SEQ ID NO: 119474

SEQ ID NO: 640998 - RNA, 64 nt, hsa; identical to SEQ ID NO: 119475

SEQ ID NO: 640999 - RNA, 64 nt, hsa; identical to SEQ ID NO: 119476

SEQ ID NO: 641000 - RNA, 64 nt, hsa; identical to SEQ ID NO: 119477

SEQ ID NO: 641001 - RNA, 64 nt, hsa; identical to SEQ ID NO: 119478

SEQ ID NO: 641002 - RNA, 64 nt, hsa; identical to SEQ ID NO: 119479

SEQ ID NO: 641003 - RNA, 64 nt, hsa; identical to SEQ ID NO: 119480

SEQ ID NO: 641004 - RNA, 64 nt, hsa; identical to SEQ ID NO: 119481

SEQ ID NO: 641005 - RNA, 64 nt, hsa; identical to SEQ ID NO: 171819

SEQ ID NO: 641006 - RNA, 64 nt, hsa; identical to SEQ ID NO: 171820

SEQ ID NO: 641007 - RNA, 64 nt, hsa; identical to SEQ ID NO: 171821

SEQ ID NO: 641008 - RNA, 64 nt, hsa; identical to SEQ ID NO: 171822

SEQ ID NO: 641009 - RNA, 64 nt, hsa; identical to SEQ ID NO: 171823

SEQ ID NO: 641010 - RNA, 64 nt, hsa; identical to SEQ ID NO: 171824

SEQ ID NO: 641011 - RNA, 64 nt, hsa; identical to SEQ ID NO: 171825

SEQ ID NO: 641012 - RNA, 64 nt, hsa; identical to SEQ ID NO: 171826

SEQ ID NO: 641013 - RNA, 64 nt, hsa; identical to SEQ ID NO: 171827

SEQ ID NO: 641014 - RNA, 64 nt, hsa; identical to SEQ ID NO: 171828

SEQ ID NO: 641015 - RNA, 64 nt, hsa; identical to SEQ ID NO: 171829

SEQ ID NO: 641016 - RNA, 64 nt, hsa
gaagcaggcgagagagaaacagcuacugcgugcgugcgcgcacgcauacacacacacacacaca

SEQ ID NO: 641017 - RNA, 64 nt, hsa
agucagguggcccguccuuggugagugcacacacugcgcgcacacaucgcggccuuccuggcuu

SEQ ID NO: 641018 - RNA, 64 nt, hsa
gccucucgguggcagucuugguugguuagcuauuugcgcgcaaauguugugauccugccauuau

SEQ ID NO: 641019 - RNA, 64 nt, hsa
cagaggggucacuagcaccuuguguguaugugugugcgcgcacguguguguagguggguaugug

SEQ ID NO: 641020 - RNA, 64 nt, hsa
accuuguggaccuaauuuugugugcgugugugugugcgcgcauauguauauagacaggcacauc

SEQ ID NO: 641021 - RNA, 64 nt, hsa
acacacacugccuggaugcauguaugcacacacaugcgcgcacacgugcucccugaaggcacac

SEQ ID NO: 641022 - RNA, 64 nt, hsa
gggcagcuccucggguggggccugcgggguucccugcgcgcagcuggcgcguguguggccuaau

SEQ ID NO: 641023 - RNA, 64 nt, hsa
uacuaaaaauacaaaaauuagccggacgugguggugcgcgcauguaaucccagcuacucgggag

SEQ ID NO: 641024 - RNA, 64 nt, hsa
aaccaugcugcccguaagagucacaaccugugugugcgcgcaagguuagcaacaaacguacccg

SEQ ID NO: 641025 - RNA, 64 nt, hsa
gcaucuauauguguauuauguaugcgugcaugcgugcgcgcacacacacacacacacacacaca

SEQ ID NO: 641026 - RNA, 64 nt, hsa
cuaagaguugauuguggaaaacacgugaaucuauugcgcgcauuugucauuuagcaagauggca

SEQ ID NO: 641027 - RNA, 64 nt, hsa
gagcacuuuccaaggcaucccccagccccaagccugcgcgcaucugucacucagggacuuucua

SEQ ID NO: 641028 - RNA, 64 nt, hsa
agaccccuuuuuucugauacaaugcacgauucucugcgcgcaaggacccucgacucacccccau

SEQ ID NO: 641029 - RNA, 64 nt, hsa
gcagcucugccuccgcagccucagugcgcuuuccugcgcgcacugcggagggcgcccuaagcgu

SEQ ID NO: 641030 - RNA, 62 nt, hsa
cagguggaacuguaguguagcgaccucacugcugcgcgcacagucucccgggacuuggacuc

SEQ ID NO: 641031 - RNA, 64 nt, hsa
aggagcaaaggcugagaacacugugaaaacauuuugcgcgcacaauaguaaccuggguaaaugc

SEQ ID NO: 641032 - RNA, 64 nt, hsa
gugcggagggagaggggcgggcaggaaccggggcugcgcgcagcgcuugcgggccagagugagu

SEQ ID NO: 641033 - RNA, 64 nt, hsa
caacaaaucagaaucacguuuuuaguugugcgugugcgcgcacacguguguaaaaagcacuuuc

SEQ ID NO: 641034 - RNA, 64 nt, hsa
agcgucucuccucccuccuggggaaggucgcccuugcgcgcaagguuuuagcuuucagcaacug

SEQ ID NO: 641035 - RNA, 64 nt, hsa
gaguuuccccagacaccgccacauggcuuccuccugcgcgcaugugcgcacacacacacacaca

SEQ ID NO: 641036 - RNA, 64 nt, hsa
ccgcucagccccggcggggaggagcgggugggugugcgcgcaaggaggccgcacaccguuccuu

SEQ ID NO: 641037 - RNA, 64 nt, hsa
gagcugcggcggcccagguacgaagcugcaacucugcgcgcagugggcgagaucucaucagccc

SEQ ID NO: 641038 - RNA, 64 nt, hsa
cccugcguggacguggccugugcuucgcccgcacugcgcgcauccccaaccucuguccgcaugc

SEQ ID NO: 641039 - RNA, 64 nt, hsa
ugugucugacaccugccagcagcccuuugcuaucugcgcgcaggaugggggugacugcccagac

SEQ ID NO: 641040 - RNA, 64 nt, hsa; identical to SEQ ID NO: 443174

SEQ ID NO: 641041 - RNA, 64 nt, hsa; identical to SEQ ID NO: 443175

SEQ ID NO: 641042 - RNA, 64 nt, hsa; identical to SEQ ID NO: 443176

SEQ ID NO: 641043 - RNA, 64 nt, hsa; identical to SEQ ID NO: 443177

SEQ ID NO: 641044 - RNA, 64 nt, hsa; identical to SEQ ID NO: 443178

SEQ ID NO: 641045 - RNA, 64 nt, hsa; identical to SEQ ID NO: 443179

SEQ ID NO: 641046 - RNA, 64 nt, hsa; identical to SEQ ID NO: 443180

SEQ ID NO: 641047 - RNA, 64 nt, hsa; identical to SEQ ID NO: 443181

SEQ ID NO: 641048 - RNA, 64 nt, hsa; identical to SEQ ID NO: 443182

SEQ ID NO: 641049 - RNA, 64 nt, hsa; identical to SEQ ID NO: 443183

SEQ ID NO: 641050 - RNA, 64 nt, hsa; identical to SEQ ID NO: 443184

SEQ ID NO: 641051 - RNA, 64 nt, hsa; identical to SEQ ID NO: 443185

SEQ ID NO: 641052 - RNA, 64 nt, hsa; identical to SEQ ID NO: 443186

SEQ ID NO: 641053 - RNA, 64 nt, hsa; identical to SEQ ID NO: 443187

SEQ ID NO: 641054 - RNA, 64 nt, hsa; identical to SEQ ID NO: 443188

SEQ ID NO: 641055 - RNA, 64 nt, hsa; identical to SEQ ID NO: 443189

SEQ ID NO: 641056 - RNA, 64 nt, hsa; identical to SEQ ID NO: 443190

SEQ ID NO: 641057 - RNA, 64 nt, hsa; identical to SEQ ID NO: 443191

SEQ ID NO: 641058 - RNA, 64 nt, hsa; identical to SEQ ID NO: 443192

SEQ ID NO: 641059 - RNA, 64 nt, hsa; identical to SEQ ID NO: 443193

SEQ ID NO: 641060 - RNA, 64 nt, hsa; identical to SEQ ID NO: 443194

SEQ ID NO: 641061 - RNA, 64 nt, hsa; identical to SEQ ID NO: 443195

SEQ ID NO: 641062 - RNA, 64 nt, hsa; identical to SEQ ID NO: 443196

SEQ ID NO: 641063 - RNA, 64 nt, hsa; identical to SEQ ID NO: 443197

SEQ ID NO: 641064 - RNA, 64 nt, hsa; identical to SEQ ID NO: 443198

SEQ ID NO: 641065 - RNA, 64 nt, hsa; identical to SEQ ID NO: 443199

SEQ ID NO: 641066 - RNA, 64 nt, hsa; identical to SEQ ID NO: 443200

SEQ ID NO: 641067 - RNA, 64 nt, hsa; identical to SEQ ID NO: 443201

SEQ ID NO: 641068 - RNA, 64 nt, hsa; identical to SEQ ID NO: 443202

SEQ ID NO: 641069 - RNA, 64 nt, hsa; identical to SEQ ID NO: 443203

SEQ ID NO: 641070 - RNA, 64 nt, hsa; identical to SEQ ID NO: 443204

SEQ ID NO: 641071 - RNA, 64 nt, hsa; identical to SEQ ID NO: 443205

SEQ ID NO: 641072 - RNA, 64 nt, hsa; identical to SEQ ID NO: 443206

SEQ ID NO: 641073 - RNA, 64 nt, hsa; identical to SEQ ID NO: 443207

SEQ ID NO: 641074 - RNA, 64 nt, hsa; identical to SEQ ID NO: 443208

SEQ ID NO: 641075 - RNA, 64 nt, hsa; identical to SEQ ID NO: 443209

SEQ ID NO: 641076 - RNA, 64 nt, hsa; identical to SEQ ID NO: 443210

SEQ ID NO: 641077 - RNA, 64 nt, hsa; identical to SEQ ID NO: 443211

SEQ ID NO: 641078 - RNA, 64 nt, hsa; identical to SEQ ID NO: 443212

SEQ ID NO: 641079 - RNA, 64 nt, hsa; identical to SEQ ID NO: 443213

SEQ ID NO: 641080 - RNA, 64 nt, hsa; identical to SEQ ID NO: 443214

SEQ ID NO: 641081 - RNA, 64 nt, hsa; identical to SEQ ID NO: 443215

SEQ ID NO: 641082 - RNA, 64 nt, hsa; identical to SEQ ID NO: 443216

SEQ ID NO: 641083 - RNA, 64 nt, hsa; identical to SEQ ID NO: 443217

SEQ ID NO: 641084 - RNA, 64 nt, hsa; identical to SEQ ID NO: 443218

SEQ ID NO: 641085 - RNA, 64 nt, hsa; identical to SEQ ID NO: 443219

SEQ ID NO: 641086 - RNA, 64 nt, hsa; identical to SEQ ID NO: 443220

SEQ ID NO: 641087 - RNA, 64 nt, hsa; identical to SEQ ID NO: 443221

SEQ ID NO: 641088 - RNA, 64 nt, hsa; identical to SEQ ID NO: 443222

SEQ ID NO: 641089 - RNA, 64 nt, hsa; identical to SEQ ID NO: 443223

SEQ ID NO: 641090 - RNA, 64 nt, hsa; identical to SEQ ID NO: 443224

SEQ ID NO: 641091 - RNA, 64 nt, hsa; identical to SEQ ID NO: 443225

SEQ ID NO: 641092 - RNA, 64 nt, hsa; identical to SEQ ID NO: 443226

SEQ ID NO: 641093 - RNA, 64 nt, hsa; identical to SEQ ID NO: 443227

SEQ ID NO: 641094 - RNA, 64 nt, hsa; identical to SEQ ID NO: 443228

SEQ ID NO: 641095 - RNA, 64 nt, hsa; identical to SEQ ID NO: 443229

SEQ ID NO: 641096 - RNA, 64 nt, hsa; identical to SEQ ID NO: 443230

SEQ ID NO: 641097 - RNA, 64 nt, hsa; identical to SEQ ID NO: 443231

SEQ ID NO: 641098 - RNA, 64 nt, hsa; identical to SEQ ID NO: 443232

SEQ ID NO: 641099 - RNA, 64 nt, hsa; identical to SEQ ID NO: 443233

SEQ ID NO: 641100 - RNA, 64 nt, hsa; identical to SEQ ID NO: 443234

SEQ ID NO: 641101 - RNA, 64 nt, hsa; identical to SEQ ID NO: 443235

SEQ ID NO: 641102 - RNA, 64 nt, hsa; identical to SEQ ID NO: 443236

SEQ ID NO: 641103 - RNA, 64 nt, hsa; identical to SEQ ID NO: 443237

SEQ ID NO: 641104 - RNA, 64 nt, hsa; identical to SEQ ID NO: 443238

SEQ ID NO: 641105 - RNA, 64 nt, hsa; identical to SEQ ID NO: 443239

SEQ ID NO: 641106 - RNA, 64 nt, hsa; identical to SEQ ID NO: 131663

SEQ ID NO: 641107 - RNA, 64 nt, hsa; identical to SEQ ID NO: 131664

SEQ ID NO: 641108 - RNA, 64 nt, hsa; identical to SEQ ID NO: 131665

SEQ ID NO: 641109 - RNA, 64 nt, hsa; identical to SEQ ID NO: 131666

SEQ ID NO: 641110 - RNA, 64 nt, hsa; identical to SEQ ID NO: 131667

SEQ ID NO: 641111 - RNA, 64 nt, hsa; identical to SEQ ID NO: 131668

SEQ ID NO: 641112 - RNA, 64 nt, hsa; identical to SEQ ID NO: 131669

SEQ ID NO: 641113 - RNA, 64 nt, hsa; identical to SEQ ID NO: 131670

SEQ ID NO: 641114 - RNA, 64 nt, hsa; identical to SEQ ID NO: 131671

SEQ ID NO: 641115 - RNA, 64 nt, hsa; identical to SEQ ID NO: 131672

SEQ ID NO: 641116 - RNA, 64 nt, hsa; identical to SEQ ID NO: 131673

SEQ ID NO: 641117 - RNA, 64 nt, hsa; identical to SEQ ID NO: 131674

SEQ ID NO: 641118 - RNA, 64 nt, hsa; identical to SEQ ID NO: 131675

SEQ ID NO: 641119 - RNA, 64 nt, hsa; identical to SEQ ID NO: 131676

SEQ ID NO: 641120 - RNA, 64 nt, hsa; identical to SEQ ID NO: 131677

SEQ ID NO: 641121 - RNA, 64 nt, hsa; identical to SEQ ID NO: 131678

SEQ ID NO: 641122 - RNA, 64 nt, hsa; identical to SEQ ID NO: 131679

SEQ ID NO: 641123 - RNA, 63 nt, hsa; identical to SEQ ID NO: 332886

SEQ ID NO: 641124 - RNA, 63 nt, hsa; identical to SEQ ID NO: 332887

SEQ ID NO: 641125 - RNA, 63 nt, hsa; identical to SEQ ID NO: 332888

SEQ ID NO: 641126 - RNA, 63 nt, hsa; identical to SEQ ID NO: 332889

SEQ ID NO: 641127 - RNA, 53 nt, hsa; identical to SEQ ID NO: 55194

SEQ ID NO: 641128 - RNA, 63 nt, hsa; identical to SEQ ID NO: 332891

SEQ ID NO: 641129 - RNA, 63 nt, hsa; identical to SEQ ID NO: 332892

SEQ ID NO: 641130 - RNA, 63 nt, hsa; identical to SEQ ID NO: 332893

SEQ ID NO: 641131 - RNA, 63 nt, hsa; identical to SEQ ID NO: 332894

SEQ ID NO: 641132 - RNA, 63 nt, hsa; identical to SEQ ID NO: 332895

SEQ ID NO: 641133 - RNA, 63 nt, hsa; identical to SEQ ID NO: 332896

SEQ ID NO: 641134 - RNA, 63 nt, hsa; identical to SEQ ID NO: 332897

SEQ ID NO: 641135 - RNA, 63 nt, hsa; identical to SEQ ID NO: 332898

SEQ ID NO: 641136 - RNA, 63 nt, hsa; identical to SEQ ID NO: 332899

SEQ ID NO: 641137 - RNA, 63 nt, hsa; identical to SEQ ID NO: 332900

SEQ ID NO: 641138 - RNA, 63 nt, hsa; identical to SEQ ID NO: 332901

SEQ ID NO: 641139 - RNA, 63 nt, hsa; identical to SEQ ID NO: 332902

SEQ ID NO: 641140 - RNA, 63 nt, hsa; identical to SEQ ID NO: 332903

SEQ ID NO: 641141 - RNA, 63 nt, hsa; identical to SEQ ID NO: 332904

SEQ ID NO: 641142 - RNA, 63 nt, hsa; identical to SEQ ID NO: 332905

SEQ ID NO: 641143 - RNA, 63 nt, hsa; identical to SEQ ID NO: 332906

SEQ ID NO: 641144 - RNA, 63 nt, hsa; identical to SEQ ID NO: 332907

SEQ ID NO: 641145 - RNA, 63 nt, hsa; identical to SEQ ID NO: 332908

SEQ ID NO: 641146 - RNA, 63 nt, hsa; identical to SEQ ID NO: 332909

SEQ ID NO: 641147 - RNA, 63 nt, hsa; identical to SEQ ID NO: 332910

SEQ ID NO: 641148 - RNA, 63 nt, hsa; identical to SEQ ID NO: 332911

SEQ ID NO: 641149 - RNA, 63 nt, hsa; identical to SEQ ID NO: 332912

SEQ ID NO: 641150 - RNA, 64 nt, hsa; identical to SEQ ID NO: 155105

SEQ ID NO: 641151 - RNA, 64 nt, hsa; identical to SEQ ID NO: 155106

SEQ ID NO: 641152 - RNA, 64 nt, hsa; identical to SEQ ID NO: 155107

SEQ ID NO: 641153 - RNA, 64 nt, hsa; identical to SEQ ID NO: 155108

SEQ ID NO: 641154 - RNA, 64 nt, hsa; identical to SEQ ID NO: 426252

SEQ ID NO: 641155 - RNA, 64 nt, hsa; identical to SEQ ID NO: 426253

SEQ ID NO: 641156 - RNA, 64 nt, hsa; identical to SEQ ID NO: 426254

SEQ ID NO: 641157 - RNA, 64 nt, hsa; identical to SEQ ID NO: 426255

SEQ ID NO: 641158 - RNA, 64 nt, hsa; identical to SEQ ID NO: 426256

SEQ ID NO: 641159 - RNA, 64 nt, hsa; identical to SEQ ID NO: 426257

SEQ ID NO: 641160 - RNA, 64 nt, hsa; identical to SEQ ID NO: 426258

SEQ ID NO: 641161 - RNA, 64 nt, hsa; identical to SEQ ID NO: 426259

SEQ ID NO: 641162 - RNA, 64 nt, hsa; identical to SEQ ID NO: 426260

SEQ ID NO: 641163 - RNA, 64 nt, hsa; identical to SEQ ID NO: 426261

SEQ ID NO: 641164 - RNA, 64 nt, hsa; identical to SEQ ID NO: 426262

SEQ ID NO: 641165 - RNA, 64 nt, hsa; identical to SEQ ID NO: 426263

SEQ ID NO: 641166 - RNA, 64 nt, hsa; identical to SEQ ID NO: 426264

SEQ ID NO: 641167 - RNA, 64 nt, hsa; identical to SEQ ID NO: 426265

SEQ ID NO: 641168 - RNA, 64 nt, hsa; identical to SEQ ID NO: 426266

SEQ ID NO: 641169 - RNA, 64 nt, hsa; identical to SEQ ID NO: 426267

SEQ ID NO: 641170 - RNA, 64 nt, hsa; identical to SEQ ID NO: 426268

SEQ ID NO: 641171 - RNA, 64 nt, hsa; identical to SEQ ID NO: 426269

SEQ ID NO: 641172 - RNA, 64 nt, hsa; identical to SEQ ID NO: 426270

SEQ ID NO: 641173 - RNA, 64 nt, hsa; identical to SEQ ID NO: 426271

SEQ ID NO: 641174 - RNA, 64 nt, hsa; identical to SEQ ID NO: 426272

SEQ ID NO: 641175 - RNA, 64 nt, hsa; identical to SEQ ID NO: 426273

SEQ ID NO: 641176 - RNA, 64 nt, hsa; identical to SEQ ID NO: 426274

SEQ ID NO: 641177 - RNA, 64 nt, hsa; identical to SEQ ID NO: 426275

SEQ ID NO: 641178 - RNA, 60 nt, hsa; identical to SEQ ID NO: 90161

SEQ ID NO: 641179 - RNA, 64 nt, hsa; identical to SEQ ID NO: 426277

SEQ ID NO: 641180 - RNA, 64 nt, hsa; identical to SEQ ID NO: 426278

SEQ ID NO: 641181 - RNA, 64 nt, hsa; identical to SEQ ID NO: 426279

SEQ ID NO: 641182 - RNA, 64 nt, hsa; identical to SEQ ID NO: 426280

SEQ ID NO: 641183 - RNA, 64 nt, hsa; identical to SEQ ID NO: 426281

SEQ ID NO: 641184 - RNA, 64 nt, hsa; identical to SEQ ID NO: 426282

SEQ ID NO: 641185 - RNA, 64 nt, hsa; identical to SEQ ID NO: 426283

SEQ ID NO: 641186 - RNA, 64 nt, hsa; identical to SEQ ID NO: 426284

SEQ ID NO: 641187 - RNA, 64 nt, hsa; identical to SEQ ID NO: 426285

SEQ ID NO: 641188 - RNA, 64 nt, hsa; identical to SEQ ID NO: 426286

SEQ ID NO: 641189 - RNA, 64 nt, hsa; identical to SEQ ID NO: 426287

SEQ ID NO: 641190 - RNA, 64 nt, hsa; identical to SEQ ID NO: 426288

SEQ ID NO: 641191 - RNA, 64 nt, hsa; identical to SEQ ID NO: 426289

SEQ ID NO: 641192 - RNA, 64 nt, hsa; identical to SEQ ID NO: 426290

SEQ ID NO: 641193 - RNA, 64 nt, hsa; identical to SEQ ID NO: 426291

SEQ ID NO: 641194 - RNA, 64 nt, hsa; identical to SEQ ID NO: 426292

SEQ ID NO: 641195 - RNA, 64 nt, hsa; identical to SEQ ID NO: 426293

SEQ ID NO: 641196 - RNA, 64 nt, hsa; identical to SEQ ID NO: 426294

SEQ ID NO: 641197 - RNA, 64 nt, hsa; identical to SEQ ID NO: 426295

SEQ ID NO: 641198 - RNA, 64 nt, hsa; identical to SEQ ID NO: 426296

SEQ ID NO: 641199 - RNA, 64 nt, hsa; identical to SEQ ID NO: 426297

SEQ ID NO: 641200 - RNA, 64 nt, hsa; identical to SEQ ID NO: 426298

SEQ ID NO: 641201 - RNA, 64 nt, hsa; identical to SEQ ID NO: 426299

SEQ ID NO: 641202 - RNA, 64 nt, hsa; identical to SEQ ID NO: 426300

SEQ ID NO: 641203 - RNA, 64 nt, hsa; identical to SEQ ID NO: 426301

SEQ ID NO: 641204 - RNA, 64 nt, hsa; identical to SEQ ID NO: 426302

SEQ ID NO: 641205 - RNA, 64 nt, hsa; identical to SEQ ID NO: 426303

SEQ ID NO: 641206 - RNA, 64 nt, hsa
gaguggggaacagggccagcaagacagaccaccagccagaaaucucugauaucaaccucauguc

SEQ ID NO: 641207 - RNA, 64 nt, hsa
ggggaagaaauaccccagacccaacaaaccuccagccagaaagccagcuauuuugcauuugaag

SEQ ID NO: 641208 - RNA, 64 nt, hsa
uugaggguuuccuguccauaucuggcuugcaugugccagaaagcagagaauagaaaauguaauc

SEQ ID NO: 641209 - RNA, 64 nt, hsa
uuaauaaagugccaacccuuuacucucucauacagccagaaauguuagaaauccaaaaucuugg

SEQ ID NO: 641210 - RNA, 64 nt, hsa
uauauugauaaaaagugacucucagauugguaaugccagaaaaaauuuuaagaggacucaccaa

SEQ ID NO: 641211 - RNA, 64 nt, hsa
ugcuucuaacaugaaggccuuuagaugccagucugccagaaaucuggaaacagaggaaccggug

SEQ ID NO: 641212 - RNA, 64 nt, hsa
uugaauccaaacaauguguuaaguaauauuuagggccagaaaaaucuuguacagaauaaugauu

SEQ ID NO: 641213 - RNA, 64 nt, hsa
uugaagcuggaaagugugcauuggacaucuggaagccagaaaagacaaagaaauauccagaaag

SEQ ID NO: 641214 - RNA, 64 nt, hsa
cgacagcagaaggauguugcuuuuuuaagggagggccagaaagaaaguuaguggauugcaaagu

SEQ ID NO: 641215 - RNA, 64 nt, hsa
gccugguggaaguuagaacagaccaacauuuugugccagaaauuuaagaguuccauagguggag

SEQ ID NO: 641216 - RNA, 64 nt, hsa
auagauccgagggcagcagugcuggguggagagagccagaaaacagaucuggaggcagcagugc

SEQ ID NO: 641217 - RNA, 64 nt, hsa
ggggcuaaauuaauuggaguggggcgaggagagagccagaaaacauagauccgagggcagcagu

SEQ ID NO: 641218 - RNA, 64 nt, hsa
acaaacccuaucaagagcugcugcuucccuuccagccagaaaagugguaagcggagcaagugcc

SEQ ID NO: 641219 - RNA, 64 nt, hsa
aaugcauaccaugcuuucagaacaaaagcucugggccagaaaggcaauuuggcuaaaaaaugaa

SEQ ID NO: 641220 - RNA, 64 nt, hsa
gcauaaauguuauauuuauauacaguuacagcaggccagaaacauacauacacugcauccugua

SEQ ID NO: 641221 - RNA, 64 nt, hsa
gugcugggauuacaggcgugagccaccgugcccggccagaaaauacauucuuuacagcaaaugu

SEQ ID NO: 641222 - RNA, 64 nt, hsa
auugagccauuaucuccucuuggaaacgaaucuugccagaaaaacgggauuucagggccuuccc

SEQ ID NO: 641223 - RNA, 64 nt, hsa
gcugcuuuugaaccugagguuccugcgucguugagccagaaaucagaccaccgaagcucacucc

SEQ ID NO: 641224 - RNA, 64 nt, hsa
ggaaaguagcuuacccuagaaaacagcugcaaaugccagaaagaugaucccuaaaaauguugag

SEQ ID NO: 641225 - RNA, 64 nt, hsa
cuaagaauuuauaugaaagauuuguaucauuagagccagaaauaauuuuauauuaauauauaau

SEQ ID NO: 641226 - RNA, 64 nt, hsa
acaccaaauuaaaauuuucaugucaaacuucaaagccagaaagcugcuaaauacgugucuggca

SEQ ID NO: 641227 - RNA, 64 nt, hsa
uuauccucccuguuauacuuuggagcacagcacagccagaaaggggcugcauuugugcccaggu

SEQ ID NO: 641228 - RNA, 64 nt, hsa; identical to SEQ ID NO: 475135

SEQ ID NO: 641229 - RNA, 64 nt, hsa; identical to SEQ ID NO: 475136

SEQ ID NO: 641230 - RNA, 64 nt, hsa; identical to SEQ ID NO: 475137

SEQ ID NO: 641231 - RNA, 64 nt, hsa; identical to SEQ ID NO: 475138

SEQ ID NO: 641232 - RNA, 64 nt, hsa; identical to SEQ ID NO: 475139

SEQ ID NO: 641233 - RNA, 64 nt, hsa; identical to SEQ ID NO: 475140

SEQ ID NO: 641234 - RNA, 64 nt, hsa
uuauuuuucuuauucaugucuguaucucaagggucuagcacaaugcuugaugcauauuguguga

SEQ ID NO: 641235 - RNA, 64 nt, hsa
ggguauuaggauaauuaaaaauaauguaaugugccuagcacacuaccugaaaacgauggcauuu

SEQ ID NO: 641236 - RNA, 64 nt, hsa
cuuguggccgaauaaaaaauaacaccucuuaagucuagcacacugcagugaggccaggcaccuc

SEQ ID NO: 641237 - RNA, 64 nt, hsa
cagaucucuauuucauuuuguggcuuaccauucccuagcacacuggccuugccaucuuguggcc

SEQ ID NO: 641238 - RNA, 64 nt, hsa; identical to SEQ ID NO: 361949

SEQ ID NO: 641239 - RNA, 64 nt, hsa; identical to SEQ ID NO: 361950

SEQ ID NO: 641240 - RNA, 64 nt, hsa; identical to SEQ ID NO: 361951

SEQ ID NO: 641241 - RNA, 64 nt, hsa; identical to SEQ ID NO: 361952

SEQ ID NO: 641242 - RNA, 64 nt, hsa; identical to SEQ ID NO: 361953

SEQ ID NO: 641243 - RNA, 64 nt, hsa; identical to SEQ ID NO: 361954

SEQ ID NO: 641244 - RNA, 64 nt, hsa; identical to SEQ ID NO: 361955

SEQ ID NO: 641245 - RNA, 64 nt, hsa; identical to SEQ ID NO: 361956

SEQ ID NO: 641246 - RNA, 64 nt, hsa; identical to SEQ ID NO: 361957

SEQ ID NO: 641247 - RNA, 64 nt, hsa; identical to SEQ ID NO: 361958

SEQ ID NO: 641248 - RNA, 64 nt, hsa; identical to SEQ ID NO: 361959

SEQ ID NO: 641249 - RNA, 64 nt, hsa; identical to SEQ ID NO: 361960

SEQ ID NO: 641250 - RNA, 64 nt, hsa; identical to SEQ ID NO: 361961

SEQ ID NO: 641251 - RNA, 64 nt, hsa; identical to SEQ ID NO: 361962

SEQ ID NO: 641252 - RNA, 64 nt, hsa; identical to SEQ ID NO: 361963

SEQ ID NO: 641253 - RNA, 64 nt, hsa; identical to SEQ ID NO: 361964

SEQ ID NO: 641254 - RNA, 64 nt, hsa; identical to SEQ ID NO: 361965

SEQ ID NO: 641255 - RNA, 64 nt, hsa; identical to SEQ ID NO: 361966

SEQ ID NO: 641256 - RNA, 64 nt, hsa; identical to SEQ ID NO: 361967

SEQ ID NO: 641257 - RNA, 64 nt, hsa; identical to SEQ ID NO: 361968

SEQ ID NO: 641258 - RNA, 64 nt, hsa; identical to SEQ ID NO: 361969

SEQ ID NO: 641259 - RNA, 64 nt, hsa; identical to SEQ ID NO: 361970

SEQ ID NO: 641260 - RNA, 64 nt, hsa; identical to SEQ ID NO: 361971

SEQ ID NO: 641261 - RNA, 64 nt, hsa
ccauauuaguuauucugaauauacuaaaaaaauccagcuagauugcaguuuaauaauuaaacug

SEQ ID NO: 641262 - RNA, 64 nt, hsa
acaacuuacugcagggccaaaaaagggacugucccagcuagaacugugagaguauacauaggca

SEQ ID NO: 641263 - RNA, 64 nt, hsa
aagaaugggccacacacagcuagaaguccucucccagcuagaaguccuguccccacucuccugg

SEQ ID NO: 641264 - RNA, 64 nt, hsa
cccuuucagccauucuucaagaaugggccacacacagcuagaaguccucucccagcuagaaguc

SEQ ID NO: 641265 - RNA, 64 nt, hsa
aguggaccaggaagcaagaggggaagcgggaucccagcuagacuuagaacuuggacuuuucccc

SEQ ID NO: 641266 - RNA, 64 nt, hsa
cagcuacaguagggccuccucaccccguaccccacagcuagacagugucagcacucaucuccuc

SEQ ID NO: 641267 - RNA, 64 nt, hsa; identical to SEQ ID NO: 94908

SEQ ID NO: 641268 - RNA, 64 nt, hsa; identical to SEQ ID NO: 94909

SEQ ID NO: 641269 - RNA, 64 nt, hsa; identical to SEQ ID NO: 94910

SEQ ID NO: 641270 - RNA, 64 nt, hsa; identical to SEQ ID NO: 94911

SEQ ID NO: 641271 - RNA, 64 nt, hsa; identical to SEQ ID NO: 94912

SEQ ID NO: 641272 - RNA, 64 nt, hsa; identical to SEQ ID NO: 94913

SEQ ID NO: 641273 - RNA, 64 nt, hsa; identical to SEQ ID NO: 94914

SEQ ID NO: 641274 - RNA, 64 nt, hsa; identical to SEQ ID NO: 94915

SEQ ID NO: 641275 - RNA, 64 nt, hsa; identical to SEQ ID NO: 94916

SEQ ID NO: 641276 - RNA, 64 nt, hsa; identical to SEQ ID NO: 94917

SEQ ID NO: 641277 - RNA, 64 nt, hsa; identical to SEQ ID NO: 94918

SEQ ID NO: 641278 - RNA, 64 nt, hsa; identical to SEQ ID NO: 94919

SEQ ID NO: 641279 - RNA, 64 nt, hsa; identical to SEQ ID NO: 94920

SEQ ID NO: 641280 - RNA, 64 nt, hsa; identical to SEQ ID NO: 94921

SEQ ID NO: 641281 - RNA, 64 nt, hsa; identical to SEQ ID NO: 94922

SEQ ID NO: 641282 - RNA, 64 nt, hsa; identical to SEQ ID NO: 94923

SEQ ID NO: 641283 - RNA, 64 nt, hsa; identical to SEQ ID NO: 94924

SEQ ID NO: 641284 - RNA, 64 nt, hsa; identical to SEQ ID NO: 94925

SEQ ID NO: 641285 - RNA, 64 nt, hsa; identical to SEQ ID NO: 94926

SEQ ID NO: 641286 - RNA, 64 nt, hsa; identical to SEQ ID NO: 94927

SEQ ID NO: 641287 - RNA, 64 nt, hsa; identical to SEQ ID NO: 94928

SEQ ID NO: 641288 - RNA, 64 nt, hsa; identical to SEQ ID NO: 94929

SEQ ID NO: 641289 - RNA, 64 nt, hsa; identical to SEQ ID NO: 94930

SEQ ID NO: 641290 - RNA, 64 nt, hsa; identical to SEQ ID NO: 94931

SEQ ID NO: 641291 - RNA, 64 nt, hsa; identical to SEQ ID NO: 416970

SEQ ID NO: 641292 - RNA, 64 nt, hsa; identical to SEQ ID NO: 416971

SEQ ID NO: 641293 - RNA, 64 nt, hsa; identical to SEQ ID NO: 416972

SEQ ID NO: 641294 - RNA, 64 nt, hsa; identical to SEQ ID NO: 416973

SEQ ID NO: 641295 - RNA, 64 nt, hsa; identical to SEQ ID NO: 416974

SEQ ID NO: 641296 - RNA, 64 nt, hsa; identical to SEQ ID NO: 416975

SEQ ID NO: 641297 - RNA, 64 nt, hsa; identical to SEQ ID NO: 416976

SEQ ID NO: 641298 - RNA, 64 nt, hsa; identical to SEQ ID NO: 416977

SEQ ID NO: 641299 - RNA, 64 nt, hsa; identical to SEQ ID NO: 416978

SEQ ID NO: 641300 - RNA, 64 nt, hsa; identical to SEQ ID NO: 416979

SEQ ID NO: 641301 - RNA, 64 nt, hsa; identical to SEQ ID NO: 416980

SEQ ID NO: 641302 - RNA, 64 nt, hsa; identical to SEQ ID NO: 416981

SEQ ID NO: 641303 - RNA, 64 nt, hsa; identical to SEQ ID NO: 416982

SEQ ID NO: 641304 - RNA, 64 nt, hsa; identical to SEQ ID NO: 416983

SEQ ID NO: 641305 - RNA, 51 nt, hsa; identical to SEQ ID NO: 416984

SEQ ID NO: 641306 - RNA, 64 nt, hsa; identical to SEQ ID NO: 416985

SEQ ID NO: 641307 - RNA, 64 nt, hsa; identical to SEQ ID NO: 416986

SEQ ID NO: 641308 - RNA, 64 nt, hsa; identical to SEQ ID NO: 416987

SEQ ID NO: 641309 - RNA, 64 nt, hsa; identical to SEQ ID NO: 416988

SEQ ID NO: 641310 - RNA, 60 nt, hsa; identical to SEQ ID NO: 416989

SEQ ID NO: 641311 - RNA, 64 nt, hsa; identical to SEQ ID NO: 416990

SEQ ID NO: 641312 - RNA, 64 nt, hsa; identical to SEQ ID NO: 416991

SEQ ID NO: 641313 - RNA, 64 nt, hsa; identical to SEQ ID NO: 416992

SEQ ID NO: 641314 - RNA, 64 nt, hsa; identical to SEQ ID NO: 416993

SEQ ID NO: 641315 - RNA, 64 nt, hsa; identical to SEQ ID NO: 416994

SEQ ID NO: 641316 - RNA, 64 nt, hsa; identical to SEQ ID NO: 416995

SEQ ID NO: 641317 - RNA, 64 nt, hsa; identical to SEQ ID NO: 416996

SEQ ID NO: 641318 - RNA, 64 nt, hsa; identical to SEQ ID NO: 416997

SEQ ID NO: 641319 - RNA, 64 nt, hsa; identical to SEQ ID NO: 416998

SEQ ID NO: 641320 - RNA, 64 nt, hsa; identical to SEQ ID NO: 416999

SEQ ID NO: 641321 - RNA, 64 nt, hsa; identical to SEQ ID NO: 417000

SEQ ID NO: 641322 - RNA, 64 nt, hsa; identical to SEQ ID NO: 417001

SEQ ID NO: 641323 - RNA, 64 nt, hsa; identical to SEQ ID NO: 417002

SEQ ID NO: 641324 - RNA, 64 nt, hsa; identical to SEQ ID NO: 417003

SEQ ID NO: 641325 - RNA, 64 nt, hsa; identical to SEQ ID NO: 417004

SEQ ID NO: 641326 - RNA, 64 nt, hsa; identical to SEQ ID NO: 417005

SEQ ID NO: 641327 - RNA, 64 nt, hsa; identical to SEQ ID NO: 417006

SEQ ID NO: 641328 - RNA, 64 nt, hsa; identical to SEQ ID NO: 417007

SEQ ID NO: 641329 - RNA, 64 nt, hsa; identical to SEQ ID NO: 417008

SEQ ID NO: 641330 - RNA, 64 nt, hsa; identical to SEQ ID NO: 417009

SEQ ID NO: 641331 - RNA, 64 nt, hsa; identical to SEQ ID NO: 417010

SEQ ID NO: 641332 - RNA, 64 nt, hsa; identical to SEQ ID NO: 417011

SEQ ID NO: 641333 - RNA, 64 nt, hsa; identical to SEQ ID NO: 417012

SEQ ID NO: 641334 - RNA, 64 nt, hsa; identical to SEQ ID NO: 417013

SEQ ID NO: 641335 - RNA, 64 nt, hsa; identical to SEQ ID NO: 417014

SEQ ID NO: 641336 - RNA, 64 nt, hsa; identical to SEQ ID NO: 417015

SEQ ID NO: 641337 - RNA, 64 nt, hsa; identical to SEQ ID NO: 417016

SEQ ID NO: 641338 - RNA, 64 nt, hsa; identical to SEQ ID NO: 417017

SEQ ID NO: 641339 - RNA, 64 nt, hsa; identical to SEQ ID NO: 417018

SEQ ID NO: 641340 - RNA, 64 nt, hsa; identical to SEQ ID NO: 417019

SEQ ID NO: 641341 - RNA, 64 nt, hsa; identical to SEQ ID NO: 417020

SEQ ID NO: 641342 - RNA, 64 nt, hsa; identical to SEQ ID NO: 417021

SEQ ID NO: 641343 - RNA, 64 nt, hsa; identical to SEQ ID NO: 417022

SEQ ID NO: 641344 - RNA, 64 nt, hsa; identical to SEQ ID NO: 417023

SEQ ID NO: 641345 - RNA, 64 nt, hsa; identical to SEQ ID NO: 417024

SEQ ID NO: 641346 - RNA, 64 nt, hsa; identical to SEQ ID NO: 417025

SEQ ID NO: 641347 - RNA, 64 nt, hsa; identical to SEQ ID NO: 417026

SEQ ID NO: 641348 - RNA, 64 nt, hsa; identical to SEQ ID NO: 417027

SEQ ID NO: 641349 - RNA, 64 nt, hsa; identical to SEQ ID NO: 417028

SEQ ID NO: 641350 - RNA, 64 nt, hsa; identical to SEQ ID NO: 417029

SEQ ID NO: 641351 - RNA, 64 nt, hsa; identical to SEQ ID NO: 417030

SEQ ID NO: 641352 - RNA, 64 nt, hsa; identical to SEQ ID NO: 417031

SEQ ID NO: 641353 - RNA, 64 nt, hsa; identical to SEQ ID NO: 417032

SEQ ID NO: 641354 - RNA, 64 nt, hsa; identical to SEQ ID NO: 71989

SEQ ID NO: 641355 - RNA, 64 nt, hsa; identical to SEQ ID NO: 71990

SEQ ID NO: 641356 - RNA, 64 nt, hsa; identical to SEQ ID NO: 71991

SEQ ID NO: 641357 - RNA, 64 nt, hsa; identical to SEQ ID NO: 71992

SEQ ID NO: 641358 - RNA, 64 nt, hsa; identical to SEQ ID NO: 71993

SEQ ID NO: 641359 - RNA, 64 nt, hsa; identical to SEQ ID NO: 71994

SEQ ID NO: 641360 - RNA, 64 nt, hsa; identical to SEQ ID NO: 71995

SEQ ID NO: 641361 - RNA, 64 nt, hsa; identical to SEQ ID NO: 71996

SEQ ID NO: 641362 - RNA, 64 nt, hsa; identical to SEQ ID NO: 71997

SEQ ID NO: 641363 - RNA, 64 nt, hsa; identical to SEQ ID NO: 71998

SEQ ID NO: 641364 - RNA, 64 nt, hsa; identical to SEQ ID NO: 71999

SEQ ID NO: 641365 - RNA, 64 nt, hsa; identical to SEQ ID NO: 72000

SEQ ID NO: 641366 - RNA, 64 nt, hsa; identical to SEQ ID NO: 72001

SEQ ID NO: 641367 - RNA, 64 nt, hsa; identical to SEQ ID NO: 72002

SEQ ID NO: 641368 - RNA, 64 nt, hsa; identical to SEQ ID NO: 72003

SEQ ID NO: 641369 - RNA, 64 nt, hsa; identical to SEQ ID NO: 72004

SEQ ID NO: 641370 - RNA, 64 nt, hsa; identical to SEQ ID NO: 72005

SEQ ID NO: 641371 - RNA, 64 nt, hsa; identical to SEQ ID NO: 72006

SEQ ID NO: 641372 - RNA, 64 nt, hsa; identical to SEQ ID NO: 72007

SEQ ID NO: 641373 - RNA, 64 nt, hsa; identical to SEQ ID NO: 72008

SEQ ID NO: 641374 - RNA, 64 nt, hsa; identical to SEQ ID NO: 72009

SEQ ID NO: 641375 - RNA, 64 nt, hsa; identical to SEQ ID NO: 72010

SEQ ID NO: 641376 - RNA, 64 nt, hsa; identical to SEQ ID NO: 72011

SEQ ID NO: 641377 - RNA, 64 nt, hsa; identical to SEQ ID NO: 72012

SEQ ID NO: 641378 - RNA, 64 nt, hsa; identical to SEQ ID NO: 72013

SEQ ID NO: 641379 - RNA, 64 nt, hsa; identical to SEQ ID NO: 72014

SEQ ID NO: 641380 - RNA, 64 nt, hsa; identical to SEQ ID NO: 72015

SEQ ID NO: 641381 - RNA, 64 nt, hsa; identical to SEQ ID NO: 72016

SEQ ID NO: 641382 - RNA, 64 nt, hsa; identical to SEQ ID NO: 72017

SEQ ID NO: 641383 - RNA, 64 nt, hsa; identical to SEQ ID NO: 72018

SEQ ID NO: 641384 - RNA, 64 nt, hsa; identical to SEQ ID NO: 72019

SEQ ID NO: 641385 - RNA, 64 nt, hsa; identical to SEQ ID NO: 72020

SEQ ID NO: 641386 - RNA, 64 nt, hsa; identical to SEQ ID NO: 72021

SEQ ID NO: 641387 - RNA, 64 nt, hsa; identical to SEQ ID NO: 72022

SEQ ID NO: 641388 - RNA, 64 nt, hsa; identical to SEQ ID NO: 72023

SEQ ID NO: 641389 - RNA, 64 nt, hsa; identical to SEQ ID NO: 219832

SEQ ID NO: 641390 - RNA, 64 nt, hsa; identical to SEQ ID NO: 219833

SEQ ID NO: 641391 - RNA, 64 nt, hsa; identical to SEQ ID NO: 219834

SEQ ID NO: 641392 - RNA, 64 nt, hsa; identical to SEQ ID NO: 219835

SEQ ID NO: 641393 - RNA, 64 nt, hsa; identical to SEQ ID NO: 219836

SEQ ID NO: 641394 - RNA, 64 nt, hsa; identical to SEQ ID NO: 219837

SEQ ID NO: 641395 - RNA, 64 nt, hsa; identical to SEQ ID NO: 219838

SEQ ID NO: 641396 - RNA, 64 nt, hsa; identical to SEQ ID NO: 219839

SEQ ID NO: 641397 - RNA, 64 nt, hsa; identical to SEQ ID NO: 76961

SEQ ID NO: 641398 - RNA, 64 nt, hsa; identical to SEQ ID NO: 76962

SEQ ID NO: 641399 - RNA, 64 nt, hsa; identical to SEQ ID NO: 76963

SEQ ID NO: 641400 - RNA, 64 nt, hsa; identical to SEQ ID NO: 76964

SEQ ID NO: 641401 - RNA, 64 nt, hsa; identical to SEQ ID NO: 76965

SEQ ID NO: 641402 - RNA, 64 nt, hsa; identical to SEQ ID NO: 76966

SEQ ID NO: 641403 - RNA, 64 nt, hsa; identical to SEQ ID NO: 76967

SEQ ID NO: 641404 - RNA, 64 nt, hsa; identical to SEQ ID NO: 76968

SEQ ID NO: 641405 - RNA, 64 nt, hsa; identical to SEQ ID NO: 76969

SEQ ID NO: 641406 - RNA, 64 nt, hsa; identical to SEQ ID NO: 76970

SEQ ID NO: 641407 - RNA, 64 nt, hsa; identical to SEQ ID NO: 76971

SEQ ID NO: 641408 - RNA, 64 nt, hsa; identical to SEQ ID NO: 76972

SEQ ID NO: 641409 - RNA, 64 nt, hsa; identical to SEQ ID NO: 76973

SEQ ID NO: 641410 - RNA, 64 nt, hsa; identical to SEQ ID NO: 76974

SEQ ID NO: 641411 - RNA, 64 nt, hsa; identical to SEQ ID NO: 76975

SEQ ID NO: 641412 - RNA, 64 nt, hsa; identical to SEQ ID NO: 76976

SEQ ID NO: 641413 - RNA, 64 nt, hsa; identical to SEQ ID NO: 76977

SEQ ID NO: 641414 - RNA, 64 nt, hsa; identical to SEQ ID NO: 76978

SEQ ID NO: 641415 - RNA, 64 nt, hsa; identical to SEQ ID NO: 76979

SEQ ID NO: 641416 - RNA, 64 nt, hsa; identical to SEQ ID NO: 76980

SEQ ID NO: 641417 - RNA, 64 nt, hsa; identical to SEQ ID NO: 76981

SEQ ID NO: 641418 - RNA, 64 nt, hsa; identical to SEQ ID NO: 76982

SEQ ID NO: 641419 - RNA, 64 nt, hsa; identical to SEQ ID NO: 76983

SEQ ID NO: 641420 - RNA, 64 nt, hsa; identical to SEQ ID NO: 76984

SEQ ID NO: 641421 - RNA, 64 nt, hsa; identical to SEQ ID NO: 76985

SEQ ID NO: 641422 - RNA, 64 nt, hsa; identical to SEQ ID NO: 76986

SEQ ID NO: 641423 - RNA, 64 nt, hsa; identical to SEQ ID NO: 76987

SEQ ID NO: 641424 - RNA, 64 nt, hsa; identical to SEQ ID NO: 76988

SEQ ID NO: 641425 - RNA, 64 nt, hsa; identical to SEQ ID NO: 76989

SEQ ID NO: 641426 - RNA, 64 nt, hsa; identical to SEQ ID NO: 76990

SEQ ID NO: 641427 - RNA, 64 nt, hsa; identical to SEQ ID NO: 76991

SEQ ID NO: 641428 - RNA, 64 nt, hsa; identical to SEQ ID NO: 76992

SEQ ID NO: 641429 - RNA, 64 nt, hsa; identical to SEQ ID NO: 76993

SEQ ID NO: 641430 - RNA, 64 nt, hsa; identical to SEQ ID NO: 76994

SEQ ID NO: 641431 - RNA, 64 nt, hsa; identical to SEQ ID NO: 76995

SEQ ID NO: 641432 - RNA, 64 nt, hsa; identical to SEQ ID NO: 76996

SEQ ID NO: 641433 - RNA, 64 nt, hsa; identical to SEQ ID NO: 76997

SEQ ID NO: 641434 - RNA, 64 nt, hsa; identical to SEQ ID NO: 76998

SEQ ID NO: 641435 - RNA, 64 nt, hsa; identical to SEQ ID NO: 76999

SEQ ID NO: 641436 - RNA, 64 nt, hsa; identical to SEQ ID NO: 77000

SEQ ID NO: 641437 - RNA, 64 nt, hsa; identical to SEQ ID NO: 77001

SEQ ID NO: 641438 - RNA, 64 nt, hsa; identical to SEQ ID NO: 77002

SEQ ID NO: 641439 - RNA, 64 nt, hsa; identical to SEQ ID NO: 77003

SEQ ID NO: 641440 - RNA, 64 nt, hsa; identical to SEQ ID NO: 77004

SEQ ID NO: 641441 - RNA, 64 nt, hsa; identical to SEQ ID NO: 77005

SEQ ID NO: 641442 - RNA, 64 nt, hsa; identical to SEQ ID NO: 77006

SEQ ID NO: 641443 - RNA, 64 nt, hsa; identical to SEQ ID NO: 77007

SEQ ID NO: 641444 - RNA, 64 nt, hsa; identical to SEQ ID NO: 77008

SEQ ID NO: 641445 - RNA, 64 nt, hsa; identical to SEQ ID NO: 77009

SEQ ID NO: 641446 - RNA, 64 nt, hsa; identical to SEQ ID NO: 77010

SEQ ID NO: 641447 - RNA, 64 nt, hsa; identical to SEQ ID NO: 77011

SEQ ID NO: 641448 - RNA, 64 nt, hsa; identical to SEQ ID NO: 77012

SEQ ID NO: 641449 - RNA, 64 nt, hsa; identical to SEQ ID NO: 77013

SEQ ID NO: 641450 - RNA, 64 nt, hsa; identical to SEQ ID NO: 77014

SEQ ID NO: 641451 - RNA, 64 nt, hsa; identical to SEQ ID NO: 77015

SEQ ID NO: 641452 - RNA, 64 nt, hsa; identical to SEQ ID NO: 74916

SEQ ID NO: 641453 - RNA, 64 nt, hsa; identical to SEQ ID NO: 74917

SEQ ID NO: 641454 - RNA, 64 nt, hsa; identical to SEQ ID NO: 74918

SEQ ID NO: 641455 - RNA, 64 nt, hsa; identical to SEQ ID NO: 74919

SEQ ID NO: 641456 - RNA, 64 nt, hsa; identical to SEQ ID NO: 74920

SEQ ID NO: 641457 - RNA, 64 nt, hsa; identical to SEQ ID NO: 74921

SEQ ID NO: 641458 - RNA, 64 nt, hsa; identical to SEQ ID NO: 74922

SEQ ID NO: 641459 - RNA, 64 nt, hsa; identical to SEQ ID NO: 74923

SEQ ID NO: 641460 - RNA, 64 nt, hsa; identical to SEQ ID NO: 74924

SEQ ID NO: 641461 - RNA, 64 nt, hsa; identical to SEQ ID NO: 74925

SEQ ID NO: 641462 - RNA, 64 nt, hsa; identical to SEQ ID NO: 74926

SEQ ID NO: 641463 - RNA, 64 nt, hsa; identical to SEQ ID NO: 74927

SEQ ID NO: 641464 - RNA, 64 nt, hsa; identical to SEQ ID NO: 74928

SEQ ID NO: 641465 - RNA, 64 nt, hsa; identical to SEQ ID NO: 74929

SEQ ID NO: 641466 - RNA, 64 nt, hsa; identical to SEQ ID NO: 74930

SEQ ID NO: 641467 - RNA, 64 nt, hsa; identical to SEQ ID NO: 74931

SEQ ID NO: 641468 - RNA, 64 nt, hsa; identical to SEQ ID NO: 74932

SEQ ID NO: 641469 - RNA, 64 nt, hsa; identical to SEQ ID NO: 74933

SEQ ID NO: 641470 - RNA, 64 nt, hsa; identical to SEQ ID NO: 74934

SEQ ID NO: 641471 - RNA, 64 nt, hsa; identical to SEQ ID NO: 74935

SEQ ID NO: 641472 - RNA, 64 nt, hsa; identical to SEQ ID NO: 74936

SEQ ID NO: 641473 - RNA, 64 nt, hsa; identical to SEQ ID NO: 74937

SEQ ID NO: 641474 - RNA, 64 nt, hsa; identical to SEQ ID NO: 74938

SEQ ID NO: 641475 - RNA, 64 nt, hsa; identical to SEQ ID NO: 74939

SEQ ID NO: 641476 - RNA, 64 nt, hsa; identical to SEQ ID NO: 74940

SEQ ID NO: 641477 - RNA, 64 nt, hsa; identical to SEQ ID NO: 74941

SEQ ID NO: 641478 - RNA, 64 nt, hsa; identical to SEQ ID NO: 74942

SEQ ID NO: 641479 - RNA, 64 nt, hsa; identical to SEQ ID NO: 74943

SEQ ID NO: 641480 - RNA, 64 nt, hsa; identical to SEQ ID NO: 74944

SEQ ID NO: 641481 - RNA, 64 nt, hsa; identical to SEQ ID NO: 74945

SEQ ID NO: 641482 - RNA, 64 nt, hsa; identical to SEQ ID NO: 74946

SEQ ID NO: 641483 - RNA, 64 nt, hsa; identical to SEQ ID NO: 74947

SEQ ID NO: 641484 - RNA, 64 nt, hsa; identical to SEQ ID NO: 74948

SEQ ID NO: 641485 - RNA, 64 nt, hsa; identical to SEQ ID NO: 74949

SEQ ID NO: 641486 - RNA, 64 nt, hsa; identical to SEQ ID NO: 74950

SEQ ID NO: 641487 - RNA, 64 nt, hsa; identical to SEQ ID NO: 74951

SEQ ID NO: 641488 - RNA, 64 nt, hsa; identical to SEQ ID NO: 74952

SEQ ID NO: 641489 - RNA, 64 nt, hsa; identical to SEQ ID NO: 74953

SEQ ID NO: 641490 - RNA, 64 nt, hsa; identical to SEQ ID NO: 74954

SEQ ID NO: 641491 - RNA, 64 nt, hsa; identical to SEQ ID NO: 74955

SEQ ID NO: 641492 - RNA, 64 nt, hsa; identical to SEQ ID NO: 74956

SEQ ID NO: 641493 - RNA, 64 nt, hsa; identical to SEQ ID NO: 74957

SEQ ID NO: 641494 - RNA, 64 nt, hsa; identical to SEQ ID NO: 74958

SEQ ID NO: 641495 - RNA, 64 nt, hsa; identical to SEQ ID NO: 74959

SEQ ID NO: 641496 - RNA, 64 nt, hsa; identical to SEQ ID NO: 74960

SEQ ID NO: 641497 - RNA, 64 nt, hsa; identical to SEQ ID NO: 74961

SEQ ID NO: 641498 - RNA, 64 nt, hsa; identical to SEQ ID NO: 74962

SEQ ID NO: 641499 - RNA, 64 nt, hsa; identical to SEQ ID NO: 74963

SEQ ID NO: 641500 - RNA, 64 nt, hsa; identical to SEQ ID NO: 74964

SEQ ID NO: 641501 - RNA, 64 nt, hsa; identical to SEQ ID NO: 74965

SEQ ID NO: 641502 - RNA, 64 nt, hsa; identical to SEQ ID NO: 74966

SEQ ID NO: 641503 - RNA, 64 nt, hsa; identical to SEQ ID NO: 74967

SEQ ID NO: 641504 - RNA, 64 nt, hsa; identical to SEQ ID NO: 74968

SEQ ID NO: 641505 - RNA, 64 nt, hsa; identical to SEQ ID NO: 74969

SEQ ID NO: 641506 - RNA, 64 nt, hsa; identical to SEQ ID NO: 74970

SEQ ID NO: 641507 - RNA, 64 nt, hsa; identical to SEQ ID NO: 74971

SEQ ID NO: 641508 - RNA, 64 nt, hsa; identical to SEQ ID NO: 74972

SEQ ID NO: 641509 - RNA, 64 nt, hsa; identical to SEQ ID NO: 74973

SEQ ID NO: 641510 - RNA, 64 nt, hsa; identical to SEQ ID NO: 74974

SEQ ID NO: 641511 - RNA, 64 nt, hsa; identical to SEQ ID NO: 74975

SEQ ID NO: 641512 - RNA, 64 nt, hsa; identical to SEQ ID NO: 74976

SEQ ID NO: 641513 - RNA, 64 nt, hsa; identical to SEQ ID NO: 74977

SEQ ID NO: 641514 - RNA, 64 nt, hsa; identical to SEQ ID NO: 74978

SEQ ID NO: 641515 - RNA, 64 nt, hsa; identical to SEQ ID NO: 74979

SEQ ID NO: 641516 - RNA, 64 nt, hsa; identical to SEQ ID NO: 74980

SEQ ID NO: 641517 - RNA, 64 nt, hsa; identical to SEQ ID NO: 74981

SEQ ID NO: 641518 - RNA, 64 nt, hsa; identical to SEQ ID NO: 74982

SEQ ID NO: 641519 - RNA, 64 nt, hsa; identical to SEQ ID NO: 74983

SEQ ID NO: 641520 - RNA, 64 nt, hsa; identical to SEQ ID NO: 74984

SEQ ID NO: 641521 - RNA, 64 nt, hsa; identical to SEQ ID NO: 74985

SEQ ID NO: 641522 - RNA, 64 nt, hsa; identical to SEQ ID NO: 74986

SEQ ID NO: 641523 - RNA, 64 nt, hsa; identical to SEQ ID NO: 74987

SEQ ID NO: 641524 - RNA, 64 nt, hsa; identical to SEQ ID NO: 74988

SEQ ID NO: 641525 - RNA, 64 nt, hsa; identical to SEQ ID NO: 74989

SEQ ID NO: 641526 - RNA, 64 nt, hsa; identical to SEQ ID NO: 74990

SEQ ID NO: 641527 - RNA, 64 nt, hsa; identical to SEQ ID NO: 74991

SEQ ID NO: 641528 - RNA, 64 nt, hsa; identical to SEQ ID NO: 74992

SEQ ID NO: 641529 - RNA, 64 nt, hsa; identical to SEQ ID NO: 74993

SEQ ID NO: 641530 - RNA, 64 nt, hsa; identical to SEQ ID NO: 74994

SEQ ID NO: 641531 - RNA, 64 nt, hsa; identical to SEQ ID NO: 74995

SEQ ID NO: 641532 - RNA, 64 nt, hsa; identical to SEQ ID NO: 349170

SEQ ID NO: 641533 - RNA, 64 nt, hsa; identical to SEQ ID NO: 349171

SEQ ID NO: 641534 - RNA, 64 nt, hsa; identical to SEQ ID NO: 349172

SEQ ID NO: 641535 - RNA, 64 nt, hsa; identical to SEQ ID NO: 349173

SEQ ID NO: 641536 - RNA, 64 nt, hsa; identical to SEQ ID NO: 74555

SEQ ID NO: 641537 - RNA, 64 nt, hsa; identical to SEQ ID NO: 74556

SEQ ID NO: 641538 - RNA, 64 nt, hsa; identical to SEQ ID NO: 74557

SEQ ID NO: 641539 - RNA, 64 nt, hsa; identical to SEQ ID NO: 74558

SEQ ID NO: 641540 - RNA, 64 nt, hsa; identical to SEQ ID NO: 74559

SEQ ID NO: 641541 - RNA, 64 nt, hsa; identical to SEQ ID NO: 74560

SEQ ID NO: 641542 - RNA, 64 nt, hsa; identical to SEQ ID NO: 284001

SEQ ID NO: 641543 - RNA, 64 nt, hsa; identical to SEQ ID NO: 284002

SEQ ID NO: 641544 - RNA, 64 nt, hsa; identical to SEQ ID NO: 284003

SEQ ID NO: 641545 - RNA, 64 nt, hsa; identical to SEQ ID NO: 284004

SEQ ID NO: 641546 - RNA, 64 nt, hsa; identical to SEQ ID NO: 284005

SEQ ID NO: 641547 - RNA, 64 nt, hsa; identical to SEQ ID NO: 284006

SEQ ID NO: 641548 - RNA, 64 nt, hsa; identical to SEQ ID NO: 284007

SEQ ID NO: 641549 - RNA, 64 nt, hsa; identical to SEQ ID NO: 284008

SEQ ID NO: 641550 - RNA, 64 nt, hsa; identical to SEQ ID NO: 284009

SEQ ID NO: 641551 - RNA, 64 nt, hsa; identical to SEQ ID NO: 284010

SEQ ID NO: 641552 - RNA, 64 nt, hsa; identical to SEQ ID NO: 284011

SEQ ID NO: 641553 - RNA, 64 nt, hsa; identical to SEQ ID NO: 284012

SEQ ID NO: 641554 - RNA, 64 nt, hsa; identical to SEQ ID NO: 284013

SEQ ID NO: 641555 - RNA, 64 nt, hsa; identical to SEQ ID NO: 284014

SEQ ID NO: 641556 - RNA, 64 nt, hsa; identical to SEQ ID NO: 284015

SEQ ID NO: 641557 - RNA, 64 nt, hsa; identical to SEQ ID NO: 284016

SEQ ID NO: 641558 - RNA, 64 nt, hsa; identical to SEQ ID NO: 284017

SEQ ID NO: 641559 - RNA, 64 nt, hsa; identical to SEQ ID NO: 284018

SEQ ID NO: 641560 - RNA, 64 nt, hsa; identical to SEQ ID NO: 284019

SEQ ID NO: 641561 - RNA, 64 nt, hsa; identical to SEQ ID NO: 284020

SEQ ID NO: 641562 - RNA, 64 nt, hsa; identical to SEQ ID NO: 284021

SEQ ID NO: 641563 - RNA, 64 nt, hsa; identical to SEQ ID NO: 284022

SEQ ID NO: 641564 - RNA, 64 nt, hsa; identical to SEQ ID NO: 284023

SEQ ID NO: 641565 - RNA, 64 nt, hsa; identical to SEQ ID NO: 284024

SEQ ID NO: 641566 - RNA, 64 nt, hsa; identical to SEQ ID NO: 284025

SEQ ID NO: 641567 - RNA, 64 nt, hsa; identical to SEQ ID NO: 284026

SEQ ID NO: 641568 - RNA, 64 nt, hsa; identical to SEQ ID NO: 284027

SEQ ID NO: 641569 - RNA, 64 nt, hsa; identical to SEQ ID NO: 284028

SEQ ID NO: 641570 - RNA, 64 nt, hsa; identical to SEQ ID NO: 284029

SEQ ID NO: 641571 - RNA, 54 nt, hsa; identical to SEQ ID NO: 284030

SEQ ID NO: 641572 - RNA, 64 nt, hsa; identical to SEQ ID NO: 284031

SEQ ID NO: 641573 - RNA, 64 nt, hsa; identical to SEQ ID NO: 284032

SEQ ID NO: 641574 - RNA, 64 nt, hsa; identical to SEQ ID NO: 284033

SEQ ID NO: 641575 - RNA, 64 nt, hsa; identical to SEQ ID NO: 284034

SEQ ID NO: 641576 - RNA, 64 nt, hsa; identical to SEQ ID NO: 284035

SEQ ID NO: 641577 - RNA, 64 nt, hsa; identical to SEQ ID NO: 284036

SEQ ID NO: 641578 - RNA, 64 nt, hsa; identical to SEQ ID NO: 284037

SEQ ID NO: 641579 - RNA, 64 nt, hsa; identical to SEQ ID NO: 284038

SEQ ID NO: 641580 - RNA, 64 nt, hsa; identical to SEQ ID NO: 23330

SEQ ID NO: 641581 - RNA, 64 nt, hsa; identical to SEQ ID NO: 23331

SEQ ID NO: 641582 - RNA, 64 nt, hsa; identical to SEQ ID NO: 23332

SEQ ID NO: 641583 - RNA, 64 nt, hsa; identical to SEQ ID NO: 23333

SEQ ID NO: 641584 - RNA, 64 nt, hsa; identical to SEQ ID NO: 23334

SEQ ID NO: 641585 - RNA, 64 nt, hsa; identical to SEQ ID NO: 23335

SEQ ID NO: 641586 - RNA, 64 nt, hsa; identical to SEQ ID NO: 23336

SEQ ID NO: 641587 - RNA, 64 nt, hsa; identical to SEQ ID NO: 23337

SEQ ID NO: 641588 - RNA, 64 nt, hsa; identical to SEQ ID NO: 23338

SEQ ID NO: 641589 - RNA, 64 nt, hsa; identical to SEQ ID NO: 23339

SEQ ID NO: 641590 - RNA, 64 nt, hsa; identical to SEQ ID NO: 138795

SEQ ID NO: 641591 - RNA, 64 nt, hsa; identical to SEQ ID NO: 138796

SEQ ID NO: 641592 - RNA, 64 nt, hsa; identical to SEQ ID NO: 138797

SEQ ID NO: 641593 - RNA, 64 nt, hsa; identical to SEQ ID NO: 138798

SEQ ID NO: 641594 - RNA, 64 nt, hsa; identical to SEQ ID NO: 138799

SEQ ID NO: 641595 - RNA, 64 nt, hsa; identical to SEQ ID NO: 138800

SEQ ID NO: 641596 - RNA, 64 nt, hsa; identical to SEQ ID NO: 138801

SEQ ID NO: 641597 - RNA, 64 nt, hsa; identical to SEQ ID NO: 138802

SEQ ID NO: 641598 - RNA, 64 nt, hsa; identical to SEQ ID NO: 138803

SEQ ID NO: 641599 - RNA, 64 nt, hsa; identical to SEQ ID NO: 138804

SEQ ID NO: 641600 - RNA, 64 nt, hsa; identical to SEQ ID NO: 138805

SEQ ID NO: 641601 - RNA, 64 nt, hsa; identical to SEQ ID NO: 138806

SEQ ID NO: 641602 - RNA, 64 nt, hsa; identical to SEQ ID NO: 138807

SEQ ID NO: 641603 - RNA, 64 nt, hsa; identical to SEQ ID NO: 138808

SEQ ID NO: 641604 - RNA, 64 nt, hsa
guguuuacaguauucaauuuauugcaguuauagaauuggucagagagcauuuucauagugugcu

SEQ ID NO: 641605 - RNA, 64 nt, hsa
uguuaauagaggaucagagcagaguugggaguauauuggucaggaucauagaaaagaagacaaa

SEQ ID NO: 641606 - RNA, 64 nt, hsa
uuuuguauuuuuaguagagacaggguuucaccauauuggucaggcuggucuugaacuccugacc

SEQ ID NO: 641607 - RNA, 64 nt, hsa; identical to SEQ ID NO: 641606

SEQ ID NO: 641608 - RNA, 63 nt, hsa
uccucuuagaagaaaagccugaaacugaguugaauagagaagugugacccugugacaaaauga

SEQ ID NO: 641609 - RNA, 63 nt, hsa
caaauaacugaugaaggauucauaaucacaaauauagagaauuccuauuuaaaaaaauagaaa

SEQ ID NO: 641610 - RNA, 63 nt, hsa
aaagaagaaaaaacugaagguacuuuacucccuauagagaaaccauugccaucauuguagcaa

SEQ ID NO: 641611 - RNA, 63 nt, hsa
guaaaucuuuuaucaacuguauacugguguuuaauagagaaugauugucuuccgaguuuuuug

SEQ ID NO: 641612 - RNA, 63 nt, hsa
agguaacauuuaacaauaaucugauacacauaaauagagaaagagcaauugauaaaguaaaug

SEQ ID NO: 641613 - RNA, 63 nt, hsa
gauagauagauagauagauagauagauagauagauagagaaaugagaagguuucucuuuugca

SEQ ID NO: 641614 - RNA, 63 nt, hsa
ucacaauggaaccuuaaauacuucugguaaaccauagagaauggaggauggcugugaugaagc

SEQ ID NO: 641615 - RNA, 63 nt, hsa
uacuaucagaacaaauacauaaaauaacuucccauagagaacaggauauagcaauaauagcuc

SEQ ID NO: 641616 - RNA, 63 nt, hsa
gugugugauuuacuuuucugaucucuuugagaaauagagaaauauaaaaguguguucuuaacu

SEQ ID NO: 641617 - RNA, 63 nt, hsa
gaagcaugaauuauuuucauauaaauauagaaaauagagaaaaggcuaugccuguaauuuuua

SEQ ID NO: 641618 - RNA, 63 nt, hsa
uuuucuuuuaagguguauuggcauguaauuugcauagagaagguccucugguuagucucucaa

SEQ ID NO: 641619 - RNA, 63 nt, hsa
uauaaaacaacauaaauuuagaccauaacuuuuauagagaaaggguuuugucaaauguuuucu

SEQ ID NO: 641620 - RNA, 63 nt, hsa
cuaaaauuuuauuugacuuauagagaauagcauauagagaauaaucauguugacuuugugaau

SEQ ID NO: 641621 - RNA, 63 nt, hsa
uaaaaacauuaccacuaaaauuuuauuugacuuauagagaauagcauauagagaauaaucaug

SEQ ID NO: 641622 - RNA, 64 nt, hsa; identical to SEQ ID NO: 641604

SEQ ID NO: 641623 - RNA, 64 nt, hsa; identical to SEQ ID NO: 641605

SEQ ID NO: 641624 - RNA, 64 nt, hsa; identical to SEQ ID NO: 641606

SEQ ID NO: 641625 - RNA, 64 nt, hsa; identical to SEQ ID NO: 641606

SEQ ID NO: 641626 - RNA, 63 nt, hsa; identical to SEQ ID NO: 641608

SEQ ID NO: 641627 - RNA, 63 nt, hsa; identical to SEQ ID NO: 641609

SEQ ID NO: 641628 - RNA, 63 nt, hsa; identical to SEQ ID NO: 641610

SEQ ID NO: 641629 - RNA, 63 nt, hsa; identical to SEQ ID NO: 641611

SEQ ID NO: 641630 - RNA, 63 nt, hsa; identical to SEQ ID NO: 641612

SEQ ID NO: 641631 - RNA, 63 nt, hsa; identical to SEQ ID NO: 641613

SEQ ID NO: 641632 - RNA, 63 nt, hsa; identical to SEQ ID NO: 641614

SEQ ID NO: 641633 - RNA, 63 nt, hsa; identical to SEQ ID NO: 641615

SEQ ID NO: 641634 - RNA, 63 nt, hsa; identical to SEQ ID NO: 641616

SEQ ID NO: 641635 - RNA, 63 nt, hsa; identical to SEQ ID NO: 641617

SEQ ID NO: 641636 - RNA, 63 nt, hsa; identical to SEQ ID NO: 641618

SEQ ID NO: 641637 - RNA, 63 nt, hsa; identical to SEQ ID NO: 641619

SEQ ID NO: 641638 - RNA, 63 nt, hsa; identical to SEQ ID NO: 641620

SEQ ID NO: 641639 - RNA, 63 nt, hsa; identical to SEQ ID NO: 641621

SEQ ID NO: 641640 - RNA, 64 nt, hsa
gaaaggauaaggcaaaugacugaacaguucccucaggacucacguacugaucucccaaaagaag

SEQ ID NO: 641641 - RNA, 64 nt, hsa
gacuauuucacacucuccaugcuuaugucaaugcaggacucaucacaucuauucggauauucug

SEQ ID NO: 641642 - RNA, 64 nt, hsa
gugcugauggaaguggaagugccugaagucuuacaggacucacuggauagauauuauucgacuc

SEQ ID NO: 641643 - RNA, 64 nt, hsa
gagcugcuggagguaguagagccugaagucuugcaggacucacuggauguuauucaacuccuuc

SEQ ID NO: 641644 - RNA, 64 nt, hsa
gagcugcuggcugagaaagagccugaagucuugcaggacucacuggauagauguuauucgacuc

SEQ ID NO: 641645 - RNA, 64 nt, hsa
gagcugcuggaugagaaagagccugaagucuugcaggacucacuggauagauguuauucaacuc

SEQ ID NO: 641646 - RNA, 64 nt, hsa
gagaggccugggggcggugcucacugggagggccaggacucaguuccugcucucauccuccccu

SEQ ID NO: 641647 - RNA, 64 nt, hsa
ccagccccaaugucagcaggauagggagagccccaggacucaggagugcugggcugguccuacu

SEQ ID NO: 641648 - RNA, 64 nt, hsa
ucugaaucccugcaggccaagucauugcucagccaggacucaguucauggaggaaacuuguccu

SEQ ID NO: 641649 - RNA, 64 nt, hsa
gggaaacagcaggaggagggaucccugacugcugaggacucacacugaccagacgccacaccuu

SEQ ID NO: 641650 - RNA, 64 nt, hsa
uccagugguggucaguagauccaggacgcccugcaggacucagccuguacagggagaugaagug

SEQ ID NO: 641651 - RNA, 64 nt, hsa
uuuuggcaacaggagagacaggauugggccaacaaggacucagacgaguuuuauugacucauuu

SEQ ID NO: 641652 - RNA, 64 nt, hsa
uuagguaaucauuccagguguguucaguaguuccaggacucagggacucaggccagucacccug

SEQ ID NO: 641653 - RNA, 64 nt, hsa
uuuuggcaacaggagagacaggauugggccaacaaggacucagaugaguuuuauugacucauuc

SEQ ID NO: 641654 - RNA, 64 nt, hsa
uuuuaggcaccuacugugugcauagcauuccaccaggacucaucucccuuccuucucagggggu

SEQ ID NO: 641655 - RNA, 64 nt, hsa
gaggacccugagggcucagccagggaggggucccaggacucaacugggccccguuucuaggaag

SEQ ID NO: 641656 - RNA, 64 nt, hsa
gauauugggucaguguccaaagcagggucugggcaggacucagcuccccagaguccucuaugaa

SEQ ID NO: 641657 - RNA, 64 nt, hsa
ucacaucuuggcacauuuaagagacagucaccccaggacucaaaaauagggaaguaacaguaac

SEQ ID NO: 641658 - RNA, 64 nt, hsa
ccuuucugugguucucagccaagacauaaaaacuaggacucagagcacauacaaaaccaguuau

SEQ ID NO: 641659 - RNA, 64 nt, hsa
gagugagaacuacaaaaauacaaaaugcuuguccaggacucagccaugcacaccuugagcagcg

SEQ ID NO: 641660 - RNA, 64 nt, hsa
cuuuguuuccuucacuuccuuucgauaucaugaaaggacucacacuggagagaaccccuaugag

SEQ ID NO: 641661 - RNA, 64 nt, hsa
cuuuauuucuuccacuucuuuucaauaucaugaaaggacucacaugggagagaaacccuaugag

SEQ ID NO: 641662 - RNA, 64 nt, hsa
cuucauuucuucuaguucccuucaauaucaugaaaggacucacacuggagagaagcccuaugaa

SEQ ID NO: 641663 - RNA, 64 nt, hsa
cuucagaucagccucgcaccuucaaaugcauggaaggacucacacuggagaaaaacccuaugaa

SEQ ID NO: 641664 - RNA, 64 nt, hsa
gccuuaauuguuccaguuccuuucgauaucuaaaaggacucacaguggagaaaaacucuaugag

SEQ ID NO: 641665 - RNA, 64 nt, hsa
auucaauuauuuuucuuccuugcauauacaugaaaggacucauacgagagagaauccguaugaa

SEQ ID NO: 641666 - RNA, 64 nt, hsa
uuucacuucuuccaguucuuuucaauaucaugaaaggacucacacuggggagaaaccguaucaa

SEQ ID NO: 641667 - RNA, 64 nt, hsa
cuucaaucuuuccaguuccuuucaguaucaugaaaggacucacacuggagagaaacccuaugag

SEQ ID NO: 641668 - RNA, 64 nt, hsa
cuucagaugugccccacaccuucgaaggcaugguaggacucacuggagagaaacccuaugagug

SEQ ID NO: 641669 - RNA, 64 nt, hsa
cuucaguaguuccaguuccuuuugguaccaugaaaggacucacacuggagagaaacccuaugag

SEQ ID NO: 641670 - RNA, 64 nt, hsa
cuuuauuucuuucacuucuuuucgauaacaugaaaggacucacacuggagagaaacccuaugag

SEQ ID NO: 641671 - RNA, 64 nt, hsa
cuucagaucuaccucacaccuucgaaaacaugguaggacucacacuggauagaaaccaaagcag

SEQ ID NO: 641672 - RNA, 64 nt, hsa
auuuagauacuacuacucagcucaaagacaugaaaggacucauacuggagagaaacccuacaaa

SEQ ID NO: 641673 - RNA, 64 nt, hsa
cuucaguugucaacguucuuuccaaauacauggaaggacucacacuggagauaaacccuuuaag

SEQ ID NO: 641674 - RNA, 64 nt, hsa
auugaguucucucagcuccuugcacagacacaaaaggacucauuggaaagauacucuauaaaug

SEQ ID NO: 641675 - RNA, 64 nt, hsa
cuuuguuuauuucauuggauuucaaagacaugaaaggacucacacuagggagaaaaucuauaaa

SEQ ID NO: 641676 - RNA, 64 nt, hsa
gugucacccuaggccugauaagcgaucagaggaaaggacucauucaugucacgcuuccuugagc

SEQ ID NO: 641677 - RNA, 64 nt, hsa
augcaucuggcaccaauuagguauuucuuaaaacaggacucaucugucagagugcacaugaaaa

SEQ ID NO: 641678 - RNA, 57 nt, hsa
cgacuccaucaauguacuuugaacuaccugacucauuccagcacuacagaagugugu

SEQ ID NO: 641679 - RNA, 57 nt, hsa
caacuccuucaguuuaucuuggacugacugacucaugccagcccuacagaagugccu

SEQ ID NO: 641680 - RNA, 57 nt, hsa
uccaaggaucagaaacuccccguuuugcugacucauuccauaacuggagaaagaagc

SEQ ID NO: 641681 - RNA, 57 nt, hsa
uucauuugucucuggugggacaaaauacugacucaguccuuagauguaguuucaccc

SEQ ID NO: 641682 - RNA, 57 nt, hsa
gccugccccuucugcugcuccuguuggcugacucaccacuguccccuuaggauugga

SEQ ID NO: 641683 - RNA, 57 nt, hsa
agaucuucuggccuucagauucugcaacugacucauuuucaggagguugggggaaaa

SEQ ID NO: 641684 - RNA, 57 nt, hsa
gugcucugaucccucuacagagcuucccugacucauucugaaggagccccauuccug

SEQ ID NO: 641685 - RNA, 57 nt, hsa
agagugucuuuccacggagccacuccucugacucagggcuccuggguuuuguauucu

SEQ ID NO: 641686 - RNA, 57 nt, hsa
cuggagcccucugcucacuggcacuuccugacucaaaggcacuaacagugcucaugu

SEQ ID NO: 641687 - RNA, 57 nt, hsa
ggcgcacuaccuauuuugucaccagagcugacucaggcuuccuggacccucaacccc

SEQ ID NO: 641688 - RNA, 57 nt, hsa
caucaaaccuuccacuuagcaauagcccugacucaggcagaaugccucauaaauuag

SEQ ID NO: 641689 - RNA, 57 nt, hsa
caagaagacgcccucugaagccauguccugacucauggguggaucucccagaaauag

SEQ ID NO: 641690 - RNA, 57 nt, hsa
ugggcucccccuacucccucagaggaacugacucaccggcuguccuagaaugggcag

SEQ ID NO: 641691 - RNA, 57 nt, hsa
ugggugccaaggaagcuggaggaaucccugacucaacuuccccgaaggaggccucug

SEQ ID NO: 641692 - RNA, 57 nt, hsa
cuuacagccguggauguuuccuggaagcugacucagucuguucacugguugagcuuu

SEQ ID NO: 641693 - RNA, 57 nt, hsa
aggccccuggaacacacucaggcuucccugacucaggacaaggaccacgggaggccc

SEQ ID NO: 641694 - RNA, 64 nt, hsa
aaggaaauaacauugaagaaggaaaacaauauguagaaaguauuuuagaaaguaaccugucuuu

SEQ ID NO: 641695 - RNA, 64 nt, hsa
uugaagaaggaaaacaauauguagaaaguauuuuagaaaguaaccugucuuugaugaugcuucu

SEQ ID NO: 641696 - RNA, 64 nt, hsa
uugugugaaaucaccuuaucaaauuaaaaugggaagaaaguaauuuuaauaauuuuuaauaauc

SEQ ID NO: 641697 - RNA, 64 nt, hsa
cacuuucaauugaagucaggguauugugcauaauagaaaguauuggacugagauauuugguuac

SEQ ID NO: 641698 - RNA, 64 nt, hsa
aguguugagcuuuauuuugcuuuuucauagaggcagaaaguaggaaccagauagagaugaaaag

SEQ ID NO: 641699 - RNA, 64 nt, hsa
ugccuagaaauuauguaaagcuaaacuacugguuagaaaguauucaguguaauauuguauuaau

SEQ ID NO: 641700 - RNA, 64 nt, hsa
gaauguauaauuggcauaucauggaaaauuaaccagaaaguaucaguucuuaaaaguuaugccu

SEQ ID NO: 641701 - RNA, 64 nt, hsa
auaugucaaagguagagacaggucuucaugugugagaaaguauagcgagagcagaucaucuuua

SEQ ID NO: 641702 - RNA, 64 nt, hsa
aggacagcagcucugcuagcuuggcuagugcuggagaaaguaccgggaagaaggagguggcuga

SEQ ID NO: 641703 - RNA, 64 nt, hsa
gaaauuuaaaucacaaacucauuuucugguuuuuagaaaguagaugaugauuucagaggaguaa

SEQ ID NO: 641704 - RNA, 64 nt, hsa
ccucugauuuugguuuucuuguuucugaguucuuagaaaguacccacauacucuuuuuuuuuuu

SEQ ID NO: 641705 - RNA, 64 nt, hsa
cccacucuuccuuauugccucuucagaacccuuuagaaaguauaaaauauugccuccaacaugc

SEQ ID NO: 641706 - RNA, 64 nt, hsa
accauuaauuuccacgcugcaguuuuuauuuuaaagaaaguaacaagaugucuuuacacugaca

SEQ ID NO: 641707 - RNA, 64 nt, hsa
cauggaaaaauuaauuauaugguugaaauguaaaagaaaguaagcauaaaaaucgaguaaugua

SEQ ID NO: 641708 - RNA, 64 nt, hsa
uguacaauuguuuacauaacagaaaaggcuaagcagaaaguaaauuucaauaugucaguauaga

SEQ ID NO: 641709 - RNA, 64 nt, hsa
uggaccccuucugcucuacuacagagagugaagaagaaaguauuaaagcucacuuuaccauucc

SEQ ID NO: 641710 - RNA, 64 nt, hsa
auaauaguuuccuuuaauaggaguauuagagauaagaaaguauaugaaaauauacuggaaauau

SEQ ID NO: 641711 - RNA, 64 nt, hsa
aaaaaaaaaaucagaaaacccccaccuaauccacagaaaguaaugucuuuccccuccccuugga

SEQ ID NO: 641712 - RNA, 64 nt, hsa
uuuuuuccccuuuccuggugauugauuuuacaaaagaaaguaagcugcuuagaaggcccuggaa

SEQ ID NO: 641713 - RNA, 64 nt, hsa
uuuugaaaagaaaaaauugguaaugcgaauguauagaaaguaaagguaggaugcucagguuuuc

SEQ ID NO: 641714 - RNA, 64 nt, hsa
uuguucuggugaacagagaaucuuaagagcuguuagaaaguagcacuugaugcaagggauguuu

SEQ ID NO: 641715 - RNA, 64 nt, hsa
cuuacuuagcuccuugcgauacugugagccagagagaaaguaaaagcacuucacaaaaaaauga

SEQ ID NO: 641716 - RNA, 64 nt, hsa
cauuuauccggcauuauuucaacaccuccugugaagaaaguacuuuucuggcauagcuaccgug

SEQ ID NO: 641717 - RNA, 64 nt, hsa
gagugucuuucaaggguugcaggaucuuagagauagaaaguaccuuggugaucaucuccagccu

SEQ ID NO: 641718 - RNA, 64 nt, hsa
caggcgugagccacuuaguauuuguaaccauaagagaaaguauauuuuaacagcauuacauuuc

SEQ ID NO: 641719 - RNA, 64 nt, hsa
ccuacuggaaaaagaguggaaauuuauuaaaaucagaaaguaugagauccuguuauguuaaggg

SEQ ID NO: 641720 - RNA, 64 nt, hsa
aaaccuuucuuuguguaugcauguuugaauuaaaagaaaguaauggaagaauugaucgaugaau

SEQ ID NO: 641721 - RNA, 64 nt, hsa
gacugaaagguuuauuaaaaugauuguaauauauagaaaguaucuguguuuaagaagauaauua

SEQ ID NO: 641722 - RNA, 64 nt, hsa
auguggaagcgaacccccagggcauaacauaguaagaaaguaugguucuguauggcaauagguu

SEQ ID NO: 641723 - RNA, 64 nt, hsa
ucaauguuaaauaaaagccaaaacuggaaugugcagaaaguaggcuuugguuaauuuguggauu

SEQ ID NO: 641724 - RNA, 64 nt, hsa
uuuuuuuauaccauuuuauccuuuucucuuuaacagaaaguaaauauguauaaaauuugaagga

SEQ ID NO: 641725 - RNA, 64 nt, hsa
gucgcugaucauccucuuccucaucuguaaaugaagaaaguaggcccugucuaccucacaugca

SEQ ID NO: 641726 - RNA, 64 nt, hsa
uucugcagcccaguucugugggugcagcucuuccagaaaguauuaggagccucacaucuacucu

SEQ ID NO: 641727 - RNA, 64 nt, hsa
uaacagcaggaaggacuuaagguguauaagaaaaagaaaguauucauacagaaauuaccuagca

SEQ ID NO: 641728 - RNA, 64 nt, hsa
gguaacaucaggacagacagaguuuuuggugagaagaaaguacuauaugccugcuugauagcau

SEQ ID NO: 641729 - RNA, 64 nt, hsa
ccauugauuuuacagggauuuuaguucguaauccagaaaguaauaaucagggauuuuauuuuaa

SEQ ID NO: 641730 - RNA, 64 nt, hsa
uauucuuuuuaaacuauaaauaccauuuugagugagaaaguacuuuuaaacaagaaagaaauug

SEQ ID NO: 641731 - RNA, 64 nt, hsa
ucugauccuguagugccucuauagaaguacccacagaaaguaaaguaucacauuuauaaauacc

SEQ ID NO: 641732 - RNA, 64 nt, hsa
ccuggacccuaaagaacagugacugcaaaggcaaagaaaguaaaaaaggaauuggccauuagac

SEQ ID NO: 641733 - RNA, 64 nt, hsa
auaguaacauugauauuucuugugaaggagaaguagaaaguaacagugacuucuagauuucugg

SEQ ID NO: 641734 - RNA, 64 nt, hsa
acaguugaccacagguaacggaaaccucaaucacagaaaguaaagccguggauacggugggacu

SEQ ID NO: 641735 - RNA, 64 nt, hsa
cauucugccugcccaggccccugccacccuggggagaaaguacuucuuuuuuuuuauuuuuaga

SEQ ID NO: 641736 - RNA, 64 nt, hsa
gauuacaagcgugagccacugcaccgggccacagagaaaguacuucuccacccugcucuccgac

SEQ ID NO: 641737 - RNA, 64 nt, hsa
gagaaauguacauaugugugaaccaaauuguacgagaaaguaucuauuuuuggcuaaauaaaug

SEQ ID NO: 641738 - RNA, 64 nt, hsa
ccguguauaaauaccuaaaagcaaaacuaaacaaagaaaguaagaaaaagaaauaaaaccaguc

SEQ ID NO: 641739 - RNA, 64 nt, hsa
uaaagauacauaccugguuugcuuggcuuacguaagaaaguagaagaaaguaaacuguaauaaa

SEQ ID NO: 641740 - RNA, 64 nt, hsa
uaccugguuugcuuggcuuacguaagaaaguagaagaaaguaaacuguaauaaauaaaaguguc

SEQ ID NO: 641741 - RNA, 64 nt, hsa; identical to SEQ ID NO: 302274

SEQ ID NO: 641742 - RNA, 64 nt, hsa; identical to SEQ ID NO: 302275

SEQ ID NO: 641743 - RNA, 64 nt, hsa; identical to SEQ ID NO: 302276

SEQ ID NO: 641744 - RNA, 64 nt, hsa; identical to SEQ ID NO: 302277

SEQ ID NO: 641745 - RNA, 64 nt, hsa; identical to SEQ ID NO: 302278

SEQ ID NO: 641746 - RNA, 64 nt, hsa; identical to SEQ ID NO: 302279

SEQ ID NO: 641747 - RNA, 64 nt, hsa; identical to SEQ ID NO: 302280

SEQ ID NO: 641748 - RNA, 64 nt, hsa; identical to SEQ ID NO: 302281

SEQ ID NO: 641749 - RNA, 64 nt, hsa; identical to SEQ ID NO: 302282

SEQ ID NO: 641750 - RNA, 64 nt, hsa; identical to SEQ ID NO: 302283

SEQ ID NO: 641751 - RNA, 64 nt, hsa; identical to SEQ ID NO: 302284

SEQ ID NO: 641752 - RNA, 64 nt, hsa; identical to SEQ ID NO: 302285

SEQ ID NO: 641753 - RNA, 64 nt, hsa; identical to SEQ ID NO: 302286

SEQ ID NO: 641754 - RNA, 64 nt, hsa; identical to SEQ ID NO: 302287

SEQ ID NO: 641755 - RNA, 64 nt, hsa; identical to SEQ ID NO: 302288

SEQ ID NO: 641756 - RNA, 64 nt, hsa; identical to SEQ ID NO: 302289

SEQ ID NO: 641757 - RNA, 64 nt, hsa; identical to SEQ ID NO: 302290

SEQ ID NO: 641758 - RNA, 64 nt, hsa; identical to SEQ ID NO: 302291

SEQ ID NO: 641759 - RNA, 64 nt, hsa; identical to SEQ ID NO: 302292

SEQ ID NO: 641760 - RNA, 64 nt, hsa; identical to SEQ ID NO: 302293

SEQ ID NO: 641761 - RNA, 64 nt, hsa; identical to SEQ ID NO: 302294

SEQ ID NO: 641762 - RNA, 64 nt, hsa; identical to SEQ ID NO: 302295

SEQ ID NO: 641763 - RNA, 64 nt, hsa; identical to SEQ ID NO: 302296

SEQ ID NO: 641764 - RNA, 64 nt, hsa; identical to SEQ ID NO: 302297

SEQ ID NO: 641765 - RNA, 64 nt, hsa; identical to SEQ ID NO: 302298

SEQ ID NO: 641766 - RNA, 64 nt, hsa; identical to SEQ ID NO: 302299

SEQ ID NO: 641767 - RNA, 64 nt, hsa; identical to SEQ ID NO: 380024

SEQ ID NO: 641768 - RNA, 64 nt, hsa; identical to SEQ ID NO: 380025

SEQ ID NO: 641769 - RNA, 64 nt, hsa; identical to SEQ ID NO: 380026

SEQ ID NO: 641770 - RNA, 64 nt, hsa; identical to SEQ ID NO: 380027

SEQ ID NO: 641771 - RNA, 64 nt, hsa; identical to SEQ ID NO: 380028

SEQ ID NO: 641772 - RNA, 64 nt, hsa; identical to SEQ ID NO: 380029

SEQ ID NO: 641773 - RNA, 64 nt, hsa; identical to SEQ ID NO: 110317

SEQ ID NO: 641774 - RNA, 64 nt, hsa; identical to SEQ ID NO: 110318

SEQ ID NO: 641775 - RNA, 64 nt, hsa; identical to SEQ ID NO: 110319

SEQ ID NO: 641776 - RNA, 64 nt, hsa; identical to SEQ ID NO: 110320

SEQ ID NO: 641777 - RNA, 64 nt, hsa; identical to SEQ ID NO: 110321

SEQ ID NO: 641778 - RNA, 64 nt, hsa; identical to SEQ ID NO: 110322

SEQ ID NO: 641779 - RNA, 51 nt, hsa; identical to SEQ ID NO: 110323

SEQ ID NO: 641780 - RNA, 64 nt, hsa; identical to SEQ ID NO: 110324

SEQ ID NO: 641781 - RNA, 64 nt, hsa; identical to SEQ ID NO: 110325

SEQ ID NO: 641782 - RNA, 64 nt, hsa; identical to SEQ ID NO: 110326

SEQ ID NO: 641783 - RNA, 64 nt, hsa; identical to SEQ ID NO: 110327

SEQ ID NO: 641784 - RNA, 64 nt, hsa; identical to SEQ ID NO: 110328

SEQ ID NO: 641785 - RNA, 64 nt, hsa; identical to SEQ ID NO: 110329

SEQ ID NO: 641786 - RNA, 64 nt, hsa; identical to SEQ ID NO: 110330

SEQ ID NO: 641787 - RNA, 64 nt, hsa; identical to SEQ ID NO: 110331

SEQ ID NO: 641788 - RNA, 64 nt, hsa; identical to SEQ ID NO: 110332

SEQ ID NO: 641789 - RNA, 64 nt, hsa; identical to SEQ ID NO: 110333

SEQ ID NO: 641790 - RNA, 64 nt, hsa; identical to SEQ ID NO: 110334

SEQ ID NO: 641791 - RNA, 64 nt, hsa; identical to SEQ ID NO: 110335

SEQ ID NO: 641792 - RNA, 64 nt, hsa; identical to SEQ ID NO: 110336

SEQ ID NO: 641793 - RNA, 64 nt, hsa; identical to SEQ ID NO: 110337

SEQ ID NO: 641794 - RNA, 64 nt, hsa; identical to SEQ ID NO: 110338

SEQ ID NO: 641795 - RNA, 64 nt, hsa; identical to SEQ ID NO: 110339

SEQ ID NO: 641796 - RNA, 64 nt, hsa; identical to SEQ ID NO: 110340

SEQ ID NO: 641797 - RNA, 64 nt, hsa; identical to SEQ ID NO: 110341

SEQ ID NO: 641798 - RNA, 64 nt, hsa; identical to SEQ ID NO: 110342

SEQ ID NO: 641799 - RNA, 64 nt, hsa; identical to SEQ ID NO: 110343

SEQ ID NO: 641800 - RNA, 64 nt, hsa; identical to SEQ ID NO: 110344

SEQ ID NO: 641801 - RNA, 64 nt, hsa; identical to SEQ ID NO: 110345

SEQ ID NO: 641802 - RNA, 64 nt, hsa; identical to SEQ ID NO: 110346

SEQ ID NO: 641803 - RNA, 64 nt, hsa; identical to SEQ ID NO: 110347

SEQ ID NO: 641804 - RNA, 64 nt, hsa; identical to SEQ ID NO: 110348

SEQ ID NO: 641805 - RNA, 64 nt, hsa; identical to SEQ ID NO: 110349

SEQ ID NO: 641806 - RNA, 64 nt, hsa; identical to SEQ ID NO: 110350

SEQ ID NO: 641807 - RNA, 64 nt, hsa; identical to SEQ ID NO: 110351

SEQ ID NO: 641808 - RNA, 64 nt, hsa; identical to SEQ ID NO: 110352

SEQ ID NO: 641809 - RNA, 64 nt, hsa; identical to SEQ ID NO: 110353

SEQ ID NO: 641810 - RNA, 64 nt, hsa; identical to SEQ ID NO: 110354

SEQ ID NO: 641811 - RNA, 64 nt, hsa; identical to SEQ ID NO: 110355

SEQ ID NO: 641812 - RNA, 64 nt, hsa; identical to SEQ ID NO: 110356

SEQ ID NO: 641813 - RNA, 64 nt, hsa; identical to SEQ ID NO: 110357

SEQ ID NO: 641814 - RNA, 64 nt, hsa; identical to SEQ ID NO: 110358

SEQ ID NO: 641815 - RNA, 64 nt, hsa; identical to SEQ ID NO: 110359

SEQ ID NO: 641816 - RNA, 64 nt, hsa
aaccaaaguuuuaagauuugcugugugaugaagugacagggagggccggagucagcaggugcca

SEQ ID NO: 641817 - RNA, 64 nt, hsa
gcugccuucuuguagaugacuugcuguucuuuaugacagggaucaguggcauuuguuuccuagc

SEQ ID NO: 641818 - RNA, 64 nt, hsa
ccuuucuaagcccuggggcgcccaagucccaugggacagggaaacgugguccucagugaggcug

SEQ ID NO: 641819 - RNA, 64 nt, hsa
ccacaucccuauuaacagaggcagcuccacuucagacagggacaaggcuuccugcugugccuuu

SEQ ID NO: 641820 - RNA, 64 nt, hsa
gcccaggaggaggagcccuagggaagaagucagggacagggaccaggauaccacucugucacug

SEQ ID NO: 641821 - RNA, 64 nt, hsa
ugaccacggccuggaggacuggcccaggcagggggacagggaaaauggagcccaaguagccucu

SEQ ID NO: 641822 - RNA, 64 nt, hsa
aaccuguuauguugcuuuuggaaggagacucuaagacagggaaagcaaguucaugguacauacg

SEQ ID NO: 641823 - RNA, 64 nt, hsa
ggaggccugcccagacuaggaggcagcggggauagacagggaauggggagaagaaagaccccca

SEQ ID NO: 641824 - RNA, 64 nt, hsa
cagcuccacaaugggcucccccgccaacggggacgacagggaucuucaggaacuucugaccuca

SEQ ID NO: 641825 - RNA, 64 nt, hsa
aucuaagacaaggaaguccuauagaagccaaagggacagggacggaaaggacaggucccaaggg

SEQ ID NO: 641826 - RNA, 64 nt, hsa
uuuauaaaaauccaugcuuuacaccuggacaguagacagggacuucagagauugcacguuugaa

SEQ ID NO: 641827 - RNA, 64 nt, hsa
caguauguuaggaggggccaggcagcggggcagggacagggagccgagugccccucagaguccc

SEQ ID NO: 641828 - RNA, 64 nt, hsa
cggcuggaaagaggagaaggagagggaguacaaagacagggaauagugggaucaaagcuaggaa

SEQ ID NO: 641829 - RNA, 64 nt, hsa
aggagaggaugcacaguuugcuauuugcuuuagagacagggacuguauaaacaagccuaacauu

SEQ ID NO: 641830 - RNA, 64 nt, hsa
gcuaccugggugguugaggggacugacauuugaggacagggagauggagcagugucauugucag

SEQ ID NO: 641831 - RNA, 64 nt, hsa
ucuuugccagaugaugggaaggcaaggaagaagggacagggaaagauaauuacugauaaaugaa

SEQ ID NO: 641832 - RNA, 64 nt, hsa
uucuccccagcucugcccucuggguccacaugaggacagggaagcucgggaaggggaagggaga

SEQ ID NO: 641833 - RNA, 64 nt, hsa
cccccgcugggcacucucugucccaucccucuaggacagggaagcuggccugguccagggcacu

SEQ ID NO: 641834 - RNA, 64 nt, hsa
cauuccaggcccgaagcaugaacagugcaccugggacagggagcagccccaaauugucaccugc

SEQ ID NO: 641835 - RNA, 64 nt, hsa
cuccccccaccucccccacucccaaccacguugggacagggaggugugaggcaggagagacagu

SEQ ID NO: 641836 - RNA, 64 nt, hsa; identical to SEQ ID NO: 234645

SEQ ID NO: 641837 - RNA, 64 nt, hsa; identical to SEQ ID NO: 234646

SEQ ID NO: 641838 - RNA, 64 nt, hsa; identical to SEQ ID NO: 234647

SEQ ID NO: 641839 - RNA, 64 nt, hsa; identical to SEQ ID NO: 234648

SEQ ID NO: 641840 - RNA, 64 nt, hsa; identical to SEQ ID NO: 234649

SEQ ID NO: 641841 - RNA, 64 nt, hsa; identical to SEQ ID NO: 234650

SEQ ID NO: 641842 - RNA, 64 nt, hsa; identical to SEQ ID NO: 234651

SEQ ID NO: 641843 - RNA, 64 nt, hsa; identical to SEQ ID NO: 234652

SEQ ID NO: 641844 - RNA, 64 nt, hsa; identical to SEQ ID NO: 234653

SEQ ID NO: 641845 - RNA, 64 nt, hsa; identical to SEQ ID NO: 234654

SEQ ID NO: 641846 - RNA, 64 nt, hsa; identical to SEQ ID NO: 234655

SEQ ID NO: 641847 - RNA, 64 nt, hsa; identical to SEQ ID NO: 234656

SEQ ID NO: 641848 - RNA, 64 nt, hsa; identical to SEQ ID NO: 234657

SEQ ID NO: 641849 - RNA, 64 nt, hsa; identical to SEQ ID NO: 234658

SEQ ID NO: 641850 - RNA, 64 nt, hsa; identical to SEQ ID NO: 234659

SEQ ID NO: 641851 - RNA, 64 nt, hsa; identical to SEQ ID NO: 234660

SEQ ID NO: 641852 - RNA, 64 nt, hsa; identical to SEQ ID NO: 234661

SEQ ID NO: 641853 - RNA, 64 nt, hsa; identical to SEQ ID NO: 234662

SEQ ID NO: 641854 - RNA, 64 nt, hsa; identical to SEQ ID NO: 234663

SEQ ID NO: 641855 - RNA, 64 nt, hsa; identical to SEQ ID NO: 234664

SEQ ID NO: 641856 - RNA, 64 nt, hsa; identical to SEQ ID NO: 234665

SEQ ID NO: 641857 - RNA, 63 nt, hsa; identical to SEQ ID NO: 234666

SEQ ID NO: 641858 - RNA, 64 nt, hsa; identical to SEQ ID NO: 234667

SEQ ID NO: 641859 - RNA, 64 nt, hsa; identical to SEQ ID NO: 234668

SEQ ID NO: 641860 - RNA, 64 nt, hsa; identical to SEQ ID NO: 234669

SEQ ID NO: 641861 - RNA, 64 nt, hsa; identical to SEQ ID NO: 234670

SEQ ID NO: 641862 - RNA, 64 nt, hsa; identical to SEQ ID NO: 234671

SEQ ID NO: 641863 - RNA, 64 nt, hsa; identical to SEQ ID NO: 234672

SEQ ID NO: 641864 - RNA, 64 nt, hsa; identical to SEQ ID NO: 234673

SEQ ID NO: 641865 - RNA, 64 nt, hsa; identical to SEQ ID NO: 234674

SEQ ID NO: 641866 - RNA, 64 nt, hsa; identical to SEQ ID NO: 234675

SEQ ID NO: 641867 - RNA, 64 nt, hsa; identical to SEQ ID NO: 234676

SEQ ID NO: 641868 - RNA, 64 nt, hsa; identical to SEQ ID NO: 234677

SEQ ID NO: 641869 - RNA, 64 nt, hsa; identical to SEQ ID NO: 234678

SEQ ID NO: 641870 - RNA, 64 nt, hsa; identical to SEQ ID NO: 234679

SEQ ID NO: 641871 - RNA, 64 nt, hsa; identical to SEQ ID NO: 234680

SEQ ID NO: 641872 - RNA, 64 nt, hsa; identical to SEQ ID NO: 234681

SEQ ID NO: 641873 - RNA, 64 nt, hsa; identical to SEQ ID NO: 234682

SEQ ID NO: 641874 - RNA, 64 nt, hsa; identical to SEQ ID NO: 234683

SEQ ID NO: 641875 - RNA, 64 nt, hsa; identical to SEQ ID NO: 234684

SEQ ID NO: 641876 - RNA, 64 nt, hsa; identical to SEQ ID NO: 234685

SEQ ID NO: 641877 - RNA, 64 nt, hsa; identical to SEQ ID NO: 234686

SEQ ID NO: 641878 - RNA, 64 nt, hsa; identical to SEQ ID NO: 234687

SEQ ID NO: 641879 - RNA, 64 nt, hsa; identical to SEQ ID NO: 234688

SEQ ID NO: 641880 - RNA, 64 nt, hsa; identical to SEQ ID NO: 234689

SEQ ID NO: 641881 - RNA, 64 nt, hsa; identical to SEQ ID NO: 234690

SEQ ID NO: 641882 - RNA, 64 nt, hsa; identical to SEQ ID NO: 234691

SEQ ID NO: 641883 - RNA, 64 nt, hsa; identical to SEQ ID NO: 234692

SEQ ID NO: 641884 - RNA, 64 nt, hsa; identical to SEQ ID NO: 234693

SEQ ID NO: 641885 - RNA, 64 nt, hsa; identical to SEQ ID NO: 234694

SEQ ID NO: 641886 - RNA, 64 nt, hsa; identical to SEQ ID NO: 234695

SEQ ID NO: 641887 - RNA, 64 nt, hsa; identical to SEQ ID NO: 234696

SEQ ID NO: 641888 - RNA, 64 nt, hsa; identical to SEQ ID NO: 555802

SEQ ID NO: 641889 - RNA, 64 nt, hsa; identical to SEQ ID NO: 555803

SEQ ID NO: 641890 - RNA, 64 nt, hsa; identical to SEQ ID NO: 555804

SEQ ID NO: 641891 - RNA, 64 nt, hsa; identical to SEQ ID NO: 555805

SEQ ID NO: 641892 - RNA, 64 nt, hsa; identical to SEQ ID NO: 555806

SEQ ID NO: 641893 - RNA, 64 nt, hsa; identical to SEQ ID NO: 555807

SEQ ID NO: 641894 - RNA, 64 nt, hsa; identical to SEQ ID NO: 555808

SEQ ID NO: 641895 - RNA, 64 nt, hsa; identical to SEQ ID NO: 555809

SEQ ID NO: 641896 - RNA, 64 nt, hsa
uaaaccagaaaggugauuccaggaggaguuagccaaacaacaacaaaaacaaaaaaugugcugu

SEQ ID NO: 641897 - RNA, 64 nt, hsa
gaauccagcugggcuagaggcugagcaccuuuggaaacaacauuuaagggaaugugagcacaau

SEQ ID NO: 641898 - RNA, 64 nt, hsa
ccugaagaugaguaaaacuggugggucuuuaauaaaacaacaacaaaaacagcaguuugugaua

SEQ ID NO: 641899 - RNA, 64 nt, hsa
aaccagguugcaguagcaguggauguuagccugcaaacaacauuaggggauucuucuuuugugu

SEQ ID NO: 641900 - RNA, 64 nt, hsa
acuacagagugagacuccaucucaaaacaaaacaaaacaacaacagcaaaaaacaacaaaacaa

SEQ ID NO: 641901 - RNA, 64 nt, hsa
ccaucucaaaacaaaacaaaacaacaacagcaaaaaacaacaaaacaaaacacaaauacucuca

SEQ ID NO: 641902 - RNA, 64 nt, hsa
acugguacgguagucuguggaaaccaggaagauaaaacaacagccacaaaagagaaaaucaaga

SEQ ID NO: 641903 - RNA, 64 nt, hsa
uuaugagaauuucacauuggaauucauaaugguaaaacaacauacaucugccaauauacguuuu

SEQ ID NO: 641904 - RNA, 64 nt, hsa
acugcaucucaaaaaaaacccaaaaaacaaaaacaaacaacaacaacaaaauuauaaagguaga

SEQ ID NO: 641905 - RNA, 64 nt, hsa
cuggccaacaugguaaaacccugucucuacugaaaaacaacaaaaacaaaaacacaaauuaguc

SEQ ID NO: 641906 - RNA, 64 nt, hsa
uagaagcaauauuuucacuuauuuaacauucuccaaacaacaucaagcauugauacacacugaa

SEQ ID NO: 641907 - RNA, 64 nt, hsa
caauuacaccaguucuggggcaaagacacugaugaaacaacacccauaccugaaaagaauaaau

SEQ ID NO: 641908 - RNA, 64 nt, hsa
uguaauuuaauguguuuuauauucuuuuguaguaaaacaacauaacucagauuucuacaggaga

SEQ ID NO: 641909 - RNA, 64 nt, hsa
auagcaagaccccgucucuacaaagcacaacgaaaaacaacaaauggaguugugcuauguugua

SEQ ID NO: 641910 - RNA, 64 nt, hsa
uauauguaaaguauuauuuauuugaaucuacaaaaaacaacaaauaauuuuuaaauauaaggau

SEQ ID NO: 641911 - RNA, 64 nt, hsa
caauuggguacccaguuaaauuuucauuucagauaaacaacaaauaauuuuuuaguauaaguac

SEQ ID NO: 641912 - RNA, 64 nt, hsa
uugugucuaguuugaagcuucuuguauuugucuaaaacaacaagccagaauuuuguaucuccuu

SEQ ID NO: 641913 - RNA, 64 nt, hsa
cauuuccuuacacguuucuagcaugggucagaggaaacaacauuuguguuauaacuucgucuug

SEQ ID NO: 641914 - RNA, 64 nt, hsa
acuaguaaguucaucuaguccuuuucaaauagaaaaacaacaaaacccaugaaauggaaaagag

SEQ ID NO: 641915 - RNA, 64 nt, hsa
cugcauaaagauauccagcuuggguacccuacuaaaacaacaucaccaucuuuuucauuauaua

SEQ ID NO: 641916 - RNA, 64 nt, hsa
aauauuuuuuuuuugagcauggcuaguggauuuaaaacaacacauaccugucacugcuggaguc

SEQ ID NO: 641917 - RNA, 64 nt, hsa
ggaauaguuuaacccagcaacuuuccuuuuuauaaaacaacaaaugguucaacucugucugcaa

SEQ ID NO: 641918 - RNA, 64 nt, hsa
aauaggcaaaauguuuauuuuccuuauuguuuguaaacaacaaacuuggucuuacaucugugug

SEQ ID NO: 641919 - RNA, 64 nt, hsa
aaaguuuaacacaauuuaagggcucagcauaaguaaacaacauauuugggguuugcuuguaaaa

SEQ ID NO: 641920 - RNA, 64 nt, hsa
aguccugcuauguuaaaaacaaacaacaaaaaacaaacaacaaaaaaaaaauuaaaaaaaaaaa

SEQ ID NO: 641921 - RNA, 64 nt, hsa
aauaucaccaaagaaguccugcuauguuaaaaacaaacaacaaaaaacaaacaacaaaaaaaaa

SEQ ID NO: 641922 - RNA, 64 nt, hsa
ugagcugguagaggggagacauuagaaaaaaaugaaacaacaaaacaauuacuaaugagguacg

SEQ ID NO: 641923 - RNA, 64 nt, hsa
uggaaaucucagauucuucacuggugagacaaugaaacaacagagacagugaaaguuuuaauac

SEQ ID NO: 641924 - RNA, 64 nt, hsa
aauauuccuuaguagaauguauauuuaagaaauaaaacaacaaaggggaacuauaucacccaug

SEQ ID NO: 641925 - RNA, 64 nt, hsa
uccuugagaagcagcuuucaugcuuauuccuuaaaaacaacagaagaguguuuauccugagauu

SEQ ID NO: 641926 - RNA, 64 nt, hsa
uaggacaguaaaacguuaaaguacuggauuaagaaaacaacaacaggcugggcgcaguggcuca

SEQ ID NO: 641927 - RNA, 64 nt, hsa
ccucugucucaaaaaauaauaauaauaauaaauaaaacaacaacaaaaugcaucagagagccaa

SEQ ID NO: 641928 - RNA, 64 nt, hsa
ugucacuguacaguuuuguggacugagcgaggaaaaacaacaaauaauuuaaguuggcuagagc

SEQ ID NO: 641929 - RNA, 64 nt, hsa
uuuaugaccagagcaaaaauguaaaaaacaaaaaaaacaacaaaaaaaguuuguuacuuugaau

SEQ ID NO: 641930 - RNA, 64 nt, hsa
aacauuuuuagguuuuacagagauuuuaaccuuuaaacaacagaucuuuaaaaaacaggugaau

SEQ ID NO: 641931 - RNA, 64 nt, hsa
aucuuuguccuaacaugagugcuuguaacaaaauaaacaacaaaaacaaagccaaaaacuaccu

SEQ ID NO: 641932 - RNA, 64 nt, hsa
agucuauaaaaacaguuuuacuugcaauccauuaaaacaacaaacgaaaccuagugaagcaucu

SEQ ID NO: 641933 - RNA, 64 nt, hsa
gaaagacugguuauuucuccuuuguguaagugauaaacaacagcaaauauacuugaauaaaaug

SEQ ID NO: 641934 - RNA, 64 nt, hsa
gcauacuguggagaaccauuaaaaauuugagaagaaacaacaaguauuaugucaacuuacuuca

SEQ ID NO: 641935 - RNA, 64 nt, hsa
cucagugcugucugaagaugcaguugcuguuugcaaacaacaggaacaccaguuaaacuaauua

SEQ ID NO: 641936 - RNA, 64 nt, hsa
gaaaacuguuucuauaaggaaauaauacuuuuuuaaacaacaaccaaaaaaugccuugcugauu

SEQ ID NO: 641937 - RNA, 64 nt, hsa
ccacauuaacuauaucauguucucgguauuuuaaaaacaacaacaaccauauuugucacagaaa

SEQ ID NO: 641938 - RNA, 64 nt, hsa
ccaaagaauaagccaucauauuuuuucgguguugaaacaacauugaaagucagaauuggauuug

SEQ ID NO: 641939 - RNA, 64 nt, hsa
uuauuuucuguauguguuaauuuuacaaauaggcaaacaacauaacuuugcccuggauugacua

SEQ ID NO: 641940 - RNA, 64 nt, hsa
cugucuuaggaauuauuaggaguugauuccugagaaacaacacauuuuuccccaugaacggugc

SEQ ID NO: 641941 - RNA, 64 nt, hsa
ugggagagacucagugagccagcaaaggccauagaaacaacaauuuauuaaauguauuuauggc

SEQ ID NO: 641942 - RNA, 64 nt, hsa
cauuugaacucaacuuagcucacacucagugauaaaacaacaugguauguagaagccuaggauc

SEQ ID NO: 641943 - RNA, 64 nt, hsa
aguagucuggcccacauuuucaaccuaguagaacaaacaacaggaaaucuuuuuuuuguuguuu

SEQ ID NO: 641944 - RNA, 64 nt, hsa
uuuguaauuacggagaggaacaaaccaucuauugaaacaacaagugccucagagauguauauau

SEQ ID NO: 641945 - RNA, 64 nt, hsa
aucguacauuauuaaaauuauucugacaguauacaaacaacaaaauuaucuauuuuccagagau

SEQ ID NO: 641946 - RNA, 64 nt, hsa
gccccuaaguuaauauuucaaacaaucgaagguaaaacaacauauuguguugggccaccuguac

SEQ ID NO: 641947 - RNA, 64 nt, hsa
uuuuugaaggacuugggagcucucuuugaaaggcaaacaacaagggaaacaguaccuuuaucuc

SEQ ID NO: 641948 - RNA, 64 nt, hsa
ugcuaaauauugaagugguuguaacaauuuguuaaaacaacaaugaaauuuaccacauuaacug

SEQ ID NO: 641949 - RNA, 64 nt, hsa
uccagccugggcgacacagcaaguucuuguuuccaaacaacaacaaaacaaaacaaaaaaaaaa

SEQ ID NO: 641950 - RNA, 64 nt, hsa; identical to SEQ ID NO: 125939

SEQ ID NO: 641951 - RNA, 64 nt, hsa; identical to SEQ ID NO: 125940

SEQ ID NO: 641952 - RNA, 64 nt, hsa; identical to SEQ ID NO: 125941

SEQ ID NO: 641953 - RNA, 64 nt, hsa; identical to SEQ ID NO: 125942

SEQ ID NO: 641954 - RNA, 64 nt, hsa; identical to SEQ ID NO: 125943

SEQ ID NO: 641955 - RNA, 64 nt, hsa; identical to SEQ ID NO: 125944

SEQ ID NO: 641956 - RNA, 64 nt, hsa; identical to SEQ ID NO: 125945

SEQ ID NO: 641957 - RNA, 64 nt, hsa; identical to SEQ ID NO: 125946

SEQ ID NO: 641958 - RNA, 64 nt, hsa; identical to SEQ ID NO: 125947

SEQ ID NO: 641959 - RNA, 64 nt, hsa; identical to SEQ ID NO: 125948

SEQ ID NO: 641960 - RNA, 64 nt, hsa; identical to SEQ ID NO: 125949

SEQ ID NO: 641961 - RNA, 64 nt, hsa; identical to SEQ ID NO: 125950

SEQ ID NO: 641962 - RNA, 64 nt, hsa; identical to SEQ ID NO: 125951

SEQ ID NO: 641963 - RNA, 64 nt, hsa; identical to SEQ ID NO: 125952

SEQ ID NO: 641964 - RNA, 64 nt, hsa; identical to SEQ ID NO: 93178

SEQ ID NO: 641965 - RNA, 64 nt, hsa; identical to SEQ ID NO: 93179

SEQ ID NO: 641966 - RNA, 64 nt, hsa; identical to SEQ ID NO: 93180

SEQ ID NO: 641967 - RNA, 64 nt, hsa; identical to SEQ ID NO: 93181

SEQ ID NO: 641968 - RNA, 64 nt, hsa; identical to SEQ ID NO: 294262

SEQ ID NO: 641969 - RNA, 64 nt, hsa; identical to SEQ ID NO: 294263

SEQ ID NO: 641970 - RNA, 64 nt, hsa; identical to SEQ ID NO: 294264

SEQ ID NO: 641971 - RNA, 64 nt, hsa; identical to SEQ ID NO: 294265

SEQ ID NO: 641972 - RNA, 64 nt, hsa; identical to SEQ ID NO: 294266

SEQ ID NO: 641973 - RNA, 64 nt, hsa; identical to SEQ ID NO: 294267

SEQ ID NO: 641974 - RNA, 64 nt, hsa; identical to SEQ ID NO: 294268

SEQ ID NO: 641975 - RNA, 64 nt, hsa; identical to SEQ ID NO: 294269

SEQ ID NO: 641976 - RNA, 64 nt, hsa; identical to SEQ ID NO: 294270

SEQ ID NO: 641977 - RNA, 64 nt, hsa; identical to SEQ ID NO: 294271

SEQ ID NO: 641978 - RNA, 64 nt, hsa; identical to SEQ ID NO: 294272

SEQ ID NO: 641979 - RNA, 64 nt, hsa; identical to SEQ ID NO: 294273

SEQ ID NO: 641980 - RNA, 64 nt, hsa; identical to SEQ ID NO: 294274

SEQ ID NO: 641981 - RNA, 64 nt, hsa; identical to SEQ ID NO: 294275

SEQ ID NO: 641982 - RNA, 64 nt, hsa; identical to SEQ ID NO: 294276

SEQ ID NO: 641983 - RNA, 64 nt, hsa; identical to SEQ ID NO: 294277

SEQ ID NO: 641984 - RNA, 64 nt, hsa; identical to SEQ ID NO: 294278

SEQ ID NO: 641985 - RNA, 64 nt, hsa; identical to SEQ ID NO: 294279

SEQ ID NO: 641986 - RNA, 64 nt, hsa; identical to SEQ ID NO: 294280

SEQ ID NO: 641987 - RNA, 64 nt, hsa; identical to SEQ ID NO: 294281

SEQ ID NO: 641988 - RNA, 64 nt, hsa; identical to SEQ ID NO: 294282

SEQ ID NO: 641989 - RNA, 64 nt, hsa; identical to SEQ ID NO: 294283

SEQ ID NO: 641990 - RNA, 64 nt, hsa; identical to SEQ ID NO: 294284

SEQ ID NO: 641991 - RNA, 64 nt, hsa; identical to SEQ ID NO: 294285

SEQ ID NO: 641992 - RNA, 64 nt, hsa; identical to SEQ ID NO: 294286

SEQ ID NO: 641993 - RNA, 64 nt, hsa; identical to SEQ ID NO: 294287

SEQ ID NO: 641994 - RNA, 64 nt, hsa; identical to SEQ ID NO: 294288

SEQ ID NO: 641995 - RNA, 64 nt, hsa; identical to SEQ ID NO: 294289

SEQ ID NO: 641996 - RNA, 64 nt, hsa; identical to SEQ ID NO: 294290

SEQ ID NO: 641997 - RNA, 64 nt, hsa; identical to SEQ ID NO: 294291

SEQ ID NO: 641998 - RNA, 64 nt, hsa; identical to SEQ ID NO: 294292

SEQ ID NO: 641999 - RNA, 64 nt, hsa; identical to SEQ ID NO: 294293

SEQ ID NO: 642000 - RNA, 64 nt, hsa; identical to SEQ ID NO: 294294

SEQ ID NO: 642001 - RNA, 64 nt, hsa; identical to SEQ ID NO: 294295

SEQ ID NO: 642002 - RNA, 64 nt, hsa; identical to SEQ ID NO: 294296

SEQ ID NO: 642003 - RNA, 64 nt, hsa; identical to SEQ ID NO: 294297

SEQ ID NO: 642004 - RNA, 64 nt, hsa; identical to SEQ ID NO: 294298

SEQ ID NO: 642005 - RNA, 64 nt, hsa; identical to SEQ ID NO: 294299

SEQ ID NO: 642006 - RNA, 64 nt, hsa; identical to SEQ ID NO: 313491

SEQ ID NO: 642007 - RNA, 64 nt, hsa; identical to SEQ ID NO: 313492

SEQ ID NO: 642008 - RNA, 64 nt, hsa; identical to SEQ ID NO: 579141

SEQ ID NO: 642009 - RNA, 64 nt, hsa; identical to SEQ ID NO: 579142

SEQ ID NO: 642010 - RNA, 64 nt, hsa; identical to SEQ ID NO: 579143

SEQ ID NO: 642011 - RNA, 64 nt, hsa; identical to SEQ ID NO: 579144

SEQ ID NO: 642012 - RNA, 64 nt, hsa; identical to SEQ ID NO: 579145

SEQ ID NO: 642013 - RNA, 64 nt, hsa; identical to SEQ ID NO: 579146

SEQ ID NO: 642014 - RNA, 64 nt, hsa; identical to SEQ ID NO: 579147

SEQ ID NO: 642015 - RNA, 64 nt, hsa; identical to SEQ ID NO: 579148

SEQ ID NO: 642016 - RNA, 58 nt, hsa; identical to SEQ ID NO: 579149

SEQ ID NO: 642017 - RNA, 64 nt, hsa; identical to SEQ ID NO: 579150

SEQ ID NO: 642018 - RNA, 64 nt, hsa; identical to SEQ ID NO: 579151

SEQ ID NO: 642019 - RNA, 64 nt, hsa; identical to SEQ ID NO: 579152

SEQ ID NO: 642020 - RNA, 64 nt, hsa; identical to SEQ ID NO: 579153

SEQ ID NO: 642021 - RNA, 64 nt, hsa; identical to SEQ ID NO: 579154

SEQ ID NO: 642022 - RNA, 64 nt, hsa; identical to SEQ ID NO: 579155

SEQ ID NO: 642023 - RNA, 64 nt, hsa; identical to SEQ ID NO: 579156

SEQ ID NO: 642024 - RNA, 64 nt, hsa; identical to SEQ ID NO: 579157

SEQ ID NO: 642025 - RNA, 64 nt, hsa; identical to SEQ ID NO: 579158

SEQ ID NO: 642026 - RNA, 64 nt, hsa; identical to SEQ ID NO: 579159

SEQ ID NO: 642027 - RNA, 64 nt, hsa; identical to SEQ ID NO: 579160

SEQ ID NO: 642028 - RNA, 64 nt, hsa; identical to SEQ ID NO: 579161

SEQ ID NO: 642029 - RNA, 64 nt, hsa; identical to SEQ ID NO: 579162

SEQ ID NO: 642030 - RNA, 64 nt, hsa; identical to SEQ ID NO: 579163

SEQ ID NO: 642031 - RNA, 64 nt, hsa; identical to SEQ ID NO: 579164

SEQ ID NO: 642032 - RNA, 64 nt, hsa; identical to SEQ ID NO: 579165

SEQ ID NO: 642033 - RNA, 64 nt, hsa; identical to SEQ ID NO: 579166

SEQ ID NO: 642034 - RNA, 64 nt, hsa; identical to SEQ ID NO: 579167

SEQ ID NO: 642035 - RNA, 64 nt, hsa; identical to SEQ ID NO: 579168

SEQ ID NO: 642036 - RNA, 64 nt, hsa; identical to SEQ ID NO: 579169

SEQ ID NO: 642037 - RNA, 64 nt, hsa; identical to SEQ ID NO: 579170

SEQ ID NO: 642038 - RNA, 64 nt, hsa; identical to SEQ ID NO: 105816

SEQ ID NO: 642039 - RNA, 64 nt, hsa; identical to SEQ ID NO: 105817

SEQ ID NO: 642040 - RNA, 64 nt, hsa; identical to SEQ ID NO: 105818

SEQ ID NO: 642041 - RNA, 64 nt, hsa; identical to SEQ ID NO: 105819

SEQ ID NO: 642042 - RNA, 64 nt, hsa; identical to SEQ ID NO: 105820

SEQ ID NO: 642043 - RNA, 64 nt, hsa; identical to SEQ ID NO: 105821

SEQ ID NO: 642044 - RNA, 64 nt, hsa; identical to SEQ ID NO: 105822

SEQ ID NO: 642045 - RNA, 64 nt, hsa; identical to SEQ ID NO: 105823

SEQ ID NO: 642046 - RNA, 64 nt, hsa; identical to SEQ ID NO: 105824

SEQ ID NO: 642047 - RNA, 64 nt, hsa; identical to SEQ ID NO: 105825

SEQ ID NO: 642048 - RNA, 64 nt, hsa; identical to SEQ ID NO: 105826

SEQ ID NO: 642049 - RNA, 64 nt, hsa; identical to SEQ ID NO: 105827

SEQ ID NO: 642050 - RNA, 64 nt, hsa; identical to SEQ ID NO: 105828

SEQ ID NO: 642051 - RNA, 64 nt, hsa; identical to SEQ ID NO: 105829

SEQ ID NO: 642052 - RNA, 64 nt, hsa; identical to SEQ ID NO: 105830

SEQ ID NO: 642053 - RNA, 64 nt, hsa; identical to SEQ ID NO: 105831

SEQ ID NO: 642054 - RNA, 64 nt, hsa; identical to SEQ ID NO: 105832

SEQ ID NO: 642055 - RNA, 64 nt, hsa; identical to SEQ ID NO: 105833

SEQ ID NO: 642056 - RNA, 64 nt, hsa; identical to SEQ ID NO: 105834

SEQ ID NO: 642057 - RNA, 64 nt, hsa; identical to SEQ ID NO: 105835

SEQ ID NO: 642058 - RNA, 64 nt, hsa; identical to SEQ ID NO: 105836

SEQ ID NO: 642059 - RNA, 64 nt, hsa; identical to SEQ ID NO: 105837

SEQ ID NO: 642060 - RNA, 64 nt, hsa; identical to SEQ ID NO: 105838

SEQ ID NO: 642061 - RNA, 64 nt, hsa; identical to SEQ ID NO: 105839

SEQ ID NO: 642062 - RNA, 64 nt, hsa; identical to SEQ ID NO: 105840

SEQ ID NO: 642063 - RNA, 64 nt, hsa; identical to SEQ ID NO: 105841

SEQ ID NO: 642064 - RNA, 64 nt, hsa; identical to SEQ ID NO: 105842

SEQ ID NO: 642065 - RNA, 64 nt, hsa; identical to SEQ ID NO: 105843

SEQ ID NO: 642066 - RNA, 64 nt, hsa; identical to SEQ ID NO: 105844

SEQ ID NO: 642067 - RNA, 64 nt, hsa; identical to SEQ ID NO: 105845

SEQ ID NO: 642068 - RNA, 64 nt, hsa; identical to SEQ ID NO: 105846

SEQ ID NO: 642069 - RNA, 64 nt, hsa; identical to SEQ ID NO: 105847

SEQ ID NO: 642070 - RNA, 64 nt, hsa; identical to SEQ ID NO: 105848

SEQ ID NO: 642071 - RNA, 64 nt, hsa; identical to SEQ ID NO: 105849

SEQ ID NO: 642072 - RNA, 64 nt, hsa; identical to SEQ ID NO: 105850

SEQ ID NO: 642073 - RNA, 64 nt, hsa; identical to SEQ ID NO: 105851

SEQ ID NO: 642074 - RNA, 64 nt, hsa; identical to SEQ ID NO: 105852

SEQ ID NO: 642075 - RNA, 64 nt, hsa; identical to SEQ ID NO: 105853

SEQ ID NO: 642076 - RNA, 64 nt, hsa; identical to SEQ ID NO: 105854

SEQ ID NO: 642077 - RNA, 64 nt, hsa; identical to SEQ ID NO: 105855

SEQ ID NO: 642078 - RNA, 64 nt, hsa; identical to SEQ ID NO: 105856

SEQ ID NO: 642079 - RNA, 64 nt, hsa; identical to SEQ ID NO: 105857

SEQ ID NO: 642080 - RNA, 64 nt, hsa; identical to SEQ ID NO: 105858

SEQ ID NO: 642081 - RNA, 64 nt, hsa; identical to SEQ ID NO: 105859

SEQ ID NO: 642082 - RNA, 64 nt, hsa; identical to SEQ ID NO: 105860

SEQ ID NO: 642083 - RNA, 64 nt, hsa; identical to SEQ ID NO: 105861

SEQ ID NO: 642084 - RNA, 64 nt, hsa; identical to SEQ ID NO: 105862

SEQ ID NO: 642085 - RNA, 64 nt, hsa; identical to SEQ ID NO: 105863

SEQ ID NO: 642086 - RNA, 64 nt, hsa; identical to SEQ ID NO: 105864

SEQ ID NO: 642087 - RNA, 64 nt, hsa; identical to SEQ ID NO: 105865

SEQ ID NO: 642088 - RNA, 64 nt, hsa; identical to SEQ ID NO: 105866

SEQ ID NO: 642089 - RNA, 64 nt, hsa; identical to SEQ ID NO: 105867

SEQ ID NO: 642090 - RNA, 64 nt, hsa; identical to SEQ ID NO: 105868

SEQ ID NO: 642091 - RNA, 64 nt, hsa; identical to SEQ ID NO: 105869

SEQ ID NO: 642092 - RNA, 64 nt, hsa; identical to SEQ ID NO: 105870

SEQ ID NO: 642093 - RNA, 64 nt, hsa; identical to SEQ ID NO: 105871

SEQ ID NO: 642094 - RNA, 64 nt, hsa; identical to SEQ ID NO: 105872

SEQ ID NO: 642095 - RNA, 64 nt, hsa; identical to SEQ ID NO: 105873

SEQ ID NO: 642096 - RNA, 64 nt, hsa; identical to SEQ ID NO: 105874

SEQ ID NO: 642097 - RNA, 64 nt, hsa; identical to SEQ ID NO: 105875

SEQ ID NO: 642098 - RNA, 64 nt, hsa; identical to SEQ ID NO: 105876

SEQ ID NO: 642099 - RNA, 64 nt, hsa; identical to SEQ ID NO: 105877

SEQ ID NO: 642100 - RNA, 64 nt, hsa; identical to SEQ ID NO: 105878

SEQ ID NO: 642101 - RNA, 64 nt, hsa; identical to SEQ ID NO: 105879

SEQ ID NO: 642102 - RNA, 64 nt, hsa; identical to SEQ ID NO: 105880

SEQ ID NO: 642103 - RNA, 64 nt, hsa; identical to SEQ ID NO: 105881

SEQ ID NO: 642104 - RNA, 64 nt, hsa; identical to SEQ ID NO: 105882

SEQ ID NO: 642105 - RNA, 64 nt, hsa; identical to SEQ ID NO: 105883

SEQ ID NO: 642106 - RNA, 64 nt, hsa; identical to SEQ ID NO: 105884

SEQ ID NO: 642107 - RNA, 64 nt, hsa; identical to SEQ ID NO: 105885

SEQ ID NO: 642108 - RNA, 64 nt, hsa; identical to SEQ ID NO: 105886

SEQ ID NO: 642109 - RNA, 64 nt, hsa; identical to SEQ ID NO: 105887

SEQ ID NO: 642110 - RNA, 64 nt, hsa; identical to SEQ ID NO: 105888

SEQ ID NO: 642111 - RNA, 64 nt, hsa; identical to SEQ ID NO: 105889

SEQ ID NO: 642112 - RNA, 64 nt, hsa; identical to SEQ ID NO: 105890

SEQ ID NO: 642113 - RNA, 64 nt, hsa; identical to SEQ ID NO: 105891

SEQ ID NO: 642114 - RNA, 64 nt, hsa; identical to SEQ ID NO: 105892

SEQ ID NO: 642115 - RNA, 64 nt, hsa; identical to SEQ ID NO: 105893

SEQ ID NO: 642116 - RNA, 64 nt, hsa; identical to SEQ ID NO: 105894

SEQ ID NO: 642117 - RNA, 64 nt, hsa; identical to SEQ ID NO: 105895

SEQ ID NO: 642118 - RNA, 64 nt, hsa; identical to SEQ ID NO: 105896

SEQ ID NO: 642119 - RNA, 64 nt, hsa; identical to SEQ ID NO: 105897

SEQ ID NO: 642120 - RNA, 64 nt, hsa; identical to SEQ ID NO: 105898

SEQ ID NO: 642121 - RNA, 64 nt, hsa; identical to SEQ ID NO: 105899

SEQ ID NO: 642122 - RNA, 64 nt, hsa; identical to SEQ ID NO: 105900

SEQ ID NO: 642123 - RNA, 64 nt, hsa; identical to SEQ ID NO: 105901

SEQ ID NO: 642124 - RNA, 64 nt, hsa; identical to SEQ ID NO: 105902

SEQ ID NO: 642125 - RNA, 64 nt, hsa; identical to SEQ ID NO: 105903

SEQ ID NO: 642126 - RNA, 64 nt, hsa; identical to SEQ ID NO: 105904

SEQ ID NO: 642127 - RNA, 64 nt, hsa; identical to SEQ ID NO: 105905

SEQ ID NO: 642128 - RNA, 64 nt, hsa; identical to SEQ ID NO: 105906

SEQ ID NO: 642129 - RNA, 64 nt, hsa; identical to SEQ ID NO: 105907

SEQ ID NO: 642130 - RNA, 64 nt, hsa; identical to SEQ ID NO: 105908

SEQ ID NO: 642131 - RNA, 64 nt, hsa; identical to SEQ ID NO: 105909

SEQ ID NO: 642132 - RNA, 64 nt, hsa; identical to SEQ ID NO: 105910

SEQ ID NO: 642133 - RNA, 64 nt, hsa; identical to SEQ ID NO: 105911

SEQ ID NO: 642134 - RNA, 64 nt, hsa; identical to SEQ ID NO: 105912

SEQ ID NO: 642135 - RNA, 64 nt, hsa; identical to SEQ ID NO: 105913

SEQ ID NO: 642136 - RNA, 64 nt, hsa; identical to SEQ ID NO: 105914

SEQ ID NO: 642137 - RNA, 64 nt, hsa; identical to SEQ ID NO: 105915

SEQ ID NO: 642138 - RNA, 64 nt, hsa; identical to SEQ ID NO: 105916

SEQ ID NO: 642139 - RNA, 64 nt, hsa; identical to SEQ ID NO: 105917

SEQ ID NO: 642140 - RNA, 64 nt, hsa; identical to SEQ ID NO: 105918

SEQ ID NO: 642141 - RNA, 64 nt, hsa; identical to SEQ ID NO: 105919

SEQ ID NO: 642142 - RNA, 64 nt, hsa; identical to SEQ ID NO: 105920

SEQ ID NO: 642143 - RNA, 64 nt, hsa; identical to SEQ ID NO: 105921

SEQ ID NO: 642144 - RNA, 64 nt, hsa; identical to SEQ ID NO: 105922

SEQ ID NO: 642145 - RNA, 64 nt, hsa; identical to SEQ ID NO: 105923

SEQ ID NO: 642146 - RNA, 64 nt, hsa; identical to SEQ ID NO: 105924

SEQ ID NO: 642147 - RNA, 64 nt, hsa; identical to SEQ ID NO: 105925

SEQ ID NO: 642148 - RNA, 64 nt, hsa; identical to SEQ ID NO: 105926

SEQ ID NO: 642149 - RNA, 64 nt, hsa; identical to SEQ ID NO: 105927

SEQ ID NO: 642150 - RNA, 64 nt, hsa; identical to SEQ ID NO: 105928

SEQ ID NO: 642151 - RNA, 64 nt, hsa; identical to SEQ ID NO: 105929

SEQ ID NO: 642152 - RNA, 61 nt, hsa; identical to SEQ ID NO: 105930

SEQ ID NO: 642153 - RNA, 64 nt, hsa; identical to SEQ ID NO: 105931

SEQ ID NO: 642154 - RNA, 64 nt, hsa; identical to SEQ ID NO: 105932

SEQ ID NO: 642155 - RNA, 64 nt, hsa; identical to SEQ ID NO: 105933

SEQ ID NO: 642156 - RNA, 64 nt, hsa; identical to SEQ ID NO: 105934

SEQ ID NO: 642157 - RNA, 64 nt, hsa; identical to SEQ ID NO: 105935

SEQ ID NO: 642158 - RNA, 64 nt, hsa; identical to SEQ ID NO: 105936

SEQ ID NO: 642159 - RNA, 64 nt, hsa; identical to SEQ ID NO: 105937

SEQ ID NO: 642160 - RNA, 64 nt, hsa; identical to SEQ ID NO: 105938

SEQ ID NO: 642161 - RNA, 64 nt, hsa; identical to SEQ ID NO: 105939

SEQ ID NO: 642162 - RNA, 64 nt, hsa; identical to SEQ ID NO: 105940

SEQ ID NO: 642163 - RNA, 64 nt, hsa; identical to SEQ ID NO: 105941

SEQ ID NO: 642164 - RNA, 64 nt, hsa; identical to SEQ ID NO: 105942

SEQ ID NO: 642165 - RNA, 64 nt, hsa; identical to SEQ ID NO: 105943

SEQ ID NO: 642166 - RNA, 64 nt, hsa; identical to SEQ ID NO: 105944

SEQ ID NO: 642167 - RNA, 64 nt, hsa; identical to SEQ ID NO: 105945

SEQ ID NO: 642168 - RNA, 64 nt, hsa; identical to SEQ ID NO: 105946

SEQ ID NO: 642169 - RNA, 64 nt, hsa; identical to SEQ ID NO: 105947

SEQ ID NO: 642170 - RNA, 64 nt, hsa; identical to SEQ ID NO: 105948

SEQ ID NO: 642171 - RNA, 64 nt, hsa; identical to SEQ ID NO: 105949

SEQ ID NO: 642172 - RNA, 64 nt, hsa; identical to SEQ ID NO: 105950

SEQ ID NO: 642173 - RNA, 64 nt, hsa; identical to SEQ ID NO: 105951

SEQ ID NO: 642174 - RNA, 64 nt, hsa; identical to SEQ ID NO: 105952

SEQ ID NO: 642175 - RNA, 64 nt, hsa; identical to SEQ ID NO: 105953

SEQ ID NO: 642176 - RNA, 64 nt, hsa; identical to SEQ ID NO: 105954

SEQ ID NO: 642177 - RNA, 61 nt, hsa; identical to SEQ ID NO: 105955

SEQ ID NO: 642178 - RNA, 64 nt, hsa; identical to SEQ ID NO: 105956

SEQ ID NO: 642179 - RNA, 64 nt, hsa; identical to SEQ ID NO: 105957

SEQ ID NO: 642180 - RNA, 64 nt, hsa; identical to SEQ ID NO: 105958

SEQ ID NO: 642181 - RNA, 64 nt, hsa; identical to SEQ ID NO: 105959

SEQ ID NO: 642182 - RNA, 64 nt, hsa; identical to SEQ ID NO: 105960

SEQ ID NO: 642183 - RNA, 64 nt, hsa; identical to SEQ ID NO: 105961

SEQ ID NO: 642184 - RNA, 64 nt, hsa; identical to SEQ ID NO: 105962

SEQ ID NO: 642185 - RNA, 64 nt, hsa; identical to SEQ ID NO: 105963

SEQ ID NO: 642186 - RNA, 64 nt, hsa; identical to SEQ ID NO: 105964

SEQ ID NO: 642187 - RNA, 64 nt, hsa; identical to SEQ ID NO: 105965

SEQ ID NO: 642188 - RNA, 64 nt, hsa; identical to SEQ ID NO: 105966

SEQ ID NO: 642189 - RNA, 64 nt, hsa; identical to SEQ ID NO: 105967

SEQ ID NO: 642190 - RNA, 64 nt, hsa; identical to SEQ ID NO: 105968

SEQ ID NO: 642191 - RNA, 64 nt, hsa; identical to SEQ ID NO: 105969

SEQ ID NO: 642192 - RNA, 64 nt, hsa; identical to SEQ ID NO: 105970

SEQ ID NO: 642193 - RNA, 64 nt, hsa; identical to SEQ ID NO: 105971

SEQ ID NO: 642194 - RNA, 64 nt, hsa; identical to SEQ ID NO: 105972

SEQ ID NO: 642195 - RNA, 59 nt, hsa; identical to SEQ ID NO: 105973

SEQ ID NO: 642196 - RNA, 64 nt, hsa; identical to SEQ ID NO: 105974

SEQ ID NO: 642197 - RNA, 64 nt, hsa; identical to SEQ ID NO: 105975

SEQ ID NO: 642198 - RNA, 64 nt, hsa; identical to SEQ ID NO: 105976

SEQ ID NO: 642199 - RNA, 64 nt, hsa; identical to SEQ ID NO: 105977

SEQ ID NO: 642200 - RNA, 64 nt, hsa; identical to SEQ ID NO: 105978

SEQ ID NO: 642201 - RNA, 64 nt, hsa; identical to SEQ ID NO: 105979

SEQ ID NO: 642202 - RNA, 64 nt, hsa; identical to SEQ ID NO: 105980

SEQ ID NO: 642203 - RNA, 64 nt, hsa; identical to SEQ ID NO: 105981

SEQ ID NO: 642204 - RNA, 64 nt, hsa; identical to SEQ ID NO: 105982

SEQ ID NO: 642205 - RNA, 64 nt, hsa; identical to SEQ ID NO: 105983

SEQ ID NO: 642206 - RNA, 64 nt, hsa; identical to SEQ ID NO: 105984

SEQ ID NO: 642207 - RNA, 64 nt, hsa; identical to SEQ ID NO: 105985

SEQ ID NO: 642208 - RNA, 64 nt, hsa; identical to SEQ ID NO: 105986

SEQ ID NO: 642209 - RNA, 64 nt, hsa; identical to SEQ ID NO: 105987

SEQ ID NO: 642210 - RNA, 64 nt, hsa; identical to SEQ ID NO: 105988

SEQ ID NO: 642211 - RNA, 64 nt, hsa; identical to SEQ ID NO: 105989

SEQ ID NO: 642212 - RNA, 64 nt, hsa; identical to SEQ ID NO: 105990

SEQ ID NO: 642213 - RNA, 64 nt, hsa; identical to SEQ ID NO: 105991

SEQ ID NO: 642214 - RNA, 64 nt, hsa; identical to SEQ ID NO: 105992

SEQ ID NO: 642215 - RNA, 64 nt, hsa; identical to SEQ ID NO: 105993

SEQ ID NO: 642216 - RNA, 64 nt, hsa; identical to SEQ ID NO: 105994

SEQ ID NO: 642217 - RNA, 64 nt, hsa; identical to SEQ ID NO: 105995

SEQ ID NO: 642218 - RNA, 64 nt, hsa; identical to SEQ ID NO: 105996

SEQ ID NO: 642219 - RNA, 64 nt, hsa; identical to SEQ ID NO: 105997

SEQ ID NO: 642220 - RNA, 64 nt, hsa; identical to SEQ ID NO: 105998

SEQ ID NO: 642221 - RNA, 64 nt, hsa; identical to SEQ ID NO: 105999

SEQ ID NO: 642222 - RNA, 64 nt, hsa; identical to SEQ ID NO: 106000

SEQ ID NO: 642223 - RNA, 64 nt, hsa; identical to SEQ ID NO: 106001

SEQ ID NO: 642224 - RNA, 64 nt, hsa; identical to SEQ ID NO: 106002

SEQ ID NO: 642225 - RNA, 64 nt, hsa; identical to SEQ ID NO: 106003

SEQ ID NO: 642226 - RNA, 64 nt, hsa; identical to SEQ ID NO: 106004

SEQ ID NO: 642227 - RNA, 64 nt, hsa; identical to SEQ ID NO: 106005

SEQ ID NO: 642228 - RNA, 64 nt, hsa; identical to SEQ ID NO: 106006

SEQ ID NO: 642229 - RNA, 64 nt, hsa; identical to SEQ ID NO: 106007

SEQ ID NO: 642230 - RNA, 64 nt, hsa; identical to SEQ ID NO: 106008

SEQ ID NO: 642231 - RNA, 64 nt, hsa; identical to SEQ ID NO: 106009

SEQ ID NO: 642232 - RNA, 64 nt, hsa; identical to SEQ ID NO: 106010

SEQ ID NO: 642233 - RNA, 64 nt, hsa; identical to SEQ ID NO: 106011

SEQ ID NO: 642234 - RNA, 64 nt, hsa; identical to SEQ ID NO: 106012

SEQ ID NO: 642235 - RNA, 64 nt, hsa; identical to SEQ ID NO: 106013

SEQ ID NO: 642236 - RNA, 64 nt, hsa; identical to SEQ ID NO: 130638

SEQ ID NO: 642237 - RNA, 64 nt, hsa; identical to SEQ ID NO: 130639

SEQ ID NO: 642238 - RNA, 64 nt, hsa; identical to SEQ ID NO: 130640

SEQ ID NO: 642239 - RNA, 64 nt, hsa; identical to SEQ ID NO: 130641

SEQ ID NO: 642240 - RNA, 64 nt, hsa; identical to SEQ ID NO: 130642

SEQ ID NO: 642241 - RNA, 64 nt, hsa; identical to SEQ ID NO: 130643

SEQ ID NO: 642242 - RNA, 64 nt, hsa; identical to SEQ ID NO: 130644

SEQ ID NO: 642243 - RNA, 64 nt, hsa; identical to SEQ ID NO: 130645

SEQ ID NO: 642244 - RNA, 64 nt, hsa; identical to SEQ ID NO: 130646

SEQ ID NO: 642245 - RNA, 64 nt, hsa; identical to SEQ ID NO: 130647

SEQ ID NO: 642246 - RNA, 64 nt, hsa; identical to SEQ ID NO: 130648

SEQ ID NO: 642247 - RNA, 64 nt, hsa; identical to SEQ ID NO: 130649

SEQ ID NO: 642248 - RNA, 64 nt, hsa; identical to SEQ ID NO: 130650

SEQ ID NO: 642249 - RNA, 64 nt, hsa; identical to SEQ ID NO: 130651

SEQ ID NO: 642250 - RNA, 64 nt, hsa; identical to SEQ ID NO: 130652

SEQ ID NO: 642251 - RNA, 64 nt, hsa; identical to SEQ ID NO: 130653

SEQ ID NO: 642252 - RNA, 64 nt, hsa; identical to SEQ ID NO: 130654

SEQ ID NO: 642253 - RNA, 64 nt, hsa; identical to SEQ ID NO: 130655

SEQ ID NO: 642254 - RNA, 64 nt, hsa; identical to SEQ ID NO: 130656

SEQ ID NO: 642255 - RNA, 64 nt, hsa; identical to SEQ ID NO: 130657

SEQ ID NO: 642256 - RNA, 64 nt, hsa; identical to SEQ ID NO: 130658

SEQ ID NO: 642257 - RNA, 64 nt, hsa; identical to SEQ ID NO: 130659

SEQ ID NO: 642258 - RNA, 64 nt, hsa; identical to SEQ ID NO: 611214

SEQ ID NO: 642259 - RNA, 64 nt, hsa; identical to SEQ ID NO: 611215

SEQ ID NO: 642260 - RNA, 64 nt, hsa; identical to SEQ ID NO: 341042

SEQ ID NO: 642261 - RNA, 64 nt, hsa; identical to SEQ ID NO: 341043

SEQ ID NO: 642262 - RNA, 64 nt, hsa
caaguagcugaggagaggucgaauuuacugcuuuuuccaggacaauucuggaaguaaagaaaau

SEQ ID NO: 642263 - RNA, 64 nt, hsa
aaaagcccuggguggugaggcucacaguacugguuuccaggaggaagagccuuugugcauuuga

SEQ ID NO: 642264 - RNA, 64 nt, hsa
guaaacuugguaaaauccaagucuuuuuuuuuuuuuccaggaacaacuacauuuucucauauac

SEQ ID NO: 642265 - RNA, 64 nt, hsa
gguucuuguuccugagaaggguggguaacagauauuccaggaaaaagaaugcacauugaaugga

SEQ ID NO: 642266 - RNA, 64 nt, hsa
gcuauauuacaagcaauccccaaauuuuauggucuuccaggaaaaguuauuaccguuuaugaua

SEQ ID NO: 642267 - RNA, 64 nt, hsa
cugcuagggacagaaguguuucuggaagugaugcuuccaggauuuguuuucagaaacaagaauu

SEQ ID NO: 642268 - RNA, 64 nt, hsa
gcaguaggauuuaaaaagcagcccacugcucaguuuccaggaucagcuuccuccuucugucacu

SEQ ID NO: 642269 - RNA, 64 nt, hsa
cauuuugaaaggggacagaaauauaacuaaaugcuuccaggagaaaaauuccaagaguuacaau

SEQ ID NO: 642270 - RNA, 64 nt, hsa
uaccaccacauugcauuucuguuugcaccaugucuuccaggagacuagacuacuguuguccagg

SEQ ID NO: 642271 - RNA, 64 nt, hsa
ucucuagggguuucaaaagacucaguuaauugauuuccaggaaguacucauagcaaguucauaa

SEQ ID NO: 642272 - RNA, 64 nt, hsa
ugaagagucugaacacuggccugugauugguccauuccaggaccuucauuugcauaagguauca

SEQ ID NO: 642273 - RNA, 64 nt, hsa
ggccagaccugcacucuggccaaugauugguucauuccaggacauucauuugcauaaggaguca

SEQ ID NO: 642274 - RNA, 64 nt, hsa
uucauucgcuacuaguuauucagagcguacuuuguuccaggaacuaugcuggaaacugauaguu

SEQ ID NO: 642275 - RNA, 64 nt, hsa
uuauuuacuacauaguuauucagagccuacuguguuccaggaacuaugcuagaaacugucucuc

SEQ ID NO: 642276 - RNA, 64 nt, hsa
cccuuguccugguggccuucagugucucuuccaguuccaggagcugcugggaagcuggccuuca

SEQ ID NO: 642277 - RNA, 64 nt, hsa
acauggcuggcugguccugaggccacccaccuuguuccaggacaugggcccgggcccggugugg

SEQ ID NO: 642278 - RNA, 64 nt, hsa
auagacaacacacaaacgagagggcuuggcucccuuccaggaagauuuauuuaacaggcuccca

SEQ ID NO: 642279 - RNA, 64 nt, hsa
cucagccaagauugguaaagcugcguccuggcgauuccaggagacccagcuggaaaccuggcuu

SEQ ID NO: 642280 - RNA, 64 nt, hsa
uggugcugucuccgcggaagucagggcggcuggauuccaggacaggagugaauguaaaaauaaa

SEQ ID NO: 642281 - RNA, 64 nt, hsa
augauugguuaagugaaaaccagaacucaaaauauuccaggagagaagauaacauuuacaagua

SEQ ID NO: 642282 - RNA, 64 nt, hsa
uuucagaaaucagggcacuugcauccauugccuuuuccaggaaagggaagaaaacacucaguug

SEQ ID NO: 642283 - RNA, 64 nt, hsa
ucccagcugauggugagcugacaguguccacagguuccaggaccauuugagauuggaagcuaca

SEQ ID NO: 642284 - RNA, 64 nt, hsa
cgggggccuugggagaguuuaaggcaccugcugguuccaggaccucgcuuuccaucuguucuug

SEQ ID NO: 642285 - RNA, 64 nt, hsa
guccaaguagagauuacacccagaacaccauuccuuccaggagcaguaggugggagguuugacc

SEQ ID NO: 642286 - RNA, 64 nt, hsa
ugggagguuugacccagagaagccaauccuugcauuccaggaguggccugugccucccaccucu

SEQ ID NO: 642287 - RNA, 64 nt, hsa
caacugaugauauccuauccucuccaagcuccuauuccaggaaaaaagauccaauguuuuuucu

SEQ ID NO: 642288 - RNA, 64 nt, hsa
uuacauuugacauaagcaauuuaccuccccacauuuccaggaccucuaugacacuucaucagau

SEQ ID NO: 642289 - RNA, 64 nt, hsa
ugaggagcugugcugauguugggaacuuaucuuuuuccaggauccauaacauuuaggggaauua

SEQ ID NO: 642290 - RNA, 64 nt, hsa
augccccauucccugccccagcacuucccagccuuuccaggagcucugccccaccccuacucaa

SEQ ID NO: 642291 - RNA, 64 nt, hsa
uuaugaugcagucuaguacgaguauugcaucuaauuccaggagcauuguuuuaaguugauugac

SEQ ID NO: 642292 - RNA, 64 nt, hsa
ccuuggaguuuuuuuucauucauauuuuuguuguuuccaggaauuuauuugauauuaaugggcg

SEQ ID NO: 642293 - RNA, 64 nt, hsa
cagggcucagcagugaugggagaacagaggacaguuccaggauaaacugcugccuggggcugug

SEQ ID NO: 642294 - RNA, 64 nt, hsa
ugaaucagucaccccgaaucuuggaaaaacccccuuccaggagaggaugggcaggcauuuaaaa

SEQ ID NO: 642295 - RNA, 64 nt, hsa
uuaugcaugagucacgcaauguucugguccuggauuccaggaguagaggaccuagcuuuaaauc

SEQ ID NO: 642296 - RNA, 64 nt, hsa
gugugcagucugagcuuaggcacacacaggaggguuccaggacuuucugaacaucugauucugu

SEQ ID NO: 642297 - RNA, 64 nt, hsa
agaugaaauuggaaauaaaccaacauuguuuacauuccaggagacuuguagcucagccacacac

SEQ ID NO: 642298 - RNA, 64 nt, hsa
guccacuugcgggguaagagauaaacaguaacccuuccaggagcccacugacguuggagugcua

SEQ ID NO: 642299 - RNA, 64 nt, hsa
agggauggggagcccucuggggaugagcaaggccuuccaggacaggcucgguucugguccccug

SEQ ID NO: 642300 - RNA, 64 nt, hsa
ucccaacguugcucaucaaauuaugaccauaaauuuccaggaucagacuaacggcuaaagagac

SEQ ID NO: 642301 - RNA, 64 nt, hsa
guaggacggaaagcuccuuucauucaguuuaucuuuccaggauauaugaaaagggaccagcugg

SEQ ID NO: 642302 - RNA, 64 nt, hsa
ggaagccuggaaugaccucuugcacaagccuaaauuccaggaaucuuccccaaaucccagaucc

SEQ ID NO: 642303 - RNA, 64 nt, hsa
cauguacugaguuccuucagaucagccacaccuuuuccaggaguucugaagcugacagcacuac

SEQ ID NO: 642304 - RNA, 64 nt, hsa
ucagccaaaagaacaaaagagaugucaggacagauuccaggagugucggagcacauguguggca

SEQ ID NO: 642305 - RNA, 64 nt, hsa
uaggggccaauaaaauguaucugcauauguuuuccacauaaauuuuaauucaagaaaugacagu

SEQ ID NO: 642306 - RNA, 64 nt, hsa
uacauccguaggacaaguuuuaguuaaaacucaucacauaaagaaauucaagaaguauuuuuuu

SEQ ID NO: 642307 - RNA, 64 nt, hsa
uccuauggcaagaaaaauuuucuugcaaaucauccacauaaaaucagauauuuaaauuuguucu

SEQ ID NO: 642308 - RNA, 64 nt, hsa
caccaaacuuuuugacaaggcaacacauaacuuacacauaaaugucucuguucuugcauuuaug

SEQ ID NO: 642309 - RNA, 64 nt, hsa
agugacaagaagucacuuguauagugaccaaguacacauaaaauacugauuauaaaaauauugu

SEQ ID NO: 642310 - RNA, 64 nt, hsa
ucccccaugaacuucagccuguccacacaaaagccacauaaacucaagcaagaaauauguucag

SEQ ID NO: 642311 - RNA, 64 nt, hsa
uuaaccuguauuuguuaaaaaagaaaaaaaaacacacauaaaguuccauguguaagcuucucua

SEQ ID NO: 642312 - RNA, 64 nt, hsa
cucaccucaaagacaauucauagccuguggucuccacauaaacagcaacaagacaaguaauagu

SEQ ID NO: 642313 - RNA, 64 nt, hsa
aauaaaacacagcuccuucaaacagcacuuuuuccacauaaaucuaguugccucucccugugga

SEQ ID NO: 642314 - RNA, 64 nt, hsa
cccaaaguaaugaaucauguggcuguaccuucuccacauaaaugggauggauaauuaucguaua

SEQ ID NO: 642315 - RNA, 64 nt, hsa
guucguaauaaaucaugugccacaucuugucuuacacauaaaagccacugcuuuuaacauccca

SEQ ID NO: 642316 - RNA, 64 nt, hsa
agccacugcuuuuaacaucccauuguacauuuaacacauaaaugguguuaacaucccauuguac

SEQ ID NO: 642317 - RNA, 64 nt, hsa
cauaaaugguguuaacaucccauuguacauuuaacacauaaauggccauugucuuugucucagu

SEQ ID NO: 642318 - RNA, 64 nt, hsa
ugaugaaaauguugcacauucuauaguugcaaaacacauaaaaggggacuuaacauuucacguu

SEQ ID NO: 642319 - RNA, 64 nt, hsa
gucuuauauccccauauggaauuuauccaucaaccacauaaaaacaaacagugccuucugcccu

SEQ ID NO: 642320 - RNA, 64 nt, hsa
gcaguguacugggggugggagggaaggaaacaaucacauaaaaucagcugacucaaaauugagg

SEQ ID NO: 642321 - RNA, 64 nt, hsa
ugguuuucuaagcagagacuaauacaaaugcagccacauaaaggcaguguacugggggugggag

SEQ ID NO: 642322 - RNA, 64 nt, hsa
ccauuagagaaaccauuuguaaaacucaaaugaccacauaaagcuuaucaaggagucuagauug

SEQ ID NO: 642323 - RNA, 64 nt, hsa
ugcuguauguuacaguaaagcuaucuggagagaacacauaaaugauuuuggcauaccauuagag

SEQ ID NO: 642324 - RNA, 64 nt, hsa; identical to SEQ ID NO: 305774

SEQ ID NO: 642325 - RNA, 64 nt, hsa; identical to SEQ ID NO: 305775

SEQ ID NO: 642326 - RNA, 64 nt, hsa; identical to SEQ ID NO: 305776

SEQ ID NO: 642327 - RNA, 64 nt, hsa; identical to SEQ ID NO: 305777

SEQ ID NO: 642328 - RNA, 64 nt, hsa; identical to SEQ ID NO: 305778

SEQ ID NO: 642329 - RNA, 64 nt, hsa; identical to SEQ ID NO: 305779

SEQ ID NO: 642330 - RNA, 64 nt, hsa; identical to SEQ ID NO: 305780

SEQ ID NO: 642331 - RNA, 64 nt, hsa; identical to SEQ ID NO: 305781

SEQ ID NO: 642332 - RNA, 64 nt, hsa; identical to SEQ ID NO: 305782

SEQ ID NO: 642333 - RNA, 64 nt, hsa; identical to SEQ ID NO: 305783

SEQ ID NO: 642334 - RNA, 64 nt, hsa; identical to SEQ ID NO: 305784

SEQ ID NO: 642335 - RNA, 64 nt, hsa; identical to SEQ ID NO: 305785

SEQ ID NO: 642336 - RNA, 64 nt, hsa; identical to SEQ ID NO: 305786

SEQ ID NO: 642337 - RNA, 64 nt, hsa; identical to SEQ ID NO: 305787

SEQ ID NO: 642338 - RNA, 64 nt, hsa; identical to SEQ ID NO: 305788

SEQ ID NO: 642339 - RNA, 64 nt, hsa; identical to SEQ ID NO: 305789

SEQ ID NO: 642340 - RNA, 64 nt, hsa; identical to SEQ ID NO: 305790

SEQ ID NO: 642341 - RNA, 64 nt, hsa; identical to SEQ ID NO: 305791

SEQ ID NO: 642342 - RNA, 64 nt, hsa; identical to SEQ ID NO: 305792

SEQ ID NO: 642343 - RNA, 64 nt, hsa; identical to SEQ ID NO: 305793

SEQ ID NO: 642344 - RNA, 63 nt, hsa; identical to SEQ ID NO: 305794

SEQ ID NO: 642345 - RNA, 64 nt, hsa; identical to SEQ ID NO: 305795

SEQ ID NO: 642346 - RNA, 64 nt, hsa; identical to SEQ ID NO: 305796

SEQ ID NO: 642347 - RNA, 64 nt, hsa; identical to SEQ ID NO: 305797

SEQ ID NO: 642348 - RNA, 64 nt, hsa; identical to SEQ ID NO: 305798

SEQ ID NO: 642349 - RNA, 64 nt, hsa; identical to SEQ ID NO: 305799

SEQ ID NO: 642350 - RNA, 64 nt, hsa; identical to SEQ ID NO: 305800

SEQ ID NO: 642351 - RNA, 64 nt, hsa; identical to SEQ ID NO: 305801

SEQ ID NO: 642352 - RNA, 64 nt, hsa; identical to SEQ ID NO: 305802

SEQ ID NO: 642353 - RNA, 64 nt, hsa; identical to SEQ ID NO: 305803

SEQ ID NO: 642354 - RNA, 64 nt, hsa; identical to SEQ ID NO: 305804

SEQ ID NO: 642355 - RNA, 64 nt, hsa; identical to SEQ ID NO: 305805

SEQ ID NO: 642356 - RNA, 64 nt, hsa; identical to SEQ ID NO: 305806

SEQ ID NO: 642357 - RNA, 64 nt, hsa; identical to SEQ ID NO: 305807

SEQ ID NO: 642358 - RNA, 64 nt, hsa; identical to SEQ ID NO: 305808

SEQ ID NO: 642359 - RNA, 64 nt, hsa; identical to SEQ ID NO: 305809

SEQ ID NO: 642360 - RNA, 64 nt, hsa; identical to SEQ ID NO: 305810

SEQ ID NO: 642361 - RNA, 64 nt, hsa; identical to SEQ ID NO: 305811

SEQ ID NO: 642362 - RNA, 64 nt, hsa; identical to SEQ ID NO: 305812

SEQ ID NO: 642363 - RNA, 64 nt, hsa; identical to SEQ ID NO: 305813

SEQ ID NO: 642364 - RNA, 64 nt, hsa; identical to SEQ ID NO: 305814

SEQ ID NO: 642365 - RNA, 64 nt, hsa; identical to SEQ ID NO: 305815

SEQ ID NO: 642366 - RNA, 64 nt, hsa; identical to SEQ ID NO: 305816

SEQ ID NO: 642367 - RNA, 64 nt, hsa; identical to SEQ ID NO: 305817

SEQ ID NO: 642368 - RNA, 64 nt, hsa
aucaauagcuuguagaagcucagcucuucuuggucuuggcuagacugccuagauucccacagca

SEQ ID NO: 642369 - RNA, 64 nt, hsa
cgaguagcugggacuacaggcacccaccaucaugcuuggcuaauuuuuguauuuuuaguagaga

SEQ ID NO: 642370 - RNA, 64 nt, hsa
agucagccguaggaauucaaaauggcuggccuaccuuggcuaccagacauauugggguuuuugu

SEQ ID NO: 642371 - RNA, 64 nt, hsa
aauacaggguuuuuccaagccaggaaacgcccuccuuggcuacuaggagcaccuaucccauauc

SEQ ID NO: 642372 - RNA, 64 nt, hsa
gaacuaggcaaagaugaaaguauagccaacuauucuuggcuauauauauauauucaagugggcc

SEQ ID NO: 642373 - RNA, 64 nt, hsa
aauccuaacuccugauuccgucuccuauuucuugcuuggcuacgccaguucccaaaucugguag

SEQ ID NO: 642374 - RNA, 64 nt, hsa
aguggccaagaguguuuaucccaacccuuccauuuaacaggauuucacucacauuucuggaacu

SEQ ID NO: 642375 - RNA, 64 nt, hsa
aauucugaguuccagcacaauuuucuuuggaaucuaacaggaaucuagccugaggaagaaggga

SEQ ID NO: 642376 - RNA, 64 nt, hsa
gaagccaagaagggagaguuucgugcacugugguuaacaggagggcugccuggaggcaguggcu

SEQ ID NO: 642377 - RNA, 64 nt, hsa
cuccagggaggccuggccuggaggaggaguccacuaacaggaaacacuucucacccccucacac

SEQ ID NO: 642378 - RNA, 64 nt, hsa
aacaccucggcuguggucucucugcuuuaaauccuaacaggacuuccuagagcguugacagaaa

SEQ ID NO: 642379 - RNA, 64 nt, hsa
agcaacgagggcuugcucuaaaucguuuagaggauaacaggaucuagagaugcucucugcuuga

SEQ ID NO: 642380 - RNA, 64 nt, hsa; identical to SEQ ID NO: 346161

SEQ ID NO: 642381 - RNA, 64 nt, hsa; identical to SEQ ID NO: 346162

SEQ ID NO: 642382 - RNA, 63 nt, hsa
uaguagguucuguuacaguuuuucuuuugaucgugcacuuauagucuucauuuaauuccucau

SEQ ID NO: 642383 - RNA, 63 nt, hsa
guauuuguggaaauugguauuaucucuguuuuaugcacuuacauuuaucccuuacauuuuguu

SEQ ID NO: 642384 - RNA, 63 nt, hsa
cauaugcaaucacucguuuaugcugucuagucaugcacuuaaagcaauuuucaaauguacuca

SEQ ID NO: 642385 - RNA, 63 nt, hsa
cgcgugcaguucauuucuaguucuugauagaacugcacuuaauuuucaguaguagucuugacu

SEQ ID NO: 642386 - RNA, 63 nt, hsa
aagaucuggggcugcagagaacagaagagcuggugcacuuaauccagcucugcccuugggggg

SEQ ID NO: 642387 - RNA, 63 nt, hsa
ggccguggggucucaggggugccuggugaauucugcacuuacacguacucaagggagcgcgcc

SEQ ID NO: 642388 - RNA, 63 nt, hsa
uuuuuuuccuauuuuucuucuuuuugcuuuuuuugcacuuaucagaaauauuugaugugugca

SEQ ID NO: 642389 - RNA, 63 nt, hsa
ugauuuagaagagacucuuugcugaaauugaauugcacuuauacauguaaauugucaacaugu

SEQ ID NO: 642390 - RNA, 63 nt, hsa
ugcaagugacaaucagaggugacuaucuauauuugcacuuaaaaucaaaguaguucaacaugc

SEQ ID NO: 642391 - RNA, 63 nt, hsa
uuugacuccccuuauucccucuccaagaguaguugcacuuaacuuuuuuuuuuuuuuuuuagu

SEQ ID NO: 642392 - RNA, 63 nt, hsa
aauauaaaugaagauauuuuaccaugaagagauugcacuuauccuugagaacagucuaaauau

SEQ ID NO: 642393 - RNA, 63 nt, hsa
aauauaaaugaagauauuuuaccaugaagagauugcacuuauccuugagaacagucuaaugau

SEQ ID NO: 642394 - RNA, 63 nt, hsa
uugagggugaugacaagagacauccggggacugugcacuuacagucgguguggaaugucacuc

SEQ ID NO: 642395 - RNA, 63 nt, hsa
gggagaccagcaguuaacggugagggagguaggugcacuuacccucuccucucuucuccuauc

SEQ ID NO: 642396 - RNA, 64 nt, hsa; identical to SEQ ID NO: 628794

SEQ ID NO: 642397 - RNA, 64 nt, hsa; identical to SEQ ID NO: 628795

SEQ ID NO: 642398 - RNA, 64 nt, hsa; identical to SEQ ID NO: 628796

SEQ ID NO: 642399 - RNA, 64 nt, hsa; identical to SEQ ID NO: 628797

SEQ ID NO: 642400 - RNA, 64 nt, hsa; identical to SEQ ID NO: 628798

SEQ ID NO: 642401 - RNA, 64 nt, hsa; identical to SEQ ID NO: 628799

SEQ ID NO: 642402 - RNA, 64 nt, hsa; identical to SEQ ID NO: 628800

SEQ ID NO: 642403 - RNA, 64 nt, hsa; identical to SEQ ID NO: 628801

SEQ ID NO: 642404 - RNA, 64 nt, hsa; identical to SEQ ID NO: 628802

SEQ ID NO: 642405 - RNA, 64 nt, hsa; identical to SEQ ID NO: 628803

SEQ ID NO: 642406 - RNA, 64 nt, hsa; identical to SEQ ID NO: 628804

SEQ ID NO: 642407 - RNA, 64 nt, hsa; identical to SEQ ID NO: 628805

SEQ ID NO: 642408 - RNA, 64 nt, hsa; identical to SEQ ID NO: 628806

SEQ ID NO: 642409 - RNA, 64 nt, hsa; identical to SEQ ID NO: 628807

SEQ ID NO: 642410 - RNA, 64 nt, hsa
ggcggagggugggagcaggugugccagggcucagggcucagacuugggagggccuaggcagaag

SEQ ID NO: 642411 - RNA, 64 nt, hsa
gacacccucacgaagggucgcaagucacucuuguggcucagauugcucuuaggaccuggaggga

SEQ ID NO: 642412 - RNA, 64 nt, hsa
gcauccauggggcuuauaugagacaugaagcauuggcucagaaguagagggagaagaggaaccc

SEQ ID NO: 642413 - RNA, 64 nt, hsa
cuaaacccuauccuaagcuccaguuccauggcaaggcucagacuuuuaaugccaucuuaaucug

SEQ ID NO: 642414 - RNA, 64 nt, hsa
cggagaagcuggaaagugugaaugcugaacugaaggcucagauugaggagcucaagaacgagaa

SEQ ID NO: 642415 - RNA, 64 nt, hsa
ugcucaaccuucaucggcccacguguauuguccgggcucagaaugggaggacuccagaagauga

SEQ ID NO: 642416 - RNA, 64 nt, hsa
ugauacugauugccacauuaagguugaacagcauggcucagagucuagagaaagugaucaccaa

SEQ ID NO: 642417 - RNA, 64 nt, hsa
ugauacugauucccacauuaagguugaacaacauggcucagagucuuguucaagagaaagugau

SEQ ID NO: 642418 - RNA, 64 nt, hsa
ccugcacuaugaagugcugcuggcugggcuugguggcucagaacaaggcacugucacugcccac

SEQ ID NO: 642419 - RNA, 64 nt, hsa
gccagggccucggcggcugcugaagggauucuauggcucagaggcccaggguguggugaaggac

SEQ ID NO: 642420 - RNA, 64 nt, hsa
caggaacccuuuccaaaagcccagagaugcccugggcucagaucuguaauucucccaggagcug

SEQ ID NO: 642421 - RNA, 64 nt, hsa
cagcuccccagggcagacucacgugccccucugaggcucagaaaaugcccagcccuuccucaaa

SEQ ID NO: 642422 - RNA, 64 nt, hsa
guuguuguuacuucccuccaagaggcuggaaaagggcucagagcugcugagcaggaaccggagg

SEQ ID NO: 642423 - RNA, 64 nt, hsa
caacaggcccuugguagagcuggugccagaugugggcucagauccugggcaugaugggccgagc

SEQ ID NO: 642424 - RNA, 64 nt, hsa
uuuacgacgugaucuaaaccaguccuuagcaaggggcucagaacaccccgcucuggcaguaggu

SEQ ID NO: 642425 - RNA, 64 nt, hsa
gagagcugcugagggaccuuggagagcucaggauggcucagacgaggacacucgcuugccgggc

SEQ ID NO: 642426 - RNA, 64 nt, hsa
ucccgaggaaucugccucccacccacugacucagggcucagacucagccucuauuguccagagc

SEQ ID NO: 642427 - RNA, 64 nt, hsa
cugcucaccccacagacacugguggggagaccauggcucagaggaaggguggagcaacccuccu

SEQ ID NO: 642428 - RNA, 64 nt, hsa
gagaucaugaacccauuuaacagacgaggagacaggcucagagaggcaccgucccuugccuaac

SEQ ID NO: 642429 - RNA, 64 nt, hsa
uagcccaacucccuguuucaugaaagagaaaagaggcucagaaaaguuuagagagcagcucagu

SEQ ID NO: 642430 - RNA, 64 nt, hsa
ggggcaaggagcauagagauguuuuccaggaaggggcucagaagcugcacuaggccccgagucc

SEQ ID NO: 642431 - RNA, 64 nt, hsa
acgucuccgugcagcccccagagagaggcccaugggcucagaccaggcuuuguuguccugcucu

SEQ ID NO: 642432 - RNA, 64 nt, hsa
gauguuagagaggccuggggagagcagccgauggggcucagacuacauauggcaggccgaucag

SEQ ID NO: 642433 - RNA, 64 nt, hsa
cauucuucucuacccagaaccugucaugggcuggggcucagauuuuccuggcuuugggagcaga

SEQ ID NO: 642434 - RNA, 64 nt, hsa
cacaguccuuacuucucuaccugccucaagaaggggcucagagcagagacuugugaauuccuua

SEQ ID NO: 642435 - RNA, 64 nt, hsa
ucaaaggaccggcucauggcguuggucacuggcaggcucagagacauucugcugugggcgcagg

SEQ ID NO: 642436 - RNA, 64 nt, hsa
cacacacacacucacugcggagaaccuugugccuggcucagagccagucuuuuuggugagggua

SEQ ID NO: 642437 - RNA, 64 nt, hsa
aaccugccagggagacagagcucacaauaaaaauggcucagaugccacuucaaagaaccaguga

SEQ ID NO: 642438 - RNA, 64 nt, hsa
gcucuggacagaguucuuauaaauguauaaauuaggcucagaaaccacugcauucugaccugcu

SEQ ID NO: 642439 - RNA, 64 nt, hsa
ggagucaagucaggaugcucucaaggaccccucgggcucagagcccuaaagugggcccugguga

SEQ ID NO: 642440 - RNA, 64 nt, hsa
ggacuauuugcaaggugacagggacuggagccauggcucagaggugauucgggcagccagggac

SEQ ID NO: 642441 - RNA, 64 nt, hsa
ucaguugugagccuucuagggccccaggcugggaggcucagaggacugaaucugggaccugugu

SEQ ID NO: 642442 - RNA, 64 nt, hsa
ccccucgacccccagccuggguagagccaccagguacgacgaccagguaccagaaaccaccagg

SEQ ID NO: 642443 - RNA, 64 nt, hsa
gcaggugaccgggcgccgccucuggaagaacguguacgacgagcuggggggcagcccaggcagc

SEQ ID NO: 642444 - RNA, 64 nt, hsa
uaaugauuaugaacuuuugcuuaacaaaauaacauacgacgagagcuugaguugucaaaauaua

SEQ ID NO: 642445 - RNA, 64 nt, hsa
uaugcuuucauucagucagucucuguugacuaaauacgacgaaaauucauacuuuaugcaggag

SEQ ID NO: 642446 - RNA, 64 nt, hsa
auuucggguuuccggagaggcagagacgccuggcuacgacgauuuguuccacuuccuugagugu

SEQ ID NO: 642447 - RNA, 64 nt, hsa
uggggacaucacugaccugggccugacgcugucuuacgacgaggacgucaugggucagguaggu

SEQ ID NO: 642448 - RNA, 64 nt, hsa
cccucugccugguccccuuugcccccaggaugaauacgacgacauugugguucacagcagccgc

SEQ ID NO: 642449 - RNA, 64 nt, hsa
uccccggcaccauggcuacuaccggggcuccgacuacgacgaggccgauggcccgggcagcggg

SEQ ID NO: 642450 - RNA, 64 nt, hsa
ugugggugccaggcuguguggguacccccccuucuacgacgagagcgacccugagcucuucagc

SEQ ID NO: 642451 - RNA, 62 nt, hsa
cauacauucgugccuggagacccugcaggccagaguccaaauauuuaacaaucagaaggggc

SEQ ID NO: 642452 - RNA, 62 nt, hsa
aguaauauggacaccauggaaguacaggaucugaguccaacauugccaugggggagggaaga

SEQ ID NO: 642453 - RNA, 62 nt, hsa
uuugccugaacaccccaacacucuugguuuuagaguccaagaguaaguugugcagagacaug

SEQ ID NO: 642454 - RNA, 62 nt, hsa
cauuuucugugccuuaucucacuguuucagcugaguccaaguuguuuacucuguuccucucc

SEQ ID NO: 642455 - RNA, 62 nt, hsa
gggugaggcuguccaggcaccauguuuucuuugaguccaacucauuaaaaaagaagaaucuc

SEQ ID NO: 642456 - RNA, 62 nt, hsa
gcccucccagguguuaacauuccaagacucuagaguccaagguuuaaagagucuagauucaa

SEQ ID NO: 642457 - RNA, 62 nt, hsa
gcugcauucugccucucuaggaccaugguuaagaguccaagaauccacauuucuaaaaucuu

SEQ ID NO: 642458 - RNA, 62 nt, hsa
uguuuguaacuuaugaacacacgugaaguguugaguccaaaagacaaaggggcaucggcaug

SEQ ID NO: 642459 - RNA, 62 nt, hsa
agcgugcuuucauuuucaaguagcauaugcaagaguccaaacaggcuacccaauguuacuac

SEQ ID NO: 642460 - RNA, 64 nt, hsa; identical to SEQ ID NO: 504475

SEQ ID NO: 642461 - RNA, 64 nt, hsa; identical to SEQ ID NO: 504476

SEQ ID NO: 642462 - RNA, 64 nt, hsa; identical to SEQ ID NO: 504477

SEQ ID NO: 642463 - RNA, 64 nt, hsa; identical to SEQ ID NO: 504478

SEQ ID NO: 642464 - RNA, 64 nt, hsa; identical to SEQ ID NO: 504479

SEQ ID NO: 642465 - RNA, 64 nt, hsa; identical to SEQ ID NO: 504480

SEQ ID NO: 642466 - RNA, 64 nt, hsa; identical to SEQ ID NO: 504481

SEQ ID NO: 642467 - RNA, 64 nt, hsa; identical to SEQ ID NO: 504482

SEQ ID NO: 642468 - RNA, 64 nt, hsa; identical to SEQ ID NO: 504483

SEQ ID NO: 642469 - RNA, 64 nt, hsa; identical to SEQ ID NO: 504484

SEQ ID NO: 642470 - RNA, 64 nt, hsa; identical to SEQ ID NO: 504485

SEQ ID NO: 642471 - RNA, 64 nt, hsa; identical to SEQ ID NO: 504486

SEQ ID NO: 642472 - RNA, 64 nt, hsa; identical to SEQ ID NO: 504487

SEQ ID NO: 642473 - RNA, 64 nt, hsa; identical to SEQ ID NO: 504488

SEQ ID NO: 642474 - RNA, 64 nt, hsa; identical to SEQ ID NO: 504489

SEQ ID NO: 642475 - RNA, 64 nt, hsa; identical to SEQ ID NO: 504490

SEQ ID NO: 642476 - RNA, 64 nt, hsa; identical to SEQ ID NO: 504491

SEQ ID NO: 642477 - RNA, 64 nt, hsa; identical to SEQ ID NO: 504492

SEQ ID NO: 642478 - RNA, 64 nt, hsa; identical to SEQ ID NO: 504493

SEQ ID NO: 642479 - RNA, 64 nt, hsa; identical to SEQ ID NO: 504494

SEQ ID NO: 642480 - RNA, 64 nt, hsa; identical to SEQ ID NO: 504495

SEQ ID NO: 642481 - RNA, 64 nt, hsa; identical to SEQ ID NO: 504496

SEQ ID NO: 642482 - RNA, 64 nt, hsa; identical to SEQ ID NO: 504497

SEQ ID NO: 642483 - RNA, 64 nt, hsa; identical to SEQ ID NO: 504498

SEQ ID NO: 642484 - RNA, 64 nt, hsa; identical to SEQ ID NO: 504499

SEQ ID NO: 642485 - RNA, 64 nt, hsa; identical to SEQ ID NO: 504500

SEQ ID NO: 642486 - RNA, 64 nt, hsa; identical to SEQ ID NO: 504501

SEQ ID NO: 642487 - RNA, 64 nt, hsa; identical to SEQ ID NO: 504502

SEQ ID NO: 642488 - RNA, 64 nt, hsa; identical to SEQ ID NO: 504503

SEQ ID NO: 642489 - RNA, 64 nt, hsa; identical to SEQ ID NO: 504504

SEQ ID NO: 642490 - RNA, 64 nt, hsa; identical to SEQ ID NO: 504505

SEQ ID NO: 642491 - RNA, 64 nt, hsa; identical to SEQ ID NO: 504506

SEQ ID NO: 642492 - RNA, 64 nt, hsa; identical to SEQ ID NO: 504507

SEQ ID NO: 642493 - RNA, 64 nt, hsa; identical to SEQ ID NO: 504508

SEQ ID NO: 642494 - RNA, 64 nt, hsa; identical to SEQ ID NO: 504509

SEQ ID NO: 642495 - RNA, 64 nt, hsa; identical to SEQ ID NO: 504510

SEQ ID NO: 642496 - RNA, 64 nt, hsa; identical to SEQ ID NO: 504511

SEQ ID NO: 642497 - RNA, 64 nt, hsa; identical to SEQ ID NO: 504512

SEQ ID NO: 642498 - RNA, 64 nt, hsa; identical to SEQ ID NO: 504513

SEQ ID NO: 642499 - RNA, 64 nt, hsa; identical to SEQ ID NO: 504514

SEQ ID NO: 642500 - RNA, 64 nt, hsa; identical to SEQ ID NO: 504515

SEQ ID NO: 642501 - RNA, 64 nt, hsa; identical to SEQ ID NO: 504516

SEQ ID NO: 642502 - RNA, 64 nt, hsa; identical to SEQ ID NO: 504517

SEQ ID NO: 642503 - RNA, 64 nt, hsa; identical to SEQ ID NO: 504518

SEQ ID NO: 642504 - RNA, 64 nt, hsa; identical to SEQ ID NO: 504519

SEQ ID NO: 642505 - RNA, 64 nt, hsa; identical to SEQ ID NO: 504520

SEQ ID NO: 642506 - RNA, 64 nt, hsa; identical to SEQ ID NO: 504521

SEQ ID NO: 642507 - RNA, 64 nt, hsa; identical to SEQ ID NO: 504522

SEQ ID NO: 642508 - RNA, 64 nt, hsa; identical to SEQ ID NO: 504523

SEQ ID NO: 642509 - RNA, 64 nt, hsa; identical to SEQ ID NO: 504524

SEQ ID NO: 642510 - RNA, 64 nt, hsa; identical to SEQ ID NO: 504525

SEQ ID NO: 642511 - RNA, 64 nt, hsa; identical to SEQ ID NO: 504526

SEQ ID NO: 642512 - RNA, 64 nt, hsa; identical to SEQ ID NO: 504527

SEQ ID NO: 642513 - RNA, 64 nt, hsa; identical to SEQ ID NO: 504528

SEQ ID NO: 642514 - RNA, 64 nt, hsa; identical to SEQ ID NO: 504529

SEQ ID NO: 642515 - RNA, 64 nt, hsa; identical to SEQ ID NO: 504530

SEQ ID NO: 642516 - RNA, 64 nt, hsa; identical to SEQ ID NO: 504531

SEQ ID NO: 642517 - RNA, 64 nt, hsa; identical to SEQ ID NO: 504532

SEQ ID NO: 642518 - RNA, 64 nt, hsa; identical to SEQ ID NO: 504533

SEQ ID NO: 642519 - RNA, 64 nt, hsa; identical to SEQ ID NO: 504534

SEQ ID NO: 642520 - RNA, 64 nt, hsa; identical to SEQ ID NO: 504535

SEQ ID NO: 642521 - RNA, 64 nt, hsa; identical to SEQ ID NO: 504536

SEQ ID NO: 642522 - RNA, 64 nt, hsa; identical to SEQ ID NO: 504537

SEQ ID NO: 642523 - RNA, 64 nt, hsa; identical to SEQ ID NO: 504538

SEQ ID NO: 642524 - RNA, 64 nt, hsa; identical to SEQ ID NO: 504539

SEQ ID NO: 642525 - RNA, 64 nt, hsa; identical to SEQ ID NO: 504540

SEQ ID NO: 642526 - RNA, 64 nt, hsa; identical to SEQ ID NO: 504541

SEQ ID NO: 642527 - RNA, 64 nt, hsa; identical to SEQ ID NO: 504542

SEQ ID NO: 642528 - RNA, 64 nt, hsa; identical to SEQ ID NO: 504543

SEQ ID NO: 642529 - RNA, 64 nt, hsa; identical to SEQ ID NO: 504544

SEQ ID NO: 642530 - RNA, 64 nt, hsa; identical to SEQ ID NO: 504545

SEQ ID NO: 642531 - RNA, 64 nt, hsa; identical to SEQ ID NO: 504546

SEQ ID NO: 642532 - RNA, 64 nt, hsa; identical to SEQ ID NO: 504547

SEQ ID NO: 642533 - RNA, 64 nt, hsa; identical to SEQ ID NO: 504548

SEQ ID NO: 642534 - RNA, 64 nt, hsa; identical to SEQ ID NO: 504549

SEQ ID NO: 642535 - RNA, 64 nt, hsa; identical to SEQ ID NO: 504550

SEQ ID NO: 642536 - RNA, 64 nt, hsa; identical to SEQ ID NO: 504551

SEQ ID NO: 642537 - RNA, 64 nt, hsa; identical to SEQ ID NO: 504552

SEQ ID NO: 642538 - RNA, 64 nt, hsa; identical to SEQ ID NO: 504553

SEQ ID NO: 642539 - RNA, 64 nt, hsa; identical to SEQ ID NO: 504554

SEQ ID NO: 642540 - RNA, 64 nt, hsa; identical to SEQ ID NO: 504555

SEQ ID NO: 642541 - RNA, 64 nt, hsa; identical to SEQ ID NO: 504556

SEQ ID NO: 642542 - RNA, 64 nt, hsa; identical to SEQ ID NO: 504557

SEQ ID NO: 642543 - RNA, 64 nt, hsa; identical to SEQ ID NO: 504558

SEQ ID NO: 642544 - RNA, 64 nt, hsa; identical to SEQ ID NO: 504559

SEQ ID NO: 642545 - RNA, 64 nt, hsa; identical to SEQ ID NO: 504560

SEQ ID NO: 642546 - RNA, 64 nt, hsa; identical to SEQ ID NO: 504561

SEQ ID NO: 642547 - RNA, 64 nt, hsa; identical to SEQ ID NO: 504562

SEQ ID NO: 642548 - RNA, 64 nt, hsa; identical to SEQ ID NO: 504563

SEQ ID NO: 642549 - RNA, 64 nt, hsa; identical to SEQ ID NO: 504564

SEQ ID NO: 642550 - RNA, 64 nt, hsa; identical to SEQ ID NO: 504565

SEQ ID NO: 642551 - RNA, 64 nt, hsa; identical to SEQ ID NO: 504566

SEQ ID NO: 642552 - RNA, 64 nt, hsa; identical to SEQ ID NO: 504567

SEQ ID NO: 642553 - RNA, 64 nt, hsa; identical to SEQ ID NO: 504568

SEQ ID NO: 642554 - RNA, 64 nt, hsa; identical to SEQ ID NO: 504569

SEQ ID NO: 642555 - RNA, 64 nt, hsa; identical to SEQ ID NO: 504570

SEQ ID NO: 642556 - RNA, 64 nt, hsa; identical to SEQ ID NO: 504571

SEQ ID NO: 642557 - RNA, 64 nt, hsa; identical to SEQ ID NO: 504572

SEQ ID NO: 642558 - RNA, 64 nt, hsa; identical to SEQ ID NO: 504573

SEQ ID NO: 642559 - RNA, 64 nt, hsa; identical to SEQ ID NO: 504574

SEQ ID NO: 642560 - RNA, 64 nt, hsa; identical to SEQ ID NO: 504575

SEQ ID NO: 642561 - RNA, 64 nt, hsa; identical to SEQ ID NO: 504576

SEQ ID NO: 642562 - RNA, 64 nt, hsa; identical to SEQ ID NO: 504577

SEQ ID NO: 642563 - RNA, 64 nt, hsa; identical to SEQ ID NO: 504578

SEQ ID NO: 642564 - RNA, 64 nt, hsa; identical to SEQ ID NO: 504579

SEQ ID NO: 642565 - RNA, 64 nt, hsa; identical to SEQ ID NO: 504580

SEQ ID NO: 642566 - RNA, 64 nt, hsa; identical to SEQ ID NO: 504581

SEQ ID NO: 642567 - RNA, 64 nt, hsa; identical to SEQ ID NO: 504582

SEQ ID NO: 642568 - RNA, 64 nt, hsa; identical to SEQ ID NO: 504583

SEQ ID NO: 642569 - RNA, 64 nt, hsa; identical to SEQ ID NO: 504584

SEQ ID NO: 642570 - RNA, 64 nt, hsa; identical to SEQ ID NO: 504585

SEQ ID NO: 642571 - RNA, 64 nt, hsa; identical to SEQ ID NO: 504586

SEQ ID NO: 642572 - RNA, 64 nt, hsa; identical to SEQ ID NO: 504587

SEQ ID NO: 642573 - RNA, 64 nt, hsa; identical to SEQ ID NO: 504588

SEQ ID NO: 642574 - RNA, 64 nt, hsa; identical to SEQ ID NO: 504589

SEQ ID NO: 642575 - RNA, 64 nt, hsa; identical to SEQ ID NO: 504590

SEQ ID NO: 642576 - RNA, 64 nt, hsa; identical to SEQ ID NO: 504591

SEQ ID NO: 642577 - RNA, 64 nt, hsa; identical to SEQ ID NO: 504592

SEQ ID NO: 642578 - RNA, 64 nt, hsa; identical to SEQ ID NO: 504593

SEQ ID NO: 642579 - RNA, 64 nt, hsa; identical to SEQ ID NO: 504594

SEQ ID NO: 642580 - RNA, 64 nt, hsa; identical to SEQ ID NO: 504595

SEQ ID NO: 642581 - RNA, 64 nt, hsa; identical to SEQ ID NO: 504596

SEQ ID NO: 642582 - RNA, 64 nt, hsa; identical to SEQ ID NO: 504597

SEQ ID NO: 642583 - RNA, 64 nt, hsa; identical to SEQ ID NO: 504598

SEQ ID NO: 642584 - RNA, 64 nt, hsa; identical to SEQ ID NO: 504599

SEQ ID NO: 642585 - RNA, 64 nt, hsa; identical to SEQ ID NO: 504600

SEQ ID NO: 642586 - RNA, 64 nt, hsa; identical to SEQ ID NO: 504601

SEQ ID NO: 642587 - RNA, 64 nt, hsa; identical to SEQ ID NO: 504602

SEQ ID NO: 642588 - RNA, 64 nt, hsa; identical to SEQ ID NO: 504603

SEQ ID NO: 642589 - RNA, 64 nt, hsa; identical to SEQ ID NO: 504604

SEQ ID NO: 642590 - RNA, 64 nt, hsa; identical to SEQ ID NO: 504605

SEQ ID NO: 642591 - RNA, 64 nt, hsa; identical to SEQ ID NO: 504606

SEQ ID NO: 642592 - RNA, 64 nt, hsa; identical to SEQ ID NO: 504607

SEQ ID NO: 642593 - RNA, 64 nt, hsa; identical to SEQ ID NO: 504608

SEQ ID NO: 642594 - RNA, 64 nt, hsa; identical to SEQ ID NO: 504609

SEQ ID NO: 642595 - RNA, 64 nt, hsa; identical to SEQ ID NO: 504610

SEQ ID NO: 642596 - RNA, 50 nt, hsa; identical to SEQ ID NO: 504611

SEQ ID NO: 642597 - RNA, 64 nt, hsa; identical to SEQ ID NO: 504612

SEQ ID NO: 642598 - RNA, 64 nt, hsa; identical to SEQ ID NO: 504613

SEQ ID NO: 642599 - RNA, 64 nt, hsa; identical to SEQ ID NO: 504614

SEQ ID NO: 642600 - RNA, 64 nt, hsa; identical to SEQ ID NO: 504615

SEQ ID NO: 642601 - RNA, 64 nt, hsa; identical to SEQ ID NO: 504616

SEQ ID NO: 642602 - RNA, 64 nt, hsa; identical to SEQ ID NO: 504617

SEQ ID NO: 642603 - RNA, 64 nt, hsa; identical to SEQ ID NO: 504618

SEQ ID NO: 642604 - RNA, 64 nt, hsa; identical to SEQ ID NO: 504619

SEQ ID NO: 642605 - RNA, 64 nt, hsa; identical to SEQ ID NO: 504620

SEQ ID NO: 642606 - RNA, 64 nt, hsa; identical to SEQ ID NO: 504621

SEQ ID NO: 642607 - RNA, 64 nt, hsa; identical to SEQ ID NO: 504622

SEQ ID NO: 642608 - RNA, 64 nt, hsa; identical to SEQ ID NO: 504623

SEQ ID NO: 642609 - RNA, 64 nt, hsa; identical to SEQ ID NO: 504624

SEQ ID NO: 642610 - RNA, 64 nt, hsa; identical to SEQ ID NO: 504625

SEQ ID NO: 642611 - RNA, 64 nt, hsa; identical to SEQ ID NO: 504626

SEQ ID NO: 642612 - RNA, 64 nt, hsa; identical to SEQ ID NO: 210199

SEQ ID NO: 642613 - RNA, 64 nt, hsa; identical to SEQ ID NO: 210200

SEQ ID NO: 642614 - RNA, 64 nt, hsa; identical to SEQ ID NO: 210201

SEQ ID NO: 642615 - RNA, 64 nt, hsa; identical to SEQ ID NO: 210202

SEQ ID NO: 642616 - RNA, 64 nt, hsa; identical to SEQ ID NO: 210203

SEQ ID NO: 642617 - RNA, 64 nt, hsa; identical to SEQ ID NO: 210204

SEQ ID NO: 642618 - RNA, 64 nt, hsa; identical to SEQ ID NO: 210205

SEQ ID NO: 642619 - RNA, 64 nt, hsa; identical to SEQ ID NO: 210206

SEQ ID NO: 642620 - RNA, 64 nt, hsa; identical to SEQ ID NO: 210207

SEQ ID NO: 642621 - RNA, 64 nt, hsa; identical to SEQ ID NO: 210208

SEQ ID NO: 642622 - RNA, 64 nt, hsa; identical to SEQ ID NO: 210209

SEQ ID NO: 642623 - RNA, 64 nt, hsa; identical to SEQ ID NO: 210210

SEQ ID NO: 642624 - RNA, 64 nt, hsa; identical to SEQ ID NO: 210211

SEQ ID NO: 642625 - RNA, 60 nt, hsa; identical to SEQ ID NO: 44968

SEQ ID NO: 642626 - RNA, 64 nt, hsa; identical to SEQ ID NO: 210213

SEQ ID NO: 642627 - RNA, 64 nt, hsa; identical to SEQ ID NO: 210214

SEQ ID NO: 642628 - RNA, 64 nt, hsa; identical to SEQ ID NO: 210215

SEQ ID NO: 642629 - RNA, 64 nt, hsa; identical to SEQ ID NO: 210216

SEQ ID NO: 642630 - RNA, 64 nt, hsa; identical to SEQ ID NO: 532477

SEQ ID NO: 642631 - RNA, 64 nt, hsa; identical to SEQ ID NO: 532478

SEQ ID NO: 642632 - RNA, 64 nt, hsa; identical to SEQ ID NO: 532479

SEQ ID NO: 642633 - RNA, 64 nt, hsa; identical to SEQ ID NO: 532480

SEQ ID NO: 642634 - RNA, 64 nt, hsa; identical to SEQ ID NO: 532481

SEQ ID NO: 642635 - RNA, 64 nt, hsa; identical to SEQ ID NO: 532482

SEQ ID NO: 642636 - RNA, 64 nt, hsa; identical to SEQ ID NO: 532483

SEQ ID NO: 642637 - RNA, 64 nt, hsa; identical to SEQ ID NO: 532484

SEQ ID NO: 642638 - RNA, 64 nt, hsa; identical to SEQ ID NO: 532485

SEQ ID NO: 642639 - RNA, 64 nt, hsa; identical to SEQ ID NO: 532486

SEQ ID NO: 642640 - RNA, 64 nt, hsa; identical to SEQ ID NO: 532487

SEQ ID NO: 642641 - RNA, 64 nt, hsa; identical to SEQ ID NO: 532488

SEQ ID NO: 642642 - RNA, 64 nt, hsa; identical to SEQ ID NO: 532489

SEQ ID NO: 642643 - RNA, 64 nt, hsa; identical to SEQ ID NO: 532490

SEQ ID NO: 642644 - RNA, 64 nt, hsa; identical to SEQ ID NO: 532491

SEQ ID NO: 642645 - RNA, 64 nt, hsa; identical to SEQ ID NO: 532492

SEQ ID NO: 642646 - RNA, 64 nt, hsa; identical to SEQ ID NO: 532493

SEQ ID NO: 642647 - RNA, 64 nt, hsa; identical to SEQ ID NO: 532494

SEQ ID NO: 642648 - RNA, 64 nt, hsa; identical to SEQ ID NO: 532495

SEQ ID NO: 642649 - RNA, 64 nt, hsa; identical to SEQ ID NO: 532496

SEQ ID NO: 642650 - RNA, 64 nt, hsa; identical to SEQ ID NO: 532497

SEQ ID NO: 642651 - RNA, 64 nt, hsa
aaguacucaguaauacaguacaguauucaguaaggcagugaaguacucaguaauacaauacagu

SEQ ID NO: 642652 - RNA, 64 nt, hsa
cagugcucaauaaggcagugcagugcucaguaaggcagugaauugcuuaguaacacaguguagu

SEQ ID NO: 642653 - RNA, 64 nt, hsa
gauuccaucauugaaaauuuugacccaaggcacagcagugaaauuuauaguucucaauuuaguu

SEQ ID NO: 642654 - RNA, 64 nt, hsa
uucacugugguacauuuuaaaauaaaauauuuuagcagugaauauggauuaagguguuuugggu

SEQ ID NO: 642655 - RNA, 64 nt, hsa
uauggaagagcgguagggaguccacggagaagaugcagugaaugcuugcaugcauucacacgug

SEQ ID NO: 642656 - RNA, 64 nt, hsa
cgugcgugguggaggcuggccucucuggcugggugcagugaauggccagcggguuucuuuucug

SEQ ID NO: 642657 - RNA, 64 nt, hsa
cccaugaacauuuguccuaacucagauuuugugagcagugaaguuuaacagagcagugacauuu

SEQ ID NO: 642658 - RNA, 64 nt, hsa
agugaaguuuaacagagcagugacauuuaacaaagcagugaaguuuaacagaguucugagaaua

SEQ ID NO: 642659 - RNA, 64 nt, hsa
agaacccucauaauuuuuaaaugaucugaauuuggcagugaauuuuuuuuuaagccacuuaauu

SEQ ID NO: 642660 - RNA, 64 nt, hsa
gaagcacuguacaaguuugugguuccuaagccccgcagugaauguucaaagccagagcagcugg

SEQ ID NO: 642661 - RNA, 64 nt, hsa
gugcgccaggugcuggcccugcggauagacuuccgcagugaagauaucaagaggcugcgccugu

SEQ ID NO: 642662 - RNA, 64 nt, hsa
aucucccaggugacucugaacaacguggaagucugcagugaaaacaucuccacucugaagaaga

SEQ ID NO: 642663 - RNA, 64 nt, hsa
acaaaauguucugcuagcuuguuuucuucacagugcagugaauuggaagacuugacugcaaaua

SEQ ID NO: 642664 - RNA, 64 nt, hsa
aauuguacugaauugcaaauugauaguuguucuagcagugaagagauaaagaaaaaaaaguaca

SEQ ID NO: 642665 - RNA, 64 nt, hsa
cagaaaauucacacuggagagaaaccuuaugaaugcagugaaugugggaaagcuuuuauucaga

SEQ ID NO: 642666 - RNA, 64 nt, hsa
auucaaaugauagaauaguauacagcacuuaaaagcagugaaccagauccauauuguguaacau

SEQ ID NO: 642667 - RNA, 64 nt, hsa
cagagaguucacucuggagagaggccuuaugaaugcagugaauguggcaaauucuuuguggaca

SEQ ID NO: 642668 - RNA, 64 nt, hsa
gagagaguucauacuggagaaaagccuuaugagugcagugaaugugggaaagucuuuagauaca

SEQ ID NO: 642669 - RNA, 64 nt, hsa
cggagaauucacacuggagagagaccuuaucagugcagugaauguggaagagucuuuaaccaaa

SEQ ID NO: 642670 - RNA, 64 nt, hsa
guguccccaagugacaauacguauagauugcugggcagugaaacaguuaagaugucaccguagc

SEQ ID NO: 642671 - RNA, 52 nt, hsa
acaggagaaaggccuuaugagugcagugaauaugggaaaucguuugcugaaa

SEQ ID NO: 642672 - RNA, 64 nt, hsa
uugccauuucuucugaaccggcccuccuguggacuagcacaacuuccuugcccacuguuucuuc

SEQ ID NO: 642673 - RNA, 64 nt, hsa
ucccugguuuuguaauacucccgaguguuccguauagcacaaagaguuuugcuuuuacuggcca

SEQ ID NO: 642674 - RNA, 64 nt, hsa
auaguuaccauuuuuuccugaucugucaucuucauagcacaacaaaacgaaaugauggaaaugc

SEQ ID NO: 642675 - RNA, 64 nt, hsa
guaugguuugggggaggcuauuuuauugugugguuagcacaaggaaucuaauuuauagcaagug

SEQ ID NO: 642676 - RNA, 64 nt, hsa
uaauuuaucaaugcaaacaguacauuaaaaacuguagcacaaucuauaauuuuuaccuucauau

SEQ ID NO: 642677 - RNA, 64 nt, hsa
guuggaaaauauuuuuuugaaaugcuuccugaaauagcacaauaaauuuccuuaaaauuucaua

SEQ ID NO: 642678 - RNA, 64 nt, hsa
ccuugacacaaggacuccacacugugcucucuaguagcacaaggaggaaguuggacagaacauu

SEQ ID NO: 642679 - RNA, 64 nt, hsa
gacuucuuggaauuaucagagguaggguggucuuuagcacaaagacuugcaugcagagaucccu

SEQ ID NO: 642680 - RNA, 64 nt, hsa
gucccuguuugaaagauuagcacaaaagucuugauagcacaacacaaauuccauccaagaggag

SEQ ID NO: 642681 - RNA, 64 nt, hsa
aagguuugccucaaaaugucccuguuugaaagauuagcacaaaagucuugauagcacaacacaa

SEQ ID NO: 642682 - RNA, 64 nt, hsa; identical to SEQ ID NO: 165822

SEQ ID NO: 642683 - RNA, 64 nt, hsa; identical to SEQ ID NO: 165823

SEQ ID NO: 642684 - RNA, 64 nt, hsa; identical to SEQ ID NO: 189259

SEQ ID NO: 642685 - RNA, 64 nt, hsa; identical to SEQ ID NO: 189260

SEQ ID NO: 642686 - RNA, 64 nt, hsa; identical to SEQ ID NO: 189261

SEQ ID NO: 642687 - RNA, 64 nt, hsa; identical to SEQ ID NO: 189262

SEQ ID NO: 642688 - RNA, 56 nt, hsa; identical to SEQ ID NO: 189263

SEQ ID NO: 642689 - RNA, 64 nt, hsa; identical to SEQ ID NO: 189264

SEQ ID NO: 642690 - RNA, 64 nt, hsa; identical to SEQ ID NO: 189265

SEQ ID NO: 642691 - RNA, 64 nt, hsa; identical to SEQ ID NO: 189266

SEQ ID NO: 642692 - RNA, 64 nt, hsa; identical to SEQ ID NO: 189267

SEQ ID NO: 642693 - RNA, 64 nt, hsa; identical to SEQ ID NO: 189268

SEQ ID NO: 642694 - RNA, 64 nt, hsa; identical to SEQ ID NO: 189269

SEQ ID NO: 642695 - RNA, 64 nt, hsa; identical to SEQ ID NO: 189270

SEQ ID NO: 642696 - RNA, 64 nt, hsa; identical to SEQ ID NO: 189271

SEQ ID NO: 642697 - RNA, 64 nt, hsa; identical to SEQ ID NO: 189272

SEQ ID NO: 642698 - RNA, 64 nt, hsa; identical to SEQ ID NO: 189273

SEQ ID NO: 642699 - RNA, 64 nt, hsa; identical to SEQ ID NO: 189274

SEQ ID NO: 642700 - RNA, 64 nt, hsa; identical to SEQ ID NO: 189275

SEQ ID NO: 642701 - RNA, 64 nt, hsa; identical to SEQ ID NO: 189276

SEQ ID NO: 642702 - RNA, 64 nt, hsa; identical to SEQ ID NO: 189277

SEQ ID NO: 642703 - RNA, 64 nt, hsa; identical to SEQ ID NO: 189278

SEQ ID NO: 642704 - RNA, 64 nt, hsa; identical to SEQ ID NO: 189279

SEQ ID NO: 642705 - RNA, 64 nt, hsa; identical to SEQ ID NO: 189280

SEQ ID NO: 642706 - RNA, 64 nt, hsa; identical to SEQ ID NO: 524136

SEQ ID NO: 642707 - RNA, 64 nt, hsa; identical to SEQ ID NO: 524137

SEQ ID NO: 642708 - RNA, 64 nt, hsa
uuucuauuuggcauagcuaacuacacuuugauacuaacuccaguuuuacuauuauuauuuuggu

SEQ ID NO: 642709 - RNA, 64 nt, hsa
uucucauaacauauaugagguauacaaaauuuucuaacuccagauuguagucauuuugagaggu

SEQ ID NO: 642710 - RNA, 64 nt, hsa
gaccaaucucuugaaucccauaucuacccagaauuaacuccauuccagucucugcauguaauca

SEQ ID NO: 642711 - RNA, 64 nt, hsa
aguugauggugguaaacauucucucaggagacaauaacuccagugauguucuucaaagauuuua

SEQ ID NO: 642712 - RNA, 64 nt, hsa; identical to SEQ ID NO: 110784

SEQ ID NO: 642713 - RNA, 64 nt, hsa; identical to SEQ ID NO: 110785

SEQ ID NO: 642714 - RNA, 64 nt, hsa; identical to SEQ ID NO: 110786

SEQ ID NO: 642715 - RNA, 64 nt, hsa; identical to SEQ ID NO: 110787

SEQ ID NO: 642716 - RNA, 64 nt, hsa; identical to SEQ ID NO: 110788

SEQ ID NO: 642717 - RNA, 64 nt, hsa; identical to SEQ ID NO: 110789

SEQ ID NO: 642718 - RNA, 64 nt, hsa; identical to SEQ ID NO: 110790

SEQ ID NO: 642719 - RNA, 64 nt, hsa; identical to SEQ ID NO: 110791

SEQ ID NO: 642720 - RNA, 64 nt, hsa; identical to SEQ ID NO: 110792

SEQ ID NO: 642721 - RNA, 64 nt, hsa; identical to SEQ ID NO: 110793

SEQ ID NO: 642722 - RNA, 64 nt, hsa; identical to SEQ ID NO: 110794

SEQ ID NO: 642723 - RNA, 64 nt, hsa; identical to SEQ ID NO: 110795

SEQ ID NO: 642724 - RNA, 64 nt, hsa; identical to SEQ ID NO: 110796

SEQ ID NO: 642725 - RNA, 64 nt, hsa; identical to SEQ ID NO: 110797

SEQ ID NO: 642726 - RNA, 64 nt, hsa; identical to SEQ ID NO: 110798

SEQ ID NO: 642727 - RNA, 64 nt, hsa; identical to SEQ ID NO: 110799

SEQ ID NO: 642728 - RNA, 64 nt, hsa; identical to SEQ ID NO: 47675

SEQ ID NO: 642729 - RNA, 64 nt, hsa; identical to SEQ ID NO: 47676

SEQ ID NO: 642730 - RNA, 64 nt, hsa; identical to SEQ ID NO: 47677

SEQ ID NO: 642731 - RNA, 64 nt, hsa; identical to SEQ ID NO: 47678

SEQ ID NO: 642732 - RNA, 64 nt, hsa; identical to SEQ ID NO: 47679

SEQ ID NO: 642733 - RNA, 64 nt, hsa; identical to SEQ ID NO: 47680

SEQ ID NO: 642734 - RNA, 64 nt, hsa; identical to SEQ ID NO: 47681

SEQ ID NO: 642735 - RNA, 64 nt, hsa; identical to SEQ ID NO: 47682

SEQ ID NO: 642736 - RNA, 64 nt, hsa; identical to SEQ ID NO: 47683

SEQ ID NO: 642737 - RNA, 64 nt, hsa; identical to SEQ ID NO: 47684

SEQ ID NO: 642738 - RNA, 64 nt, hsa; identical to SEQ ID NO: 47685

SEQ ID NO: 642739 - RNA, 64 nt, hsa; identical to SEQ ID NO: 47686

SEQ ID NO: 642740 - RNA, 64 nt, hsa; identical to SEQ ID NO: 47687

SEQ ID NO: 642741 - RNA, 64 nt, hsa; identical to SEQ ID NO: 47688

SEQ ID NO: 642742 - RNA, 64 nt, hsa; identical to SEQ ID NO: 390683

SEQ ID NO: 642743 - RNA, 64 nt, hsa; identical to SEQ ID NO: 390684

SEQ ID NO: 642744 - RNA, 64 nt, hsa; identical to SEQ ID NO: 390685

SEQ ID NO: 642745 - RNA, 64 nt, hsa; identical to SEQ ID NO: 390686

SEQ ID NO: 642746 - RNA, 64 nt, hsa; identical to SEQ ID NO: 390687

SEQ ID NO: 642747 - RNA, 64 nt, hsa; identical to SEQ ID NO: 390688

SEQ ID NO: 642748 - RNA, 64 nt, hsa; identical to SEQ ID NO: 390689

SEQ ID NO: 642749 - RNA, 64 nt, hsa; identical to SEQ ID NO: 390690

SEQ ID NO: 642750 - RNA, 64 nt, hsa; identical to SEQ ID NO: 390691

SEQ ID NO: 642751 - RNA, 64 nt, hsa; identical to SEQ ID NO: 390692

SEQ ID NO: 642752 - RNA, 64 nt, hsa; identical to SEQ ID NO: 390693

SEQ ID NO: 642753 - RNA, 64 nt, hsa; identical to SEQ ID NO: 390694

SEQ ID NO: 642754 - RNA, 64 nt, hsa; identical to SEQ ID NO: 390695

SEQ ID NO: 642755 - RNA, 64 nt, hsa; identical to SEQ ID NO: 390696

SEQ ID NO: 642756 - RNA, 64 nt, hsa; identical to SEQ ID NO: 390697

SEQ ID NO: 642757 - RNA, 64 nt, hsa; identical to SEQ ID NO: 390698

SEQ ID NO: 642758 - RNA, 64 nt, hsa; identical to SEQ ID NO: 390699

SEQ ID NO: 642759 - RNA, 64 nt, hsa; identical to SEQ ID NO: 390700

SEQ ID NO: 642760 - RNA, 64 nt, hsa; identical to SEQ ID NO: 390701

SEQ ID NO: 642761 - RNA, 64 nt, hsa; identical to SEQ ID NO: 390702

SEQ ID NO: 642762 - RNA, 64 nt, hsa; identical to SEQ ID NO: 390703

SEQ ID NO: 642763 - RNA, 64 nt, hsa; identical to SEQ ID NO: 390704

SEQ ID NO: 642764 - RNA, 64 nt, hsa; identical to SEQ ID NO: 390705

SEQ ID NO: 642765 - RNA, 64 nt, hsa; identical to SEQ ID NO: 390706

SEQ ID NO: 642766 - RNA, 64 nt, hsa; identical to SEQ ID NO: 390707

SEQ ID NO: 642767 - RNA, 64 nt, hsa; identical to SEQ ID NO: 390708

SEQ ID NO: 642768 - RNA, 64 nt, hsa; identical to SEQ ID NO: 390709

SEQ ID NO: 642769 - RNA, 64 nt, hsa; identical to SEQ ID NO: 390710

SEQ ID NO: 642770 - RNA, 64 nt, hsa; identical to SEQ ID NO: 390711

SEQ ID NO: 642771 - RNA, 64 nt, hsa; identical to SEQ ID NO: 390712

SEQ ID NO: 642772 - RNA, 64 nt, hsa; identical to SEQ ID NO: 390713

SEQ ID NO: 642773 - RNA, 64 nt, hsa; identical to SEQ ID NO: 390714

SEQ ID NO: 642774 - RNA, 64 nt, hsa; identical to SEQ ID NO: 390715

SEQ ID NO: 642775 - RNA, 64 nt, hsa; identical to SEQ ID NO: 390716

SEQ ID NO: 642776 - RNA, 64 nt, hsa; identical to SEQ ID NO: 390717

SEQ ID NO: 642777 - RNA, 64 nt, hsa; identical to SEQ ID NO: 390718

SEQ ID NO: 642778 - RNA, 64 nt, hsa; identical to SEQ ID NO: 390719

SEQ ID NO: 642779 - RNA, 64 nt, hsa; identical to SEQ ID NO: 390720

SEQ ID NO: 642780 - RNA, 64 nt, hsa; identical to SEQ ID NO: 390721

SEQ ID NO: 642781 - RNA, 64 nt, hsa; identical to SEQ ID NO: 390722

SEQ ID NO: 642782 - RNA, 64 nt, hsa; identical to SEQ ID NO: 390723

SEQ ID NO: 642783 - RNA, 64 nt, hsa; identical to SEQ ID NO: 390724

SEQ ID NO: 642784 - RNA, 64 nt, hsa; identical to SEQ ID NO: 390725

SEQ ID NO: 642785 - RNA, 64 nt, hsa; identical to SEQ ID NO: 390726

SEQ ID NO: 642786 - RNA, 64 nt, hsa; identical to SEQ ID NO: 390727

SEQ ID NO: 642787 - RNA, 64 nt, hsa; identical to SEQ ID NO: 390728

SEQ ID NO: 642788 - RNA, 64 nt, hsa; identical to SEQ ID NO: 390729

SEQ ID NO: 642789 - RNA, 64 nt, hsa; identical to SEQ ID NO: 390730

SEQ ID NO: 642790 - RNA, 64 nt, hsa; identical to SEQ ID NO: 390731

SEQ ID NO: 642791 - RNA, 64 nt, hsa; identical to SEQ ID NO: 390732

SEQ ID NO: 642792 - RNA, 64 nt, hsa; identical to SEQ ID NO: 390733

SEQ ID NO: 642793 - RNA, 64 nt, hsa; identical to SEQ ID NO: 390734

SEQ ID NO: 642794 - RNA, 64 nt, hsa; identical to SEQ ID NO: 390735

SEQ ID NO: 642795 - RNA, 64 nt, hsa; identical to SEQ ID NO: 390736

SEQ ID NO: 642796 - RNA, 64 nt, hsa; identical to SEQ ID NO: 390737

SEQ ID NO: 642797 - RNA, 64 nt, hsa; identical to SEQ ID NO: 390738

SEQ ID NO: 642798 - RNA, 64 nt, hsa; identical to SEQ ID NO: 390739

SEQ ID NO: 642799 - RNA, 64 nt, hsa; identical to SEQ ID NO: 390740

SEQ ID NO: 642800 - RNA, 64 nt, hsa; identical to SEQ ID NO: 390741

SEQ ID NO: 642801 - RNA, 64 nt, hsa; identical to SEQ ID NO: 390742

SEQ ID NO: 642802 - RNA, 64 nt, hsa; identical to SEQ ID NO: 390743

SEQ ID NO: 642803 - RNA, 64 nt, hsa; identical to SEQ ID NO: 47675

SEQ ID NO: 642804 - RNA, 64 nt, hsa; identical to SEQ ID NO: 47676

SEQ ID NO: 642805 - RNA, 64 nt, hsa; identical to SEQ ID NO: 47677

SEQ ID NO: 642806 - RNA, 64 nt, hsa; identical to SEQ ID NO: 47678

SEQ ID NO: 642807 - RNA, 64 nt, hsa; identical to SEQ ID NO: 47679

SEQ ID NO: 642808 - RNA, 64 nt, hsa; identical to SEQ ID NO: 47680

SEQ ID NO: 642809 - RNA, 64 nt, hsa; identical to SEQ ID NO: 47681

SEQ ID NO: 642810 - RNA, 64 nt, hsa; identical to SEQ ID NO: 47682

SEQ ID NO: 642811 - RNA, 64 nt, hsa; identical to SEQ ID NO: 47683

SEQ ID NO: 642812 - RNA, 64 nt, hsa; identical to SEQ ID NO: 47684

SEQ ID NO: 642813 - RNA, 64 nt, hsa; identical to SEQ ID NO: 47685

SEQ ID NO: 642814 - RNA, 64 nt, hsa; identical to SEQ ID NO: 47686

SEQ ID NO: 642815 - RNA, 64 nt, hsa; identical to SEQ ID NO: 47687

SEQ ID NO: 642816 - RNA, 64 nt, hsa; identical to SEQ ID NO: 47688

SEQ ID NO: 642817 - RNA, 64 nt, hsa; identical to SEQ ID NO: 390683

SEQ ID NO: 642818 - RNA, 64 nt, hsa; identical to SEQ ID NO: 390684

SEQ ID NO: 642819 - RNA, 64 nt, hsa; identical to SEQ ID NO: 390685

SEQ ID NO: 642820 - RNA, 64 nt, hsa; identical to SEQ ID NO: 390686

SEQ ID NO: 642821 - RNA, 64 nt, hsa; identical to SEQ ID NO: 390687

SEQ ID NO: 642822 - RNA, 64 nt, hsa; identical to SEQ ID NO: 390688

SEQ ID NO: 642823 - RNA, 64 nt, hsa; identical to SEQ ID NO: 390689

SEQ ID NO: 642824 - RNA, 64 nt, hsa; identical to SEQ ID NO: 390690

SEQ ID NO: 642825 - RNA, 64 nt, hsa; identical to SEQ ID NO: 390691

SEQ ID NO: 642826 - RNA, 64 nt, hsa; identical to SEQ ID NO: 390692

SEQ ID NO: 642827 - RNA, 64 nt, hsa; identical to SEQ ID NO: 390693

SEQ ID NO: 642828 - RNA, 64 nt, hsa; identical to SEQ ID NO: 390694

SEQ ID NO: 642829 - RNA, 64 nt, hsa; identical to SEQ ID NO: 390695

SEQ ID NO: 642830 - RNA, 64 nt, hsa; identical to SEQ ID NO: 390696

SEQ ID NO: 642831 - RNA, 64 nt, hsa; identical to SEQ ID NO: 390697

SEQ ID NO: 642832 - RNA, 64 nt, hsa; identical to SEQ ID NO: 390698

SEQ ID NO: 642833 - RNA, 64 nt, hsa; identical to SEQ ID NO: 390699

SEQ ID NO: 642834 - RNA, 64 nt, hsa; identical to SEQ ID NO: 390700

SEQ ID NO: 642835 - RNA, 64 nt, hsa; identical to SEQ ID NO: 390701

SEQ ID NO: 642836 - RNA, 64 nt, hsa; identical to SEQ ID NO: 390702

SEQ ID NO: 642837 - RNA, 64 nt, hsa; identical to SEQ ID NO: 390703

SEQ ID NO: 642838 - RNA, 64 nt, hsa; identical to SEQ ID NO: 390704

SEQ ID NO: 642839 - RNA, 64 nt, hsa; identical to SEQ ID NO: 390705

SEQ ID NO: 642840 - RNA, 64 nt, hsa; identical to SEQ ID NO: 390706

SEQ ID NO: 642841 - RNA, 64 nt, hsa; identical to SEQ ID NO: 390707

SEQ ID NO: 642842 - RNA, 64 nt, hsa; identical to SEQ ID NO: 390708

SEQ ID NO: 642843 - RNA, 64 nt, hsa; identical to SEQ ID NO: 390709

SEQ ID NO: 642844 - RNA, 64 nt, hsa; identical to SEQ ID NO: 390710

SEQ ID NO: 642845 - RNA, 64 nt, hsa; identical to SEQ ID NO: 390711

SEQ ID NO: 642846 - RNA, 64 nt, hsa; identical to SEQ ID NO: 390712

SEQ ID NO: 642847 - RNA, 64 nt, hsa; identical to SEQ ID NO: 390713

SEQ ID NO: 642848 - RNA, 64 nt, hsa; identical to SEQ ID NO: 390714

SEQ ID NO: 642849 - RNA, 64 nt, hsa; identical to SEQ ID NO: 390715

SEQ ID NO: 642850 - RNA, 64 nt, hsa; identical to SEQ ID NO: 390716

SEQ ID NO: 642851 - RNA, 64 nt, hsa; identical to SEQ ID NO: 390717

SEQ ID NO: 642852 - RNA, 64 nt, hsa; identical to SEQ ID NO: 390718

SEQ ID NO: 642853 - RNA, 64 nt, hsa; identical to SEQ ID NO: 390719

SEQ ID NO: 642854 - RNA, 64 nt, hsa; identical to SEQ ID NO: 390720

SEQ ID NO: 642855 - RNA, 64 nt, hsa; identical to SEQ ID NO: 390721

SEQ ID NO: 642856 - RNA, 64 nt, hsa; identical to SEQ ID NO: 390722

SEQ ID NO: 642857 - RNA, 64 nt, hsa; identical to SEQ ID NO: 390723

SEQ ID NO: 642858 - RNA, 64 nt, hsa; identical to SEQ ID NO: 390724

SEQ ID NO: 642859 - RNA, 64 nt, hsa; identical to SEQ ID NO: 390725

SEQ ID NO: 642860 - RNA, 64 nt, hsa; identical to SEQ ID NO: 390726

SEQ ID NO: 642861 - RNA, 64 nt, hsa; identical to SEQ ID NO: 390727

SEQ ID NO: 642862 - RNA, 64 nt, hsa; identical to SEQ ID NO: 390728

SEQ ID NO: 642863 - RNA, 64 nt, hsa; identical to SEQ ID NO: 390729

SEQ ID NO: 642864 - RNA, 64 nt, hsa; identical to SEQ ID NO: 390730

SEQ ID NO: 642865 - RNA, 64 nt, hsa; identical to SEQ ID NO: 390731

SEQ ID NO: 642866 - RNA, 64 nt, hsa; identical to SEQ ID NO: 390732

SEQ ID NO: 642867 - RNA, 64 nt, hsa; identical to SEQ ID NO: 390733

SEQ ID NO: 642868 - RNA, 64 nt, hsa; identical to SEQ ID NO: 390734

SEQ ID NO: 642869 - RNA, 64 nt, hsa; identical to SEQ ID NO: 390735

SEQ ID NO: 642870 - RNA, 64 nt, hsa; identical to SEQ ID NO: 390736

SEQ ID NO: 642871 - RNA, 64 nt, hsa; identical to SEQ ID NO: 390737

SEQ ID NO: 642872 - RNA, 64 nt, hsa; identical to SEQ ID NO: 390738

SEQ ID NO: 642873 - RNA, 64 nt, hsa; identical to SEQ ID NO: 390739

SEQ ID NO: 642874 - RNA, 64 nt, hsa; identical to SEQ ID NO: 390740

SEQ ID NO: 642875 - RNA, 64 nt, hsa; identical to SEQ ID NO: 390741

SEQ ID NO: 642876 - RNA, 64 nt, hsa; identical to SEQ ID NO: 390742

SEQ ID NO: 642877 - RNA, 64 nt, hsa; identical to SEQ ID NO: 390743

SEQ ID NO: 642878 - RNA, 64 nt, hsa
uaccuucauguggcucagugccuuccucucucuaccagucuauuuccauucuuucagcuguguc

SEQ ID NO: 642879 - RNA, 64 nt, hsa
uaccuucaugugguucagugccuuccucucucuaccagucuauuuccacugaacaaaaccuacg

SEQ ID NO: 642880 - RNA, 64 nt, hsa
uaccuucaugugauucacugccuuccucucucuaccagucuauuuccacugaacaaaaccuaca

SEQ ID NO: 642881 - RNA, 64 nt, hsa
uuguaaagugacuaccuuaauguguauagagaccccagucuacuauuauuugggaaaauuguuu

SEQ ID NO: 642882 - RNA, 64 nt, hsa
uuucuauaaaagaaauggucauuuuacuuagaugccagucuacuuuauaaagacaaauggauua

SEQ ID NO: 642883 - RNA, 64 nt, hsa
ugugguaacaagcuaauaugcuuccaguugacuuccagucuacccugguguuagaaaccguuuc

SEQ ID NO: 642884 - RNA, 64 nt, hsa
aaccuacaaaaugggcccugcccucagagagguuccagucuagaugaggagcugaucuagacag

SEQ ID NO: 642885 - RNA, 64 nt, hsa
uuacaugagggguucuucacgauucuccuggaacccagucuagcaaaaugagaggaaaggcccu

SEQ ID NO: 642886 - RNA, 64 nt, hsa
auucuccucauggauauuuucagucucaauguugccagucuaauaguauaguaugugguugcuu

SEQ ID NO: 642887 - RNA, 64 nt, hsa; identical to SEQ ID NO: 266633

SEQ ID NO: 642888 - RNA, 64 nt, hsa; identical to SEQ ID NO: 266634

SEQ ID NO: 642889 - RNA, 64 nt, hsa; identical to SEQ ID NO: 266635

SEQ ID NO: 642890 - RNA, 64 nt, hsa; identical to SEQ ID NO: 266636

SEQ ID NO: 642891 - RNA, 64 nt, hsa; identical to SEQ ID NO: 266637

SEQ ID NO: 642892 - RNA, 64 nt, hsa; identical to SEQ ID NO: 266638

SEQ ID NO: 642893 - RNA, 64 nt, hsa; identical to SEQ ID NO: 266639

SEQ ID NO: 642894 - RNA, 64 nt, hsa; identical to SEQ ID NO: 266640

SEQ ID NO: 642895 - RNA, 64 nt, hsa; identical to SEQ ID NO: 266641

SEQ ID NO: 642896 - RNA, 64 nt, hsa; identical to SEQ ID NO: 266642

SEQ ID NO: 642897 - RNA, 64 nt, hsa; identical to SEQ ID NO: 266643

SEQ ID NO: 642898 - RNA, 64 nt, hsa; identical to SEQ ID NO: 266644

SEQ ID NO: 642899 - RNA, 64 nt, hsa; identical to SEQ ID NO: 266645

SEQ ID NO: 642900 - RNA, 64 nt, hsa; identical to SEQ ID NO: 266646

SEQ ID NO: 642901 - RNA, 63 nt, hsa; identical to SEQ ID NO: 266647

SEQ ID NO: 642902 - RNA, 64 nt, hsa; identical to SEQ ID NO: 266648

SEQ ID NO: 642903 - RNA, 64 nt, hsa; identical to SEQ ID NO: 266649

SEQ ID NO: 642904 - RNA, 64 nt, hsa; identical to SEQ ID NO: 266650

SEQ ID NO: 642905 - RNA, 64 nt, hsa; identical to SEQ ID NO: 199907

SEQ ID NO: 642906 - RNA, 64 nt, hsa; identical to SEQ ID NO: 199908

SEQ ID NO: 642907 - RNA, 64 nt, hsa; identical to SEQ ID NO: 199909

SEQ ID NO: 642908 - RNA, 64 nt, hsa; identical to SEQ ID NO: 199910

SEQ ID NO: 642909 - RNA, 64 nt, hsa; identical to SEQ ID NO: 199911

SEQ ID NO: 642910 - RNA, 64 nt, hsa; identical to SEQ ID NO: 199912

SEQ ID NO: 642911 - RNA, 64 nt, hsa; identical to SEQ ID NO: 199913

SEQ ID NO: 642912 - RNA, 64 nt, hsa; identical to SEQ ID NO: 199914

SEQ ID NO: 642913 - RNA, 64 nt, hsa; identical to SEQ ID NO: 199915

SEQ ID NO: 642914 - RNA, 64 nt, hsa; identical to SEQ ID NO: 199916

SEQ ID NO: 642915 - RNA, 64 nt, hsa; identical to SEQ ID NO: 199917

SEQ ID NO: 642916 - RNA, 64 nt, hsa; identical to SEQ ID NO: 199918

SEQ ID NO: 642917 - RNA, 64 nt, hsa; identical to SEQ ID NO: 199919

SEQ ID NO: 642918 - RNA, 64 nt, hsa; identical to SEQ ID NO: 199920

SEQ ID NO: 642919 - RNA, 64 nt, hsa; identical to SEQ ID NO: 199921

SEQ ID NO: 642920 - RNA, 64 nt, hsa; identical to SEQ ID NO: 199922

SEQ ID NO: 642921 - RNA, 64 nt, hsa; identical to SEQ ID NO: 199923

SEQ ID NO: 642922 - RNA, 64 nt, hsa; identical to SEQ ID NO: 199924

SEQ ID NO: 642923 - RNA, 64 nt, hsa; identical to SEQ ID NO: 199925

SEQ ID NO: 642924 - RNA, 64 nt, hsa; identical to SEQ ID NO: 199926

SEQ ID NO: 642925 - RNA, 64 nt, hsa; identical to SEQ ID NO: 199927

SEQ ID NO: 642926 - RNA, 64 nt, hsa; identical to SEQ ID NO: 199928

SEQ ID NO: 642927 - RNA, 64 nt, hsa; identical to SEQ ID NO: 199929

SEQ ID NO: 642928 - RNA, 64 nt, hsa; identical to SEQ ID NO: 199930

SEQ ID NO: 642929 - RNA, 64 nt, hsa; identical to SEQ ID NO: 199931

SEQ ID NO: 642930 - RNA, 64 nt, hsa; identical to SEQ ID NO: 199932

SEQ ID NO: 642931 - RNA, 64 nt, hsa; identical to SEQ ID NO: 199933

SEQ ID NO: 642932 - RNA, 64 nt, hsa; identical to SEQ ID NO: 199934

SEQ ID NO: 642933 - RNA, 64 nt, hsa; identical to SEQ ID NO: 199935

SEQ ID NO: 642934 - RNA, 64 nt, hsa; identical to SEQ ID NO: 199936

SEQ ID NO: 642935 - RNA, 64 nt, hsa; identical to SEQ ID NO: 199937

SEQ ID NO: 642936 - RNA, 64 nt, hsa; identical to SEQ ID NO: 199938

SEQ ID NO: 642937 - RNA, 64 nt, hsa; identical to SEQ ID NO: 199939

SEQ ID NO: 642938 - RNA, 64 nt, hsa; identical to SEQ ID NO: 199940

SEQ ID NO: 642939 - RNA, 64 nt, hsa; identical to SEQ ID NO: 199941

SEQ ID NO: 642940 - RNA, 64 nt, hsa; identical to SEQ ID NO: 199942

SEQ ID NO: 642941 - RNA, 64 nt, hsa; identical to SEQ ID NO: 390131

SEQ ID NO: 642942 - RNA, 64 nt, hsa; identical to SEQ ID NO: 390132

SEQ ID NO: 642943 - RNA, 64 nt, hsa; identical to SEQ ID NO: 390133

SEQ ID NO: 642944 - RNA, 64 nt, hsa; identical to SEQ ID NO: 390134

SEQ ID NO: 642945 - RNA, 64 nt, hsa; identical to SEQ ID NO: 390135

SEQ ID NO: 642946 - RNA, 64 nt, hsa; identical to SEQ ID NO: 390136

SEQ ID NO: 642947 - RNA, 64 nt, hsa; identical to SEQ ID NO: 390137

SEQ ID NO: 642948 - RNA, 64 nt, hsa; identical to SEQ ID NO: 390138

SEQ ID NO: 642949 - RNA, 64 nt, hsa; identical to SEQ ID NO: 390139

SEQ ID NO: 642950 - RNA, 64 nt, hsa; identical to SEQ ID NO: 390140

SEQ ID NO: 642951 - RNA, 64 nt, hsa; identical to SEQ ID NO: 390141

SEQ ID NO: 642952 - RNA, 64 nt, hsa; identical to SEQ ID NO: 390142

SEQ ID NO: 642953 - RNA, 64 nt, hsa; identical to SEQ ID NO: 390143

SEQ ID NO: 642954 - RNA, 57 nt, hsa; identical to SEQ ID NO: 390144

SEQ ID NO: 642955 - RNA, 64 nt, hsa; identical to SEQ ID NO: 390145

SEQ ID NO: 642956 - RNA, 64 nt, hsa; identical to SEQ ID NO: 390146

SEQ ID NO: 642957 - RNA, 64 nt, hsa; identical to SEQ ID NO: 390147

SEQ ID NO: 642958 - RNA, 64 nt, hsa; identical to SEQ ID NO: 390148

SEQ ID NO: 642959 - RNA, 64 nt, hsa; identical to SEQ ID NO: 390149

SEQ ID NO: 642960 - RNA, 64 nt, hsa; identical to SEQ ID NO: 390150

SEQ ID NO: 642961 - RNA, 64 nt, hsa; identical to SEQ ID NO: 390151

SEQ ID NO: 642962 - RNA, 64 nt, hsa; identical to SEQ ID NO: 390152

SEQ ID NO: 642963 - RNA, 64 nt, hsa; identical to SEQ ID NO: 390153

SEQ ID NO: 642964 - RNA, 64 nt, hsa; identical to SEQ ID NO: 390154

SEQ ID NO: 642965 - RNA, 64 nt, hsa; identical to SEQ ID NO: 390155

SEQ ID NO: 642966 - RNA, 64 nt, hsa; identical to SEQ ID NO: 390156

SEQ ID NO: 642967 - RNA, 64 nt, hsa; identical to SEQ ID NO: 390157

SEQ ID NO: 642968 - RNA, 64 nt, hsa; identical to SEQ ID NO: 390158

SEQ ID NO: 642969 - RNA, 64 nt, hsa; identical to SEQ ID NO: 390159

SEQ ID NO: 642970 - RNA, 64 nt, hsa; identical to SEQ ID NO: 390160

SEQ ID NO: 642971 - RNA, 64 nt, hsa; identical to SEQ ID NO: 390161

SEQ ID NO: 642972 - RNA, 64 nt, hsa; identical to SEQ ID NO: 390162

SEQ ID NO: 642973 - RNA, 64 nt, hsa; identical to SEQ ID NO: 390163

SEQ ID NO: 642974 - RNA, 64 nt, hsa; identical to SEQ ID NO: 390164

SEQ ID NO: 642975 - RNA, 64 nt, hsa; identical to SEQ ID NO: 390165

SEQ ID NO: 642976 - RNA, 64 nt, hsa; identical to SEQ ID NO: 390166

SEQ ID NO: 642977 - RNA, 64 nt, hsa; identical to SEQ ID NO: 390167

SEQ ID NO: 642978 - RNA, 64 nt, hsa; identical to SEQ ID NO: 390168

SEQ ID NO: 642979 - RNA, 64 nt, hsa; identical to SEQ ID NO: 390169

SEQ ID NO: 642980 - RNA, 64 nt, hsa; identical to SEQ ID NO: 390170

SEQ ID NO: 642981 - RNA, 64 nt, hsa; identical to SEQ ID NO: 390171

SEQ ID NO: 642982 - RNA, 64 nt, hsa; identical to SEQ ID NO: 390172

SEQ ID NO: 642983 - RNA, 64 nt, hsa; identical to SEQ ID NO: 390173

SEQ ID NO: 642984 - RNA, 64 nt, hsa; identical to SEQ ID NO: 390174

SEQ ID NO: 642985 - RNA, 64 nt, hsa; identical to SEQ ID NO: 390175

SEQ ID NO: 642986 - RNA, 64 nt, hsa; identical to SEQ ID NO: 390176

SEQ ID NO: 642987 - RNA, 64 nt, hsa; identical to SEQ ID NO: 390177

SEQ ID NO: 642988 - RNA, 64 nt, hsa; identical to SEQ ID NO: 390178

SEQ ID NO: 642989 - RNA, 64 nt, hsa; identical to SEQ ID NO: 390179

SEQ ID NO: 642990 - RNA, 64 nt, hsa; identical to SEQ ID NO: 390180

SEQ ID NO: 642991 - RNA, 64 nt, hsa; identical to SEQ ID NO: 390181

SEQ ID NO: 642992 - RNA, 64 nt, hsa; identical to SEQ ID NO: 390182

SEQ ID NO: 642993 - RNA, 64 nt, hsa; identical to SEQ ID NO: 390183

SEQ ID NO: 642994 - RNA, 64 nt, hsa; identical to SEQ ID NO: 390184

SEQ ID NO: 642995 - RNA, 64 nt, hsa; identical to SEQ ID NO: 390185

SEQ ID NO: 642996 - RNA, 64 nt, hsa; identical to SEQ ID NO: 390186

SEQ ID NO: 642997 - RNA, 64 nt, hsa; identical to SEQ ID NO: 390187

SEQ ID NO: 642998 - RNA, 64 nt, hsa; identical to SEQ ID NO: 390188

SEQ ID NO: 642999 - RNA, 64 nt, hsa; identical to SEQ ID NO: 390189

SEQ ID NO: 643000 - RNA, 64 nt, hsa; identical to SEQ ID NO: 390190

SEQ ID NO: 643001 - RNA, 64 nt, hsa; identical to SEQ ID NO: 390191

SEQ ID NO: 643002 - RNA, 64 nt, hsa; identical to SEQ ID NO: 390192

SEQ ID NO: 643003 - RNA, 64 nt, hsa; identical to SEQ ID NO: 390193

SEQ ID NO: 643004 - RNA, 64 nt, hsa; identical to SEQ ID NO: 390194

SEQ ID NO: 643005 - RNA, 64 nt, hsa; identical to SEQ ID NO: 390195

SEQ ID NO: 643006 - RNA, 64 nt, hsa; identical to SEQ ID NO: 390196

SEQ ID NO: 643007 - RNA, 64 nt, hsa; identical to SEQ ID NO: 390197

SEQ ID NO: 643008 - RNA, 64 nt, hsa; identical to SEQ ID NO: 390198

SEQ ID NO: 643009 - RNA, 64 nt, hsa; identical to SEQ ID NO: 390199

SEQ ID NO: 643010 - RNA, 64 nt, hsa; identical to SEQ ID NO: 390200

SEQ ID NO: 643011 - RNA, 64 nt, hsa; identical to SEQ ID NO: 390201

SEQ ID NO: 643012 - RNA, 64 nt, hsa; identical to SEQ ID NO: 390202

SEQ ID NO: 643013 - RNA, 64 nt, hsa; identical to SEQ ID NO: 390203

SEQ ID NO: 643014 - RNA, 64 nt, hsa; identical to SEQ ID NO: 390204

SEQ ID NO: 643015 - RNA, 60 nt, hsa; identical to SEQ ID NO: 390205

SEQ ID NO: 643016 - RNA, 64 nt, hsa; identical to SEQ ID NO: 390206

SEQ ID NO: 643017 - RNA, 64 nt, hsa; identical to SEQ ID NO: 390207

SEQ ID NO: 643018 - RNA, 64 nt, hsa; identical to SEQ ID NO: 390208

SEQ ID NO: 643019 - RNA, 64 nt, hsa; identical to SEQ ID NO: 390209

SEQ ID NO: 643020 - RNA, 64 nt, hsa; identical to SEQ ID NO: 390210

SEQ ID NO: 643021 - RNA, 64 nt, hsa; identical to SEQ ID NO: 390211

SEQ ID NO: 643022 - RNA, 64 nt, hsa; identical to SEQ ID NO: 390212

SEQ ID NO: 643023 - RNA, 64 nt, hsa; identical to SEQ ID NO: 390213

SEQ ID NO: 643024 - RNA, 64 nt, hsa; identical to SEQ ID NO: 390214

SEQ ID NO: 643025 - RNA, 64 nt, hsa; identical to SEQ ID NO: 390215

SEQ ID NO: 643026 - RNA, 64 nt, hsa; identical to SEQ ID NO: 390216

SEQ ID NO: 643027 - RNA, 64 nt, hsa; identical to SEQ ID NO: 390217

SEQ ID NO: 643028 - RNA, 64 nt, hsa; identical to SEQ ID NO: 390218

SEQ ID NO: 643029 - RNA, 64 nt, hsa; identical to SEQ ID NO: 390219

SEQ ID NO: 643030 - RNA, 64 nt, hsa; identical to SEQ ID NO: 390220

SEQ ID NO: 643031 - RNA, 64 nt, hsa; identical to SEQ ID NO: 390221

SEQ ID NO: 643032 - RNA, 64 nt, hsa; identical to SEQ ID NO: 390222

SEQ ID NO: 643033 - RNA, 64 nt, hsa; identical to SEQ ID NO: 390223

SEQ ID NO: 643034 - RNA, 64 nt, hsa; identical to SEQ ID NO: 390224

SEQ ID NO: 643035 - RNA, 64 nt, hsa; identical to SEQ ID NO: 390225

SEQ ID NO: 643036 - RNA, 64 nt, hsa; identical to SEQ ID NO: 390226

SEQ ID NO: 643037 - RNA, 64 nt, hsa; identical to SEQ ID NO: 390227

SEQ ID NO: 643038 - RNA, 64 nt, hsa; identical to SEQ ID NO: 390228

SEQ ID NO: 643039 - RNA, 64 nt, hsa; identical to SEQ ID NO: 390229

SEQ ID NO: 643040 - RNA, 64 nt, hsa; identical to SEQ ID NO: 390230

SEQ ID NO: 643041 - RNA, 64 nt, hsa; identical to SEQ ID NO: 390231

SEQ ID NO: 643042 - RNA, 64 nt, hsa; identical to SEQ ID NO: 390232

SEQ ID NO: 643043 - RNA, 64 nt, hsa; identical to SEQ ID NO: 390233

SEQ ID NO: 643044 - RNA, 64 nt, hsa; identical to SEQ ID NO: 390234

SEQ ID NO: 643045 - RNA, 64 nt, hsa; identical to SEQ ID NO: 390235

SEQ ID NO: 643046 - RNA, 64 nt, hsa; identical to SEQ ID NO: 390236

SEQ ID NO: 643047 - RNA, 64 nt, hsa; identical to SEQ ID NO: 390237

SEQ ID NO: 643048 - RNA, 64 nt, hsa; identical to SEQ ID NO: 390238

SEQ ID NO: 643049 - RNA, 64 nt, hsa; identical to SEQ ID NO: 390239

SEQ ID NO: 643050 - RNA, 64 nt, hsa; identical to SEQ ID NO: 390240

SEQ ID NO: 643051 - RNA, 64 nt, hsa; identical to SEQ ID NO: 390241

SEQ ID NO: 643052 - RNA, 64 nt, hsa; identical to SEQ ID NO: 390242

SEQ ID NO: 643053 - RNA, 64 nt, hsa; identical to SEQ ID NO: 390243

SEQ ID NO: 643054 - RNA, 64 nt, hsa; identical to SEQ ID NO: 390244

SEQ ID NO: 643055 - RNA, 64 nt, hsa; identical to SEQ ID NO: 390245

SEQ ID NO: 643056 - RNA, 64 nt, hsa; identical to SEQ ID NO: 390246

SEQ ID NO: 643057 - RNA, 64 nt, hsa; identical to SEQ ID NO: 390247

SEQ ID NO: 643058 - RNA, 64 nt, hsa; identical to SEQ ID NO: 390248

SEQ ID NO: 643059 - RNA, 64 nt, hsa; identical to SEQ ID NO: 390249

SEQ ID NO: 643060 - RNA, 64 nt, hsa; identical to SEQ ID NO: 390250

SEQ ID NO: 643061 - RNA, 64 nt, hsa; identical to SEQ ID NO: 390251

SEQ ID NO: 643062 - RNA, 64 nt, hsa; identical to SEQ ID NO: 390252

SEQ ID NO: 643063 - RNA, 64 nt, hsa; identical to SEQ ID NO: 390253

SEQ ID NO: 643064 - RNA, 64 nt, hsa; identical to SEQ ID NO: 390254

SEQ ID NO: 643065 - RNA, 64 nt, hsa; identical to SEQ ID NO: 390255

SEQ ID NO: 643066 - RNA, 64 nt, hsa; identical to SEQ ID NO: 390256

SEQ ID NO: 643067 - RNA, 64 nt, hsa; identical to SEQ ID NO: 390257

SEQ ID NO: 643068 - RNA, 64 nt, hsa; identical to SEQ ID NO: 390258

SEQ ID NO: 643069 - RNA, 64 nt, hsa; identical to SEQ ID NO: 390259

SEQ ID NO: 643070 - RNA, 64 nt, hsa; identical to SEQ ID NO: 472962

SEQ ID NO: 643071 - RNA, 55 nt, hsa; identical to SEQ ID NO: 472963

SEQ ID NO: 643072 - RNA, 64 nt, hsa; identical to SEQ ID NO: 472964

SEQ ID NO: 643073 - RNA, 64 nt, hsa; identical to SEQ ID NO: 472965

SEQ ID NO: 643074 - RNA, 64 nt, hsa; identical to SEQ ID NO: 472966

SEQ ID NO: 643075 - RNA, 64 nt, hsa; identical to SEQ ID NO: 472967

SEQ ID NO: 643076 - RNA, 64 nt, hsa; identical to SEQ ID NO: 472968

SEQ ID NO: 643077 - RNA, 64 nt, hsa; identical to SEQ ID NO: 472969

SEQ ID NO: 643078 - RNA, 64 nt, hsa; identical to SEQ ID NO: 472970

SEQ ID NO: 643079 - RNA, 64 nt, hsa; identical to SEQ ID NO: 472971

SEQ ID NO: 643080 - RNA, 64 nt, hsa; identical to SEQ ID NO: 61495

SEQ ID NO: 643081 - RNA, 64 nt, hsa; identical to SEQ ID NO: 61496

SEQ ID NO: 643082 - RNA, 64 nt, hsa; identical to SEQ ID NO: 61497

SEQ ID NO: 643083 - RNA, 64 nt, hsa; identical to SEQ ID NO: 61498

SEQ ID NO: 643084 - RNA, 64 nt, hsa; identical to SEQ ID NO: 61499

SEQ ID NO: 643085 - RNA, 64 nt, hsa; identical to SEQ ID NO: 61500

SEQ ID NO: 643086 - RNA, 64 nt, hsa; identical to SEQ ID NO: 61501

SEQ ID NO: 643087 - RNA, 64 nt, hsa; identical to SEQ ID NO: 61502

SEQ ID NO: 643088 - RNA, 64 nt, hsa; identical to SEQ ID NO: 61503

SEQ ID NO: 643089 - RNA, 64 nt, hsa; identical to SEQ ID NO: 61504

SEQ ID NO: 643090 - RNA, 64 nt, hsa; identical to SEQ ID NO: 61505

SEQ ID NO: 643091 - RNA, 64 nt, hsa; identical to SEQ ID NO: 61506

SEQ ID NO: 643092 - RNA, 64 nt, hsa; identical to SEQ ID NO: 61507

SEQ ID NO: 643093 - RNA, 64 nt, hsa; identical to SEQ ID NO: 61508

SEQ ID NO: 643094 - RNA, 64 nt, hsa; identical to SEQ ID NO: 61509

SEQ ID NO: 643095 - RNA, 64 nt, hsa; identical to SEQ ID NO: 61510

SEQ ID NO: 643096 - RNA, 64 nt, hsa; identical to SEQ ID NO: 61511

SEQ ID NO: 643097 - RNA, 64 nt, hsa; identical to SEQ ID NO: 61512

SEQ ID NO: 643098 - RNA, 64 nt, hsa; identical to SEQ ID NO: 61513

SEQ ID NO: 643099 - RNA, 64 nt, hsa; identical to SEQ ID NO: 61514

SEQ ID NO: 643100 - RNA, 64 nt, hsa; identical to SEQ ID NO: 61515

SEQ ID NO: 643101 - RNA, 64 nt, hsa; identical to SEQ ID NO: 61516

SEQ ID NO: 643102 - RNA, 64 nt, hsa; identical to SEQ ID NO: 61517

SEQ ID NO: 643103 - RNA, 64 nt, hsa
aaaagaaaaaacaaacaacaacaaaaaaaacucuucggaauaaagagggcuguaaauuuugaau

SEQ ID NO: 643104 - RNA, 64 nt, hsa
aaaugucuuucauaaaaugugcuacaauuagccuucggaauauuugcugggugauuuaaaugug

SEQ ID NO: 643105 - RNA, 64 nt, hsa
ccacguugacuucagguggucuucuaccagcagcucggaauaguugcacugaaucuauacuuug

SEQ ID NO: 643106 - RNA, 64 nt, hsa
guguuacaaaaaauauuaucaggccaaaauuuguucggaauacacuaauuuuugcuccucuaua

SEQ ID NO: 643107 - RNA, 64 nt, hsa
uuuacauuuugacaauuguuuucaaaauaaauguucggaauacagugcagcccuuacgacaggc

SEQ ID NO: 643108 - RNA, 64 nt, hsa
aaucucacacauuuacuuacuaaagauugaggauucggaauauuuagaauaaauuaguuuucug

SEQ ID NO: 643109 - RNA, 64 nt, hsa
agcgauauaaauuuaucauauaaaccaggacaucucggaauaaaaggggcucuguuagucauua

SEQ ID NO: 643110 - RNA, 64 nt, hsa
uuaacauccuauuuuguuguacuaaagugacaaaucggaauaauauaauugguauggccauuag

SEQ ID NO: 643111 - RNA, 64 nt, hsa
cugacaggguuauuugccucauccacauccaccuucggaauacauuaacuuccuuuguaauuua

SEQ ID NO: 643112 - RNA, 64 nt, hsa
auaaacaugcguguuaauggcuguucgagagaaaucggaauaaaagccuaaacaggaacaacuu

SEQ ID NO: 643113 - RNA, 64 nt, hsa
ugaugaucuucugaagcucuuggaugucauuugaucggaauaugcaguggaauaggugacucac

SEQ ID NO: 643114 - RNA, 64 nt, hsa
ggaacuguucccuuucugauuaauuucagcagcaucggaauauauuuggagcacacccuaguaa

SEQ ID NO: 643115 - RNA, 64 nt, hsa
acucuauaauaaaacaaaagauuuuguaggcaacucggaauauagcucuuuugaaaguacucga

SEQ ID NO: 643116 - RNA, 64 nt, hsa
ggugaugcgacuccuguuuauuuugcuuuuuauuucggaauaaauggauuuagccauacugcuc

SEQ ID NO: 643117 - RNA, 64 nt, hsa
uugcauauuuuaaauuuuucaugugcaguauggcucggaauauguuuggccuuuugcauguuuc

SEQ ID NO: 643118 - RNA, 64 nt, hsa
aacaugugugaugugccaugguggaaaaguacuaucggaauaacucugcagugacagaauuuga

SEQ ID NO: 643119 - RNA, 64 nt, hsa
auguuggguggcuuuuguucuuucacugagaaauucggaauacauuugucucaccccugauauu

SEQ ID NO: 643120 - RNA, 64 nt, hsa
ccuuucuagguaaaccgcuugccuucaucuugagucggaauauauuuaaauaaauuguguuauc

SEQ ID NO: 643121 - RNA, 64 nt, hsa
uagaauuuccaaaaucuucauauuacugaaacugucggaauauaugggucuugaaauucagaag

SEQ ID NO: 643122 - RNA, 64 nt, hsa
gcuuauccucuuuguaguacuacuuaaaagcaugucggaauauaagaauaaaaaggauuauggg

SEQ ID NO: 643123 - RNA, 64 nt, hsa
auggucagggagagggcuagagcucacacccagcucggaauagaucuucccugaugacauuuca

SEQ ID NO: 643124 - RNA, 64 nt, hsa
ugaugaacuauuuuauguagacauuaggaguggaucggaauacuucugcuuucuggguaaaacu

SEQ ID NO: 643125 - RNA, 64 nt, hsa
uguuuaaauaaaaggaacuuuauaaugaaacgguucggaauacuggcucaagaaccuaugucaa

SEQ ID NO: 643126 - RNA, 64 nt, hsa
aaauugggcuuggcacucaagucaaagaugaacaucggaauaacaaacauuguccucuccagaa

SEQ ID NO: 643127 - RNA, 64 nt, hsa
gcaucaagcacaaggccaugcaggugaugauacgucggaauagaggcaccagcccugguaacug

SEQ ID NO: 643128 - RNA, 64 nt, hsa
cacaaaauuagcauaauugcagugcuaaugaauaucggaauaugugcacaguaacauuuggacu

SEQ ID NO: 643129 - RNA, 50 nt, hsa
aagaggagaucgauggauagucggaauagagccgccccaacucagauccu

SEQ ID NO: 643130 - RNA, 64 nt, hsa
caaaagggauggaggcuuuacggccacuucccguucggaauaacugaaaucccccagcgauggg

SEQ ID NO: 643131 - RNA, 64 nt, hsa
uuagggaguccccaacacucccccccuccuuugaucggaauauguacugugaagaguaggggug

SEQ ID NO: 643132 - RNA, 64 nt, hsa
aggacuggaaggcuaugaaaagaacuugaaauugucggaauaugugcucucuucaugucauauu

SEQ ID NO: 643133 - RNA, 64 nt, hsa
aggggugcggggugggggggagcugaaucuucaaucggaauaaaagcagcccuccccuuccccc

SEQ ID NO: 643134 - RNA, 64 nt, hsa
agaugaucuccugucaaagacaguuaacaaauccucggaauauugcuucauguacaguuauugg

SEQ ID NO: 643135 - RNA, 64 nt, hsa; identical to SEQ ID NO: 368444

SEQ ID NO: 643136 - RNA, 64 nt, hsa; identical to SEQ ID NO: 368445

SEQ ID NO: 643137 - RNA, 64 nt, hsa; identical to SEQ ID NO: 368446

SEQ ID NO: 643138 - RNA, 64 nt, hsa; identical to SEQ ID NO: 368447

SEQ ID NO: 643139 - RNA, 64 nt, hsa; identical to SEQ ID NO: 368448

SEQ ID NO: 643140 - RNA, 64 nt, hsa; identical to SEQ ID NO: 368449

SEQ ID NO: 643141 - RNA, 64 nt, hsa; identical to SEQ ID NO: 368450

SEQ ID NO: 643142 - RNA, 64 nt, hsa; identical to SEQ ID NO: 368451

SEQ ID NO: 643143 - RNA, 64 nt, hsa; identical to SEQ ID NO: 368452

SEQ ID NO: 643144 - RNA, 64 nt, hsa; identical to SEQ ID NO: 368453

SEQ ID NO: 643145 - RNA, 64 nt, hsa; identical to SEQ ID NO: 368454

SEQ ID NO: 643146 - RNA, 64 nt, hsa; identical to SEQ ID NO: 368455

SEQ ID NO: 643147 - RNA, 64 nt, hsa; identical to SEQ ID NO: 415214

SEQ ID NO: 643148 - RNA, 64 nt, hsa; identical to SEQ ID NO: 415215

SEQ ID NO: 643149 - RNA, 64 nt, hsa; identical to SEQ ID NO: 415216

SEQ ID NO: 643150 - RNA, 64 nt, hsa; identical to SEQ ID NO: 415217

SEQ ID NO: 643151 - RNA, 64 nt, hsa; identical to SEQ ID NO: 415218

SEQ ID NO: 643152 - RNA, 64 nt, hsa; identical to SEQ ID NO: 415219

SEQ ID NO: 643153 - RNA, 64 nt, hsa; identical to SEQ ID NO: 415220

SEQ ID NO: 643154 - RNA, 64 nt, hsa; identical to SEQ ID NO: 415221

SEQ ID NO: 643155 - RNA, 55 nt, hsa; identical to SEQ ID NO: 415222

SEQ ID NO: 643156 - RNA, 64 nt, hsa; identical to SEQ ID NO: 415223

SEQ ID NO: 643157 - RNA, 64 nt, hsa; identical to SEQ ID NO: 415224

SEQ ID NO: 643158 - RNA, 64 nt, hsa; identical to SEQ ID NO: 415225

SEQ ID NO: 643159 - RNA, 64 nt, hsa; identical to SEQ ID NO: 415226

SEQ ID NO: 643160 - RNA, 64 nt, hsa; identical to SEQ ID NO: 415227

SEQ ID NO: 643161 - RNA, 64 nt, hsa; identical to SEQ ID NO: 415228

SEQ ID NO: 643162 - RNA, 50 nt, hsa; identical to SEQ ID NO: 415229

SEQ ID NO: 643163 - RNA, 64 nt, hsa; identical to SEQ ID NO: 415230

SEQ ID NO: 643164 - RNA, 64 nt, hsa; identical to SEQ ID NO: 415231

SEQ ID NO: 643165 - RNA, 64 nt, hsa; identical to SEQ ID NO: 415232

SEQ ID NO: 643166 - RNA, 64 nt, hsa; identical to SEQ ID NO: 415233

SEQ ID NO: 643167 - RNA, 64 nt, hsa; identical to SEQ ID NO: 415234

SEQ ID NO: 643168 - RNA, 64 nt, hsa; identical to SEQ ID NO: 415235

SEQ ID NO: 643169 - RNA, 64 nt, hsa; identical to SEQ ID NO: 415236

SEQ ID NO: 643170 - RNA, 64 nt, hsa; identical to SEQ ID NO: 415237

SEQ ID NO: 643171 - RNA, 64 nt, hsa; identical to SEQ ID NO: 415238

SEQ ID NO: 643172 - RNA, 64 nt, hsa; identical to SEQ ID NO: 415239

SEQ ID NO: 643173 - RNA, 64 nt, hsa; identical to SEQ ID NO: 415240

SEQ ID NO: 643174 - RNA, 64 nt, hsa; identical to SEQ ID NO: 415241

SEQ ID NO: 643175 - RNA, 64 nt, hsa; identical to SEQ ID NO: 415242

SEQ ID NO: 643176 - RNA, 64 nt, hsa; identical to SEQ ID NO: 415243

SEQ ID NO: 643177 - RNA, 64 nt, hsa; identical to SEQ ID NO: 415244

SEQ ID NO: 643178 - RNA, 64 nt, hsa; identical to SEQ ID NO: 415245

SEQ ID NO: 643179 - RNA, 64 nt, hsa; identical to SEQ ID NO: 415246

SEQ ID NO: 643180 - RNA, 64 nt, hsa; identical to SEQ ID NO: 415247

SEQ ID NO: 643181 - RNA, 64 nt, hsa; identical to SEQ ID NO: 415248

SEQ ID NO: 643182 - RNA, 64 nt, hsa; identical to SEQ ID NO: 415249

SEQ ID NO: 643183 - RNA, 64 nt, hsa; identical to SEQ ID NO: 415250

SEQ ID NO: 643184 - RNA, 64 nt, hsa; identical to SEQ ID NO: 415251

SEQ ID NO: 643185 - RNA, 64 nt, hsa; identical to SEQ ID NO: 415252

SEQ ID NO: 643186 - RNA, 64 nt, hsa; identical to SEQ ID NO: 415253

SEQ ID NO: 643187 - RNA, 64 nt, hsa; identical to SEQ ID NO: 415254

SEQ ID NO: 643188 - RNA, 64 nt, hsa; identical to SEQ ID NO: 415255

SEQ ID NO: 643189 - RNA, 64 nt, hsa; identical to SEQ ID NO: 415256

SEQ ID NO: 643190 - RNA, 64 nt, hsa; identical to SEQ ID NO: 370820

SEQ ID NO: 643191 - RNA, 64 nt, hsa; identical to SEQ ID NO: 370821

SEQ ID NO: 643192 - RNA, 64 nt, hsa; identical to SEQ ID NO: 370822

SEQ ID NO: 643193 - RNA, 64 nt, hsa; identical to SEQ ID NO: 370823

SEQ ID NO: 643194 - RNA, 64 nt, hsa; identical to SEQ ID NO: 370824

SEQ ID NO: 643195 - RNA, 64 nt, hsa; identical to SEQ ID NO: 370825

SEQ ID NO: 643196 - RNA, 64 nt, hsa; identical to SEQ ID NO: 370826

SEQ ID NO: 643197 - RNA, 64 nt, hsa; identical to SEQ ID NO: 370827

SEQ ID NO: 643198 - RNA, 64 nt, hsa; identical to SEQ ID NO: 370828

SEQ ID NO: 643199 - RNA, 64 nt, hsa; identical to SEQ ID NO: 370829

SEQ ID NO: 643200 - RNA, 64 nt, hsa; identical to SEQ ID NO: 370830

SEQ ID NO: 643201 - RNA, 64 nt, hsa; identical to SEQ ID NO: 370831

SEQ ID NO: 643202 - RNA, 64 nt, hsa; identical to SEQ ID NO: 370832

SEQ ID NO: 643203 - RNA, 64 nt, hsa; identical to SEQ ID NO: 370833

SEQ ID NO: 643204 - RNA, 64 nt, hsa; identical to SEQ ID NO: 370834

SEQ ID NO: 643205 - RNA, 64 nt, hsa; identical to SEQ ID NO: 370835

SEQ ID NO: 643206 - RNA, 64 nt, hsa; identical to SEQ ID NO: 370836

SEQ ID NO: 643207 - RNA, 64 nt, hsa; identical to SEQ ID NO: 370837

SEQ ID NO: 643208 - RNA, 64 nt, hsa; identical to SEQ ID NO: 370838

SEQ ID NO: 643209 - RNA, 64 nt, hsa; identical to SEQ ID NO: 370839

SEQ ID NO: 643210 - RNA, 64 nt, hsa; identical to SEQ ID NO: 370840

SEQ ID NO: 643211 - RNA, 64 nt, hsa; identical to SEQ ID NO: 370841

SEQ ID NO: 643212 - RNA, 64 nt, hsa; identical to SEQ ID NO: 370842

SEQ ID NO: 643213 - RNA, 64 nt, hsa; identical to SEQ ID NO: 370843

SEQ ID NO: 643214 - RNA, 64 nt, hsa; identical to SEQ ID NO: 370844

SEQ ID NO: 643215 - RNA, 64 nt, hsa; identical to SEQ ID NO: 370845

SEQ ID NO: 643216 - RNA, 64 nt, hsa; identical to SEQ ID NO: 370846

SEQ ID NO: 643217 - RNA, 64 nt, hsa; identical to SEQ ID NO: 370847

SEQ ID NO: 643218 - RNA, 64 nt, hsa; identical to SEQ ID NO: 370848

SEQ ID NO: 643219 - RNA, 64 nt, hsa; identical to SEQ ID NO: 370849

SEQ ID NO: 643220 - RNA, 64 nt, hsa; identical to SEQ ID NO: 370850

SEQ ID NO: 643221 - RNA, 64 nt, hsa; identical to SEQ ID NO: 370851

SEQ ID NO: 643222 - RNA, 64 nt, hsa; identical to SEQ ID NO: 370852

SEQ ID NO: 643223 - RNA, 64 nt, hsa; identical to SEQ ID NO: 370853

SEQ ID NO: 643224 - RNA, 64 nt, hsa; identical to SEQ ID NO: 370854

SEQ ID NO: 643225 - RNA, 60 nt, hsa; identical to SEQ ID NO: 370855

SEQ ID NO: 643226 - RNA, 64 nt, hsa; identical to SEQ ID NO: 370856

SEQ ID NO: 643227 - RNA, 64 nt, hsa; identical to SEQ ID NO: 370857

SEQ ID NO: 643228 - RNA, 64 nt, hsa; identical to SEQ ID NO: 370858

SEQ ID NO: 643229 - RNA, 64 nt, hsa; identical to SEQ ID NO: 370859

SEQ ID NO: 643230 - RNA, 64 nt, hsa; identical to SEQ ID NO: 370860

SEQ ID NO: 643231 - RNA, 64 nt, hsa; identical to SEQ ID NO: 370861

SEQ ID NO: 643232 - RNA, 64 nt, hsa; identical to SEQ ID NO: 370862

SEQ ID NO: 643233 - RNA, 64 nt, hsa; identical to SEQ ID NO: 370863

SEQ ID NO: 643234 - RNA, 64 nt, hsa; identical to SEQ ID NO: 370864

SEQ ID NO: 643235 - RNA, 64 nt, hsa; identical to SEQ ID NO: 370865

SEQ ID NO: 643236 - RNA, 64 nt, hsa; identical to SEQ ID NO: 370866

SEQ ID NO: 643237 - RNA, 64 nt, hsa; identical to SEQ ID NO: 370867

SEQ ID NO: 643238 - RNA, 64 nt, hsa; identical to SEQ ID NO: 370868

SEQ ID NO: 643239 - RNA, 64 nt, hsa; identical to SEQ ID NO: 370869

SEQ ID NO: 643240 - RNA, 64 nt, hsa; identical to SEQ ID NO: 384913

SEQ ID NO: 643241 - RNA, 64 nt, hsa; identical to SEQ ID NO: 384914

SEQ ID NO: 643242 - RNA, 64 nt, hsa; identical to SEQ ID NO: 384915

SEQ ID NO: 643243 - RNA, 64 nt, hsa; identical to SEQ ID NO: 384916

SEQ ID NO: 643244 - RNA, 64 nt, hsa; identical to SEQ ID NO: 384917

SEQ ID NO: 643245 - RNA, 64 nt, hsa; identical to SEQ ID NO: 384918

SEQ ID NO: 643246 - RNA, 64 nt, hsa; identical to SEQ ID NO: 384919

SEQ ID NO: 643247 - RNA, 64 nt, hsa; identical to SEQ ID NO: 384920

SEQ ID NO: 643248 - RNA, 64 nt, hsa; identical to SEQ ID NO: 384921

SEQ ID NO: 643249 - RNA, 64 nt, hsa; identical to SEQ ID NO: 384922

SEQ ID NO: 643250 - RNA, 64 nt, hsa; identical to SEQ ID NO: 384923

SEQ ID NO: 643251 - RNA, 64 nt, hsa; identical to SEQ ID NO: 384924

SEQ ID NO: 643252 - RNA, 64 nt, hsa; identical to SEQ ID NO: 384925

SEQ ID NO: 643253 - RNA, 64 nt, hsa; identical to SEQ ID NO: 384926

SEQ ID NO: 643254 - RNA, 64 nt, hsa; identical to SEQ ID NO: 384927

SEQ ID NO: 643255 - RNA, 64 nt, hsa; identical to SEQ ID NO: 384928

SEQ ID NO: 643256 - RNA, 64 nt, hsa; identical to SEQ ID NO: 384929

SEQ ID NO: 643257 - RNA, 64 nt, hsa; identical to SEQ ID NO: 384930

SEQ ID NO: 643258 - RNA, 64 nt, hsa; identical to SEQ ID NO: 384931

SEQ ID NO: 643259 - RNA, 64 nt, hsa; identical to SEQ ID NO: 384932

SEQ ID NO: 643260 - RNA, 64 nt, hsa; identical to SEQ ID NO: 384933

SEQ ID NO: 643261 - RNA, 64 nt, hsa; identical to SEQ ID NO: 384934

SEQ ID NO: 643262 - RNA, 64 nt, hsa; identical to SEQ ID NO: 384935

SEQ ID NO: 643263 - RNA, 64 nt, hsa; identical to SEQ ID NO: 384936

SEQ ID NO: 643264 - RNA, 64 nt, hsa; identical to SEQ ID NO: 384937

SEQ ID NO: 643265 - RNA, 64 nt, hsa; identical to SEQ ID NO: 384938

SEQ ID NO: 643266 - RNA, 64 nt, hsa; identical to SEQ ID NO: 384939

SEQ ID NO: 643267 - RNA, 64 nt, hsa; identical to SEQ ID NO: 384940

SEQ ID NO: 643268 - RNA, 64 nt, hsa; identical to SEQ ID NO: 384941

SEQ ID NO: 643269 - RNA, 64 nt, hsa; identical to SEQ ID NO: 384942

SEQ ID NO: 643270 - RNA, 64 nt, hsa; identical to SEQ ID NO: 384943

SEQ ID NO: 643271 - RNA, 64 nt, hsa; identical to SEQ ID NO: 384944

SEQ ID NO: 643272 - RNA, 64 nt, hsa; identical to SEQ ID NO: 384945

SEQ ID NO: 643273 - RNA, 64 nt, hsa; identical to SEQ ID NO: 384946

SEQ ID NO: 643274 - RNA, 64 nt, hsa; identical to SEQ ID NO: 384947

SEQ ID NO: 643275 - RNA, 64 nt, hsa; identical to SEQ ID NO: 384948

SEQ ID NO: 643276 - RNA, 64 nt, hsa; identical to SEQ ID NO: 384949

SEQ ID NO: 643277 - RNA, 64 nt, hsa; identical to SEQ ID NO: 384950

SEQ ID NO: 643278 - RNA, 64 nt, hsa; identical to SEQ ID NO: 384951

SEQ ID NO: 643279 - RNA, 64 nt, hsa; identical to SEQ ID NO: 384952

SEQ ID NO: 643280 - RNA, 64 nt, hsa; identical to SEQ ID NO: 384953

SEQ ID NO: 643281 - RNA, 64 nt, hsa; identical to SEQ ID NO: 384954

SEQ ID NO: 643282 - RNA, 64 nt, hsa; identical to SEQ ID NO: 384955

SEQ ID NO: 643283 - RNA, 64 nt, hsa; identical to SEQ ID NO: 384956

SEQ ID NO: 643284 - RNA, 64 nt, hsa; identical to SEQ ID NO: 384957

SEQ ID NO: 643285 - RNA, 64 nt, hsa; identical to SEQ ID NO: 384958

SEQ ID NO: 643286 - RNA, 64 nt, hsa; identical to SEQ ID NO: 384959

SEQ ID NO: 643287 - RNA, 64 nt, hsa
auagaugcagaaacaaggaagaaauggagucugcuccugagaagcuucaaauucaggccaggag

SEQ ID NO: 643288 - RNA, 64 nt, hsa
gcccucugggguugucugguucccagugagaggcuccugagaaaaauaaagcugguucccagag

SEQ ID NO: 643289 - RNA, 64 nt, hsa
gugagcauaugaggaugugacccuacuggcucacuccugagaaugggcuccuguuagaugggca

SEQ ID NO: 643290 - RNA, 64 nt, hsa; identical to SEQ ID NO: 132769

SEQ ID NO: 643291 - RNA, 64 nt, hsa; identical to SEQ ID NO: 132770

SEQ ID NO: 643292 - RNA, 64 nt, hsa
gggagggacagaguguuggagggccagagacuaguccugagauggaaacagcaacuuguacagu

SEQ ID NO: 643293 - RNA, 64 nt, hsa
auggcuuugccacaagcuuaccuguggguuucaguccugagaggccaccaccaguucccaucag

SEQ ID NO: 643294 - RNA, 64 nt, hsa
acuguacaagguaccccuuucuggcucucccauuuccugagaccacagagagaggggagaagcc

SEQ ID NO: 643295 - RNA, 64 nt, hsa
agaggccuguggcuuaugucacccaacagagggguccugagaagucuggcugccugggaugccc

SEQ ID NO: 643296 - RNA, 64 nt, hsa
uuucccucuguggcaguuacgauuuugacuucaguccugagaaaaacuucagguuuugaaaauc

SEQ ID NO: 643297 - RNA, 64 nt, hsa
uguacacagcagaucaguacuguucaacagaacuuccugagaugauggaaauguucuaccucug

SEQ ID NO: 643298 - RNA, 64 nt, hsa
aaggcuucauuaaauuaaucucacuuugaauaucuccugagagauggacaaugaaauaucaguu

SEQ ID NO: 643299 - RNA, 64 nt, hsa
uuaacaugcuggauugcccuagucuucagaaugguccugagaaaacaucacuacuucgauguuc

SEQ ID NO: 643300 - RNA, 64 nt, hsa
gaugugccgauccuugucaaaaugagauuccagguccugagagcugcuuugaggcaguuccagg

SEQ ID NO: 643301 - RNA, 64 nt, hsa; identical to SEQ ID NO: 132771

SEQ ID NO: 643302 - RNA, 64 nt, hsa; identical to SEQ ID NO: 132772

SEQ ID NO: 643303 - RNA, 64 nt, hsa
gauuugugcugagggucagcuuuuggcuccuucuuccugagacaguggaaacaaugccagcucu

SEQ ID NO: 643304 - RNA, 64 nt, hsa
ucugucugauacaauguaaaugacaaaacauaauuccugagaggcccagaacaaacuggagucu

SEQ ID NO: 643305 - RNA, 64 nt, hsa
uuccuuuccugaucaaggugcucuucucauuuuuuccugagaaccuuagccaucagaugaggcu

SEQ ID NO: 643306 - RNA, 64 nt, hsa
aggagcgcaaacucauccuuuauaaagacaccacuccugagauaacaauccaaucccaugauaa

SEQ ID NO: 643307 - RNA, 64 nt, hsa
cgcggcccagccauuuccacccucgggaggcggcuccugagaaacagggaggaaggggcggagc

SEQ ID NO: 643308 - RNA, 64 nt, hsa
agggaaagcagugccugccagcuguugugcaccuuccugagaaauaaauauccucuaaauuuuc

SEQ ID NO: 643309 - RNA, 64 nt, hsa
gugugggggaguaggugacgaaacacuagaccucuccugagagagaauugcugcuuccugaauc

SEQ ID NO: 643310 - RNA, 64 nt, hsa
ccucucucugaaauacgguaaagauuuaaauagguccugagacuguugauagccccagacauac

SEQ ID NO: 643311 - RNA, 64 nt, hsa; identical to SEQ ID NO: 132773

SEQ ID NO: 643312 - RNA, 64 nt, hsa; identical to SEQ ID NO: 132774

SEQ ID NO: 643313 - RNA, 64 nt, hsa; identical to SEQ ID NO: 132775

SEQ ID NO: 643314 - RNA, 64 nt, hsa
auccacauaguaguguucguuugucgagaggauuuccugagacugguuuggaucucccugcaug

SEQ ID NO: 643315 - RNA, 64 nt, hsa
uugcguccugcagaggaccacaguggguggcaccuccugagaaggcgaggagagugguuguugc

SEQ ID NO: 643316 - RNA, 64 nt, hsa
aagccuuuucugcaggcaggaguuucagacccuauccugagaaugggguuugaaaggaagguga

SEQ ID NO: 643317 - RNA, 64 nt, hsa
aucuuagaagcacuacaccuugccuugcuguuuguccugagauggaaaaguguccuucuugcuc

SEQ ID NO: 643318 - RNA, 64 nt, hsa
cuggagaucaacccacauuagagugucuaaggacuccugagaauuccuguuacaguaaacaaaa

SEQ ID NO: 643319 - RNA, 64 nt, hsa
auaaguuuuugcuugcucauauuuuuugucuugauccugagaaugcaaguaaggaauuaauagg

SEQ ID NO: 643320 - RNA, 64 nt, hsa
gguaguaggaggagccugucccagcuucaucuuguccugagauuuauccacauacaggaaacag

SEQ ID NO: 643321 - RNA, 64 nt, hsa
aguaaaaaaggcaaaucuuuucaccucuggcuauuccugagaccccaggaagucaggaaaagcc

SEQ ID NO: 643322 - RNA, 64 nt, hsa
uauaacuccuuggucagugauuuuauuguuuacauccugagacuguucuacaguuucuuugacu

SEQ ID NO: 643323 - RNA, 64 nt, hsa
uuuaguuuuuuuucauauuauaacuaaauauguuuccugagagauaagagaaauaauguuccua

SEQ ID NO: 643324 - RNA, 64 nt, hsa
ucaaauguaguguguuucccuaacuuucuguuuuuccugagaaaaaaaaauaaaucuuuuauuc

SEQ ID NO: 643325 - RNA, 64 nt, hsa
ccauucuuauuccuaggcaacuauuaauaaucuauccugagaauauuaauugugguauucuggu

SEQ ID NO: 643326 - RNA, 64 nt, hsa
gcuuugcugucugugauguagauggugguuccuauccugagagcaaguguguuuauucuuuugc

SEQ ID NO: 643327 - RNA, 64 nt, hsa
gggcaaggggcccaggggcagccgaagcacgggguccugagaccucaggcaggauuggagauca

SEQ ID NO: 643328 - RNA, 64 nt, hsa
uucugaucaaauaaccauggcuucccucagccauuccugagacuugguauaaaaugaagaaauc

SEQ ID NO: 643329 - RNA, 64 nt, hsa
uuugacacauacuccccgucguccugguucuuguuccugagaaggguggguaacagauauucca

SEQ ID NO: 643330 - RNA, 64 nt, hsa
aaacagugauaaucucaaguuagaaaacaguagguccugagaaccauaagaaaaaugacuggug

SEQ ID NO: 643331 - RNA, 64 nt, hsa
ggucaucaggaguacagccuauuauauucccacauccugagaaaggucauuucucccacacacg

SEQ ID NO: 643332 - RNA, 64 nt, hsa
uuccuaucuucuaaaccagauuucucuuuuuuuuuccugagacggagucucgcucuguagccua

SEQ ID NO: 643333 - RNA, 64 nt, hsa
ggucacugaacacacgaauaacuuggauagcaaauccugagacaauggaaaaccauuaacuuua

SEQ ID NO: 643334 - RNA, 64 nt, hsa
uaaauauggcauuuuccccccuucagcugcagguuccugagauuuggugccugugagcucugau

SEQ ID NO: 643335 - RNA, 64 nt, hsa
ccucuuuuauauauggaguucucuccucuuuauauccugagacuuugacaccagauguagauau

SEQ ID NO: 643336 - RNA, 64 nt, hsa
auccagggauuacuggccuccagagucuucaagauccugagaacuuggaauuccuuguaacugg

SEQ ID NO: 643337 - RNA, 64 nt, hsa
ggacccuguagagucacugacccuggagcggcucuccugagaggugcugcaggcaaagugagac

SEQ ID NO: 643338 - RNA, 64 nt, hsa
ucccagucaucugguuuguuuguuucuuuguucguccugagacggagucucgcucugucgccag

SEQ ID NO: 643339 - RNA, 64 nt, hsa
uaacuaguggauuugggaaagguucuuaaguagauccugagacuauuugcaugcuucugucuaa

SEQ ID NO: 643340 - RNA, 64 nt, hsa
cacuagagaauucuacaaaacaagcaaaaacacauccugagacaccucagggcugcauucagcu

SEQ ID NO: 643341 - RNA, 64 nt, hsa
agaaugcuugugauuuuuguacauugauuuuguauccugagacuuugcugaaguugcuuaucag

SEQ ID NO: 643342 - RNA, 64 nt, hsa
aaaaaacacauuuauuaauggaugcuaaagugauuccugagaaaaauaauguguaugguuaaua

SEQ ID NO: 643343 - RNA, 64 nt, hsa
aagcaccacucagaugggcagcuggacucugguguccugagacucugcccucuucccacagccu

SEQ ID NO: 643344 - RNA, 64 nt, hsa
ggcgcgugcaggcagcaggauagagugggacaguuccugagaccagccaaccugggggcuuuag

SEQ ID NO: 643345 - RNA, 64 nt, hsa
cuuuggagaacaugcucucuuuucaccccccaccuccugagagccacuaauguaagauacagaa

SEQ ID NO: 643346 - RNA, 64 nt, hsa
augauggcccaaaauuuauuaaaaagcuauauuuuccugagagacugauacauacacucauaca

SEQ ID NO: 643347 - RNA, 64 nt, hsa
uaugauccuggauuuagccaaagugcuagcgcuuuccugagaagucaguccaauugccagagaa

SEQ ID NO: 643348 - RNA, 64 nt, hsa
uuggucugugugaauuaugggaccccauuacuuuuccugagacuggucaccuauugcugccugc

SEQ ID NO: 643349 - RNA, 64 nt, hsa
gaauuuuuguguuuuucuuuucagcuacacuuaguccugagauguauuuuuucuuuaagucuug

SEQ ID NO: 643350 - RNA, 64 nt, hsa
aggaaaaguuauuaccguuuaugauacuaacaguuccugagacuuagcuaugaucaguauguuc

SEQ ID NO: 643351 - RNA, 64 nt, hsa
uuguuccuuucauuuacaaaagagauaccugacauccugagacacugagaaauguccugaaguc

SEQ ID NO: 643352 - RNA, 64 nt, hsa
cuacuucauuauuaaaaauugauagaauuuuagcuccugagauauuuacaacugggagaaaugu

SEQ ID NO: 643353 - RNA, 64 nt, hsa
gccauucacaagaacuuugacuguuugaaguugauccugagacucuugaaguaauggcugaucc

SEQ ID NO: 643354 - RNA, 64 nt, hsa
aaauuacuaguugcuagcauguuaugauuucauauccugagauagcucugcagauaagaaaaua

SEQ ID NO: 643355 - RNA, 64 nt, hsa
aaggugggacaguaccccggacccauccacucacuccugagagggcuccggcccagaaugggaa

SEQ ID NO: 643356 - RNA, 64 nt, hsa
aaacuuguccugcugcagucccugagucuuguccuccugagaggaagcccuggcuuccaaggcu

SEQ ID NO: 643357 - RNA, 64 nt, hsa
ucauccacucacuggggagauuggacuagaggaguccugagaggacacuuccaacaagagacau

SEQ ID NO: 643358 - RNA, 64 nt, hsa
ggaguaaccuguuuuuguaguuuggaugaauauguccugagaaauuuccauccacuuugguuca

SEQ ID NO: 643359 - RNA, 64 nt, hsa
gaagcggccaagaaugucauucucaaugcccagauccugagauuggacccauacccugucucca

SEQ ID NO: 643360 - RNA, 64 nt, hsa
cccaauagaaaaauggggauauuuccuaggguuguccugagaauaaaaugaguucugugugaca

SEQ ID NO: 643361 - RNA, 64 nt, hsa
cuuucaugaccccaggcaacagccagggccccacuccugagagacacuggcaacaccucuuagu

SEQ ID NO: 643362 - RNA, 64 nt, hsa
cagagcaagacccaucucaaaaaaaaaauuuuuuuccugagaggaagccugagguugaccagcu

SEQ ID NO: 643363 - RNA, 64 nt, hsa
auguggcaacacccucugccaagagacagagcuguccugagaaugcuuuguccuucugagccca

SEQ ID NO: 643364 - RNA, 64 nt, hsa
agcagacuuucaguguaaaugcuuccuccauuucuccugagagugggugauuuuaauucuaucu

SEQ ID NO: 643365 - RNA, 64 nt, hsa
ugugaaguuagagugcuuggcugugcuaccugauuccugagauuggugaaagagggcuugguuu

SEQ ID NO: 643366 - RNA, 64 nt, hsa
cugagggcucaaaacuccuggacaaguugcuggcuccugagaccaguauuuccuggagcugugc

SEQ ID NO: 643367 - RNA, 64 nt, hsa
cuggcuucucugguucuucccuguggaaagcccauccugagacaucuugcuggaaccaaggcaa

SEQ ID NO: 643368 - RNA, 64 nt, hsa
aaggagccacuugaaaaugucugcuccuucgggguccugagauuguggcucccccucuggagga

SEQ ID NO: 643369 - RNA, 64 nt, hsa
uuccccaggccaggguugcugggaugccugccccuccugagaggacccccuccccauugucagg

SEQ ID NO: 643370 - RNA, 64 nt, hsa
gcggguaugaaguguggggcgggggucuauacauuccugagauucugggaaaggugcucaaaga

SEQ ID NO: 643371 - RNA, 64 nt, hsa
caguuuaucuguugaguucugugagcuacugaccuccugagacuggcacuguguaaguuuuagu

SEQ ID NO: 643372 - RNA, 64 nt, hsa
uauccccuugcuacuuuacugauaccuuuaucauuccugagacaguuugcuaauuuaaaaaugu

SEQ ID NO: 643373 - RNA, 64 nt, hsa
cuuuauugaauuagaaaacaagugggacauauuuuccugagagcagcacaggaaucuucuucuu

SEQ ID NO: 643374 - RNA, 64 nt, hsa
uaaaaagauccugcauuuaugguguaguucugaguccugagacuuuucugcgugauggcuaugc

SEQ ID NO: 643375 - RNA, 64 nt, hsa
uuacggacaaaccuacugugggcuccagccuuuguccugagauagccaagcgggagaaugggca

SEQ ID NO: 643376 - RNA, 64 nt, hsa; identical to SEQ ID NO: 132776

SEQ ID NO: 643377 - RNA, 64 nt, hsa; identical to SEQ ID NO: 132777

SEQ ID NO: 643378 - RNA, 64 nt, hsa
ggauguauauaaaauuaagaugauaagaaagugcuccugagaaggcucuugccagaagccugau

SEQ ID NO: 643379 - RNA, 64 nt, hsa
cagccagguucuccagugguaucugccuccauuuuccugagaucaaaaagacuguuucgaaacc

SEQ ID NO: 643380 - RNA, 64 nt, hsa
uccccccgaggcgcucugggcaggcauccugguguccugagaggcucuugcaggaaugauacgu

SEQ ID NO: 643381 - RNA, 64 nt, hsa
gaggaacugugauuggcacgugcagauacaaugcuccugagaagacagcauuuuccacaggagg

SEQ ID NO: 643382 - RNA, 64 nt, hsa
cagcaagaaagauugugaugcaagauuucuuucuuccugagacaaaaaaaaaaaaagaaaaaaa

SEQ ID NO: 643383 - RNA, 64 nt, hsa
aaggcuuccuaucuguguggugaugaaucgcauuuccugagaacaaaauaaaaggauuuuucug

SEQ ID NO: 643384 - RNA, 64 nt, hsa
caguuaaaggugggucaguagccuugcagaacuguccugagaaguuauugcuggugcuggccag

SEQ ID NO: 643385 - RNA, 50 nt, hsa
uuggcagacucguauuuugauccugagagaguccaaaaugcacuggucac

SEQ ID NO: 643386 - RNA, 64 nt, hsa; identical to SEQ ID NO: 132778

SEQ ID NO: 643387 - RNA, 64 nt, hsa; identical to SEQ ID NO: 132779

SEQ ID NO: 643388 - RNA, 64 nt, hsa
uauuuauuuucggggagaggaucuuguuauuguuuccugagauuauuuaaaauguuuuuucuuu

SEQ ID NO: 643389 - RNA, 64 nt, hsa
ggguagguuucauccuacccauugccacucuguuuccugagagauaccucacauuccaaugcca

SEQ ID NO: 643390 - RNA, 64 nt, hsa
guguuuguuuccccuuuggucaugauuguaaguauccugagaccuucccagccaugcaaaacug

SEQ ID NO: 643391 - RNA, 64 nt, hsa
cucaaagguggcaaguuguccuggguucugugaguccugagauggauuuaauucuugaugcugg

SEQ ID NO: 643392 - RNA, 64 nt, hsa
aagccugcgaggaagccuauggaauaguuuccuguccugagacgaaauucagauuaggagauau

SEQ ID NO: 643393 - RNA, 64 nt, hsa
ugucaaaauuguuuaaaaauucuugaaagaauuuuccugagacaaauuuuaacuucuugucuau

SEQ ID NO: 643394 - RNA, 64 nt, hsa
caguggcugacaaggcauauagggauauaugccauccugagaggaguaaaguguuuagauucug

SEQ ID NO: 643395 - RNA, 64 nt, hsa
aauuugaccuaggcaaguuuguucaaaagguagauccugagaugauuuggucagauugggauaa

SEQ ID NO: 643396 - RNA, 64 nt, hsa
uagugaauguaggcuggcuuucagaguaggcuauuccugagagcugcauguguccgcccccgau

SEQ ID NO: 643397 - RNA, 64 nt, hsa
uaucuaacagacaagagugguauauacaaguagauccugagaaguaccuuuguuacagcuacua

SEQ ID NO: 643398 - RNA, 64 nt, hsa
aaugaaugguuuaggauuucaaauagugauacccuccugagacaugagcauuuggagaggccug

SEQ ID NO: 643399 - RNA, 64 nt, hsa
cccgugcuguaucagcuguaaagaauaugaaucuuccugagaucccaagaaauauuaacauugg

SEQ ID NO: 643400 - RNA, 64 nt, hsa
ccuagagacugcuucuuguguuugugucauucuguccugagaaaugaagucaucugaaaaauaa

SEQ ID NO: 643401 - RNA, 64 nt, hsa
agugucauuccaaauccaugcaugcuguugauuuuccugagauuuuuuucucuucuuguuggua

SEQ ID NO: 643402 - RNA, 64 nt, hsa
aucagaagucuaauaccugggcagguuuauaacauccugagagccagccugacauuagacagaa

SEQ ID NO: 643403 - RNA, 64 nt, hsa
aaagcuaccacagauauaaggguguuaugcugaauccugagaagcuuucaagaaccagagaacc

SEQ ID NO: 643404 - RNA, 64 nt, hsa
gccuccucuucugcacagaaugcuuccaccagcauccugagaagaaaugauuacuucugaaaaa

SEQ ID NO: 643405 - RNA, 64 nt, hsa
auuuuuguaagaccaauaccugggaugagaagaauccugagacugccuggaggugagguagaaa

SEQ ID NO: 643406 - RNA, 64 nt, hsa
uggacugugaggguagaguaggcucgcuuugcuuuccugagaagaugcgguggcugccuauguu

SEQ ID NO: 643407 - RNA, 64 nt, hsa
aguguguauacaggaugucaaguacugaccaaaguccugagaacucggcagauaauaaaacaga

SEQ ID NO: 643408 - RNA, 64 nt, hsa
agcccagguacaugaggccaaggugaacugugcauccugagaccuugugucccugagucuccuu

SEQ ID NO: 643409 - RNA, 64 nt, hsa
aaauggggcugaggaaacuuuaagcauaaaagauuccugagaugacuuuacaagucuguacgaa

SEQ ID NO: 643410 - RNA, 64 nt, hsa
agcauaauaaauuauauuaaagaaccaaaaguuuuccugagaauaagaaaguuucacccaauaa

SEQ ID NO: 643411 - RNA, 64 nt, hsa
aauucauauugaguaaaugaaugaaauugugauuuccugagaaucgaaccuugguucccuaacc

SEQ ID NO: 643412 - RNA, 64 nt, hsa
ccucaccucccacccccugagagcuggggcaggcuccugagaugucuagacuggugcguugugg

SEQ ID NO: 643413 - RNA, 52 nt, hsa
cugcagaaauuauggccuaacuuccugagagaccgaacccccucaccugaau

SEQ ID NO: 643414 - RNA, 64 nt, hsa
uggcuucggcggcugaaucuaagaauacgcggucuccugagaacuucaaaaaacaaaaacaaaa

SEQ ID NO: 643415 - RNA, 64 nt, hsa
cucuggggaucaggaaccacacaauccccaggguuccugagaccccaggccuaaaccugagacu

SEQ ID NO: 643416 - RNA, 64 nt, hsa
aucuguccaccuguuccccaguauugcccucaauuccugagagcccuggagcgguuuccuacca

SEQ ID NO: 643417 - RNA, 64 nt, hsa
uccucugagaguccuuccaguguccuccccagccuccugagacuccggugggcugccaugcccu

SEQ ID NO: 643418 - RNA, 64 nt, hsa
aagccuuuuauuauaacacuaaaacuggacagucuccugagacaagaccuccuacuguacucuu

SEQ ID NO: 643419 - RNA, 64 nt, hsa
ggaaccauguguccacuggcguuggggaguugguuccugagaggucugagggccagagcugccc

SEQ ID NO: 643420 - RNA, 64 nt, hsa
ggaaguucuaucuugugauacggaaacaauaaauuccugagauacauucuuccaaucuguggua

SEQ ID NO: 643421 - RNA, 64 nt, hsa
gaaccccccacauacaccccucacaagccaccccuccugagaggcagggggcccuccgcccccu

SEQ ID NO: 643422 - RNA, 64 nt, hsa
cccaagcuucugcagggggugauuuuugcucuuguccugagaaauaacagugcuguuuuaaaaa

SEQ ID NO: 643423 - RNA, 64 nt, hsa
ccugaugagcucugagcccacccagcauccucuguccugagaccccugauuuugaagcugagga

SEQ ID NO: 643424 - RNA, 64 nt, hsa
uuucuucagcucuggggaaaaugccacaguguucuccugagagaacauccuugcuuugagucag

SEQ ID NO: 643425 - RNA, 64 nt, hsa
gcuucucuugugugugccucagcucugaagaaguuccugagaauggguuacagaugucauguua

SEQ ID NO: 643426 - RNA, 64 nt, hsa
agguagagucccauuucuuaugggaccugugugcuccugagaacucuuacuugagacaucaaaa

SEQ ID NO: 643427 - RNA, 64 nt, hsa
cagauuuguguacaauauacccauugaauguauauccugagaaaaauuggggccaaagaagcag

SEQ ID NO: 643428 - RNA, 64 nt, hsa
uuggagaguguaaacaucauauaugauucuguguuccugagaucuggguuuaacgaucugggcu

SEQ ID NO: 643429 - RNA, 64 nt, hsa
ugcccguugcugagcacaaugguuuugucgccguuccugagaggagaaacacaugguaaggcgg

SEQ ID NO: 643430 - RNA, 64 nt, hsa
gggaagagaaggagcuugggugcauuugcccucauccugagaaggccagaauacuggagaccag

SEQ ID NO: 643431 - RNA, 64 nt, hsa
gcugucagaagacuuaggaagcuuugccaguaguuccugagaccagaaauacauauuaugaagc

SEQ ID NO: 643432 - RNA, 64 nt, hsa
uguuuagagcaugacacucucccccucaacagccuccugagaaggaaaggaucugcccugacca

SEQ ID NO: 643433 - RNA, 59 nt, hsa
ccccagucccaggaggcugagccugauuguccugagaaaugggaaggaucagauaugac

SEQ ID NO: 643434 - RNA, 64 nt, hsa
aagguaagagugggaggcugagcagaugcacacauccugagagagggaagaugauuccuuggag

SEQ ID NO: 643435 - RNA, 64 nt, hsa
cauuaggcccagacugcugcugcugguaccagucuccugagacacugccucccuggagcccaug

SEQ ID NO: 643436 - RNA, 64 nt, hsa; identical to SEQ ID NO: 132780

SEQ ID NO: 643437 - RNA, 64 nt, hsa; identical to SEQ ID NO: 132781

SEQ ID NO: 643438 - RNA, 64 nt, hsa
auuuauaagaaaugaauggaaggaaauaugauccuccugagacuaacuuuguauguuaagguuu

SEQ ID NO: 643439 - RNA, 64 nt, hsa
cucaaaacuguaaaaaucauggaaaauaagggaauccugagaaacaaucacagaccacaugaga

SEQ ID NO: 643440 - RNA, 64 nt, hsa
cugcuccccggauaccgugaucacacgucccagguccugagagcgccucauagguagacaguuc

SEQ ID NO: 643441 - RNA, 64 nt, hsa
gccccaaccagguuucugaagauaauuuucauauuccugagaaacuggacuuuuuacaagucuu

SEQ ID NO: 643442 - RNA, 64 nt, hsa
acuucuauauaggugauuuuaccagguuuaguuauccugagaaaacaucuggacuuaagaguuu

SEQ ID NO: 643443 - RNA, 64 nt, hsa
gacccuuagaacagcacugggagaccagcaggacuccugagaacugugcugguggagagguccu

SEQ ID NO: 643444 - RNA, 64 nt, hsa
ugucugggucaguuccuuguaucuauuuucguauuccugagaacaaaucuuuuucuuagaaaaa

SEQ ID NO: 643445 - RNA, 64 nt, hsa
ugggggaaagauguacaggaugcuuugguuucacuccugagauacgagaacguccucugaacac

SEQ ID NO: 643446 - RNA, 64 nt, hsa
uuugggcacugcagcucuggacuuuucuggccccuccugagaugaccugauggagcugaugcuu

SEQ ID NO: 643447 - RNA, 64 nt, hsa
cuuguuuuacauuauauauauguucguaauuguuuccugagaauuacaaugaauaauaauuugc

SEQ ID NO: 643448 - RNA, 64 nt, hsa
aaaucucuguagaguuagucuucuccuuuucucuuccugagaaguucuccugccugcauaacca

SEQ ID NO: 643449 - RNA, 64 nt, hsa; identical to SEQ ID NO: 132782

SEQ ID NO: 643450 - RNA, 64 nt, hsa; identical to SEQ ID NO: 132783

SEQ ID NO: 643451 - RNA, 64 nt, hsa
gaggcacaguguugauggggcagugaccagacaguccugagacccagaaggcccagguggccca

SEQ ID NO: 643452 - RNA, 64 nt, hsa
ucugugcaaccuuacuaugugcaauauuuuuaaauccugagaaaugugugcuuuuguuuucgga

SEQ ID NO: 643453 - RNA, 64 nt, hsa
cuccaguggugaagaaaacuccuuuagcaggugguccugagaccugacaagcacugcuaggcga

SEQ ID NO: 643454 - RNA, 64 nt, hsa
cuagaugugaaaaugaagagagaggguuuuaccauccugagaagaaauaaugauggaaacaugu

SEQ ID NO: 643455 - RNA, 64 nt, hsa
cuagacucuguaaccaccucucugucuuuuuccuuccugagaaacguccaucucucucccuuac

SEQ ID NO: 643456 - RNA, 64 nt, hsa
aguguggaggagaaacucuuggccuaucaagugcuccugagagaaaccaugcaauuuaacacuu

SEQ ID NO: 643457 - RNA, 64 nt, hsa
cuaaaaacagucucaccccauguagugcgccguguccugagagaggugcccucccuacgaggag

SEQ ID NO: 643458 - RNA, 64 nt, hsa
guuuuaaaccuaacucaacaacccuuuaugugauuccugagagcaguaugaggccugcaagaaa

SEQ ID NO: 643459 - RNA, 64 nt, hsa; identical to SEQ ID NO: 132784

SEQ ID NO: 643460 - RNA, 64 nt, hsa; identical to SEQ ID NO: 132785

SEQ ID NO: 643461 - RNA, 64 nt, hsa
uggcaaacaucccagcuaaucaaaauagucauauuccugagaaguaggaaacuaaaacuucuuu

SEQ ID NO: 643462 - RNA, 64 nt, hsa
agcagagguuuguacuuuccccaagagguccucauccugagacggucucuacccauguuuaacc

SEQ ID NO: 643463 - RNA, 64 nt, hsa
cuacaguuucuccugcguaaccuucugccuaccuuccugagagugguuggugacagcagccggg

SEQ ID NO: 643464 - RNA, 64 nt, hsa
gcacuagcauuggaugucgccaaggcccacauuuuccugagagaagccacaaaagaugugcaaa

SEQ ID NO: 643465 - RNA, 64 nt, hsa
uguggccauggcucugugcccaccagcaucucccuccugagaugccggccucucaugcucccgg

SEQ ID NO: 643466 - RNA, 64 nt, hsa
accuggaugagaagaauaaaugacacggauacacuccugagaagacacucguuaaacauugcau

SEQ ID NO: 643467 - RNA, 64 nt, hsa
ccuggguuccgucugauuuuagguuccaggaacuuccugagaacacccgaucgcagaggguaau

SEQ ID NO: 643468 - RNA, 64 nt, hsa
ugauuccgggugguuggcaaacucaucgugucuguccugagaggcuccacaaugcccacccgca

SEQ ID NO: 643469 - RNA, 64 nt, hsa
uaguucuuauaguguacuccaccuuuuacuuuuuuccugagacaaaucuacccuuauucuuucu

SEQ ID NO: 643470 - RNA, 64 nt, hsa
ggagagcaaauuugaacaaaagguuuuucuuauauccugagauugagggguaggggguguccaa

SEQ ID NO: 643471 - RNA, 64 nt, hsa
uaguaauagcuucaaaagaacacauacagaguaauccugagaguaagcaaaggaaccaugagaa

SEQ ID NO: 643472 - RNA, 64 nt, hsa
ucaguuucuuuccaaaacuuauuaccuccccuaauccugagacuuuggaaaagguggaaggaag

SEQ ID NO: 643473 - RNA, 64 nt, hsa
uuuucugauugugguucaguuuaacugaagaauauccugagauuguaagaaaagcauuuuuuaa

SEQ ID NO: 643474 - RNA, 64 nt, hsa
ugccuuaaaaguucccuguaugugaaacgggaaguccugagaguguguguugguggcugugcgc

SEQ ID NO: 643475 - RNA, 64 nt, hsa
ugcuuauuccuuaaaaacaacagaagaguguuuauccugagauugguauugcacuauuuuauuu

SEQ ID NO: 643476 - RNA, 64 nt, hsa
agagaaauaccagguaggaaagaagaguuacuauuccugagaaauaaucaagaacauauuuaau

SEQ ID NO: 643477 - RNA, 64 nt, hsa
cacaaaggccccgguagugaaggaaccccccgucuccugagaguggggcugacccugccuuggg

SEQ ID NO: 643478 - RNA, 64 nt, hsa
gaucugugcuuuccagcucaccccccacacucacuccugagaccccuggccuccggcgucagcc

SEQ ID NO: 643479 - RNA, 64 nt, hsa
cgaaauuggaagguucccuggugcugccucacacuccugagauccagaccacgagaagugaccu

SEQ ID NO: 643480 - RNA, 64 nt, hsa
aguuuguagacgaaaugugccauuauauuagcuuuccugagacuguaucuaaugggcaagucag

SEQ ID NO: 643481 - RNA, 58 nt, hsa
augaacuuucgucuaagugauucacucauccugagacuuucuuuuugcaguggagaga

SEQ ID NO: 643482 - RNA, 56 nt, hsa
cagcugcuggucgccaguaauaaguauccugagagcccagaaaagguacacuuugc

SEQ ID NO: 643483 - RNA, 64 nt, hsa
aauugauaggagggaacauguccuaauucuucuguccugagaagcauguaauguuaauguuaua

SEQ ID NO: 643484 - RNA, 64 nt, hsa
uuuuuucuuaugcgggucuuuuauauauuagggauccugagauacccgauucuauauguaaaag

SEQ ID NO: 643485 - RNA, 64 nt, hsa
uauaaaauaucuaucuuuucaucaugucuauaguuccugagauuuuaaaaaaauuugcuuagua

SEQ ID NO: 643486 - RNA, 64 nt, hsa
gguaguuaggcacccaugaaugucuccagagacauccugagaggcaagauuccucuuaauugau

SEQ ID NO: 643487 - RNA, 64 nt, hsa
ucuuccuagcccuucaggcuagaguaggcuuugauccugagaaccuugcuguugcucugaggag

SEQ ID NO: 643488 - RNA, 64 nt, hsa
cugccagccgaucgggucaggcaaguccaucccguccugagagccccaggccccccuucgaccu

SEQ ID NO: 643489 - RNA, 64 nt, hsa
acauuuuaacuuaccaugacuuugcuccuuccuuuccugagaaaauauuuccacuggauuuuuu

SEQ ID NO: 643490 - RNA, 64 nt, hsa
uuucucaguaacuuacuauccagcagacuggcuuuccugagacuugagguuguggcuuauacug

SEQ ID NO: 643491 - RNA, 64 nt, hsa
uuuaaaaauacauguucauggguuuaccacuaacuccugagaaauguuaaagguucacaggggu

SEQ ID NO: 643492 - RNA, 64 nt, hsa
cccaggaacagcagagguggaggcaagcagugacuccugagagacauuccccacucacuuugug

SEQ ID NO: 643493 - RNA, 64 nt, hsa
agguggccaggcaggcgggggcugcucagccucauccugagagaccugcccucucugcgcugag

SEQ ID NO: 643494 - RNA, 64 nt, hsa
gggucggaagacaaggggcuucugaaaugggaguuccugagauacaacaaaaugugugccuuca

SEQ ID NO: 643495 - RNA, 64 nt, hsa
gcuggacagaguuuuaagcacuaugcugcaggaauccugagaaaaaggggaaauuaauucuauu

SEQ ID NO: 643496 - RNA, 64 nt, hsa
ccccagggaaaaccaggcugggacagcccccuguuccugagauggaaagcacaaauuuaauaca

SEQ ID NO: 643497 - RNA, 64 nt, hsa
aggucuaaaauuccaugauuuuguauuuaauucuuccugagaacagaagaggggaaagcaagag

SEQ ID NO: 643498 - RNA, 64 nt, hsa
cuugagggacccagaccaggugucugcagucagcuccugagacacagcuggccggcacaacagg

SEQ ID NO: 643499 - RNA, 64 nt, hsa
cucagggcugggucuccagagaguggggccuugguccugagaaucagcccuuagaggcuccuuc

SEQ ID NO: 643500 - RNA, 64 nt, hsa
uguuuuugggugaguuuccccccuccuuauucuguccugagaccacgggcaaagcucuucauuu

SEQ ID NO: 643501 - RNA, 64 nt, hsa
accguaaguacugaggguaguuucccuaagucuguccugagaaaaagcauacuuaguacuccug

SEQ ID NO: 643502 - RNA, 64 nt, hsa
caaggcagauauuccagucauauuaacagaacacuccugagacaguugaagaagaaauagcaca

SEQ ID NO: 643503 - RNA, 64 nt, hsa
caagcccaggagugcagacacugcccuaauugcuuccugagaauucccauauuaauaaagaaga

SEQ ID NO: 643504 - RNA, 64 nt, hsa
acaaaccaaacucuaaacuuucucagauuaaaaguccugagaccugaagauuguaauauucaug

SEQ ID NO: 643505 - RNA, 64 nt, hsa
gggaauggggaacccgcucucccagaccuagggauccugagagggagagacugcaauuucucca

SEQ ID NO: 643506 - RNA, 64 nt, hsa
ugugagcuuguccgccaugcuguacccugcaacauccugagaccaaagaccuugugcccuuccc

SEQ ID NO: 643507 - RNA, 64 nt, hsa
caggagucuucuucccaacacgagcgcauccauguccugagaaaaagucugugguuuagaaaau

SEQ ID NO: 643508 - RNA, 64 nt, hsa
gcaaauguaugucucugaguaggacuuggaccuuuccugagauuuauuuuauccgugauguauu

SEQ ID NO: 643509 - RNA, 64 nt, hsa
guggacacacaaggugcaaaucaaugcguacguuuccugagaagugucuaaaaacaccaaaaag

SEQ ID NO: 643510 - RNA, 64 nt, hsa
caaaucuccuuggauuuccuccagaguucggauuuccugagaagauaacagugaaacagcguua

SEQ ID NO: 643511 - RNA, 64 nt, hsa
ccagagggcacucugcuuguuauuagagauuaccuccugagaaaaaagguuccgcuuggagcag

SEQ ID NO: 643512 - RNA, 64 nt, hsa
uugaauaucacacugaauagcaggugucaccaccuccugagauaagaaacauaguuuuauacau

SEQ ID NO: 643513 - RNA, 64 nt, hsa
cuucguugacugaaaggaguuuuaaauucugagcuccugagauacugacuagcaaccauggaau

SEQ ID NO: 643514 - RNA, 64 nt, hsa
gagaagagaagacaaccuccaucuauuuauugcuuccugagaacugaccuggaugcggcccucu

SEQ ID NO: 643515 - RNA, 64 nt, hsa
cauugcacccucugagggugcaggcuagaccgucuccugagaggaaguuaggaucagaaagaag

SEQ ID NO: 643516 - RNA, 64 nt, hsa
agagagaggaauggaaucgacaguauaaauugguuccugagaggguuuccuaacagcuuuguaa

SEQ ID NO: 643517 - RNA, 64 nt, hsa
aggcccugcuguugugagccauguccacccugauuccugagaggccagagaggaaguuuguuca

SEQ ID NO: 643518 - RNA, 64 nt, hsa
cuggaggguuguguaucaguucucuaacacuuguuccugagaacuaaaugucuuuuuuauucuu

SEQ ID NO: 643519 - RNA, 64 nt, hsa
cugugcugcccgagcaccucccccgccccuuuacuccugagaacuuugcagcugcccuucccuc

SEQ ID NO: 643520 - RNA, 64 nt, hsa
gcaaucaacugagguuucuuaauugugauuauauuccugagaaugaaugaguaggaaaggaaua

SEQ ID NO: 643521 - RNA, 64 nt, hsa
cauaaaugacaccugagguccguagaagcuaagcuccugagacccagggggaccugccacuggu

SEQ ID NO: 643522 - RNA, 64 nt, hsa
cuccuguagcuguccaucacacugacaggcuucuuccugagauauccucagguuuucucagcca

SEQ ID NO: 643523 - RNA, 64 nt, hsa; identical to SEQ ID NO: 132786

SEQ ID NO: 643524 - RNA, 64 nt, hsa; identical to SEQ ID NO: 132787

SEQ ID NO: 643525 - RNA, 64 nt, hsa
gcucagaccaggcuuuguuguccugcucugaguauccugagauuaaacugaauugcugaaugaa

SEQ ID NO: 643526 - RNA, 64 nt, hsa
ccaugagcaaaaagccgagagccagaccuguuuguccugagaaaacuguccgcucuucacuuga

SEQ ID NO: 643527 - RNA, 64 nt, hsa
ugagcugcugcugaaggcugucccccaaccccacuccugagacauagggcccauccguccuggg

SEQ ID NO: 643528 - RNA, 64 nt, hsa
ggugcacacaggauggcaggaggcauccaaaggcuccugagacacaugggugcuauugggguug

SEQ ID NO: 643529 - RNA, 64 nt, hsa
ggacuuuguuguuuggauuccucacagccuuggcuccugagaaaggugaggagggcaguccaag

SEQ ID NO: 643530 - RNA, 64 nt, hsa
gugaauagaguguaguguaaguggagaaccaggauccugagaugagcuugagcuuuaaaaacuu

SEQ ID NO: 643531 - RNA, 64 nt, hsa
cacuuugcaacagcacugaaauggcuguaaggacuccugagauauguguccagcaaggaguuua

SEQ ID NO: 643532 - RNA, 64 nt, hsa
aagaaaccucucagguuagcuuugaacugccucuuccugagaugacuaggacagucuguaccca

SEQ ID NO: 643533 - RNA, 64 nt, hsa
ugggccagccagucucuccccacugcuccuaagauccugagacacuugacuucacaauccacaa

SEQ ID NO: 643534 - RNA, 64 nt, hsa
gcucucucccuucuccaaugagggagccacagaauccugagaaggugaaugugcccuaaccugc

SEQ ID NO: 643535 - RNA, 64 nt, hsa
ccccggauggggacccuucccacccucugcaagcuccugagauuuguuuuagcaaacagaugga

SEQ ID NO: 643536 - RNA, 64 nt, hsa
gauggguugcagacggaggucaggucuuccucuuuccugagacuggaucuguucaaacagcaaa

SEQ ID NO: 643537 - RNA, 64 nt, hsa
cccuggcccugcuggggcugaaggucagaaguaauccugagaaauguuucaggccuggggaggg

SEQ ID NO: 643538 - RNA, 64 nt, hsa
cccucccuuuacuccaacccucuccugccugcuuuccugagauguccuggucuuccuuggugcc

SEQ ID NO: 643539 - RNA, 64 nt, hsa
auucccccugaggccaguucugucauggaugcuguccugagaauaacuugcugucccgguguca

SEQ ID NO: 643540 - RNA, 64 nt, hsa
ucuuguaggcagacaccagugcacucuagauaccuccugagaccuccguccucugcuuuccggg

SEQ ID NO: 643541 - RNA, 64 nt, hsa
uaagcaggcauauucacucacuuuucuuugccuuuccugagaguuuuauuaaaacuucucccuu

SEQ ID NO: 643542 - RNA, 64 nt, hsa
gaagcacuuaugggaacagucugugagauugauguccugagaagaccaagauaucaggaaugag

SEQ ID NO: 643543 - RNA, 64 nt, hsa
gguggccggcgggaagaccagccccgacagcaccuccugagaaagucagccaagggccuacccu

SEQ ID NO: 643544 - RNA, 64 nt, hsa
uuugggucugggacuggagauuggccauuaggccuccugagauuccagcucccuuccaccaagc

SEQ ID NO: 643545 - RNA, 64 nt, hsa
uucuucccaauucucuaaaugcuuuaucauuuuuuccugagaugcuucugagggaugcugaccu

SEQ ID NO: 643546 - RNA, 64 nt, hsa
aacuuccuccccacaaaaaugccuuuaaaaaccuuccugagacuuaagcauucugccccacuua

SEQ ID NO: 643547 - RNA, 64 nt, hsa
gcuugcagcuuccaaaaaccugcaaaccagcgcuuccugagacggggccagcggaggcagagcc

SEQ ID NO: 643548 - RNA, 64 nt, hsa
ggaagcugguauuugacauaguguguuaaacagcuccugagaaccuuugggacacucugccaug

SEQ ID NO: 643549 - RNA, 64 nt, hsa
ccacuuuuuccacucuuauuagcacugcaaaagcuccugagaauuuaaaaacacaguaauucuc

SEQ ID NO: 643550 - RNA, 64 nt, hsa
gcagcgaccucaaguguccugaaagcuuacauuuuccugagaccucaaugaagcagaaauguac

SEQ ID NO: 643551 - RNA, 64 nt, hsa
aaacucguuuuuauuuugcacacuuuucucauuuuccugagaauuuaccagaaaaaaaaaagau

SEQ ID NO: 643552 - RNA, 64 nt, hsa; identical to SEQ ID NO: 132788

SEQ ID NO: 643553 - RNA, 64 nt, hsa; identical to SEQ ID NO: 132789

SEQ ID NO: 643554 - RNA, 64 nt, hsa
cucccucccaggugguaucgcccaccugaaaaaauccugagaauuucucccaucuuggccucuu

SEQ ID NO: 643555 - RNA, 64 nt, hsa
caacuccagccaccacuuuccugugcauuuucacuccugagaagugcuccccuaacucagaucc

SEQ ID NO: 643556 - RNA, 64 nt, hsa
auuuauuaaaauauaguucuaaaaauaaguuucuuccugagaagaaugauacuguuuaugauga

SEQ ID NO: 643557 - RNA, 64 nt, hsa
gugaacacauuguuuguagugcuauccauuccucuccugagauuuuaacuuacuacuggaaauc

SEQ ID NO: 643558 - RNA, 64 nt, hsa
ugaccacucugcaggcugggcccaggaugugguguccugagauaguuuuguaucuuaaagacug

SEQ ID NO: 643559 - RNA, 64 nt, hsa
uuuuauuuuuaauuuucuacacguuugagcugaguccugagacacuuagcuucccucucccuca

SEQ ID NO: 643560 - RNA, 64 nt, hsa
auuccaguaacuggggaaagaaccagcugcuguguccugagagccuggcccugugcuguggucu

SEQ ID NO: 643561 - RNA, 64 nt, hsa
ggcugcggaggccucucccuacuggucuggccuuuccugagaggcaggucuuccguccucagag

SEQ ID NO: 643562 - RNA, 64 nt, hsa
ggauuuuacauaaaugccauauuuaugguuuccuuccugagaacaaucuugcucuugccauguu

SEQ ID NO: 643563 - RNA, 64 nt, hsa
gagguucaguacucucgggacucgaggaaauuauuccugagacauggaguaauucuuacaaauu

SEQ ID NO: 643564 - RNA, 64 nt, hsa
caauuaugugauucaguuucaacuuucaaguacuuccugagagguuaguacauuauuauugagc

SEQ ID NO: 643565 - RNA, 64 nt, hsa
agugaaguuuaaucuagcuaaacacugguccugcuccugagaugggauccuauguguuuggaaa

SEQ ID NO: 643566 - RNA, 64 nt, hsa
uacacuuuuuuguaaaaugagaauaauguuuauuuccugagauacugcuguauuuuuuaauugc

SEQ ID NO: 643567 - RNA, 64 nt, hsa
auaggcacucaauuuauuauaaaucuucaguauguccugagaacagcuuuagucauggaauacu

SEQ ID NO: 643568 - RNA, 64 nt, hsa
ggaguucuuaaaggcaagggccuggaagugcuguuccugagauggauucucuugacuuaccagu

SEQ ID NO: 643569 - RNA, 64 nt, hsa
uuggugaugaguuuaaauccaguagcuaaucccuuccugagacucaaagaucgugacgcugguu

SEQ ID NO: 643570 - RNA, 64 nt, hsa
aaaguggacaaguccgcuuugugagaugaauacuuccugagaaacuugacaaguaucucuccau

SEQ ID NO: 643571 - RNA, 52 nt, hsa
caggccaccgagcucucugacguccugagacggcugcggacacuggcuccuu

SEQ ID NO: 643572 - RNA, 64 nt, hsa
ccaggcuuguggcccagguaucaccuucccuuccuccugagaguugaggccuguaaauacaagg

SEQ ID NO: 643573 - RNA, 50 nt, hsa
ucaaugcagacuuucacuaguccugagacccuucgcccccuuuuccugca

SEQ ID NO: 643574 - RNA, 64 nt, hsa
agccccucuuggagaagucucagcuaagcucacguccugagaaagcucaaagguuuggaaggag

SEQ ID NO: 643575 - RNA, 64 nt, hsa
ggggauggcccuggcugaacuggacagacaguguuccugagaggcugggcacuuagcuggaaac

SEQ ID NO: 643576 - RNA, 64 nt, hsa
cuuccccaaggcugagugucccaguuuuaucugcuccugagacugagcccagauccccaaaucu

SEQ ID NO: 643577 - RNA, 64 nt, hsa
ccuuauuagaccuaauuuaugcauaaaguaguauuccugagaacuuuauuuuggaaaauuuaua

SEQ ID NO: 643578 - RNA, 64 nt, hsa; identical to SEQ ID NO: 132790

SEQ ID NO: 643579 - RNA, 64 nt, hsa; identical to SEQ ID NO: 132791

SEQ ID NO: 643580 - RNA, 64 nt, hsa
caacuccaaguuacagcugaaucugucgugacuuuccugagaucuacccggggcuuggcugucu

SEQ ID NO: 643581 - RNA, 64 nt, hsa
uccuuugagucacaagccaaguuuucgcccugucuccugagaccauuucccuacgcuuugcugc

SEQ ID NO: 643582 - RNA, 64 nt, hsa
gaccuggaacugacaauggcgugcugccaaguguuccugagagguguuuaggcacagcagaggg

SEQ ID NO: 643583 - RNA, 64 nt, hsa
uuuuuaccuuuaguucagccaagucauuuucaaguccugagaaaugacaucaucuucaggauaa

SEQ ID NO: 643584 - RNA, 64 nt, hsa
uuaaugacuuugaucaccgagagaggggcagguuuccugagaguucagcaguacagucuucauc

SEQ ID NO: 643585 - RNA, 64 nt, hsa
uaaccccacaugcucaaaaucaaaugauacauauuccugagagacccagcaauaccauaagaau

SEQ ID NO: 643586 - RNA, 64 nt, hsa
ggccaggcaagugggaccaggauacuggacgcuguccugagaugagagguagccgggcucugca

SEQ ID NO: 643587 - RNA, 64 nt, hsa
gacugagcuguccucgauaggccaugcaagggcuuccugagaguucaggaaaguucucuugugc

SEQ ID NO: 643588 - RNA, 64 nt, hsa
uacuucuggaauccucaauucaaccaacauccaguccugagaagcccugaucagucaaccagcu

SEQ ID NO: 643589 - RNA, 64 nt, hsa
cccagucccucagcaccuggccccaggacugagguccugagaaggggauagcacugcccaggac

SEQ ID NO: 643590 - RNA, 64 nt, hsa; identical to SEQ ID NO: 132792

SEQ ID NO: 643591 - RNA, 64 nt, hsa; identical to SEQ ID NO: 132793

SEQ ID NO: 643592 - RNA, 64 nt, hsa
cuaaggggcucagaugugucuugugcccaccucuuccugagaagagauggaaguggagcuguga

SEQ ID NO: 643593 - RNA, 64 nt, hsa
ucuguguaaccugggaauuccaauucuuuuucucuccugagaucuaugacuuugccuaguggua

SEQ ID NO: 643594 - RNA, 64 nt, hsa
uaagcagguuugcaaggcucuaaaguuccuauaguccugagacccccugccagcaaagagugac

SEQ ID NO: 643595 - RNA, 64 nt, hsa
acaacaguuucuaaccaaguuucucugaauccuuuccugagagguggugggcaggagggaggag

SEQ ID NO: 643596 - RNA, 64 nt, hsa; identical to SEQ ID NO: 132794

SEQ ID NO: 643597 - RNA, 64 nt, hsa; identical to SEQ ID NO: 132795

SEQ ID NO: 643598 - RNA, 64 nt, hsa
gaccaccggugucagauaucagagcauucuggacuccugagaggcaguggccucuugagugaac

SEQ ID NO: 643599 - RNA, 64 nt, hsa
acacaaaaacccauauuucugaaauaaugcugauuccugagauaagaaaguggauuugaucccc

SEQ ID NO: 643600 - RNA, 64 nt, hsa
caggaaugcgguucaaacccaguggcuugaaacuuccugagaaacuguagcauauccagccccc

SEQ ID NO: 643601 - RNA, 64 nt, hsa
ggagcccugcugcccacaugcaaggaccagcaucuccugagaggacgccugggcuuaccugggg

SEQ ID NO: 643602 - RNA, 64 nt, hsa
gcuuggcaguuccugugcuguccugucucccagauccugagacccuggcugagaacuuggccca

SEQ ID NO: 643603 - RNA, 64 nt, hsa
acccaucaggacagccagagccagggucccggcguccugagaguccagggcaccuccccccauu

SEQ ID NO: 643604 - RNA, 64 nt, hsa
gggugaggugggguauaggagaagaaugacagcuuccugagagguuucacccaaguuccaagug

SEQ ID NO: 643605 - RNA, 64 nt, hsa
acucagcaacuuucccuugcccugggcugccuccuccugagagcuguuccccaccgcccugccu

SEQ ID NO: 643606 - RNA, 64 nt, hsa
ucuaaauugauugccuggaaacuaccugccuucguccugagagcuucugugugucaggcugcug

SEQ ID NO: 643607 - RNA, 64 nt, hsa
cagagaguuuuuaugggggucuguuguuugaccguccugagaccgagggaagggcucagcugaa

SEQ ID NO: 643608 - RNA, 64 nt, hsa
gucuuuuuguuuguuugcuuguuuguuuuuagauuccugagagaugucucuggaagggaaaguu

SEQ ID NO: 643609 - RNA, 64 nt, hsa
cuuucuuuccacacucacacaacgccaugccuuuuccugagauggcgcugggaguucccacaug

SEQ ID NO: 643610 - RNA, 64 nt, hsa
cuaaacugauugacuuucagccuuuuuggcuagauccugagaggcuauuuuucuuacgaauaua

SEQ ID NO: 643611 - RNA, 64 nt, hsa
auggugcaauaucuuuguuuuuuuuuuaugaggcuccugagaaucaacccaacugaagcauuuc

SEQ ID NO: 643612 - RNA, 64 nt, hsa; identical to SEQ ID NO: 132796

SEQ ID NO: 643613 - RNA, 64 nt, hsa; identical to SEQ ID NO: 132797

SEQ ID NO: 643614 - RNA, 64 nt, hsa
uagggaggaauucuacuucccauaaaaggaccucuccugagaggcaaaaccuguugccuccacc

SEQ ID NO: 643615 - RNA, 64 nt, hsa
acagggcaggacccuaagaucuggggaaaggagguccugagaaccuugagguacccuuagaucc

SEQ ID NO: 643616 - RNA, 64 nt, hsa
auggccagagaugcuggacuugccuaaaauauauuccugagauuuccuccuggccuuuccuggu

SEQ ID NO: 643617 - RNA, 64 nt, hsa
auacaggaaaacuguccaaauuaucuaaagauccuccugagaagcuuaaaacaucuuaaaauac

SEQ ID NO: 643618 - RNA, 64 nt, hsa
agcuacuacacaagccuuugacccccaugcugcuuccugagagucuuuuuuugcacuguugaaa

SEQ ID NO: 643619 - RNA, 64 nt, hsa
uuauaauaaaccacucaguaaaagcaaaagcuuguccugagaaguagagugaguucuuuuucac

SEQ ID NO: 643620 - RNA, 64 nt, hsa
gcccuucagggcuucugguuccuucugccgcccuuccugagaccuuagaaaccagaagagccau

SEQ ID NO: 643621 - RNA, 64 nt, hsa
uucgcuggaaaccucuggaggucaucucggcuguuccugagaaauaaaaagccugucauuucaa

SEQ ID NO: 643622 - RNA, 64 nt, hsa
gcuugucuguuucucaggcuccugugagccucaguccugagaccagagucaagaggaaguacac

SEQ ID NO: 643623 - RNA, 64 nt, hsa
agugaggcccgaccuggcucucgcuggaggggcauccugagacuccuuccucaugcuggcgccg

SEQ ID NO: 643624 - RNA, 63 nt, hsa
ucaaaccggagcccaucuagcguggcuccggccuccugagacguuauuuaaaacucagccuuc

SEQ ID NO: 643625 - RNA, 64 nt, hsa
cccuguccaggcugcccagggcuucucauagacguccugagaaggacgguguaaugcaaggaaa

SEQ ID NO: 643626 - RNA, 64 nt, hsa
uggcaguauauaguuuucacauuuuaauuccuccuccugagaugcacuauacuuaaaaccauuc

SEQ ID NO: 643627 - RNA, 64 nt, hsa
uacaagccccgcuacagacaacagaauuggaagguccugagagcuaccagaagcaucuucaguu

SEQ ID NO: 643628 - RNA, 64 nt, hsa
gcuuugcuguccaucuucccaugcugcaauuucuuccugagauuucuauaaauauaaauguaug

SEQ ID NO: 643629 - RNA, 64 nt, hsa
gagcugaauaauggagauuuugugucugcaaaauuccugagaucauugaaaaaguaacaagcug

SEQ ID NO: 643630 - RNA, 64 nt, hsa
cuccagugccuucccccguggaauaaacgguguguccugagaaaccacacacaggcucguggca

SEQ ID NO: 643631 - RNA, 64 nt, hsa
caaccaccugggggcuagcuaaucuugaauguuuuccugagacaggagcguaugugaaaacauc

SEQ ID NO: 643632 - RNA, 64 nt, hsa
gguagaaggaaagcaugucucugcuuccauggcuuccugagaaagcccaccugggcugggcgcg

SEQ ID NO: 643633 - RNA, 64 nt, hsa
acacugaaguuuuguccucugcugucuccucugguccugagaugagcugugagccuagguggcc

SEQ ID NO: 643634 - RNA, 64 nt, hsa
acuccuacuccaguaucagcuggcacgggcuccuuccugagagcaaaggucaaggacccccucu

SEQ ID NO: 643635 - RNA, 64 nt, hsa
ucagcaucagauacauucaaccauaacuguaucuuccugagagauggauuucacuuucauacgu

SEQ ID NO: 643636 - RNA, 64 nt, hsa
ggaaaauccuccggagccgcccuccauuguggguuccugagaguaggacacauugccaugguuu

SEQ ID NO: 643637 - RNA, 64 nt, hsa
uccagccgcugaauacaguguuaggacugggggcuccugagaugagaguuugagauucagggaa

SEQ ID NO: 643638 - RNA, 64 nt, hsa
agccccacagccauacagcccauuggugacaagguccugagaacacaguggccaggugucccca

SEQ ID NO: 643639 - RNA, 64 nt, hsa
ccuuucugagugcaggggggcugcaugcguugccuccugagaucgaggcugcaggauaugcuca

SEQ ID NO: 643640 - RNA, 64 nt, hsa
uccucugccucaaagacucuuguccucuugucccuccugagaaaaaagaaaacgaaaagugggg

SEQ ID NO: 643641 - RNA, 64 nt, hsa
aucugccuggagucccgucccugcccagaacccuuccugagaccucgccggccuuguuuuauuc

SEQ ID NO: 643642 - RNA, 64 nt, hsa
cuuuuuuucuuuuacuuuucuuuuuuuuuuuuuuuccugagacagagucucgcgcuguugccca

SEQ ID NO: 643643 - RNA, 64 nt, hsa
gaaaugcccccuccacaccccugguagcucuguguccugagaaauccagagugugggagacauc

SEQ ID NO: 643644 - RNA, 64 nt, hsa
ucaguuguccugcccuguggaaugggcucaagguuccugagacacccgauuccugcccaaacag

SEQ ID NO: 643645 - RNA, 64 nt, hsa
gacaugaagccugagccagagaaccagcuauaaguccugagaagacacuggugucuggggacag

SEQ ID NO: 643646 - RNA, 64 nt, hsa
ggaauuuugagccaagcuuuaagcaagucuggacuccugagaccuccugggucuagucaguaaa

SEQ ID NO: 643647 - RNA, 64 nt, hsa
guucagggaacuucagggaagaggcuuggucaauuccugagagcauccucugugcuggggacac

SEQ ID NO: 643648 - RNA, 64 nt, hsa
cugcuucccugcaguuuagaucccgggauggcauuccugagaaagcaacccgaaccagcugucc

SEQ ID NO: 643649 - RNA, 64 nt, hsa
uacuggaccuuaauuccucugcuucugugcucccuccugagaacccuuuaugagccugauuccu

SEQ ID NO: 643650 - RNA, 64 nt, hsa
guguuauuuuuucaugucuggaccucagccuauauccugagacuaaguggaagugggaaaagag

SEQ ID NO: 643651 - RNA, 64 nt, hsa
gaauggugcauauugaauguauaaagcccaccgguccugagaguuugcucacuggagacuuucu

SEQ ID NO: 643652 - RNA, 64 nt, hsa
ggaggcaagaugagaauuccugacagauuguccuuccugagaagacagcccucugccuuggagc

SEQ ID NO: 643653 - RNA, 64 nt, hsa
uuguagagcugccuuuuccaaggauaccauaaacuccugagagcaggggccaugucuuacucuc

SEQ ID NO: 643654 - RNA, 64 nt, hsa
cccgcugcaggucgggcgucuccccccgugccacuccugagacucccaccguuacccccaggag

SEQ ID NO: 643655 - RNA, 64 nt, hsa
agaggucauugucacccaagcagaggccaccuucuccugagaaguugcuguugaccaaggagag

SEQ ID NO: 643656 - RNA, 64 nt, hsa
uuccccccagcaaaugcaauaaugcccucaccccuccugagaggagcccccucccuguggagcc

SEQ ID NO: 643657 - RNA, 64 nt, hsa
cagaacccgcaggcuccugaagacuggccacgccuccugagaccacuuggaaacagaccaacug

SEQ ID NO: 643658 - RNA, 64 nt, hsa
agaugaagcuuccaaaggugccugagaugaaacuuccugagaugaaacucccugaagugcaacu

SEQ ID NO: 643659 - RNA, 64 nt, hsa
gguggugcacccccaacuucauagggguagaggcuccugagauuaggagaacccuuuuuaggcu

SEQ ID NO: 643660 - RNA, 64 nt, hsa
caacaaauuugauuauauuuuuaagugucuuagauccugagaaagauuuauugugcauuauuug

SEQ ID NO: 643661 - RNA, 64 nt, hsa
uggugcucuggguagugagggaugaccagucuuguccugagaaauguuucucuuagucuuuaag

SEQ ID NO: 643662 - RNA, 64 nt, hsa
auguguuucugggcagcuuuucugcucagugugauccugagauggcuuccccgccgccacccag

SEQ ID NO: 643663 - RNA, 64 nt, hsa
uggcaauggagaauugcaucugaugguucaaguguccugagauuguuugcuaccuacccccagu

SEQ ID NO: 643664 - RNA, 64 nt, hsa
ggucucaaaugcugcaguuuuaauaaucugugacuccugagagcccaugguuuuuugaccuugu

SEQ ID NO: 643665 - RNA, 64 nt, hsa
cucuaccuauauacuuaguuugaaguuaguaacuuccugagaugcuaaagacuuacagccugcg

SEQ ID NO: 643666 - RNA, 64 nt, hsa
acgugggacccucaucucugcugccuccuuccuuuccugagaggcucagcuugagagaaugagc

SEQ ID NO: 643667 - RNA, 64 nt, hsa
cuuaagagaguucuaauuaauaacacuaaauucuuccugagaaaugacuccucuugguuugguu

SEQ ID NO: 643668 - RNA, 64 nt, hsa
uuagcacaguucauaguccacaguugaugcagcauccugagauuuuaaauccugaagugugggu

SEQ ID NO: 643669 - RNA, 64 nt, hsa
cccacuugcaccucuccaccuuuggcacuagaacuccugagacaccacuucucaugcuucuccc

SEQ ID NO: 643670 - RNA, 64 nt, hsa
auugaagggcaaagaggaacuguuguuugaauuuuccugagagccuggcuuagugcugggccuu

SEQ ID NO: 643671 - RNA, 64 nt, hsa
caugguagugagccucccaggaucacucaugcuguccugagaaaugagauucaaaagcugcauu

SEQ ID NO: 643672 - RNA, 64 nt, hsa
ggggucacucucacuuggcaccugccccugaggguccugagacuuggaauauggaagaagcaau

SEQ ID NO: 643673 - RNA, 64 nt, hsa
cccagcuggggccuguugucugggacccucccucuccugagaggggaggccugguggcuuagcc

SEQ ID NO: 643674 - RNA, 64 nt, hsa
ccuggggcuucaagaaccucccaucuauccccauuccugagacaggaguuacagucccuuuugg

SEQ ID NO: 643675 - RNA, 64 nt, hsa
uuucacauuucagaaucggcaaugccuggcccacuccugagagcucuaguuuucuaguuuucca

SEQ ID NO: 643676 - RNA, 64 nt, hsa
auggcgaggacagcguggcacuggcugcgaguguuccugagaguugaaagugggaugacuuaug

SEQ ID NO: 643677 - RNA, 64 nt, hsa
uggccgaggagacuggcucuggccaggggccccguccugagagguccucagcgucugacucucg

SEQ ID NO: 643678 - RNA, 64 nt, hsa
cccagagccugucuggaagggcugucuguggcuguccugagaccuggccuuggacucacaagga

SEQ ID NO: 643679 - RNA, 64 nt, hsa
caggcgcuccucccucacgcaggagacucaguuguccugagagagaugaagcagccuugaagca

SEQ ID NO: 643680 - RNA, 64 nt, hsa
agacccacugugggucuucccgugggaugcgggauccugagaccgaaggguguuugguuuaaaa

SEQ ID NO: 643681 - RNA, 64 nt, hsa
agauaacugcuguauucaugaaucuugagaguguuccugagacagaauuaauggucauuuggga

SEQ ID NO: 643682 - RNA, 64 nt, hsa
ccagcccaaccccuuggaaucuuuccuccaggcuuccugagagcccugggggugggaggcugug

SEQ ID NO: 643683 - RNA, 64 nt, hsa
gggagcagcuuggcugugagcaccaggccaagacuccugagaacaggcagcccaguccugcgac

SEQ ID NO: 643684 - RNA, 64 nt, hsa
acguauccuguucuccagagacuucagaacccacuccugagaacagcggagccaggcgcuuaga

SEQ ID NO: 643685 - RNA, 64 nt, hsa
aaccagucaccuuucacuucuuggccaaauuuuauccugagaaugcugaagaggagcugguuca

SEQ ID NO: 643686 - RNA, 64 nt, hsa
ccuuucccuagcucccuggugggugaaugccaccuccugagauccucaccucuuggaauuaaaa

SEQ ID NO: 643687 - RNA, 64 nt, hsa
uccuauuuaacaauuaacguggcagucccggccguccugagagucgggccgagccccguguguu

SEQ ID NO: 643688 - RNA, 64 nt, hsa
accugguucucaacagacccagugagcccuucacuccugagaaaaaggaaagaugaaauaaaua

SEQ ID NO: 643689 - RNA, 64 nt, hsa
acacagccaucagcagcuugcgcccucccucugcuccugagaugcugacccagcauggagccca

SEQ ID NO: 643690 - RNA, 64 nt, hsa
uacagguguuuccagagaccauagaaauguguuuuccugagaguucgugucauucgugacuuuu

SEQ ID NO: 643691 - RNA, 64 nt, hsa
ucuugcuuggaaaguggaccugugucugugucuguccugagaacuuaccagcagaaauccucau

SEQ ID NO: 643692 - RNA, 64 nt, hsa
uuguguacauccugucccugccacauccauaagcuccugagagaaaggucugacuuguugauug

SEQ ID NO: 643693 - RNA, 64 nt, hsa
ccgacucugguagcugggacgcugguuuauggcauccugagacaguugcacagugccagcggag

SEQ ID NO: 643694 - RNA, 64 nt, hsa
acagccagucaggggccuggugguggggggcgucuccugagacaggccagcuuggauggccucc

SEQ ID NO: 643695 - RNA, 64 nt, hsa
ccccuccucuccccuaccacugucuucuucaggguccugagauuuacacgguuggaguguuaug

SEQ ID NO: 643696 - RNA, 64 nt, hsa
uaauuaugucacacacacaaaaaauccuuuucaauccugagaaaauuaaaggcguuuuacucac

SEQ ID NO: 643697 - RNA, 64 nt, hsa
uguaguuaguacaggaugaauuuaaauguguuuuuccugagagacaaggaagacuuggguauuu

SEQ ID NO: 643698 - RNA, 64 nt, hsa; identical to SEQ ID NO: 132798

SEQ ID NO: 643699 - RNA, 64 nt, hsa; identical to SEQ ID NO: 132799

SEQ ID NO: 643700 - RNA, 64 nt, hsa
caaagaaugggaagcacuugugauaaagacaggcuccugagaaaugcaacaaguggucuuacau

SEQ ID NO: 643701 - RNA, 64 nt, hsa
ugaugauaugcacugaucacacaagacugcccuuuccugagaagcugcgggcuucgguguggag

SEQ ID NO: 643702 - RNA, 64 nt, hsa
agacauuaaaauucuugcagaaucugaaugugucuccugagacaagcaucgugauagaguucac

SEQ ID NO: 643703 - RNA, 64 nt, hsa
cucuucaaucccaaccugcgcugugauuuuagccuccugagauuggaguuuccaucccauguug

SEQ ID NO: 643704 - RNA, 64 nt, hsa
agcacauaauuuuuaaggccaaggcacauuugacuccugagaugaauuuuuuguggucauaauc

SEQ ID NO: 643705 - RNA, 64 nt, hsa
auguaguuuuuguuuguaaggaaggggagguauuuccugagaaugaauuuuuuuuuuuuuggau

SEQ ID NO: 643706 - RNA, 64 nt, hsa
uaguuuuguuuuagaauuuugcuuucagcuuuuauccugagaguggggcucacugaaccucucu

SEQ ID NO: 643707 - RNA, 64 nt, hsa
uuuucccacuaaguaguauugccuuccauuaggcuccugagaguuauuucucagggucauguug

SEQ ID NO: 643708 - RNA, 64 nt, hsa
uuuguuuugucugacaguauugcagucuugaaaauccugagagcuaaaaaacugaaaggaauuu

SEQ ID NO: 643709 - RNA, 64 nt, hsa
gcagcuggcuuccaccuggcacgugccugcugcuuccugagagcccggccucucccuccaguac

SEQ ID NO: 643710 - RNA, 64 nt, hsa
aauuaugucacacacacaaaaaaauccuuuucaauccugagaaaauuaaagguguuuuacucac

SEQ ID NO: 643711 - RNA, 64 nt, hsa
ugaaguuucuggagcccuugucugagacugaaccuccugagaaggggccccuagcagcggucag

SEQ ID NO: 643712 - RNA, 61 nt, hsa
ccagguucaagugauucuucugccucagccuccugaguagcugggauuacaggugugcacc

SEQ ID NO: 643713 - RNA, 61 nt, hsa
augucaaaaagcaauucuccugccucagccuccugaguagcugggacuacagguuccuacc

SEQ ID NO: 643714 - RNA, 61 nt, hsa
cauccuuuagugaauuagaggauuuggcuacccugaguauauuuauauucauuucuucugu

SEQ ID NO: 643715 - RNA, 61 nt, hsa
cuggguucaagcaauucucccaccucagccuccugaguagcugggauuacaggcacaugcc

SEQ ID NO: 643716 - RNA, 61 nt, hsa
cuggguucaagggauucuccugucuuagccuccugaguagcugugauuacaggcaugcgcc

SEQ ID NO: 643717 - RNA, 61 nt, hsa
uagaagcugcuuccugugaagaucaaaucuuccugaguaauuaaauggaccaacaaugagc

SEQ ID NO: 643718 - RNA, 61 nt, hsa
ccggguucaagugauucuccugucucagcucccugaguaacuggaauuacaggugcacgcc

SEQ ID NO: 643719 - RNA, 61 nt, hsa
cagcuccuuuguuucauacggaacuccagauccugaguaauccuuuuagagcccgaagagu

SEQ ID NO: 643720 - RNA, 61 nt, hsa
cacugcaaccuccgccuccagggcgcagccuccugaguagcugggaggacaggcauaugcc

SEQ ID NO: 643721 - RNA, 61 nt, hsa
cugggcucaggugauccuuccgccucacccuccugaguagcugggacuacaggugugcacc

SEQ ID NO: 643722 - RNA, 61 nt, hsa
cuggguucaagcgauucuccugccucagccuccugaguagcugggauuacaggcacacacc

SEQ ID NO: 643723 - RNA, 61 nt, hsa
uccauguuuguacuccugugcuggacuguuuccugaguaccagcaggucccuuuuugucuc

SEQ ID NO: 643724 - RNA, 61 nt, hsa
cuuaaaaggauucauagcaacauaaugugucccugaguagaggaugcugcuaugcgugagu

SEQ ID NO: 643725 - RNA, 61 nt, hsa
gagagucacaaauuuuucuucaguguuucagccugaguaaguuacauaaaccucgcuuagc

SEQ ID NO: 643726 - RNA, 61 nt, hsa
cuggguucaagcgauucuccugccucagccuccugaguagcugggauuacaggugugcacc

SEQ ID NO: 643727 - RNA, 61 nt, hsa
ccggguugacaccauuuuccugccucagccuccugaguaguugggauuaccaguagauggg

SEQ ID NO: 643728 - RNA, 61 nt, hsa
ccgaauucaagugauucuccugccucagccuccugaguagcugggauuacaggcgcccguc

SEQ ID NO: 643729 - RNA, 61 nt, hsa
gggagcucaagugauccuccugccucagucuccugaguagcuggaacuacaaggaagggcc

SEQ ID NO: 643730 - RNA, 61 nt, hsa
ccgaguucaaucgauucuccugccucagccuccugaguaccugggauuacaggugccugcc

SEQ ID NO: 643731 - RNA, 61 nt, hsa
cuggguucaagcaauucuccugccucagccuccugaguagcugggauuauaggcgugcacc

SEQ ID NO: 643732 - RNA, 61 nt, hsa
ccagguucaagcgauucuccugugucagucuccugaguagcugggauuacaggcacccacc

SEQ ID NO: 643733 - RNA, 61 nt, hsa
ccuagaguuucagguaggcuaaugcuuagugccugaguauuuaaauuuucuuuucaaacag

SEQ ID NO: 643734 - RNA, 61 nt, hsa
uccacaggagguauuucuuuuuuauguugguccugaguauuuugcaaaugcacagagaaaa

SEQ ID NO: 643735 - RNA, 61 nt, hsa
uucauggaggggaaacgcaaaaccugcaguuccugaguaccuucuacaggcccggcccagc

SEQ ID NO: 643736 - RNA, 61 nt, hsa
auuauucggaggaagggaaugggggagacagccugaguaaaaggcuuggaaguuggaauua

SEQ ID NO: 643737 - RNA, 61 nt, hsa
ccggguucaagccauucuccugccucagucuccugaguagcugggauuacgggugcgugcc

SEQ ID NO: 643738 - RNA, 61 nt, hsa
ccggguucaagugauucucaugccucagccuccugaguagcugggauuacaggcuccugcc

SEQ ID NO: 643739 - RNA, 61 nt, hsa
cucuugggauucuggucuuugagaaauagucccugaguauuaggauacuuuuaucaaaauc

SEQ ID NO: 643740 - RNA, 61 nt, hsa
ccagguucaagcgauucuccugcuucaaccuccugaguagcugggauuacaggugcgugcc

SEQ ID NO: 643741 - RNA, 61 nt, hsa
cuggguucaagcgauucuccugccucagccuccugaguagcugggaucauaggcacgcgcc

SEQ ID NO: 643742 - RNA, 61 nt, hsa
gggaagcucaucagagaaaaugggugcugggccugaguacucccgucggaggggauggaca

SEQ ID NO: 643743 - RNA, 61 nt, hsa
cagauaacuuuuuuuuuucuuuauaagaaagccugaguacuccacacugcacaauaacucc

SEQ ID NO: 643744 - RNA, 61 nt, hsa
cugggcuugagcaguccucccgucucagccuccugaguagcugagacuacaggugcacacc

SEQ ID NO: 643745 - RNA, 61 nt, hsa
ucaucacccuuuuucacuaugacccuuagacccugaguauuuucaaauauaugauugcuga

SEQ ID NO: 643746 - RNA, 61 nt, hsa
cugggcucaagcaguccucccaccucagucuccugaguagcugagacuacagcugugcgcc

SEQ ID NO: 643747 - RNA, 61 nt, hsa
uuagguucaagcgauucuccugccucagccuccugaguagcugggauuacaggcacgcacc

SEQ ID NO: 643748 - RNA, 61 nt, hsa
auauaaucguuugcauuuuguuacuugcuacccugaguacuuucaggaagacugacuuaaa

SEQ ID NO: 643749 - RNA, 61 nt, hsa
ccagguucaagcgauucuccugccucagccaccugaguagcugggauuacacgcacaugcc

SEQ ID NO: 643750 - RNA, 61 nt, hsa
uuggguucaagugauucuccugccucagccuccugaguagcuggauuacaggcaugugcca

SEQ ID NO: 643751 - RNA, 61 nt, hsa
ggcucagacuaaaucagaggucaaggcuuccccugaguaagguccauuucuucccaggaau

SEQ ID NO: 643752 - RNA, 61 nt, hsa
gggcucaauacucuugccucagccuccucuuccugaguagcugcaacuacagacacaugcc

SEQ ID NO: 643753 - RNA, 61 nt, hsa
ccagguucaagcgauucuccugccucagccuccugaguagcugggauuacaggcaacugcc

SEQ ID NO: 643754 - RNA, 61 nt, hsa
ccagguucaagcgauucuccugccucagccuccugaguagcugggaccacaggcgacugcc

SEQ ID NO: 643755 - RNA, 61 nt, hsa
gaagaaacaacgacacaaucuuagaaucacuccugaguaucucgaguuguggcauuuguua

SEQ ID NO: 643756 - RNA, 61 nt, hsa
caaccucugccuccuggguucacguaauccuccugaguagcugggauuacaggcgccugcc

SEQ ID NO: 643757 - RNA, 61 nt, hsa
ucagguucaagugauucuccugccucagccuccugaguagaugggacuguaggcaccugcc

SEQ ID NO: 643758 - RNA, 61 nt, hsa
ccggguucaagugauucucuugccucagccuccugaguagugugugccaccacgcccagcu

SEQ ID NO: 643759 - RNA, 61 nt, hsa
guggugucaucaccugcuggccccacuacagccugaguaggccugaguggccguggccagg

SEQ ID NO: 643760 - RNA, 61 nt, hsa
ccggauucaagcgauucuccugccucagccuccugaguagcuggaacuacaugcgcgugcc

SEQ ID NO: 643761 - RNA, 61 nt, hsa
ccaugcucagaaugucugguccuggcuugggccugaguagggcagagagggccuuuccugg

SEQ ID NO: 643762 - RNA, 61 nt, hsa
ucaguuugggcuguggacgcugccacacaagccugaguagagcccaugcaaaggaagggau

SEQ ID NO: 643763 - RNA, 61 nt, hsa
aaugcaagcuuguucagggggcugagaagauccugaguacacuaggugcaaaccagaacuc

SEQ ID NO: 643764 - RNA, 61 nt, hsa
ggcagacuccuccauguuuuguucccuucccccugaguaugcaugugccuguucagagucu

SEQ ID NO: 643765 - RNA, 61 nt, hsa
cugggcucaggugauccucccaccucagccuccugaguagcuaggacuacagaugcucgcc

SEQ ID NO: 643766 - RNA, 61 nt, hsa
ugggguucaagugauucuccugugucagccuccugaguagcugggauuacaggcgugugcc

SEQ ID NO: 643767 - RNA, 61 nt, hsa
ccggguucaagcgauucuccugccucagccuccugaguagcugggauuacaggugugugcc

SEQ ID NO: 643768 - RNA, 61 nt, hsa
gaagcuucuuuggccuagauuuuagcacaaaccugaguauaucucuucuacuuucaucaug

SEQ ID NO: 643769 - RNA, 61 nt, hsa
uguuaaaauauuguuuaauauuuuugaaaucccugaguaucaggccuuguuauaaauaagc

SEQ ID NO: 643770 - RNA, 61 nt, hsa
ccuccagggacuggccaggucuccccccuuuccugaguaccaacuaucauauccccaaaga

SEQ ID NO: 643771 - RNA, 61 nt, hsa
gcauaucugccuuuauuguguuugucauuagccugaguagaaaggccuuuaaaauuuuuuu

SEQ ID NO: 643772 - RNA, 61 nt, hsa
cuggguucaagcaauucucaugccucagccuccugaguagcugagaccacaggcacccgcc

SEQ ID NO: 643773 - RNA, 61 nt, hsa
ccagguucaugccauucuccugccucagccuccugaguagcugauacuacaggcacccacc

SEQ ID NO: 643774 - RNA, 61 nt, hsa
ugucugugagcugccuuucaucaccauuuuuccugaguagggcuuaguuuuauucuggaaa

SEQ ID NO: 643775 - RNA, 61 nt, hsa
gguuugggagaugaugccugccuugagaaguccugaguacagagacugguuccccccagac

SEQ ID NO: 643776 - RNA, 61 nt, hsa
aaaaccuuuggugccuuuucucucuucuuuaccugaguaaauaauuggcaccugccuucuu

SEQ ID NO: 643777 - RNA, 61 nt, hsa
cuggguucaaaugauucuccugccucagccuccugaguagcuagguacaggcaccugccac

SEQ ID NO: 643778 - RNA, 61 nt, hsa
ugcuugcuuaaucuucucugccccaguucuuccugaguauaugaauuugauuucuaaaaac

SEQ ID NO: 643779 - RNA, 61 nt, hsa
ccggguucacgccauccuccugccucagccuccugaguagcugggacuacaggugccugcc

SEQ ID NO: 643780 - RNA, 61 nt, hsa
ccgaguucaagcaauucuccugccucagccuccugaguagcugggauuauaggcaugcacc

SEQ ID NO: 643781 - RNA, 61 nt, hsa
ccggguucacgccauucuccugccucagccuccugaguagcugggacuacaggcgcccgcc

SEQ ID NO: 643782 - RNA, 61 nt, hsa
ccagccucaacugauccucgcaucucagccuccugaguagcugggaugacaggcgugcacc

SEQ ID NO: 643783 - RNA, 61 nt, hsa
ccagguucaagcgauucucgugccucagccuccugaguagcugggacuacaggcgcccacc

SEQ ID NO: 643784 - RNA, 61 nt, hsa
cuggguucaagcaauucuccugccucagccuccugaguagcugggauuacaggcaugaacc

SEQ ID NO: 643785 - RNA, 61 nt, hsa
caccauagcagcugacugaaaaucagcacugccugaguaguuuugaucaguuuaacuugaa

SEQ ID NO: 643786 - RNA, 61 nt, hsa
accugaccacaaaaccucuuguaaaaacagcccugaguagguauuuccagggcuccacaaa

SEQ ID NO: 643787 - RNA, 61 nt, hsa
ccggguucaagugauucuugugccucagccuccugaguagcugggauuauaggcaugcacc

SEQ ID NO: 643788 - RNA, 61 nt, hsa
ccgaguucaagcgauucuugugcuucagccuccugaguagcugggacuauaggccuguacc

SEQ ID NO: 643789 - RNA, 61 nt, hsa
ccagguucaagugauucuccugccucagccuccugaguagcugggacuacaggcgccugcc

SEQ ID NO: 643790 - RNA, 61 nt, hsa
auguguuggugggccuggccgugcugccucuccugaguagggugggugcaaguagggccuc

SEQ ID NO: 643791 - RNA, 61 nt, hsa
gaaauauauauauuuuuaaguuuggcaaaauccugaguaguguaguccuauuaauuccaga

SEQ ID NO: 643792 - RNA, 61 nt, hsa
cugggcugaacugauccuuccaccucagccuccugaguagcugggacuacaggugugugcc

SEQ ID NO: 643793 - RNA, 61 nt, hsa
cgccucccaggcgauucuccugccucagccuccugaguagcugggauuacaggcaugcacc

SEQ ID NO: 643794 - RNA, 61 nt, hsa; identical to SEQ ID NO: 643781

SEQ ID NO: 643795 - RNA, 61 nt, hsa
auggggguuacaucagugcuggucauuguagccugaguauacaaucaagcuucagugugca

SEQ ID NO: 643796 - RNA, 61 nt, hsa
aucaaugauauguaaggugacuuaugaaucaccugaguacaauucuuuguuguuuagcacu

SEQ ID NO: 643797 - RNA, 61 nt, hsa
aacaaaaaugacagauacaaacuauuucuauccugaguaguaaucucacacuucauccuau

SEQ ID NO: 643798 - RNA, 61 nt, hsa
acagguucaggcgauucccgugccucagccuccugaguagcugggacuacaggcacgcacc

SEQ ID NO: 643799 - RNA, 61 nt, hsa
ccggguucaagcgauucuccugccucagccuccugaguagcuggaauuacaggcacccacc

SEQ ID NO: 643800 - RNA, 61 nt, hsa
ccggguucaagcgauucuccagccucagcuuccugaguagaugggauuacaggcgccugcc

SEQ ID NO: 643801 - RNA, 61 nt, hsa
ccggguuuaagcaguucuccugccucagccuccugaguagcugggauuacaggugugcccc

SEQ ID NO: 643802 - RNA, 61 nt, hsa
aguggcuuauaaggaaccagcaguguuuuucccugaguaauuaugaacuuagucaagauca

SEQ ID NO: 643803 - RNA, 61 nt, hsa
cccagguucaagcgaucaugugccuaagccuccugaguagcugggaucacagguguguacc

SEQ ID NO: 643804 - RNA, 61 nt, hsa
ccagguucaggugauucuccugccucagccuccugaguagcugggauuacaagcacguguc

SEQ ID NO: 643805 - RNA, 61 nt, hsa
cuggguucaagcaauucuccugccucagccuccugaguagcugggauuauaggcacaugcc

SEQ ID NO: 643806 - RNA, 61 nt, hsa
acuuucauuucccagaaaaaagauuaaugguccugaguaggaauauuacauaauuuugauu

SEQ ID NO: 643807 - RNA, 61 nt, hsa
cugggcucaaguuauccuuccauuuuggccuccugaguagcuagaccauagguaugcauca

SEQ ID NO: 643808 - RNA, 61 nt, hsa
aaagaaguauugcaugucuaaaagcuagugcccugaguacucaugaauucgauuccaagag

SEQ ID NO: 643809 - RNA, 61 nt, hsa
gcuuaucccgcaugagcaggagcgugcuggcccugaguacugaacuuucugaguaacaaug

SEQ ID NO: 643810 - RNA, 61 nt, hsa
gucaguucuugcaaccuuguggaauuugcuuccugaguaaguggauauacaaccucagcaa

SEQ ID NO: 643811 - RNA, 61 nt, hsa
ccggguucaagugauucucccgccucagcuuccugaguagcuggaacuacaggcgugugcc

SEQ ID NO: 643812 - RNA, 61 nt, hsa
gaaacaguuucaaguaagccuugaauugaaaccugaguagguuaaaacaauucuauuucau

SEQ ID NO: 643813 - RNA, 61 nt, hsa
gaaauaaaucaucaccaauaccuuugaggucccugaguaauccaccccagcuaaaggcaaa

SEQ ID NO: 643814 - RNA, 61 nt, hsa
agccuccauaaucagugugguugccuucagaccugaguacuuagcugagggugggugagag

SEQ ID NO: 643815 - RNA, 61 nt, hsa
cuuugguuaauaguaaaugcuuaacuguaguccugaguaggugcauuucugucugucucaa

SEQ ID NO: 643816 - RNA, 61 nt, hsa
uuuuguucuuauucuuuuucucauaaguacuccugaguacaaguggucaccucccauagua

SEQ ID NO: 643817 - RNA, 61 nt, hsa
cugggcucaagcaauccucccgcuucagccuccugaguagcuggugcgcacgaccauaccc

SEQ ID NO: 643818 - RNA, 61 nt, hsa
uacucaaauguaccuuaauuuuuuuuuuuucccugaguaaaagcaagaaauuucuuccuuu

SEQ ID NO: 643819 - RNA, 61 nt, hsa
agaaaaucucaguucccaccaguaaaauuauccugaguagcuaaugcaccuugagaaaaau

SEQ ID NO: 643820 - RNA, 61 nt, hsa
aggccagugcccacuugcccaccgaccugagccugaguaaguggcugucaccugagccugu

SEQ ID NO: 643821 - RNA, 61 nt, hsa
ccggguucacgccauucuccugccucagccuccugaguagcuggggcuacaggcgucugcc

SEQ ID NO: 643822 - RNA, 61 nt, hsa
cugggcucaggcaauccuccugccucagccuccugaguagcugggacuacaguuucgugug

SEQ ID NO: 643823 - RNA, 61 nt, hsa
cuggguucaagcgauucuccagccucagccuccugaguagcuggaauuacagguacgcacc

SEQ ID NO: 643824 - RNA, 61 nt, hsa
ccucacacugcuguccucucccccuucagcuccugaguagcugggccugugcacugggcag

SEQ ID NO: 643825 - RNA, 61 nt, hsa
ugguagaauauuuauucauaugacaaggauaccugaguaaaacuauccuuuuuaaaaucac

SEQ ID NO: 643826 - RNA, 61 nt, hsa
ggguggggugguucaaauggaugacugaucuccugaguacacugaagccacaggcuggugg

SEQ ID NO: 643827 - RNA, 61 nt, hsa
ccagguucaagcgauuguccugccucagucuccugaguagcugggacuacaggugugcacc

SEQ ID NO: 643828 - RNA, 61 nt, hsa
caggaaaacaauauuguauaacagaccacuuccugaguagaagaguuucuuugugaaaagg

SEQ ID NO: 643829 - RNA, 61 nt, hsa
auagguucaagucauucuccugccucagccuccugaguagcugggacuacaggugagugcc

SEQ ID NO: 643830 - RNA, 61 nt, hsa
cgugaugaaagcagcguuacuucugaccgugccugaguaagagaaugcugaugccauaacu

SEQ ID NO: 643831 - RNA, 61 nt, hsa
ccagguucaggugauucuccugccucagccuccugaguagcugggauuacaggugugcgcc

SEQ ID NO: 643832 - RNA, 61 nt, hsa
cugggcuuaagugacccucccaccucagucuccugaguagcuaggacuacaggcacacacu

SEQ ID NO: 643833 - RNA, 61 nt, hsa
cucggugcccacgccucugcccaucuggaggccugaguaaggaguggcucagccccacguu

SEQ ID NO: 643834 - RNA, 61 nt, hsa
ucugcaaccucugccucccagguucaagccuccugaguaacugggacuacaggcgcccgcc

SEQ ID NO: 643835 - RNA, 61 nt, hsa
cucugaggggcuaucaauguguagauaaagcccugaguaggcaagagcagugagauccacu

SEQ ID NO: 643836 - RNA, 61 nt, hsa
cucuauacagucauuagauguaacauccuucccugaguagaaaguaaugcauguguuugga

SEQ ID NO: 643837 - RNA, 61 nt, hsa
uccaaacuggccccuccugcucacugccucuccugaguagaaaucuggugaccuaaggcuc

SEQ ID NO: 643838 - RNA, 61 nt, hsa
auuauggauauauguugaggucauucagcuuccugaguaccacauuccccagcuacuuaga

SEQ ID NO: 643839 - RNA, 61 nt, hsa
ccagguucaagcaauucuccugccucagucuccugaguagcuggaacuacaggugugcgcc

SEQ ID NO: 643840 - RNA, 61 nt, hsa
ccgaguucaagcuauccuuccaccuccgccuccugaguagcugggaccacagguucacaua

SEQ ID NO: 643841 - RNA, 61 nt, hsa
ccguauucaagcgauucuccugucucagccuccugaguagcugggacuacaggugugcacc

SEQ ID NO: 643842 - RNA, 61 nt, hsa
cuggguucaagugauucuagugccucagccuccugaguagcugggauaaugggcgugugcc

SEQ ID NO: 643843 - RNA, 61 nt, hsa
cugggcccaagcaauucucccaccucagccuccugaguagcugggacuacaagugugcacc

SEQ ID NO: 643844 - RNA, 61 nt, hsa
cugggcucaagcaauccuccugccucagcuuccugaguagcuggaaccacaggugugugcu

SEQ ID NO: 643845 - RNA, 61 nt, hsa
gagugaauagcuuuauggaaucaaguaugucccugaguagcaagauuaggccucaccaaag

SEQ ID NO: 643846 - RNA, 61 nt, hsa
cuuccccauccugcuccgcuucauguccccuccugaguagucaugugauaauaaacucuca

SEQ ID NO: 643847 - RNA, 61 nt, hsa
cgcguagcaggggaguuguuugaaacaccuuccugaguaguccggccuugucaaugagugc

SEQ ID NO: 643848 - RNA, 61 nt, hsa
ccgggcucaagacauccuccugccucagccuccugaguagcugggacugcaguuguaagcc

SEQ ID NO: 643849 - RNA, 61 nt, hsa
ugccuccuagguucaagugauucuccuaccuccugaguaacugggauuacagucgugugcc

SEQ ID NO: 643850 - RNA, 61 nt, hsa
ccaguugcaagugauucuccugccucagccuccugaguagcugggauuacaggcacccgcc

SEQ ID NO: 643851 - RNA, 61 nt, hsa
cucuacugggagccuacccacccccaggaccccugaguaaaaaagcugugugcucuccaag

SEQ ID NO: 643852 - RNA, 61 nt, hsa
ccguauucaagcgauucuccugucucagccuccugaguagcuaggacuacaggugugcacc

SEQ ID NO: 643853 - RNA, 61 nt, hsa
uuguaaauguuccagaacaaccuagagaacaccugaguacuaagcagcaguuuugcaagga

SEQ ID NO: 643854 - RNA, 61 nt, hsa
ugaucauucccucuccuuguaauugcaguauccugaguagcaguuuaauuuucaucaaaca

SEQ ID NO: 643855 - RNA, 61 nt, hsa
auucagagaacuaauuuuucacuggauaagaccugaguaacccagaccccccaccgugguu

SEQ ID NO: 643856 - RNA, 61 nt, hsa
ugaucgcuugagcccaggaguuuaagaccggccugaguagcauagcaagacccugucucua

SEQ ID NO: 643857 - RNA, 61 nt, hsa
ccggguucaagcgauucucccgccucagccuccugaguagcugggauuacaggcacccgcc

SEQ ID NO: 643858 - RNA, 61 nt, hsa
ccagguucaagugauucuccugccucagccuccugaguagcugggauuacaggcacacacc

SEQ ID NO: 643859 - RNA, 61 nt, hsa
auguaaagaaaaaaacuugaaaauaguaauaccugaguacccaugggaauaauagacacug

SEQ ID NO: 643860 - RNA, 61 nt, hsa
ggcaguauucaggcucaacguacaguuugauccugaguaugcuugguguuugccuucagaa

SEQ ID NO: 643861 - RNA, 61 nt, hsa
ccagguucaagugauucuccugccucauccuccugaguagcugggauuacaggcgugugcc

SEQ ID NO: 643862 - RNA, 61 nt, hsa
uuuaacucacauucagaggaaguccagaucuccugaguagugauuuuggugacaaguuuuu

SEQ ID NO: 643863 - RNA, 61 nt, hsa
ccaggcucaagcguuucucccaccuuagccuccugaguagcugggacuaaggcacacacac

SEQ ID NO: 643864 - RNA, 61 nt, hsa
cucaaagcaggaacaguggguuugugucucaccugaguaucuggaauuuuauuuuuucaag

SEQ ID NO: 643865 - RNA, 61 nt, hsa
ccggguucacgccauucuccugccucagccuccugaguagcugggacuacaggcaccugcc

SEQ ID NO: 643866 - RNA, 61 nt, hsa
cugauugaaugauauauaaauauauuuauagccugaguaaaguuaaaagaauguaaaauau

SEQ ID NO: 643867 - RNA, 61 nt, hsa
ccuggcuugagugauccucccgccccagccuccugaguagcugggacuagaggcacgcacc

SEQ ID NO: 643868 - RNA, 61 nt, hsa
ccagguucaagcaauucuccugccuuagccuccugaguagcugggauuacaggcgugcgcc

SEQ ID NO: 643869 - RNA, 61 nt, hsa
ccagauucaagcgauucuccugucucagccuccugaguagcugggauuauagguacaugcc

SEQ ID NO: 643870 - RNA, 61 nt, hsa
gucuacuuguucaguuuuucaaaucuguuuuccugaguauaaauaagaguauuuaaagaaa

SEQ ID NO: 643871 - RNA, 61 nt, hsa
uccuuaggcaagacuuugccucucuccuaguccugaguauaaauccugugcauagauuccu

SEQ ID NO: 643872 - RNA, 61 nt, hsa
guuagagacucgccugggaaauugcuccauuccugaguaaacagauauuuucgcccaccua

SEQ ID NO: 643873 - RNA, 61 nt, hsa
ccucuuuugcacuggaaggcccucccuuuggccugaguacuuuucccguucacgccucagu

SEQ ID NO: 643874 - RNA, 61 nt, hsa
ccuugccucaagugagcuucaaccuuagccuccugaguagccaggacuauggcauguacca

SEQ ID NO: 643875 - RNA, 61 nt, hsa
ucaaauauuggauuuaccuuuaaaaaaaaaaccugaguaucauugcaugaauuuuuaucuc

SEQ ID NO: 643876 - RNA, 61 nt, hsa
acuuuuuguauauaaucucuuugcccucuauccugaguaacuaauggacaucuucucaugc

SEQ ID NO: 643877 - RNA, 61 nt, hsa
ccagguucaagcgacucuccugccucagccuccugaguagcugggauuauaggcgucugcc

SEQ ID NO: 643878 - RNA, 61 nt, hsa
cugggcucaggugauccucccgccugagccuccugaguaucugggacuacagaugcgugcc

SEQ ID NO: 643879 - RNA, 61 nt, hsa
cuggguucaagcaguucuccugccucagccuccugaguagcugggcacgguguuguaccuc

SEQ ID NO: 643880 - RNA, 61 nt, hsa
gcgacacuuggagccaucucaggcuccacucccugaguaauucacggcauuugggggcuca

SEQ ID NO: 643881 - RNA, 61 nt, hsa
ccgggcucaccccauucuccugccucagccuccugaguagcugggacuacaggcgcccgcc

SEQ ID NO: 643882 - RNA, 61 nt, hsa
ccagguucaagcaguucuccugccucagccuccugaguagcuggcauuauaggugcccacc

SEQ ID NO: 643883 - RNA, 61 nt, hsa
ccggguucaagcgauucucccgccucagccuccugaguagcugggauuacaggcgcguauc

SEQ ID NO: 643884 - RNA, 61 nt, hsa
cuggguucaugccauucuccugccucagccuccugaguagcugggacuacaggcgcucgcc

SEQ ID NO: 643885 - RNA, 61 nt, hsa
acauaaagugcuagaaaaucauguuccuuguccugaguaagaguuaaucagaguaaaugca

SEQ ID NO: 643886 - RNA, 61 nt, hsa
uugggauccuucagcacaggaauucucaagaccugaguauuuuuuauaauaggaaugucca

SEQ ID NO: 643887 - RNA, 61 nt, hsa
cacuccuagccagugagucauggucauauuuccugaguaaagucauucugaguuacuuacu

SEQ ID NO: 643888 - RNA, 61 nt, hsa
ucauuggaaaggguuuuaaacggagucggaaccugaguagauuuccaaauuuuacagccag

SEQ ID NO: 643889 - RNA, 61 nt, hsa
uacagaagugcaucauucuagaauguguagaccugaguagcuuauacacuacagagcacuu

SEQ ID NO: 643890 - RNA, 61 nt, hsa
cuggguucaaacgauucugcugccucagccuccugaguagcugggauuacgggcgcgugcc

SEQ ID NO: 643891 - RNA, 61 nt, hsa
cauugcuagugacuagccccuuaaaugccagccugaguaccugaaggaaucugggaauuag

SEQ ID NO: 643892 - RNA, 61 nt, hsa
cuggguucaagagguucuccugccucagccuccugaguagccggggagcuacaagcaugca

SEQ ID NO: 643893 - RNA, 61 nt, hsa
gccugcccacgcuccuucuuuagcucugacaccugaguacacgaucacccacucuuaccug

SEQ ID NO: 643894 - RNA, 61 nt, hsa
guaacgugggaaccauugagauuguauuugcccugaguauuaaagcuagcuuagcaaaaua

SEQ ID NO: 643895 - RNA, 61 nt, hsa
cuagagugucagaacagagccauucucuccuccugaguaggaacguuucuguucaguuucc

SEQ ID NO: 643896 - RNA, 61 nt, hsa
cuuuuuacccuauggaaggggguaagcuguuccugaguauaacaccaagaugcugcugucu

SEQ ID NO: 643897 - RNA, 61 nt, hsa
cauuuuggcguugcaucuauuguacaucagcccugaguaguaacugguuagcuucucugga

SEQ ID NO: 643898 - RNA, 61 nt, hsa
uuucaacaagcuccuguuaaaaguauaugaaccugaguacuagucuucuuacauuuacaag

SEQ ID NO: 643899 - RNA, 61 nt, hsa
uuuuucuuuguuagguacauguauacaccugccugaguauaaauacucucucuaccuaaua

SEQ ID NO: 643900 - RNA, 61 nt, hsa
ccagguucaagcgauacuccugccucagucuccugaguagcugggaucacaggugcacacc

SEQ ID NO: 643901 - RNA, 61 nt, hsa
ucugucucaagcgauucuccugccucagccuccugaguagcugggauuacaggugcaugcc

SEQ ID NO: 643902 - RNA, 61 nt, hsa
ggacuguuugagcccaggaguuugagaccaaccugaguaagguggcaaaaccccaucucua

SEQ ID NO: 643903 - RNA, 56 nt, hsa
gaaaugguacaaagucaugaugauucccugaguaacaaagggaaaugaaaacuguu

SEQ ID NO: 643904 - RNA, 61 nt, hsa
ucaggugauugucaguaccuuaccucagccuccugaguagcuggaacugcagaugugcgcc

SEQ ID NO: 643905 - RNA, 61 nt, hsa
ucauauaacaaauauuuucccacuauuacagccugaguaauacccguauuaaaagagccuc

SEQ ID NO: 643906 - RNA, 61 nt, hsa
cuggguucaagcaauucuccugccucagccuccugaguagcugggacuauaggugcaugcc

SEQ ID NO: 643907 - RNA, 61 nt, hsa
cuggguucaagugauuccccugccuuagccuccugaguagcugggacuacaggcaugcacc

SEQ ID NO: 643908 - RNA, 61 nt, hsa
ccagguucaagcuauucuccugccucagccuccugaguagcugggacuacaggugugcgcc

SEQ ID NO: 643909 - RNA, 61 nt, hsa
ggcugcccugcccacgugggauucacaggggccugaguagggcccggggaagcagagcccu

SEQ ID NO: 643910 - RNA, 61 nt, hsa
gaggaguguucauuguauaauaaguuauucaccugaguaugcaauaaagaugugguggcca

SEQ ID NO: 643911 - RNA, 61 nt, hsa
uguugacucaaaacuugcuaguuacugccuaccugaguagaaucuuauuuaugaacuccug

SEQ ID NO: 643912 - RNA, 61 nt, hsa
gggaacagccugagccgaacauguuauuuaaccugaguauaguauuuaacgaagccuagaa

SEQ ID NO: 643913 - RNA, 61 nt, hsa
uuugugccuggugauauauuuuuuuuuccucccugaguauaaaugcaaugcgacugcaaaa

SEQ ID NO: 643914 - RNA, 61 nt, hsa
uccuccaucccagcauagagaauggggacucccugaguaaugggaguucuuucauggccuc

SEQ ID NO: 643915 - RNA, 61 nt, hsa
ggaaaagugguacuaacccacgauucugagcccugaguaugccuggacauugaugcuaaca

SEQ ID NO: 643916 - RNA, 61 nt, hsa
ccgaguucaagcaauucuccugccucagccuccugaguagcugggauuacaggcguccgcu

SEQ ID NO: 643917 - RNA, 61 nt, hsa
ccagaagaaguuaaagcucgugcgcacaaguccugaguaugggaugcccucagugaccuuu

SEQ ID NO: 643918 - RNA, 61 nt, hsa
ccaggcucaagugauccucccaccucagcuuccugaguagggauuuauaguaaaacaagug

SEQ ID NO: 643919 - RNA, 61 nt, hsa
gaaguggguggguagauuuaaaaaaucccuuccugaguaauaaagauacaaaauguuacug

SEQ ID NO: 643920 - RNA, 61 nt, hsa
ccagguucaagcgauucucgugccucggccuccugaguagcugggauuacaggcgugugcc

SEQ ID NO: 643921 - RNA, 61 nt, hsa
ccggguucaagcaauucucccaucucagccuccugaguagcugggauuacaggcacacacc

SEQ ID NO: 643922 - RNA, 61 nt, hsa
cuggguucaagcgauucuccugccuccgccuccugaguagcugggauuauaggcacgcacc

SEQ ID NO: 643923 - RNA, 61 nt, hsa
guaagcauucuuaacauguauuuccacuugcccugaguaaaucuguggugagagaagcuuc

SEQ ID NO: 643924 - RNA, 61 nt, hsa
cuggguucaagcgauucucuugccucagccuccugaguagcugggacuacaugcgcacacc

SEQ ID NO: 643925 - RNA, 61 nt, hsa
ugcugaagaaagaagaauagaagaaaaucaaccugaguaaaagcagcacugguuuugaguu

SEQ ID NO: 643926 - RNA, 61 nt, hsa
cuagguucaagcaauucuccugccucagccuccugaguagcugggacuacaggcaugcacc

SEQ ID NO: 643927 - RNA, 61 nt, hsa
cuggguucaagugauucuccugccucagccuccugaguagcugggauuacagacacccgcc

SEQ ID NO: 643928 - RNA, 61 nt, hsa
ccagguucaagugauuauccugccuuagccuccugaguagcugggauuacaggcgcgugcc

SEQ ID NO: 643929 - RNA, 61 nt, hsa
ugcuccugccgucucccccgacuggcuguguccugaguaacuggaacaugagacaguaucu

SEQ ID NO: 643930 - RNA, 61 nt, hsa
ccagguucaagccauucuccugccucggccuccugaguagcugggauuacaguugccgcca

SEQ ID NO: 643931 - RNA, 61 nt, hsa
gauaauaaauguauuuaggacugaaaauacuccugaguacucccuuggcuguaugucugac

SEQ ID NO: 643932 - RNA, 61 nt, hsa
ugaacuucuguuuaaguugaaagcaagagucccugaguauaaaggaaaaacagcaaaacaa

SEQ ID NO: 643933 - RNA, 61 nt, hsa
agagagaugacagucuuccugcaaucccaugccugaguauguaaccaaaagaauugaaauc

SEQ ID NO: 643934 - RNA, 61 nt, hsa
ccuagaguccagaggggaggugagguuaaaaccugaguaauggaaaagcuuuuagaguaga

SEQ ID NO: 643935 - RNA, 61 nt, hsa
cuggguucaagcgcuucuccagccucagccuccugaguagcugggauuacagguaugugcc

SEQ ID NO: 643936 - RNA, 61 nt, hsa
caauucucuuguuacauucucccuuuagcaaccugaguaagagacucucugccacugggcu

SEQ ID NO: 643937 - RNA, 61 nt, hsa
auuccagacuaaacauaaaagauaaucuugaccugaguagagaagagaccuucaggugcuu

SEQ ID NO: 643938 - RNA, 61 nt, hsa
cuacugaaaaaaaucuggaaauuccuaauguccugaguauuaauaauaaaguuuaaaaaug

SEQ ID NO: 643939 - RNA, 61 nt, hsa
uguuguuuuuuggaggggaagguuagucaggccugaguauucauguaacauucuaaaauug

SEQ ID NO: 643940 - RNA, 61 nt, hsa
uuggguuaaaagaauucuccugccucagccuccugaguagcugggauuauaggcacacacc

SEQ ID NO: 643941 - RNA, 61 nt, hsa
uagaaacaaguuuguuuaagacugacuccauccugaguaaucucccuuuauuuuugaccag

SEQ ID NO: 643942 - RNA, 61 nt, hsa
cuggguucaagcaauucuccugccucagccuccugaguagcugggaauauaggugcacacc

SEQ ID NO: 643943 - RNA, 61 nt, hsa
ccagguucaagcgauucuccugccucagccaccugaguagcugggaguacaggcauguggc

SEQ ID NO: 643944 - RNA, 61 nt, hsa
cugggcucaagcgauccuccccgcucagccuccugaguagcugggacuacaggugugcacc

SEQ ID NO: 643945 - RNA, 61 nt, hsa
cccugguucaagcaauucuccugccuugccuccugaguagcugggauuacaggcguguguc

SEQ ID NO: 643946 - RNA, 61 nt, hsa
aagcucugcagacuuuugcaggauugucuagccugaguaccgggcuacuucuuaaaugccg

SEQ ID NO: 643947 - RNA, 61 nt, hsa
auauauaucuauaccugcauauauauauugaccugaguauuuauaacugugugguguucau

SEQ ID NO: 643948 - RNA, 61 nt, hsa
ggguuaucagauauguuuuuaaaucucucgcccugaguacucuucuugggaguugcugcug

SEQ ID NO: 643949 - RNA, 61 nt, hsa
cuauggaggaccucggucuucauccaaguggccugaguauuucacuggcagguugugaauu

SEQ ID NO: 643950 - RNA, 61 nt, hsa
ccagauuccagcgauucuccugccucagccuccugaguagcugggauuacaggugccugcc

SEQ ID NO: 643951 - RNA, 61 nt, hsa
uggugaauguguaccaagaaaaaauuagucaccugaguaacuuggccacuaauaauuaacc

SEQ ID NO: 643952 - RNA, 61 nt, hsa
agugagccauguccacaccauugcacugcagccugaguaacaaaaugagacccuaucucaa

SEQ ID NO: 643953 - RNA, 61 nt, hsa
cuggauucaaacaauucuccugccucagccuccugaguagcugggauuacaggcacaugcc

SEQ ID NO: 643954 - RNA, 61 nt, hsa
cuggguucaaacaauucuccugccucagccuccugaguagcugggacuacaggcaccugcc

SEQ ID NO: 643955 - RNA, 61 nt, hsa
ggcuuccaaguuuucuaagguucaugugaaaccugaguacauuuacaaagcugcaagugga

SEQ ID NO: 643956 - RNA, 61 nt, hsa
ucggguucaagcuguucuacugccucagccuccugaguagcugggauuacaggugugugcc

SEQ ID NO: 643957 - RNA, 61 nt, hsa
ucuuucuuugcuuccugucaccccaggggcuccugaguauaggcuuuucagucccugggca

SEQ ID NO: 643958 - RNA, 61 nt, hsa
ccagguucaagcaauucuccugccucagccuccugaguagcugggauuacaggcacacgcc

SEQ ID NO: 643959 - RNA, 61 nt, hsa
gauucuccugccucccugccucagccugggaccugaguagcugggaccacaggcaugcgcc

SEQ ID NO: 643960 - RNA, 61 nt, hsa
ccggguucaagugaucguccugccuuaggcuccugaguagcuggggauuacaggugccuac

SEQ ID NO: 643961 - RNA, 61 nt, hsa
ccaauguggggagaaaggaagcuuuccgaggccugaguauugcaauacaugcaguaguaca

SEQ ID NO: 643962 - RNA, 61 nt, hsa
auuuaaauaaaaacaacagcagcaggcugucccugaguaguuuugcugccauagguuaagu

SEQ ID NO: 643963 - RNA, 61 nt, hsa
cuggguucaagcaauucuccugccucaggcuccugaguagcugggauuacaggcacgugac

SEQ ID NO: 643964 - RNA, 61 nt, hsa
ccagguucgagcacuuuucaugccucagccuccugaguagcugggauuacaggcgugcacc

SEQ ID NO: 643965 - RNA, 61 nt, hsa
ccggguucaaguaauucugcugucucagccuccugaguagcugggacuacaggcacacgcc

SEQ ID NO: 643966 - RNA, 61 nt, hsa
cuggguucaagugauucucuugccucagccuccugaguagcugggauuacagguuccugcu

SEQ ID NO: 643967 - RNA, 61 nt, hsa
gaagaccuuuaauggcuucccucuuucaucuccugaguauguaacuugcaaugggcagcua

SEQ ID NO: 643968 - RNA, 61 nt, hsa
ccggguucaagcaauucuccugccucagccuccugaguagcugggaugacaggugcacgcc

SEQ ID NO: 643969 - RNA, 61 nt, hsa
cugggcucaaguguuccuccugccucauccuccugaguagcugggguuacaggugugugcc

SEQ ID NO: 643970 - RNA, 61 nt, hsa
ccuucaaaacacgaggcacucuuggaucuacccugaguauccuccaaacuguggauacagu

SEQ ID NO: 643971 - RNA, 61 nt, hsa
cuaaaacuacaauauaugucaucuuauuuucccugaguauccaaguauagugcagauucua

SEQ ID NO: 643972 - RNA, 61 nt, hsa
gaaggccaccauccuccacagagcacccuguccugaguagggguugugcucauuaccccag

SEQ ID NO: 643973 - RNA, 61 nt, hsa
caauggauuuaucccccgcaaagacaucaaaccugaguaucaguacaugccuagaccuggg

SEQ ID NO: 643974 - RNA, 61 nt, hsa
cuggguucaugccauuuuccugcuucagccuccugaguagcugggacuacaggcgcccgcc

SEQ ID NO: 643975 - RNA, 61 nt, hsa
ggugggggcaggcaggaggcauggaugggaaccugaguagguaguguggccaagagaucag

SEQ ID NO: 643976 - RNA, 61 nt, hsa
aaaguaagguugggaccuggguacguggaucccugaguagaucccagcaucugggccaugg

SEQ ID NO: 643977 - RNA, 61 nt, hsa
cugggcucaagugauccucccaccucagccuccugaguagcugagaccacaggcgugugcc

SEQ ID NO: 643978 - RNA, 61 nt, hsa
guaauuucccccacaguaaaauacacugacuccugaguaaauugauuuuccaguuuuaugg

SEQ ID NO: 643979 - RNA, 61 nt, hsa
ccaggcucaagcgauccucccgccuuaacugccugaguagcugggacuacaggcaugcacc

SEQ ID NO: 643980 - RNA, 61 nt, hsa
ccggguucaagcaauucuccugccucagccuccugaguagcuggcacuguaggcauguacc

SEQ ID NO: 643981 - RNA, 61 nt, hsa
caauaauccuauuguacgcuagagcaugcugccugaguauuacuaguggacguaggauauu

SEQ ID NO: 643982 - RNA, 61 nt, hsa
ugaggugagaggcccaggugguccuggcaacccugaguagaaggagagacgggguagggaa

SEQ ID NO: 643983 - RNA, 61 nt, hsa
ccgggcucaagcgauucucucaccucagccuccugaguaggugggauuacagaugcccgcc

SEQ ID NO: 643984 - RNA, 61 nt, hsa
gaagcaggcugaagaggaaaggcaggaggaaccugaguaugagaauguuguacccaucucc

SEQ ID NO: 643985 - RNA, 61 nt, hsa
cugggcucaaaugauccucccaccucagccuccugaguagcugggacuacaggcucaugcc

SEQ ID NO: 643986 - RNA, 61 nt, hsa
cucccagguucaagcgauucuccugccuccuccugaguagcugggacuacaggugcucacc

SEQ ID NO: 643987 - RNA, 61 nt, hsa
ccacguucaagcgauccuccugccucaggcuccugaguagcugggauuacaggcgucggcc

SEQ ID NO: 643988 - RNA, 61 nt, hsa
gucauuggauauaaaagagugauuuuccucaccugaguacaugaaaagaaaaugcugaaau

SEQ ID NO: 643989 - RNA, 61 nt, hsa
ccaggcucaagugauccucccaccccagccuccugaguagcugggacuacaggcuugcgcc

SEQ ID NO: 643990 - RNA, 61 nt, hsa
cugaccucacacaauccuccugccuuagccuccugaguaacugagauuacaggcacaagcu

SEQ ID NO: 643991 - RNA, 61 nt, hsa
ccaggcucaagcgauccucccaucucagccuccugaguagcugggacuacaggcacaggcc

SEQ ID NO: 643992 - RNA, 54 nt, hsa
aaaaagaugacaagaacuaacgcuccugaguaccagccccugucacaucugacu

SEQ ID NO: 643993 - RNA, 61 nt, hsa
agcuaucagcaucugccagucucuuguccucccugaguaucucacaguccauauccugaug

SEQ ID NO: 643994 - RNA, 61 nt, hsa
augggcucaugggauucuccuaccucagccuccugaguagcugggauuacagguguaugcc

SEQ ID NO: 643995 - RNA, 61 nt, hsa
accucccaggcgcacaaaauccuccucucagccugaguaacugggacuacagguguguacc

SEQ ID NO: 643996 - RNA, 61 nt, hsa
cuggguucaagugauucucauggcucagccgccugaguagcugggauuacaggugugagcc

SEQ ID NO: 643997 - RNA, 61 nt, hsa
ccagguucaagcaguucuccugccucagccuccugaguagcugggaugacaggcacccgcc

SEQ ID NO: 643998 - RNA, 61 nt, hsa
ccggguucacgccauucuccugccucagccuccugaguagcugggacuacaggcgcccacc

SEQ ID NO: 643999 - RNA, 61 nt, hsa
ccggguucaagugauucuccugccucagccuccugaguagcugggauuacaggcacccacc

SEQ ID NO: 644000 - RNA, 61 nt, hsa
ccgggcucaagcgauucuccagccucagccuccugaguagcuaggacugcaggugcuccac

SEQ ID NO: 644001 - RNA, 61 nt, hsa
uugggcucaagugauccucccaccucagccuccugaguagcugggaccauaggcucacaac

SEQ ID NO: 644002 - RNA, 61 nt, hsa
ggcguccuuuuuccuuguagcuaacguuaggccugaguagcuccccuccauccuuguagac

SEQ ID NO: 644003 - RNA, 61 nt, hsa
caggguucaagcaauucuccugccucagucuccugaguagcugggacuacaggcaugcgcc

SEQ ID NO: 644004 - RNA, 61 nt, hsa
caggguucaagcaacucuccugcuucagccuccugaguagcugggacuacaggcaugcacc

SEQ ID NO: 644005 - RNA, 61 nt, hsa
ccaggcucaagcaguucuccugccucagccuccugaguagcugggacuacaggcacccgcc

SEQ ID NO: 644006 - RNA, 61 nt, hsa
cggggcucaagcgcuucuccugccucagccuccugaguagcugggauuacaggcaugugcc

SEQ ID NO: 644007 - RNA, 61 nt, hsa
ugggguucaagugauccucccaccucagccuccugaguagcugggauuacaggcacccgcc

SEQ ID NO: 644008 - RNA, 61 nt, hsa
ugaucuccaagugacccuccugccucagccuccugaguacccuccuggggacuacaggugc

SEQ ID NO: 644009 - RNA, 61 nt, hsa
ucaacgccaagucauccucccaccucagccuccugaguagcuaugacuacagguaugugcc

SEQ ID NO: 644010 - RNA, 61 nt, hsa
ccggguucacgccauucuccugccucagccuccugaguagcugggacuacaggccccugcc

SEQ ID NO: 644011 - RNA, 61 nt, hsa
cuggguugaagugauucucgugccucagccuccugaguagcugggacugcaggcacgcgcc

SEQ ID NO: 644012 - RNA, 61 nt, hsa
cuggguucaagcgauucuccugccucagccuccugaguagcugggauuacaggugugcgcc

SEQ ID NO: 644013 - RNA, 61 nt, hsa
cugggaucaagugauucuccugccacagccuccugaguaccugagauuacaggcacccacc

SEQ ID NO: 644014 - RNA, 61 nt, hsa
gagccaacacaugcucacugccagcuccuguccugaguacugggaaguuucuccugaagcc

SEQ ID NO: 644015 - RNA, 61 nt, hsa
gaugcagccccaucuccucagcaccccaggaccugaguauccccagcucagguggugaguc

SEQ ID NO: 644016 - RNA, 61 nt, hsa; identical to SEQ ID NO: 643865

SEQ ID NO: 644017 - RNA, 61 nt, hsa
ucagguucaagcaauucuccugccucagccuccugaguagcugggacuauaggcgcgugcc

SEQ ID NO: 644018 - RNA, 61 nt, hsa
cuggguucaagugauucuccugccucagccuccugaguagcugggauuacagcacccgcca

SEQ ID NO: 644019 - RNA, 61 nt, hsa
uacagaccccaugucacccagaaagagauucccugaguagcaccuucaggcuagucccuau

SEQ ID NO: 644020 - RNA, 61 nt, hsa
acccagguuaaaaauucuccugccucagccuccugaguagcugggacuacaggcaugcgca

SEQ ID NO: 644021 - RNA, 61 nt, hsa
cuggguucacaccauucuccugccucagccuccugaguagcugggacuacaggcgccugcc

SEQ ID NO: 644022 - RNA, 61 nt, hsa
ccgggcucaagcgauucucuugccucagccuccugaguagcuaggacuacaggugcaugcc

SEQ ID NO: 644023 - RNA, 61 nt, hsa
cucccggguucaugccauucugccucagccuccugaguagcugggacuacaggcgcccgcc

SEQ ID NO: 644024 - RNA, 61 nt, hsa
cuguguucaagcgauucuccugucucagccuccugaguagaugggacuacaggcacaggcc

SEQ ID NO: 644025 - RNA, 61 nt, hsa
aguuuugugagcccuguagcaaauuaucaaaccugaguagggcagugggaacucggaauuu

SEQ ID NO: 644026 - RNA, 61 nt, hsa
ccagguucaugcaauucuccugccucagucuccugaguagcugggacuacaggugcgugcc

SEQ ID NO: 644027 - RNA, 61 nt, hsa
uccagucucauuaaauauuggagaauacacaccugaguaagauccugugauugcagcaaau

SEQ ID NO: 644028 - RNA, 61 nt, hsa
cuggguucaagugauucucgugccucagccuccugaguagcugggcugacaggcacccacc

SEQ ID NO: 644029 - RNA, 61 nt, hsa
cuggccuuaagugauccucccaccucagccuccugaguagcugggacuacaggcaugagcc

SEQ ID NO: 644030 - RNA, 61 nt, hsa
cacacccugcucaguauggcuagccagcaguccugaguaggaguccaggacucccacuguc

SEQ ID NO: 644031 - RNA, 61 nt, hsa
ccuagguuauugcuagccaaaauauuuuuguccugaguagugucacugggccaaaagauag

SEQ ID NO: 644032 - RNA, 61 nt, hsa
gacgcaacccacguguaacugucagccgggcccugaguaaucgcuuaaagauguuccuacg

SEQ ID NO: 644033 - RNA, 61 nt, hsa
ccagguucaagcgauucuccugccucagccuccugaguagcugggauuacaggcgcacgcc

SEQ ID NO: 644034 - RNA, 61 nt, hsa
uuguuccuggucuaauuuggcacccuuccaaccugaguauuguaggggaaggaaauuuaca

SEQ ID NO: 644035 - RNA, 61 nt, hsa
caggguucaagugauucuccugccucagccuccugaguagcugggauuacaggcauguacc

SEQ ID NO: 644036 - RNA, 61 nt, hsa
gaaacacugccccauccuccaugcccugaacccugaguagacagccccaagcauggccagg

SEQ ID NO: 644037 - RNA, 61 nt, hsa
gaaacagaacccagguuucuugauucccacuccugaguaaaauuaaauagguuuuauguau

SEQ ID NO: 644038 - RNA, 61 nt, hsa
ggucaccgauggucagagucacuagaaguuaccugaguaucucugggaggccucaugucuc

SEQ ID NO: 644039 - RNA, 61 nt, hsa
uguugcagaagccggcguuuuuauuagcgguccugaguaauuucccuuggcaaaauuccca

SEQ ID NO: 644040 - RNA, 61 nt, hsa
uugaugauuaaaaagaauaaacacaguguuuccugaguagcagugauuguuaugccuugcu

SEQ ID NO: 644041 - RNA, 61 nt, hsa
ccguguucacaccauucuccugccucagccuccugaguagcugggacuacaggcacccgcc

SEQ ID NO: 644042 - RNA, 61 nt, hsa
ccagguuccaacgauugucuugucucagccuccugaguagcugagauuauaagcacgcacc

SEQ ID NO: 644043 - RNA, 61 nt, hsa
uacccaaagaacgaagcugacacugcaggguccugaguaaauguguucuguauaaacaaau

SEQ ID NO: 644044 - RNA, 61 nt, hsa
uuauguucaagcaauucuccuuccuuagccuccugaguagcugggauuacaggcaugcgcc

SEQ ID NO: 644045 - RNA, 61 nt, hsa
cccuggcucaagcgaucccuccccucagccuccugaguagcugagacuacaggugagugcc

SEQ ID NO: 644046 - RNA, 61 nt, hsa
aaguacaauuguuaacagugacuuuaagccuccugaguagcugggacuacaggcaugcacc

SEQ ID NO: 644047 - RNA, 61 nt, hsa
ucugcugcuuggaauaaaaaaugcagcuggcccugaguacagggaaguggaacauaggcag

SEQ ID NO: 644048 - RNA, 61 nt, hsa
gguagcugucacuucaaaagaagacaguuucccugaguaaucaucaccuacauggccauua

SEQ ID NO: 644049 - RNA, 61 nt, hsa
uggagccucaugccccugggucgugagcucgccugaguaugggguggugucauggagccgc

SEQ ID NO: 644050 - RNA, 61 nt, hsa
gcccuggugccugcugaagauucccucuaucccugaguacuuagucuucucccccuucccu

SEQ ID NO: 644051 - RNA, 61 nt, hsa
agaguuaaaaaaaaaaaaaaaaaucuguaugccugaguaccauccuggaugaaucuagaag

SEQ ID NO: 644052 - RNA, 61 nt, hsa
uucuccaaggacagauggcaguggagcuagaccugaguagggggcagggaguucaggacaa

SEQ ID NO: 644053 - RNA, 61 nt, hsa
cggguucaagcggauucucgugccucagccuccugaguagcugggauuacaggcaugcacc

SEQ ID NO: 644054 - RNA, 61 nt, hsa
cuggguucaagcgauuccccugcuucagccuccugaguagcugggacuacaggugcgugcc

SEQ ID NO: 644055 - RNA, 61 nt, hsa
cccccuccuuugugugucccagcacccuuggccugaguaaacuuggaaaggggcucccucc

SEQ ID NO: 644056 - RNA, 61 nt, hsa
cgggucugugucccauguguccugucaguccccugaguauguguguggguguggcgcaugu

SEQ ID NO: 644057 - RNA, 61 nt, hsa
cuggguucaagcgauucuccugccucagccuccugaguagcugggaauacaggcaugcgcc

SEQ ID NO: 644058 - RNA, 61 nt, hsa
uuuaaagacaaauuaugggacguuuguagaaccugaguauuuuucuuuuuaccaguuuuuu

SEQ ID NO: 644059 - RNA, 61 nt, hsa
cggauucaaggaauucucccugccucagccuccugaguagcuaggauuacaggugccugcc

SEQ ID NO: 644060 - RNA, 61 nt, hsa
gccgcugaucagccuuauguucccaaagagcccugaguagugcuuugguguucacagucug

SEQ ID NO: 644061 - RNA, 61 nt, hsa
cuggguucaagcgauucuccugccugagccuccugaguagcugggacuacaggcacgugcc

SEQ ID NO: 644062 - RNA, 61 nt, hsa
ccggauucaagugauucuccagccucagccuccugaguagcugggauuacaggcacacacc

SEQ ID NO: 644063 - RNA, 61 nt, hsa
cuggguucaagcgauucucgugccucagcuuccugaguagcuggaauuacaggcaggugcc

SEQ ID NO: 644064 - RNA, 61 nt, hsa
gaugccgugggaguacaaaaguggaguguggccugaguaaugcauuaugggugguuuacca

SEQ ID NO: 644065 - RNA, 61 nt, hsa
cuggguucaagcgauucuccugccucagccuccugaguagcugggacuacaggcgccagcc

SEQ ID NO: 644066 - RNA, 61 nt, hsa
agccacagcagcagcuugaccugguauucuaccugaguagaugaagcagaagaucagcaag

SEQ ID NO: 644067 - RNA, 61 nt, hsa
cugggcuuaagggauccuuccgccucagccuccugaguagcugggacuacaguugugcacc

SEQ ID NO: 644068 - RNA, 61 nt, hsa
aauauaaucugaauuauuguuaucuuuaccuccugaguaauaagcauggugucaguuuugu

SEQ ID NO: 644069 - RNA, 61 nt, hsa
ggacagucuucucuguugaucacagagggagccugaguacaggcuuggagaaauggcuagg

SEQ ID NO: 644070 - RNA, 61 nt, hsa
gggagaauugucccauucuuguugcuucucuccugaguacccacuaccacaaugucuucug

SEQ ID NO: 644071 - RNA, 65 nt, hsa
ccucccagguucaagugauucuucugccucagccuccugaguagcugggauuacaggugugcacc

SEQ ID NO: 644072 - RNA, 65 nt, hsa
caggaugucaaaaagcaauucuccugccucagccuccugaguagcugggacuacagguuccuacc

SEQ ID NO: 644073 - RNA, 65 nt, hsa
gguucauccuuuagugaauuagaggauuuggcuacccugaguauauuuauauucauuucuucugu

SEQ ID NO: 644074 - RNA, 65 nt, hsa
ccuccuggguucaagcaauucucccaccucagccuccugaguagcugggauuacaggcacaugcc

SEQ ID NO: 644075 - RNA, 65 nt, hsa
ccuccuggguucaagggauucuccugucuuagccuccugaguagcugugauuacaggcaugcgcc

SEQ ID NO: 644076 - RNA, 65 nt, hsa
cuauuagaagcugcuuccugugaagaucaaaucuuccugaguaauuaaauggaccaacaaugagc

SEQ ID NO: 644077 - RNA, 65 nt, hsa
ccucccggguucaagugauucuccugucucagcucccugaguaacuggaauuacaggugcacgcc

SEQ ID NO: 644078 - RNA, 65 nt, hsa
cuuucagcuccuuuguuucauacggaacuccagauccugaguaauccuuuuagagcccgaagagu

SEQ ID NO: 644079 - RNA, 65 nt, hsa
ggcucacugcaaccuccgccuccagggcgcagccuccugaguagcugggaggacaggcauaugcc

SEQ ID NO: 644080 - RNA, 65 nt, hsa
aauucugggcucaggugauccuuccgccucacccuccugaguagcugggacuacaggugugcacc

SEQ ID NO: 644081 - RNA, 65 nt, hsa
ccuccuggguucaagcgauucuccugccucagccuccugaguagcugggauuacaggcacacacc

SEQ ID NO: 644082 - RNA, 65 nt, hsa
gaguuccauguuuguacuccugugcuggacuguuuccugaguaccagcaggucccuuuuugucuc

SEQ ID NO: 644083 - RNA, 65 nt, hsa
aauucuuaaaaggauucauagcaacauaaugugucccugaguagaggaugcugcuaugcgugagu

SEQ ID NO: 644084 - RNA, 65 nt, hsa
aaaugagagucacaaauuuuucuucaguguuucagccugaguaaguuacauaaaccucgcuuagc

SEQ ID NO: 644085 - RNA, 65 nt, hsa
ccuccuggguucaagcgauucuccugccucagccuccugaguagcugggauuacaggugugcacc

SEQ ID NO: 644086 - RNA, 65 nt, hsa
ccucccggguugacaccauuuuccugccucagccuccugaguaguugggauuaccaguagauggg

SEQ ID NO: 644087 - RNA, 65 nt, hsa
ccucccgaauucaagugauucuccugccucagccuccugaguagcugggauuacaggcgcccguc

SEQ ID NO: 644088 - RNA, 65 nt, hsa
cucugggagcucaagugauccuccugccucagucuccugaguagcuggaacuacaaggaagggcc

SEQ ID NO: 644089 - RNA, 65 nt, hsa
ccucccgaguucaaucgauucuccugccucagccuccugaguaccugggauuacaggugccugcc

SEQ ID NO: 644090 - RNA, 65 nt, hsa
ccuccuggguucaagcaauucuccugccucagccuccugaguagcugggauuauaggcgugcacc

SEQ ID NO: 644091 - RNA, 65 nt, hsa
ccucccagguucaagcgauucuccugugucagucuccugaguagcugggauuacaggcacccacc

SEQ ID NO: 644092 - RNA, 65 nt, hsa
ucauccuagaguuucagguaggcuaaugcuuagugccugaguauuuaaauuuucuuuucaaacag

SEQ ID NO: 644093 - RNA, 65 nt, hsa
uuuuuccacaggagguauuucuuuuuuauguugguccugaguauuuugcaaaugcacagagaaaa

SEQ ID NO: 644094 - RNA, 65 nt, hsa
caguuucauggaggggaaacgcaaaaccugcaguuccugaguaccuucuacaggcccggcccagc

SEQ ID NO: 644095 - RNA, 65 nt, hsa
ugagauuauucggaggaagggaaugggggagacagccugaguaaaaggcuuggaaguuggaauua

SEQ ID NO: 644096 - RNA, 65 nt, hsa
ccucccggguucaagccauucuccugccucagucuccugaguagcugggauuacgggugcgugcc

SEQ ID NO: 644097 - RNA, 65 nt, hsa
ccucccggguucaagugauucucaugccucagccuccugaguagcugggauuacaggcuccugcc

SEQ ID NO: 644098 - RNA, 65 nt, hsa
cuggcucuugggauucuggucuuugagaaauagucccugaguauuaggauacuuuuaucaaaauc

SEQ ID NO: 644099 - RNA, 65 nt, hsa
ccucccagguucaagcgauucuccugcuucaaccuccugaguagcugggauuacaggugcgugcc

SEQ ID NO: 644100 - RNA, 65 nt, hsa
ccuccuggguucaagcgauucuccugccucagccuccugaguagcugggaucauaggcacgcgcc

SEQ ID NO: 644101 - RNA, 65 nt, hsa
cacugggaagcucaucagagaaaaugggugcugggccugaguacucccgucggaggggauggaca

SEQ ID NO: 644102 - RNA, 65 nt, hsa
guaccagauaacuuuuuuuuuucuuuauaagaaagccugaguacuccacacugcacaauaacucc

SEQ ID NO: 644103 - RNA, 65 nt, hsa
auuucugggcuugagcaguccucccgucucagccuccugaguagcugagacuacaggugcacacc

SEQ ID NO: 644104 - RNA, 65 nt, hsa
uaacucaucacccuuuuucacuaugacccuuagacccugaguauuuucaaauauaugauugcuga

SEQ ID NO: 644105 - RNA, 65 nt, hsa
ccuccugggcucaagcaguccucccaccucagucuccugaguagcugagacuacagcugugcgcc

SEQ ID NO: 644106 - RNA, 65 nt, hsa
cuucuuagguucaagcgauucuccugccucagccuccugaguagcugggauuacaggcacgcacc

SEQ ID NO: 644107 - RNA, 65 nt, hsa
cuuuauauaaucguuugcauuuuguuacuugcuacccugaguacuuucaggaagacugacuuaaa

SEQ ID NO: 644108 - RNA, 65 nt, hsa
ccucccagguucaagcgauucuccugccucagccaccugaguagcugggauuacacgcacaugcc

SEQ ID NO: 644109 - RNA, 65 nt, hsa
ccucuuggguucaagugauucuccugccucagccuccugaguagcuggauuacaggcaugugcca

SEQ ID NO: 644110 - RNA, 65 nt, hsa
cacaggcucagacuaaaucagaggucaaggcuuccccugaguaagguccauuucuucccaggaau

SEQ ID NO: 644111 - RNA, 65 nt, hsa
uccugggcucaauacucuugccucagccuccucuuccugaguagcugcaacuacagacacaugcc

SEQ ID NO: 644112 - RNA, 65 nt, hsa
ccucccagguucaagcgauucuccugccucagccuccugaguagcugggauuacaggcaacugcc

SEQ ID NO: 644113 - RNA, 65 nt, hsa
ccucccagguucaagcgauucuccugccucagccuccugaguagcugggaccacaggcgacugcc

SEQ ID NO: 644114 - RNA, 65 nt, hsa
cccagaagaaacaacgacacaaucuuagaaucacuccugaguaucucgaguuguggcauuuguua

SEQ ID NO: 644115 - RNA, 65 nt, hsa
acugcaaccucugccuccuggguucacguaauccuccugaguagcugggauuacaggcgccugcc

SEQ ID NO: 644116 - RNA, 65 nt, hsa
ccucucagguucaagugauucuccugccucagccuccugaguagaugggacuguaggcaccugcc

SEQ ID NO: 644117 - RNA, 65 nt, hsa
ccucccggguucaagugauucucuugccucagccuccugaguagugugugccaccacgcccagcu

SEQ ID NO: 644118 - RNA, 65 nt, hsa
acugguggugucaucaccugcuggccccacuacagccugaguaggccugaguggccguggccagg

SEQ ID NO: 644119 - RNA, 65 nt, hsa
ccucccggauucaagcgauucuccugccucagccuccugaguagcuggaacuacaugcgcgugcc

SEQ ID NO: 644120 - RNA, 65 nt, hsa
ugagccaugcucagaaugucugguccuggcuugggccugaguagggcagagagggccuuuccugg

SEQ ID NO: 644121 - RNA, 65 nt, hsa
agcuucaguuugggcuguggacgcugccacacaagccugaguagagcccaugcaaaggaagggau

SEQ ID NO: 644122 - RNA, 65 nt, hsa
aagaaaugcaagcuuguucagggggcugagaagauccugaguacacuaggugcaaaccagaacuc

SEQ ID NO: 644123 - RNA, 65 nt, hsa
cuuuggcagacuccuccauguuuuguucccuucccccugaguaugcaugugccuguucagagucu

SEQ ID NO: 644124 - RNA, 65 nt, hsa
ccuccugggcucaggugauccucccaccucagccuccugaguagcuaggacuacagaugcucgcc

SEQ ID NO: 644125 - RNA, 65 nt, hsa
cuccugggguucaagugauucuccugugucagccuccugaguagcugggauuacaggcgugugcc

SEQ ID NO: 644126 - RNA, 65 nt, hsa
cuucccggguucaagcgauucuccugccucagccuccugaguagcugggauuacaggugugugcc

SEQ ID NO: 644127 - RNA, 65 nt, hsa
aucugaagcuucuuuggccuagauuuuagcacaaaccugaguauaucucuucuacuuucaucaug

SEQ ID NO: 644128 - RNA, 65 nt, hsa
caaauguuaaaauauuguuuaauauuuuugaaaucccugaguaucaggccuuguuauaaauaagc

SEQ ID NO: 644129 - RNA, 65 nt, hsa
cuugccuccagggacuggccaggucuccccccuuuccugaguaccaacuaucauauccccaaaga

SEQ ID NO: 644130 - RNA, 65 nt, hsa
acuagcauaucugccuuuauuguguuugucauuagccugaguagaaaggccuuuaaaauuuuuuu

SEQ ID NO: 644131 - RNA, 65 nt, hsa
cuuccuggguucaagcaauucucaugccucagccuccugaguagcugagaccacaggcacccgcc

SEQ ID NO: 644132 - RNA, 65 nt, hsa
ccucccagguucaugccauucuccugccucagccuccugaguagcugauacuacaggcacccacc

SEQ ID NO: 644133 - RNA, 65 nt, hsa
ugcaugucugugagcugccuuucaucaccauuuuuccugaguagggcuuaguuuuauucuggaaa

SEQ ID NO: 644134 - RNA, 65 nt, hsa
acuugguuugggagaugaugccugccuugagaaguccugaguacagagacugguuccccccagac

SEQ ID NO: 644135 - RNA, 65 nt, hsa
aaaaaaaaccuuuggugccuuuucucucuucuuuaccugaguaaauaauuggcaccugccuucuu

SEQ ID NO: 644136 - RNA, 65 nt, hsa
ccuccuggguucaaaugauucuccugccucagccuccugaguagcuagguacaggcaccugccac

SEQ ID NO: 644137 - RNA, 65 nt, hsa
uuuuugcuugcuuaaucuucucugccccaguucuuccugaguauaugaauuugauuucuaaaaac

SEQ ID NO: 644138 - RNA, 65 nt, hsa
ccucccggguucacgccauccuccugccucagccuccugaguagcugggacuacaggugccugcc

SEQ ID NO: 644139 - RNA, 65 nt, hsa
cuucccgaguucaagcaauucuccugccucagccuccugaguagcugggauuauaggcaugcacc

SEQ ID NO: 644140 - RNA, 65 nt, hsa
ccucccggguucacgccauucuccugccucagccuccugaguagcugggacuacaggcgcccgcc

SEQ ID NO: 644141 - RNA, 65 nt, hsa
acccccagccucaacugauccucgcaucucagccuccugaguagcugggaugacaggcgugcacc

SEQ ID NO: 644142 - RNA, 65 nt, hsa
ccucccagguucaagcgauucucgugccucagccuccugaguagcugggacuacaggcgcccacc

SEQ ID NO: 644143 - RNA, 65 nt, hsa
ccuccuggguucaagcaauucuccugccucagccuccugaguagcugggauuacaggcaugaacc

SEQ ID NO: 644144 - RNA, 65 nt, hsa
cagucaccauagcagcugacugaaaaucagcacugccugaguaguuuugaucaguuuaacuugaa

SEQ ID NO: 644145 - RNA, 65 nt, hsa
aagcaccugaccacaaaaccucuuguaaaaacagcccugaguagguauuuccagggcuccacaaa

SEQ ID NO: 644146 - RNA, 65 nt, hsa
ccuaccggguucaagugauucuugugccucagccuccugaguagcugggauuauaggcaugcacc

SEQ ID NO: 644147 - RNA, 65 nt, hsa
ccuaccgaguucaagcgauucuugugcuucagccuccugaguagcugggacuauaggccuguacc

SEQ ID NO: 644148 - RNA, 65 nt, hsa
ccucccagguucaagugauucuccugccucagccuccugaguagcugggacuacaggcgccugcc

SEQ ID NO: 644149 - RNA, 65 nt, hsa
acuaauguguuggugggccuggccgugcugccucuccugaguagggugggugcaaguagggccuc

SEQ ID NO: 644150 - RNA, 65 nt, hsa
agaggaaauauauauauuuuuaaguuuggcaaaauccugaguaguguaguccuauuaauuccaga

SEQ ID NO: 644151 - RNA, 65 nt, hsa
cuuccugggcugaacugauccuuccaccucagccuccugaguagcugggacuacaggugugugcc

SEQ ID NO: 644152 - RNA, 65 nt, hsa
aguccgccucccaggcgauucuccugccucagccuccugaguagcugggauuacaggcaugcacc

SEQ ID NO: 644153 - RNA, 65 nt, hsa; identical to SEQ ID NO: 644140

SEQ ID NO: 644154 - RNA, 65 nt, hsa
agauauggggguuacaucagugcuggucauuguagccugaguauacaaucaagcuucagugugca

SEQ ID NO: 644155 - RNA, 65 nt, hsa
ucucaucaaugauauguaaggugacuuaugaaucaccugaguacaauucuuuguuguuuagcacu

SEQ ID NO: 644156 - RNA, 65 nt, hsa
cuugaacaaaaaugacagauacaaacuauuucuauccugaguaguaaucucacacuucauccuau

SEQ ID NO: 644157 - RNA, 65 nt, hsa
ucccacagguucaggcgauucccgugccucagccuccugaguagcugggacuacaggcacgcacc

SEQ ID NO: 644158 - RNA, 65 nt, hsa
ccucccggguucaagcgauucuccugccucagccuccugaguagcuggaauuacaggcacccacc

SEQ ID NO: 644159 - RNA, 65 nt, hsa
ccucccggguucaagcgauucuccagccucagcuuccugaguagaugggauuacaggcgccugcc

SEQ ID NO: 644160 - RNA, 65 nt, hsa
ccucccggguuuaagcaguucuccugccucagccuccugaguagcugggauuacaggugugcccc

SEQ ID NO: 644161 - RNA, 65 nt, hsa
gcacaguggcuuauaaggaaccagcaguguuuuucccugaguaauuaugaacuuagucaagauca

SEQ ID NO: 644162 - RNA, 65 nt, hsa
aucucccagguucaagcgaucaugugccuaagccuccugaguagcugggaucacagguguguacc

SEQ ID NO: 644163 - RNA, 65 nt, hsa
ccucccagguucaggugauucuccugccucagccuccugaguagcugggauuacaagcacguguc

SEQ ID NO: 644164 - RNA, 65 nt, hsa
ccuccuggguucaagcaauucuccugccucagccuccugaguagcugggauuauaggcacaugcc

SEQ ID NO: 644165 - RNA, 65 nt, hsa
uaugacuuucauuucccagaaaaaagauuaaugguccugaguaggaauauuacauaauuuugauu

SEQ ID NO: 644166 - RNA, 65 nt, hsa
acuccugggcucaaguuauccuuccauuuuggccuccugaguagcuagaccauagguaugcauca

SEQ ID NO: 644167 - RNA, 65 nt, hsa
ucaaaaagaaguauugcaugucuaaaagcuagugcccugaguacucaugaauucgauuccaagag

SEQ ID NO: 644168 - RNA, 65 nt, hsa
aguggcuuaucccgcaugagcaggagcgugcuggcccugaguacugaacuuucugaguaacaaug

SEQ ID NO: 644169 - RNA, 65 nt, hsa
gggggucaguucuugcaaccuuguggaauuugcuuccugaguaaguggauauacaaccucagcaa

SEQ ID NO: 644170 - RNA, 65 nt, hsa
ccucccggguucaagugauucucccgccucagcuuccugaguagcuggaacuacaggcgugugcc

SEQ ID NO: 644171 - RNA, 65 nt, hsa
ggaugaaacaguuucaaguaagccuugaauugaaaccugaguagguuaaaacaauucuauuucau

SEQ ID NO: 644172 - RNA, 65 nt, hsa
ucaagaaauaaaucaucaccaauaccuuugaggucccugaguaauccaccccagcuaaaggcaaa

SEQ ID NO: 644173 - RNA, 65 nt, hsa
guggagccuccauaaucagugugguugccuucagaccugaguacuuagcugagggugggugagag

SEQ ID NO: 644174 - RNA, 65 nt, hsa
aacucuuugguuaauaguaaaugcuuaacuguaguccugaguaggugcauuucugucugucucaa

SEQ ID NO: 644175 - RNA, 65 nt, hsa
cauuuuuuguucuuauucuuuuucucauaaguacuccugaguacaaguggucaccucccauagua

SEQ ID NO: 644176 - RNA, 65 nt, hsa
cgaccugggcucaagcaauccucccgcuucagccuccugaguagcuggugcgcacgaccauaccc

SEQ ID NO: 644177 - RNA, 65 nt, hsa
auucuacucaaauguaccuuaauuuuuuuuuuuucccugaguaaaagcaagaaauuucuuccuuu

SEQ ID NO: 644178 - RNA, 65 nt, hsa
gucuagaaaaucucaguucccaccaguaaaauuauccugaguagcuaaugcaccuugagaaaaau

SEQ ID NO: 644179 - RNA, 65 nt, hsa
gaggaggccagugcccacuugcccaccgaccugagccugaguaaguggcugucaccugagccugu

SEQ ID NO: 644180 - RNA, 65 nt, hsa
ccucccggguucacgccauucuccugccucagccuccugaguagcuggggcuacaggcgucugcc

SEQ ID NO: 644181 - RNA, 65 nt, hsa
auuccugggcucaggcaauccuccugccucagccuccugaguagcugggacuacaguuucgugug

SEQ ID NO: 644182 - RNA, 65 nt, hsa
ccuccuggguucaagcgauucuccagccucagccuccugaguagcuggaauuacagguacgcacc

SEQ ID NO: 644183 - RNA, 65 nt, hsa
ucuuccucacacugcuguccucucccccuucagcuccugaguagcugggccugugcacugggcag

SEQ ID NO: 644184 - RNA, 65 nt, hsa
aaacugguagaauauuuauucauaugacaaggauaccugaguaaaacuauccuuuuuaaaaucac

SEQ ID NO: 644185 - RNA, 65 nt, hsa
ggugggguggggugguucaaauggaugacugaucuccugaguacacugaagccacaggcuggugg

SEQ ID NO: 644186 - RNA, 65 nt, hsa
ccucccagguucaagcgauuguccugccucagucuccugaguagcugggacuacaggugugcacc

SEQ ID NO: 644187 - RNA, 65 nt, hsa
cagacaggaaaacaauauuguauaacagaccacuuccugaguagaagaguuucuuugugaaaagg

SEQ ID NO: 644188 - RNA, 65 nt, hsa
ccucauagguucaagucauucuccugccucagccuccugaguagcugggacuacaggugagugcc

SEQ ID NO: 644189 - RNA, 65 nt, hsa
uagccgugaugaaagcagcguuacuucugaccgugccugaguaagagaaugcugaugccauaacu

SEQ ID NO: 644190 - RNA, 65 nt, hsa
ccucccagguucaggugauucuccugccucagccuccugaguagcugggauuacaggugugcgcc

SEQ ID NO: 644191 - RNA, 65 nt, hsa
acuccugggcuuaagugacccucccaccucagucuccugaguagcuaggacuacaggcacacacu

SEQ ID NO: 644192 - RNA, 65 nt, hsa
ggcccucggugcccacgccucugcccaucuggaggccugaguaaggaguggcucagccccacguu

SEQ ID NO: 644193 - RNA, 65 nt, hsa
gcucucugcaaccucugccucccagguucaagccuccugaguaacugggacuacaggcgcccgcc

SEQ ID NO: 644194 - RNA, 65 nt, hsa
uuuccucugaggggcuaucaauguguagauaaagcccugaguaggcaagagcagugagauccacu

SEQ ID NO: 644195 - RNA, 65 nt, hsa
aucacucuauacagucauuagauguaacauccuucccugaguagaaaguaaugcauguguuugga

SEQ ID NO: 644196 - RNA, 65 nt, hsa
gcccuccaaacuggccccuccugcucacugccucuccugaguagaaaucuggugaccuaaggcuc

SEQ ID NO: 644197 - RNA, 65 nt, hsa
aggaauuauggauauauguugaggucauucagcuuccugaguaccacauuccccagcuacuuaga

SEQ ID NO: 644198 - RNA, 65 nt, hsa
ccucccagguucaagcaauucuccugccucagucuccugaguagcuggaacuacaggugugcgcc

SEQ ID NO: 644199 - RNA, 65 nt, hsa
uccuccgaguucaagcuauccuuccaccuccgccuccugaguagcugggaccacagguucacaua

SEQ ID NO: 644200 - RNA, 65 nt, hsa
ccucccguauucaagcgauucuccugucucagccuccugaguagcugggacuacaggugugcacc

SEQ ID NO: 644201 - RNA, 65 nt, hsa
ccuccuggguucaagugauucuagugccucagccuccugaguagcugggauaaugggcgugugcc

SEQ ID NO: 644202 - RNA, 65 nt, hsa
auuccugggcccaagcaauucucccaccucagccuccugaguagcugggacuacaagugugcacc

SEQ ID NO: 644203 - RNA, 65 nt, hsa
acuccugggcucaagcaauccuccugccucagcuuccugaguagcuggaaccacaggugugugcu

SEQ ID NO: 644204 - RNA, 65 nt, hsa
uuaagagugaauagcuuuauggaaucaaguaugucccugaguagcaagauuaggccucaccaaag

SEQ ID NO: 644205 - RNA, 65 nt, hsa
accccuuccccauccugcuccgcuucauguccccuccugaguagucaugugauaauaaacucuca

SEQ ID NO: 644206 - RNA, 65 nt, hsa
gauucgcguagcaggggaguuguuugaaacaccuuccugaguaguccggccuugucaaugagugc

SEQ ID NO: 644207 - RNA, 65 nt, hsa
ccucccgggcucaagacauccuccugccucagccuccugaguagcugggacugcaguuguaagcc

SEQ ID NO: 644208 - RNA, 65 nt, hsa
ccuuugccuccuagguucaagugauucuccuaccuccugaguaacugggauuacagucgugugcc

SEQ ID NO: 644209 - RNA, 65 nt, hsa
ccuuccaguugcaagugauucuccugccucagccuccugaguagcugggauuacaggcacccgcc

SEQ ID NO: 644210 - RNA, 65 nt, hsa
cucccucuacugggagccuacccacccccaggaccccugaguaaaaaagcugugugcucuccaag

SEQ ID NO: 644211 - RNA, 65 nt, hsa
ccucccguauucaagcgauucuccugucucagccuccugaguagcuaggacuacaggugugcacc

SEQ ID NO: 644212 - RNA, 65 nt, hsa
aaguuuguaaauguuccagaacaaccuagagaacaccugaguacuaagcagcaguuuugcaagga

SEQ ID NO: 644213 - RNA, 65 nt, hsa
gggcugaucauucccucuccuuguaauugcaguauccugaguagcaguuuaauuuucaucaaaca

SEQ ID NO: 644214 - RNA, 65 nt, hsa
aaagauucagagaacuaauuuuucacuggauaagaccugaguaacccagaccccccaccgugguu

SEQ ID NO: 644215 - RNA, 65 nt, hsa
aagcugaucgcuugagcccaggaguuuaagaccggccugaguagcauagcaagacccugucucua

SEQ ID NO: 644216 - RNA, 65 nt, hsa
ccucccggguucaagcgauucucccgccucagccuccugaguagcugggauuacaggcacccgcc

SEQ ID NO: 644217 - RNA, 65 nt, hsa
ccucccagguucaagugauucuccugccucagccuccugaguagcugggauuacaggcacacacc

SEQ ID NO: 644218 - RNA, 65 nt, hsa
uuucauguaaagaaaaaaacuugaaaauaguaauaccugaguacccaugggaauaauagacacug

SEQ ID NO: 644219 - RNA, 65 nt, hsa
gaauggcaguauucaggcucaacguacaguuugauccugaguaugcuugguguuugccuucagaa

SEQ ID NO: 644220 - RNA, 65 nt, hsa
ccucccagguucaagugauucuccugccucauccuccugaguagcugggauuacaggcgugugcc

SEQ ID NO: 644221 - RNA, 65 nt, hsa
guucuuuaacucacauucagaggaaguccagaucuccugaguagugauuuuggugacaaguuuuu

SEQ ID NO: 644222 - RNA, 65 nt, hsa
gcucccaggcucaagcguuucucccaccuuagccuccugaguagcugggacuaaggcacacacac

SEQ ID NO: 644223 - RNA, 65 nt, hsa
aggucucaaagcaggaacaguggguuugugucucaccugaguaucuggaauuuuauuuuuucaag

SEQ ID NO: 644224 - RNA, 65 nt, hsa
ccucccggguucacgccauucuccugccucagccuccugaguagcugggacuacaggcaccugcc

SEQ ID NO: 644225 - RNA, 65 nt, hsa
aaaacugauugaaugauauauaaauauauuuauagccugaguaaaguuaaaagaauguaaaauau

SEQ ID NO: 644226 - RNA, 65 nt, hsa
ccucccuggcuugagugauccucccgccccagccuccugaguagcugggacuagaggcacgcacc

SEQ ID NO: 644227 - RNA, 65 nt, hsa
ccucccagguucaagcaauucuccugccuuagccuccugaguagcugggauuacaggcgugcgcc

SEQ ID NO: 644228 - RNA, 65 nt, hsa
ccucccagauucaagcgauucuccugucucagccuccugaguagcugggauuauagguacaugcc

SEQ ID NO: 644229 - RNA, 65 nt, hsa
agaugucuacuuguucaguuuuucaaaucuguuuuccugaguauaaauaagaguauuuaaagaaa

SEQ ID NO: 644230 - RNA, 65 nt, hsa
uaucuccuuaggcaagacuuugccucucuccuaguccugaguauaaauccugugcauagauuccu

SEQ ID NO: 644231 - RNA, 65 nt, hsa
gcuaguuagagacucgccugggaaauugcuccauuccugaguaaacagauauuuucgcccaccua

SEQ ID NO: 644232 - RNA, 65 nt, hsa
cucgccucuuuugcacuggaaggcccucccuuuggccugaguacuuuucccguucacgccucagu

SEQ ID NO: 644233 - RNA, 65 nt, hsa
aaccccuugccucaagugagcuucaaccuuagccuccugaguagccaggacuauggcauguacca

SEQ ID NO: 644234 - RNA, 65 nt, hsa
augaucaaauauuggauuuaccuuuaaaaaaaaaaccugaguaucauugcaugaauuuuuaucuc

SEQ ID NO: 644235 - RNA, 65 nt, hsa
aaauacuuuuuguauauaaucucuuugcccucuauccugaguaacuaauggacaucuucucaugc

SEQ ID NO: 644236 - RNA, 65 nt, hsa
ucucccagguucaagcgacucuccugccucagccuccugaguagcugggauuauaggcgucugcc

SEQ ID NO: 644237 - RNA, 65 nt, hsa
aauccugggcucaggugauccucccgccugagccuccugaguaucugggacuacagaugcgugcc

SEQ ID NO: 644238 - RNA, 65 nt, hsa
ccuccuggguucaagcaguucuccugccucagccuccugaguagcugggcacgguguuguaccuc

SEQ ID NO: 644239 - RNA, 65 nt, hsa
ucuggcgacacuuggagccaucucaggcuccacucccugaguaauucacggcauuugggggcuca

SEQ ID NO: 644240 - RNA, 65 nt, hsa
ccucccgggcucaccccauucuccugccucagccuccugaguagcugggacuacaggcgcccgcc

SEQ ID NO: 644241 - RNA, 65 nt, hsa
ccucccagguucaagcaguucuccugccucagccuccugaguagcuggcauuauaggugcccacc

SEQ ID NO: 644242 - RNA, 65 nt, hsa
ccucccggguucaagcgauucucccgccucagccuccugaguagcugggauuacaggcgcguauc

SEQ ID NO: 644243 - RNA, 65 nt, hsa
ccuccuggguucaugccauucuccugccucagccuccugaguagcugggacuacaggcgcucgcc

SEQ ID NO: 644244 - RNA, 65 nt, hsa
uuguacauaaagugcuagaaaaucauguuccuuguccugaguaagaguuaaucagaguaaaugca

SEQ ID NO: 644245 - RNA, 65 nt, hsa
cauuuugggauccuucagcacaggaauucucaagaccugaguauuuuuuauaauaggaaugucca

SEQ ID NO: 644246 - RNA, 65 nt, hsa
ggggcacuccuagccagugagucauggucauauuuccugaguaaagucauucugaguuacuuacu

SEQ ID NO: 644247 - RNA, 65 nt, hsa
cuguucauuggaaaggguuuuaaacggagucggaaccugaguagauuuccaaauuuuacagccag

SEQ ID NO: 644248 - RNA, 65 nt, hsa
ggacuacagaagugcaucauucuagaauguguagaccugaguagcuuauacacuacagagcacuu

SEQ ID NO: 644249 - RNA, 65 nt, hsa
ccuccuggguucaaacgauucugcugccucagccuccugaguagcugggauuacgggcgcgugcc

SEQ ID NO: 644250 - RNA, 65 nt, hsa
cuuucauugcuagugacuagccccuuaaaugccagccugaguaccugaaggaaucugggaauuag

SEQ ID NO: 644251 - RNA, 65 nt, hsa
ccuccuggguucaagagguucuccugccucagccuccugaguagccggggagcuacaagcaugca

SEQ ID NO: 644252 - RNA, 65 nt, hsa
accugccugcccacgcuccuucuuuagcucugacaccugaguacacgaucacccacucuuaccug

SEQ ID NO: 644253 - RNA, 65 nt, hsa
caguguaacgugggaaccauugagauuguauuugcccugaguauuaaagcuagcuuagcaaaaua

SEQ ID NO: 644254 - RNA, 65 nt, hsa
gauccuagagugucagaacagagccauucucuccuccugaguaggaacguuucuguucaguuucc

SEQ ID NO: 644255 - RNA, 65 nt, hsa
gccacuuuuuacccuauggaaggggguaagcuguuccugaguauaacaccaagaugcugcugucu

SEQ ID NO: 644256 - RNA, 65 nt, hsa
aucucauuuuggcguugcaucuauuguacaucagcccugaguaguaacugguuagcuucucugga

SEQ ID NO: 644257 - RNA, 65 nt, hsa
uuucuuucaacaagcuccuguuaaaaguauaugaaccugaguacuagucuucuuacauuuacaag

SEQ ID NO: 644258 - RNA, 65 nt, hsa
uuucuuuuucuuuguuagguacauguauacaccugccugaguauaaauacucucucuaccuaaua

SEQ ID NO: 644259 - RNA, 65 nt, hsa
ucucccagguucaagcgauacuccugccucagucuccugaguagcugggaucacaggugcacacc

SEQ ID NO: 644260 - RNA, 65 nt, hsa
aaccucugucucaagcgauucuccugccucagccuccugaguagcugggauuacaggugcaugcc

SEQ ID NO: 644261 - RNA, 65 nt, hsa
aggaggacuguuugagcccaggaguuugagaccaaccugaguaagguggcaaaaccccaucucua

SEQ ID NO: 644262 - RNA, 56 nt, hsa; identical to SEQ ID NO: 643903

SEQ ID NO: 644263 - RNA, 65 nt, hsa
ggguucaggugauugucaguaccuuaccucagccuccugaguagcuggaacugcagaugugcgcc

SEQ ID NO: 644264 - RNA, 65 nt, hsa
uuuaucauauaacaaauauuuucccacuauuacagccugaguaauacccguauuaaaagagccuc

SEQ ID NO: 644265 - RNA, 65 nt, hsa
ccuucuggguucaagcaauucuccugccucagccuccugaguagcugggacuauaggugcaugcc

SEQ ID NO: 644266 - RNA, 65 nt, hsa
ccuccuggguucaagugauuccccugccuuagccuccugaguagcugggacuacaggcaugcacc

SEQ ID NO: 644267 - RNA, 65 nt, hsa
ccucccagguucaagcuauucuccugccucagccuccugaguagcugggacuacaggugugcgcc

SEQ ID NO: 644268 - RNA, 65 nt, hsa
uugaggcugcccugcccacgugggauucacaggggccugaguagggcccggggaagcagagcccu

SEQ ID NO: 644269 - RNA, 65 nt, hsa
aauggaggaguguucauuguauaauaaguuauucaccugaguaugcaauaaagaugugguggcca

SEQ ID NO: 644270 - RNA, 65 nt, hsa
acuuuguugacucaaaacuugcuaguuacugccuaccugaguagaaucuuauuuaugaacuccug

SEQ ID NO: 644271 - RNA, 65 nt, hsa
ugaagggaacagccugagccgaacauguuauuuaaccugaguauaguauuuaacgaagccuagaa

SEQ ID NO: 644272 - RNA, 65 nt, hsa
ucccuuugugccuggugauauauuuuuuuuuccucccugaguauaaaugcaaugcgacugcaaaa

SEQ ID NO: 644273 - RNA, 65 nt, hsa
cacauccuccaucccagcauagagaauggggacucccugaguaaugggaguucuuucauggccuc

SEQ ID NO: 644274 - RNA, 65 nt, hsa
agugggaaaagugguacuaacccacgauucugagcccugaguaugccuggacauugaugcuaaca

SEQ ID NO: 644275 - RNA, 65 nt, hsa
ccucccgaguucaagcaauucuccugccucagccuccugaguagcugggauuacaggcguccgcu

SEQ ID NO: 644276 - RNA, 65 nt, hsa
cugcccagaagaaguuaaagcucgugcgcacaaguccugaguaugggaugcccucagugaccuuu

SEQ ID NO: 644277 - RNA, 65 nt, hsa
caucccaggcucaagugauccucccaccucagcuuccugaguagggauuuauaguaaaacaagug

SEQ ID NO: 644278 - RNA, 65 nt, hsa
uggggaaguggguggguagauuuaaaaaaucccuuccugaguaauaaagauacaaaauguuacug

SEQ ID NO: 644279 - RNA, 65 nt, hsa
ucucccagguucaagcgauucucgugccucggccuccugaguagcugggauuacaggcgugugcc

SEQ ID NO: 644280 - RNA, 65 nt, hsa
ucucccggguucaagcaauucucccaucucagccuccugaguagcugggauuacaggcacacacc

SEQ ID NO: 644281 - RNA, 65 nt, hsa
ccuccuggguucaagcgauucuccugccuccgccuccugaguagcugggauuauaggcacgcacc

SEQ ID NO: 644282 - RNA, 65 nt, hsa
uaggguaagcauucuuaacauguauuuccacuugcccugaguaaaucuguggugagagaagcuuc

SEQ ID NO: 644283 - RNA, 65 nt, hsa
ccuccuggguucaagcgauucucuugccucagccuccugaguagcugggacuacaugcgcacacc

SEQ ID NO: 644284 - RNA, 65 nt, hsa
aaucugcugaagaaagaagaauagaagaaaaucaaccugaguaaaagcagcacugguuuugaguu

SEQ ID NO: 644285 - RNA, 65 nt, hsa
ccuccuagguucaagcaauucuccugccucagccuccugaguagcugggacuacaggcaugcacc

SEQ ID NO: 644286 - RNA, 65 nt, hsa
ccuccuggguucaagugauucuccugccucagccuccugaguagcugggauuacagacacccgcc

SEQ ID NO: 644287 - RNA, 65 nt, hsa
ccucccagguucaagugauuauccugccuuagccuccugaguagcugggauuacaggcgcgugcc

SEQ ID NO: 644288 - RNA, 65 nt, hsa
uugcugcuccugccgucucccccgacuggcuguguccugaguaacuggaacaugagacaguaucu

SEQ ID NO: 644289 - RNA, 65 nt, hsa
ccucccagguucaagccauucuccugccucggccuccugaguagcugggauuacaguugccgcca

SEQ ID NO: 644290 - RNA, 65 nt, hsa
uccugauaauaaauguauuuaggacugaaaauacuccugaguacucccuuggcuguaugucugac

SEQ ID NO: 644291 - RNA, 65 nt, hsa
gacuugaacuucuguuuaaguugaaagcaagagucccugaguauaaaggaaaaacagcaaaacaa

SEQ ID NO: 644292 - RNA, 65 nt, hsa
gaugagagagaugacagucuuccugcaaucccaugccugaguauguaaccaaaagaauugaaauc

SEQ ID NO: 644293 - RNA, 65 nt, hsa
uauuccuagaguccagaggggaggugagguuaaaaccugaguaauggaaaagcuuuuagaguaga

SEQ ID NO: 644294 - RNA, 65 nt, hsa
ccuccuggguucaagcgcuucuccagccucagccuccugaguagcugggauuacagguaugugcc

SEQ ID NO: 644295 - RNA, 65 nt, hsa
augucaauucucuuguuacauucucccuuuagcaaccugaguaagagacucucugccacugggcu

SEQ ID NO: 644296 - RNA, 65 nt, hsa
acuuauuccagacuaaacauaaaagauaaucuugaccugaguagagaagagaccuucaggugcuu

SEQ ID NO: 644297 - RNA, 65 nt, hsa
aaugcuacugaaaaaaaucuggaaauuccuaauguccugaguauuaauaauaaaguuuaaaaaug

SEQ ID NO: 644298 - RNA, 65 nt, hsa
guuuuguuguuuuuuggaggggaagguuagucaggccugaguauucauguaacauucuaaaauug

SEQ ID NO: 644299 - RNA, 65 nt, hsa
ccucuuggguuaaaagaauucuccugccucagccuccugaguagcugggauuauaggcacacacc

SEQ ID NO: 644300 - RNA, 65 nt, hsa
ccguuagaaacaaguuuguuuaagacugacuccauccugaguaaucucccuuuauuuuugaccag

SEQ ID NO: 644301 - RNA, 65 nt, hsa
ccuccuggguucaagcaauucuccugccucagccuccugaguagcugggaauauaggugcacacc

SEQ ID NO: 644302 - RNA, 65 nt, hsa
ccucccagguucaagcgauucuccugccucagccaccugaguagcugggaguacaggcauguggc

SEQ ID NO: 644303 - RNA, 65 nt, hsa
acuccugggcucaagcgauccuccccgcucagccuccugaguagcugggacuacaggugugcacc

SEQ ID NO: 644304 - RNA, 65 nt, hsa
gccucccugguucaagcaauucuccugccuugccuccugaguagcugggauuacaggcguguguc

SEQ ID NO: 644305 - RNA, 65 nt, hsa
agccaagcucugcagacuuuugcaggauugucuagccugaguaccgggcuacuucuuaaaugccg

SEQ ID NO: 644306 - RNA, 65 nt, hsa
gaauauauauaucuauaccugcauauauauauugaccugaguauuuauaacugugugguguucau

SEQ ID NO: 644307 - RNA, 65 nt, hsa
aaugggguuaucagauauguuuuuaaaucucucgcccugaguacucuucuugggaguugcugcug

SEQ ID NO: 644308 - RNA, 65 nt, hsa
gauucuauggaggaccucggucuucauccaaguggccugaguauuucacuggcagguugugaauu

SEQ ID NO: 644309 - RNA, 65 nt, hsa
caucccagauuccagcgauucuccugccucagccuccugaguagcugggauuacaggugccugcc

SEQ ID NO: 644310 - RNA, 65 nt, hsa
auuuuggugaauguguaccaagaaaaaauuagucaccugaguaacuuggccacuaauaauuaacc

SEQ ID NO: 644311 - RNA, 65 nt, hsa
cugcagugagccauguccacaccauugcacugcagccugaguaacaaaaugagacccuaucucaa

SEQ ID NO: 644312 - RNA, 65 nt, hsa
ccuccuggauucaaacaauucuccugccucagccuccugaguagcugggauuacaggcacaugcc

SEQ ID NO: 644313 - RNA, 65 nt, hsa
cuuccuggguucaaacaauucuccugccucagccuccugaguagcugggacuacaggcaccugcc

SEQ ID NO: 644314 - RNA, 65 nt, hsa
caguggcuuccaaguuuucuaagguucaugugaaaccugaguacauuuacaaagcugcaagugga

SEQ ID NO: 644315 - RNA, 65 nt, hsa
ccucucggguucaagcuguucuacugccucagccuccugaguagcugggauuacaggugugugcc

SEQ ID NO: 644316 - RNA, 65 nt, hsa
auuuucuuucuuugcuuccugucaccccaggggcuccugaguauaggcuuuucagucccugggca

SEQ ID NO: 644317 - RNA, 65 nt, hsa
ccucccagguucaagcaauucuccugccucagccuccugaguagcugggauuacaggcacacgcc

SEQ ID NO: 644318 - RNA, 65 nt, hsa
cagcgauucuccugccucccugccucagccugggaccugaguagcugggaccacaggcaugcgcc

SEQ ID NO: 644319 - RNA, 65 nt, hsa
ccucccggguucaagugaucguccugccuuaggcuccugaguagcuggggauuacaggugccuac

SEQ ID NO: 644320 - RNA, 65 nt, hsa
ccuuccaauguggggagaaaggaagcuuuccgaggccugaguauugcaauacaugcaguaguaca

SEQ ID NO: 644321 - RNA, 65 nt, hsa
uuguauuuaaauaaaaacaacagcagcaggcugucccugaguaguuuugcugccauagguuaagu

SEQ ID NO: 644322 - RNA, 65 nt, hsa
uccucuggguucaagcaauucuccugccucaggcuccugaguagcugggauuacaggcacgugac

SEQ ID NO: 644323 - RNA, 65 nt, hsa
ccucccagguucgagcacuuuucaugccucagccuccugaguagcugggauuacaggcgugcacc

SEQ ID NO: 644324 - RNA, 65 nt, hsa
ccucccggguucaaguaauucugcugucucagccuccugaguagcugggacuacaggcacacgcc

SEQ ID NO: 644325 - RNA, 65 nt, hsa
ccuccuggguucaagugauucucuugccucagccuccugaguagcugggauuacagguuccugcu

SEQ ID NO: 644326 - RNA, 65 nt, hsa
cucugaagaccuuuaauggcuucccucuuucaucuccugaguauguaacuugcaaugggcagcua

SEQ ID NO: 644327 - RNA, 65 nt, hsa
ccucccggguucaagcaauucuccugccucagccuccugaguagcugggaugacaggugcacgcc

SEQ ID NO: 644328 - RNA, 65 nt, hsa
aucccugggcucaaguguuccuccugccucauccuccugaguagcugggguuacaggugugugcc

SEQ ID NO: 644329 - RNA, 65 nt, hsa
aaagccuucaaaacacgaggcacucuuggaucuacccugaguauccuccaaacuguggauacagu

SEQ ID NO: 644330 - RNA, 65 nt, hsa
cguucuaaaacuacaauauaugucaucuuauuuucccugaguauccaaguauagugcagauucua

SEQ ID NO: 644331 - RNA, 65 nt, hsa
gacagaaggccaccauccuccacagagcacccuguccugaguagggguugugcucauuaccccag

SEQ ID NO: 644332 - RNA, 65 nt, hsa
guaucaauggauuuaucccccgcaaagacaucaaaccugaguaucaguacaugccuagaccuggg

SEQ ID NO: 644333 - RNA, 65 nt, hsa
ccuccuggguucaugccauuuuccugcuucagccuccugaguagcugggacuacaggcgcccgcc

SEQ ID NO: 644334 - RNA, 65 nt, hsa
ugggggugggggcaggcaggaggcauggaugggaaccugaguagguaguguggccaagagaucag

SEQ ID NO: 644335 - RNA, 65 nt, hsa
cugaaaaguaagguugggaccuggguacguggaucccugaguagaucccagcaucugggccaugg

SEQ ID NO: 644336 - RNA, 65 nt, hsa
ccuccugggcucaagugauccucccaccucagccuccugaguagcugagaccacaggcgugugcc

SEQ ID NO: 644337 - RNA, 65 nt, hsa
uaaaguaauuucccccacaguaaaauacacugacuccugaguaaauugauuuuccaguuuuaugg

SEQ ID NO: 644338 - RNA, 65 nt, hsa
acucccaggcucaagcgauccucccgccuuaacugccugaguagcugggacuacaggcaugcacc

SEQ ID NO: 644339 - RNA, 65 nt, hsa
ccucccggguucaagcaauucuccugccucagccuccugaguagcuggcacuguaggcauguacc

SEQ ID NO: 644340 - RNA, 65 nt, hsa
aaagcaauaauccuauuguacgcuagagcaugcugccugaguauuacuaguggacguaggauauu

SEQ ID NO: 644341 - RNA, 65 nt, hsa
uuuuugaggugagaggcccaggugguccuggcaacccugaguagaaggagagacgggguagggaa
